United States Patent 10,006,042 (ISOLATED POLYNUCLEOTIDES AND POLYPEPTIDES, AND METHODS OF USING SAME FOR INCREASING PLANT YIELD AND/OR AGRICULTURAL CHARACTERISTICS) - sequence listing, part 3

SEQ ID NO: 3195 - DNA, 2670 bp, Flaveria ramosissima
ttgcaatcatggcgggggctttggtgcaatctaccagctttccttctgcagtttcaagtgaaagcaaggtctgttcaaagcgatctggtaatacaaaaagaggagtcaagatgatggcgggggctttagctcctccagtgagggtgaggaccttttctggtttgcggggagtcaatgctttagacaacatggtaaatagagcccaggatttccactccaaagttgcagcagccacctcagtccggaaagcaaagccttctagaattgtacctaaggccatgtttgaacgattcactgagaaggctattaaagtaattatgcttgcacaagaggaagcaagacgacttggccacaattttgtgggtacagagcagattttgttaggtcttattggtgagggcactggcattgcagcaaaagtgctgaagtcaatgggaatcaacttgaaggatgcacgtgttgaagtagaaaaaattattggtaggggtagtggatttgttgctgtagagattccgtttactcctcgtgctaaacgtgtgctggaattgtcactagaggaggccagacaacttggtcataattatattggttcggagcacttgcttcttggtttgcttcgtgagggtgaaggtgtagcagctcgggttcttgagaatttgggtgcagacccaaataacattcgcacacaggtgatcagaatggtcggcgaaagtgcagaagctgtgggtgctggagttggtggtgggacttctggtaataagatgccaacactggaggagtatggtaccaacttgacaaagcttgcagaggagggtaagctggatcctgttgttggaagacagccacaaattgaacgagttacccaaattttgggacggcgtacaaaaaacaatccctgcctcattggagagcctggtgttggaaagactgctattgcagaaggtctggcacaaaggattgcaaatggtgatgttccagaaacaattgaggggaagaaggtgattactctcgatatgggtctactagttgctggcacaaagtaccgtggggagtttgaagaaagactaaagaagctcatggaagaaatcaagcaaagtgacgaaattatcctcttcattgatgaggtccatacgttaattggtgcaggagcagcagagggagctattgatgctgctaacatcttgaagcctgctcttgctagaggtgaattacagtgtattggggcaacaacccttgatgagtaccggaagcatattgagaaggacccagcactagagagacggttccagcctgtaaaagtgcctgagcccacagtcgatgaaaccattcagattttgaaggggcttcgagaacgatatgaaattcaccacaaactccgttacaccgatgaggcactggtagctgctgcccagttatcatatcagtacataagtgaccgttttctgcctgataaagctattgacttgatcgatgaagccggttctcgtgttagacttcgtcatgcacaactcccagaggaagctaaggagcttgagaaagaacttaggcagataacaaaagaaaagaatgaagcagttcgtggccaggacttcgaaaaggctggggagttacgggatcgggaaatggatctcaagactcaaatatcagctcttgtggacaagaacaaagagatgagcaaagccgagacagaggcaggagaggagggtcccaccgtcactgaagcagacattcagcacattgtctcatcatggactggaatacctgtggagaaagtctctacagacgaatctgaccgcctcctgaaaatggaagaaacccttcatacacgaattattggtcaagacgaagcagtcaaagccataagccgtgccatccgtcgtgcccgtgttggactcaaaaacccgaaccgccccattgccagtttcatcttctcaggaccaaccggtgttggtaaatccgaactggcaaaagctttagctgcttactactttggctctgaagaagccatgattagactcgacatgagcgagttcatggagagacacaccgtctcaaagctcatcggttcacctcccgggtacgttggttacaccgaaggcggtcagttaaccgaggcagtccgccgccgcccatacactgttgttctattcgacgaaattgaaaaggctcaccctgatgtcttcaacatgatgcttcaaatccttgaagatggaaggctgactgacagcaaaggacgaaccgttgacttcaagaacacacttctaatcatgacttcaaacgttggcagcagtgtaatcgaaaaaggtggtcgtagaatcgggtttgacctggactacgacgagaaagacagcagctacaacagaatcaagagcctggtgaccgaagaactcaaacaatatttcaggcccgaattcctgaacaggttagatgaaatgatcgtgttcagacagttgaccaaacttgaagtcaaagagatcgctgatataatgctgaaggaggttttcgagaggctaaaaggaaaagaaatcgagcttcaagtgactgagaggtttagagaccgagttgtagaggagggatacaaccccagctatggtgcaaggccgcttagacgggcgatcatgaggctgttggaagacagcatggcggagaagatgcttgctcgtgagatca

SEQ ID NO: 3196 - DNA, 3089 bp, Arachis hypogaea
aggactacgtacagttaatccgtttggatactatgttgagacctggactggtatttcactcgaaggtgtcaattgcaacttcttcacggcgagcaaagcctatcagaggtgttcctaaagccatgtttgagcgtttcacagaaaaagcaatcaaggtgattatgcttgcccaggaggaagcaagacgtcttggtcacaattttgttggaacagagcagattcttttgggtcttattggtgagggcactggtattgccgctaaggttctgaagtctatgggaatcaaccttaaagatgcacgtgttgaagtggagaagataataggaaggggtagtgggtttgtagctgttgagattccatttactcctcgtgcaaaacgtgttttggaactctcattagaggaagctcgccaacttggtcacaattatattggatctgagcacttgcttctgggtcttcttcgtgagggtgaaggtgtagcagcacgtgttcttgaaaacttgggtgctgacccaactaatattcgaacacaggttattcgcatggttggtgagagtgctgacagtgttactgcaactgttgggtcaggaagtagtggcaataagatgccaacattggaggagtatggcaccaatttaaccaagttagcagaggagggaaaattggatccagttgtgggaaggcagccacaaatagaacgtgtcactcaaattttgggtcgtcgcaccaaaaataacccttgtcttattggagaacccggtgttggtaagacagcaattgctgaaggtcttgctcagaggattgcaaatggtgatgtacctgaaaccatagagggaaaaaaggttataacccttgatatgggtttgcttgttgctggaactaaatatcgtggtgagtttgaggagaggttgaagaaactgatggaggaaattaacaaagtgatgagataatactttttatcgatgaagtgcacactctaattggagctggagcagctgaaggggctattgatgctgctaacatactaaaacctgctcttgcaaggggtgaactgcagtgtattggagccacaacacttgatgaataccggaaacacattgaaaaagatccagctttggagagacgattccagccagttaaggtgccagagccaactgtagatgaaaccatacaaatactgaaaggacttagagaacgctatgaaattcaccacaagcttcgctatactgatgaggctcttgtagctgctgcacagctgtcttaccaatatatcagtgatcgatttttgccagacaaagctatagatcttattgatgaagctggttcacgtgtccggctgcaacatgcacagttgcctgaagaagcaagagaacttgacaaggaactcaggcagattgttaaggagaaagaagaagctgttcgcaaccaagactttgagaaggctggagagctacgagatagagaaatggatcttaaggcacaaatatcaacacttgtagagaaaggcaaggagatgagcaaggcagagagtgaagcaggagactcaggtcccattgtgacggaagttgacatacaacatattgtctcctcttggactggtatccctgttgagaaagtctcaaccgatgaatccgatcgcctccttaagatggaggagacattgcacaagcgtgtcattggtcaggatgaagcggtaaaagcaattagccgagctattcgtcgagcccgggttggattgaaaaaccctaatcgtccaattgccagcttcatcttttctggtccaactggtgttgggaagtctgaattggcgaaagcattggctgcatattactttggctctgaagaagccatgattcggctagacatgagtgaattcatggagaggcacaccgtctctaaactcataggttcacctcctggatatgttggttacaccgaaggtggtcaactgactgaggcagttcggcgtcgtccttacactgttgtgctctttgatgagattgagaaagcccatcctgatgtattcaacatgatgcttcaaatcctggaagatggtagacttacagatagcaagggaagaaccgtggatttcaagaacacgcttctcataatgacgtcgaatgttggaagcagtgtaattgagaaaggaggccggaaaataggatttgatctggattacgatgagaaggacagcagctacaaccgaatcaagagcttggtgaccgaggagctaaaacaatacttcaggccagagttcttgaacaggctggatgaaatgattgtcttcaggcaactcacaaaactcgaggtgaaggagattgctgacataatgctaaaggaggtgtttgacagactaaagaccaaagatatcgaacttcaagtgacggaaagatttagagacagagtagttgaggaaggttacaaccctagctatggagctaggcctctaaggagagccataatgagacttttggaggacagcatggctgagaagatgcttgctagagagatcaaagaaggtgactctgttatagttgatgttgatgctgatggcaatgtgattgttctcaatggtagcagtggtactccagagtccttgccagaggaggctcttcctgtataatgaggttataacctttgataatagtaatacctgtactaataataatatatatacacatttgatctaaaccatagtcatagtttctgttttacttgtcaatggacgttcagcttttaatggatcacagattcccagccaggtttcgcccatagccaatcaaaactagtagagaagaaaggggtgaccatggaagaagacaaatggtatgtgtgaaaggtgaggtacgttgatgaattaattacttcaaaagctgggtgttttttcaagtttccaatggttcaatctatgtaatctccctgcatttgttgtaaattgttaatttgttatggtgtattcaaatgcttgaaaggaagtacatgtaatgataggttccaagtaattagtacaaaaaaaaaaaaaaaacaaaagtactctgcgttgataccactgcttctgagactgaccgtaaggcacgacaggggatagg

SEQ ID NO: 3197 - DNA, 2888 bp, Aquilegia formosa
tttgtgacatcatggctagggctctgatccagtcagcaatcctacctactggagtttcttgtggaactcatggccaacttctagaatctggaaaaggcaaaagggcagttaaaatgatgtgtaatgtccattcatctcatatcagagtgtgtggtttctcaggtctgcgtgcgccaaatgctttagatacattggtgaagtctggctttgatttccattctaaggtagcagctgcagtctctgctccacgtggaaaaggaagaagaattgtggctaaagctatgtttgagcgcttcacagaaaaggccattaaagttattatgcttgcacaagaggaagcaagacgattagggcacaactttgttggtacagaacaaattctgttgggactcattggtgaaggaactggtatagctgcaaaagttcttaaatctatgggaattaatctgaaagatgctcgtgttgaagtggagaagattattggaagaggaagtggatttgttgctgtggaaataccatttactcctcgggcaaaacgtgttttggaactctcactggaggaagctcgtcaacttggtcataactatattgggtctgagcatctgctgcttggattgcttcgtgagggtgaaggtgttgctgcccgtgtgcttgaaaaccttggtgctgatccaaataacatccgtacacaggttattcgtatggttggtgaaagtacagaagctgttggtgctggagttggaggaggaagcagtaacaataagatgcctacactggaggaatatggtactaatcttacaaagctggcggaggagggcaagctggatccagttgttggaagacaggtacaaatagaacgcgtgactcaaattttgggtcggaggacaaagaacaatccatgtctaatcggagaacctggtgtggggaaaacggctattgcagagggacttgctcaacgaattgcaagtggtgatgttccagaaacaattgaggggaaaaaggttattaccttggatatgggtcttcttgttgctggtacaaaatatcgtggagagtttgaggaaaggttaaagaagctgatggaggaaattaaacaaagtgatgagataatactcttcattgatgaggtccacacattgattggagcaggggcggcagagggtgcaattgatgctgcaaacatcttgaaaccatctcttgctagaggtgaactgcagtgtattggtgcaaccactctagatgaatatagaaaacatatcgagaaagacccagctttggaaagacgattccaaccagtgaaagtgcctgaaccctctgttgatgagaccatacagattctgaaaggccttcgagaacgatatgaaattcatcacaaactccgttacacggatgaagccttagttgccgctgcacaattgtcataccaatacatcagcgatcgttttctccccgataaagcaatcgacttgattgatgaagcaggttctcgtgttcggcttcgtaatgcacagctccccgaggaagctagggaactcgagaaagagctcagacagattacaaaggagaaaaacgaagccgttcgtggccaagatttcgagaaggctggggaattgagggataaagaaatggatctcaaggcccggatcacaagtctaattgacaaaggtaaggagaaaaccaaggcagagagcgaggcgagtgaagcaggtcctcttgtgacagaagttgacattcagcacattgtgtcttcatggactgggattccagttgacaaggtatcaagtgacgaatctgaacgtctcctcaagatggaagaaacactccacaaaagaatcattggtcaggatgaagctgtccatgctattagccgtgccattcgacgtgcccgtgttgggctgaagaacccaaatcgaccaattgccagcttcatattctctggtccaactggtgtaggaaaatcagaactcgcaaagacattggctgcctattactttggctctgaggaagccatgattcgtcttgatatgagtgaattcatggagaggcacaccgtctccaagctgattgggtcaccacctggttatgttggctacactgagggtggtcagctgaccgaagcagttcgccgtcgtccctacactgtggttctatttgacgaaatagagaaagctcaccctgatgtcttcaatatgatgcttcagattctggaagatggaagactgacagatagtaagggacggacagttgattttaagaatacactgcttataatgacttcaaatgttggaagcagtgttattcaaaagggaggtcgtcgaatgggatttgatcttgatttcaataaggagaaggaaaaagaggaggacaccagctacaaccggataaagagcttggtgacagaagaattgaagcattatttcagaccggagttcctcaataggttagatgagatgatcgtcttccgccaactgacaaaggtagaagtgaaggagattgctgttataatgttgaaggaagtatctgataggctgaagacaaaaggaattgagcttcaggtgacagaaaatttcacaaataaagttgtcaatcaaggatacagcaagacctatggagcaagacctctaagaagggcaataatgaggcttttggaggacagcatggctgagaagatgcttgctggagagatcaaggagggggattctgttattgtggatgttgatgctgatggaaaagtgactgtgcttaatggaagcagtggtactcttgaaccatcagccccagcattacctgtgtaaactacccttttctccatccaacattgacaagcaagttgtatcttgtatgtactactaaattcaaataggtcaagtatagtatttttatttttt

SEQ ID NO: 3198 - DNA, 3632 bp, Cleome spinosa
gaaagataggggccgagattagaagctcaccatatccatctgttttctctctccctctctctctgtgtctgtctgtctctgttcttcttcatccttgtttttgatccagtgctgtgtctccgtcgattcaggacatcatggctatgtctacaagggtgctggctgaatctgctgccccatctttagcttgctaccagaggaatataccatcacgcgaatctggaagatcaagaaggtcggcaaggatgatgtctagtcagcctcaggcacctggattgagaatacaagggttcttgggcttaaggggtcagaatgtgttagatatgcttggaagatcccgtcaagatttccattctaaggtgcggcttacaatgagttcccgaagaggaaagcccagccgctgtatgccgaaagccatgtttgaaaggtttactgaaaaagctatcaaagttattatgcttgcacaagaggaagctagaagactgggccacaattttgtgggcactgaacaaattttgttgggtctcattggtgagggtactggaattgctgctaaagttctgaaatcaatggggatcaatctaaaagatgcaagggtggaggtagagaagattattggaaggggtagtggatttgttgctgttgagatcccatttactcctcgtgcaaagcgtgttcttgaactctcgctcgaagaagcccgccaacttggtcataattacattggatctgagcaccttcttcttgggttgctacgtgagggcgaaggtgttgcagctcgtgtccttgagaacttaggtgctgatcctagcaatatccgaactcaggttatacgcatggttggtgagaacaatgaggtcactgccaatgttgggggaggaagcaacagcaataagatgccaactcttgaagagtacggaacaaacttgacgaaactagcagaggagggtaaattggacccagttgtgggaagacagccacagatagaacgagtggtacaaatccttggcaggagaaccaagaacaacccatgtcttattggagaacctggtgttggaaaaacagctattgcagaaggacttgcacagcgcattgcgagtggggatgttcctgaaaccattgaggggaagaaggttatcactctcgacatgggtcttcttgtagcgggaacgaaatatcgtggagagtttgaagagagattgaaaaagcttatggaggagataaagcagagtgatgagataatcttgtttattgatgaagtgcacaccttgatcggagctggagcagcagaaggtgcaattgatgctgctaacattctaaagccagctcttgcaagaggtgaattacagtgtattggagcgacaacattagacgaatacagaaagcacatcgagaaagaccctgccttggaaagaagattccagccggtgaaagttcctgaaccttcggtagatgaaactatccaaattctaaacggtctacgggaacgatacgaaatccatcacaagcttcgttacacagatgaggctttagtcgcagctgcacacttgtcctaccagtacataagtgatcgtttcctgcccgataaagcgatcgacttgatcgatgaggctggttctcgggttcgacttcgtcatgcacaggttccagaggaagccaaagagctcgaaaaggagctcaggcagatcacgaaggagaagaatgaagctgttcgtgggcaggactttgagaaggctgggacacttcgtgatcgggaaatcgaactaagagccgagatatccgctatccaagccaaaggcaaggagatgagcaaagctgagagcgagacaggagatggaggtcccttcgtgactgaatctgacattcaacacattgtctcttcgtggacgggtattcccgtggagaaagtttcgaccgacgaatctgatcgccttctcaagatggaagagaccctccacacacgtgtcatcggccaagatgaagccgtcaaagctattagccgagccatccgccgtgcacgtgtcggactcaagaaccctaaccacccaatagccagtttcatcttttcaggtccaacgggtgttggaaaatccgagcttgcaaaagctttggctgcgtactacttcggatccgaagaagccatgatccgtcttgacatgagcgagttcatggaaaggcacaccgtctcgaaactcatcggttcacctccaggatacgtcggttacacggaaggcggtcagttaactgaagcagtcaggcgccgtccctacacagttgtcctcttcgacgagatcgagaaagctcaccccgacgtcttcaacatgatgcttcaaatcctcgaagacgggagattaaccgacagcaaaggaagaacggtcgatttcaagaatacgctcctaatcatgacatcaaacgtcggaagcagcgtgatcgagaaaggaggaaggcgaattgggtttgacctagagagcgacgagaaagacagcagctacaacaggatcaagagcctcgtgaccgaagagctgaagcaatacttcaggcccgagtttttgaacaggctagacgagatgatcgtgttcagacaactcacgaagctcgaagtgaaggaaatagccgacataatgctcaaagaagtgttcgagagattgaagaagaaagagatcgagctccaagtcacggagaggttccgagagagagtcgtcgatgaagggtacaacccgagctacggagcgaggccgttgcggagagcgataatgcggcttctcgaggacagcatggcggagaagatgctgtcgagagagatcaaggagggagactccgttatcgtagacgtggactctgacggcaacgtaacggtgcttaacggaagcagcggagctcccaaggctttggaagaggaagacccacttcccgttgtgtaatgctttctaatacggtaataatatgtacagacagacagagtactctggctttgctttttctctttctttttaattttaattttcacaaggtgatttcatggttttggcattcgaaattatgcaaagaaagggattgctatgatccaagcgattccatgtattgtctcacagagaatcatcatcattgaatactagaatcagtcggttcaatttcccggtttggctaaaccggtgattgattgatcagcttgcttcgggtttcttctcggccaactgctctatcaaatcagcggcttcttggatcgtagtaatgtcctgagcatcagactcatccacacttatctcaaactgttcctccaaagtcatcactatctccacagtgtcaagggaatcagcgccaagggctgagaatttggattcgggagtgagctgggagtcagcgggcaaagcgagttgctcccttacgatatcacacactctctgcaccgtctccgcctttgcagcggaagagacttgaagacggagattcttcgaagacgggaaacaacaaccctttgtgaagccaaaggagacggaccgaaatatcaaggttttctccaacaccttggagatcctgtcgggttgcatcgatgaagctttgaaggtgagacaagtggctgagagagacgccattgaagcagagctcaaagaacacagtgagagagagagaga

SEQ ID NO: 3199 - DNA, 3192 bp, Vigna unguiculata
gtgtttttttccttcctctttgcccttgttaccacgccttctctatatatctatcaacttcctctatcttcttctctaatcttccaaatttccccttttcccccttctcttctattcgtatttctctgtctgcaagtcaattcttttcgcttacggcaaaaatataggaataatggctagggttttggctcagtctattggcatgcctggcctacttagtgggcagaggcaggggcagcataaggcatcaggaaaatcaagaagatctgtcaaaatgatggctaccatacgaatgcctgcatcaagaatgtcgagtttctctggactgcgtactttgaacactttggatcttctttccagacctcgacaaaattttccttccaagatgttgacttcaacttcttcccgtcgtgaaagggctaaaagatgcgtacctaaagccatgttcgagcgtttcacggagaaagcaatcaaagtaattatgctagcccaggaggaagccagacggctgggacataattttgttggaactgaacaaattttattgggtcttattggggaaggcacgggcattgctgctaaggtgctgaagtcaatgggaattaacctgaaggatgctcgtgtggaagtggaaaagataattggaaggggtagtggatttgttgctgttgagattccatttactccccgtgcaaaacgtgttttggaactctcactggaggaagctcgccaacttggtcacaattatattggatctgagcacttgcttcttggtcttcttcgagagggtgagggtgtagcagcacgcgttcttgaaaatttgggtgctgatccaaataatattcgtgctcaggttattcgtatggtgggtgagggtgctgacagtgttggtgctactgttggccctggaggtggtaataacactaagatgccaactttggaggagtatggcaccaatctgaccaagctagccgaagagggaaaattggatcctgtcgtgggtaggcagccacaaattgagcgtgtcactcaaatcttgggtcgccgtaccaaaaataatccttgtcttattggagaacctggggttgggaagactgctattgctgaagggcttgcccagaggattgcaaatggagatgttcctgaaaccatagagggaaagaaggttataacccttgatatgggtctactggtagctggaactaaatatcgtggagaatttgaggagagattgaaaaaactaatggaggaaatcaaacaaagtgatgagataatactttttattgatgaagtacacactctaattggagctggagcagctgagggggcaattgatgctgcaaacatactaaaacctgctcttgctagaggtgaactacagtgtattggagccacaacgctggatgaatataggaagcacattgaaaaggacccagcactggagaggcgattccagccagttaaggtgccagagcctacggttgatgaaaccatacagatactgaaagggcttagggagcggtatgagattcatcacaagctccaatatacagatgaagcacttgaagctgctgcccagctgtcacatcagtatattagtgatcgatttttgcccgacaaagctatagatttaattgatgaagcaggttcccgtgtgcggcttcaacatgcacagttaccggaagaagcaagagagcttgacaaggagctcagacagattgtgaaagaaaaagatgaagccgttcgcaatcaagactttgaaaaggctggagagctacgagataaagaaatggatctgaagacccagatatcctcacttatagaaaaaggcaaggagatgagcaaggcagaaagtgaggcaggagatggaggtcccatggtgactgaagttgacatacaacatattgtctcctcctggactggtattccggtagagaaagtctcaactgacgaatctgatcgcctcctaaagatggaagagactttacacacacgagtcataggtcaggatgaagcagtaaaagcaattagccgagccatccgccgagctagggtgggattgaagaatcctaatcgaccaattgccagcttcatcttttccggtccaactggtgtggggaagtctgaattagccaaagcattggctgcatactattttggttctgaagaagccatgattaggcttgacatgagtgaatttatggaaacacacacagtctctaaactcattggttcaccccctggatatgttggttacaccgaaagtggtcaactgactgaggcagttcggcgtcgtccctacactgttgtactatttgatgagattgagaaagcacatcctgatgtattcaacatgatgcttcagattctggaagatggaagactaaccgacagcaaagggagaactgtggacttcaagaacactcttctaataatgacatcaaatgttggaagcagtgtgattgagaaaggaggacgtaaaatgggatttgacctcgattacgatgagaaggatagcagttacaatcgaatcaagagcttggtgactgaggagctgaaacaatactttaggccagagttcttgaataggttggacgaaatgattgttttcaggcaactcacaaagctggaggtaaaggagatagctgatataatgttgaaggaggtgtttgaaagactgaaggccaaagagattgatctctcagtgacagaaagatttagggagagggtggttgaggaaggatataatcctagttatggggctaggcctctaagaagagccatcatgcgacttttggaggacagtatggccgagaagatgcttgctagagagattaaagagggtgactctgttatagtggatgctgattccgatggtaatgtgattgtgctcaacggaagtagtggtgctccggagtcactaacagaagctcttcctgtgtaacgtggttgtctttactgtgtgcttttgttctctttttttaaagaaaaaacatagtcatagtttgttttagttgatattggacataaagcttttaattgaatgctagtagtctaaatgtctgtcggttaacatcgttagtgaccaatttttttttttagaaaaaaatttaaaagttaaacattgaaggtcttgtagcttgcttaacttcagataatcctttgataacaaaggatcaattataaaatgta

SEQ ID NO: 3200 - DNA, 3339 bp, Medicago truncatula
cttcagttttcattttatcttcttctttcctccctctctcgccccctttgaaaccaaacctagacaccattttccctttactttctttcttccaatttcttttccttcgaattttcgttgaattcatcactattggatattcccttcagtcaagaagcttctgtgaacaatccaggaatcatgtctagggctttggcgcagtcgattaatgtccctggtctagtggctggtcgaaggcatgtcaataacaacaagggagcagctagatcaagaaggtctgtcagaatgatgtttaccacacgaactgcttcacccagactgtccagttactcgggattacgtactttgaattctttggattcaatgttgagacctggccaagattttcattctaaggtgctcactcagattggtactaatcgagctaagggtggtagaggtagtagatgtgttactaaagccatgtttgagcgttttacggagaaagctatcaaagttattatgttggctcaggaggaagcaaggcggctgggacacaattttgttggaactgaacagattctattgggtcttattggtgaaggaactggtattgcggctaaggttttgaagtctatggggattaacctaaaagatgcacgtgtcgaggtagagaagataattggaaggggcagtggttttgtcgctgttgagattccgtttactccgcgtgccaagagagttttggaactctcattggaggaagctcgtcaacttggtcacaattatatcggatctgagcacttgcttttgggtcttcttcgagagggtgaaggtgtggcagcacgtgttcttgaaaatttgggtgccgacccaactaatattcgcacccaggttattcgcatggttggtgagggtgctgatagtgttggggctactgttggctctggaagtagtaacaataagatgccaactttggaggagtatggcaccaatttgaccaagctagcagaggagggaaaattagatcctgttgtgggtaggcagccacaaattgaacgtgtcactcaaatcttgggtcgccgtaccaaaaataatccttgtcttattggggaacctggtgtcggaaagacagcaattgctgaaggtcttgctcaacggattgcaaatggtgatgtccccgaaaccatagagggaaagaaggttataaccctagatatgggtctacttgtagctggaactaaataccgtggagaatttgaagaaagattgaaaaaactaatggaggaaatcaaacaaagcgatgaaataatacttttcattgatgaagtgcacactctaattggagcaggagcagctgaaggggcaattgatgcggcaaacatattgaaaccagctcttgctagaggtgaactacagtgtataggagccacaactctagatgaatataggaagcacattgaaaaagatccagctttggagaggcgattccaacctgttaaagtgccagagccaactgttcctgaaaccatacaaatactgaaaggacttagagagcgctatgagattcaccacaagctccgttatactgatgaggctcttgtagctgctgcagagctgtcacatcaatatattagcgatcgatttttgcctgacaaagctatagatttgattgatgaagctggttcccgagtccgacttcaacatgcacagttacctgaagaggcaagaggtcttgaaaaggaggttaggcagatagtaaaggagaaagatgaagctgttcgcaaccaagaatttgaaaaggctggagagctaagggataaagaaatggatctcaagactcagatatcagcacttatagaaaaaaacaaggagatgaacaaggcagagagtgaggcaggagatgtaggtgcacttgtgactgaagttgacatacaacatattgtcgcctcctggactggtatccctgttgacaaagtctcggttgacgaatctgatcgtcttctcaagatggaagacacattacacaaacgcattattggtcagcatgaagcagtagaagccattagcagggctatccgtcgagctcgtgttggacttaagaaccctaacaggccaattgccagcttcatcttttctggccctactggtgtggggaagtctgagttggccaaggcactggcctcatactactttggatctgaagaagccatgattcgtcttgacatgagtgaattcatggaaaggcacacagtctccaaactcattggttcacctccaggatatgttggttatactgagggtggtcaactgactgaggcagttcggcgtcgtccctacacggttgtactctttgatgagattgagaaagcccatcctgatgtcttcaacatgatgcttcaaatcctggaagatgggaggctaacagatagtaagggaagaactgtggacttcaagaacacacttcttataatgacatcaaatgttggaagcagtgtgatcgagaaaggaggccgtcgcataggatttgaccttgactatgatgagaaggacagcagttataacagaatcaagagcttggtgaccgaagagctgaaacaatactttaggccagagttcttgaataggcttgatgaaatgattgttttcaggcaactcactaaactggaggttaaggagatagcagatataatgctgaaggaggtgttcgagagactgaaaaccaaagagattgagctctcagtgacagagagatttagggagagagtggtcgacgaaggttataatcctagttatggggccaggcctctaagacgagccataatgcgacttttggaggacagcatggctgaaaagatgcttgctagggagattaaagagggcgactctgttatagtggatgctgattctgatggaaacgtgattgtactcaacggtagtactggtgctccagattcattgccagatgctcttcctgtgtaatatggtcatctttgccaagttgtgtacttgttttaagagccatagtctgttttgttgttgatgaacataaagctttttatttgactattggtagtctaaggcaagttttggccatagccaacaaagcaaagtagaaaatggttggggaccttggatcggctgcataattgaacaatttcaattcttaatgaaagcccagcatttcaaagtgattttacaagtgctaggggtttggtggtctcacattatgtatttcctaagggagtctgtaaaaactatttttagatagtttatatcgcaatatgtttaatttaaaacaataaatatatgacattggcggatgatagtggtaagagtggggtgcggttatcatgcata

SEQ ID NO: 3201 - DNA, 3267 bp, Medicago truncatula
ttcaacttcagttttcattttatcttcttctttcctccctctctcgccccctttgaaaccaaacctagacaccattttccctttactttctttcttccaatttcttttccttcgaattttcgttgaattcatcactattggatattcccttcagtcaagaagcttctgtgaacaatccaggaatcatgtctagggctttggcgcagtcgattaatgtccctggtctagtggctggtcgaaggcatgtcaataacaacaagggagcagctagatcaagaaggtctgtcagaatgatgtttaccacacgaactgcttcacccagactgtccagttactcgggattacgtactttgaattctttggattcaatgttgagacctggccaagattttcattctaaggtgctcactcagattggtactaatcgagctaagggtggtagaggtagtagatgtgttactaaagccatgtttgagcgttttacggagaaagctatcaaagttattatgttggctcaggaggaagcaaggcggctgggacacaattttgttggaactgaacagattctattgggtcttattggtgaaggaactggtattgcggctaaggttttgaagtctatggggattaacctaaaagatgcacgtgtcgaggtagagaagataattggaaggggcagtggttttgtcgctgttgagattccgtttactccgcgtgccaagagagttttggaactctcattggaggaagctcgtcaacttggtcacaattatatcggatctgagcacttgcttttgggtcttcttcgagagggtgaaggtgtggcagcacgtgttcttgaaaatttgggtgccgacccaactaatattcgcacccaggttattcgcatggttggtgagggtgctgatagtgttggggctactgttggctctggaagtagtaacaataagatgccaactttggaggagtatggcaccaatttgaccaagctagcagaggagggaaaattagatcctgttgtgggtaggcagccacaaattgaacgtgtcactcaaatcttgggtcgccgtaccaaaaataatccttgtcttattggggaacctggtgtcggaaagacagcaattgctgaaggtcttgctcaacggattgcaaatggtgatgtccccgaaaccatagagggaaagaaggttataaccctagatatgggtctacttgtagctggaactaaataccgtggagaatttgaagaaagattgaaaaaactaatggaggaaatcaaacaaagcgatgaaataatacttttcattgatgaagtgcacactctaattggagcaggagcagctgaaggggcaattgatgcggcaaacatattgaaaccagctcttgctagaggtgaactacagtgtataggagccacaactctagatgaatataggaagcacattgaaaaagatccagctttggagaggcgattccaacctgttaaagtgccagagccaactgttcctgaaaccatacaaatactgaaaggacttagagagcgctatgagattcaccacaagctccgttatactgatgaggctcttgtagctgctgcagagctgtcacatcaatatattagcgatcgatttttgcctgacaaagctatagatttgattgatgaagctggttcccgagtccgacttcaacatgcacagttacctgaagaggcaagaggtcttgaaaaggaggttaggcagatagtaaaggagaaagatgaagctgttcgcaaccaagaatttgaaaaggctggagagctaagggataaagaaatggatctcaagactcagatatcagcacttatagaaaaaaacaaggagatgaacaaggcagagagtgaggcaggagatgtaggtgcacttgtgactgaagttgacatacaacatattgtcgcctcctggactggtatccctgttgacaaagtctcggttgacgaatctgatcgtcttctcaagatggaagacacattacacaaacgcattattggtcagcatgaagcagtagaagccattagcagggctatccgtcgagctcgtgttggacttaagaaccctaacaggccaattgccagcttcatcttttctggccctactggtgtggggaagtctgagttggccaaggcactggcctcatactactttggatctgaagaagccatgattcgtcttgacatgagtgaattcatggaaaggcacacagtctccaaactcattggttcacctccaggatatgttggttatactgagggtggtcaactgactgaggcagttcggcgtcgtccctacacggttgtactctttgatgagattgagaaagcccatcctgatgtcttcaacatgatgcttcaaatcctggaagatgggaggctaacagatagtaagggaagaactgtggacttcaagaacacacttcttataatgacatcaaatgttggaagcagtgtgatcgagaaaggaggccgtcgcataggatttgaccttgactatgatgagaaggacagcagttataacagaatcaagagcttggtgaccgaagagctgaaacaatactttaggccagagttcttgaataggcttgatgaaatgattgttttcaggcaactcactaaactggaggttaaggagatagcagatataatgctgaaggaggtgttcgagagactgaaaaccaaagagattgagctctcagtgacagagagatttagggagagagtggtcgacgaaggttataatcctagttatggggccaggcctctaagacgagccataatgcgacttttggaggacagcatggctgaaaagatgcttgctagggagattaaagagggcgactctgttatagtggatgctgattctgatggaaacgtgattgtactcaacggtagtactggtgctccagattcattgccagatgctcttcctgtgtaatatggtcatctttgccaagttgtgtacttgttttaagagccatagtctgttttgttgttgatgaacataaagctttttatttgactattggtagtctaaggcaagttttggccatagccaacaaagcaaagtagaaaatggttggggaccttggatcggctgcataattgaacaatttcaattcttaatgaaagcccagcatttcaaagtgattttacaagtgctaggggtttggtggtctcacattatgtatttcctaagggagtctgtaaaaactatttttagatagtttatatcgcaa

SEQ ID NO: 3202 - DNA, 3077 bp, Mimulus guttatus
gaaaggtgaagcgtgaagataaataaatccaggactaattgggggagatatgacgcatactttaattcgaccgaccaatttgccttcttctgtagttttgggcaacaatgggcagttgaatggatctaataaagcaagaaaggcaccgactatgttgtgcagcacacaaccgactgccattaggttgcagagtttctcgggattgcgtcgagctaattcgttagatataatggtgtggcaacctcgccacactctccaatcgaaggtggcagctgcgatagcacctgtgaggcaaggtagaaagtcgcggatggctccacgagccatgttcgagcgcttcacggagaaagcgataaaagtgattatgctcgcgcaggaagaggcgaggcggctcggccataatttcgtcggaaccgagcagatcttgttgggccttatcggtgagggcagtggaattgctgcaaaggtcatcaagtcgatggggataaatttgaaagatgcacgtatagaggtggagaaaattattggaaggggtagtggatttgttgctgtggagattcctttcacacctcgtgcgaagcgtgttcttgaactcgctctcgaagaagcccgccagctcggtcacaattacattggatcagagcacgtgcttcttggattactgcgcgagggtgaaggtgtggctgcacgtgtactcgagaacttaggggctgaccctaacaatattcgaactcaggttattagaatggtgggtgaaagtgtagaggctgttactgttaagggagacggaaactcgaacggcaaaatgcctactttggaggagtacggtactaatttgacgaagctcgctgaggagggtaaactagaccctgttgttggaagggcggctcaaatcgaacgtgtcactcaaattttgggacggcgcacaaaaaataatccttgccttattggagaacctggtgttggaaaaacagctattgcagaaggccttgcccagagaatagccaatggtgatgttccagagactatcgagggtaaaaaggttattaccctggatatgggtcttcttgttgccgggactaagtaccgtggtgaatttgaggaaaggttaaagaagctgatggaggagattaagcaaagcgatgacatcatcctctttattgatgaggtgcacacattgattggagcaggagctgctgaaggggcaattgacgctgcaaacatcttgaagcctgcactagctcgtggcgaacttcagtgtatcggcgcaactaccctggatgaataccgtaagcatattgaaaaggaccctgcactagaaagaaggttccagcctgtcaaggtacctgaacccacagtagatgaagctattcagattctcaaaggtcttcgagaacgttacgagattcaccacaagctccgctacactgatgaatctttagttgctgcagcgcagttggctcatcagtatatcagtgaccggtttttgcctgacaaagcaattgacttgattgatgaagctggttcacgagtccgacttcgtcatgcacagctccctgaggaagccagagaactcgagaaagagctcaggcagattaccaaggagaagaacgaagctgttcgaggtcaagactttgagaaggctggtgaactacgagatagagaaatggatttcaaggcacagatatcagtcctcatagacaaaaacaaagagatgaccaaggcagaaaacgaggcaggtgacggaggcgcaatcgtaaccgaagtagacattcagcacatcgtagcctcgtggaccggcatcccggtggataaagtctccaccgacgaatccgaccgcctcctcaagatggaggacaccctccacacccgtgtcattggtcaggacgaggcggtcaaagccatcagccgggccatccgccgggcccgcgtgggcctcaagaaccccaaccgccccatcgccagcttcatcttctcgggccccaccggtgtcggaaaatccgagctggcaaaatctctcgccacctactacttcgggtccgaagaagccatgatcaggctcgacatgtccgagttcatggagaggcacaccgtatcgaaactcataggatcgccgcccggttacgtggggtacaccgagggagggcagctgaccgaagccgttcgccgccgcccgtacacggttgtgctttttgacgagatcgaaaaggcccaccccgacgtattcaacatgatgcttcaaattcttgaagacgggcgtttgaccgatagtaaaggtcggacggtcgacttcaagaatacccttttgatcatgacttcgaacgttggctctagtgtgatcgaaaagggtggccgtaggattggtttcgacctcgattacgacgagaaggatagcagttacaacaggatcaagagccttgtgactgaggagttgaagcagtatttcaggccggagtttttgaataggcttgacgaaatgattgtgtttaggcagctaacgaagcttgaagtgaaggagatagccgatattatgctgaaagaggtgtttgtgagattgaaggataaggatatcgagcttcaagtgactgagaggtttagggatagggtggttgacgagggctacgaccctagctatggggctaggccgcttagacgagctattatgaggcttttggaggatagcatggcggagaaaatgcttggcggtgaaattaaggaaggtgattcggttattgttgacgttgattctgatgggaaggtggttgttctcaatggtagtagcggtgctccgtcggaaatggctgaggagccgattgtgtttgtctagatgtgggccccattggtcttttttctgcactgtttctgctgatttttctagcatcgaaaagtgattggttcgaagccagtccaagaaaatgacagttttgaggcatttaacttaaaaattagcctagatggtagactcttatttacttatactgaacaatgtgcagatttgtagtcttattggttaagtattatttcttttatgtttggtagaaacagtttgaatttattattaatttttttttcttcaa

SEQ ID NO: 3203 - DNA, 3191 bp, Medicago truncatula
cctattcctatagggaaaatctctttcacgcttaacctttctttctcggttcccacgaccgaccatcttcttcttcttcttcaccgaacgaccctctttcgtctctgcaactgctttttcctatcagtgaacaattccggaatcatgtctagggttttggcacagtcgattaatgtccccggcctagtggctggtcgaaggcatgtcaataacaacaatggatccgtgagatcaagacctaggtctgtcagaatgatgtatgctacacaaactgctacaatgcgactgtctggtttctctggattacgtcctttgaactctttggattctatgtttagacccagacaagattttcattctaaggtgctcactcagattggtactaatagagcaaggggtggtagaggtagcagatgtgtaactagagccatgtttgagcgtttcacggagaaagcaatcaaagttattatgctggctcaagaggaagctaggcggcttggtcacaattttgtcggaacagaacaaattttgttgggtcttattggtgaaggcactggtattggtgctaaggttctaaagtctatgggaattaacctgaaagactctcgcgtggaagttgaaaagataattggaaggggtagcggttttgttgctgttgagattccgtttactccgcgtgccaagagagttttggaactctcattggaggaagctcgccaacttggtcacaattatatcggatctgagcacctgcttttgggtcttcttcgagagggtgagggtgtggccgcacgtgttcttgaaaatttgggtgctgatccaactaatattcgcacccaggttattcgcatggttggtgagggtgctgacaatgttggggctactgttggctctggaagtagtaatagcaagatgccaactttggaggagtatggcaccaatttgaccaagctagcagaggagggaaaattggatcctgttgtgggtaggcagccacaaattgaacgtgttactcaaatcttgggtcgtcgcaccaaaaataatccttgtcttattggggaacctggtgtcggaaagacagctattgctgaaggtctcgcccaacggattgcaaatggtgatgtccctgaaaccatagagggaaagcaggttataaccctggatatgggtctacttgttgctggaactaaatatcgtggagaatttgaggagagattgaaaaaactaatggaggaaattaaacaaagtgatgaaataatacttttcattgatgaagtgcacactctcattggagcaggagcagctgaaggggcaattgatgcggcaaacatattgaaaccagctcttgctagaggtgaactacagtgtataggagccacaacactagatgaatacaggaagcacattgaaaaagatccagctttggagaggagattccagccagttaaagtgccagagccaactgtgagtgaaaccatacaaatattgaaagggcttagagagcgctatgagattcaccacaagctccgttataccgatgatgctcttgtagctgctgcagagctgtcatatcaatatatcagtgatcgatttttgcctgacaaagctatagatttgattgatgaagctggttcccgagttcgacttcaacatgcacagttacctgaagaagcaagagggcttgaaaaggaggttaggcagatagttaaggagaaagatgaagctgttcgcaatcaagaatttgaaaaggctggagagctacgggataaagaaatggatcttaaggctcagatatcaggactaatacaaaaaaacaaggagatgagcaaggcagagagtgaggcaggagatgtaggtgcacttgtgactgaagttgacatacaacatattgttgccgcctggactggtatccctgttgataaagtctcagttgacgaatctgatcgccttctcaagatggaagagaccttacacaaacgcgttattggtcagcatgaagcagtagaagccattagccgtgctatccgccgagctcgtgttggacttaagaaccctaaccggccgattgccagcttcatcttttctggccctactggtgtggggaagtctgagttggccaaaacattggcctcatactactttggatctgaagaagccatgattcggcttgacatgagcgaatttatggaacggcacacagtctccaaactcatcggttcacctcctggatatgttggttataccgagggtggtcaattgactgaggcagttcggcgccgtccctatactgttgtactctttgatgagattgagaaagcccatcctgatgtcttcaatatgatgcttcaaattctggaagatgggaggctaacagatagtaagggaagaactgtcgacttcaagaacacacttcttataatgacatcaaatgttggaagcagtgtgattgagaaaggaggtcgtcgcataggatttgaccttgactatgatgagaaggacagcagttataaccgaatcaaaagcttggtgaccgaggagctgaagcaatactttaggccagagttcttgaataggctggatgaaatgattgttttcaggcaacttacaaaactggaggttaaggagatagctgatataatgctgaaggaggtgttcgagagactgaaaaccaaagagattgagctctcagtgacagagagatttagggagagagtggtcgacgaaggttataatcctagttatggtgccagacctctaagaagagctataatgcgacttttggaagacagcatggctgagaagatgcttgctagagagattaaagagggtgactctgttatagtggatgctgattccgatggaaatgtgattgtgctcaatggtagtagtggtgctccaaattcattgccagagtctcttcctgtgtaatattgtgtacttgttttaagagccatagtctgtttagctgttgatgtacatagagtttttgattggactattgttagtgtaaggcaagtttgcccatatcaacaaagcaaagtagggaatggtcggggacctgggataggttgcatagttgaagaatttcaatttttagtgacagcccaacatttcaaagattttttagtgctaggcgtttggttgtctcacatttatgtattgcctaagggagtctgttctatctatctatc

SEQ ID NO: 3204 - DNA, 3714 bp, Cicer arietinum
atgtataccaatgtatgtgtgtattggtattttttacataattatacgtggcacacttgactacactcatagaactaatgataatttgacatgtaagagcttttctaaaactatacggcatcgtattaccagaaggtcggtgaaaaccaggttacgcaacaatacataaacatcatcctatatattgatatttatacctagtttgtcgttcaagaacagttttcattttatcttttcgccaccctatttctccttcccataactattgaagccaaactcgcggtttctctatctggagagagaaatttccttcactttttcttttgatttcaatcttccgaattcttttttactcttttttttttttctctctaaatttaatttcgttgaattattcagtattggatattcgtgtactcaagggtttctgacaatacaggaatcatgtctaggcttttggtgcattctcttaatgtcccgggcttagtgcccgggcaaaggcatggcaataacaacaaggtattggcgaaagtaagaaggcctgtcaaaatgatgtttgccacaggaaccgctgcctcgagaatgcctggtttctcgggactacgtactgttaactctttggattctatgttgagacctagactagattttcattctaaggtgcttactcaaattggtactaatcgagcaaggagtggaagaggtaacagagtcgtacccaaagccatgtttgagcgtttcaccgagaaagcaatcaaagtaattatgctggctcaggaggaagcaaggaggctaggtcacaattttgttggaacagaacagattctattgggtcttattggtgaaggcacaggtattgctgctaaggttctaaagtctatgggaattaacctaaaagatgcacgcgtggaagtggaaaagataattggaaggggtagtggtttcgtggctgttgagattccgtttactccccgtgccaagagagttttggaactctcattggaggaagctcggcaacttggtcacaattatattggatctgagcacttgcttctgggtcttcttcgagagggtgaaggtgtggcagcacgtgtccttgaaaatctgggtgctgatccaactaatattcgcacacaggttattcgcatggtcggtgagggggctgacaatgttggggctactgttggttctggaagtagtaacaataagatgccaactttggaggagtatggcaccaatttgaccaagctagcagaagagggaaaattggatcctgttgtgggtaggcagccacaaattgaacgtgtcactcaaatcttgggccgtcggaccaaaaataatccctgtcttattggggaacctggtgttggaaagacagctattgctgaaggtcttgctcaacggattgcaaatggtgatgtccccgaaactatagagggaaagaaggttataaccctagatatgggtctacttgttgctggaactaaataccgtggagaatttgaggagagattgaaaaaactaatggaggagatcaaacaaagtgatgaaataatacttttcattgatgaagtccacactctaattggagcaggagcagctgaaggggcaattgatgcagcaaacattttgaaaccagctcttgccagaggtgaactacagtgtattggagccacaacactagatgaatataggaagcacattgaaaaagatccagctttggagaggcggttccagccagttaaagtacctgagccaactgtggatgaaaccatacaaatactgaaagggcttagagagcgctatgagattcaccacaagctccgttatactgatgatgctcttgtagctgctgcacagctatcacatcaatatatcagtgatcgatttttgcctgacaaagctatagatttgattgatgaagctggttcccgagtccgacttcaacatgcacagttaccagaagaagcaaaggagcttgaaaaggaggttaggaagattgttaaggagaaagatcaagctgttcgcaaccaagaatttgaaaaggctggagagctacgggatcaagaaatggatcttaaggctcagatatcagcagttgtagaaaaaggcaaggagatgagcaaggcagagagtgaggcaggggatataggtgcacttgtgactgaggttgacatacaacatattgttgctgcctggactggtattcctgttgacaaagtttcgacggacgaatctgaccgccttctcaagatggaagacaccttacacaagagaattattggtcagcatgaagcagtagaagccattagccgggctatccgtcgtgctcgtgttggacttaagaaccctaacaggccaatcgccagcttcattttttctgggcctactggtgtggggaagtctgagttggccaaagcattggctacatactactttggatctgaagaagccatgattcggcttgacatgagtgaatttatggaaaggcacacagtctcgaaactcattggttcacctcctggatatgttggttacaccgagggtggtcaactgactgaggcagttcgtcgtcgtccctacacagttgtactctttgatgagattgagaaagcccatcccgacgtcttcaacatgatgcttcaaatcctggaagatggaaggctaacagatagcaagggaagaaccgtggacttcaagaacacacttcttataatgacatcaaatgttggaagcagtgttattgagaaaggaggccgtcgtataggatttgaccttgactatgatgagaaggatagcagttataatcgaatcaagagcttggtgactgaggagctgaagcaatacttcaggccagagtttttgaataggttggatgaaatgattgttttcaggcaattaacaaaacttgaggtaaaggagatagctgatataatgctgaaggaggtgtttgagagactgaaagccaaagatattgagttgtcagtgacagagagatttaaggagagagtggtcgacgaaggttataatcctagttatggtgccaggcctctaagaagagccataatgagacttttggaggacagcatggctgagaagatgctcgctagagagattaaagagggtgattctgtcatagtggatgctgattctgatggtaatgtgattgtgctcaatggcagtagtggtgcttcagattcattgccagaggctcttcctgtttaatattgttgcctttgccaagctgtgtacttgacttttaatagtcatagtctgtttagttgtcaatggataaagcttttaatttatctttagccaacaggagcaaagttgagaatggttggggactttggataggtttaattcaacaattttcaatttttaatgaaaactcgacatttgaagtgttttcagtgctagggctattcgtggtctcacatttattgcataagggagtttgtaaattatttttacataattttagataaatgttccagtatgtttaacacattgaatataggacatgatggaagaattatcgctacttaaatcctactgaaaaggatttagactttcaattctgaaagagatattttttcaataaactaaatggttaacttggtttacttacgtgaataattatgtatatgtataattatattttgttggtgaataatgaatataattaagtgtagtaattcactaactatccac

SEQ ID NO: 3205 - DNA, 3091 bp, Cicer arietinum
acaatacaggaatcatgtctaggcttttggtgcattctcttaatgtcccgggcttagtgcccgggcaaaggcatggcaataacaacaaggtattggcgaaagtaagaaggcctgtcaaaatgatgtttgccacaggaaccgctgcctcgagaatgcctggtttctcgggactacgtactgttaactctttggattctatgttgagacctagactagattttcattctaaggtgcttactcaaattggtactaatcgagcaaggagtggaagaggtaacagagtcgtacccaaagccatgtttgagcgtttcaccgagaaagcaatcaaagtaattatgctggctcaggaggaagcaaggaggctaggtcacaattttgttggaacagaacagattctattgggtcttattggtgaaggcacaggtattgctgctaaggttctaaagtctatgggaattaacctaaaagatgcacgcgtggaagtggaaaagataattggaaggggtagtggtttcgtggctgttgagattccgtttactccccgtgccaagagagttttggaactctcattggaggaagctcggcaacttggtcacaattatattggatctgagcacttgcttctgggtcttcttcgagagggtgaaggtgtggcagcacgtgtccttgaaaatctgggtgctgatccaactaatattcgcacacaggttattcgcatggtcggtgagggggctgacaatgttggggctactgttggttctggaagtagtaacaataagatgccaactttggaggagtatggcaccaatttgaccaagctagcagaagagggaaaattggatcctgttgtgggtaggcagccacaaattgaacgtgtcactcaaatcttgggccgtcggaccaaaaataatccctgtcttattggggaacctggtgttggaaagacagctattgctgaaggtcttgctcaacggattgcaaatggtgatgtccccgaaactatagagggaaagaaggttataaccctagatatgggtctacttgttgctggaactaaataccgtggagaatttgaggagagattgaaaaaactaatggaggagatcaaacaaagtgatgaaataatacttttcattgatgaagtccacactctaattggagcaggagcagctgaaggggcaattgatgcagcaaacattttgaaaccagctcttgccagaggtgaactacagtgtattggagccacaacactagatgaatataggaagcacattgaaaaagatccagctttggagaggcggttccagccagttaaagtacctgagccaactgtggatgaaaccatacaaatactgaaagggcttagagagcgctatgagattcaccacaagctccgttatactgatgatgctcttgtagctgctgcacagctatcacatcaatatatcagtgatcgatttttgcctgacaaagctatagatttgattgatgaagctggttcccgagtccgacttcaacatgcacagttaccagaagaagcaaaggagcttgaaaaggaggttaggaagattgttaaggagaaagatcaagctgttcgcaaccaagaatttgaaaaggctggagagctacgggatcaagaaatggatcttaaggctcagatatcagcagttgtagaaaaaggcaaggagatgagcaaggcagagagtgaggcaggggatataggtgcacttgtgactgaggttgacatacaacatattgttgctgcctggactggtattcctgttgacaaagtttcgacggacgaatctgaccgccttctcaagatggaagacaccttacacaagagaattattggtcagcatgaagcagtagaagccattagccgggctatccgtcgtgctcgtgttggacttaagaaccctaacaggccaatcgccagcttcattttttctgggcctactggtgtggggaagtctgagttggccaaagcattggctacatactactttggatctgaagaagccatgattcggcttgacatgagtgaatttatggaaaggcacacagtctcgaaactcattggttcacctcctggatatgttggttacaccgagggtggtcaactgactgaggcagttcgtcgtcgtccctacacagttgtactctttgatgagattgagaaagcccatcccgacgtcttcaacatgatgcttcaaatcctggaagatggaaggctaacagatagcaagggaagaaccgtggacttcaagaacacacttcttataatgacatcaaatgttggaagcagtgttattgagaaaggaggccgtcgtataggatttgaccttgactatgatgagaaggatagcagttataatcgaatcaagagcttggtgactgaggagctgaagcaatacttcaggccagagtttttgaataggttggatgaaatgattgttttcaggcaattaacaaaacttgaggtaaaggagatagctgatataatgctgaaggaggtgtttgagagactgaaagccaaagatattgagttgtcagtgacagagagatttaaggagagagtggtcgacgaaggttataatcctagttatggtgccaggcctctaagaagagccataatgagacttttggaggacagcatggctgagaagatgctcgctagagagattaaagagggtgattctgtcatagtggatgctgattctgatggtaatgtgattgtgctcaatggcagtagtggtgcttcagattcattgccagaggctcttcctgtttaatattgttgcctttgccaagctgtgtacttgacttttaatagtcatagtctgtttagttgtcaatggataaagcttttaatttatctttagccaacaggagcaaagttgagaatggttggggactttggataggtttaattcaacaattttcaatttttaatgaaaactcgacatttgaagtgttttcagtgctagggctattcgtggtctcacatttattgcataagggagtttgtaaattatttttacataattttagataaatgttccagtatgtttaacacattgaatatagg

SEQ ID NO: 3206 - DNA, 2967 bp, Elaeis guineensis
ttgcaaggttttgcaggcttgagggggtcgaataatttggatttgctgtccaggtctaggcgggattttcattctgtggtatcagcttatatctctgctccacagggcaaggcttgtcgaggagtccctgtagccatgtttgagcgtttcacagagaaggcaatcaaagttatcatgcttgcgcaagaagaagcaaggcggctaggtcacaattttgttgggactgaacaaatattgttgggtcttattggtgaagggactggtattgctgcaaaagttttaaagtccatgggtataaatcttaaagatgcccgtgtggaagtggaaaagattattggaaggggcagtggctttgttgctgttgaaataccatttacaccgcgtgcaaagcgtgttttggaactctcgctagaggaagcccgccaacttggtcataactatataggatctgagcacttgcttcttgggctgttgcgtgagggtgagggtgtggctgcccgtgtgcttgagagtcttggagctgatccaagcaacatccgtacgcaggttattaggatggttggtgaaagcacggaagcagttggtgctggggttggaggtggaagcagtggcaataagatgcccacgctcgaggagtatggaactaatttgacaaagttggcagaggagggcaaactagatccagttgttggcaggcaggagcaaatagagcgtgttacccaaattctgggaaggcgaacaaagaacaatccctgcctgattggagagcctggtgttgggaagacagccattgcagaaggacttgctcaacgcatagcaaatggggatgttccagaaactattgaaggaaagaaggtcattacccttgatatgggactccttgttgctggtaccaaatatcgtggagagtttgaagaaagattaaaaaagttgatggatgaaataaagcaaagcgatgagataatactctttattgatgaggtacacacattaattggagcaggagcagcagagggtgcaatagatgcagctaatatcttaaaaccagctcttgcaagaggtgaactacagtgtattggagccacaacactcgatgagtacaggaagcacattgagaaggatcctgctttggaaagacgatttcaaccagtaagagtgccagagccaacagttgatgaaacaatacagatcctgaaagggcttcgtgaacgctatgagattcaccacaaacttcgttatacagatgaagctttagttgctgctgctcaattgtcataccaatacattagtgaccgcttccttcctgataaagcaattgacttgattgatgaagctggttctcgtgttaggctgcgccatgcgcagcttcctgaggaggccagagaacttgacaaagagctcaggcagatcaccaaggagaaaaatgaatctgtccgtagccaagattttgagaaggctggggagctgcgtgatagggaaatggaactgaaggcacagatatcagccctaattgacaagggtaaagagagaagcaaagcggagagtgaggcaggtgattcgggtccacttgtcacagaagcagacatacagcacattgtgtcttcttggactggaatacctgtggagaaagtctcaagtgatgagtcagatcgcctccttaagatggaagagacccttcacaagcgtgttgtgggccaggatgaagctgtcaaagccataagtcgtgccatccgccgagctcgtgttgggctcaagaatcccaaccggccaattgccagcttcatattttctggcccaactggtgtgggaaaatcagagctggcaaaggcgctggctgcctactacttcggctctgaggaagctatgatcagactggacatgagtgagttcatggagagacatacagtctccaaactcatcggctcacctcctggttatgttggttacactgagggtggtcagctaactgaagcagttcgccgtcgcccttacactgttgtcctctttgatgagatagagaaggctcatcctgatgtcttcaacatgatgcttcaaattttggaggatgggaggttgacagatagcaagggacgaactgtggatttcaagaacaccctgctaattatgacgtccaatgtcggcagtagtgtgatcgaaaagggagggcgtagaattggatttgatctcgactatgatgagaaggacagcagctataaccgaatcaagagtctggttacagaggagttgaagcaatatttcaggcccgagttcttgaataggttggatgaaatgatcgtgttccggcagctgacaaagcttgaggtgaaggaaattgctgatataatgctgaaagaggtctttgagaggctgaaggctaaggacatagagcttcaagttacagagagatttagagacagggtggtggaggaaggttatagcccaagctatggtgcaaggcctttgaggagggcaataatgaggcttttggaggacagcttggcggagaagatgcttgctggagagatcaaggagggagattcagccattgtggatgtcaattctgatgggaatgttacagttcttagcggtgcaagtggtgtaccagagcctccagctattcctgtataaagtgtaataaacaatgtaccatttaaatgtcgagcagttttatgccaatattgtcaatctttgtggaggcttccatgatgcagcagcagcggcagcagcccaatcatcctttttgctggccttaaagtttgttaacaacttagaacatacagttccacgaatatagtaacagtgaggttaatgtgtaccaagaagagcaaagtagctcgacttatgtgactgagaatggcagaatcaaatcgaggtatttctgttctttatcaaaattgtgttgtttcctgtttctcttttgggactctgtacgaactggctggattttatgcaaagtagatgtgaatc

SEQ ID NO: 3207 - DNA, 3987 bp, Glycine max
tttttcctgtcttgttcttattcatttcagatatttataagtatttcaaaacactcttctagaatgctcgattagctcaaatattttcttcagataaagtcttgaagatggctgggcctcttagtaatcctcttgggcctaatgtgttgggctgtgtccctatcatttgccttcttctcttcttcttcttcctccctccgcgcattctctttcttccttttaatctttcaatttcttttcccctttttctcttttctgactaactcaatcaatttagtgtggcttccgggaacaattcaggaatcatggctagggttttagctcagtctactggtatgcctggcctactgagtgggcgaaggcatgggccgcataaaggatcaggaaaaacgaaaagatctgttaaaatgatgagtaccttacgaattcctgctttaagaatgtcgagtttctctggattacggacacttaatcctttggattctgtgtcgagaccacgacacacttttccgttgactacaacttctaggcgcgagagggctaaaagatgtgtacctaaagctatgtttgagcgtttcacagagaaggcaatcaaagtaattatgctagcccaggaggaagcaagacgactggggcacaattttgttggaacggaacagattctattgggtctcattggcgaaggaaccggcattgctgctaaggttctgaagtcaatgggaattaacctcaaggatgctcgggttgaagtggagaaaattattggaaggggtagtggatttgttgctgttgagattccgtttacttcccgtgcaaagcgtgttttggaactctcactggaggaagctcgccaacttggtcacaattatattggatctgagcacttgcttcttggtctccttcgagagggtgagggtgtagcagcacgtgttcttgaaaatttggctgctgatccaaacaatattcgcgctcaggttatccgcatggttggtgagggtgctgacagtgttggtgctactgttggccctggaagtagtaataacaacaagatgccaactttggaggagtatggcaccaatttgaccaagctagcggaagaggggaaattggatcctgtcatgggtaggcagccacaaattgaacgtgtcactcaaattttgggtcgtcgtacaaaaaataatccttgtcttattggggaacctggggtcgggaagacagctattgctgaaggtcttgcccaaaggattgcaaatggtgatgtacctgaaaccatagagggaaagaaggttataacccttgatatgggtctgctggtagctggaactaaatatcgtggagaatttgaagagagattgaagaaactaatggaggaaatcaaacaaagtgatgagataatactctttattgatgaagtgcacactctaattggagctggagcagctgagggagcaattgatgctgcaaatatattaaaaccagctcttgccagaggtgaactgcagtgtataggagccacaacactggatgaatataggaagcacattgaaaaggatccagctttggagaggcgattccagccagttaaagtgccagagccaactgtcaatgaaaccatacaaatactgaaaggactcagagaacgctatgaaattcaccacaagcttcattacacagatgatgctcttgtagctgctgcccagctatcacaccaatatattagtgatcgatttttgccagacaaagctatagatttaattgatgaagcaggttctcgagtccggcttcaacatgcacagttacctgaagaagcaagagagcttgacaaggaggttagacagattgtaaaggagaaagaagaatctgttcgcaatcaagactttgagaaggccggagagctaagagataaagaaatggatcttaaggcgcagatatctgcacttatagaaaaaggcaaggagatgagtaaggcagaaagtgaggcaggagatgaaggtcccatggtcactgaagttgacatacaacatattgtctcctcctggactggtattcctgtggagaaagtctcgactgatgaatctgatcgcctcctcaaaatggaagagactttacacaagcgagtcataggtcaggatgaagcagtgaaagccataagcagggccatccgtcgagccagggttggactgaagaaccctaaccgtccaattgccagcttcatcttttctgggccaactggtgtggggaagtctgagttggccaaagcattggctgcatactactttggttctgaagaagccatgattcggcttgacatgagtgaattcatggaaaggcacacagtctcgaaacttattggttcacctcctggatacgttggttacactgagggtggtcaactgactgaggcagttcgccgtcgtccctatactgttgtactctttgatgagattgagaaagcccatcctgatgtattcaacatgatgcttcagatcctggaagatggaagattaacagacagcaaaggaagaactgtggacttcaagaacacgcttcttataatgacatcaaatgttggaagcagtgtaattgagaaaggaggccgtaaaataggatttgaccttgattatgatgagaaggatagcagttacaaccgaatcaagagcttggtgactgaggaactgaagcaatactttaggccagagttcttgaataggttggatgaaatgattgttttcaggcaactcacaaaattggaggttaaggagatagcagacataatgctgaaggaggtgttccagagactgaaagctaaagagattgatctttcagtgacagaaagatttagggagagggtggttgacgaaggatataatcctagttatggggctaggcctctaagaagagccataatgcaacttttggaggatagcatggctgagaagatgcttgctagagagattaaggagggtgactcagttatagttgattctgattctgagggtaatgtgattgtgctcaacggtagtagtggtgccccagattcactagaagatgtcttagttagttgagttgtacttttttttttttcttcttcttttatttgtttaaaaaaacatagccatagtttgtttttagttgtcaatggacatcagtcaagcttttaactgaatgctggtggtctcagccacccataacataatgaacacagctgggtttgggtggaatgaaaaaatgacgttatttctgtgggtcctacccttaatatgctgcattatgaacaattttgatttactggaagcaactaattttgtagttttcacggttctgtaaactattgttataaataagttgcaccacatcaaatgatctgtttggctgacttgatcaattctcaaatgcgtgcttttgattacaaaatagagtacaaattcaccatctgggatatgcttgattctgattatacgaatttggggtcagagaatagcaatcatatcctaactgatccgtgtgctggccctgtgggaaactttattgtgagaagaattctgatgctccaattgaacatataataatgggacagccgttagacgcactccgaacctatactccacttacactttgtagaagaaaaactaactgaaaaacaccattagggtgatattggctgttagattgggatggggccaaaattgcgtaaaaaattgggaaaatttggaagtgataaattgttgcttcattataaaggcagaaacttaatcgatttgtttttattgcactgccattccaaatacactcgttactttctaacctgctgatacttggcagcacaaaatctataaatttgcagtttctattgatctattagtggatgagatgatctttgtgtggggctgacactcccaccacggctaatcttcaaagctgttaatgctttctggatttccatagtcatggcactatctacactcccagatgatagctttttatgtg

SEQ ID NO: 3208 - DNA, 3834 bp, Glycine max
tttttcctgtcttgttcttattcatttcagatatttataagtatttcaaaacactcttctagaatgctcgattagctcaaatattttcttcagataaagtcttgaagatggctgggcctcttagtaatcctcttgggcctaatgtgttgggctgtgtccctatcatttgccttcttctcttcttcttcttcctccctccgcgcattctctttcttccttttaatctttcaatttcttttcccctttttctcttttctgactaactcaatcaatttagtgtggcttccgggaacaattcaggaatcatggctagggttttagctcagtctactggtatgcctggcctactgagtgggcgaaggcatgggccgcataaaggatcaggaaaaacgaaaagatctgttaaaatgatgagtaccttacgaattcctgctttaagaatgtcgagtttctctggattacggacacttaatcctttggattctgtgtcgagaccacgacacacttttccgttgactacaacttctaggcgcgagagggctaaaagatgtgtacctaaagctatgtttgagcgtttcacagagaaggcaatcaaagtaattatgctagcccaggaggaagcaagacgactggggcacaattttgttggaacggaacagattctattgggtctcattggcgaaggaaccggcattgctgctaaggttctgaagtcaatgggaattaacctcaaggatgctcgggttgaagtggagaaaattattggaaggggtagtggatttgttgctgttgagattccgtttacttcccgtgcaaagcgtgttttggaactctcactggaggaagctcgccaacttggtcacaattatattggatctgagcacttgcttcttggtctccttcgagagggtgagggtgtagcagcacgtgttcttgaaaatttggctgctgatccaaacaatattcgcgctcaggttatccgcatggttggtgagggtgctgacagtgttggtgctactgttggccctggaagtagtaataacaacaagatgccaactttggaggagtatggcaccaatttgaccaagctagcggaagaggggaaattggatcctgtcatgggtaggcagccacaaattgaacgtgtcactcaaattttgggtcgtcgtacaaaaaataatccttgtcttattggggaacctggggtcgggaagacagctattgctgaaggtcttgcccaaaggattgcaaatggtgatgtacctgaaaccatagagggaaagaaggttataacccttgatatgggtctgctggtagctggaactaaatatcgtggagaatttgaagagagattgaagaaactaatggaggaaatcaaacaaagtgatgagataatactctttattgatgaagtgcacactctaattggagctggagcagctgagggagcaattgatgctgcaaatatattaaaaccagctcttgccagaggtgaactgcagtgtataggagccacaacactggatgaatataggaagcacattgaaaaggatccagctttggagaggcgattccagccagttaaagtgccagagccaactgtcaatgaaaccatacaaatactgaaaggactcagagaacgctatgaaattcaccacaagcttcattacacagatgatgctcttgtagctgctgcccagctatcacaccaatatattagtgatcgatttttgccagacaaagctatagatttaattgatgaagcaggttctcgagtccggcttcaacatgcacagttacctgaagaagcaagagagcttgacaaggaggttagacagattgtaaaggagaaagaagaatctgttcgcaatcaagactttgagaaggccggagagctaagagataaagaaatggatcttaaggcgcagatatctgcacttatagaaaaaggcaaggagatgagtaaggcagaaagtgaggcaggagatgaaggtcccatggtcactgaagttgacatacaacatattgtctcctcctggactggtattcctgtggagaaagtctcgactgatgaatctgatcgcctcctcaaaatggaagagactttacacaagcgagtcataggtcaggatgaagcagtgaaagccataagcagggccatccgtcgagccagggttggactgaagaaccctaaccgtccaattgccagcttcatcttttctgggccaactggtgtggggaagtctgagttggccaaagcattggctgcatactactttggttctgaagaagccatgattcggcttgacatgagtgaattcatggaaaggcacacagtctcgaaacttattggttcacctcctggatacgttggttacactgagggtggtcaactgactgaggcagttcgccgtcgtccctatactgttgtactctttgatgagattgagaaagcccatcctgatgtattcaacatgatgcttcagatcctggaagatggaagattaacagacagcaaaggaagaactgtggacttcaagaacacgcttcttataatgacatcaaatgttggaagcagtgtaattgagaaaggaggccgtaaaataggatttgaccttgattatgatgagaaggatagcagttacaaccgaatcaagagcttggtgactgaggaactgaagcaatactttaggccagagttcttgaataggttggatgaaatgattgttttcaggcaactcacaaaattggaggttaaggagatagcagacataatgctgaaggaggtgttccagagactgaaagctaaagagattgatctttcagtgacagaaagatttagggagagggtggttgacgaaggatataatcctagttatggggctaggcctctaagaagagccataatgcaacttttggaggatagcatggctgagaagatgcttgctagagagattaaggagggtgactcagttatagttgattctgattctgagggtaatgtgattgtgctcaacggtagtagtggtgccccagattcactagaagatgtcttagttagttgagttgtacttttttttttttcttcttcttttatttgtttaaaaaaacatagccatagtttgtttttagttgtcaatggacatcagtcaagcttttaactgaatgctggtggtctcagccacccataacataatgaacacagctgggtttgggtggaatgaaaaaatgacgttatttctgtgggtcctacccttaatatgctgcattatgaacaattttgatttactggaagcaactaattttgtagttttcacggttctgtaaactattgttataaataagttgcaccacatcaaatgatctgtttggctgacttgatcaattctcaaatgcgtgcttttgattacaaaatagagtacaaattcaccatctgggatatgcttgattctgattatacgaatttggggtcagagaatagcaatcatatcctaactgatccgtgtgctggccctgtgggaaactttattgtgagaagaattctgatgctccaattgaacatataataatgggacagccgttagacgcactccgaacctatactccacttacactttgtagaagaaaaactaactgaaaaacaccattagggtgatattggctgttagattgggatggggccaaaattgcgtaaaaaattgggaaaatttggaagtgataaattgttgcttcattataaaggcagaaacttaatcgatttgtttttattgcactgccattccaaatacactcgttactttctaacctgctgatacttggcagcacaaaatctat

SEQ ID NO: 3209 - DNA, 2812 bp, Zostera marina
tttcattccacggtagccgcatcaatttgcaagccacgaggaaagaaccgcacacgtagcgggatagtagcgatgtttgagcgtttcacggagaaggccatcaaagttatcatgcttgctcaagaggaagcaagacgtttgggtcataattttgtagggactgagcagattcttttgggtttgattggtgaaggcactggcatcgcagccaaagttttgaaatcaatgggtatcaatcttaaagatgctcgtcaagaagtggagaaaattatcggacgtggcagtggatttgttgctgttgaaatcccatttactccacgtgcaaagcgtgttttggagttgtcccttgaagaagctcgccaacttggtcataattatatcggatctgagcatttgcttcttggattgcttcgtgagggtgaaggcgtagctgctcgagtccttgaaagcttgggagccgattcaaacaacatccgcacacaggttatacgaatggttggtgaaagcacagaggctgttggtgctggagttggaggaggaagcagtggaaacaagatgcccacactcgaagagtatgggactaatcttacaaaattagccgaagagggaaaactagatcctgtcgtcggtaggcaagatcagatagagcgtgttactcaaattctcggtagaagaacaaaaaacaatccatgtcttattggagagcctggagttggaaagacggcgattgctgaaggattagctcaacgcattgcaactggcgacgttcccgaaacaattgaaggaaaaaggtgatcacattggacatgggtctacttgttgctggtacaaaataccgaggagaatttgaagagaggttaaaaaattaatggaggaaatcaagcaaagtgatgaaataatactcttcattgatgaagttcacacgctcattggagctggagcagcggagggtgcaattgatgcagcaaacatccttaagccagctcttgctaggggtgaattacaatgtattggagctacaactattgacgagtacagaaaacacatagagaaagatcctgcattagagaggcgatttcaacctgtgaaagtgccagaaccaagtgttgacgaaactatagaaatcttgaaaggacttcgtgaaagatacgaaattcaccacaaacttcgttacaccgatgaagctttggttgctgctgctcgtttatcctaccaatacatcagtgatcgatttctaccagataaagccattgatctcgttgacgaagccggttcacgtgttcggctccagcatgcgcagcttcctgaagaggccagggagcttgacaaagaattaagacagataactaaagagaaaaatgaagctgttcgcggccaagactttgaaaaggcgggcgagatccgagatagggaaatggagttgaaagcacagataacggcactcattgataaaggcaaagagatgaacaaagctgaaagtgaagcgggagatgcaggtcctattgttgatgagagtgacatccaacacatcgtttcatcgtggactggtattccagttgagaaggtatcaactgatgaatctgaccgtcttttaaaaatggaagaaactctccaccagcgtattatcgggcaagatgaagctgtcaaggcgataagtcgtgcaatccggcgtgcccgtgttgggctgaaaaacccaaatcgacccattgccagcttcatattttctggcccaactggtgttggaaaatctgagcttgctaaagcactagcaacttactacttcggatctaatgaagccatgattcggcttgacatgagtgagttcatggaaaggcacacaggtctcgaagcttattgggtctccacctggatatgttgggtacactgaaggtggccaattaactgaagccgttcgccgccgaccatacacagttgtactatttgatgagatcgagaaagctcaccctgatgtcttcaacatgatgcttcaaatccttgaagatggaaggctcactgacagcaagggtcgaacagttgacttcaagaacacacttttgataatgacatcaaatgtcggtagcagtgtgatcgagaaaggtggtcgccggattgggtttgatcttgactacgatgagaaagacagcagctacaaccgaataaaaagtttagtcaccgaggagctgaagcagtatttccgaccagaattcttgaatcgactcgatgagatgattgtgttccgacagctaaccaaaatcgaagttaaggacattgctgcgataatgctcaatgaagtttttgatagactcaaaacaaaagacatcgctctacaagtgacagagcggttcagagatagagttgtcgatgaaggttacaacccaagctatggtgcaaggccattaaggagagccatcatgaggctactcgaagatagcttagccgagaagatgctcgcaggagaaatcaaagatggtgactctgccattgttgatgtagattctgatgggaatgtcattgttcttcatggtgagaccaccatggcagaaccagagccagaaccagaaaccgtccttcctgtatagtttagaaggccttggcttccttctaaggaattttctaggattcaggccagttttacctgcggccacctagtatgatgaagaatgtaaattaatcatggtttggaaaattaaacattaacatttcctcctgtccttattcgcttctttgtcatggtttatggttttggaatggaaaattgtctaaaataactcctgaaccaattcttattcttactttacattttagctttatt

SEQ ID NO: 3210 - DNA, 3261 bp, Trigonella foenum-graecum
agagagaagatttcccttatctcgttctctctttccatcttccaatttcttttctttgaattttcgttgaattcatcactattggataagggtttctggaatcatgtctagggttttggcgcagtcaattaatgtcccgggcctagtggctggtcgaaggcatgtcaataacaacaagggatctgcgagatcaagaaggtctgtcagaatgatgtatgccacacgagctgctgcaccgagactgtgtagttactcgggattgcgcactttgaactcgttggattctatgttcagacctggacaggattttcattctaaggtgctcactcagattggcactaatagagcaaagggtggtagaggtagcagattcgttactaaagctatgtttgagcgttttacggagaaagcaatcaaagtaattatgttggctcaagaggaagcaaggcggcttggacacaattttgtcggaactgaacagattctgttgggtcttattggtgaaggcactggtattgctgctaaggttctaaagtctatgggaattaacctgaaagatgcacgtgtagaagttgaaaagataattggaaggggcagtggttttgtcgctgttgagattccgtttactccgcgtgccaagagggttttggaactctcattggaggaagctcgccaacttggtcacaattatatcggatctgagcacttgcttttgggtcttcttcgagaaggtgaaggtgtggcagcacgtgttcttgaaaatttgggtgctgatccaactaatattcgcacccaggttattcgcatggttggtgagggtgctgatagtgttggggctactgttggccctggaagcagtaacaataagatgccaactttggaggagtatggcaccaatttgaccaagctagcagaggagggaaaattggatcctgttgtgggtagagagccacaaattgaacgtgtcactcaaatcttgggtcgtcgtaccaaaaataatccttgtcttattggggaacctggtgtcggaaagacagccattgctgaaggtcttgctcaacggattgcaaatggtgatgtccccgaaaccatagagggaaagaaggttataaccctagatatgggtctacttgtagctggaactaaataccgtggagaatttgaggagaggttgaaaaaactaatggaggaaatcaaacaaagcgatgaaataatacttttcattgatgaagtgcacactctaattggagcaggagcagctgaaggggcaattgatgccgcaaacatattgaaaccagctcttgccagaggtgaactacagtgtataggtgccacaacactagatgaatataggaagcacattgaaaaagatccagctttggagaggcgattccaaccagttaaagtgccagagccaactgttcctgaaaccatacaaatactgagagggcttagagagcgctacgagattcaccacaagctccgttatactgatgaggctcttgtagctgctgcagagctgtcacatcaatatattagtgatcgatttttgcctgacaaagctatagatttgattgacgaagctggttcccgagtccgacttcaacatgcacagttacctgaggaagcacgaggtctagaaaaagaggttaggcagatagtcaaggagaaagatgaagctgttcgtaaccaagagtttgaaaaggctggagagctaagggataaagaaatggatctcaagactcagatatcagcacttattgaaaaaaacaaggagatgaacaaggcagagagtgaggcaggagatgtaggtgcacttgtgactgaagttgacatacaacatattgtcgcctcctggactggtatccctgttgacaaagtctcggttgacgaatctgatcgtcttctcaagatggaagacacattgcacaaacgtattattggtcaggatgaagctgtagaagccattagcagggctatccgtcgtgctcgtgttggacttaagaaccctaaccggccaattgccagcttcatcttttctggccctactggtgtggggaagtctgagttggccaaagcattggccacgtactactttggatctgaagaagccatgattcggcttgatatgagtgagttcatggaaaggcacacagtctccaaactcattggttcacctcctggatatgttggctatactgagggtggccaactgactgaggcagttcggcgtcgtccctacaccgttgtactctttgatgagattgagaaagcccatcctgacgtcttcaacatgatgcttcaaatcctggaagatgggaggctaacagatagtaagggaagaactgtggacttcaagaacacacttcttataatgacatcaaatgttggaagcagtgtgatcgagaaaggaggtcgtcgcttaggatttgaccttgattatgatgagaaggacagcagttacaaccgaatcaagagcttggtgacggaggagctgaagcaatactttaggccggagttcttgaataggcttgatgaaatgattgttttcaggcaactcacaaaactggaggttaaggagatagctgatataatgctgaaggaggtgtttgagagactgaaaatcaaagagattgagctctcggtgacagagagatttagggagagagtggtcgacgaaggttataatcctagttatggggccaggcctctacgacgagccatcatgcgacttttggaggacagcatggctgagaagatgcttgctagagagattaaagagggcgactctgttatcgtggatgctgattctgatggtaatgtaatcgtgctcaatggtagtagtggtgctccagattcattgccagatgttcttcctgtgtaatatggccacctttccctagttgtgtacttgttttaagagccatagtctgttttgttgttgatgaacataaagctttttatttgactattggtagtctaaggcaagtttgcccatagccaacaaaacaaagtagaaaatggttggggaccagaccttggataggcttcataattgaacaatttcaatttttaatgattgcccaacatttcaaagggttgtgtttttataagtgctaggggttttgtggtctcacatttatgtattgcctaagggagtctgtaaactatttttacttatctttagatagaatttgtatcgcaatatgttcaatttaaaacaataaatataggaacattggcggatgatagtagtaataa

SEQ ID NO: 3211 - DNA, 3147 bp, Cynara scolymus
  misc_feature (743)..(743): n is a, c, g, or t
  misc_feature (888)..(888): n is a, c, g, or t
  misc_feature (913)..(913): n is a, c, g, or t
  misc_feature (957)..(957): n is a, c, g, or t
gcgggggagtgcgtgtacaataaccatgcgaagaagattagaccgaccgcctgtatcatcaacatttattcatccggcggacctttacacaggtcccttctctctcgcttccgattaaccggaaaacgactttcttccatcgctcctaattctaattcccgtgatttagaattctttggttgcaatcatggctggggctttggtgcaatccaccagttttacttctgcagtttccggtgaaagcgaggtccgttcaaagcgatctggtagtataaaaagaccagtcaagatgatgggcttacaagctccttcagtgagggttaggaccttctctggtttgcggggagtaaatgctttagacaacttggtaaagagaggccaggatttccactcaaaggttgcagcagccacctctgtccgaagagcaaaacctagtcgaattgtgccaaaggccatgttcgagcgcttcacagagaaggctatcaaagttattatgcttgcacaagaggaggcaagacggcttggtcacaattttgtgggtacggagcagattttattaggtcttattggtgagggcactggcattgcagcaaaggtgcttaagtcaatgggaattaatttgaaagatgcacgtgttgaggtagaaaaaattattggtaggggtagtggatttgttgctgtagagattccatttacacctcgtgcaaagcgtgtactggaactatcactagaggaggcccggncacttggtcatattacattggttcagagcacttgctttctggtttgcttcgtgagggggaaggtgtagcagctcgcgttcttgagaatttaggtgcagacccaaatacatcgcacacagtgatcagatggttgcgagatgcaaanctgtggtgctggagttggtggtggnagctcggaacagatgccaacactggaggaatatggtaccaactngacaaagctagcggaggagggtaagctggatcctgttgtaggaaggcagccacaaattgaaagagttactcaaattctgggacgccgtacaaaaaacaatccctgcctgattggagaacctggtgttggaaagacagcgattgcagaaggtcttgcccaaagaattgcaactggtgatgttccagaaacaattgagggaaagaaggtgattactctggatatgggtctgcttgttgctggcacaaagtatcgtggagagtttgaggagagactaaagaagctcatggaggaaatcaagcaaagtgatgaaattattctctttattgatgaagtccatacattaattggagcaggagcagcagagggggctattgatgctgctaacatcttgaagcctgctcttgccagaggtgaattacagtgtattggggcaacgacccttgatgagtaccggaagcatatcgagaaggacccagcactggagagacgattccagcctgtaaaggtgcctgagccgacagttgatgagactatacagattctgaaagggcttcgagaacgatatgagattcaccacaaactccgttacaccgatgaagcacttgtagctgctgcccagttgtcatatcagtacataagtgaccgttttcttcctgataaagctatcgatttaattgatgaagctggttctcgtgttcgacttcgtcatgcacaacttccggaagaagccagagagcttgagaaagagcttaggcagataacaaaagagaagaatgaagcagttcgcggccaggactttgaaaaggctggggaattgcgtgatcgagagatggatctcaagactcagatatcggctcttgtggataagaacaaagagatgagcaaggccgagacagaggcgggagaggaaggcccgatggtaacggaagcagacattcaacacattgtctcgtcttggacaggtataccggtcgagaaagtctcgaccgatgaatccgaccgcctcctcaagatggaagagactctccacacacgaatcatcggtcaagatgaagctgtcaaagctattagtcgtgccattcgtcgtgcccgtgttggactaaagaaccccaaccgccccattgccagtttcatcttttctggacccaccggtgtcgggaagtctgaacttgctaaagcgttggctacttactattttgggtcagaagaagccatgattcggctcgacatgagtgagttcatggagaggcacaccgtctcaaagctcatcggttcacctcccggttacgttggttacaccgaaggtggtcaattgaccgaggccgtgcgtcgccgtccctacaccgttgtgctattcgacgaaatcgagaaagctcaccctgatgtcttcaacatgatgcttcaaatcctcgaagacggaagattgaccgacagcaaaggaagaaccgtggacttcaagaacacgcttctaatcatgacatcaaacgtcggaagtagtgtaatcgagaagggtggccgaaggattgggttcgacctcgactatgatgagaaggacagcagctacaaccgaatcaagagcctggtcaccgaggaactgaaacaatatttccgcccggaattcttgaacagactcgacgagatgatcgtattccgacagttgaccaaacttgaggtcaaagaaatcgctgacataatgttgaaggaagtctttgagaggctaaaggttaaagaaatcgagcttcaagtaaccgagcgattcagggatcgggtcgtggaggaaggatacaacccgagctacggtgcaaggccgctgagacgtgcaatcatgaggctactggaagacagcatggcggagaagatgcttgcacgtgaaatcaaggaaggcgattccgtgatcgtggatgtcgattctgacgggaacgtgaccgttctcaacggcagcagcggagctccgccggaggcattgccggagccaattccggtgtagacaaaaaaggccagtttctgatctctatctacaatcgaccaaatatgttgtttgttgtactgtgatgcttttaattggcacataaaaacatatgatacagtcttattgaggcagcaaagttagggttctgcccaatggatttgcatgcacagtccagctcccgctcccgccacaaatcagggttatttatagatgttgcaaat

SEQ ID NO: 3212 - DNA, 3419 bp, Podocarpus macrophillus
ctgtctaggcctacgcacagtcgtaccttctctgcccacttccttcccctggggagaaattccagaccaggtggctacacacctctcaatcgccactgctcttattttcttctttgaagactctctctttgaaagctagctgtttgagcaggcttacaacctgggtgaagatggcagggacactagcacagtcggcagttcttccttctagagtaattagtcatggtcaaattcagagctctaaaagatcaaaacaagtaacaaagatgatgggcaaaatgcaatcacgatcctctaccattggaagtttcactggcttacgccaacaaacaagcatacatatgggtgtgcgtcctgcaaaagactttcatagagctgttgcgactgcagtctcttctgttcaagtgaaagccaataaaggtgtggttgtatgcatgttcgagcgctttacagagaaggccatcaaagtaattatgcttgctcaagaggaagcccgacgccttggtcacaactttgtaggtacagagcagatcctgttgggactcattggtgaagggacgggtattgcagcaaaagtcctgaaatccatgggaattaatttgaaggaggctcgtgtagaagttgagaaaatcattggcagaggcagtgggtttgttgctgtggaaattccctttactccaagggcgaagcgtgtattagaactttcacttgaggaagctcggcaacttggccataactacataggatctgagcacctacttttagggttgttgcgtgagggtgaaggtgtcgcagctcgggtgcttgagaaccttggagctgaccctagcaatattcgtactcaagtgattcgaatggttggtgaaagcacagaagctgttggagcaggagttggaggtggtagtagcagcaacaagatgccaactcttgaggaatatggaaccaatttgaccaaaatggctgaggagggcaagcttgatccggtagttggaaggcagccacagattgagcgtgttactcaaatattgggacgacgcacaaagaacaacccttgccttattggtgagcctggagtaggaaagacagctattgctgagggacttgcccagcgaatagcttctggagatgttccagagacgattgaggggaaaaaggttattactttggatatggggttacttgttgctggtaccaagtatcgtggagagtttgaggaaagattaaagaagctaatggaggaaatcaaacagagtgatgagataatactctttatagatgaagtacatactttaattggagcaggtgcagcagaaggggcaattgatgcggcaaatatcttaaaaccagctcttgcacgaggggaactgcagtgcattggggccaccaccttggatgaatataggaaacatattgaaaaggacccagcactcgagaggagattccaacctgttcaagtgccagagccaactgtggatgagacgatacaaatattgaaaggtctacgagaacggtatgagattcatcataagcttcgttatactgatgaggctctgattgccgctgcacagttgtcatatcaatatatcagtgatcgtttcctccctgacaaagcaattgatctagttgatgaagctggttctcgagtgcgccttcgccatgcacaggttcctgaggaagccagagagcttgacaaagaactgagacagattacaaaggagaagaatgaagctgttcgaaaccaagattttgagaaggctggtgagctacgtgatcgtgagatggaattaaaggcacaaattacagctttaacggagaaaggaaaagagaaatcaaaagctgagacggaggctggggatgttggtccacttgtaaccgaggtagatattcaacatatagtagctgcatggacaggtattcctgtttcaaaagtgtccacggatgaatctgacagactcttgaagatggaggagacactccaccaacgcatcgtcggacaagatgaagctgtcaaagctatcagccgagccattcgtcgtgcaagagttggcttgaagaacccaaacaggccaattgcaagcttcattttctcaggtcctacaggtgtcgggaagtcagagcttgccaaagcattggcagcgtactattttggttctgaggaggcaatgataaggctagatatgagcgaattcatggagagacacactgtttccaagctgattggttcacccccagggtatgtgggatacactgaaggaggtcagctgactgaagctgtcaggagacgcccttatactgtggtcctttttgatgaaattgaaaaggctcatccagatgttttcaatatgatgcttcaaatccttgaagatggaagattgacagatagtaaaggcaggactgttgactttaagaatacccttttgattatgacttctaatgttggtagtagtgtgattgagaagggaggtcgtaaaatggggttccaatttgcggatgatattgatatggaagaagatagcaactacacaagaatcaaaagccttgtccttgaggagctgaagcgctatttccgtcctgagttcttgaatcgtcttgacgagatgattgtatttagacagctcaacaaacaagaggtgagagagatttcagacatcatgttgaaagaagtatttgaacggcttaaaacaaaagaaattgaacttcaagtgacagagcgtttcaaagatagagttgtagatgaaggttatagtcccagctatggtgcaagaccactacgcagggcaattatgaggttgttagaggactgtatggctgaaaagatgctatctggcgagatcaaagagggtgattcggctatagttgatgtggacctggaagggaatgtgaccgtcttgaatgggcgtagtggcacaactgctccatcaaccacaccagtagctgtctaggaaaacaggtcatacatctgactgactgggccaaatattggtggaagtgagtaatttcttttgaagtgccatgttaggccttctgtcctagttttactgtaatttcattggccacttagatgtgctatttataggatcatgttttgagtgacacataactcacaagttatagtatgttcttcaatgaataatatgacataccgtgggttacacctgccctcccttggtgtttatgagcatatatatctcgataagagagtatttctcgtgtccttggtagatttctcgaagtaagactagcaattgcagctacacaacaatttagttgtactctcctattagtgttgtgataagtctgtgtcaggacgaaagcaactaatatgagaatttgcatgctgaagtgtttttcttatgctttaagatgaacaaatcattgtaacttgatcactatattatgtttttgtattgataaacttt

SEQ ID NO: 3213 - DNA, 2913 bp, Papaver somniferum
catctttgacagtaggaggttttaatggacttcgaggaactaacgctatagataaattggtattttctggccatgattttcattctaaggtagcactatctatagctgcaccttgcggaaggggtagtcggtgtgttgcaagagctatgtttgagagattcacagagaaggctattaaagttatcatgctagcacaagaggaagcgagacggttgggtcataattttgttggtactgagcagatattgttagggcttataggtgaaggtactggtattgctgcaaaggttcttaaatctatgggaattaatcttaaggatgctcgtgtggaagtagaaaagatcattgggagaggtagtgggtttgttgctgtcgagataccatttactcctcgtgcaaagcgagttttggaactttcactagaagaagcacgccaacttggacataactatattggctctgagcatttgcttcttggtttacttcgtgagggtgaaggtgtggctgcccgtgtacttgaaaaccttggggccgacccaaacaacatccgcacgcaggttatccggatggttggtgaaagtactgaagctgtaggtgctggcgttggaggaggtagcaccaacagtaagatgcctacactcgaggagtatgggaccaatctaacaaaactggccgaggagggcaaattagatcctgttgttggaagggcagcacaaatagagcgtgtaacccaaattttgggcagacgtacgaagaataaacccttgcttgatcggagaacctggtgtgggtaaaactgcaatcgctgaagggcttgctcagagaattgccagtggtgatgtgccagaacgatgagggaaagaaggttattaccttggatatgggtctccttgtagctggtacaaagtatcgtggagagttcgaagaacgattaaagaagttaatggaagagattaagcaaagtgacgagattatattgtttatagatgaagtacatactttaattggagctggtgcagctgaaggtgcaatcgatgcagcaaacattttgaaaccagctcttgcaagaggtgaactacagtgtattggtgctacaacactggatgaatatagaaagcatatcgagaaggacccagctttagaaagacgatttcagccagtaaaagtgccggaacccactgttgacgagtctatccagattctaaaaggtcttcgtgaaagatatgaaattcatcacaagcttcgttatacagatgaagccttggaagctgcagcacgattgtcataccagtacatcagtgaccgtttcctccctgacaaagcgattgacttgattgatgaagctggttctcgagttcgacttcgtaatgctcagctgcccgaggaagccagagaactcgagaaagagctcaggcaaataacaaaaagagaagaaatgaggcagttcgtggccaagactttgaaaaggctggagagctgagagacagagagatggacttgagggcccagatcacaaatgttgttgacaagggtaaagagctaagcaaggcagagagtgagtcaggtgatacaggacccgttgttaccgaagtcgatattcagcacattgttgcttcttggactggaatcccagtcgacaagtctcaagtgacgaatccgataagctccttaagatggaagacacactccacacaagggtcatcgggcaagatgaagctgttaaagctatcagtcgtgcaattcgtcgtgcacgtgttggacttaaaacccatcgtcctattgccagcttcatattctctggacctactggtgttggaaagtcagtaattggcaaagcactggcttcttactattttgggtctgaggaggctatgattcgtcttgatatgagtgagttcatggagaggcatactgtctcgaagcttattggatcaccaccaggttatgttgggtacactgagggtggtcagctgacagaagctgttcgccgtagaccttacacagtggttctttttgatgagatagagaaggctcaccctgatgtcttcaacatgatgcttcagattctggaagatgggcgattaactgatagcaagggtagaaccgtagattttaagaacacacttctcataatgacttctaatgtcggaagcaatgtgattgagaagggaggtaggagaattggttttgatctagactatgatgagaaagacagcagctacaacaggatcaagagtctcgtgcaagaggagctgaaacagtatttcagaccagaattcttgaatagattagatgagatgattgttttcagacagctgacaaagttggaagtcaaggagattgcagacataatgctcaaggaggtgtttgaaagactgcgtaagaaggaaatagagcttcaagtaactgaaaggtttagagacagagtggttgatgaaggatacaacccaagctatggtgcgaggccgctgaggagagcaattatgagacttttggaggatagcatggcagagaagatgctgggaggagagattaaagagggagattcagtcatcgtagacgtagatggtgatggaaatgtcacagtgctcaatggtacatcaccacagctggtgtaaaaacatgactaccagaagaatgatatattgtacttctagtttggtagttccaggtctcctcttcatatttttttcttcttttttatctaaaagataaacttggtgttttgatagactcagttttaagattgtagttcattcaccaatgtcaatgtatgtctaatgccaatttcttagctttacgggatagctgattgatactctaatcagttttcatgttcatgaacaatgagagagggtctactgaaatataaccggaaaagggcttattgtaaactatcaatgaagagctgta

SEQ ID NO: 3214 - DNA, 3046 bp, Secale cereale
gagcaattctcttctctggttgcttgttgggcacccccaaccaagcgactgttctcttctcccttcttatctccttctccttggaggagaaacaaacagggccgcgctcttctttctccctctctcggtctctcgtcgcaggtttgggacaacttacttttgaccatggcagggaccttagtcctgccggttgcccttgagacaacttttgcaggcagtacaggcgctcggcactgcaagtctcatggaaccaggaggactccctcaatgttggcaatgtcattgaaccgtcctgtaaggatggcagcatttgtcggtctgagatcagtacatagcttctcagccatgcgctcgtccaacttcaggtcaaccattgcatcttacagattctctagacagggaaggcgtgcttcttttgtaaccagagcgatgttcgagaggtttactgagaaagctataaaggtcataatgcttgcgcaagaggaagcgaggcgcctgggccacaattttgtcggaaccgagcaagttctattgggtctggttggagaaggcactggtattgcggcaaaggtgcttaagtccatgggtataaatctgaaggatgcccgcgtggaagtggagaagatcattgggaggggcaacggttttgttgctgtcgaaataccattcacaccacgtgcaaaacgtgttttagagctttcattggaggaagctcgccagctaggacacaactatattgggtccgagcacttgcttcttggattgcttcgtgagggggaaggggtggcagctcgcgtgcttgagtctcttggtgctgaccccagcaatattcgtacccaggttgtccggatgattggtgagacaacagaagctgttggtgctggagttgggggaggagcagtggtaacaagatgccgacacttgaggagtatgggactaatttaacaaaattagccgaggagggaaagctagatcctgttgttgggagggaaccacagattgaacgtgtcgtacaaattttgggcagaagaaccaagaacaatccctgcttgattggagaacctggtgttgggaaaacagctattgcagaagggcttgctcaacgcatttctagtggcgatgtgcctgagacgatagaggggaagaaggtcattacccttgatatgggacttcttgttgctggtacaaaataccgtggagaatttgaagaacggttgaagaaactgatggaagaaatcaaacagagcgatgagataattctcttcatcgatgaagttcacaccctcataggagcaggagccgccgaaggtgctattgatgctgctaatattttgaagccagcattagcaagaggagaactacagtgtattggagccaccacacttgatgaatacaggaagcatgttgagaaagacccagcattagaaagacgtttccagccagtaaaggtaccagaaccatcagttgatgaaaccatagaaattctcagagggctccgagagcgatacgagatccatcataaacttcgttacactgatgattctttgattgcggctgctaagctatcttatcaatatatcagtgatcgtttcctcccagataaagcaattgatttgattgatgaagcaggttcacgtgttaggcttcgacatgcccaggttcctgaggaagccagagagcttgacaaggagcttaagcaaataacgaaagataaaaatgaagctgtccgtggccaggattttgagaaggctggagagttgcgagatcgtgaaatggaattgaaggcccagataacagccctgattgacaagagcaaggagatgaacaaagcagagactgaatccggagagaccgggccgatggtgcatgaatcagatatccagcacattgtgtcatcatggactggtattccagtggagaaagtctcgactgacgaatctgataaacttcttaagatggaagagacattgcataagcgtgtcatcggccaagatgaggctgtgaaagcaataagtcggtccgttcgccgtgctcgtgtgggcctcaagagccccaacagaccaatcgcgagcttcatttttgcaggtcccactggtgttgggaaatcagagcttgcaaagactctggcatcatattacttcggctctgaagaagccatgatccggctggatatgagtgagttcatggagaggcacactgtgtccaagttgatcggttcaccaccaggctatgtgggatacactgaaggtgggcagctgacggaggcggttcgacggcggccatacagcgttgtgctttttgacgagattgagaaggcgcatccggatgtgttcaacatgatgctccagatcctggaagatggaaggttaactgacagcaaggggagaacagtggacttcaagaacacgcttctgataatgacatcaaatgtggggagcagcgtgattgagaagggagggaggaagatcgggttcgacctcgactccgacgagaaggacagcagctatggcaggatcaagagcttggtgatcgaggagatgaagcagtacttccgaccggagtttctcaaccgtctcgacgagatgatcgtcttcagacagctgaccaagctggaagtcaaagagatcgcggacataatgctgcaggaggttttcacgaggctgaagaccaaggacatcaacctacaggtgacggagaagttcaaggagcgggtcgtggacgaagggtacaaccctagctacggagcgcggccgctgaggagggcgatcatgaggctccttagaggacagccgtcgcggagaagtagtttggggcgggggagggtcgaagggagggcgactctgtgatcgttgatgtggaccagaggggaaaggtcattgtgctgaatggcgagagcggactgccggagcttccaaccccggcggtcgctgtatagttgttggtatagatggattgttaagcatacaatacagcgtttgcatttcattccagcacatatctcttcataggagcagtcaggtgtatataattgtataactgtataaaa

SEQ ID NO: 3215 - DNA, 2966 bp, Flaveria ramosissima
cgtcaggagcaacggttgttctatcgtctcctatctgttagaattctctggttgtaatcatggcgaggggctttagtgacaatctaccagcctttccttctgctagttacagtagaaagacaaagtccgttacaagcgttctggtaacacgaaaagagacagtcaagatgatgtgtagcttacaagctgctcctatggagggtgaggtactttttctggtttggcggggagccaatgtctttagaacacgttaggttaaaagaggccaggtacttcactacaaaagttgcagctgccacctcggttcggaaagcaaagcctagtagagttgtaccaaaggctatgtttgaacgcttcactgagaaggctattaaagtcattatgcttgcacaagaggaagcaagaaggcttggccacaattttgtgggtacagagcagattttattaggtcttattggtgagggcactggcattgcagcaaaggttctgaagtcaatgggaattaatttaaaagatgcacgtgttgaggtggaaaagattatcggaaggggtagtggatttgttgctgtagagattccatttactcctcgtgccaaacgtgtactggaactctcactagaggaggcccggcaacttggtcataattatattggatcagagcatttgcttcttggtttgcttcgagaaggtgaaggtgtagcagctcgtgttcttgagaatttaggtgcagacccaaataacattcgcacacaggtgatcaggatggttggcgagagtgcagaagccgtgggcgctggagttggtggcgggacctctggtaacaagatgccaacattggaggaatatggtaccaacttaactaagctagcagaggagggtaagctggatcctgttgttggaagacagccacaaattgaaagagttactcaaattcttggacgacgtacaaaaaacaatccttgtttaattggagagcctggtgttgggaagactgctattgcagaaggccttgctcaaagaattgctaatggtgatgtcccagaaacaattgaggggaagaaagtgataactttggatatgggtctccttgttgctggcacaaaataccgtggggagtttgaagaaagactaaagaagctgatggaggaaatcaagcaaagtgatgaaatcattctctttattgatgaggtccatacattaattggagcaggagcagcagagggagctattgatgctgctaacatcttgaaacctgctcttgctcgtggtgaattacagtgtattggggctacaacccttgatgagtaccgaaagcacattgagaaggacccagcactggagagacggttccagcctgtaaaggtgcccgagcccacagttgatgaaaccatacagattttaaaggggcttcgagaacgatatgaaattcaccacaaactccgctacacagatgatgcactggttgctgctgcccagctgtcatatcagtacataagtgaccgttttctgcctgataaggctattgatctaatcgatgaagctggttctcgtgttagacttcgtcatgcacaactcccagaagaagctagagagcttgagaaagaacttaggcaattaacaaaagaaaagaacgaagcagtccgtggccaagacttcgaaaaggctggggagttacgtgatcgggaaatggatcttaaaactcagatatccgctcttgtggacaagaacaaggagatgagcaaagccgagactgaggcgggagaggagggccccactgtaactgaagcagacattcagcatattgtctcatcatggactggcataccagttgaaaaagtgtctacagatgaatcagaccgcctcctcaaaatggaagaaacactccacacaagaatcattggtcaagatgaagcggtcaaagccattagccgtgccatccgccgtgctcgtgttggactcaaaaaccccaaccgtcccatcgccagtttcatcttttcgggacccactggtgttggtaaatctgaactcgcgaaagctttagccgcttactacttcggctctgaagaagccatgatccggctggacatgagtgagtttatggagcgacacactgtctcaaagctcattggttcacctcctggttacgttggctacacagaaggcggtcagttaacagaggcggtccgccgccgcccttacaccgtcgtcctatttgacgaaatcgaaaaagctcaccctgacgtcttcaacatgatgcttcaaatccttgaagatggaaggttgaccgacagcaaaggacgtaccgttgacttcaagaacacacttctaatcatgacctcgaacgtgggtagcagtgtaatcgaaaaaggtggaaggagaatcgggtttgacctcgattatgacgagaaagacagcagctacaacagaatcaagagcctggtgactgaagaactaaaacaatatttcaggcccgaattcttgaacagactagacgagatgatcgtgttcagacagttgaccaaactggaagtcaaagagatcgctgatattatgttgaaggaagttttcgagaggctaaaaggtaaagaaattgaacttcaagtaaccgagaggtttagagaccgtgttgtggaggaaggttacaaccctagctatggtgcaaggccattaagacgggctatcatgcggctattggaagacagcatggcggaaaagatgcttgcacgcgatatcaaggagggtgattctgtaattgttgatgtcgactccgatggtaacgtcaccgtcctcaatggtagcagtggtgctccaccagaggccttgccggaacccgtctccgtgtagacaaaggctagtctcttatctctgaactaaaatcatgtattatgttgttttatactgtggtgcttttccttaaatttaataacatataacagggtcaatagatgttgcagtattttttattt

SEQ ID NO: 3216 - DNA, 3346 bp, Physcomitrella patens
gcttcttctcctcatgcttcttccgattctgcttctccttctatttcccaccctctcccccgtgcatgcatggtcttgcacaaactctcctctcgtttggaagtatccacccccgtcgcaactgcgggagcttccgatcgaccgggattacatggtgtacaggtcagcgtagttttacagtgtaattgtgctgcaatcgaaattcttttaatcggaaacaggaaattttacttaagggcgacgaacatcagaaaatccctgagaacatcaagatggcggctgtgacacagtccttgatggttccggcagtgggagcatcccatggccaaattcatagtagtaacaaatctcaaacgccagcaagggtgggtcctctaggcaggaaaaaagcgcagattaagaattcttcagtgcccagcacaaggattcagtcgttttctggaatgcgtaaggcttcagtaattgatgctttgactgtgaaacaaggacgggatttcaaatccactgtggcagctgcgcttgcggtggataatcaagaagggacctccaagggtgtcattacggcaatgttcgaacgatttaccgagaaggccatcaaggttatcatgttggctcaggaagaagccaggcgtttagggcacaactttgttggtacggagcagattctcctaggccttatcggagaggggactggaattgctgctaaggtgttgaagtccatgggtgtaaaccttaaggaggctcgtgtggaggtagagaagatcattggccgtggtagtggttttgtggctgttgagattccgttcacacccagagctaagcgagtccttgagctgtcacttgaggaagctaggcagctcggtcacaattatataggaaccgagcatctcctcctgggtttgttgcgggagggtgaaggtgttgccgctcgtgtccttgaaaacctcggagcagaccctagcaatatacggactcaagtaattcggatggttggcgagagtactgagtctgtaggtgctggagtgggtggtggtagcagtggcaataagatgcctactttggaggaatacggtacaaatttaacgaagcttgctgaagaggggaagttggaccctgttgttggaagacagccgcaaattgagcgtgtgactcaaattttgggccgaaggacaaagaataacccttgccttattggagagcctggagttggaaaaactgcaattgctgaaggattggctcaacgtattgcaactggcgatgtgcctgaaaccattgagggcaagaaagttatcaccctggatatgggattgttggtagctggtacaaagtacaggggagaatttgaagagaggcttaagaagttgatggaagagatcaaacaagctgacgacattatccttgtgattgatgaagtacatacacttattggtgctggtgctgctgagggtgctattgatgcagctaacatcttgaagcctgccctcgctcgtggtgaactccagtgtatcggagctaccacattggacgaatataggaagcatattgagaaggatgctgcattggaacgtcgattccagcctgtgttggttccagaacccactgttgatgagaccattcaaattcttaagggattgagagagagatatgaaattcatcacaagctgcgttacactgatgaggctttggtagcagcagcacaactttcttatcaatacatcagtgatcggtttttgcctgacaaggccatcgacctgattgatgaagctggatcacgcgtacgtctaaggcacgctcagctacctgaagaagctagagagcttgacaaggagctgcgcggtgtcaccaaggaaaagaatgaagctgttcgtgggcaggatttcgagaaggctggagagttgagggatcgagaaatggagcttaaggctcaaatttctgctattactcagaagggcaaagagcagatgaaggcagagagtgaggctggtgataccggtcctactgttgaagagtcagatattcagcatattgtttcagcctggaccggtatccctgtagagaaagtctctagtgatgagtctgaccgtttgttgaagatggaggatacccttcatcaacgagtcgtcgggcaggacgaagctgtaaaagccatcagccgtgctattcgcagagctcgtgttggacttaagaatccaaaccgtcctatcgcaagttttatcttctctggacccactggtgttggaaaatctgagctagcgaaggctcttgcctcgtactactttggctcggaagaagctatggttagactcgatatgtctgagtttatggagagacacactgtatctaaacttattggttctccacccggttatgtcgggtacagcgaagggggtcagttaacagaagctgttcgcaggaggccgtacacagttgttcttttcgatgagattgaaaaggcacatcctgatgtgttcaacatgatgcttcagattttggaagacggtcgtctcactgacagcaaaggaagaactgtagattttaagaatacgcttttgattatgacctcgaacgttggaagcagcgtcattgagaagggtggcggtggcattggtttccagttggactacggtgaaaaggattcaagttacaaccgaatcaaaagccttgttaacgaggaattgaagcaatacttcaggccagagttcttgaataggttggatgagattattgttttcaggcagttgactaaacttgaagtgaaggaaattgccgacatcatgttgaaggaggtgttcgagcgattgaagaagaaggaaattgaccttcaggttacggagcggttcagggaccgtgtggtcgatgagggttacagtcctagctatggagctagacctctgagacgagcaatcatgaggttactagaagatagtatggcagagcgtatgcttgcaggagaaattaaagaaggtgattcagccattattgatgtggatagtgaaggaggcgtgactgtgttaaatggtacaacaggatcatcttcaagtacagctatcgaggctcctgcaggcatcgcctaatgatccttgtaaaattgagcctctaattaggtgacattaccatcgtcccaccaggcctaggtattgcatagactcttgagttcctgatgtaaacggtacctgaagtggacttgtattattacgataatgtttgtaaatgtattccttcaacttttatatttcccgtgttttcttttgctggtgatgatacacgagacatgtgaattttaccagggattgttcgtaagctaaggcactcttcttctttacgagaagagtagacctgttaagga

SEQ ID NO: 3217 - DNA, 2639 bp, Flaveria ramosissima
aggccaggatttccactcaaaagttgcagctgccacctcggttcggaaagcaaagcctagtagaattgtaccaaaggctatgtttgaacgcttcactgagaaggctattaaagtcattatgcttgcacaagaggaagcgagaaggcttggccacaattttgttggtacagagcagattttattaggtcttattggtgagggcactggcattgcagcaaaggttctgaagtcaatgggaattaatttaaaagatgcacgtgttgaggtggaaaagattatcggaaggggtagtggatttgttgctgtagagattccatttactcctcgtgccaaacgtgtactggaactctcactagaggaggctcggcaacttggtcataattatattggatcagagcatttgcttctcggtttgcttcgagaaggtgaaggtgtagcagctcgtgttcttgagaatttaggtgcagacccaaataacattcgcacacaggtgatcaggatggttggcgagagtgcagaagccgtgggcgctggagttggtggcgggacctctggtaacaagatgccaacattggaggaatatggtaccaacttaacaaagctagcagaggagggtaagctggatcctgttgttggaagacagccacaaattgaaagagttactcaaattcttggacggcgtacaaaaaacaatccttgtttaattggagagcctggtgtcggaaagactgctattgcagaaggccttgctcaaagaattgctaatggcgatgtcccagaaacaattgaggggaagaaagtgataactttggatatgggtctccttgttgctggcacaaagtaccgtggggagtttgaagaaagactaaagaagctgatggaggaaatcaagcaaagtgatgaaatcattctctttattgatgaggtccatacattaattggagcaggagcagcagagggagctattgatgctgcaaacatcttgaaacctgctcttgctcgtggtgaattacagtgtattggggctacaacccttgatgaataccgaaagcacattgagaaggacccagcactggagagacggttccagcctgtaaaggtgcccgagcccacagttgatgaaaccatacagatttaaagggcttcgagaacgatatgaaattcaccacaaactccgctacacagatgatgcactggttgctgctgcccagctgtcatatcagtacataagtgaccgttttctgcctgataaggctattgatctaatcgatgaagctggttctcgtgttagacttcgtcatgcacaactcccagaagaagctagagagcttgagaaagaacttaggcaattaacaaaagaaaagaacgaagcagtccgtggccaagacttcgaaaaggcgtgggagttacgtgatcgggaaatggatcttaaaactcagatatctgctcttgtggacaagaacaaggagatgagcaaagccgagactgaggcgggagaggagggccccactgtaactgaagcagacattcagcatattgtctcatcatggactggcataccagttgaaaaagtgtctacagatgaatcagaccgcctcctcaaaatggaagaaacactccacacaagaatcattggtcaagatgaagcggtcaaagccattagccgtgccatccgccgtgctcgtgtcggactcaaaaaccccaaccgtcccatcgccagtttcatcttctcgggacccactggtgttggtaaatctgaactcgcgaaagctttagccgcttactacttcggctctgaagaagccatgatccggctggacatgagtgagtttatggagcgacacactgtctcaaagctcattggttcacctcctggttacgttggctacacagaaggcggtcagttaacagaggcggtccgccgccgcccttacaccgtcgtcctattcgacgaaatcgaaaaagctcaccccgacgtcttcaacatgatgcttcaaatccttgaagatggaaggttgaccgacagcaaaggacgtaccgttgacttcaagaacacacttctaatcatgacctcgaatgtgggtagcagtgtaatcgaaaaaggtggaaggagaatcgggtttgacctcgatatgacgagaaagacagcagctacaacagaatcaagagcctggtgactgaagaactaaaacaatatttcaggcccgaattcttgaacagattagacgagatgatccgtgttcagacagttgaccaaacttggaagtcaaagagattgcttgatattaagtgttgaaggaagttttcgaagaggctaaaaggtaaagaaattgaacttcaagtaactgagaggtttagtagaccggtgttagtggaggaaggttacaaccccagctatggtgcaaggccattaagacgggcaatcatgcggctgttggaagacagcatggcggaaaagatgcttgcacgcgatatcaaggagggtgattctgtaattgttgatgtagactccgatggtaacgtcaccgtcctcaatggtagcagtggtgctccgccagaggcgttgccggaacctgtctccgtgtagacaaaggctagtctcttatctctgaactcaaatcatgtattatgttgtttta

SEQ ID NO: 3218 - DNA, 3485 bp, Sorghum bicolor
aaaataaataaagaaggaaaatactaggaaacagacaaaaggcagaatcaggaggctatacgaaaggaggagaaagagagaacaatcacggagtcctctttcttgttgggcactcgggcagcgcggcccccttatctccagggaccaggggaggacgcacaccaacgcaccgcccttccttccctcctcctcctcctcctcctctctctctcctcggaaggttaagggacggtatttctgaccatggcagggaccttactccagtcagttgccctcggaacaacattcgggggtcgcataagcacccagcgttggaggtcccatggcgccaggaggcctgcctctatgttggcaatgtcacttagccgccccgtcaagatgtcagcatttgtgggtctaagatcagtgcatagcttctcggtcacacccacggtgtccaattccaggtcgacagttgcatcttacaggtcatctcgacggacaagacgttctcgttttgttactcgggcaatgtttgagaggttcacggagaaagctattaaggtcatcatgcttgcgcaagaggaagcaagacgcctggggcacaactttgttggaactgagcagattctcttgggtctgattggagagggcactggtattgcagcaaaggtgctcaagtccatgggaataaatctcaaggatgcacgtgtggaggtggaaaagattattggccgtggcaatggttttgttgctgttgaaataccattcacaccacgtgcgaaacgtgttttggagctctccttggaggaagctcgccaattaggacataattatattggatctgagcacctgcttcttggactgcttcgtgagggtgaaggtgtggcggctcgtgttcttgagagtcttggagctgatcccagcaatatccgtacacaggttattcgaatgattggtgagaccacagaagctgttggtgctggagttggagggggcagcagtggtaataagatgccaactcttgaggagtatggaactaatttaacaaaattagcagaggagggaaaattagatcctgttgttggaaggcagccacagattgagcgtgtggtacaaattttaggcagacgaactaagaacaatccctgcttgattggagagcctggtgttggaaagactgcaattgctgaaggacttgctcaacgcatttctacaggcgatgtacctgaaacaatagaagggaaaaaggtcattacccttgacatgggacttcttgttgctggcacaaaataccgtggagaattcgaagaaagattaaagaagctgatggaggaaataaagcaaagtgacgagataatactctttattgatgaagttcacactctgataggagcaggagcagccgaaggtgctatagatgctgctaatatcttgaagcctgcgttggccagaggtgaattacagtgcattggagcgactacacttgatgaatataggaagcacattgagaaagacccagcacttgaacggcggtttcaacctgtgaaagtgccagagccaacagtagatgaaaccattgaaattctcagaggactgagggaacgatatgagatccaccataaacttcgttacactgatgaagctctgattgcagctgcaaagctgtcatatcaatatatcagtgaccgtttcctcccagataaggcaattgacttgattgatgaagcaggttcccgtgttaggctacagcatgcacaggttcctgaggaagcaagagagcttgacaaggagcttaaacaaatcacgaaacagaagaatgaagctgttcgtagccaggatttcgagaaggctggcgaattgcgagaccgtgaaatggaattgaaggcccagataacagccttcattgacaagagcaaggaattgagcaaagcagaggaagagtctggagagacaggacctatggtcaatgaagcagatatccagcacatagtatcgtcatggactggcatccctgtggagaaggtttccagcgatgagtcagataagcttcttaagatggaagagactttgcacacgcgtgtcattggccaagatgaggctgtggtagccattagtcgctccatccgccgtgctcgtgtgggtctcaagaaccccaacaggccaattgcaagctttatttttgcaggtcccaccggcgttgggaagtcagagcttgcaaaggctcttgcagcctattactttggctctgaggaggctatgatccggcttgatatgagtgaattcatggagaggcacacagtatccaagctgattggttcacctccaggatatgtaggatacactgagggtggccagctgacagaggcagttcgacggcggccatacacagttgtgctctttgatgagattgagaaggcacacccggatgtcttcaacatgatgcttcagattttggaagatgggagattgactgacagcaagggaaggactgtggacttcaagaacacactactgatcatgacctcaaatgtagggagcagcgtcatcgagaagggtgggcggaagatcggatttgaccttgactctgatgagaaggacagcagctacagcaggatcaagagcctggtcatcgaggagatgaagcagtacttccgacctgagttcctcaaccgtctcgacgagatgatcgtgttcaggcagctgaccaagctcgaggtcaaggagatcgcggagatcatgctcaaggaggtctttgacaggttgaaggccaaggacataaatcttcaagtgaccgagaagttcaaggagcgggtggtggacgaaggctacaacccaagctacggtgcacgcccgctgaggcgagccatcatgaggctgctggaggacagccttgctgagaagatgctcgctggggaggtaaaggagggcgactctgccatagtggatgtggactcggaagggaaggttgttgtgctcaatggccagggcggcataccggagctctcaactccggcgatcaccgtttagctcgtacatgacagaagatgacaaaatagaagagtttttgtttcaaacacattatcatatatagttagcatataactgtgtatatgtagtggtatagtcaaaggggaaatcgttgctgcctttgaattccttttcaaattcaagtattcttttgtctcaagttaatctgcctggttattgaggtattgtgtacaaagtgatgtgaaaagctcttgtctgtgtacaggcatacataaagatacctaaagtagcacgtaggcagatacatagcacgtaggcatcattccaatagctagaaatatatattcgaaataacgattatcttaattatagagtttcttctcaaatcgtatctttttttaacaaaccttgttaaattaaaatatagttattatatagaatgcattgtattttaatacaaattttaaaagttataatgtactctattttagtgtggagggagtaggcccgttggt

SEQ ID NO: 3219 - DNA, 3135 bp, Lactuca sativa
ctcgttttacaccgggtggaattgcgtgtcgaaataatcaaatatgcgagatagtttggagaagaagatatagacccacctcctgttatcatccacatttcttcaatccggcggatctccagcagccgattatcagaatcttcgcttccaaacgaaacacgaatttctcctatctcgttcaagtgattttggcttaatagtgttgcaatcatggcgggggttgtagtgcaatctacgagttttccttcagtttccagtgaaaacaagatccattcaaagagatctggaaatgcaaaaagaccagtcaaaatgatgtgtagcttacaatctcctccaatgagggtgaggactttctctggtttacctggagtcaacgcattagacaacatggtcaacagaagccatgatttccactcaaaggtaaaggtagcagtagccacctctattaggagaggaaaaggaaaggctccaagaatcgtgccaaaggccatgtttgaacgctttacagaaaaagctatcaaagttattatgcttgcacaagaggaggcaagacgccttggtcataattttgtgggcacagagcagattttattaggtcttattggtgagggcactggtatagcagcaaaggttttgaagtcaatgggaattaatttaaaagatgcacgtgctgaagtagaaaaaattattggtagaggtagtggatttgttgctgttgagattccatttacacctcgtgcaaagcgtgttcttgaactatcactagaggaagcccgacaactaggtcataattatattggatcagagcacttgcttcttggtttgcttcgcgagggtgaaggtgtagcagctcgtgttcttgagaatttaggtgctgacccaaataacattcgcacacaggtaagtgtggttagatttttttttcatgtgccgaaaatacccttgtcttatgtgcgatgtttatacttgttgaatgggtgattagaatggttggggagagtgcagaagctgtgggtgctggagttggtggtgggagctctggaaacaagatgccaactctagaggaatatggtaccaatttgacaaagctagcagaagagggtaaattggatcctgttgttggaaggcagccacaaattgaaagagttactcaaattctgggaagacgtacaaaaaacaatccctgcctcattggagaacctggtgttggaaaaactgctattgcagaaggtcttgcccaaagaattgcaaatggggatgttccagaaacaatcgaggggaagaaagtgattactctagacatgggtctacttgttgctgggacaaagtatcgtggggagtttgaggagagattgaagaagctgatggaagaaatcaaacaaagtgatgaaattattctatttattgatgaggtccatactttaattggagcaggagctgcagagggggctattgatgctgctaacatcttgaagccagctcttgctagaggtgaattgcagtgtattggtgctacaacccttgatgaataccgaaaacacattgagaaggaccctgcattagagagacgattccagcccgtaaaagtgcctgagccaatagtcgatgagacaatacagattttaaaagggcttcgagaacaatatgagatccaccacaagctccgatacactgatgaagcgttagtagctgctgcccacttgtcatatcagtacataagcgaccgctttcttcccgataaagctatcgatttaatcgatgaagctggttcacgtgtccgacttcgtcatgcacaacttccagaagaagcaagagagctggagaaagaacttagacaaataacaaaagagaaaaacgaagctgtccgtggtcaagacttcgaaaaggctggcgagttacgcgatcgagaaatggaccttaagacacagatatctgctcttgtggataaaaacaaagagatgagcaaggtggagaccgaggcgggagaggagggccccaccgtaaccgaagcagacatccaacacattgtctcatcatggacagggatcccggtcgagaaagtctcgaccgacgaatccgaccgtctcctcaaaatggaagagacgcttcacacacgaatcatcggtcaagacgaagcggtcaaagccattagccgcgccatccgccgcgcccgtgtcggtctaaaaaatcccaaccgccccattgcgagtttcatcttctcgggtcccaccggtgtcgggaaatccgaactcgcgaaagcgttagccgcttactacttcggctcagaagaagccatgattcgcctcgacatgagtgagttcatggaacgccacaccgtctcaaagctcattggctcccctcccggttacgtcggctacaccgaaggcggtcagctgaccgaagcggtccggcgccgcccctacactgttgtcctgttcgacgaaatcgaaaaagctcatcccgacgtcttcaacatgatgcttcaaatccttgaagacggaaggttgaccgatagtaaaggaagaacggttgactttaagaacacgcttctaatcatgacatcaaacgttggaagtagtgtaatcgagaaaggtgggcggaggatcgggtttgaccttgactatgacgaaaaggacagcagttacaacagaatcaagagtttagtcacggaggaactaaaacagtatttccggccggaattcttgaacagattagacgaaatgattgtgttcaggcagttgactaaactcgaggtcaaagagattgctgatataatgttgaaggaagtttttgaaaggttgaagggtaaagacattgagcttcaagtgactgagaggtttagggatcgggttgtggaggaagggtataaccctagctatggtgcgagaccgctgagacgcgcaatcatgaggcttttagaagacagcatggcggaaaagatgcttgcccgtgatatcaaggagggcgattccgtaattgttgatgttgattctgacggtaatgttactgttcttaatggtagcagtggagctccactggaggcattgcctgagccaatctcggtgtgaacgtacaaggctggccatctttaaacataaatcatatatgttgttggaactctgatgttttataatt

SEQ ID NO: 3220 - DNA, 3186 bp, Lotus japonicus
acgaagaccgcactttatcttcttgttctggttactctctccttcctcctcgccggaccgtacaatcaccttcaccctcttttcggagagggccatatccacccacccctctctctctctctctctctattctttcttctctctcaattttttagtaccaagtattccagggtttctgcgagcaattcaggaatcatgtctagggttttggctcagtcaattactatccctggcttagtgtgtgggcgaagtcatggtcataataacaggtccacaatgtcgagaagatctctaaaaatgatgtctaccttacaagcacctgcgttaagaatgtcaggattctcaggactgcgtacttataataatttggatacaatgttgagacctggactagattttcgttctaaggtgtttggtgtaactacctcccgaaaggcaagggctagcagatgcatacctaaagccatgtttgagcgtttcacggagaaagcaatcaaggttattatgctttcccaggaggaggcgagacggctgggtcataattttgttggaacagaacagatcctgttgggtcttgttggtgaaggcactggtattgctgctagggttttgaaggctatggggattagccttaaagatgcacgcgtggaagtggaaaagaccattggaaggggtagtggatttgttgctgttgagattccatttactcctcgtgcaaagcgtgttttggaactctcactggaggaggctcgtcagcttggtcacaactatattgggtctgagcacttgcttttgggtcttcttcgagagggtgagggtgtagcagcacgtgttcttcaagacctgggtgctgatcctaacaatattcgcgctcaggttattcgcatggttggtgagagtaacaatgaaacggctggggttgctgttggccgcggaggtagtagcaataagatgccaactttggaggagtatggaaccaatttgaccaagctagcaaatgagggaaaattggaccctgttgtgggtaggcagcaacaaattgaacgtgtcattcaaattttgggtcgtcgtaccaaaaataatccttgtcttgtcggcgagcctggtgttggaaagacagctattgccgaaggtcttgctcaacggattgcaactggtgatgtccctgaaaccatagagggaaaggaggtaataacccttgatatgggtctacttgttgctggaactaaatatcgtggagaatttgaggagaggttgaagaagctaatggaggaaatcaaacaaaacgataatataatacttttcattgatgaagttcacacactaattggagctggagcagctgaaggggcgattgatgctgcaaacatattaaaacccgctcttgccagaggggaactacagtgtataggagccacaacactggatgaatacaggaagcacattgaaaaagatccagctttggaaaggcgattccagccagttagagtgccggagccaaccgtggatgaatccatacaaatactgagaggacttagagaacgctatgagaggcaccacaagctcagttatacagatgatgctcttgtagctgcttcacagctgtcacatcaatatatcagtgatcggtttttgcctgacaaagctatcgatttgattgatgaagctggttcccgagtccgtcttcgacatgcacagttacctgaagaagcaagagagcttgacaaggaggtcaggcagattgtgaaggagaaagatgaagctgttcgcaaccaagactttgaaaaggctggagagctgcgagacagagaaatggatcttaagacacagatctcagcacttatagaaaaaggcaaggagatgagtaaggcagagagtgaggccgatggtgcaggtccagttgtgactgaagttgacatacaacatattgtggcctcctggactggtgttcctgttgacaaagtatcgtcagatgaatctgatcgccttctcaagatggaagagacattacacaagcgagttattggtcaggatgaagcagtaaaagccatttgcagggctatccgtcgagcccgggttggactgaagaaccctaatcgtccaattgcaagctttatcttttctgggccaactggtgtggggaagtccgagttggccaaaacactggcttcatactactttggttctgaagaggccatgattcggcttgacatgagtgaatttatggaaaggcacacagtgtccaagctcatcggttcacctcctggatatgttggttacactgagggtggtcaactgactgaagcagtccgacgccgtccctacactgttgtactctttgatgagattgagaaagcccatcctgatgtattcaacatgatgcttcagatcctggaagatggaaggctaacagacagtaaggggagaactgtggacttcaagaacacccttcttataatgacatcgaacgttggaagcagcgtgattgagaaaggaggacgtaaaataggatttgaccttgattatgatgagaaggacagctcttataatcgaatcaagagcttggtgactgaggagctaaagcagtactttaggcctgagtttttgaataggttggacgaaatgattgttttcaggcaactcacaaagctggaggtgaaggagatagctgatataatgctgaaggaggtatttgacagactgaaaaccaaagaaattgatctttcagtgacagagagatttagggatagagtggttgaagaaggttatgatcctagttatggggcaaggcctctaagacgagccataatgcggctcttggaggacagcatggcagagaagatgcttgctggagagattaaagagggtgactctgttataattgatgctgattctgatggtaaggtgattgtgctcaatggtagtagtggtgcaccagaatcactgccagaggctcttcctgtgtaacatggtggccttgctaacttgtttctagttttttaaatttatacactcatctgttttagctgtcaacttttttaattgaactggtcaggtttgcccaatgtagccaacatagcaagccaatcggttggaatgaatgatacacaaggctttgtttgccataccttggataggtagcatcaatgaacaattttaatgaaagcacattaaaaaaatttcact

SEQ ID NO: 3221 - DNA, 2847 bp, Cucumis melo
tctggacttagagggttgaattctttggataatatgtttagacctgggcaagattttcattccaagatggctattgcaatctcttcaaggcgagtagggagggctagcagatgtgttccaagagcaatgtttgagcgatttactgaaaaggcaattaaagtaattatgcttgctcaggaggaagcgaggcgacttggtcacaattttgttggtacggagcagatccttttgggtcttattggggaaggcactggtattgctgctaaggtccttaaatctatgggaattaatcttaaagatgcgcgtgtggaggtggagaagataattggtcggggtggtggttttgttgctgtagaaattccattcactcctcgtgcaaagcgtgttttggaactctctctcgaagaagctcgccaacttggccacaattatattggatcggagcacttgcttctgggactacttcgtgaaggggagggtgttgcagctcgcgttcttgagaatttaggtgccgaccccgcaaacatacggactcaggttattagaatggtgggtgagagcacagaggctgttggtgctggtgttggaggagggagcagtgggaacaagatgccgaccctggaagagtatgggacaaacttaactaagctggcagaagagggtaaactagatcccgttgttggtaggcagcagcaaatagaacgtgtaacccaaattcttggtcgtagaacaaaaaataacccttgcctcattggtgaacctggtgttgggaaaactgccattgccgaaggtctggctcaaaggattgctaacggtgatgttcctgaaacaatagaagggaagaaggttataacgttggatatgggccttcttgtagctggcacaaaatatcgtggggagtttgaagaaagactaaagaaactgatggaggaaataaaacaaagtgatgaaataattctatttattgatgaggtgcatacattaattggagcaggggctgcagaaggagctattgatgcagcaaacatattaaaacctgcccttgcaaggggtgaactgcagtgcattggtgcgacaaccttggacgaatacagaaaacatatcgagaaggatccagccctagaacggcgatttcagccggttaaagtgccagaaccatctgtggatgaaacgatacagattttgaagggccttagggagcgctatgaaatccaccacaaacttcgttacacagatgaagcaatagaagctgctgcacagctgtcatatcagtatattagtgatcgattcttgcctgacaaggcaatcgacttgattgatgaagcagggtccagggttcgcctccgtcatgctcagctacctgaggaagctaaggaggttgagaaagagctcaggcagatcacaaaggagaagaatgatgctgttcggagtcaagattttgagaaggctggagaattgcgtgatagagaaatggaacttaaggctaagatctctgccctaatcgacaagggcaaggagatgagcaaggcagaaagcgaggcaggagatgtaggccctgttgtgaccgaagttgatattcagcatattgtctcctcctggactggcattcctgttgagaaagtatccactgatgaatctgaccgcctgctcaaaatggaagagactcttcataggagggtcattggtcaagatgaagcagttaaagccatcagccgtgccatacgccgagctcgtgttgggctcaagaatcccaatcgtccgattgccagctttatattttctggtccaactggtgtgggtaaatctgagttagcaaaagcattggctgcttactattttggttctgaagaagcaatgattcgtctcgatatgagtgaatttatggaaagacatactgtttccaagctcattggttctccccctgggtatgttggttacacagagggtggtcaattaactgaggctgttcgtcgtcgtccgtacacagtggttctctttgatgagattgaaaaggctcatcctgacgtgttcaacatgatgcttcaaattctagaggatggaaggttgacagatagcaagggcagaacagtagacttcaagaatacacttttgataatgacatcgaatgtgggaagcaatgtaatagagaagggaggtcgcagaatagggttcgacctcgattacgatgagaaggacagtagttataaccgcatcaagatgttagtgacagaggaactgaaacaatacttcaggcctgagtttttgaacaggttggacgaaatgatcgtgttccgtcagctcacaaaactagaggtgaaggagattgcggatataatgctgaaggaggtatttgatagactaaaaggaaaagaaattgatcttcaagttaccgagagattcagagagagggtagttgatgaaggatacaacccaagctatggtgccagaccattgagaagggcaatcatgagacttttggaggacagcatggctgagaagatgctggctagggagatcaaggagggcgactctgttattgtggacgtcgattctgatggaaacgtgacagttctcaacggcagcagtggagctgcacccgagtctttggcagatcctattcctgtgtaacctgtaaaggtacgcgaacattttatttgatagagagaataaacaatcttattgtttaaaagttatgaaatgaaatgtatttccatccttgattcaatggagtgtacattcatttataatctatttctaactagaaaatggatggggcagctggtgtaaaggatcttgaaatgtgtagttgatttgttacttcttttctattcaagttttattttataa

SEQ ID NO: 3222 - DNA, 2703 bp, Phalaenopsis aphrodite
tgagaaggcaattaaagttatcatgcttgcacaggaagaagctagaagattagggcacaatttcgtgggaactgaacagatattgctaggtcttattggcgaaggtacggggattgcggctaaagttctgaaatccatgggtataaatctgaaagatgctcgggtcgaagtggaaaagattattgggagaggcagcgggtttgttgctgttgaaataccatttacgccacgtgcaaaacgggttctagaactctccttggaagaagcccgtcaactaggtcataattacataggttcagagcatttactacttggattgcttcgcgagggtgaaggtgtggcagctcgtgtgttggagagccttggagccgacccaagcaatattcggacacaggttattcggatggttggtgagagcacagaagctgttggtgctggagttggagggggaagcagtgggaataagatgccaacactcgaggagtatggcactaatcttacgaagttggctgaggagggtaagcttgatcctgttgtaggtaggcagcagcaaatagagagggttacccagattttaggtaggcgaacaaagaataacccttgcctaattggagagcctggagttggtaaaacagccattgcagaagggctagctcaacgcattgcaaatggggatgtaccagagacaattgaaggaaagaaggtgatcactcttgacatgggccttcttgttgccggcacaaaatatcgtggagaatttgaagaaaggttgaagaaattaatggaggaaatcaaacagagtgatgagattatactctttattgacgaggtccacacattaattggagcaggagctgcggagggtgcaattgatgccgcaaatatcttgaaacctgcacttgctagaggtgaactgcagtgcattggagccactacacttgatgagtatcgaaagcacatagagaaagatcctgcattggaaaggaggtttcaacctgtgaaagtacctgaaccaacggtcgatgaaacaattcaaattctaaaaggacttcgcgagcgctatgaaattcaccacaaacttcgctacacggatgaggctctcattgctgctgcacagttatcttatcagtatatcagcgatcgattcctaccagataaagcgatcgacttgatcgatgaggccggttctcgcgttcgacttcgacatgctcaactccctgaggatgccagagaactggataaggagctccgacaaatcaccaaagataagaatgaagctgttcgcagccaggatttcgagaaggctggtgagttgagagaccgagagatggagctgaaggcccaaatctccgccctcatcgacaaaggcaaggaaataagcaaagccgagagtgaggccggcgacgccggccccatcgtcactgaagtagatatccaacatatcgtatcctcctggactggaattcccgtcgagaaggtctccagtgacgaatccgaccgccttctcaaaatggaggaaacacttcaccagcgcgtcatcggccaagacgaggccgtcaaggccatcagtcgcgccattcgtcgcgctcgcgtcggcctaaaaaaccctaaccgccccattgccagcttcattttctctggccctactggcgtcggcaagtcggagcttgccaaggcccttgccgcctactacttcggctccgaagatgccatgattcgcctcgacatgagcgagttcatggaacgccacaccgtctcgaagctcatcggctcgccaccaggctatgttggctacaccgaaggtggccaattgaccgaagccgttcgccgacgtccatacaccgttgttctcttcgatgagattgagaaggctcacccggacgtcttcaacatgatgctccagatcttagaggacggccggctcaccgacagtaagggccgaaccgttgacttcaagaacacgcttctgatcatgacgtcgaacgtaggcagcagcgtgattgagaaaggagggcggagaatcggcttcgatctagactatgatgagaaggacagcagctataacagaatcaagagcctggtgactgaggagctgaagcagtatttccggccagagttcctgaaccggctcgacgagatgatcgtgttcaggcagctgacgaagctggaggttaaggagatcgccgacatcatgctgaaggaggtgttcgagaggttgaagacgaaggacattgagttgcaggtgactgagaggtttagggatagggttgtggaagaagggtatagtccgagttatggggcgaggccgttgaggagggcgattatgaggcttttggaggatagtttggctgagaggatgctttcgggggagataaaggaaggggattcagcgatcgtcgatgtcgattcggatgggaatgttacggtgttgaacggtagcagcggcgcgccggagacgattagtccggcgatgtcgatctgatgcgatgcagcttttcggcgagatggggtgtggtttatgttgatgtagaatgaatgtgtagtaaactggttgtaaaacttttaattgagtgtggagaagagggttctatgtaagctggagatgagttctcgggttaggtctaaatagggtttaatgaaataataatgcagttaggtaaagtatggtgaatgatgatgatatttttatagttaaaagtttgt

SEQ ID NO: 3223 - DNA, 3182 bp, Aquilegia formosa
tggaaatcatggctaggtcattgatacagtcgacaaacgttccagcgacagttgcctttaatacaaaacatgcccaactccgaggatctaagactaatagaagaacaatcaaaatgatatgtaattttcagtcaccttgtttgagaactcaagcaccaccccttacattacgtggtttctcgggtttgcgaggatccaatgctttagatacattggtaatgcctggccttgatttccattctaaagtagctgcttcaatgaatgtaccacgtaataaaagaggtagccgatgtgttgttaatgctatgtttgaacgcttcacagaaaaggccatcaaagtaattatgcttgcacaagaagaagcaagacggttaggccacaattttgttggtacagaacaaatcttgttaggtctcattggtgaaggtactggcattgctgcaaaggtgctcaaatccatgggtatcaatctcaaggatgctcgggtggaagtcgaaaaagttattggtaggggaagtgggtttgttgctgtggagataccatttactcctcgtgcaaagcgtgtactggagctttccttagaggaagcccgtcaactcggtcataactatattggatccgagcaccttcttctagggttgcttcgtgagggtgaaggtgtagcagctcgtgttcttgaaaatcttggtgctgatccaaataacattcgaacacaggcatgttattcgtatggtgggagagagcacagacgctgttggcgctggagttgggggagggaccagtggcaataagatgcctacgcttgaagaatatgggaccaatctgacaaaactagcagaggagggtaagctggatccagtggttggaaggcagatacaaatagaacgtgtaactcaaattctgggtaggcggacaaagaacaacccctgcctaattggagaacctggtgtggggaaaacagcaattgcagaagggcttgctcagaggatcgcaactggtgatgtgcctgaaactattgagggaaagaaggtaattaccttggatatgggtcttcttgttgctggtacaaaatatcgtggagagtttgaggagagattaaagaaacttatggaagaaattaagcaaagcgacgagataatacttttcattgatgaggtacataccttgattggagcaggagctgccgagggtgctattgatgctgcaaatatcttgaaacctgctcttgcaagaggagaacttcagtgtattggggctacaacactcgatgaatacagaaagcacattgagaaggacccagctttggaaagacgattccaaccagtaaaggtgcctgaaccatctgttgatgagaccgtacagattcttaaagggcttcgtgagcgttatgaaattcaccacaaactccgttacacagacgaagctctagaggctgctgcacagttgtcatatcagtacatcagcgatcgcttccttccagacaaagcaattgatttgattgatgaggctggctcccgagttcggcttcgtgatgcacagcttccggaggaagcacgagagcttgaaaaagagctcaggcagatcacaaaggagaaaaacgaagctgctcgtggccaggactttgaaaaggcaggggagttgagggatagggagatggatctaaagacccagatcatgagtctcgttgacaaaggtaaagaaaaaaccaaggcagaaaatgaggcaggtgattcaggccctgttgtaacagaagttgatatacaacatattgtagcttcatggactggaatacctgttgataaagtttcagtagatgagtcaggtcgccttctgagaatggaagaaacactccataaaagagtcattggtcagaatgaagctgttgaagctatcagccgggctatacgccgtgcccgtgttggacttaaacatcccaacaggccaattgctagtttcatattctctggtcctacaggtgtaggaaagtcagaattggcgaaggcgctggcttcctattactttggttccgaggaatctatgatacggcttgatatgagtgagttcatggagcggcacactgtttccaaactcatcggttcaccaccaggttatgttggttatactgagggtggtcagctaacagaagctgttcgccgccgaccctatactgtagtcctatttgacgagatagagaaggctcaccccgatgtctttaacatgatgcttcagattttggaggatgggaggttgacagatagcaagggtcgaactgtagacttcaagaacacactcttgatcatgacctcgaatatcggaagcagtgtgattgagaaaggtggtagacgcatggggtttgatcttgacttcaacaagaccgagaaggacaccagctacagccgtataaaaagtctggtgacggaggagctgaaacagtattttagaccagaatttctaaacaggttggatgagatgattgttttccgccgattaacgaagctggaggttaaggagatttctgttatcatgctgcgcgaggtgtttgagaggctccgtgtgaagggaatagagcttcaggtgacagagaagttcaaagacagagtggttaacgaaggatacaacccgagctatggggcaaggcctctgagaagggctataatgaggcttttggaagatagtatggctgagaagatgcttggaggtgagatcaaagaaggagattcagttattgtggatgttgatgaaagtggaaatgttactgtgttgaatggtagcagtggtgctcctgagccattatctccagcattacaaatttgagggtatcctttggctccaccctgacaatttaaaccactgtttttagcagtacttatggttatctctgtaacagagcgtggacttccctgaggaaagacaatatcggtacaaaaactggccctcttcccatctaaccacctgctgctgtttgtttcttgatattacactgcgaaagggttaagtgatactcaataaaacagtagttggcattctaggggatggctaaatttttttgagcttgtatctacacatttcatttcgtgcttttctagcagttgaaattatcagttttgggttgatatgttccttcttccctgtataaatggatagctacaagaaagcagtagagtccatttctttccagattt

SEQ ID NO: 3224 - DNA, 3745 bp, Zea mays
gctcaagttagttttgtcagcgctactttttatcctttcaacacttgcgttgcataaagatacacttaagaaaatactgctgtttctgttctcatattttagatgggaaaaaaaatctattactccccaaaaaatatctgcccttgtgaagaaatttcatgtttgccaataatttcccatcctcagaagtttcagaaatgcgaaaagaaaataggaaacagacaaaaaaggcagaatcaggaggctagacgaaaggaggagaaagagagaacaatcagtagttttctttcttgttggacattcgggcggccaaagcagcggcccccttatctccagggaccaggggaggtcgcacaccaacgcaccgtccttccctttcctcctcctcctccctctcctcggaaggtcaagtgacggtatttgtgaccatggcagggaccttactccagtcagttgccctgggaacaccatttgggggtcgcatgagaacccattgttggaggtcccatggcaccaggaggcctgcctctatgttggcagtgtcacttagccgccctgtcaagatgtcagcatttgtgggtctaagatcagtgcatagcttctcggtcacaccgacggtgtccaattccaggtcggcagttgcatcttacaggtcatcgcgacagacaagacgatctcgttttgtcactcaggcaatgtttgagaggttcacggagaaagctattaaggtcatcatgcttgcgcaagaggaagcaaggcgcctgggccacaactttgttggaactgagcagatcctcttgggtctgattggagagggcactggtattgcagctaaggtgctcaagtccatgggaataaatcttaaggatgcacgtgtggaggtggagaagattattggccgcggcaatggttttgttgctgttgaaataccattcacaccacgtgcgaaacgtgttttggagctctccttggaggaagctcgccaattaggacataattatattggatctgagcacctgctccttggactgcttcgtgagggtgaaggtgtggcggctcgtgtgcttgagagtctcggagctgaccccagcaatatccgtacacaagttattcgaatgattggtgagaccacagaagctgttggtgctggagttggcggcggcagcagtggtaataagatgccaactcttgaggagtatggaactaatttaacaaaattagcagaggagggaaaattagatcctgttgttggaaggcagccacaaattgagcgtgtggtacaaattttaggcagacgaaccaagaacaatccctgcttgattggagagcctggtgttggaaaaactgcaattgctgaaggacttgctcagcgcatttctacaggcgatgtacctgaaacaatagaagggaaaaaggtcataacccttgacatgggacttcttgttgctggcacaaagtaccgtggagaattcgaagaaagattaaagaagctgatggaggaaataaagcaaagtgatgagataatactctttattgatgaagttcacactctgataggagcaggagcagcggaaggtgctatagatgctgctaatatcttgaagcctgcgttggccagaggtgaattacagtgcattggagccactacactagatgaatataggaagcacattgagaaagacccagcacttgaacggaggtttcaacctgtgaaagtgccagaaccaacagtagatgaaaccattgaaatcctcagaggactgagggaacgatatgagatccaccataaacttcgttacactgatgaagctctgattgcagctgcaaagctgtcatatcaatatatcagtgatcggtttctcccagataaggcaattgacttgattgatgaagcaggttcccgtgttaggctacagcatgcacaggtccccgaggaagcaagagagcttgacaaggagctcaaacaagtcacgaaacagaagaatgaagctgttcgaagccaggattttgagaaggctggggaattgagagaccgtgaaatggaattgaaggcccagataacagccctcattgacaagagcaaggaattgagcaaagcagaggaagagtctggagagacaggacctatggtcaatgaagaagatatccagcacatagtatcttcatggactggcatccctgtggagaaggtttccagcgatgaatctgataagcttcttaagatggaagagactttgcacaagcgtgtcattggccaagatgaggctgtggtagcaattagtcgctccatccgccgtgctcgtgtgggtctcaagaaccccaacaggccaattgcaagctttatttttgctggtcccaccggcgttgggaagtctgagcttgcaaaggctcttgcagcctattactttggctctgaggaggctatgatccggcttgatatgagtgaattcatggagagacacacggtatccaagctgattggttcacctccaggatatgtaggatacactgagggtggccagctgacagaggcagttcgacggcggccatacacagttgtgctctttgatgagattgagaaggcacaccctgatgtcttcaacatgatgcttcagattttggaagatgggagattgactgacagcaagggaaggacggtggacttcaagaacacactcctgatcatgacctcaaatgtagggagcagtgtcatcgagaagggtggaaggaagatcggatttgaccttgactctgatgagaaggacagtagctacagcaggatcaagagcctggtcatcgaggagatgaagcagtatttccgacctgagttcctcaaccgtctcgatgagatgatcgtgttcaggcagcttaccaagctcgaggtcaaggagatagcggacatcatgctccaggaggtctttgacaggctgaaggccaaggacatcaatcttcaagtgaccgagaagttcaaggagcgggtggtggacgaaggctacaaccctagctatggtgcacgcccgctgaggcgagccatcatgaggctgctggaggacagccttgctgagaagatgctcgcaggggaggtaaaggagggcgactctgccatagtagatgtggactcggaggggaaggttgttgtgctcaatggtcagggcggcataccggagctctcaactccggcgatcaccgtttagctcgtacataacaaatgacaaaattaatagcatagtttttgttcaaacacattatcatttatggttagaatatctgtgtatatgtagtggtatagtcaatggggaaatcgttcctgcctctaaattcctttttttcaagttaaggtgtttcttttgtcgcaagttaatctgcctggttattaagatattgtttacagagtgatgtgaaaagctcttgtctgtgttcaaggatacatatacagacgggtcaagtagcatgtaggcaatagttccaatataggcctcagcgttgtctttaaccgagcatccgaaaacacttgcacctaaataccgtcgcctgaaaatacaaaaaaacgaaccatatactacgataaaaaaatactgtcggcgtttcgaacccgggtatccgtaagtcaaccagtaaatttgtcgctgcgtgtccctgcccagatggattggcgcaagatggaacacaaggggaaacgcggcttgtattatctcgcaccggggatgtgctcgtagtaggggttacaagcgtcgcgagagagaga

SEQ ID NO: 3225 - DNA, 4811 bp, Brachypodium distachyon
tagtggtaatggatgcttctttcatgtgtttactattcgtttcatgacatgtttcttctggtttgtccataatgactattctaaccggagcaaaaaatatcctatccgacttattaatggccaaacgattattgttcttcctgtttactcgcttgtcttggctgatggaccagtaacaactcttatttccagttttctatcaataccaggtaaaaccgagcttaaagtggtacaaaactagtgtcatggaagacctcaaggtggatagggatgcttgcagaaaggacggatcaagaatcttagtgattgaacaaaatggttttgaggagctgattgtgcgtgtagaaggtttatgtgctggtagtgagtcattaaaaagttatccctcttcaagtcctgacggtgataaacttgaattcagctgcaatacgatttcccataatgaccagttctcagcacacttaacattatctagctccaatgatggagacatgaacatgcagaccggttctgtcaacgaggttgcaacagccatacttaatgtaccattgggaagtgttaaagaggtagctactgatgaggaggtaatgcaatggaggctcgaaatggatgatttcatctttatgtactcggagtgtggtgattattcatacgacagctcggtcagtgagcaatcttcggcaatcagcagcccatgtacatcattaacagtacattcagatgatactcagtccgaagatcttgacagagcagatatttgggtctcatccttggatcttgacgaggaggactcaaccttgcttgaagacaatgagcaatttctggatgtttttagttctggcttccccagcccttctttcagtccaatgagaagtctccaatttggtcattgcagctctagtccagcaacattacatatggaagaatccattgagattgatgacccaatattttggccatttgaacgcacatcctatagcagccctcaatttgataagtttctgagcatatcaccacgaaaaagttcaatgaatattgggcttgctgaaattcgccagttaagtccaatgacgcagaggctccacaagaacaaacaaccttcgccgaataagagcaaagaggcacatcgacgaaatgccagtttgggcaaactaccttcaccgagtaagatcaaagagccacatcgaggaaatgccaatttgggcaaactaccgtcgccaaataagagcaaagagccgcatcgaggaaatgccagtttgggtgcaaaaggaaacaaagtctctcaagataaggttcagaaggatgttgcagttccctccaggctaagaagaacaacaaaaacatcctccaagcaccagccattaaacagcagcgagaaaagaaggccacctctcttaaaaattgatgcgtcgataaagggtagctctccccgtttgcaggtaattcatcctcttcaagagcttgaagcaagtgacctccaaaacctagctgataacaaaattctcatcgaagagtttgttgggttagatgaatttgatggtcatgaaggtatcagttcagatttgtcaaactgccaatttggtttggggaagctatttctgaccatggcagggaccttactcctgccagttgctctagggtcaacttttgcaggccgtgcaagcggtcagcgctggaagtctcatggcaccaggaggcctgcctcgatgttagccatgtcattgaaccgtccggttaggatggcagcatttgttggtctgagatcggcacacagctttacagccacacctgcatccaactacagatcgacagttgcatcttacagatcctccagacgcggacgacgtactcggtttgtaaccagagcgatgttcgagaggttcactgagaaagctataaaggtcataatgcttgcacaggaggaagcaaggcgcctgggtcacaactttgtcggaacagagcaaattttgttgggtctggttggagaaggcactggtattgctgcaaaggtgctcaagtccatgggtataaatctgaaggatgcccgtgtggaagtggaaaaaatcattggcaggggcaatggttttgttgctgttgaaataccattcacgccacgtgcaaaacgtgttttggagctttcattggaagaagctcgccaactaggacacaattatattgggtctgagcacttgcttcttggactgcttcgtgagggtgaaggtgtggcagcccgtgtccttgagtctcttggtgctgaccctagcaatattcgaacacaggttgtcagaatgattggcgagacaaccgaagctgttggtgctggagttgggggagggagcagtggtaataagatgccaacactcgaggagtatggaactaatttgacgaaattagccgaggagggaaagctagatcctgtcgttggaaggcaaccacagattgaacgtgttgtacaaattttaggcagacgtaccaagaacaatccatgcttaattggagagcctggtgttgggaagacagcaattgcagaagggcttgctcaacgtatttctagtggggatgtgcctgagacgatagaagggaagaaggttattacccttgatatgggacttcttgttgctggtacaaaataccgtggagaatttgaagaacggttaaagaaactgatggaagaaataaagcaaagtgatgagataattctcttcattgatgaagttcacaccctcataggagcaggagcagccgaaggtgctattgatgctgctaatatcttaaagccagcattagcaagaggagaactacagtgtattggagccaccacacttgatgaatacaggaagcatgttgagaaagacccagcattagaaaggcgtttccaacctgtaaaagtgccagagccatcagttgatgaaacgatagaaattctcagagggcttcaggaacgatatgagatccatcataaacttcgatacactgatgatgctttgattgcagctgctaagctatcttatcagtatatcagtgaccgtttcctcccagataaggcaattgacttgattgatgaagcaggttcacgtgtaaggcttcgacatgcgcaggttcctgaggaagctagagagcttgacaaggagcttaagcaaataacaaaagataaaaatgaagctgtccgtggccaggatttcgaaaaggctggagagttgcgagatcgcgaaatggaactgaaggctcagataacagctctcattgacaagagcaaggagatgatcaaagcagagaccgattcaggagagaccgggccaatggtcaccgaagcagatatccagcacattgtatcatcatggactggtatcccggtggagaaagtctcaactgatgaatctgataaacttcttaagatggaagagacattgcataagcgtgtcattggccaagacgaggctgtgaaagcaataagccgctctgttcgccgtgctcgtgtgggcctgaagaaccccaacaggccaattgcaagctttatttttgcaggtcccactggtgttgggaagtcggaacttgcaaaggctctcgcgtcgtattactttggctccgaagaagccatgatccggctggatatgagtgagttcatggagaggcacacagtatccaagttgatcggttcaccaccaggatatgttggatacaccgaaggtggccagttgacggaggcggttcgacgcaggccatacagcgttgtgctttttgatgagattgagaaggcgcatccggatgtcttcaacatgatgctccagatcctcgaagacggcaggttaactgacagcaagggaagaacagtggatttcaagaacacgcttctcataatgacatcgaatgttggcagcagcgtcatcgagaagggagggcggaagatcgggttcgaccttgactcagacgagaaggacagcagctacggcaggatcaagagcttggtcgtcgaggagatgaagcagtacttccgtcctgaatttctcaaccgtctcgatgagatgatcgtcttcaggcagctgaccaagctggaagtgaaagatatcgctgagatcatgctactggaggtcttcaacaggctgaaggccaaggagatcaacctgcaggtgaccgagaagttcaaggaacgggtcgtcgacgaaggctacaaccctagctacggagcacggccgctaaggagggcgatcatgaggctgctggaggacagcctcgcggagaagatcttggctggggaggtcaaggagggcgattccgccatcgttgatgttgactcagaggggaaggtgattgtgctgaatggcgagagcgggctgccggagcttccaaccccagccgtcaccgtgtagttcacacagattaactgtccaacatatacagcagcgttttcatttcattcgagcacatatctcttcatagttagtgtataactgtaaactgtacatacattatatatatacaatattttttttgcgagagaaagtataatatatacagtatgcatatatataatcaaaagggaaacattgctggcgactgattagttctgatgctttaagaggactgtctctgaattactgtctctgaattttcgcaatacgcttatatggatgtgacgtcatccattttttgtttttttgttttctttgaggaagaggaaatctatttttcggttaagagggcgctttcgctgattcggcctgctaaaacagcactgggttttcaaccttgttgggctgttgctgctgggcctccagccctcgttcaatccaccacactgtcaaaatccagcc

SEQ ID NO: 3226 - DNA, 3598 bp, Gossypium raimondii
cgataatctagtaaaaatatcatcttaaaccacataaatctaaacaagtgtaaatcaaatggcggagaagtcgatagaagatgatagactgtcgacgtagagaattatcaaagagagagagagagagcgcgtgttaatataaaccacatctatcctctttatttgctcttcggccgaccattcctactatcagtttaaaagaaaaaaaaaagggtaaaaagagggtctcttctctctgcaattcccaaaagaaaagacccctttttagtatattttactgtccatttcactctctattcaatttcaccctctttcttttcgatagtttaggagtgatggctaaagttctggcgcagtcgactattgttccttctctagttacgagtcgaagtcatggtcgatccactgggaaatcgaaaaggtctgtcaaaatgatgtctagtttacgaacacctggattgaggataaatagtttctctgggttgcggggctcagcttctttggataatatggttagagttgaccaagatttccattccaaggttgcgatttcaatctcgtctcaacgtggaaggggaagtaggtgtgtgcctaaagccatgtttgaacgctttactgaaaaagcaattaaagtaatcatgcttgctcaagaggaagctaggcgacttggccataactttgtcggtacagagcaaattttgttgggtcttattggtgaaggtactggcattgctgcaaaagttcttaaatccatgggaatcaatcttaaagatgcgcgagttgaagtggagaagataattggaaggggaagtggttttgttgctgtggaaattccatttactcctcgtgctaaacgtgttttggaactctcgttagaagaagctcgccaacttggccataattacattggatcagagcatctgcttctggggttgcttcgtgaaggtgaaggtgtagcagcacgtgttcttgagaatttgggtgctgacccaagcaatatccgcacacaggttattcgtatggttggtgagggcaacgaagttagtgtggttaccggtggatcaactggtaacacaaagatgccaacacttgaggaatatggaaccaatttgactaagttagctgaagagggtaaattggatcctgttgttggaaggcaagatcaaatcgaacgagttgtccaaatattgggtagacgaaccaaaaacaacccgtgtcttattggagaacctggtgttggaaaaactgctattgcagaaggccttgcccaacgaattgctactggtgatgttcctgatactattgagggcaagaaggttataactcttgatatgggtcttcttgttgccggaacaaaatatcgtggtgagtttgaggagaggttgaagaagctaatggaggaaatcaagcaaagtgatgagataatattgtttattgatgaggtgcacactttgattggagctggagcagctgaaggtgcgattgatgctgccaatatcttgaagcctgctcttgcaagaggtgaattgcagtgtattggagctaccacacttgatgaataccgaaagcatattgagaaagacccagctttggaaagacgtttccagccagttaaagtgcccgaaccatctgttgatgaaactatacagattttgaaaggtttgcgagagcgttacgagattcaccacaagcttcgttacacagatgaggccttaatctctgccgcacagctttcataccagtacatcagtgaccgttttctgcctgataaagcaattgacttgattgatgaagctggatctcgtgttcgccttcgtcatgcacaggtatgcttgtataataacctagtcatgaagtgactcttacatgcttttctttctccagttcatttcatgacattgttgatacagctccctgaggaagctagagagcttgagaaagagctccggcagatcacaaagtcgaagaacgaagcagttcgcagccaggactttgagaaggctggggaattacgtgatcgggaaattgaactcagggctcagatcactgcaatccaagagaaagacaaggagatgaataaggcagaggcggaggcaggggatggagggcctgtagtgactgaagtcgacattcagcatatagtctcttcatggactggtattcctgtcgagaaagtatcaactgatgaatctgatcgcctacttaaaatggaagagacccttcataagcgagtcattggtcaggatgaagctgtcaaagccattagccgtgctattcgacgtgctcgtgttggtctcaagaaccccaaccggccaattgccagctttatcttctctggaccaactggtgtaggaaaatcggaactagcaaaggcactagctgcttactactttggctctgaagaagccatgatccgacttgatatgagtgagttcatggaaaggcacacggtgtccaagctgattggttcaccccctgggtatgttgggtacaccgagggtggtcagctaactgaggctgttaggaggcgaccatacaccgtagtacttttcgatgagattgagaaagcccatcctgatgttttcaacatgatgcttcagatcctcgaggacggaaggctcacagatagtaaaggaagaactgtcgatttcaagaatacactcctgataatgacatcaaacgtcggaagcagtgtgatcgaaaagggtggacggcgaattggatttgatctcgattatgatgagaaagacagtagttacaatagaataaagagcctggtgacagaagaactgaagcaatatttcaggccggaatttttgaacagattggacgagatgattgttttcaggcaactcaccaagttagaagtgaaggaaattgccgatataatgctcaaagaagtgtttgacaggcttaaaagcaaagaaatcgagctccaagtgaccgaaaggtttagagaaagggtggtggaagaagggtacaacccaagttacggagcaaggcctttaagaagagccataatgagacttctggaagacagcatggctgagaagatgcttgcaagggaaatcaaggaaggtgattcagtaattgtagatgttgactctgatggaaatgtcacggttctcaatggtagcagtggcacttccgagtcattgaccgatccgattccagttgtgtaaaccacatataagccactctagatatgttgttttgtaccctcttttttctttttcttctccttttgattgaactggctatactattatgaagtctgttttgttggaaggactagttgggcagttgaaattggaagccattagttgctttttgcatttggaagtgttgaaactgtaaatcttttaacactgaatttgtgcatgcatagttggagtaggctttcaacgaggatggtggttggtagtgttgttttgcttagtttatttcacaataaaaaagtttaaatttgttcaaaatgtgattcctttacttcagtacatgaatgatgaatcaaaatgttttttagctgcttctctaatggttcatgtttacaaccttgtcaacatttagaccaagtttagtacttgaaattataatt

SEQ ID NO: 3227 - DNA, 3479 bp, Pinus taeda
ccatccagagacattgttccattataatttccctggggcagtttgttgggcatttgatgatcttgctgctctagagctacaaggttctgtataacttgtcaagtgaaaattaatctgggtagggtgtaaagatggctgggacactggcacaatcagcaattctgccgggtagcataatcaactcaaaatatggtccagtaaagggatccaaaagatcaaggagagctgtaaagatgattggaaatgcacatgcccgttctttccccatgcagacattttctggtttacgacgagtaacatcgattgacaatattgcatgtcctcggaaagactttcatgcggcagttgcagctgccgtatatcttccaagttcaaagggaaatccaaggcgaggggtggttgttgctatgtttgaacgttttactgaaaaagccattaaagtaattatgcttgctcaggaggaagcaagacgccttggacacaactttgtaggtacagagcagatactgttaggtcttattggtgagggaacaggcattgcagccaaagtattgaagtctatggggattaatctcaaggaggctcggattgaggttgagaaagttattggtagaggcagcggatttgttgctgtggaaattccattcactcccagagcaaagcgtgtattggaactgtcattggaggaagccagacaacttggccacagttacataggatctgagcacctgcttttgggattactaagggagggtgaaggtgttgcagctcgggtgcttgaaaatcttggagcagaaccgagtaacattcgtacgcaagtagttcgcatggtgggagaaaatagagatgatgatagagctgtggtcggacctggaagcggcagtaacaagactccaacacttgaagagtatgggacgaatttgactaagttggcagaggagggaaagcttgatccagtggttggaaggcagccacaaatagaacgggttactcaaattttgggacgtcgtacaaagaataatccttgtcttattggtgagccaggtgtgggaaagacagctattgctgagggtcttgcccagcgaattgcatctggggatgttccagaaacgattgagggtaaaaaagtgattaccctagatatgggcttacttgttgctgggaccaagtaccggggagaattcgaagaaagattaaagaagttaatggaggaagttaaacagagtgatgatctaatactcttcatagatgaagtgcataccttaattggagcaggagcagcagaaggtgctattgatgctgccaacattctaaagcctgctcttgcacgcggcgagctacagtgcatcggggccaccacacttgatgaatacagaaaacacattgagaaggacccagctcttgaaaggagattccagccagtccaggttccagagcctaccgtggatgagaccatacagattttgaaaggtttgcgagaacgatatgagattcatcacaagctgcgttatactgacgaggcattagtttctgccgctcaattgtcccatcagtacatcagtgatcgtttccttcccgataaggcaattgatctgattgatgaggctggttctcgagtgagattgaggcatgcacagcttcccgaggaggccagagagcttgaaaaagaacttagacaaataacaaaagaaaagaatgaagctgttcgaagccaggactttgaaaaggctggagagctacgtgaccgggagatggagttgaaggcacaaattgttgctataacagagaagggtaaagaaaaatcaaaagctgagagcgaggcaagtgatgagggtccaacagtgacagaggcagacattgaacatattgtatcttcatggacaggtattcctgttgaaaaggtatcaactgatgagtctgacagacttttgaagatggaggaaactcttcatcaccgtgtcatagggcaagatgaagctgtaaaagcaatcagtcgagctattcgtcgagcacgagttggtttgaaaaatcccaacaggccaattgcgagttttattttctcaggtccaactggtgttggcaaatcagagcttgcgaaggcactagcagcttattattttggttcagaggaggcaatgatacggttggatatgagtgaatttatggagaggcatactgtctcaaaattgattggttcacccccaggatatgttggttacagtgaaggaggacagctgactgaagctgtgagaaggcgaccctatacagtggtcctttttgatgagattgagaaggctcatcctgatgtattcaatatgatgctccaaattctagaagatggaagattaactgatagtaagggtagaactgtagatttcaagaacactcttttgattatgacatctaatgtaggaagcagcgtgattgagaaaggaggagctagaattgggttcaatcttgattatggggaaaaggacagcagttacacaaggattaagagtcttgtgaatgaagaaatgaaacaatattttcggcctgagttcttgaatcgtttggatgaaatcattgtgttcaggcagctcactaagatagaggtgaaagaaatatctgatattatgctgaaagaggtttttgagcgccttaaacaaaaagagattgatcttcaggtaacagagaggttcagggaccgggttgttgatgaaggttatagcccaagctatggtgcgagacctttgcgtagggcaattatgaggttgttagaagattgtatggctgaaaaaatgcttgctggtgaaatcaaggcaggtgattctgcgataattgatgtagatcctgaaggcaatgtgactgtcttgaatggaaattcccactcatcagcatctatacccaccatggttactgcctagggaaatgctatagttgctttatagctggctagatgtgttggtaatgttttcaggtataaattgatatacacggtctctctgctttccgtccaggaaggatttggataattgctggttagagaaggtatcaaattaaccacatatttgaaatattttgttatggtttgttctttgtacagtgctgatcttgaagtttcaatcacatttgtttgcaattacatcagcgacaaataatttcatttactgaacgaccatgtgtactactggaggaaattgctctttatatcttaacttatttggaatcaaataactttttgtgacttcttaattaatgctctatcatgcattgtctatttaggatacgatgtattttttataaaaggattagtagtttcattgttttcctgagtggatatgtggtatccattggtaagggctttgtgtaattttttttggttcctgatgcatgcttacgaggacaatcttctaacaacctcataattgccctacgcaaaggtctcgcaccatagcttgggctataaccttcatcaacaacccggtccctgaacctct

SEQ ID NO: 3228 - DNA, 2835 bp, Solanum phureja
aggttgcgggtccatcatggctagagctttagttcagtcaacagatattctatcttcagttgctgttgccggtgaaagggctggacaattcaatggatcccggaaaaatcaaagaactgttagaatgatatgtgatgtaaagtttccttccttaaagctgaagagctttgtaggactgcgagggtgcaatgcattagatacactacttgtaaaatctggagaaactctccattcaaaagtggcagctgcaacttttgtcagacggtcacaaggatgccgatttgtcccaaaagcaatgtttgagcgcttcaccgagaaagcaataaaaggcattatgcttgcgcaagatgaggccagacgactaggtcacgactttgtcgggacagaacagatcctgctgggtcttattggtgagggaactggtattgctgctaaggttcttaaatccatgggaattaatttgaaagatgctcgtgtggaagtagagaagattattggcaggggtagtgtatttattacagtggaaatcccttttactcctcttgcaaagcgtgttctagaactatctctggaggaagcccgccaactagggcataattacattcactcggaacacttgctacttggattgttgcgccagggtgaaggtgtggctgcccgtgttcttgaaaacttgggtgctgaccccagtaatattcgcacacaggcaactaatttccctttctcaaactggtttgaaatgcttttcttgaagccaagggtcatacggatggtaggcgagagtagtgatggtgctactgttggaggtggaacttctggcctaaagatgcctacattggaggagtacggcacgaatttgacaaagttagctgaagaggggaaactagatcctgtagttggaagacaggctcaaatcgagcgtgttactcaaatcttgggtcgccgtacaaaaaacaacccttgtcttattggagaaccaggtgttggaaaaactgctattgccgaagggctagctcaaagaatcgctaatggtgatgtccctgaaacaatagagggaaagaaggtcataacacttgatatgggattgcttgttgctgggacaaaataccgtggagagtttgaggaaagactgaagaaactaatggaggaaattaaacaaagtgatgacataatactgtttattgatgaagtacacacattgattggagctggagctgcagagggagcaattgatgctgcaaacatcttgaaacctgccctggctagacgcgagctacagtgtattggagccacaaccctggatgagtacagaaagcacattgagaaagaccctgcactggagaggaggttccagccagttaaagtccctgaaccttctgtggatgaaaccatacagatcctgaaagggcttcgggagaggtatgagattcatcacaagctccgttacactgatgaggcaatagaggctgctgccaagctttctcaccagtacatcagtgaccgctttctgcctgataaagcaattgacttgattgatgaagctggttcccgtgttcggcttcgtcatgcacagctccctgaggaagcaagagagctggagaaggagcttcgccagattacaaaggagaaaaatgaatctgtccgcggtcaagattttgagaaggctggggagttgcgtgatagagaaatggatcttaaggcacaaatctcagccttgatatacaaaaacaaagagaagagcaaagcagagtctgaggcaggagatgcagcaggtcccttagtgacagaggcagatattcagcacattgtctcttcttggactggcattcctgtagagaaggtctcaactgatgaatctgatcgcctcctaaaaatggaagaaacacttcatacccgagtcattggccaggatgaagctgtaaaagccattagtcgtgctatcagacgtgcccgtgttggactcaagaatcccaaccgacctattgccagtttcatcttttctggtccaactggtgttgggaagtcagaactggccaagtctttagcaacgtactactttggttctgaagaagcaatgattcggcttgatatgagtgagtttatggagagacacactgtgtctaaactcatcggttctccccctgggtatgttggttacactgaaggtggtcaattaactgaagctgtgaggcgtcgaccttacactgttgtgctctttgatgagattgagaaggctcatcctgatgtctttaacatgatgcttcaaattcttgaagatggaagattgacagacagcaagggcagaactgtcgacttcaagaatacactcctcatcatgacatcgaatgttggaagcagtgtgatagagaaaggaggtcgtcgtataggttttgatctagattttgacgagaaggatagtagttacaaccgtatcaagagcttggtgactgaggagttgaaacagtacttcaggccagagttcttaaacagattagatgagatgattgtattccgtcagctcactaagttggaggtgaaggagattgctgatatcatgcttaaggaagtctttgtgaggttgaagaataaggagatagaacttcaagtgacagagaggtttagagacagggtggttgatgaaggatacaacccaagctatggagctaggccattgaggagagctattatgagactattggaggatagcatggccgagaagatgcttgcaagtgagatcaaagaaggtgattcagtaattgttgatgtggattcagatggcaatgtcaccgtcctcaatggcagtagcggtgctccctcagatccacaaatttattg

SEQ ID NO: 3229 - DNA, 2854 bp, Brassica napus
tccgctacctatctctttcccagacgggccgaccattacaagagtctctctctcgcactttagccgcctccatccaactctcgccatcatggctaggctcttggctaatttcacagcccgtcctttacttggtcccggaagacatgttcagtccgacgactatagaaaaccaagacgatgtgtgaagatgatgtacacttcacaaacgccggttttgagcatccagagcttctcaggcttaagggctgccaatgcagtggatctaatagcaaggcctgctcatggtttctttagtaaagttaaccttcaaatctcttcccgcaaaggaaaatcgagccgatgtgtgacaaaagccatgtttgagcggttcaccgagaaagctatcaaggtcataatgctgtctcaagaggaagctcggagacttggccataactttgttggcactgagcagatactgttgggtctcattggggaagggactggaatcgctgcaaaggttcttaagtccatggggatcaatcttaaagattctcgcgtggaggtggagaagatcattgggagaggcagtggattcgtggctgtggagatcccattcactcctcgtgcaaagcgtgtcctggagttgtctctagaggaagctcgacaactcgggcataactacattgggtcagagcatcttctgcttggtcttcttcgtgaaggggaaggtgttgcagctcgtgtcctggagaatttgggtgtagatgctagtaacatccggacgcaggttgtacgtatggtcggagaaaacaatgaagtgaccgcaagcgttggtggaggatccagcggaaacagcaagatgccaacgctagaagagtatgggactaacttaactaaactagcagaggagggaaaactagatccggttgtgggaaggcagccacagattgaacgagtggtccagatcttggctcggagaaccaagaacaacccctgtctaattggagaacctggagttggtaagacagcaatagctgaaggactagcacagagaatagccagtggtgatgttcctgaaacaattgaggggaagacggttataacccttgatatgggtcttctagtggctggaacaaagtaccgtggagaattcgaggaaagattgaagaagcttatggaggagatcaggcaaagtgatgacatcattctgtttatcgatgaagtgcacactctgatcggcgcaggagccgctgaaggtgccattgatgctgccaacatcttaaagccagctcttgccagaggtgaattgcagtgtattggtgcaacaacgttggatgagtacagaaagcatattgagaaagatcctgcattagagagaaggttccagcctgtgaaggtacctgaaccaactgtagatgaagctatacagatcttgcacggtctgcgtgagcgttatgagatccaccacaagctccggtacactgatgaagccttggttgctgctgcgcagttgtctcatcagtacatcagtgatcggtttcttccggacaaagcgattgacttgattgatgaagctgggtctcgagttcgactacgccatgctcaggtacctgaggaagctagggagcttgaaaagcaactcagacagatcacaaaggagaagaatgaagctgtgagaggccaagactttgagaaggctggttctcaccgtgaccgggaaatagagcttagggccgagatagctgctgttttagccaaaggcaaagaagtgagcaaagctgagactgaagctggcgaagaaggaggaccaactgtcactgaatccgacatccaacacattgtctccacctggacaggaatccctgtagagaaagtctcgtccgatgaatctagccgtcttctcaagatggagcagacccttcacacaagagtcattggccaagacgaagcagtcaaagctataagccgagccatcagacgtgcgcgtgttggactcaagaacccgaaccgcccaatagcaagtttcatcttctctggtccaccggtgtggggaaatcagagcttgccaaagccttggctgcttactacttcggttcagaggaagcaatgatccgtctcgacatgagtgagttcatggaacgacacaccgtctcaaaactcatcggttcacctcctggttacgtagggtacacggaaggaggtcagttaacggaggcagttcgacgcaggccttacacgcttgtcctctttgacgaaatcgagaaagcccatcctgatgttttcaacatgatgcttcagatcctagaagacgggagactcactgacagcaaaggaagaactgtggatttcaagaacacgcttctgatcatgacatcaaacgtaggaagcagcgtgattgaaaagggcggtagaagaatcgggtttgatctggactacgacgagaaagacagcagctacaacaggatcaagagcttggtcactgaggaactgaaacagtatttcagaccggagttcttgaacaggttagatgagatgattgttttcagacagctgacgaagctggaagtgaaggagattgctgatataatgcttaaagaagtagtggtgaggcttatggacaaagagattgagcttcaagtgaccgagaggtttaaagagagagttgtggatgaagggtttgatccgagctacggtgcgaggccgctgagaagagcgataatgaggctgttggaagatagcatggcggagaagatgctttcaagggagattaaagatggagattcagtgattgttgatgttgatgctgaaggaagtgtggttgtgttgactggtaagagtggaggtggtagtgttgctgaagaagccatggaagatc

SEQ ID NO: 3230 - DNA, 3607 bp, Physcomitrella patens
gtcttcagcgcggagggacggacttcttcaagctcatcatcccctcgttgctaatcgaattgctgattccgattctgtcttctatcccccgtagagcttcatcgtttccagtaggaggaggacgaggaggaggaggtttcaggggtttgcgagacactctcgtgtggggtgttttctcggctgagccgtgtttgcatttagcggtttcgtttttgatgcggttttgagttagtagggtttagggaccctgcttttggaggaaggggattcttacgttttggttgttgtgccgttggaactaggagaggtttagcttgttggattgttgagtttagtgattttaggttgtgcattgagagagttgaattgaaatggcgtcgatggcgcattccttgactcttccgtctgcgggggcggagcttaccattggccagctcaagtgcggtgcgaagagtaggagaagagcggctgcaagagccgcagtgggtaggctgaatgtgcaagcgaagtctgctagtttgtcattgactccgtttcagtcattttcggggatgcgaaaggcctcggtgattgattccctgaccgtgaaacaagggagggattttaaatctgttgtgtcgaactccgttgcaatttgtaacgaatcgcggccttcgaaggctgtgactacggccatgttcgagcgtttcactgagaaagctattaaggttatcatgttggctcaggaggaagcaaggcgtctcgggcacaatttcgttggtactgaacaaattttgcttggccttattggtgagggtactggtattgctgcgaaagtgatgaagtccatgggagtgaaccttaaggaagctcgcgtggaagtagagaagattattgggcgcgggagcgggttcgtggctgttgagattcccttcacgcccagggccaagagagttctcgagctctcactcgaagaagctagacagcttggtcacaactatattggcacagagcatttgctgctggggctgctacgagagggagagggtgttgctgcccgagtgcttgagaaccttggcgctgaccccagcaacattcgaactcaggtgattcgaatggtaggcgaaaataccgaggctgttggtgtcggagctggcagcggcagcagtggtaacaagatgcccactctggaggaatacggaacgaatttaaccaaactcgcggaagagggaaagctagacccagttgttggaagagttgcacagatagagcgagtgactcaaatccttggtcgcagaaccaaaaacaacccgtgcctaattggagagcctggagttggaaaaactgctgttgccgaaggtttggcgcagagaattgcgtctggggacgtaccggagaccattgaaggaaagaaggttatcaccctcgacatggggctgctggttgccggaaccaagtacagaggagaatttgaggaaagactgaagaaactgatggaagaaattaaacaagcggacgatatcatccttgttattgatgaagtgcacaccctcattggtgctggtgccgccgagggtgctattgacgctgccaacatcttgaagccagctttagctcgcggtgaattacagtgcatcggagcaaccacacttgacgagtacaggaagcacattgagaaggatcctgcattggaacgtcggttccaacctgtgttagttccagagcctactgtagaggaaactattgaaattctcagaggattgagagaaagatacgagatccaccataaattgcgttacactgacgaggctttgattgcagcagcccagctatcttaccagtacatcagtgatcggtttttgcctgacaaggctattgatttgattgatgaggcgggttcgaaagtaaggctgaaacacgctcagctacccgaagaggcgaaggagcttgacaaggagttgcgtgccgttacgaaggagaagaatgaagctgtgcgtgggcaggattttgagaaggccggagaactaagggatcgcgagatggagctgaaggctcaaatatcggccttcattgagaaggacaaagagcagatgaaggcagagagtgaaaccggtgatgttggtcctactgtcgaagaatctgacattcagcagattgtgtctgcctggacaggcattcccgttgagaaggtctcaagtgatgaatctgaccgcttgttgaagatggaggatacacttcataatcgggttattggccaggatgaagcagtgaaggccatcagtcgtgctattcgcagagctcgtgttggacttaagaaccccaatcgtcccatcgctagtttcatcttttctggtcctactggtgtcggtaaatcggagcttgctaaaagtctcgcttcctactactttggttctgaagaagccatggttagacttgatatgtctgaatttatggagagacacactgtctccaaactcattggatctccaccaggttatgtgggttacagtgaaggaggacagctaacagaggctgtgcgcagaagaccatacactgtggttctttttgatgagattgagaaggcacatcctgatgttttcaatatgatgcttcagattttggaagacggaagattaaccgacagcaaagggcggactgtagatttcaagaatactcttctaattatgacttcaaacgtaggaagcagtgtaattgagaaaggtgggggtggtattggtttccaattggactacggcgaaaaggattctagctacaatcgcatcaagagcctcgttaatgaggagctgaagcagtactttaggcccgagtttttgaaccgattggatgaaatcattgttttcagacaactgactaaattggaagttaaggagatcgctgatattatgttgaaggaggtcttcgagcggttgaagaagaaggaaattgatttacaggtaactgagagattcagggatcgtgttgttgacgaaggctatagtcctagctatggagctcggccattgcgacgagcaatcatgaggctattggaagacagtatggcagaacgcatgctctctggagaaattaaggagggagactcagctatcatcgatgtagatggtgatggcaatgtcacagtgttaaatggcactacgggaactgcttccaaaacagatacagatatggcccctgctggtattgcttgaattccttgattaggtaaagaatttttgcaatttagtagggcgttgatctgctaggtctgatagattcagaaacttagttcaggtcctttgtattcatagcaaggggtgattctgaatgcaccaacgaaaaaggtcaaattcgaaaccatttattctcggctgcagagcaggaggtgtttgcatttgctagctttaaagctcatctcttgcaaattctggccaattgctttgtggggtcagttcctgttgtcaaaaggtttgacaaatacgaaggtttgaatcctgtgctattcagggttttttacacttcgtacattatgcttataatggacagtctcttatcctctgtggactgtttcaaatgtaaattttgatgtcacgcagagtgcttgtaagtgataaaataattcttattgcactgt

SEQ ID NO: 3231 - DNA, 3607 bp, Physcomitrella patens
gtcttcagcgcggagggacggacttcttcaagctcatcatcccctcgttgctaatcgaattgctgattccgattctgtcttctatcccccgtagagcttcatcgtttccagtaggaggaggacgaggaggaggaggtttcaggggtttgcgagacactctcgtgtggggtgttttctcggctgagccgtgtttgcatttagcggtttcgtttttgatgcggttttgagttagtagggtttagggaccctgcttttggaggaaggggattcttacgttttggttgttgtgccgttggaactaggagaggtttagcttgttggattgttgagtttagtgattttaggttgtgcattgagagagttgaattgaaatggcgtcgatggcgcattccttgactcttccgtctgcgggggcggagcttaccattggccagctcaagtgcggtgcgaagagtaggagaagagcggctgcaagagccgcagtgggtaggctgaatgtgcaagcgaagtctgctagtttgtcattgactccgtttcagtcattttcggggatgcgaaaggcctcggtgattgattccctgaccgtgaaacaagggagggattttaaatctgttgtgtcgaactccgttgcaatttgtaacgaatcgcggccttcgaaggctgtgactacggccatgttcgagcgtttcactgagaaagctattaaggttatcatgttggctcaggaggaagcaaggcgtctcgggcacaatttcgttggtactgaacaaattttgcttggccttattggtgagggtactggtattgctgcgaaagtgatgaagtccatgggagtgaaccttaaggaagctcgcgtggaagtagagaagattattgggcgcgggagcgggttcgtggctgttgagattcccttcacgcccagggccaagagagttctcgagctctcactcgaagaagctagacagcttggtcacaactatattggcacagagcatttgctgctggggctgctacgagagggagagggtgttgctgcccgagtgcttgagaaccttggcgctgaccccagcaacattcgaactcaggtgattcgaatggtaggcgaaaataccgaggctgttggtgtcggagctggcagcggcagcagtggtaacaagatgcccactctggaggaatacggaacgaatttaaccaaactcgcggaagagggaaagctagacccagttgttggaagagttgcacagatagagcgagtgactcaaatccttggtcgcagaaccaaaaacaacccgtgcctaattggagagcctggagttggaaaaactgctgttgccgaaggtttggcgcagagaattgcgtctggggacgtaccggagaccattgaaggaaagaaggttatcaccctcgacatggggctgctggttgccggaaccaagtacagaggagaatttgaggaaagactgaagaaactgatggaagaaattaaacaagcggacgatatcatccttgttattgatgaagtgcacaccctcattggtgctggtgccgccgagggtgctattgacgctgccaacatcttgaagccagctttagctcgcggtgaattacagtgcatcggagcaaccacacttgacgagtacaggaagcacattgagaaggatcctgcattggaacgtcggttccaacctgtgttagttccagagcctactgtagaggaaactattgaaattctcagaggattgagagaaagatacgagatccaccataaattgcgttacactgacgaggctttgattgcagcagcccagctatcttaccagtacatcagtgatcggtttttgcctgacaaggctattgatttgattgatgaggcgggttcgaaagtaaggctgaaacacgctcagctacccgaagaggcgaaggagcttgacaaggagttgcgtgccgttacgaaggagaagaatgaagctgtgcgtgggcaggattttgagaaggccggagaactaagggatcgcgagatggagctgaaggctcaaatatcggccttcattgagaaggacaaagagcagatgaaggcagagagtgaaaccggtgatgttggtcctactgtcgaagaatctgacattcagcagattgtgtctgcctggacaggcattcccgttgagaaggtctcaagtgatgaatctgaccgcttgttgaagatggaggatacacttcataatcgggttattggccaggatgaagcagtgaaggccatcagtcgtgctattcgcagagctcgtgttggacttaagaaccccaatcgtcccatcgctagtttcatcttttctggtcctactggtgtcggtaaatcggagcttgctaaaagtctcgcttcctactactttggttctgaagaagccatggttagacttgatatgtctgaatttatggagagacacactgtctccaaactcattggatctccaccaggttatgtgggttacagtgaaggaggacagctaacagaggctgtgcgcagaagaccatacactgtggttctttttgatgagattgagaaggcacatcctgatgttttcaatatgatgcttcagattttggaagacggaagattaaccgacagcaaagggcggactgtagatttcaagaatactcttctaattatgacttcaaacgtaggaagcagtgtaattgagaaaggtgggggtggtattggtttccaattggactacggcgaaaaggattctagctacaatcgcatcaagagcctcgttaatgaggagctgaagcagtactttaggcccgagtttttgaaccgattggatgaaatcattgttttcagacaactgactaaattggaagttaaggagatcgctgatattatgttgaaggaggtcttcgagcggttgaagaagaaggaaattgatttacaggtaactgagagattcagggatcgtgttgttgacgaaggctatagtcctagctatggagctcggccattgcgacgagcaatcatgaggctattggaagacagtatggcagaacgcatgctctctggagaaattaaggagggagactcagctatcatcgatgtagatggtgatggcaatgtcacagtgttaaatggcactacgggaactgcttccaaaacagatacagatatggcccctgctggtattgcttgaattcctcgattaggtaaagaatttttgcaatttagtagggcgttgatctgctaggtctgatagattcagaaacttagttcaggtcctttgtattcatagcaaggggtgattctgaatgcaccaacgaaaaaggtcaaattcgaaaccatttattctcggctgcagagcaggaggtgtttgcatttgctagctttaaagctcatctcttgcaaattctggccaattgctttgtggggtcagttcctgttgtcaaaaggtttgacaaatacgaaggtttgaatcctgtgctattcagggttttttatacttcgtacattatgcttataatggacagtctcttatcctctgtggactgtttcaaatgtaaattttgatgtcacgcagagtgcttgtaagtgataaaataattcttattgcactgt

SEQ ID NO: 3232 - DNA, 3543 bp, Papaver somniferum
gtaattataccgacgtcgactcaaaacctgacaaaataatcacttatgcatactccggtcactgttgaatctcttctcttggtataattatttatttatcaaaaaaaatatcttggtagtttacttgcatacatactacacgcaaggatattggaggaaaccttttgacaaacgtggaagaattccagtggctaaattattcagatatttttgttgaattaataggaatttacgtcatctgtcttcctacagagaagggaaaaaaacaacaagtgaagaagaattatctacaggaaaaagacagaaaaaaaataggggttgattatcatccacatttcccactttccaaatctccatttaatattccatctcacttctctgatcttcttcattcccatctcacaggatctccttctcctcctatactctccctctctcctgtaccaggagaagcagaacaacaacaacaggaagaagagtacatccatcaaaattattcaggttatcttgaaccgaaaataagaaacgtatactgagtttttgtaagtaaagaatcatggctcgggctctggttcaatccacgaacctttcggcagtcattgttggtgaaaatcatggacaacttcaaggatcttctggaaaaaaacaaaaggacagtcaaaatgatgtgtaatgctcaagcttcgacaaagagaatgcaaggtttttcgggattacggggatccaatgctttggattcaatggtaaagtctgggatggatttccactttaaggtagcagctgcaatctctgctccacgtggaaagggaagccgtgctgtggctaaagctatgtttgaacgcttcacagagaaagctattaaagttatcatgcttgcacaagaggaagcaagacgccttgggcacaattttgttggcacagaacagatattattgggtcttattggtgaaggcactggaattgctgcaaaagttctcaagtccatgggaattaatttaaaggatgctcgcgttgaagtggagaagataatcggcagaggaagtggatttgttgctgtcgagataccattcactcctcgtgccaagcgtgttttggaactgtcacttgaggaagcgcgacaacttggccataactatattggatccgagcacctgcttttgggactgctccgtgagggtgaaggtgtagcagcacgtgtgcttgagaacttaggtgctgatccaagtaatattcgtacccaggttatccgcatggtaggtgagagcacagaagctgttggagctggagttggaggaggcagcagcggaaataagatgcctacacttgaggaatatggtactaatctcacaaaactggctgaagagggtaagcttgatccagttgttggtagacaaccacaaattgaacgtgtaactcaaattttgggtaggcgaacaaagaataatccctgcctcattggagaacctggagttggaaaaactgcgattgctgaaggacttgctcaacgaattgcaactggtgatgtgccagaaactcttgaggggaagaaggtcatcaccttggacatgggtttgctagttgcgggtacaaagtatcgtggagagttcgaagagaggttgaagaaactgatggaagaaattaagcagagtgatgagataatactcttcattgatgaggtgcatacacttattggagcaggagcagcagagggtgccattgatgctgccaacatcttgaaaccagctcttgcccgaggagaattgcagtgcattggtgctaccactcttgatgaatacaggaagcacatcgaaaaagacccagcattggaaagaagattccagccagtaaaagtgcctgaaccaactgttgatgagaccatactgattctaaaaggtcttcgagagagatacgagattcaccacaaattacgatacacagatgaagccctagttgctgcagcgaacttatcataccagtacatcagtgatcgcttccttcctgataaagcaatagacttgattgatgaagctggttctcgagtgcgactacgtaatgctcagcttcctgaggaagccagagaacttgaaaaggaattaaggcaaattacaaaggagaaaaatgaatctgttcgcggacaggattttgaaaaggctggggaattgagagacagagaaatggatcttaaagcccaaatatcagctctcattgacaagggcaaagaaagatccaaggcagagtctgaagcagctgatacaggtccaattgtgacagaggtcgatatacagcacatagtctcttcatggactggtattcccgtcgacaaggtctcctctgacgaatccgataaacttctgaagatggaagaaacgcttcacaagagggtcattggccaggatgaagccgttaaagccattagtcgtgctatccgccgtgcccgtgttggacttaaaaatcctaacagaccaattgccagcttcatattctctggacctactggtgttggaaagtcagaacttgctaagacactggctgcctactactttggctccgaggaagctatgattcggctagacatgagtgagttcatggagagacacactgtttcaaagctcattgggtctccacctggttacgtcggctacaccgagggtggtcagctgactgaagcagttagacggcggccttacacggtagtcctatttgatgagattgagaaagcccatcctgatgtcttcaacatgatgcttcagattttggaagatggtaggttgacagacagcaagggccgaaccgtggatttcaagaacacgcttttgataatgacctccaatgttggaagcagtgtgattgagaaaggaggtcgccggattgggtttgatctcgactacgacgagaaggacagtagttacaacaggataaagagcctcgtaacagaggagctcaaacagtatttcaggccagagttcctcaacaggttagatgaaatgattgtcttcaggcagttgaccaagttggaggtgaaggacattgcagacataatgttgaaggaggtgtttgagagactaaaagtcaaggagattgagctccaagtaacagagagattcagagacagagtagttgacgagggctacagccctagttacggagcaagaccgttgaggagggcaattatgaggcttctggaagatagcatggccgagaaaatgctccaaggagagattaaagaaggtgattcagttatcgtggatgttgatggcgatggaaatgtgacggtgctcaatggtagtaacactgggatcccggacgcacttcctccatccgttcctgtgtaaatcaagacccttcttctctgatggaacttttatgtctatggtctgtacttaatgaactaaatatcaagtaggtattagtaacaatatatttacataaaaaaaaaaactacacatatacagcagcttaattgggtgcatggctgaacctacgaaacttgttttcttcaccacaagcaatgcatgtattatttaggtgttggacagaaaagaa

SEQ ID NO: 3233 - DNA, 3100 bp, Papaver somniferum
cccatctcacaggacctccttctcctcctatactctccctctctcctgtaccaggagaagcagaacaacaacaagaggaagaagagtacatccatcaaaattattcaggttatcttgaaccaaaaataagaaacgtatactgagtttttgtaagtaaagaatcatggctcgggctctggttcaatccacgaacctttcagcagtcattgttggtgaaaatcatggacaacttcaaggatcttctggaaaaacaaaggacagtcaaaatgatgtgtaatgctcaagcttcgacaaagagaatgcaaggtttttcgggattacggggatccaacgctttggattcaatggtaaagtctgggatggatttccactctaaggtagcagctgcaatctctgctccacgtggaaagggaagccgtgctgtggctaaagctatgtttgagcgcttcacagagaaagctattaaagttatcatgcttgcacaagaggaagcaagacgccttgggcacaattttgttggcacagaacagatattattgggtcttattggtgaaggcactggaattgctgcaaaagttctcaagtccatgggaattaatttaaaggatgctcgcgttgaagtggagaagattatcggcagaggaagtggatttgttgctgtcgagataccattcactcctcgtgccaagcgtgttttggaactgtcacttgaggaagcgcgacaacttggccataactatattggatccgagcacctgcttttgggactgctccgtgagggtgaaggtgtagcagcacgtgtgcttgagaacttaggtgctgatccaagtaatattcgtacccaggttatccgcatggtaggtgagagcacagaagctgttggagctggagttggaggaggcagcagcggaaataagatgcctacacttgaggaatatggtactaatctcacaaaactggctgaagagggtaagcttgatccagttgttggtagacaaccacaaattgaacgtgtaactcaaatattgggtaggcgaacaaagaataatccctgcctcattggagaacctggagttggaaaaactgcgattgctgaaggacttgctcaacgaattgcaactggtgatgtgccagaaactcttgaggggaagaaggtcatcaccttggatatgggtttgctagttgcgggtacaaagtatcgtggagagttcgaagagaggttgaagaaactgatggaagaaattaagcagagtgatgagataatactcttcattgatgaggtgcatacacttattggagcaggagcagcagagggtgccattgatgctgccaacatcttgaaaccagctcttgcccgaggagaattgcagtgcattggtgctaccactcttgatgaatacaggaagcacatcgaaaaagacccagcattggaaagaagattccagccagtaaaagtgcctgaaccaactgttgatgagaccatactgattcttaaaggtcttcgagagagatacgagattcaccacaaattacgatacacagatgaagccctagttgctgcagcgaacttatcataccagtacatcagtgaccggttccttcctgataaagcaatagacttgattgatgaagctggttctcgagtgcgacttcgtaatgctcagcttcctgaggaagccagagaacttgaaaaggaattaaggcaaattacaaaggagaaaaatgaatctgttcgtggccaggattttgaaaaggctggggaattgagagacagagaaatggatcttaaagcccaaatatcagctctcattgacaagggcaaagaaaaatccaaggcagagtctgaagcagccgatacaggtccaattgtgacagaggtcgatatacagcacatagtctcttcatggactggtattcctgtcgataaggtctcgtctgacgaatctgataaacttctcaagatggaagaaacgcttcacaagagggtcattggccaggatgaagccgttaaagccattagtcgtgctatccgccgtgcccgtgttggacttaaaaatcccaacagaccaattgccagcttcatattctctggaccaactggtgttggaaagtcagaacttgctaagacactagctgcctactactttggctccgaggaagccatgatccgtctggacatgagtgagttcatggagaggcacactgtttcaaagctcattgggtctccacctggttacgtcggctacaccgagggtggtcagctgactgaagcagttcgacgtcggccttacacagtagtcctatttgacgaaattgagaaagctcatcctgatgtcttcaacatgatgcttcagattttggaagatggtaggttgacagacagcaaggggcgaaccgtggatttcaagaacacacttttgataatgacctctaatgttggaagcagtgtgatcgagaaaggaggccgccgcattgggtttgatctcgactatgacgagaaggacagtagttacaacaggataaagagcctcgtaacggaggagctcaaacagtatttcaggccagagttcctcaacaggttagatgaaatgattgtcttcaggcagttgaccaagttggaggtgaaggacattgcagacataatgttgaaggaggtgtttgagagactaaaagacaaggagattgagctccaagtaacagagaggttcagagacagagtagttgacgagggttacagccctagctacggagcaagaccattgaggagggcaattatgaggcttctggaagatagcatggccgagaaaatgctccaaggagagattaaggaaggcgattcagttatcgtggatgttgacggtgatggaaatgtaacggtgctcaatggtagtaacactgggatccccgacgcacttccaccatccattcctgtgtaaatcaagacccttctctgatggaactttgatgcccacggtgtctgtacttaattaactaaatatcaagtaggtattagtaacaatgtatttacattaaaaaaaatacactacacatacagcagcttaattgggtgcatggctgaacctatgatacttgttttcat

SEQ ID NO: 3234 - DNA, 3000 bp, Eutrema parvulum
cagcccccaactctgcattatggctaggctcttggctaattatacatcccgtcctttacttggtcctggaagacattttcagtccgaagaatacagaaaaccaagaagatgtgtgaagatgatgtacagtctacaaacaacggttttgagtattcagagcttctcagggttaagggcttccaatgcagtggatcgtgtggcaagacccagtcaagatttcttttctaaggttaaccttcaaatctcatcccggagagaaaaagctagccgatgtgtaccaaaagccatgtttgagcggtttaccgagaaagcaattaaggtcataatgctgtctcaagaggaagctcggagacttggccataactttgttgggactgaacaaatattgttgggtctaattggggaagggactggaattgctgcaaaggttcttaaatccatggggatcaaccttaaagattctcgtgtagaggtggaaaagatcattggaagaggcagtggatttgtggcagtggaaatcccatttactcctcgtgcaaagcgtgtcctggagttgtcactagaagaagctcgacaactagggcataactacattgggtcagagcatcttctgcttggtcttcttcgtgaaggggaaggtgttgcagctcgtgtcctggagaatttgggtgtcgatcctagtaacatccggacacaggtaatacgtatggtcggggaaaacaatgaagtgaccgcaagtgtcggtggaggatctagcggaaatagcaaaatgccaacactggaagaatatgggactaacttaactaaactagcagaggagggtaaactggatccagttgttggaaggcagccgcagattgaacgagtggtccagattttggctcgaagaaccaagaacaatccgtgtcttattggagaacctggagttggtaagacagcaatagctgaaggactcgctcagagaattgccagtggtgacgttcctgaaacaattgaggggaagacggttataacccttgatatgggtcttctagtggctggaacgaaatatcgtggagaatttgaggaaagattgaagaagcttatggaagaaatcagacaaagtgatgacataattctatttattgatgaagtgcacacgctgatcggtgcaggagccgccgaaggtgccattgatgctgctaacatcttaaagccagctcttgcaagaggtgaattgcagtgtattggtgcaacaacattggatgagtacaggaagcacatcgagaaagatcctgcattggagagacggttccagcctgtcaaggtacctgaaccaactgtagaggaagctatacagatcttgcacggtctgcgtgagcgatatgagatccaccacaagctccggtacactgacgatgccttggttgctgctgcgcaattgtcacatcagtacatcagtgatcggtttcttcccgacaaagcgattgacttgattgatgaagctgggtctcgggttcggctacgtcatgctcaggtccctgaggaagctagagagcttgaaaagcaactcagacagatcactaaggagaagaatgaagctgtgcgaggccaagactttgagaaggctggttctcaccgtgaccgtgaaatagagcttagggccgagatagctgctgtcttagccaaaggaaaagaagtgagcaaagctgagactgaagttggcgaaggaggacctactgtcactgaatccgacattcaacacattgtttcgacctggacgggaatcccggtagagaaggtctcatctgatgaatctagccgccttctcaaaatggagcagactcttcacacaagaatcattggccaagatgaagccgtcaaagctattagccgagccatccgacgtgcacgtgttggacttaagaatccgaaccgcccaattgcaagtttcatcttctctggtccaaccggtgtggggaaatcagagcttgccaaagccttggctgcttactacttcggttcagaagaagcaatgatccgtctggacatgagtgagttcatggaacgacatacggtttcaaaactcataggttcacctcctggttatgtaggatacaccgaaggaggtcagttaactgaggctgttcgacgcaggccctacacactcgtcctctttgatgaaatcgagaaagcccatccagatgttttcaacatgatgcttcagatcctagaagacgggagactaactgacagcaaaggaagaaccgtcgatttcaagaacacgcttctgatcatgacatcaaacgtaggaagcagcgtgattgaaaagggcggtcgaagaattgggtttgatctcgactacgacgagaaagacagcagctacaacagaatcaagagcttagtgactgaggaactaaaacagtatttcagaccggagttcttgaacaggttagatgagatgattgttttcagacagttgacgaagctcgaagtgaaggagattgctgatataatgcttaaagaagtggtggtgaggctcaaggacaaagagattgagcttcaagtgactgagaggtttaaagagagagtggtggatgaaggcttcgacccaagctacggtgcgaggccgcttagacgagctattatgaggcttttggaagacagcatggctgagaagatgctttcaagagacattaaagatggagattctgtgattgttgacgttgatgcagaaggaagtgtggttgtgttgaatggtaaaagtggaggtggtggtggttttgtggctggagaagccatggaagaagatccagttcctgtgttgtagaaggaaacacaagggttctagtcttctagagattattctttcctttttaagtggttattgaattgtgtctcattttagtcgcttttgttttctactgtttttgtttctggatatttgattgttcgctcgggaactaatggaaaatttcccaacaaaaaaaaaataacagggttagagctgaagagttagtt

SEQ ID NO: 3235 - DNA, 2984 bp, Eutrema parvulum
agcccccaactctgcattatggctaggctcttggctaattatacatcccgtcctttacttggtcctggaagacattttcagtccgaagaatacagaaaaccaagaagatgtgtgaagatgatgtacagtctacaaacaacggttttgagtattcagagcttctcagggttaagggcttccaatgcagtggatcgtgtggcaagacccagtcaagatttcttttctaaggttaaccttcaaatctcatcccggagagaaaaagctagccgatgtgtaccaaaagccatgtttgagcggtttaccgagaaagcaattaaggtcataatgctgtctcaagaggaagctcggagacttggccataactttgttgggactgaacaaatattgttgggtctaattggggaagggactggaattgctgcaaaggttcttaaatccatggggatcaaccttaaagattctcgtgtagaggtggaaaagatcattggaagaggcagtggatttgtggcagtggaaatcccatttactcctcgtgcaaagcgtgtcctggagttgtcactagaagaagctcgacaactagggcataactacattgggtcagagcatcttctgcttggtcttcttcgtgaaggggaaggtgttgcagctcgtgtcctggagaatttgggtgtcgatcctagtaacatccggacacaggtaatacgtatggtcggggaaaacaatgaagtgaccgcaagtgtcggtggaggatctagcggaaatagcaaaatgccaacactggaagaatatgggactaacttaactaaactagcagaggagggtaaactggatccagttgttggaaggcagccgcagattgaacgagtggtccagattttggctcgaagaaccaagaacaatccgtgtcttattggagaacctggagttggtaagacagcaatagctgaaggactcgctcagagaattgccagtggtgacgttcctgaaacaattgaggggaagacggttataacccttgatatgggtcttctagtggctggaacgaaatatcgtggagaatttgaggaaagattgaagaagcttatggaagaaatcagacaaagtgatgacataattctatttattgatgaagtgcacacgctgatcggtgcaggagccgccgaaggtgccattgatgctgctaacatcttaaagccagctcttgcaagaggtgaattgcagtgtattggtgcaacaacattggatgagtacaggaagcacatcgagaaagatcctgcattggagagacggttccagcctgtcaaggtacctgaaccaactgtagaggaagctatacagatcttgcacggtctgcgtgagcgatatgagatccaccacaagctccggtacactgacgatgccttggttgctgctgcgcaattgtcacatcagtacatcagtgatcggtttcttcccgacaaagcgattgacttgattgatgaagctgggtctcgggttcggctacgtcatgctcaggtccctgaggaagctagagagcttgaaaagcaactcagacagatcactaaggagaagaatgaagctgtgcgaggccaagactttgagaaggctggttctcaccgtgaccgtgaaatagagcttagggccgagatagctgctgtcttagccaaaggaaaagaagtgagcaaagctgagactgaagttggcgaaggaggacctactgtcactgaatccgacattcaacacattgtttcgacctggacgggaatcccggtagagaaggtctcatctgatgaatctagccgccttctcaaaatggagcagactcttcacacaagaatcattggccaagatgaagccgtcaaagctattagccgagccatccgacgtgcacgtgttggacttaagaatccgaaccgcccaattgcaagtttcatcttctctggtccaaccggtgtggggaaatcagagcttgccaaagccttggctgcttactacttcggttcagaagaagcaatgatccgtctggacatgagtgagttcatggaacgacatacggtttcaaaactcataggttcacctcctggttatgtaggatacaccgaaggaggtcagttaactgaggctgttcgacgcaggccctacacactcgtcctctttgatgaaatcgagaaagcccatccagatgttttcaacatgatgcttcagatcctagaagacgggagactaactgacagcaaaggaagaaccgtcgatttcaagaacacgcttctgatcatgacatcaaacgtaggaagcagcgtgattgaaaagggcggtcgaagaattgggtttgatctcgactacgacgagaaagacagcagctacaacagaatcaagagcttagtgactgaggaactaaaacagtatttcagaccggagttcttgaacaggttagatgagatgattgttttcagacagttgacgaagctcgaagtgaaggagattgctgatataatgcttaaagaagtggtggtgaggctcaaggacaaagagattgagcttcaagtgactgagaggtttaaagagagagtggtggatgaaggcttcgacccaagctacggtgcgaggccgcttagacgagctattatgaggcttttggaagatagcatggcagagaagatgctttcaagggacattaaagatggagattctgtgattgttgatgttgatgcagaaggaagtgtagttgtgttgaatggtaagaacggagatggtggcggttttgttgctgaagaagccatggaagatccaattcctgtattgtagaagggaagagaagggttctagagatttaatttttcttctttatcattgaagtgttgttgaattgtgtgtcatttgattcgtttttgtattttaaattgtttctggatattgattgctcgggaaccatggagagtttccctcaacaaaaaaaaaataacagggttagagctgaagagtta

SEQ ID NO: 3236 - DNA, 3433 bp, Panax ginseng
gctttagacacaatggtaaaatctggccatgatttccattccaaggtggcagctgcgacctctgtccgccgaggaaaagccagccgaattgcaccaaaagctatgtttgagcggttcacagaaaaagctattaaagttattatgcttgcacaagaggaggcaaggcggcttggtcacaattttgttggcactgagcagatattgttgggtctaattggtgagggcactggcatagctgctaaagtgctcaagtcaatgggtatcaacttgaaagatgcgcgcgtggaggtagagaagatcattggtaggggtagtggatttgttgctgtagagattccctttactccacgtgcaaagcgtgttctagaactctcactagaggaagcccgccaacttggtcataattatattggatctgagcacttgttgttggggttgcttcgtgagggtgaaggtgtagcagcacgagttcttgagaatctaggtactgaacctaataatattcgcacacaggttatccgaatggttggtgagagtgtagaagcaggtgccactgttggaggtggaagctctggcaacaaaatgccgacactggaggagtatggtactaatttgacaaagctagcagaggagggtaaactggatcccgttgtaggaaggcagcagcaaattgaacgtgttactcaaattttgggacggcgaacaaaaaataatccctgcctgattggagagcctggtgttgggaaaacagctattgcagaaggccttgctcaaaggattgctactggtgatgttccagaaactatagaggggaagaaggttataactttggatatgggtcttcttgttgctggcacaaaatatcgtggggagtttgaggagcggcttaagaagcttatggaggaaattaaacaaagtgatgaaattatactatttattgacgaggtgcacacattaattggagcaggagcaggagcaggagcagcagagggtgccattgatgctgcgaacatcttgaaaccagcccttgctagaggcgaattgcagtgtattggggccacaacacttgatgaatacagaaagcacattgagaaagacccggcattggagaggcgatttcagccagttaaggtgcctgaacccacagtggatgaaaccatacagatcctgaaagggctcagagagcgatatgagattcaccacaagcttcgatatactgatgaagccttagtttctgcagcacagctgtcataccaatacatcagtgaccgctttcttcctgataaagcaattgacttaattgatgaagctggttctagggtccgacttcgtcatgcacagctcccagaggaagccagagagcttgaaaaagagcttaggcagataacgaaagagaagaacgaagcagttcgtagccaggattttgaaaaggctggggagttacgtgatagagaaacagatcttaagacacagatatctgctcttgtagacagaaacaaagagatgaccaaggcggagactgaggcaggggatgggggaccccttgtgatagaagtggacattcagcacattgtctcttcgtggacaggcatacctgtcgagaaagtgtcaactgatgaatctgaccgtcttctcaagatggaagagaccctccacacacgaatcattggtcaggatgaaggtgtcaaagccatcagccgtgctattcatcgtgcccgagttggactcaagaatcctaatcggcccattgctagctttatcttttctggtccaactggtgttgggaagtcagagctagcaaaggctttagctgcctactactttggctctgaagaagctatgattcgtctcgatatgagtgaattcatggagagacacacagtctcgaagctcatcggttcacttcctggctacgttggttacaccgagggtggtcagctaactgaggctgtaaggcgccgtccttacacagtggtactctttgatgagattgagaaggctcagcctgatgttttcaacatgatgcttcagattctggaggatggtaggttgacagacagcaaaggtaggactgttgacttcaagaacacgctattgattatgacatcaaatgttggaagtagtgtgattgagaagggaggtcgtcgaataggttttgatctcgattacgatgagaaggatagcagttacaaccgtatcaagagcctggtaactgaggaactaaaacaatatttcagaccagaattcttgaatagattggatgagatgattgtattcaggcagttcaccaagctggaggtgaaagagattgcagatatcatgctcaaggaagtcttcgagaggctgaagggtaaagatattgaacttcaggttacagagaggtttagggatagggtggttgaggaaggatacaacccaagctatggggccaggcctctaagaagagccataatgagactcttggaggacagtatggccgagaagatgcttgccagagaaatcaaagagggtgattcagtaattgttgatgttgattctgatggtaatgtgactgttctaaatggcagcagtggtgcccctcctcctgagtcattaccagagccaattgccgtatagattaatatttgtttgtccgactatttttccccccttcccaatatatttgtttgtatggctggttttcattgaattagctacaagtagtattttttctgtgaagaggctggttgacagtagattagatgccggtctcggtggctgtgttttaaggctgcatctgttacccaggaaggtatgcatacttggatcaatttgtagatgttattaatgttagatgtcaagagatatggtaataaaataggacatataaattaaatgtcacttaatgatttctgtgacttgatcaataattttagttgtgtatcgatactggtatgatttcaagtttcaacaataaaaaaaaaaaaaaaaaaaaaaaaaaaaaaaaaaaaaaaaagaaaaaaacaactatagtagtagagatatactgctctctacttactactactaactactacaacgactagtatatacgacccggaccggacgtctacgtacggcggactacctcctacgtacttcggttcggtcggtactaccttcctttcgtttcgttactagtaaccgttaacggttttcggttacgtattagttaagtaactaagtcggtacctaccgtaaggttaaaaggtttaagtaagttctagtataatttcttcgtaaggaatactaattagttaaacttaataactaaactaacgaaacccaacgtagacgtgagtaaggaagacatactagataactaccgtctatcttactaattaacttctgttgcgtactaattaatgaacttctcgttacgggaactaaccaaccaccaacgaggtagtaaaac

SEQ ID NO: 3237 - DNA, 3076 bp, Brassica napus
agcctccaactcttgcatcatggctaggctcttggctaattctacatcccgttctttacttggttccggaagagactttcagtcagaagactacagaaaaccaagaagatgcgtgaagatgatgatgtacacttctcaaacatccgttttgagtatccacagcttctccggtttaagggcttcttccaatgcactggatcgtgtggcaaggcctagccacgactttttcggtaaggttaaccttcaaatctcctcctcacgtaaaggcaaagctagccgaggtgtaacaaaagccatgtttgagcggtttaccgagaaagcaatcaaggtcatcatgctctctcaagaggaagctcggaggcttggccataactttgttggcactgagcaaatactcttggggctgattggggaaggcactggaatcgctgcaaaggttcttaaatccatggggatcaatcttaaagattctcgtgtggaggtggaaaagatcattggaagaggcagtggttttgtggctgtggagatcccatttactcctcgtgcaaagcgtgtcctggagctctcacttgaggaagctcgacagcttgggcataactacattgggtcagagcatcttctgcttggtcttcttcgtgaaggggaaggtgttgcagctcgtgtcctggagaatttgggtgtagatgctagcaacatccggacccaggttatacgtatggtgggagaaaacaatgaagtgacggcaagcgtgggtggaggatctagcggaaacagcaaaatgccaacactagaagagtatgggaccaacttaaccaaactagcagaagagggtaaactggatccagttgttggaaggcagccacagattgaacgagtggtccagatcttggctcgaagaaccaagaacaacccttgtcttattggagaacctggagttggtaagactgcaatagctgaagggctcgcacagaggattgccagtggagatgttcctgaaacaattgaggggaagacggttataacactcgatatgggtcttcttgtggctggaaccaagtaccgtggagaatttgaggaaagattgaagaagcttatggaggagatcagacaaagtgatgacataatcctgtttattgatgaagtgcacacgctgatcggtgcaggagccgctgaaggtgccattgatgctgctaacatcttaaagcctgctcttgcaagaggtgaattgcagtgtattggtgcaacaacattggatgagtacaggaagcacattgagaaagatcctgcactggagagacggttccagcctgtcaaagtacctgaaccaactgtagacgaagctatacagatcttgcacggtctgcgtgagcgttatgagatccaccacaagctccgctacactgatgaagctttggttgctgctgcgcagttgtcacatcagtacatcagtgatcgatttcttcctgacaaagccattgacttgattgatgaagctggatctcgggttaggctgcgtcacgctcaggtccctgaggaagctagagagcttgaaaggcaactcagacagatcactaaggagaagaatgaagctgtgcgaggccaagactttgagaaggctggttctcaccgtgaccgagaaatagagcttagagccgagatagctgctgttttagccaaaggcaaagaagtgaacaaagctgagactgaagcaggggaagaaggaggacctactgtcactgaatccgacatccaacacattgtctccacctggacaggaatcccagtagagaaagtctcgtctgatgaatctagccgtcttctcaagatggagcagacacttcacacaagagtcattggccaagacgaagccgtcaaagctattagcagggccatcagacgtgcacgtgttggactcaagaacccgaaccgccccatagcaagtttcatcttctctggtccaaccggtgtgggaaaatcagagcttgcaaaagccttggctgcttactacttcggttcagaggaagcaatgatccgtctcgacatgagtgagttcatggagcgacacacggtttcgaaactcattggttcgcctcctggttacgtaggatacacggaaggaggccagctaactgaagctgttcgacgcaggccctacacgcttgtcctcttcgacgaaatcgagaaagcccatcccgatgttttcaacatgatgcttcagatcctagaagacgggagactaactgacagcaaaggaagaaccgttgatttcaagaacacgcttctgatcatgacatcgaacgtaggaagcagcgtgattgaaaagggtggtagaagaatcgggtttgatctcgactacgacgagaaagacagcagctacaacagaatcaagagccttgtgactgaggaactgaaacagtatttcagaccagagttcttgaacaggttggatgagatgattgttttcagacagttgacgaagctggaagtgaaggagattgctgatataatgcttaaagaagtggtggtgaggcttaaggacaaggagattgagcttcaagtgactgagaggtttaaggagagagtggtggatgaagggttcgatccgagttacggtgcgaggccgcttagaagagcgattatgaggcttttggaagacagcatggcggagaagatgctttcaagggagattaaggatggagactctgtgattgttgatgttgatgctgaaggaagtgtggttgtgttgaatggtaagaacggaagtggtgacggttttgttgctgaagaagccatggaggatccaattcctgtgttgtagaagggaagaggagagttatagagattttatttttcttcttaatctctttgaagtgttgttgaactgtctcatttgattttgtttttgcatttttaaattgtttctggatattgattgctcgggaaccatggtgagcttccctcaacacaaaaaaaaagaagagaataatatggtcagagctgaatcgagtttaaaaaaaaaaaaaaaaaaactcgagactagttctcatctctctcctcgtgccgaatcctcgcccgg

SEQ ID NO: 3238 - DNA, 2778 bp, Triphysaria pusilla
aggaagaaaatcaagaatggccccacgagccatgtttgagcggttcacggagaaagcaataaaggtgattatgctcgcacaagaggaggcgagaaggctcggtcataatttcgttgggactgagcagattttgctgggactcattggcgagggcactgggattgctgctaaagtcctcaagtccatgggaattaatctgaaggacgctcgtgtagaggtggagaagataattggacgaggcagtggttttgttgcggtggagattccttttactccccgtgcgaaacgtgttcttgagctctcgctagaggaagcccgtcagcttggtcacaattacattggatcggagcacttgttgctgggattgcttcgtgagggtgaaggtgtggcagctcgtgtccttgagaatttaggtgctgacccgagtaatattagaactcagattattagaatggtaggtgagagtgcagaggttgttggtgctggagttggaggtggaagctcaggcagcaaaatgcctacactggaggagtatggtaccaatttgactaagctagcagaagagggtaagctagaccctgttgtcggaaggcagttgcaaattgaacgtgttgttcaaattttgggacgacgtactaaaaacaatccttgcctgattggtgaacccggagttgggaaaacagccattgcagagggtcttgctcagagaatagcgactggagatgtccctgagacgattgagggtaaaaaggttataactctggatatgggtcttctcgttgctggtacaaagtatcgtggtgaatttgaagaaaggctgaagaaactgatggaggaaattaggcaaagtgatgaaatcatactcttcattgatgaggtgcacacgttgatcggagcaggagctgctgaaggggcaattgacgctgcaaacattttgaaacctgctttagctcggggcgaactacagtgtattggggctactacactggatgagtaccgaaagcacatagaaaaagatccagcattagaaagaaggtttcaacctgtgaaggtccctgagcccactgtggacgaagcaattcagattcttagagggcttcgtgaacgctacgagatacaccacaagcttcgttacactgatgatgcaatagttgctgcagcccaattggcccatcaatatatcagtgatcgctttttgcctgataaagcaattgacttgattgatgaagctggttctcgagtccgccttcgccatgctcagcttccagaggaagctaaagagcttgagaaagagctcaggcagataacaaaggagaagaacgaagctgttcgaggtcaagattttgagaaggctggggaattgcgcgatagagaaatggatctcaggtcccaaatatcaactctcatagacaaaaacaaggagatgaccaaggcggaaaccgaagccggggacgagggccccaccgtcactgaggtcgacatccagcacattgtctcctcctggacaggcatccccgtcgataaagtctcgaccgatgaatctggccgtctcctcaagatggaggagaccctccacaaacgtgtcatcggccaagacgaagccgtcaaggctataagccgggccatccgtcgggcccgtgtcgggctcaagaaccccaaccgcccgattgccagcttcatcttctccggcccaactggcgtcggcaagtcagagctggcaaaatcgctcgccacctgctacttcgggtccgaggaggccatgatccgactcgacatgagcgagttcatggagcgacacaccgtctcgaagctcatcgggtcgccacctggatatgtcggttacactgagggtgggcagttgactgaggccgttagacgccgtccttacaccgtcgtgctctttgacgagatcgaaaaggcccatcccgatgtcttcaacatgatgcttcaaattcttgaagacgggaggttgaccgatagcaagggccggacagttgacttcaagaacacgttactgataatgacgtcgaacgtcgggagcaatgtgatcgagaagggtggccgtcggattgggttcgacctggactacaacgagaaagatagtagttataatcggatcaagagcctcgtgacagaggagctcaagcagtatttcaggcctgagttcttgaacagattggacgatatgatcgttttcagacagctgacgaagctggaggtgaaggagatttcggatatcatgctgaaggaggtgtttgtgaggttgaaggagaaggatatcgagcttcaagtgacggagaggtttagagatagagtggttgacgagggttatgatccgagttatggtgcaaggccgttaagaagggcgattatgaggcttttggaggatagcatggccgagaagatgcttgctcgagagattaaggagggcgattcggtaattgtggatgttgattccgatgggaaagtggtagttttgaatggtagtggtggggccgcacccgaaccggctcctgagccagtggttgtgtaggtttgctgatttaggtttgttttgtaacttatattcttgttgactagtgcaataaaatttctcattgatcttccatttttcaaaatgttaaagagcaaaaaaaaaaaaaaacgatcaggaaaagggttgtaaagttatttggtttgattgctcaacagctttttttctggttggccacatatatttataaatttatgatttggctgaaaatatattattggggttttctggccctgtttgacttt

SEQ ID NO: 3239 - DNA, 2603 bp, Flaveria ramosissima
acaaaacgagcagtcaagatgatgtgtagcttacaagctcctccaatgagggtgaggactttttctggtttgcggggagccaatgctttagacaacttggtcaaaagaggccaggatttccactcaaaagttgcagctgccacctcggttcggaaagcaaagcctagtagaattgtaccaaaggctatgtttgaacgcttcactgagaaggctattaaagtcattatgcttgcacaagaggaagcgagaaggcttggccacaattttgttggtacagagcagattttattaggtcttattggtgagggcactggcattgcagcaaaggttctgaagtcaatgggaattaatttaaaagatgcacgtgttgaggtggaaaagattatcggaaggggtagtggatttgttgctgtagagattccatttactcctcgtgccaaacgtgtactggaactctcactagaggaggctcggcaacttggtcataattatattggatcagagcatttgcttcttggtttgcttcgagaaggtgaaggtgtagcagctcgtgttcttgagaatttaggtgcagacccaaataacattcgcacacaggtgatcaggatggttggcgagagtgcagaagccgtgggcgctggagttggtggcgggacctctggtaacaagatgccaacattggaggaatatggtaccaacttaacaaagctagcagaggagggtaaactggatcctgttgttggaagacagccacaaattgaaagagttactcaaattcttggacggcgtacaaaaaacaatccttgtttaattggagagcctggtgtcggaaagactgctattgcagaaggccttgctcaaagaattgctaatggcgatgtcccagaaacaatcgaggggaagaaagtgataactttggatatgggtctccttgttgctggcacaaagtaccgtggggagtttgaagaaagactaaagaagctgatggaggaaatcaagcaaagtgatgaaatcattctctttattgatgaggtccatacattaattggagcaggagcagcagagggagctattgatgctgcaaacatcttgaaacctgctcttgctcgtggtgaattacagtgtattgggctacaacccttgatgaatatcgaaagcacattgagaaggacccagcactggagagacggttccagcccgtaaaggtgcccgagcccacagttgatgaaaccatacagtattttaaaggggcttcgcgaacgatacgaaattcaccacaaacttcgctacacagatgatgcactggtagctgctgcccagctgtcatatcagtacataagtgaccgttttctgcctgataaggctattgatctaatcgatgaagctggttctcgtgttagacttcgtcatgcacaactcccagaagaagctagagagcttgagaaagaacttaggcagataacaaaagagaagaacgaagcagttcgtggccaagacttcgaaaaggctggggagttgcgtgatcgggaaatggatcttaaaactcagatatccgctcttgtggacaagaacaaggagatgagcaaagccgagactgaggcgggagaggagggccccactgtaactgaagcggacattcaacatatcgtctcatcatggactggcatcccagttgaaaaagtgtctacagatgaatcagaccgtctcctcaagatggaagaaacactccacacaagaatcattggtcaagatgaagcggtcaaagccattagccgtgccatccgccgtgctcgtgtcggactcaaaaccccaccgtcccattgccagtttcatcttctcgggacccactggtgttggtaatctgaactcgcgaaagctttagccgcttactacttcggctctgaagaagccatgatccggctggacatgagtgagtttatggagcgacacactgtctcaaagctcattggttcacctcctggttacgttggctacacagaaggcggtcagttaacagaggcggtccgccgccgccttacaccgtcgtcctattcgacgaaatcgaaaaagctcaccctgacgtcttcaacatgatgcttcaaatccttgaagatggaaggttgaccgacagcaaaggacgtaccgttgacttcaagaacacacttctaatcatgacctcgaatgtgggtagcagtgtaatcgaaaaaggtggaaggagaatcgggtttgacctcgattatgacgagaaagacagcagctacaacagaatcaagagcctggtgactgaagaactaaagcaatatttcaggcccgattcttgaacagattagatgagatgatcgtgttcagacagttgaccaaactggaattcaaagagattgctgatattttgttgaaggaagttttcgagaggctaaaaaggtaaagaatttgaactttcaagtaaccgagaggtttagagaccgtgtgtggaggaaggttacaatcctagctatggtgcgagggccattaagacgggctatcatcgcggctagttggtaagactagacatgggacggaaaagatgcttgcgaccgcgaatatacgaaggagggacggattct

SEQ ID NO: 3240 - DNA, 3205 bp, Panax ginseng
catctatcttccaatccggccgaccggtcttaagttggtctctctctctctcgctcgctcgctcgttgaagaggaagaccttagccctcacccctctaaccctcaacttgtattcataactcaccatctgattaagattacctggtggcaatcatggcaagggctttggttcagtcaactaacttcccttcttcagttgctggtgagaggaacggtcaatttaagggatctgggaaaacaaaaagaactgttaagatgatgtgtactttaagaactgttccaataaggataagaggtttttcaggattacgaggagccaatgctttggatgccatggtaaaatctgggcatgatttccattccaaggtggcagctgcaatctctgttcgacgaggaagagccagtcgaagtgtaccgaaagctatgtttgagcggttcacagaaaaagcaaataaaagttattatgcttgcacaagaggaggcaaggcggcttggtcacaattttgttggaacagagcagatattgttgggtctcattggcgagggcactggtattgctgctaaagtgcttaagtcaatgggtatcaatttgaaagatgcgcgtgtggaggtagagaagatcattggtaggggcagtggatttgttgctgtagagattccctttactccccgtgcaaagcgtgttctagagctctcactagaggaagcccgccaacttggtcataattatattggatctgagcacttgctgctggggttgcttcgtgagggtgaaggtgtagcagcacgagttcttgagaatctaggtgctgaccctaataacattcgtacacaggttattcgaatggtcggggagagtcaagaagctggtgctgttgttggaggtggaagctctggcaacaagatgcctacactggaggagtatggtactaatttgacaaagctagcagaggagggtaaactggatcctgttgtaggaaggcagcagcaaattgaacgtgtaacccaaattttgggaaggcgaacaaaaaacaatccctgcctcattggagagcccggtgttggcaaaacagctattgcagaaggccttgctcaaaggatcgcaactggtgatgttccagaaacaatagaggggaagaaggttataaccttggatatgggtcttcttgttgctggcacaaaatatcgtggagagtttgaggagaggctgaagaagcttatggaggaaattaaacaaagtgatgaaattatattatttattgatgaggtgcacacactaattggagcaggagcagcagaaggagccatcgatgctgcgaacatcttgaaaccagcccttgctagaggagaactgcagtgtattggggccacaactcttgatgaatacagaaagcacattgaaaaagacccggcactggagaggcgatttcagccagttaaggtacctgaacccactgtggatgaaaccatacagatcttgaaaggactcagagagcgatatgagatccaccacaagcttcgatatactgatgaagccttggtttctgcagcacagctgtcataccagtacatcagtgaccgatttcttccggataaagctattgacttaattgatgaagccggttctagagtccgacttcgtcatgcacagctcccagaggaagccagagagcttgagaaagagcttaggcagataacaaaagagaagaacgaagccgttcgcggccaggactttgaaaaggctggggagttacgtgatagagaaatggatctgaagacacagataactgctctagtagagaaaaacaaagagatgagcaaggcggagaccgaggcaggggatgatggtcccatagtgacagaagtggacattcagcacattgtctcttcgtggacgggcatacctgttgagaaagtgtcaactgatgaatctgaccgcctcctcaagatggaagagacgctccacacacgagtcgttggtcaggatgaagccgtcaaagccatcagccgtgctatccggcgtgcccgagttggactcaagaatcctaaccgacccattgccagctttatcttttctggtccaactggtgttggaaagtcggaactagcgaaggcgttggctgcctactacttcggctctgaagaagctatgatccgacttgatatgagtgaattcatggagagacacacagtctcaaagctcattggttcacctcctggatatgttggttatactgaaggtggtcaactaactgaggctgttaggcgccgtccttacacagttgtgctctttgatgagatcgagaaggctcaccctgacgtatttaatatgatgcttcagattctggaggatggtaggttaacagacagcaaaggtagaactgtcgacttcaagaacacattattgattatgacgtcaaatgttggaagtagtgtgattgagaagggaggccgccggataggttttgatcttgattacgacgagaaggatagcagttacaaccgtatcaagagcctggtaacagaggaactgaaacaatacttcaggccagaattcttgaatagattggatgagatgattgtattcaggcagctaaccaagctagaggtgaaggagattgcagatattatgctcaaggaagtcttccagaggttgaaggccaaagacattgaacttcaggttacggagaggtttagggatagggtggttgaggaaggatacaacccaagctatggggccaggcccctaagaagagccataatgagactcttggaggacagcatggcggagaagatgcttgctagagagattaaagagggcgattcagtaattattgatattgattctgatggtaatgtgactgttctcaatggcagcagtggtgctcctcccgaggcattacaagagcctgtcgcagtgtagatgagtactcttttagttggacttttttaccaccgtcttgtttgtattctgatttttgttcaattctctatgaagtctcatttttatttttatttttattttttgcttgaagaggctggtggtcggtagactaaagctggtctcagtcagtagctttgtttcaaggctgtttccccggaagacttgatagtaaatgtttagtgttagatttgaagatatttggttataaataggcctttagttgaaggttggtaactcattctttgtgtatttaaataaaac

SEQ ID NO: 3241 - DNA, 2747 bp, Tropaeolum majus
ctttacagaaaaagcaattaaagtcattatgcttgcccaagaggaagctagacgactcggccacaattttgtgggcaccgagcagattctcttaggcctaattggtgaaggtacaggtattgccgccaaggttcttaagtccatgggaatcaaccttaaagatgcacgcgtagaagtagagaagattataggaaggggtagtggatttgttgctgtggagattccattcactcctcgtgcaaaacgtgttcttgaactctcattggaggaagctcgccaacttggtcataattatattggatcggagcatctacttcttgggctgcttcgtgagggcgaaggtgtggcagctcgcgtcctggagaatttgggtgctgatccaagtaacatccgtacgcaggttatacgcatggtgggtgagaacaatgaagttcctgctaatgttggaggaggatccagtaacaataagatgccaacactcgaggagtatggaactaatttgaccaagttagctgaggagggtaagttggatcctgttgttggaaggcagccacaaatagaacgtgtggttcaaattttgggcagacgaaccaagaataatccatgtcttattggagaacctggtgttgggaaaacagcaattgcagaaggccttgctcagcgaattgctagtggtgatgttccagaaacaatcgaggggaagaaggtaataacccttgatatgggtctccttgttgccggaacaaaatatcgtggagagtttgaggaacgattgaaaaagcttatggaggaaatcaaacagagtgatgaaataattctctttattgatgaagtgcataccttaattggagcaggagcagcagaaggggcgattgatgctgcaaacatcttgaagccagctcttgcaaggggtgaattacagtgtatcggggcaacaacactggatgaatacagaaaacacattgagaaagatcctgcattagaaagacgattccagccagtgaaggtgcccgagccaactgtagatgaaactattcagattttgaaagggctgagagagcgatatgagatccaccacaagcttcgttacacagatgaggccctagtggctgctgcacaactctcgtaccagtatatcagtgaccgctttttacctgataaggcaattgacttgattgatgaagctggttcaagggttcggctacgtcatgcacaggttcctgaggaagctagagagcttgaaaaagagctgagacaaatcaccaaggagaagaatgaagctgttcgaggccaggactttgaaaaggctggcacattgcgggatagagaaattgaacttagggctgagattactgccatccaaaccaaaggcaaggagatgaacaaggcagaaaatgagacaggagatacaggtccgctagttacggaagtggatattcaacacattgtttcttcatggactggcatccctgtcgagaaggtatcaactgatgaatctgatcgtctcctgaagatggaagaaacccttcacaagcgagtcattggtcaggatgaggctgttaaagctataagtcgtgctatccgacgtgcccgtgttggacttaaaaatcccaatcgacccattgctagcttcatattttcaggcccaactggtgtagggaagtcggaactggcgaaagctttggccacttattactttggttcagaagaagcaatgattcgtcttgacatgagtgagttcatggaaaggcatactgtctccaagctcattggttctcctccaggttatgttggttataccgaaggtggtcagctaacagaagcagtcaggcgtcgtccttatactgttgtactttttgacgagattgagaaggcacatcccgatgtcttcaacatgatgcttcaaattcttgaggacggaaggttgacagacagcaagggaagaacagttgacttcaagaatacccttctgataatgacatctaatgtgggaagcagtgtaattgagaagggaggtcgacgtataggatttgacctcgactacgatgaaaaggacagtagttacaatagaattaagagtctggttacggaggaactgaaacaatatttcaggccagagttcttgaacaggttggatgagatgatcgtgttcaggcaactcaccaagctggaggtaaaagatatagccgatataatgctcaaggaggtgtttgacagattgaagactaaagatatcgagcttcaagtgacggagaggtttagagaaagggttgttgatgaaggatacaacccgagctatggagcaaggcctttgagaagagccattatgagacttctagaggacagcatggctgagaagatgcttgcaagagaaatcaaagagggtgattcagtaattgtggatgttgattctgatgggaatgttacggtgctgaacggaagcagtggtgcacctgaatcattggaggaggatcctattcctgtcgtgtagactccggatctgcccatatagttgtagtctatttttttctagcttaaggactgctctgctatttgattgaatctgccccattttatcatgggaaatggcatatgcttagtaagtgtaactattgtattataacatcatgtaatgatttgtacgctttgtaagactttacacttgaacattatcttcttatggaaaatatatgcattgaaggtcaaatttctttagacaaaaaaaaaaaaaaggaaaccgctagaga

SEQ ID NO: 3242 - DNA, 3564 bp, Papaver somniferum
gcaacaaaggcgagagacctttaggatctcgttctgtatctcaaaataaaaaccctagttttcattaaagattcattcaaggggtttacttctctctggattcttaagtctgtttataactggtgagaaccatggccggggctcttgttcaatctacgaatatccgctcttctatatcttctacatttggcaaaagtcatgacaagaaacaaagaggcagttctgggtcagccaacagaaggactgttaaaatgttatgtaatagtgttcaaatgcgggggttgagaatctcagcaccatctttgatagtaggaggttttaatggacttcgaggaactaacgctctagataattggtattttctggccatgattttcaattctaaggtagcacctatctatagctgcacctcgcggaaggggtagtcggtgtgttgctagagctatgtttgagagattcacagagaaggctattaaagttatcatgcttgcacaagaggaagcaagacggttgggtcataattttgttgggactgagcagatattgttagggcttatcggtgaaggtactggtattgctgcaaaggttcttaaatctatgggaattaatcttaaggatgctcgtgtggaagtagaaaagatcattgggagaggtagtgggtttgttgctgtcgagataccatttactcctcgtgcaaagcgtgttttggaactttcactagaagaagcacgccaacttggacataactatattggctctgagcatttgcttcttggtttacttcgtgagggtgaaggagtggctgcccgtgtacttgaaaaccttggggccgacccaaacaacatccgcacacaggttatccggatggttggtgaaagtactgaagctgtaggtgctggtgttggaggaggtagcaccaacagtaagatgcctacactcgaggagtatgggaccaatttaacaaaactggctgaggagggaaaattagatcctgttgttggaagggcagcacaaatagagcgtgtaacccaaattttgggaagacgtacaaagaacaacccttgcttgattggagaacctggtgtgggtaaaactgcaatcgctgaagggcttgctcagagaattgcaagtggtgatgtgccagaaacgattgagggaaagaaggttattaccttggatatgggtctccttgtagctggtacaaagtatcgtggagagttcgaagaacgattaaagaagttaatggaagagattaagcaaagtgacgagattatcttgtttatagatgaagtacatactttaattggagctggtgcagctgaaggtgcaatcgatgcagcaaacattttgaaaccagctcttgcaagaggtgaactacagtgtatcggtgctacaacattagatgaatatagaaagcatatcgagaaggacccagccttagaaagacgatttcagccagtaaaagtgcctgaacccaccgttgacgagtctatccagattctaaaaggtctccgtgaaagatatgaaattcatcacaagcttcgttatacagatgaggccttggaagctgctgcacggttgtcataccagtacatcagtgaccgtttcctccctgacaaagcgattgacttgatcgatgaagctggttctcgagtccgacttcgtaatgctcagctgcccgaggaagctagagaactcgagaaagagctcaggcaaataacaaaagagaaaaatgaggcagttcgtggccaagactttgaaaaggctggagagctaagagacagagagatggacttgagggcccagatcacaaatgttgttgacaagggtaaagagctaagcaaggcagagagtgagtcaggtgatacaggccctgttgttaccgaagtcgatattcagcacattgttgcttcttggactggaatcccagtcgacaaagtctcgagtgacgaatccgataagctccttaagatggaagacacactccacacaagggtcatcgggcaagatgaagctgttaaagctatcagtcgtgcaattcgtcgtgcgcgtgttggacttaaaaaccctaatcgtcctattgccagcttcatattctctggacctacaggtgttggaaagtcagaattggcaaagacactggcttcttactattttggatctgaggaggctatgattcgtcttgatatgagtgagttcatggagaggcataccgtctccaagcttattggatcgccaccaggttatgttgggtacaccgagggtggtcagctgacagaagctgttcgccgtagaccttacacagtggttctttttgatgagatagagaaggctcacccagatgtcttcaacatgatgcttcaaattcttgaagatgggcgcttaactgatagcaagggtagaaccgtagatttcaagaacacacttctcataatgacttctaatgttggaagcaatgtgattgagaagggaggtaggagaattggttttgatctagactatgacgagaaagacagcagctacaacaggatcaagagtctcgtgcaagaggagctgaaacaatatttcagaccagaatttttgaatagattagatgagatgattgttttcagacagctaacgaagttggaagtcaaggagattgcggacataatgctcaaggaggtgttcgaaagactccgtaagaaggaaatagagcttcaggtcactgaaaggtttagagacagagtggttgatgaaggatacaacccaagctatggtgcgaggccattgaggagagcgattatgagacttttggaggatagcatggcagagaagatgctggggggagagattaaagagggagattcagtcatcgtagatgtagatggtgatggaaatgtgacagtgctcaatggtacatcaccacaactggtgtaaacatgactaccggaagaataatattttgtacttctttagcttggtagttctaggtcgtctcctcttcattcattctttttttttaatccaaaagataaactgtgtgttttgctaagactttcaattttaagattgtagctgattgtaaactatcgagcatctagcagaacaaaaaaactggtaaacaagttgaaagatgatcaatccaccaacagtaagattcagcatgaaattgaaatagctaactcggtctggtgggttgtgattctgtaaaaagttacgtaagcaaatgctgatggtgaactggtggaccggaaaaaaaaaaactggaatctataatactaggtggcagcagtattcctgatgagcccaatgttcaactgcgggggactattcctaaaaaaacacaactgcgtgatcattattctaaagatgggcttcagacggatcttctacaaattggcaggtggggtgtgcaaaggacggttgcggattcggggtcacccgcaaccaaaccgtcgaagttgcggattggaaaattgaaccgtaaccggcccaatcacccacggatttgacatccacggattagcgggtgatacggaccggatgcggattaaccgtggaatttaagaaaaaaaaaaaaaa

SEQ ID NO: 3243 - DNA, 3836 bp, Ceratodon purpureus
gtgattttttattccacaggaaggaagggcccatcgttcgatctaatttgctcccatttcggtctcgtctgggcattggtaaaggggcatccacccaggccgtcctcagactggccttcacgtacacctcgttcgtccctctctttgttgaagggcgcttcggagcttcttgcgggagtagggtttgggaattccgggaggcgttgcttgaattcttgataaggagctcgcagctcatcattggggactagggctcgggcgcaattgttggcggtaggcgggacgtcacttggcatggggtcgatggcacactccctgatggttccgtccgtgggagcgtcgcccgttgcccagctgcaaggcggtgcaaagagcaggaggtgggcggctgcgaggggggctctagtggggaggaagaatgtgcaggcagagtctgcgagtttgtccatctcgttgtttcagtcgttctctggcatgcggaaggcgttcgggattgattcgttgagcgtgaagcaagggaaggatcttaggtctgtggtggcgaggtccactgcggtgtcgaagcaatccggggcgtcgcgggcggtgacgacggcaatgtttgaacggttcaccgagaaggctatcaaggtgatcatgttggcacaggaggaggcgaggcggttggggcacaatttcgtgggaaccgagcagatattgttagggcttattggcgagggcactggtattgctgcgaaggtgttaaagtcgatgggagtgaacttgaaggaggcgcgtgtggaggtggagaagatcattgggcgcgggagcgggttcgtggcagtggaaataccattcacgcccagggcgaagcgagtgctggagctgtcgctagaggaagccaggcaacttggtcacaattatattggtactgagcaccttctgctcggactgctacgagaaggtgagggtgtggccgcgcgagtcctggaaaatcttggagctgacccgagcaacatccggactcaggtgatccgtatggtcggtgagaacaccgaggctgttggtgtcggtggtggcagcggcagcagtggcaacaagatgcccacgttggaggaatacggaaccaatttgaccaagcttgccgaagaggggaagcttgacccagtcgttggaagagttgcacagattgagcgggtgactcaaattctgggccgtagaactaagaacaatccttgtctgattggtgagcctggtgtgggaaagactgccgttgcggagggcttggcccagaggattgcatccggggacgtgcccgagactatcgagggcaagaaagtcatcacccttgacatggggttgttggttgcgggaaccaagtacagaggggagtttgaggagaggctaaagaagctgatggaggagatcaagcaggcagacgatattatcttggttattgacgaggtgcacacgctgattggtgctggtgccgcagagggtgcaattgacgctgcgaacatcttgaagcctgcactggctcgtggtgaactgcagtgcattggggctacgacattggatgagtacaggaagcacattgagaaggatcctgctttggagcgtcgtttccagcctgtgctggttccagagccaacggtggacgagacgatcgagatattgaagggattgagggagagatacgagatccaccacaaattgcgttacaccgatgaggcactcgtggcagcagctcagctttcttaccaatacatcagtgaccgatttttacctgacaaggccattgatttgattgacgaggctggttcccgtgtgaggttgaaacacgcccagctacccgaagaagctagggagcttgacaaggaactgcgtgctgtgacaaaagagaaaaatgaagctgttcgtggccaggatttcgagaaggcgggagagttgagggaccgtgagatggagttgaaggctcaaatatccgccttcatcgagaaaggcaaggagcagatgaaggccgagagcgagactgatgacgttggcccgaccgttgaagagtccgacattcagcagatcgtggctgcgtggaccggaatccctatggagaaggtgtcgagcgatgagtcggaccgtctcctgaagatggaggacacgcttcacaacagggtagtcggtcaagacgaggctgtgaaggccatcagtcgtgccattcgaagggcgcgtgttggactgaagaatccgaaccggccgattgccagcttcatcttctctggtcctacgggagtgggtaaatccgagctggctaaggctctggcttcgtattacttcggttctgaggaagcgatggtgaggctggacatgtcggagttcatggaaaggcatacggtgtcgaagctgatcggttccccacccggatacgtggggtacagcgaaggagggcaactgacagaagccgtgcggagaaggccatacacggtggtgctgttcgacgagatcgagaaggctcatccggatgtgttcaacatgatgctccagatcttggaagatgggcgactgacggatagcaaggggcggacagtggacttcaagaacaccctgctgatcatgacgtcgaacgtgggaagcagcgtgatcgagaagggtggaggcggcatcggtttccagctggactacggcgagaaggactcaagttacaaccggatcaagagcctggtgaatgaggagttgaagcagtacttcaggccggagtttttgaacaggctggatgagatcatcgtgttcaggcagctgacgaagctggaggtgaaggagatcgcggacatcatgctgaaggaggtcttcgagcggttgaaaaagaaggagatcgacctgcaggtgacagagaggttcagggatcgcgtagtggacgaggggtacagcccgagctatggtgcgaggccgttgaggagagcgatcatgaggctgttggaagacagcatggcagagcgcatgctgtccggggagataaaggagggagactcggctatcatcgatgtggacagcgatggcaccgtgacggtattgaacgggacgacaggaacttcttcgaacacccttatagacgtgaccccttctggcatcgcctaaacactgaaaagatatggaggagtttagtcttgtttggtagagaggctgtaatctgttaagccaggtagatgcagggacttagtcgaggtcctctgtagacatagtggaagggtggtaaggagtaggaaattaagggtgacatcggaaatcgtttctgtctgctgtcggcgaggaggtgtttcgcattgagcaggtgctgtgccgagctgctgtagattctgaataggggtccgcaagggtagtgaccacagactggaatggtgaatgttacgtgaattgtgggaattgagcaggctgctctttaggaaatgttgtgaggtgacagtcatgccctgacttgtcagagcttcaattaatgacgtcgatggatccttctaatgagttaagtcctaatctttgtcgttaccagcttatgatcgtaatctgattgacagaccggagagctggaaacatgctgcccgtctgacgtgtggtattttcactggctttatgcagtagtataaaactgaagaggtgatacactgtattctacgcaggacgttgtcctctagaggccatggtcttacgtttagaccggtcaaactcgcctgaggggtttgtatgtcgcgcaaccattttggtcataatttttgtggaaatagggtagtaaaggatctgtttctaagtagatctttttgaaagaattcctctaatctcttgcactcatgacacttaaggttgttgctgag

SEQ ID NO: 3244 - DNA, 3390 bp, Panax ginseng
cgggcaggctggttaaaccaggtcctcacatagttctgccagtgcttcttaaagtgccattagggataacattgttatgcttcatatcttaccggttaatcggcgaggaatcgctaaatgttttcaatggagctcttcccccgctgcttctccccatgtactctgcgttgataccactgcttgcctcaacaccacatctgcactacccatctatcttccaatccggccgaccggtcttaagttggtctctctctctctctcgctcgctcgttcgttgaagaggaagaccttacgccctccacccctctaaccctcaacttgtattcataactcaccatctgattaagattacctggtggcaatcatggcaagggtctttggttcagtcaactaacttcccttcttcagttgctggtgagaggaacggtcaagtttaagggatcgtagggaaaacaaaagaactgttaagatgatgtgtactttaagaactgttccaataaggataagtaggtttttcaggattacgaggagccaatgctttggatgccataggtaaaatctgggcatgatttccattccaaggtggcagctgcaatctctgttcgacgaggaagagccagtcgaagtgtaccgaaagctatgtttgagcggttcacaagaaaagcaataaagttattatgcttgcacaagaggaggcaaggcggcttggtcacaattttgttggaacagagcagatattgttgggtctcattggcgagggcactggtattgctgctaaagtgcttaagtcaatgggtatcaatttgaaagatgcgcgtgtggaggtagagaagatcattggtaggggcagtggatttgttgctgtagagattccctttactccccgtgcaaagcgtgttctagagctctcactagaggaagcccgccaacttggtcataattatattggatctgagcacttgctgctggggttgcttcgtgagggtgaaggtgtagcagcacgagttcttgagaatctaggtgctgaccctaataacattcgtacacaggttattcgaatggtcggggagagtcaagaagctggtgctgttgttggaggtggaagctctggcaacaagatgcctacactggaggagtatggtactaatttgacaaagctagcagaggagggtaaactggatcctgttgtaggaaggcagcagcaaattgaacgtgtaacccaaattttgggaaggcgaacaaaaaacaatccctgcctcattggcgagcccggtgttggcaaaacagctattgcagaaggccttgctcaaaggatcgcaactggtgatgttccagaaacaattgaggggaagaaggttataaccttggatatgggtcttcttgttgctggcacaaaatatcgtggagagtttgaggagaggctgaagaagcttatggaggaaattaaacaaagtgatgaaattatattatttattgatgaggtgcacacactaattggagctggagcagcagaaggagccatcgatgctgcgaacatcttgaaaccagcccttgctagaggagaactgcagtgtattggggccacaactcttgatgaatacagaaagcacattgaaaaagacccggcactggagaggcgatttcagccagttaaggtacctgaacccactgtggatgaaaccatacagatcttgaaaggactcagagagcgatatgagatccaccacaagcttcgatatactgatgaagccttggtttctgcagcacagctgtcataccagtacatcagtgaccgatttcttccggataaagctattgacttaattgatgaagccggttctagagtccgacttcgtcatgcacagctcccagaggaagccagagagcttgagaaagagcttaggcagataacaaaagagaagaacgaagctgttcgcggccaggactttgaaaaggctggggagttacgtgatagagaaatggatctgaagacacagataactgctctagtagagaaaaacaaagagatgagcaaggcggagaccgaggcaggggatgatggtcccatagtgacagaagtggacattcagcacattgtctcttcgtggacgggcatacctgttgagaaagtgtcaactgatgaatctgaccgcctcctcaagatggaagagacgctccacacgcgagtcattggtcaggatgaagccgtcaaagccatcagccgtgctatccggcgtgcccgagttggactcaagaatcctaaccgacccattgccagctttatcttttctggtccaactggtgttggaaagtcagaactagcgaaggcgttggctgcctactacttcggctctgaagaagctatgatccgacttgatatgagtgaattcatggagagacacacagtctcaaagctcattggttcacctcctggatatgttggttatactgaaggtggtcaactaactgaggctgttaggcgccgtccttacacagttgtgctctttgatgagatcgagaaggctcaccctgacgtattcaatatgatgcttcagattctggaggatggtaggttaacagacagcaaaggtagaactgtcgacttcaagaacacattattgattatgacgtcaaatgttggaagtagtgtgattgagaagggaggccgccggataggttttgatcttgattacgacgagaaggatagcagttacaaccgtatcaagagcctggtaacagaggaactgaaacaatacttcaggccagaattcttgaatagattggatgagatgattgtattcaggcagctaaccaagctagaggtgaaggagattgcagatattatgctcaaggaagtcttccagaggttgaaggccaaagacattgaacttcaggttacagagaggtttagggatagggttgttgaggaaggatacaacccaagctatggggccaggcccctaagaagagccataatgagactcttggaggacagcatggcggagaagatgcttgctagagagattaaagagggtgattcagtaattattgatattgattctgatggtaatgtgactgttctcaatggcagcagtggtgctccgcccgaggcattacaagagcctgttgcagtgtagactagtactcttttaattggacttttttaccaccgtcttgtttgtattctgatttttgttcaattcgccataaagtctcatttttatttttaatttttgcttgaagaggctggtggtcggtagactaaagctggtctcagtcagtagctttgttttaaggctgtttccccggaagacttgcatacttttatcggatagtaaatgtttagtgttagatttgaagatatttggttataaattaaaggttggtaac

SEQ ID NO: 3245 - DNA, 3157 bp, Brassica rapa
acgagacagagttagataaaacgagagagagagagaagcaaaagtaatctcctttgtttcgttcgtcttccgctacctatctctttccccagacgggccgaccattacaagagtctctctctcgcactttagccgcctccatccaactctcgccatcatggctaggctcttggctaatttcacagcccgtcctttacttggtcccggaagacatgttcagtccgacgactatagaaaaccaagacgatgtgtgaagatgatgtacacttcacaaacgccggttttgagcatccagagcttctcaggcttaagggctgccaatgcagtggatctaatagcaaggcctgctcatggtttctttagtaaagttaaccttcaaatctcttcccgcaaaggaaaagctagccgatgtgtgacaaaagccatgtttgaacggttcaccgagaaagctatcaaggtcataatgctgtctcaagaggaagctcggagacttggacataactttgttggcactgagcagatactgttgggtctcattggggaagggactggaatcgctgcaaaggttcttaaatccatggggatcaatcttaaagattctcgcgtggaggtggagaagatcattgggagaggcagtggattcgtggctgtggagatcccattcactcctcgtgcaaagcgtgtcctggagttgtctctagaggaagctcgacaactcgggcataactacattgggtcagagcatcttctgcttggtcttcttcgtgaaggggaaggtgttgcagctcgtgtcctggagaatttgggtgtagatgctagtaacatccggacgcaggttgtacgtatggtcggagaaaacaatgaagtgaccgcaagcgttggtggaggatccagcggaaacagcaagatgccaacgctagaagagtatgggactaacttaactaaactagcagaggagggaaaactagatccggttgtgggaaggcagccacagattgaacgagtggtccagatcttggctcggagaaccaagaacaacccctgtctaattggagaacctggagttggtaagacagcaatagctgaaggactagcacagagaatagccagtggtgatgttcctgaaacaattgaggggaagacggttataacccttgatatgggtcttctagtggctggaacaaagtaccgtggagaattcgaggaaagattgaagaagcttatggaggagatcaggcaaagtgatgacatcattctgtttatcgatgaagtgcacactctgatcggcgcaggagccgctgaaggtgccattgatgctgccaacatcttaaagccagctcttgccagaggtgaattgcagtgtattggtgcaacaacgttggatgagtacagaaagcatattgagaaagatcctgcattagagagaaggttccagcctgtgaaggtacctgaaccaactgtagatgaagctatacagatcttgcacggtctgcgtgagcgttatgagatccaccacaagctccggtacactgatgaagccttggttgctgctgcgcagttgtctcatcagtacatcagtgatcggtttcttccggacaaagcgattgacttgattgatgaagctgggtctcgagttcgactacgccatgctcaggtacctgaggaagctagggagcttgaaaagcaactcagacagatcacaaaggagaagaatgaagctgtgagaggccaagactttgagaaggctggttctcaccgtgaccgggaaatagagcttagggccgagatagctgctgttttagccaaaggcaaagaagtgagcaaagctgagactgaagctggcgaagaaggaggacctactgtcactgaatcagacatccaacacattgtctccacctggacaggaatcccggtagagaaagtctcgtccgatgaatctagccgtcttctcaagatggagcagacccttcacacaagagtcattggccaagacgaagcagtcaaagctataagccgagccatcagacgtgcgcgtgttggactcaagaacccgaaccgcccaatagcaagtttcatcttctcgggtccaaccggtgtggggaaatcagagcttgccaaagccttggctgcttactacttcggttcagaggaagcaatgatccgtctcgacatgagtgagttcatggaacgacacaccgtctcaaaactcatcggttcacctcctggctacgtagggtacacggaaggaggtcagttaactgaggcagttcgacgcaggccttacacgcttgtcctcttcgacgaaatagagaaagcccatcctgatgttttcaacatgatgcttcagatcctagaagacgggagactcactgacagcaaaggaagaaccgttgatttcaagaacacgcttctgatcatgacatcgaacgtaggaagcagcgtgattgaaaagggcggtagaagaatcgggtttgatctggactacgacgagaaagacagcagctacaacaggatcaagagcttggtcactgaggaactgaaacagtatttcagaccggagttcttgaacaggttagatgagatgattgttttcaggcagctgacgaagctggaagtgaaggagattgctgatataatgcttaaagaagtggtggtgaggcttaaggacaaagagattgagcttcaagtgaccgagaggtttaaggagagagttgtggatgaagggtttgacccgagctacggtgcgaggccgctgagaagagcgataatgaggctgttggaagatagcatggcggagaagatgctttcaagggagattaaagatggagattcagtgattgttgatgttgatgctgaaggaagtgtggttgtgttgaatggtaagagtggaggtggtggtagttttgctgaagaagctatggaagatcctattcttgtcttgtagaaggaatgagaatgtgttctagagatttttgttttagttttttctcttcgatctggatattgattgcttgtgttatgttgcagtgttttttttttctttccttatcacaaagcgtgttggacctagatttgccaaaataagaacaccaaaggttacacaatcaagtgtgtgaaaaaaggatggcacacagattctatatacatttactatgaa

SEQ ID NO: 3246 - DNA, 2982 bp, Brassica napus
ggtgatgtctcaatctactccactgtctttagcctgttcacagaggaatgctccctctcgtggatctggcacgtcaaaaaggtcggtgaaaatgatgtgcactcagctacaagtgtctggctcaagaatgcaaggctttctgggattgcgtgggaacaatgtcttagacactcttgggagatcccggcagagtttcggtggtaaggtgcggcaggcaatgaatgtgcccaaggggaaaggtagccggggtgtggtcaaagccatgtttgagaggtttactgagaaagctatcaaggttattatgcttgctcaggaggaagctaggagactaggccacaattttgtgggaaccgaacagattcttctgggtcttattggtgagggtactggaattgctgctaaggttttgaagtccatggggattaacctaaaggatgcacgtgtggaggttgagaagattattggaaggggcagtgggtttgttgctgttgagatcccgtttactcctcgtgctaagcgtgttcttgaactctcactggaagaagctcgccaactcggtcacaattacatcggttccgagcaccttcttcttgggttgcttcgtgaaggtgaaggtgttgctgcccgagtccttgagaatttaggagcagatcctagtaatattcgcactcaggtgatacgcatggtgggtgagaacaatgaggtcactgctaatgttggtggaggaagcggcagcaataagatgccaactcttgaagagtacgggacaaacttgacgaaactggctgaggagggtaaattggacccagttgttggtaggcagccgcaaatagaacgtgtcgtgcagattcttggcaggaggaccaagaacaacccatgtcttattggagaacctggtgttggtaagacagctattgccgaaggactagcgcagcgtattgccagtggagatgttcctgaaactattgaagggaagaaggttataacacttgacatgggtcttctggttgctggaacgaaatatcgtggagagtttgaagagagattgaaaaagcttatggaggaaattaaacagagcgacgagatcatcttgtttatcgatgaagtgcacactttgattggagcaggagcagcagaaggtgcaattgacgcagctaacattttaaaacccgctctcgctagaggtgaattgcagtgcattggagcgacaacattagacgaatacaggaagcacattgagaaagaccctgcattggaaagaagattccagccagtgaaagtacctgagcctactgtggatgaaacgattcagatcctaaagggtctgcgagagcgatatgaaattcatcataagcttcgttacactgacgagtctttagtagcagctgcacagttgtcataccagtatatcagtgatcgtttcctacctgacaaggcaattgacttgatcgatgaagctggttctcgggttcgacttcgtcatgcacaggtccctgaggaggctagggaacttgagaaggagcttaggcagataacaaaggagaagaatgaagctgtccgtggccaggactttgagaaggctgggactctacgggatagagaaattgaactcagagctgaggtatctgctatccaagcgaaaggcaaggaaatgagcaaagcagagagtgagactggtgaggaaggtcctatggtgacagagtcagacatccagcacattgtgtcttcatggactggtatccctgtagagaaggtatcaaccgatgagtctgatcgcctcctcaagatggaagaaacccttcacaaacgtgtcataggccaagatgaagctgtcaaagccataagccgagccattcgccgtgcacgtgttggactcaagaaccctaaccgtccaatagccagtttcatattctctggtcctaccggtgtcgggaaatcagagcttgccaaagctttggcagcttactactttggatctgaagaagccatgattcgtctagatatgagtgagttcatggagaggcacacagtctcgaaactcataggttcacctcctggatacgtcggttacactgaaggaggtcagctaacggaagcagtcagacgccgcccttacacagtcgttctattcgacgagatagagaaagcccacccagatgttttcaacatgatgcttcagatcctcgaagatggtagactaacagacagcaaaggaagaacagtggacttcaaaaacacgcttctcatcatgacatcaaatgtcggaagcagtgtgattgagaaaggaggaagacgtattggtttcgacctggactacgacgagaaagacagcagctacaacagaatcaagagccttgtgaccgaggagctgaaacagtacttcagaccggagttcctcaacaggcttgacgagatgattgtgttcagacagctaacgaagctggaagtgaaggaaattgcagacatactgttacaggaggtgtttgagaggctgaagaagaaggagattgagctccaagtgacagaaaggttcagagagagagtagtggacgaaggttacaacccgagctatggagcgagaccgttgaggagagccatcatgagacttttggaggatagcatggcggagaagatgctagcgagagagatcaaggaaggagactcagtgattgtggacgttgactctgaaggtaaagtgacagtgctaaatggtggaagtggcactcccacaacatccttggaggagcaggaagattctctccccgttgcttgaaataaaaggggaagtgtgtttcttctctcttcttttgctttccccccttgaacgaattaatggcaagagaagagtctcaatgagatacttgtgggggtttcgtaatatacattctctatatatgtaaccaatgtaatgtatagatgacattgtgtagcttctatttcaatgctttaaggacttgctttggtaccaaaaaaaaaaaaaaa

SEQ ID NO: 3247 - DNA, 3667 bp, Physcomitrella patens
agtctcccactgcttcttcgccgatccaaggaggaggaggaggaggaatttgcaggagggctatgtaaggcctgcctcaggcattgttctcgtttgcagctggctgctggttgtctcttacagcttcgtgtggttcggtgccgggtttggagatagtagggtttagagataaaaaagaaggattgcttctctgcgttagaatttcgagcaggttttgaggagtgtcttgtttttattaatttttgtttcgatcatcgagtttagaccgtgcattgagagagagagagagagagagagagagagagctagggatcaaaatgtcgtcactggcgcactcgttgacgctcccgtccgtcggggcgaatctaaatgttggccagctcaatggcggtgcgaagagttggagacgagcggctgcgaaagcttcgttgggaaggcggaacatgcattcgaagtctgtgagctcgacaatcggtccgttccagtccttttcggggatgcgcaaagcgtctgtgattgactctttgattgtgaaacaaggaaaggacttcaagtctgttgtcgcgaattctactcaagttttgaaccaatgccaaccatcgaaggctgtgaccacggctatgtttgagcgtttcactgagaaggctattaaggtcatcatgttgtcgcaggaggaggccagacgtctcgggcacaattttgttggtactgagcaaatcttgcttggtctcatcggtgagggtactggtattgctgccaaagtgttgaagtccatgggagtgaaccttaaagaagctcgtgtggaagtggagaagatcattggtcgggggagcggcttcgtggctgttgagattccctttacgcccagggccaaacgagtgctcgagctctcattagaggaagctaggcaacttggtcataattacattggtacagagcatttgcttctggggttgctacgagagggagaaggtgtggccgcccgagttcttgagaatcttggcgctgaccccagcaatattcgtactcaggtgattcgaatggttggcgagaatacagaggctgttggtgtcagatctggcagtggcagcagcgggaacaagatgcccaccctagaggagtatggaacgaatttgaccaaactcgctgaggagggaaagctggacccagtcgttgggaggatttcacagatagagcgagtaactcaaatccttggccgtagaaccaaaaataacccatgtcttattggagagcctggggttggaaaaactgctgttgccgaaggtctggctcagaggattgcatctggggatgtgcctgagacaattgagggcaagaacgttgttaccctggacatggggttgctggttgccggaacgaagtacagaggagaatttgaggagaggctgaagaaactgatggaagaaatcaaacaggcagacgatatcattctcgtaatcgatgaagtgcacacacttataggtgctggtgccgctgagggtgctatcgacgctgccaacatcttgaagccagctttggctcgtggtgaattacagtgcattggagcaactacgcttgatgagtatagaaagcacatcgagaaagatcctgcattagaacgtcgtttccagcctgtgttggttccagagcctaccgttgaggaaaccattgagatcctccgaggtttaagggagagatacgagattcatcataaattgcgttacacagatgaagctttgattgcagcagctcagctctcttaccaatatatcagtgatcggtttttacctgacaaagctatagacttaatcgatgaggcaggttctaaagttaggctgaaacatgctcagcttccggaagaggcaaaggagcttgataaggagttgcgtgccgttacgaaggagaaaaatgaagctgtccgtggacaggatttcgagaaggccggagaactgagggatcgcgagatggagttgaaggcccaaatttcagctttcattgagaaggataaagagaaggttaaggctgagagtgagactggtgatgttggtcctactgttgaagaagctgacattcagcaaattgtgtctgcgtggacaggtattcctgtagagaaggtctcaagtgatgagtctgatcgtctgttaaagatggaggatacccttcataatcgcgtcattggccaggatgaagccgtgaaggccattagtcgtgcaattcgcagagcacgtgttggacttaagaatcccaatcgtcccatagccagttttatcttctctggtcctactggagttggtaaatcggagcttgccaaaagccttgcgtcctactatttcggttctgaggaggctatggtcagacttgatatgtccgaatttatggaaagacacaccgtctccaaacttatcggttctccaccaggatacgtcggttacagtgaaggaggccaactgacagaggccgtacgaagaaggccctacaccgtggtcctttttgatgagattgagaaggcacatcctgatgttttcaacatgatgcttcagattttggaagacggacgcctgaccgacagcaaaggacggactgtagattttaagaacactcttctaattatgacttcaaatgtagggagtagtgttatcgagaaaggtggcggtggtattggtttccagttagactacggtgagaaggattccagctacaaccgcattaaaagccttgttaatgaggagctgaaacaatacttcagacctgagtttttgaacagacttgatgagattatcgtcttcaggcaattgaccaaattggaagttaaggagatcgccgacattatgttaaaggaagtctttgagcgtctgaaaaagaaagagatcgatttacaggtgactgagaggtttagggatcgtgttgttgaagaaggctacagtcctagctatggtgcccggccgctgcggcgagcaattatgaggctattggaagacagtatggcagagcgcatgctctctggagaaatcaaggagggggactcggctatcattgatgtggatggtgacggcaatgtcacagtattgaatggcaccacgggaacgtcctcaaaaacagacatagatgtgtcccctgctggaattgcctaaattctacggaaagaattgtgagattcgaacagtttggtttgttggcactccgcaaggtgtcctagattcagaagtcttcccaatttcaatgtaatcttagccaagagtgattctgaatgcatcaacgagaagggacagatttgaatccatttattcccgctcgcacagctggaggttttttcactcgccagttgcggagcccatcgctagtaaattctggccagtgatcagctaggttagtttttattgggtccaaggttcgacatatacgaagtttcgaagcctgcgctcttcaggattttgtttgtacattctttttctatgctaggattgggcagtcttttctatcatcataagggttgtccgtaatctcttcgctgctacgtatttggtagaccatagtatcccactaagaaggtgggttgtacagggagttccctcgtctgtcgtaagcatttctatcttcacatttgtgaggtattattatggaacaaggctggagggatgagcttggataacgaggagtctattttcgt

SEQ ID NO: 3248 - DNA, 4251 bp, Lupinus angustifolius
  misc_feature (2906)..(2988): n is a, c, g, or t
tgcacattatctattactctcacccagctaacccatttctcttcccttcgcgaaacctacccaatcttcctcctcctttatcttcttaatcaacttcaatcactaccagggttgctgctggtaccttcgttttcttttctgttttttctatcttgctacatattattatatatttctaatttttcctattttttataactgtgctgggtttgatactgcaaaagttgattcttttaggttcttggaactagattccatcacttcctgttatcatctcttgcttttttggtttggcgcaccaggtgtttgttcaaatgcttttcttctcttatgtataagtttatcattcttattgtccaacttaacttcccactttctttctcgcctttatctttttcataacatgcaaatagctaatttattcctttccacgcacttatgacttatcccgagtctatctaggtttaaattgtgtgtgtatggttttaactattttattaacaatatttttagttttcattagtttgtcatgttgattcgatagtcccacatttgaagctctatacgtatgttgtttatcgaatatgtttgcagtatctattttttttagcatcttagacttatagcttgtagtttcatttcataatttttagtggttggtgtgtcctaaatgaagtgattttttgtcctttagatttctatgatgtgtttcttgtaagttaatatgttttctaaaaaaaattgcagcaagcgattcagaatcatggctagggttctggctcagtcaattaatattccgggcatagtgtctgggcaaaggaatggccaacacaagggatctggaaaatctaaaagaccagtaaaaatgatgtctaccttaagaatgcctggaataagactgacaactttctctggactacgtgcttctaaccctttggatactatgttgagacctgggcaggattttcattctaaggtgttaactgcaacttcttctaggcgagcaagggctagcagatgcgtacctaaggccatgtttgagcgtttcactgagaaagcaatcaaggtaatcatgcttgcccaggaggaagcaagacggcttggtcataattttgttggaactgaacaaattctactgggtcttattggtgaaggcactggtattgccgctaaggtgctgaagtctatgggaattaaccttaaggatgcacgtgtggaagttgaaaagataattggaaggggtagtggatttgttgctgttgagattccatttacccctcgcgcaaagcgtgttttggaactctcactggaagaagctcgccaacttggccacaattatattggatctgaacacttgctcctaggtcttctacgagagggtgagggagtagcagcacgtgttcttgaaaacctgggtgccgatccaactaatattcgtactcaggttattcgcatggttggtgagagtgctgacagtgttcctgctagtgttggtggtcaaggaagtggtagcaataaaatgccaactctggaggaatatgggaccaatttgaccaagctagctgaggagggaaaactggatcctgttgtgggaaggcagccacaaattgaacgtgtcactcaaattttaggtcgtcgtaccaaaaataatccttgtcttattggagaaccaggtgttgggaagacagctattgctgaaggtttagcccagcggattgctaatggcgatgttcctgagactatagagggaaaaaaggttataacccttgatatgggtttgcttgtagctggaactaaatatcgtggagagtttgaggagagattgaagaaactaatggaggaaatcaagcaaaatgatgatataatactttttattgatgaagtgcacactctaattggagcaggagcagccgaaggggcaattgatgctgcaaacatattaaaaccagctcttgccagaggtgaactgcagtgtataggagctacaacactggatgaatacaggaaacacattgaaaaagatccagctttagagagacgattccagccagttaaagtgccagaaccaactgtggatgaaagcatacagatactgagaggacttagagaacgctatgagcttcatcataaactccgctatactgatgatgctcttgttgctgctgcccagctgtcataccaatatattagtgatcgatttttgccagacaaagctatagatttgattgatgaagccggttcccgagtccggcttcaacatgcacagttacctgaagatgccagagtgctggacaaggaggtcaggcagattgtgaaggagaaaggagaagctgttcgcaaccaagactttgaaaaggctggagaactacgagataaagaaatggatcttaaggcacagatctcagcactggtagagaagggcaaggagatgagcaaggcagagagcgaggcaggagatgaaggtccagttgtgacagaagttgacatacaacatattgtcgcctcctggactggtattcctgttgataaagtctcagcagatgaatctgaccgcctcctcaagatggaagagactttacataagcgaatcattggtcaggatgaagcagttaaagccattagccgggctattcgccgagcccgagttggattgaagaaccctaatcgtccaattgccagtttcatcttttctggacctactggggtgggaaagtctgagttggccaaatctttggcttcatactactttggctctgaagaagccatgattcggcttgacatgagtgaatttatggaaaggcacacagtctccaaactcattggttctcctcctggatatgttggttacactgagggtggtcaactgactgaggcagttcggcgtcgtccctacactgttgtactcnnnnnnnnnnnnnnnnnnnnnnnnnnnnnnnnnnnnnnnnnnnnnnnnnnnnnnnnnnnnnnnnnnnnnnnnnnnnnnnnnnnttcaagaacacacttcttataatgacatcaaatgttggaagtagtgttatcgagaagggtggtcgtaaaataggttttgaccttgattatgatgagaaggatagcagctataacagaatcaagagtttggtgactgaggagctaaaacaatacttcagaccagagtttttgaatagattggatgaaatgattgttttcaggcaactaacaaaattggaggtgaaggagatagctgacataatgctgaaggaggtgtttgagagactgaagaccaaagagattgagctttcagtgacagagaggttcagggaaagagtggttgatgaaggttataatcctagttatggggctaggcctctaagaagagccataatgcggctattggaggacagcatggctgagaagatgcttgctagagagattaaagagggtgactcagttatagtggatgctgattctgatggcaatgtgattgtgcttaatgggagcagcggtgcaccagattcactgccagaggctctttctgtctaacgtgtttgtcttttgctatgtttggacataaagcttttaatcatttattagtcccaagcatgtttgcccatatagctaacaaagcaagtagataaatggtggggagaatgataaacggggctgtctttctcatacattggatagcgtgaatcaatgaacaattgcaatgaaagcaggttgttttgaagttcaatactgttagaccaatgtaatgttattcatggccatgacatactttaataattgttatggtttgagttttactcgagatcacaatacatctaaatgcatatagttgtcaaataatgacgtgttcttgcaaggtgacatgcctctgcgttgggggacttgactaaattctcaaatgcaggtttttgattgaaattgatgcattctcccaatggaaagggtgagttttttttgcagcactcctttcatttatcatttccccagagaaattttgtatctttctgtaacaggtttccataaactgttttaagagcactttgctgcgaaataaaaaatgggatggttccaatcgttgaaatagaataagcacgattgtaattgtacagaattaggccagattcacagaatagtggacatcacccaacaaaccgaattttcggtctgaaaatgacttcatttatgccaattcagatgttacaagttgctacactgacaatatacatattaacataccgggacatcacttcatttacagaatttatg

SEQ ID NO: 3249 - DNA, 3548 bp, Arabidopsis thaliana
acgtgatattttcttagctagagtttggaagtattgctagcgtgcacgatggtgcaccgaacaagtgttatagacccttaccgtataaagaaaaaaaataaagaatcagaccggagatagatagagagagagataagggagggtgaaaaaataagcacacaccattatccatctgtttttttttttcatctctctctctctcttttcttcttcgattcgtgttttctccatttcattctctgttacgcttcaatcgaactcggaagtcatggctatggccacaagggtgttggctcaatcgactccaccgtctttagcttgttaccagaggaatgttccttcacgtggatctggaagatcgagaagatcggtgaaaatgatgtgtagtcagttacaagtgtctggtttaagaatgcaagggtttatgggattacgtggtaacaatgctttagacactcttggaaaaagtcgtcaagattttcattcgaaggtgcgacaggcaatgaatgtgcccaaggggaaagctagccggtttacggtgaaagcaatgtttgaaagatttacggagaaagctatcaaagttattatgcttgctcaggaggaagctagaagactaggccacaattttgtgggaaccgaacaaattcttcttggtcttattggtgagggtactggaatcgctgctaaagttttgaaatccatggggattaacttaaaagatgcacgtgtggaggttgagaagattattggaaggggaagtggctttgttgctgttgagatcccattcactcctcgtgccaagcgtgttcttgaactctctcttgaggaagctcgccaacttggtcacaattacattggatccgagcaccttttgcttgggttgctacgtgaaggtgaaggagttgcagctcgagtccttgagaatttaggtgcagatcctagtaatattcgcactcaggtgatacgcatggtgggtgagaacaatgaagtaactgctaatgttgggggaggaagcagcagcaataagatgccaactcttgaagagtacggaacaaacttgacgaaactggctgaggagggtaaattggacccagttgttggaaggcagccgcagatagaacgtgtggtgcaaattcttggcaggagaaccaagaacaacccttgtcttattggagaacctggtgttggtaagacagctattgctgaaggacttgcacagcgtattgccagtggcgatgtccctgaaactattgaagggaagaaggttataacactcgacatgggtcttctagttgctggaacaaaatatcgtggagagtttgaagagagattgaaaaagcttatggaggaaattagacagagcgatgagataatcttatttatcgacgaagtgcatactttgattggggctggagcagcagaaggtgcaattgacgcagctaacattttaaaaccagctctcgctagaggtgaattgcagtgcattggagcgacaacattagatgaataccgaaagcacattgagaaagaccctgccttggaaagaagattccagccagtgaaagtacctgaacctaccgtggatgaaactattcagatccttaagggtctgcgagagcgatatgaaattcaccacaagcttcgttacacagacgaatctttagtagcagctgcacagttgtcataccagtatataagtgatcgtttccttcctgacaaggcaattgacttgattgatgaagctggttctcgggttcgacttcgtcatgcacaggtccctgaggaagctagggagcttgagaaggagcttaggcagataacaaaggagaagaatgaagctgtccgtggccaggactttgagaaggctgggacacttcgggatagagaaattgaactcagagctgaggtatctgcaatccaagcgaaaggcaaggagatgagcaaagcagagagtgagaccggtgaggaaggccctatggtcacggagtcagacatccaacacattgtgtcttcatggactggtattcctgttgagaaagtatcaaccgatgagtctgaccgtctcctcaagatggaagaaaccctccacaaacgtatcataggccaagacgaagctgtgaaagccataagccgagccattcgccgtgcacgtgttggactcaagaatcctaaccgtccaatcgctagtttcatattctcgggtccaaccggtgttgggaaatctgagcttgccaaagctttagcagcttactacttcggttccgaagaagccatgattcgtctagatatgagtgagttcatggagaggcacactgtctccaaactcatcggttcacctcctggatatgtcggatacaccgaaggaggtcagttaacagaagcggttagacgtcgcccttacaccgtcgttctattcgatgagattgaaaaagcccatccagatgttttcaacatgatgcttcaaatccttgaagatggtagattaacagacagcaaaggaagaacagttgacttcaaaaacacacttctcatcatgacatcaaacgtcggaagcagcgtgattgagaaaggaggaagacgtatcggattcgacttagactacgacgagaaagacagcagttacaacagaatcaagagccttgtaacagaggagctgaaacaatacttcagacccgagttcctaaacaggctagacgagatgattgtgttcagacagctaacaaagctggaagtgaaagaaattgctgacatactgttgaaggaagtgttcgagaggttgaagaagaaagagattgagcttcaggtgaccgaaagattcaaagagagagtagtagacgaaggttataacccgagctatggagcaagaccgttgagaagagccatcatgaggcttttagaggatagtatggcagagaagatgcttgcgagagagatcaaagaaggagactcggtgattgtggacgttgacgctgaaggtaacgtcacggtgctaaatggtggaagtggcactccaactacttccttggaggagcaggaagattctctccctgttgcttaaataaaaaaagcaaagtgcgtgcgtttctctcttcttttgctttggcccttaaatgaattatggcaagagaaggttatgaattgagatacatgggggctttcttaatatacattttctaaatatatgaaaaatgtaatgtatagatgacattgtgtagcttctttttcttccatgctttttaaggacttgtctttggtgcccatgcaaagaggagtttttatgttggggttcgacgtcaaaagagtttaggatttcataacccaaaaaataaactaaagtgtaggataatacacatggaatcaatcaaacataacaaggtcaaatatatgacgtgaagaagtaagagaattgaagaaaaccaataaaagcatatggaaccgactagctactaccaaatcctaaaccaacaaaagctcacatgaactaattctttgaatgttcttcatattgtccacatttttaacctaatctacacatcattaggttatcc

SEQ ID NO: 3250 - DNA, 3074 bp, Euphorbia peplus
atcttatctaggtcaatttggcattacatggcgaggctttttctttcattcaactaatattccggcattagctcatgggcggaggaatggccaatctcgagaattggaaacttctagaaggactgctgctaagatgatgtgtagtttgcatccaatcacatcgactttgagagggttctcaggtctgcgaagtgcaaactgcttagattcgctgttaagttcacggcaagatttccattccagggttgcattctctatgtcacgtaggcaacagagggctaagagattcgtagctagggctatgtttgaacgcttcacagaaaaggcaattaaagtaattatgcttgctcaagaagaagcaaggcgacttggtcataactttgttggcacagagcagattctgttgggtcttattggtgaaggaactggaattgctgcaaaggttcttaagtccatgggaatcaatcttaaggatgcacgcgttgaagtggagaagattatagggagaggtagtggttttgttgccgtagagattccatttactcctcgcgcgaagcgtgtgttggaactctcattggaggaagcccgacaacttggtcacaactatattggatctgagcatttgcttcttgggttgctacgtgaaggtgaaggtgtagcagcccgtgttcttgagaatttaggtgctgatcctagcaacatccgcacacaggttattaggatggtgggtgaaagtacagaaaatatccctgctcctgttggtccaggtggtagcaataataagatgcctacacttgaagagtatggaacaaatttgaccaaattagcggaggagggtaagttggatccagttgttggaagacaaccacagatagaacgtgtcatccagatcttgggccgaagaactaaaaacaatccctgtcttattggagaacccggggtagggaaaacagcaattgcagaaggtcttgctcaacgcatagctaccggtgatgttcctgaaactattgagcgaaagaaggtgattactttggatatgggtcttctagttgctgggaccaagtatcgaggagagtttgaagaacgattaaagaagcttatggaagaaatcaaacagagtgatgaaattattctttttattgatgaggtccataccttaattggagctggagcagcagaaggtgcaattgatgctgctaacatcttgaaaccagctcttgcaagaggtgaattgcagtgtattggagccactacactggatgagtacagaaagcacattgagaaggatcctgctttagaaagacgattccagccagttaaagttcctgagccaacggttgatgaaacaattcagattctgaaagggcttcgtgaacgttatgagatccaccacaagctccgttacacagatgattcactagtagctgctgcacagttgtcatatcagtacatcagtgatcgctttctgcctgacaaggcaatagacttgatagatgaagctggttctcgggttcgccttcgtcatgctcaggtcccagaggaagctagggagctcgagaaagaggttagacagataataaaggagaaggatgaagctgtccgcggccaagacttcgaaaaggctggggaattacgtgatcgtgaaatggatctaagggcacagatcactgctatcgtggaaaaaggcaaggagatgagcaaggctgagtcagaggcagcggatgaaggccctatggtccatgaatcagacattcagcacattgtctcttcttggactggcattcctgttgagaaagtatccactgatgagtctgatcgcctcctgaagatggaagacaccttgcacaaaagagttattggtcaggatgaagctgttaaagcaattagtcgtgctattcgacgtgcccgtgttggacttaagaatccaaaccgtccaattgccagcttcatattttctgggccaactggtgttgggaagtctgaactggcaaaggcacttgctgcctactactttggttcagaagaagccatgatcagacttgatatgagtgagttcatggaaagacacactgtttcgaagttaattggttcaccaccgggttatgttgggtatactgagggaggtcagttgacagaagctgttcggcgtcggccatacactgtagtgctctttgatgagattgagaaggcccatcctgatgtcttcaacatgatgcttcaaattctcgaagatggacggttgacggacagcaagggtagaacagtagacttcaagaatacacttttgattatgacttcaaatgttggaagcagtgtcattgaaaagggaggacgaagaataggattcgaccttgattacgatgagaaggatagcagttatacccgtatcaagagcttggtcacagaggagttgaagcaatactttaggccagaattcttaaataggttggatgagatgattgtgttccgtcagctcaatagggcggaggttaaggatatagctgatataatgttgaaggaagtatttgaccggctaaagaacaaagaaatagagcttcaagtgacagagagatttagagaaagggtggttgaggaaggttataacccaagttacggagcgaggccattgagaagagccattatgagactgctggaggacagcatggcagagaaaatgcttgctggggagatcaaagagggcgactctgtgattgttgacgttgattctagtggtaatgttattgtgctcaatggaagcagtggatctcccgaggcaatgccagatgtgttgtctattgtgtaggcccaagccttcatattcaccaatccttgtttgcttcttgctcgtattgcattgtttttaacatatgaattggcaatgtagcagtagtctattttgttaaaatgactacgtggtcgtggtgtcggcaaactggagccttttgattttaattctggcttaggcctggggcttgatggaaatgtaatcataatcactagtagcattgatggatacatgggaaatagtggaactttggtctttagattggctttttataataatagcagatgta

SEQ ID NO: 3251 - DNA, 3041 bp, Brassica napus
tatctctttccccagacgggccgcgaccattacaagagtctctctcgcactttagacgcctccatccaactcttcccatcatggctaggctcttggctaatttcacagcccgtcctttacttggtcccggaagacatgttcagtccgacgaatatagaaaaccaagacgatgtgtgaagatgatgtacacttctcaaacgccggttttgagcatccagagcttctcagggttaaggtctgccaatgcagtggatctaatagcaaggcctgctcatggtttctttagtaaagttaaccttcaaatctcatcccgcaaaggaaaagctagccgatgtgtgactacaaaagccatgtttgagcggttcaccgagaaagctatcaaggtcataatgctgtctcaagaggaagctcggagacttggccataactttgttggcactgagcagatactgttgggtctcattggggaagggactggaatcgctgcaaaggttcttaaatcaatggggatcaatcttaaagattctcgcgtggaggtggagaagatcattgggagaggcagtggattcgtggctgtggagatcccattcactcctcgtgcaaagcgtgtcctggagttgtctctagaggaagctcgacaactcgggcataactacattgggtcagagcatcttctgcttggtcttcttcgtgaaggggaaggtgttgcagctcgtgtcctggagaatttgggtgtagatgctagtaacatccggacgcaggttatacgtatggtcggagaaaacaatgaagtgaccgcaagcgttggtggaggatccagcggaaacagcaagatgccaaccctagaagagtatgggactaacttaactaaactagcagaggagggcaaactagatccggttgtgggaaggcagccacagattgaacgagtggtccagatcttggctcgaagaaccaagaacaacccttgtctaattggagaacctggagttggcaagacagcaatagctgaaggactcgcacagagaatagccagtggtgatgttcctgaaacaattgaggggaagacggttataacccttgatatgggtcttctagtggctggaacaaagtaccgtggagaattcgaggaaagattgaagaagcttatggaggagatcaggcaaagtgatgacatcattctgtttatcgatgaagtgcacactctgatcggtgcaggagccgctgaaggtgccattgatgctgccaacatcttaaagccagctcttgccagaggtgaattgcagtgtattggtgcaacaacattggatgagtacagaaagcatattgaaaaagatcctgcgttggagagaaggttccagcctgtgaaggtacctgaaccaactgtagatgaagctatacagatcttgcacggtctccgtgagagatatgagatccgacacaagctcaggtacactgatgaagccttggttgctgctgcgcagttgtctcatcagtacatcagtgatcggtttcttccggacaaagcgattgacttgattgatgaagctgggtctcgagttcgactacgccatgctcaggtacctgaggaagctagggagcttgaaaagcaactcagacagatcacaaaggagaagaatgaagctgtgagaggccaagactttgagaaggctggttctcaccgtgaccgggaaatagagcttagggccgagatagctgctgttttagccaaaggcaaagaagtgagcaaagctgagactgaagctggcgaagaaggaggaccaactgtcactgaatccgacatccaacacattgtctccacctggacaggaatccctgtagagaaagtctcgtccgatgaatctagccgtcttctcaagatggagcagacccttcacacaagagtcattggccaagacgaagcagtcaaagctataagccgagccatcagacgtgcgcgtgttggactcaagaacccgaaccgcccaatagcaagtttcatcttctctggtccaaccggtgtggggaaatcagagcttgccaaagccttggctgcttactacttcggttcagaggaagcaatgatccgtctcgacatgagtgagttcatggaacgacacaccgtctcaaaactcatcggttcacctcctggctacgtagggtacacggaaggaggtcagttaactgaggcagttcgacgcaggccttacacgcttgtcctcttcgacgaaatagagaaagcccatcctgatgttttcaacatgatgcttcagatcctagaagacgggagactcactgacagcaaaggaagaaccgttgatttcaagaacacgcttctgatcatgacatcgaacgtaggaagcagcgtgattgaaaagggcggtagaagaatcgggtttgatctggactacgacgagaaagacagcagctacaacaggatcaagagcttggtcactgaggaactgaaacagtatttcagaccggagttcttgaacaggttagatgagatgattgttttcaggcagctgacgaagctggaagtgaaggagattgctgatataatgcttaaagaagtggtggtgaggcttaaggacaaagagattgagcttcaagtgaccgagaggtttaaggagagagttgtggatgaagggtttgacccgagctacggtgcgaggccgctgagaagagcgataatgaagctgttggaagatagcatggcggagaagatgctttcaagggagattaaagatggagattcagtgattgttgatgttgatgctgaaggaagtgtggttgtgttgaatggtaagagtggaggtggtggtagttttgctgaagaagctatggaagatcctattcttgtcttgtagaaggaatgagaatgtgttctagagatttttgttttagttttttctcttcgatctggatattgattgcttgtgttctgttgcaacgtttttttttctttccttatcacaaagcgtgttggacctagatttgccaaaataagaacaccaaaggttacacaatcaagtgtgtga

SEQ ID NO: 3252 - DNA, 3605 bp, Physcomitrella patens
atggatccgcggtctcccccaaccaccgtgaacgcgggattcgaatcccgtggaccgggtcccaagctcgtggccaagaggcccttatccctttctttccctgctaggcccgctgtatcgagggcttgctttgcttgcttcctcaagcgaattgcagacttgaaccctcttcttctcctcctcgaggcgcttcgggatagcttaccttcggtgctttccctcctgatcaagacgggagaggaggaggaggaagaagaagaagctcttgcagaagctcttgcgaggtttgtgaattcatttctcgcggcttcttcttccaccgcttgttatagctgggcacttacgggaacgttttcggccgagtgtggggttagaataggaagtagggtttaaggatttttacgaggcttaggggtcagtcggaagtggagattggagcattgggagctgcttgttggtcgtttgtgagggtagcgaaatgacgtcgatggcgcactctctgacgataccctcggtgggagcctcgcctgttggccagtttaatggcagtaggaaaagtaagaaacagggtgctgcgcgggcggcgtccatggggagacggaatgtggataagtctgcaagcatgtctgtggctaggtttcaatcgttttctggaatgcgcaagggttctgttgtggatgccttggttgtgaagcaagggaaggatttcaaatctgtggtggcgaactctaccgctgtgactggccattctcgcccatccagaggtgtcacgactgccatgtttgagcgtttcactgagaaggctatcaaggttatcatgttggcgcaggaagaagctaggcggcttgggcataattttgttggcactgagcaaattctgttggggctcatcggtgagggcactggtattgcggccaaagtgttgaaatccatgggagtgaacctcaaggaagctcgtgtggaggttgagaagatcatcggtcgtggaagtggttttgttgctgtcgagatccctttcacgcccagggccaagcgagtcctcgagctgtcattggaggaagcccggcagcttggtcacaattacatcggtacggagcatcttcttttggggttgctgcgagagggcgagggtgtagctgctcgagttctagagaatctcggggctgatcctagcaacattcgtactcaagtcattcgcatggttggtgagaacactgaagctgttggtgtgggaggtggtagcggcagcagtggcaacaagatgcccaccttagaagaatatggaacaaatttgactaaacttgctgaagagggaaagctcgacccagtcgtaggaagagttgcacaaatcgagcgagtgactcagatccttggacgtagaactaagaacaacccatgtctgatcggagaacctggtgttgggaaaactgctgttgccgaggggttggctcagagaattgcatccggggatgtgccggaaactatcgaaggcaagaaggttattactctcgacatgggattgttggttgctggaaccaagtacagaggagaattcgaggagaggctaaagaagttgatggaggagatcaaacaagcagatgatattatccttgttattgatgaggttcacacgctcattggtgctggtgcagccgagggtgctatcgacgctgcgaacatcttgaagcctgctctcgcccgtggtgaattgcagtgcattggagcaaccactctggatgagtacaggaagcatattgagaaggatcctgcattggagcgtcgcttccagcccgtgctggttccagagcctaccgttgaggaaaccatcgatattcttaagggattgagagagagatatgagatccatcacaaattgcgatacacagacgaggccctggttgcagcagcgcagctttcctatcaatacatcagcgatcgtttcttgcctgacaaggcaattgacttaattgacgaggcgggttctaaagtgaggctgaaacacgctcagctacccgaagaggcaagggagcttgataagcaactgcgtgctgttaccaaagagaaaaatgaagctgttcgtgggcaagatttcgagaaggctggagagttgagggacaaggagatggagttgaaggcccaaatttcggccttcattgagaagggtaaggagcaaatgaaggcagaaagtgaaactggcgacgttggtccaaccgtagaagagtctgatatccagcagatagtggctgcctggactggtattcccatggagaaggtttcgagtgacgagtctgaccgtcttttgaagatggaagatactctccacacccgagtcattggtcaggacgaagctgtgaaggccatcagtcgtgctatccgtagggcacgtgttggactgaagaatcccaaccgccctattgcgagtttcattttctctggtcctactggggttggaaagtcagagcttgctaaagctcttgcttcgtactacttcggttctgaggaagctatggttaggctcgacatgtccgagtttatggagaggcacaccgtatccaagcttatcggttctccacccggttacgttggttatagtgaaggaggccagttgaccgaagctgtgcgcaggaggccttacactgtggttctttttgatgagattgagaaagctcatcctgacgttttcaacatgatgcttcagattttagaagatgggcgcttgaccgacagcaagggtcgaactgtagattttaagaatactctcctcatcatgacttcaaatgtaggaagcagtgtcattgagaaaggaggaggcggcattggtttccagttggattacggtgagaaggattcaagttacaaccgcatcaagagccttgttaatgaggagttaaagcaatatttcaggcccgagtttttgaatagacttgatgagattattgtcttcaggcaactcaccaagttggaagtgaaggaaattgctgatatcatgttgaaggaggtcttcgagcgcctgaagaagaaggaaattgacttacaggtcactgagagatttagggatcgtgttgttgacgaaggctacagtcctagctatggtgctcggccattgaggcgagcgattatgaggcttctggaagatagcatggctgagcgcatgctttctggagaaattaaggagggagactctgctattattgatgtggatggtgatggtaatgtcacggttttgaatggtaccacaggtacttccacaaacacagctgtagaccaggcccctgccggtattgcctaaacctcgcgaaacattgaggttttttcttcacaggtagggaggtagttgtctggtgggcctagcggattcagaaacttagttctagtcccttcaattgtacccattagtgtttctgaatattgacgaaagagcgacgtccaccttcgctaattgctacctccattaacgttagttcttaaatgtccacatttttggcgctatttagaatctattaaggaggttttgcatttgccatccacagtttctacatcttgtatattcttgcgaattgttttcaaggtcctggacctttctgttgaaagattcgaccttaacc

SEQ ID NO: 3253 - DNA, 3649 bp, Physcomitrella patens
ttgcttgcttcctcaagcgaattgcagacttgaaccctcttcttctcctcctcgaggcgcttcgggatagcttaccttcggtgctttccctcctgatcaagacgggagaggaggaggaggaagaagaagaagctcttgcagaagctcttgcgaggtttgtgaattcatttctcgcggcttcttcttccaccgcttgttatagctgggcacttacgggaacgttttcggccgagtgtggggttagaataggaagtagggtttaaggatttttacgaggcttaggggtcagtcggaagtggagattggagcattgggagctgcttgttggtcgtttgtgagggtagcgaaatgacgtcgatggcgcactctctgacgataccctcggtgggagcctcgcctgttggccagtttaatggcagtaggaaaagtaagaaacagggtgctgcgcgggcggcgtccatggggagacggaatgtggataagtctgcaagcatgtctgtggctaggtttcaatcgttttctggaatgcgcaagggttctgttgtggatgccttggttgtgaagcaagggaaggatttcaaatctgtggtggcgaactctaccgctgtgactggccattctcgcccatccagaggtgtcacgactgccatgtttgagcgtttcactgagaaggctatcaaggttatcatgttggcgcaggaagaagctaggcggcttgggcataattttgttggcactgagcaaattctgttggggctcatcggtgagggcactggtattgcggccaaagtgttgaaatccatgggagtgaacctcaaggaagctcgtgtggaggttgagaagatcatcggtcgtggaagtggttttgttgctgtcgagatccctttcacgcccagggccaagcgagtcctcgagctgtcattggaggaagcccggcagcttggtcacaattacatcggtacggagcatcttcttttggggttgctgcgagagggcgagggtgtagctgctcgagttctagagaatctcggggctgatcctagcaacattcgtactcaagtcattcgcatggttggtgagaacactgaagctgttggtgtgggaggtggtagcggcagcagtggcaacaagatgcccaccttagaagaatatggaacaaatttgactaaacttgctgaagagggaaagctcgacccagtcgtaggaagagttgcacaaatcgagcgagtgactcagatccttggacgtagaactaagaacaacccatgtctgatcggagaacctggtgttgggaaaactgctgttgccgaggggttggctcagagaattgcatccggggatgtgccggaaactatcgaaggcaagaaggttattactctcgacatgggattgttggttgctggaaccaagtacagaggagaattcgaggagaggctaaagaagttgatggaggagatcaaacaagcagatgatattatccttgttattgatgaggttcacacgctcattggtgctggtgcagccgagggtgctatcgacgctgcgaacatcttgaagcctgctctcgcccgtggtgaattgcagtgcattggagcaaccactctggatgagtacaggaagcatattgagaaggatcctgcattggagcgtcgcttccagcccgtgctggttccagagcctaccgttgaggaaaccatcgatattcttaagggattgagagagagatatgagatccatcacaaattgcgatacacagacgaggccctggttgcagcagcgcagctttcctatcaatacatcagcgatcgtttcttgcctgacaaggcaattgacttaattgacgaggcgggttctaaagtgaggctgaaacacgctcagctacccgaagaggcaagggagcttgataagcaactgcgtgctgttaccaaagagaaaaatgaagctgttcgtgggcaagatttcgagaaggctggagagttgagggacaaggagatggagttgaaggcccaaatttcggccttcattgagaagggtaaggagcaaatgaaggcagaaagtgaaactggcgacgttggtccaaccgtagaagagtctgatatccagcagatagtggctgcctggactggtattcccatggagaaggtttcgagtgacgagtctgaccgtcttttgaagatggaagatactctccacacccgagtcattggtcaggacgaagctgtgaaggccatcagtcgtgctatccgtagggcacgtgttggactgaagaatcccaaccgccctattgcgagtttcattttctctggtcctactggggttggaaagtcagagcttgctaaagctcttgcttcgtactacttcggttctgaggaagctatggttaggctcgacatgtccgagtttatggagaggcacaccgtatccaagcttatcggttctccacccggttacgttggttatagtgaaggaggccagttgaccgaagctgtgcgcaggaggccttacactgtggttctttttgatgagattgagaaagctcatcctgacgttttcaacatgatgcttcagattttagaagatgggcgcttgaccgacagcaagggtcgaactgtagattttaagaatactctcctcatcatgacttcaaatgtaggaagcagtgtcattgagaaaggaggaggcggcattggtttccagttggattacggtgagaaggattcaagttacaaccgcatcaagagccttgttaatgaggagttaaagcaatatttcaggcccgagtttttgaatagacttgatgagattattgtcttcaggcaactcaccaagttggaagtgaaggaaattgctgatatcatgttgaaggaggtcttcgagcgcctgaagaagaaggaaattgacttacaggtcactgagagatttagggatcgtgttgttgacgaaggctacagtcctagctatggtgctcggccattgaggcgagcgattatgaggcttctggaagatagcatggctgagcgcatgctttctggagaaattaaggagggagactctgctattattgatgtggatggtgatggtaatgtcacggttttgaatggtaccacaggtacttccacaaacacagctgtagaccaggcccctgccggtattgcctaaacctcgcgaaacattgaggttttttcttcacaggtagggaggtagttgtctggtgggcctagcggattcagaaacttagttctagtcccttcaattgtacccattagtgtttctgaatattgacgaaagagcgacgtccaccttcgctaattgctacctccattaacgttagttcttaaatgtccacatttttggcgctatttagaatctattaaggaggttttgcatttgccatccacagtttctacatcttgtatattcttgcgaattgttttcaaggtcctggacctttctgttgaaagattcgaccttaaccaactggtctgaagcatgtgctttatggttggtagcgtgatggttggttggatgccctcatttagtgttgtatcaatgttgcaacctactccaaaatggactccgacgtcctccaatgcactcggtttttgttatcactcattgtaaaatcatctggtgttactttaatatcatg

SEQ ID NO: 3254 - DNA, 4127 bp, Physcomitrella patens
gctgacttgaacccttctgaggttcatcgtcacggcacggcacgtttccggtgcttttttctcttttggaagggggttccaggggcttccgcaccgacctcctgtggtttctccttgcaccggggctgctgctgcctttttcgaaactatttgcggtgatgtgtgggtttggattgggaagtagggttgtagaattctgaggtttgggtttaagtaggggttcgggattgagcattaaggaggagtttgagcattcaggatcagaaaaatggcgtcgatggcgcattctctgacgctcccgtctgtgggttcttcactcgttggccagctgaatgacagtgcgaagagtaagcgacggaccattgcgcaggcggcgtctaccggaagaaagaatttgaagaagtctgcgagtttgtccgtgtccggtttccaatccttttccggaatgcgcaaggcttccgccgttgatgctttgactgtcaagcaaggaaaggatttgaagtctgtagtggcgaaatctatggctgtggccggccattcccggccctctaggggcgtaacgtttgctatgtttgagcgtttcaccgagaaggccatcaaagttattatgctggctcaggaggaagctaggcggcttgggcacaattttgttggtaccgagcaaattcttttggggctcattggggagggtaccggtattgctgcgaaggttttgaaatcgatgggagtgaacctcaaggaagctcgtgtggaagtcgagaagatcattggtcggggaagtggtttcgttgccgttgagatcccctttacgcccagggccaagagggttcttgagctgtcgctggaagaagccaggcagcttggtcacaactacatcggcacagaacatttgcttctgggattgctgcgagagggagagggtgtggctgcccgagttctcgagaacctaggagctgaccctagcaatattcgcacacaggtcattcgcatggtcggtgagaacaatgaggctgttggcgtaggaggtggcagcggcagcggtagtaataagatgcccaccttggaagaatacgggacaaatttgactaaacttgctgaggagggaaagcttgatccagttgttggaagagttgctcagattgagcgagtgacccagattttgggccgtagaaccaagaacaatccatgtctgattggagagcctggtgtggggaaaacggccgtcgccgagggcctggctcagaggattgcatctggagatgtacccgagactattgaaggcaagaaggttatcactcttgatatgggtttattggttgctggaaccaagtacagaggagagtttgaggagaggttgaagaagttgatggaagagattaaacaagcagacgacattatcctcgttattgatgaggtgcacacgctcattggtgctggtgctgctgagggtgcgattgacgctgctaacatactgaaacccgctttagcccgaggtgaattacagtgtattggggcaaccactctggatgagtacagaaagcatattgaaaaggatcctgcattggagcgacgtttccagcccgttctggtgccagaacctaccgttgaagagaccatcgagatccttaagggtttgagggagagatatgaaattcaccacaagctgcgatacacagatgaggccttgattgcagcagcacagctgtcttaccaatacatcagtgaccgattcttgcctgacaaggcaattgatcttattgatgaagcgggttcgaaagtgaggctcaaacacgctcagctgcctgaagaggcaagggagctcgacaagcagctgcgtgctgttacaaaagagaaaaacgaagctgtccggggccaggactttgagaaggctggtgagttgagagataaggaaatggaattgaaggctcaaatttcagtcttcatcgagaagggtaaggagcaaatgaaagcagagagcgaaaccggcgatgttgggcctactgttgaagagtccgacatccagcagattgtggccgcctggactggcattcccatggagaaggtttcaagtgacgagtctgaccgtctattgaagatggaagatactcttcacaacagagttattggtcaggacgaagctgtgaaagctatcagtcgcgctattcgtagggcacgtgttgggctgaagaaccctaaccgccctattgccagtttcatcttctctggtcccaccggagtcggaaaatcagaacttgcaaaagctctggcttcctactacttcggttccgaagaagctatggtgaggcttgacatgtctgaatttatggaaagacatactgtctccaagcttatcggctctccacctggttacgtcggttacagtgaaggaggccagttgactgaagccgttcgcaggaggccttacactgtcgttctttttgatgagattgagaaggctcatcctgatgtcttcaacatgatgcttcagattttggaagatggacgcttgactgacagcaagggtcgaactgttgacttcaagaatactctactcatcatgacttcaaatgttggaagcagtgtcattgagaaaggtggaggtggtattggtttccagttggattatggtgagaaagactcgagctacaaccgcatcaagagtcttgttaatgaagagctaaagcagtatttcaggcccgagtttttaaacaggcttgacgagatcatcgtctttaggcaactcacaaagttagaagttaaggaaattgccgatatcatgttgaaggaagtcttcgagcgtctcaagaaaaaagagattgacttacaagttactgagagattcagggatcgggttgttgatgaaggctacagccctagttatggtgctcggccattgaggcgagctattatgaggcttctggaagatagcatggcggagcgcatgctttctggagaaatcaaggagggagattcagctattattgacgtggatagcgatggtggtgtcacagtattgaatggtaccacaggaacatccacgaatacagccatagaccaggctcctgctggtattgcctaaaacccacgacattcgagggtttttcttgataggtagaggttgtgatctgctaggtttggtagattcagaaacttagttcgagttccctctgtaatcatagcaaaatgtggttcgaaacatcgaagaaagagtcaattgatacctcaagcgtttattctttctcgatgatcacattcttggcactcttcagatttgtgcatggagtatgaattgttacattttgctgtgtccatcacttatacagtcaagtagatggtctcgaggttacaatccttgtgtaagaaatttagatgcacaccaagcttctgaaagctttcttcagaaccccgctgttaactggtgttaaggcctcattaagcaatgactgtcgctgtagaaactcattccttgtatcaattttcgatattcttgcactctccagttgatccttgcagagacttttatgtctttggttgggtacagcttctccattcaaattcaccgaagcatgggaagctggccaatttattcaaaagagttggttcgtctttgcaaaacgtaaaagaatcataccaacgggatgtaggagaaggtagtccgcattgcggggaacaaaaatctggatgtgtttggaaaattgaggatgcttggtagagaacgtgctcagcaggattcgaacctgcgcgggcagagcccacatgatttctagtcatgcccgataaccactccggcatgagcacgtaaccacccttgccatgtcgacgggggattcgtttcaccatatcgattccacttaaactactattcagtgcagaaagtacgcacccaccacatgaggccataaaatcttcatatttttttatgtgagtaaaagctttgcctaaaaattcttccaaaagtttcagtgtaagccatagtctacttaatgggtctttgttgttaagagagtataagatagttgtctcgcattttgatacttgttgtacatacaagttttttgaagaatcaaatattaatattttttattgaagcaaattacaatgaagaatttgaggtagaaaaagattaa

SEQ ID NO: 3255 - DNA, 3037 bp, Physcomitrella patens
gctgacttgaacccttctgaggttcatcgtcacggcacggcacgtttccggtgcttttttctcttttggaagggggttccaggggcttccgcaccgacctcctgtggtttctccttgcaccggggctgctgctgcctttttcgaaactatttgcggtgatgtgtgggtttggattgggaagtagggttgtagaattctgaggtttgggtttaagtaggggttcgggattgagcattaaggaggagtttgagcattcaggatcagaaaaatggcgtcgatggcgcattctctgacgctcccgtctgtgggttcttcactcgttggccagctgaatgacagtgcgaagagtaagcgacggaccattgcgcaggcggcgtctaccggaagaaagaatttgaagaagtctgcgagtttgtccgtgtccggtttccaatccttttccggaatgcgcaaggcttccgccgttgatgctttgactgtcaagcaaggaaaggatttgaagtctgtagtggcgaaatctatggctgtggccggccattcccggccctctaggggcgtaacgtttgctatgtttgagcgtttcaccgagaaggccatcaaagttattatgctggctcaggaggaagctaggcggcttgggcacaattttgttggtaccgagcaaattcttttggggctcattggggagggtaccggtattgctgcgaaggttttgaaatcgatgggagtgaacctcaaggaagctcgtgtggaagtcgagaagatcattggtcggggaagtggtttcgttgccgttgagatcccctttacgcccagggccaagagggttcttgagctgtcgctggaagaagccaggcagcttggtcacaactacatcggcacagaacatttgcttctgggattgctgcgagagggagagggtgtggctgcccgagttctcgagaacctaggagctgaccctagcaatattcgcacacaggtcattcgcatggtcggtgagaacaatgaggctgttggcgtaggaggtggcagcggcagcggtagtaataagatgcccaccttggaagaatacgggacaaatttgactaaacttgctgaggagggaaagcttgatccagttgttggaagagttgctcagattgagcgagtgacccagattttgggccgtagaaccaagaacaatccatgtctgattggagagcctggtgtggggaaaacggccgtcgccgagggcctggctcagaggattgcatctggagatgtacccgagactattgaaggcaagaaggttatcactcttgatatgggtttattggttgctggaaccaagtacagaggagagtttgaggagaggttgaagaagttgatggaagagattaaacaagcagacgacattatcctcgttattgatgaggtgcacacgctcattggtgctggtgctgctgagggtgcgattgacgctgctaacatactgaaacccgctttagcccgaggtgaattacagtgtattggggcaaccactctggatgagtacagaaagcatattgaaaaggatcctgcattggagcgacgtttccagcccgttctggtgccagaacctaccgttgaagagaccatcgagatccttaagggtttgagggagagatatgaaattcaccacaagctgcgatacacagatgaggccttgattgcagcagcacagctgtcttaccaatacatcagtgaccgattcttgcctgacaaggcaattgatcttattgatgaagcgggttcgaaagtgaggctcaaacacgctcagctgcctgaagaggcaagggagctcgacaagcagctgcgtgctgttacaaaagagaaaaacgaagctgtccggggccaggactttgagaaggctggtgagttgagagataaggaaatggaattgaaggctcaaatttcagtcttcatcgagaagggtaaggagcaaatgaaagcagagagcgaaaccggcgatgttgggcctactgttgaagagtccgacatccagcagattgtggccgcctggactggcattcccatggagaaggtttcaagtgacgagtctgaccgtctattgaagatggaagatactcttcacaacagagttattggtcaggacgaagctgtgaaagctatcagtcgcgctattcgtagggcacgtgttgggctgaagaaccctaaccgccctattgccagtttcatcttctctggtcccaccggagtcggaaaatcagaacttgcaaaagctctggcttcctactacttcggttccgaagaagctatggtgaggcttgacatgtctgaatttatggaaagacatactgtctccaagcttatcggctctccacctggttacgtcggttacagtgaaggaggccagttgactgaagccgttcgcaggaggccttacactgtcgttctttttgatgagattgagaaggctcatcctgatgtcttcaacatgatgcttcagattttggaagatggacgcttgactgacagcaagggtcgaactgttgacttcaagaatactctactcatcatgacttcaaatgttggaagcagtgtcattgagaaaggtggaggtggtattggtttccagttggattatggtgagaaagactcgagctacaaccgcatcaagagtcttgttaatgaagagctaaagcagtatttcaggcccgagtttttaaacaggcttgacgagatcatcgtctttaggcaactcacaaagttagaagttaaggaaattgccgatatcatgttgaaggaagtcttcgagcgtctcaagaaaaaagagattgacttacaagttactgagagattcagggatcgggttgttgatgaaggctacagccctagttatggtgctcggccattgaggcgagctattatgaggcttctggaagatagcatggcggagcgcatgctttctggagaaatcaaggagggagattcagctattattgacgtggatagcgatgcaaattacaatgaagaatttgaggtagaaaaagattaa

SEQ ID NO: 3256 - DNA, 3307 bp, Pteridium aquilinum
agagagagagggtttgggaggcgtagtgcggggggccttctgcagcagctctgctgcctgtgaatgtcgcgactcacgagcggacgcagagctgcatcaacagactaccatcggtggccggcaattccagggtttcctgtgctcgtcaatctcttcttgtccaggtgagctctttctccggcctccgtcgtacctcctttcttaaccctaaacatggcagcagcagcagcttccatgctgccatagccaaggcccttgctgccccctctggcaagggcagccgtgcagtcatagttgccatgtttgaaaggttcacagagaaggccatcaaagtcatcatgctagcgcaagaagaagcacggcgcctggggcacaactttgtgggcacagagcaaatcctgcttggattgattggtgaaggtactgggattgcagctaaagtgctgaaatccatgggtgtgaatctgaaggaagcgcgcatagaagtggagaagataatcgggcgtggcagcgggtttgttgctgtggaaatcccctttacccccagggctaaacgtgtgcttgagctttctcttgaagaggctcggcagttaggtcataattacattggatctgagcatttgctgctaggtttgctaagagaaggtgagggtgtggcagcgcgtgtgctcgaaaatcttggcgcagaccccagcaacatcagaacacaggtaattcgaatggttggtgagagcactgaagctgttggtgctggtgtaggaggtggtagcagtaatgccaaaatgcctactttggaagagtttggtacaaacttgaccaagcttgcagaggatggaaaactcgatcctgttgtgggaaggcaacctcagatagagcgtgtcacacagatacttggtcgacgcaccaagaacaatccttgcctcattggagagcctggtgttggaaaaactgcaattgctgaggggcttgcacaacgcatttccgctggtgacgtccctgagaccattgagggcaagaaagttattacacttgatatggggctgcttgttgctggcaccaagtacagaggagagtttgaagagaggctcaagaagctcatggaagagatcaagcaggcagatgacatcatactcttcatagatgaagtgcacactttgattggagctggcgcagccgagggagcaattgatgcagccaatattctgaagcctgctttggcaagaggtgagcttcaatgcattggagccacaacccttgatgagtatagaaagcacattgaaaaggatcctgccctggagaggcgatttcaacctgtgcaggttccggaaccaactgtagatgagaccatacagatcttgcaaggtctacgggagcgctatgagatccatcataaactgcgctacacagatgaagccctggttgctgctgctcagctttcttatcaatatatcagtgaccggtttcttcccgacaaggccattgatctgattgacgaagctggctctcgtgttcgccttcgccatgcccaactccccgaagaagcaaaggagcttgacaaggagttgaggcaaataacaaaggagaagaatgaagcagtgagaggtcaggactttgagaaggcaggggagcttcgtgaccgcgaaatggagttgaaggcccagatatctgccatcacagaaaagggaaaggagaaaatcaaagctgagagtgaggctggtgatgttgggccattagtcactgaagcagacattcagcagatagtttcggcctggacaggaattccagtagagaaggtatctattgatgagtcaagccgtttgctgaagatggaagaaactttgcacaagagagtgattggtcaagatgaggctgtgaaagccattagtcgtgccattcgacgagcccgagtaggcttaaaaaatcctaaccggccaattgcaagcttcatattttcaggccccactggtgttggaaaatcggagcttgcgaaggctctggcagcatactactttggttctgaggaggcaatggtgagactggatatgagtgagtttatggaaaggcatacagtttccaagcttatcgggtcaccacctggctatgttggctacagtgaaggagggcaattgacagaagccgttcgtcggcgcccttacaccgttgtgctgtttgatgagattgagaaggcacatccagatgttttcaacatgatgcttcagattcttgaggatggtaggcttacagatagcaagggcagaactgtggatttcaaaaatacattgttgatcatgacgtcgaatgttggaagtagtgtaattgaaaagggtgggggcggcattggtttccaacttgattatggtgagaaggacagcagctacaataggataaagaccctcgtaaatgaggagctgaagcagtacttcagacccgagttcttgaatcgtcttgatgagattattgtatttaggcagttgacaaagtcagaagtgaaggagatagccgacattatgctcaaggaggtgttcgatcgagtgaagaagaaattgattgatattcaagttactgaaagattccgggacagaatagtggatgaaggttatagtccgagctatggtgcgaggcctttgcgaagggcgatcatgcgtcttttggaggacagcatggctgagagaattcttggaggagaaattaaggagggtgattcagccattattgatgtggacacagaaggaaatgtgacagtcttgaatggtactacgggaacagcctcaacttcagcaatagaagctccagcaggcattgcttgaacagaagcgaaaaagtgctctaaggtttaatggcatgctcaataaggaatatgcttggtgttttcgaactcaaacttgcaggacaaggggttaaattgtgtttttccttctgcaccagtacttgtagttttaagtatgatgtaatctcacctgtctcaaatgtatacatattctaccttctaggtgaaccgcttttctacttttatgttcgatattaacacgtatgcttgtattattaccttgttgtgatgtttcttgcaattaccctgttaggtttttagaaagcatgccatcatggatttgacttctccatataagaagttttagacaaaatcccactgttgtttccactttgtggattacgacaacaccatgagcttctacaggggaggcactgtgtacctggctaggtgcggtttggggtaggggtaccacacctagctaggtatgcggtgccctttctacagaagcttgcaagtctgaatactatagggaaagag

SEQ ID NO: 3257 - DNA, 2991 bp, Eutrema halophilum
agcctccaactctgcattatggctaggctcttggctaattttacagtccgtcctctacttggtcccggaagacatctccagtccgaagaatacagaaaaccaagaagtcgtgtgaagatgatgtccagtttacacgcacctgttttgagtatccggaactactcagggttaagggttaacagtgcattggatcttatggcaagtcgcagtccagatttctttgctaaggttaatatttcaatctcatcccggaaaggaaaagctagccgatgtgtaccaaaagccatgtttgaacggtttaccgagaaagcaattaaggtcataatgctgtctcaagaggaagctcggagacttggccataattttgttgggactgagcagatactgttgggtctaattggggaagggactggaatcgctgcaaaggttcttaaatccatggggatcaatcttaaagattctcgtgtggaggttgaaaagatcattggaagaggcagtggatttgtagcagttgagatcccatttactcctcgtgcaaagcgagtactggagttgtcactagaggaagctcgacaactcgggcataactacattgggacagagcatcttctgcttggtcttcttcgtgaaggggaaggtgttgcagctcgtgtcttggagaatttgggtgtagattctagtaacatccggacgcaggttatacgtatggtcggggaaaacaatgaagtgacagcaagcgttggtggaggatccagcggaaacagcaaaatgcctacactagaagagtatgggactaacttaactaaactagcagaggagggtaaactggatcctgttgttggaaggcaaccgcagatcgaacgagtggtccagatcttggctcgaagaaccaagaacaacccatgtcttattggagaacctggagttggtaagactgcaatagctgaaggactcgcgcagagaattgccagtggcgatgttcctgaaacaattgaggggaagacggttataacccttgatatgggtcttctagtagctggaacgaaatatcgtggagaattcgaggaaagattgaagaagcttatggaagaaatcaggcaaagtgatgacattattctgtttattgatgaagtgcacacgctgatcggtgcaggagccgccgaaggtgcaattgatgctgctaacattttaaagccagctcttgcaagaggtgaattgcagtgtattggtgcaacaacattggatgagtacaggaagcacattgagaaagatcctgcattggagagacggttccagcctgtgaaggtacctgaacctactgtagaggaagctatacagatcttgcacggtctccgtgaacgatacgagattcaccacaagctccggtacaccgacgatgccttggttgctgctgcacaattgtcacaccagtacatcagtgatcggtttcttccggacaaggcgattgacttgattgatgaagctgggtctcgggttcgactacgccatgctcaggtccctgaggaagctagagagcttgaaaagcaactcagacagatcactaaggagaagaatgaagctgtgcgaggccaggactttgagaaggctggtgctcatcgtgaccgtgaaatagagcttagggctgagattgctgctgttttagccaaaggcaaagaagtgagcaaagccgagactgaagctgaagaaggaggacctactgtcactgaatccgacatccaacacattgtctcaacctggacaggaatcccggtagagaaagtctcgtctgatgaatctagccgtcttctcaaaatggagcagacccttcacacaagagtcattggccaagacgaagccgtcaaagccattagccgggccatccgccgtgcacgtgttggactcaagaacccgaaccgcccgatcgctagtttcatcttctctggtccgaccggtgtggggaagtcagagcttgccaaagccttggctgcttactacttcggttcagaggaagcaatgatccgtctcgacatgagtgagttcatggaacgacacactgtttcaaaactcatcggctcacctcctggttacgtaggatactcagaaggaggtcagttaactgaggcggttcgacgcaggccttacacacttgtcctcttcgatgaaatcgagaaagcacatccagatgttttcaacatgatgcttcagatcctagaagacgggagactaaccgatagcaaaggaagaaccgttgatttcaagaacacgcttctgatcatgacttcgaacgtaggaagcagcgtgattgaaaaaggcggtagaagaatcgggtttgatctggattacgacgagaaagacagcagctacaacagaatcaagagtttagtgactgaggagctaaagcagtatttcagaccggagttcttgaacaggttagatgagatgattgttttcagacagttgacgaagcttgaagtcaaggagattgctgatataatgcttaaagaagtggtggtgaggctgaaagacaaagagattgagcttcaggttactgagaggtttaaagagagagtggtggacgaaggatttgacccgagttacggtgcgaggccgcttagacgagctattatgaggcttttggaagacagcatggctgagaagatgctttcaagagacattaaagatggagattctgtgattgttgacgttgatgcagaaggaagtgtggttgtgttgaatggtaaaagtggaggtggtggtggttttgtggctggagaagccatggaagaagatccagttcctgtgttgtagaaggaaacacaagggttctagtcttctagagattattctttcctttttaagtggttattgaattgtgtctcattttagtcgcttttgttttctactgtttttgtttctggatatttgattgttcgctcgggaactaatggaaaatttcccacaaaaaaaatgaagggattttttaattttgca

SEQ ID NO: 3258 - DNA, 3066 bp, Eutrema halophilum
cagcctccaactctgcattatggctaggctcttggctaattttacagtccgtcctctacttggtcccggaagacatctccagtccgaagaatacagaaaaccaagaagtcgtgtgaagatgatgtccagtttacacgcacctgttttgagtatccggaactactcagggttaagggttaacagtgcattggatcttatggcaagtcgcagtccagatttctttgctaaggttaatatttcaatctcatcccggaaaggaaaagctagccgatgtgtaccaaaagccatgtttgaacggtttaccgagaaagcaattaaggtcataatgctgtctcaagaggaagctcggagacttggccataattttgttgggactgagcagatactgttgggtctaattggggaagggactggaatcgctgcaaaggttcttaaatccatggggatcaatcttaaagattctcgtgtggaggttgaaaagatcattggaagaggcagtggatttgtagcagttgagatcccatttactcctcgtgcaaagcgagtactggagttgtcactagaggaagctcgacaactcgggcataactacattgggacagagcatcttctgcttggtcttcttcgtgaaggggaaggtgttgcagctcgtgtcttggagaatttgggtgtagattctagtaacatccggacgcaggttatacgtatggtcggggaaaacaatgaagtgacagcaagcgttggtggaggatccagcggaaacagcaaaatgcctacactagaagagtatgggactaacttaactaaactagcagaggagggtaaactggatcctgttgttggaaggcaaccgcagatcgaacgagtggtccagatcttggctcgaagaaccaagaacaacccatgtcttattggagaacctggagttggtaagactgcaatagctgaaggactcgcgcagagaattgccagtggcgatgttcctgaaacaattgaggggaagacggttataacccttgatatgggtcttctagtagctggaacgaaatatcgtggagaattcgaggaaagattgaagaagcttatggaagaaatcaggcaaagtgatgacattattctgtttattgatgaagtgcacacgctgatcggtgcaggagccgccgaaggtgcaattgatgctgctaacattttaaagccagctcttgcaagaggtgaattgcagtgtattggtgcaacaacattggatgagtacaggaagcacattgagaaagatcctgcattggagagacggttccagcctgtgaaggtacctgaacctactgtagaggaagctatacagatcttgcacggtctccgtgaacgatacgagattcaccacaagctccggtacaccgacgatgccttggttgctgctgcacaattgtcacaccagtacatcagtgatcggtttcttccggacaaggcgattgacttgattgatgaagctgggtctcgggttcgactacgccatgctcaggtccctgaggaagctagagagcttgaaaagcaactcagacagatcactaaggagaagaatgaagctgtgcgaggccaggactttgagaaggctggtgctcatcgtgaccgtgaaatagagcttagggctgagattgctgctgttttagccaaaggcaaagaagtgagcaaagccgagactgaagctgaagaaggaggacctactgtcactgaatccgacatccaacacattgtctcaacctggacaggaatcccggtagagaaagtctcgtctgatgaatctagccgtcttctcaaaatggagcagacccttcacacaagagtcattggccaagacgaagccgtcaaagccattagccgggccatccgccgtgcacgtgttggactcaagaacccgaaccgcccgatcgctagtttcatcttctctggtccgaccggtgtggggaagtcagagcttgccaaagccttggctgcttactacttcggttcagaggaagcaatgatccgtctcgacatgagtgagttcatggaacgacacactgtttcaaaactcatcggctcacctcctggttacgtaggatactcagaaggaggtcagttaactgaggcggttcgacgcaggccttacacacttgtcctcttcgatgaaatcgagaaagcacatccagatgttttcaacatgatgcttcagatcctagaagacgggagactaaccgatagcaaaggaagaaccgttgatttcaagaacacgcttctgatcatgacttcgaacgtaggaagcagcgtgattgaaaaaggcggtagaagaatcgggtttgatctggattacgacgagaaagacagcagctacaacagaatcaagagtttagtgactgaggagctaaagcagtatttcagaccggagttcttgaacaggttagatgagatgattgttttcagacagttgacgaagcttgaagtcaaggagattgctgatataatgcttaaagaagtggtggtgaggctgaaagacaaagagattgagcttcaggttactgagaggtttaaagagagagtggtggacgaaggatttgacccgagttacggtgcgaggccgcttagacgagctattatgaggcttttggaagacagcatggctgagaagatgctttcaagagacattaaagatggagattctgtgattgttgacgttgatgcagaaggaagtgtggttgtgttgaatggtaaaagtggaggtggtggtggttttgtggctggagaagccatggaagaagatccagttcctgtgttgtagaaggaaacacaagggttctagtcttctagagattattctttcctttttaagtggttattgaattgtgtctcattttagtcgcttttgttttctactgtttttgtttctggatatttgattgttcgctcgggaactaatggaaaatttcccacaaaaaaaatgaagggattttttaattttgcagtgcctcttcttttcccaaaacttgttggatttgaaaataagaataccaaagcttacacaggcaactgtgaaaa

SEQ ID NO: 3259 - DNA, 3183 bp, Sequoia sempervirens
cagaatctagatccttttggcctctttttacggtcatcatctgattttcttccatatttctcaggaggaagcgcttgatccaccactgtcctgcacaggtttctccacctgaccttgctttcagtggacttaaaatctgagtaaagatggcagggacactggcacaatgtgcacttcttccttctggaataatcagtgcaagtcatggtcaaattcagagctctaaaagagtaacacaagtcccaaagatgatggggaatacatcatcacattccttagaattaaaagttacattggtttgtgccaagtaacaggccaaggcaaggttgcaaatcccataacaaacttttatgtgggagcaccagtctcttctccagcaaggaaagccaggaaatccaggaaaagggtggttacttgtatgtttgagcgatttacagaaaaggccatcaaggtaattatgctttctcaagaggaagcacggcgccttgggcacaactttgtaggtacagagcagattctgttgggtctcattggtgaagggactggtattgcagcaaaagtcctgaaatccatgggagtcaatttaaaggaggctcgtatagaggttgagaaaatcattggcagaggtgggggtttgttgctgtggagattccattcactccaagagcaaagcgtgtgttagaacttgcacttgaagaagctcgacaacttggacataattacataggatctgaacacttgctcttaggtttgttgcgtgagggtgaaggtgttgcagctcgcgtgcttgagaaacttggagctgacccagcaatattcgtactcaagtcattcggatggttggtgaaagtacagaagctgttggtgctggagtaggaggtggtagcagcagcaacaagatgccaactcttgaggaatatggaaccaatttgacaaaacaagcagaggaaggcaagcttgatccagtagttgggaggcaaccacaaattgaaagagttacacaaatattgggacgccgtacaaagaacaatccttgccttattggtgagcctggagtaggaaagacagctattgctgagggacttgctcaacgaatagcttctggagatgttccagaaacaattgagggtaaaaggttattactttagacatggggctacttgttgcaggtaccaagtatcgtggagagtttgaagaaagattgaaaaacttatggatgaaatcaaacagagtgatgagatcatactcttcatagatgaagttcatactttaattggagcaggtgcagcagaaggggcaattgatgcggccaatatcctaaaaccagccctcgcacgaggtgaactacagtgcattggggcaaccaccttggatgaatacaggaagcacattgaaaaagatcctgcactagagagaagattccaacctgtacaagtgccagagccaactgtggaagagacaatacaaatattggcaggactacgtgaacgatatgaacttcatcataagcttcgttattctgatgaggctttagagtgtgctgccaagttatcacatcaatacatcagtgatcgtttcctccctgacaaagcaattgatctagttgatgaggctggttctcgtgtgcaccttcgccattcacagcttcctgaagaagcaaaagaacttgacaaagaactgaggcagattacaaaagagaagaatgaagctgttcgaggtcaagattttgaaaaggctggagagctacgggatcgtgagatggaattgagggcacaaattacagctgtaacacagaaagggaaagagaaatctaaggcagagagtgaaacaggggatggatgcccagttgtaactgaggcagatattcagcaaattgtgtctgcatggacaggcattccagttgaaaaagtgtcgtccgatgagtcggacaaactcttgaagatggaggatacacttcatcaacgtgtcattgggcaagatgaagctgtcaaagctatcagtcgagccattcgccgtgcaagagttggcttgaagaacccaaacaggccaattgcaagctttatttctcaggtcctacaggtgttggtaaatctgagcttgccaaggcattggcagcatactattttggttctgaggaggcaatgataaggctggatatgagtgaatatatggaaagacatacagtttccaagctgattggttcaccaccaggatatgtaggatacactgaaggaggccaactgactgaagctgttaggcgacgcccttatagtgttgtcctctttgacgaaattgagaaggctcatcctgatgtctttaatatgatgcttcaaatccttgaagatggaagacttacagatagcaaaggtaggactgtggactttaagaacacccttttgatcatgacttctaatgttggtagtagcgtaattgagaagggaggtcgtagatctggattcctttttcaatttgatgaagatgaagaagataacagctacacaagaatcaaaagccttgtcttagaagagctgaaggcatattttcgccctgagttcttgaatcgactagatgaaacaattgtttttagacagctcaccaaattagaggtaagagatatgcagatatcatgttgaaagaagtctttgaacggcttaaacttaaagaaattgatcttcaagtaacagatcgcttcagagacagagttgtagatgaaggctatagtcccacttatggtgcaagatcactacgcagagcaattatgaggttgttagaggatagtatggctgaaaagatgctctctggtgagatcaaagagggtgattcagctatagttgatgtaaatgaggaagggaatgtgactgtgttaaacggaaatagaagcagtggcactgtagttccatcatccccagctccatcgaccccagctccatcgtccccagcagcagctgtcttggaatagatatcatacatttgggaggccaaggattgctgaaagttgaattttatataaatgacaaatgtaattagttattccatgttagaatttcttttttgttttactggaattttgttggctacttgttggacagatgactaacaggctgaaaaacttggaaggatctgtttggtccaattctgaaggttaatattaattacacttttatgtattgtattacttccccc

SEQ ID NO: 3260 - DNA, 2862 bp, Brassica napus
taaatccgactggtaaaggtacagtttcctacctatcctcttcctttcgtctacttactctactcttcttttctttcattttgttttttcgttttctacgtgaagtaaagcttccgtctttctgctgtgtgaatttttaagcctccaactcttgcatcatggctaggctcttggctaattctacatcccgttctttacttggttccggaagagactttcttcagtcagatgactacagaaaaccaagaagatgtgtgaagatgatgtacacttctcaaacatccgttttgagtatccagagcttctctggtttaagggcttccaatgcattggatcgagtggcaaggcctagccacgactttttcggtaaggttaaccttcaaatgtcgtcttcccggaggggaaaagctagccgaggtgtaacaaaagccatgtttgagcggtttaccgagaaagcaatcaaggtcataatgctgtctcaagaggaagctcggaggcttggccataactttgttggcactgagcaaatactgttgggactgattggagaaggcactggaatcgctgcaaaggttcttaaatccatggggatcaatcttaaagattctcgtgtggaggtggaaaagatcattggaagaggcagtggttttgtggctgtggagatcccatttactcctcgtgcaaagcgtgtcctggagctctcacttgaggaagctcgccaacttgggcataactacattgggtcagagcatcttctgcttggtcttcttcgtgaaggggaaggtgttgcagctcgtgtcctggagaatttgggtgtagatgctagcaacatccggacgcaggttatacgtatggtgggagaaaacaatgaagtgacggcaagcgtgggtggaggatctagcggaaacagcaaaatgccaacactggaagagtatgggaccaacttaactaaactagcagaagagggtaaactggatccagttgttggaaggcagccacagattgagagagtggtccagatcttggctcgaagaaccaagaacaacccttgtcttattggagaacctggagttggtaagacagcaatagctgaaggactcgctcagagaattgctagtggggatgtccctgaaacaattgaggggaagacagttataacccttgacatgggtcttcttgtggctggaacgaagtatcgtggagaatttgaggaaaggttgaagaagcttatggaggagattagacaaagtgatgacattattctctttattgatgaagtgcacacgctgatcggtgcaggagctgccgaaggtgccattgatgctgctaacatcttaaagcctgctcttgcaagaggtgaattgcagtgtattggtgcaacaacattggatgagtacaggaagcacattgagaaagatcctgcactggagagacggttccagcctgtcaaagtacctgaaccaactgtagacgaagctatacagatcttgcacggtctgcgtgagcgttatgagattcaccacaagctccgctacactgatgaagctttggttgctgctgcgcagttgtcacatcagtacatcagtgaccggtttcttcccgacaaagccattgacttgattgatgaagctggatctcgggttagactgcgtcacgctcaggtccctgaggaagctagagagcttgaaaggcaactcagacagatcactaaggagaagaatgaagctgtgcgaggccaagactttgagaaggctggttctcaccgtgaccgagaaatagagcttagagccgagatagctgctgttttagccaaaggcaaagaagtgaacaaagctgagaccgaagcaggcgaagaagggggacctactgtcactgaatccgacatccaacacattgtctccacctggacaggaatcccagtagagaaagtctcgtctgatgaatcaagtcgtcttctcaagatggagcagactctccacacaagagtcattggccaagacgaagccgtcaaagccattagcagggccatcagacgtgcacgtgttggactcaagaaccctaaccgccccatagcaagcttcatcttctctggtccaaccggtgtgggaaaatcagagcttgcaaaagccttggctgcttactacttcggctcagaggaagcaatgatccgtctggacatgagtgagttcatggagcgacacacggtttcgaaactcattggttcgcctcctggttacgtaggatacacggaaggaggtcagctaacggaggcggttagacgcaggccctacacgcttgtcctcttcgacgaaatagagaaagcccatcctgatgttttcaacatgatgcttcagatcctagaagacgggagactaactgacagcaaaggaagaacggttgatttcaagaacacgcttctgatcatgacatcaaacgtaggaagcagcgtgattgaaaagggtggtagaagaatcgggtttgatctcgactacgacgagaaagacagcagctacaacagaatcaagagcctagtgactgaggagctgaaacagtatttcagaccagagttcttgaacaggttggatgagatgattgttttcagacagttgacgaagctggaagtgaaggagattgctgatataatgcttaaagaagtggtggtgaggcttaaggacaaggagattgagcttcaagtgactgagaggtttaaggagagagtggtggatgaagggtttgatccgagttacggtgcgaggccgcttagaagagcaattatgaggctgttggaagatagcatggcggagaagatgctttcaagggagattaaagatggagactctgtgattgttgatgttgatgctg

SEQ ID NO: 3261 - DNA, 2753 bp, Euonymus alatus
attaaagtaattatgctcgcacaagaagaagctaggcggcttggtcacatttgttggcacagaacaaatactgttgggtctaataggtgaaggcactggcattgctgcaaaggttctaaaatctatggggatcaatcttaaagatgcacgtgtagaagtggagaagataattgggaggggaagtggatttgttgctgtggagataccattcactcctcgtgcaaagcgtgtgttagaactctctctggaggaggcccgccaactcggtcataactacatcggctccgagcacttgcttcttggcctacttcgtgaaggggagggtgtcgcagcccgcgttcttgagaatctaggtgctgatcctagtaatatacgtacacaggtgatccgcatggtgggtgagagcaatgaaaatgctgttggtgttacgcctggtggaggtggtagcaataagatgccgacacttgaggaatatggaactaatttgacgaaactggcagaagagggtaaattagatcctgttgttggaaggcaaccacaaatagaacgcgttgtccaaattttgggtcggcgcactaagaataacccttgtctcattggagaacctggcgtggggaaaacagctatagcagagggtcttgctcagcgaattgcaagtggtgatgttcctgacacaattgagggaaagaaggttataaccctggatatgggccttctagttgccggaaccaagtaccgtggagagtttgaggagagactaaaaaagttaatggaggaaatcaagcagagtgatgaaataattcttttcattgatgaagtgcacaccttaattggagctggggcagcagaaggggcaattgatgcggcaaacattttaaaaccgtctcttgccagaggtgaattgcagtgtattggagctacaacattagatgaatacagaaagcacattgagaaggacccagccttagaaagacgatttcagcctgtgaaagtaccggaaccaactgtagatgaaactatactgattctgcaaggattgcgggaacgttatgagatccaccacaaactccgctacacagatgaagcgctagtttctgctgcaaagctttcataccagtatatcagtgatcgttttctgcctgataaggcaattgacttggttgatgaagctggttctcgagttcggctacgtcatgcacagctccctgaggaagctagagagcttgaaaaggagctcaggcagataaccaaagagaaaaatgaagctgttcgcagccaggactttgaaaaggctggggagttgcgtgatcgagagatggacttaaaggcacagatctcagctgttgtagacaaaggaaaggagatgagcaaggcagagagtgaagctggggatgtaggtcctattgtgactgaagtggacattcagcatattgtctcctcctggactggcattccagttgataaagtgtcttctgatgaatctgatcgccttctcaagatggaagagacgcttcacaagcgggtcattggtcaggatgaagctgtcaaagcaatcagccgtgctattcgccgtgctcgtgttggcctaaagaaccccaaccggccaattgctagttttatcttttctggtccaactggtgtagggaagtcggagttggcgaaagccctagcagcatactactttggctctgaggaagcaatgattcgacttgatatgagtgagttcatggaaagacacactgtttccaagctcattggttcacctcccggttatgtaggttatactgagggtggtcagctgactgaagctgtacgccgtcgtccttatacggtagttctttttgatgagattgagaaggcccaccctgatgtcttcaacatgatgcttcaaattcttgaagatggaaggttaacagacagcaagggcagaactgttgacttcaagaatactcttctgataatgacatcaaatgttgggagcagtgtaattgagaagggtggacgccggatgggatttgatatggattatgatgataaagatagcagttacaaccgaatcaagagcctggtaacggaggagttgaagcaatatttcaggccagaatttctcaacagattggatgagatgatagttttcaggcaactcacgaaactggaggtgaaagatatagccgatataatgttgaaggaggtatttgagaggttgaaagtcagagagatagaacttcaagtgacagagagatttagagatagagtggttgaggaagggtacaaccccagctatggtgcaaggcctttgaggagagccataatgagacttttggaggacagcatggctgagaagatgcttgctagagaaatcaaagagggtgattcagttattgtggatgtcgattccgacggaaacgttaccgtgctcaatggtagcagtggtgctccggagtccttgccagattcattatctgttgtgtaaactgtcacttaatactggccatgttgtttgtaccttttcttttggtttgactttggctttatgtctgtagtctgtctgtttttctttaaggactacgcagccgtagaattgggagcagttggttaattgatgactttggttgtaaggctgtattttcgtcaccattatagtaatcgatagtcaaatagcaagcaggaaaggtaagtgctagatttagcttgtggtaataaatatgtaatgatgcaaggccaaatctttaatcttcatttctggttgcctg

SEQ ID NO: 3262 - DNA, 3164 bp, Arabidopsis thaliana
gagagagaatagagaaatctcttgtctcttgggtatcttcttcttcactttcctatctctttcccaataaaaggagtctctcgctttctccaacttcgctatccaaaggcgtcgacgcctccaacattgcatcatggcttggtcgatagctcttcttacacctcctttttttggtcccggaaggcatgtgcaggccaaagaatacagggaaccaagagggtgtgtgatgaagatgagcagtttaaaagcacctgttctgagaattcaggccacagaatacagagaaccaagagggcgtgtgaagatgatgtccagtttacaagcacctcttctgacaattcagagcttctcagggttaagggcccccagtgcattagattatttgggaaggcctagtccaggtttccttgttaagtataaacttgcaaaatcatctgggagagaaaaagctagccgatgtgtacccaaagcaatgtttgagcgttttaccgagaaagcaattaaggtcataatgctgtctcaagaggaagctcggagacttggccataactttgttgggactgagcaaatactgttgggtctaattggagaagggactgggattgccgccaaggttcttaaatccatggggatcaatcttaaagattcacgcgtggaagtagaaaagataattgggagaggcagtggattcgtggcagtggagattccatttactcctcgcgcaaagcgggtgctggagttgtcactagaggaagctcgacaacttgggcataactacattggttcagagcaccttttgcttggtctacttcgtgaaggggagggtgtggcagctcgtgtcttggagaatttgggtgcagatcctagtaatatacggacacaggttatacgtatggtcggggaaaacaatgaagtcacagcaagcgttggtgggggaagcagcggaaacagcaaaatgccaacacttgaagagtatgggactaacttaactaaactagcagaggagggtaaactggatccggttgttggaaggcagccacagatcgaacgagtggtccagatcttggctcgaagaaccaagaacaacccatgtcttattggagaacctggagttggtaagacggcaatagcagaaggacttgcacagcgaatagctagtggtgatgttcctgaaacaatcgaggggaagacggttataacccttgatatgggtcttctagtggctggaacgaaataccgtggagagttcgaggaaagattgaagaagcttatggaggaaatcaggcaaagtgatgagataattctgtttattgatgaagtgcacacgctcatcggtgcaggagccgctgaaggtgcgatcgatgctgctaacatcttaaagccagctctagcaagaggtgaattgcagtgtattggtgcaacaacaattgatgagtacaggaaacacattgagaaagatcctgcattggagagacggttccagcctgtgaaagtacctgaaccaactgtagaagaagctatacagattttgcaaggtctgcgtgagcgctatgagatccaccacaaacttcgatacactgatgaagccttggttgctgctgcacaattgtcacatcagtacatcagtgatcggtttcttcccgacaaagcgattgacttgattgatgaagctgggtctcgggttcgactacgccatgctcagcttcctgaggaagctagagagcttgaaaagcaactcaggcaaatcaccaaagagaagaatgaagctgtgcgaagccaagacttcgagatggctggttctcatcgtgaccgtgaaatagagctcaaggctgagatagctaatgttttatctcgaggcaaagaagtggccaaagccgagaatgaagctgaggaaggaggacctactgtcacagaatctgacatccaacacatcgtcgccacctggacaggaatcccggtagagaaagtctcgtctgatgaatctagccgtcttctccaaatggagcagacccttcacacaagagtcattggccaagatgaagccgttaaagcaatcagtcgggctatccgccgtgcccgtgttgggctcaaaaacccaaaccgtcctatcgccagtttcatcttctctggtccaactggtgttgggaaatcagagcttgctaaggccttggctgcttactacttcggttcagaagaagcaatgatccgtcttgacatgagtgagttcatggaacgacacactgtttcgaaactcatcggttcacctcctggttacgtaggatacacagaaggaggtcagttaacagaggcggttcgacgcaggccctacactcttgttctctttgacgaaattgagaaagcacatcccgatgttttcaacatgatgcttcagatcctagaagacggtagactaactgatagcaaaggaagaactgtcgatttcaagaacacgcttctgatcatgacttcaaacgtagggagcagcgtgatcgaaaaaggtggtagaagaattgggtttgatcttgaccacgacgagaaagacagcagttacaacagaatcaagagcttagtgactgaggaactaaaacagtatttcagaccagagttcttgaacaggttagatgagatgattgttttcagacagttaacaaagctggaagtcaaggagattgctgatataatgcttaaagaagtggtggcgagacttgaggtcaaagagattgagcttcaggtgactgagaggtttaaagagagagtggtggatgaaggattcgacccgagttatggtgcgaggccacttagacgtgcaataatgaggcttttggaggatagtatggcggagaagatgctttcaagggacattaaagaaggagattctgtgattgttgatgttgatgccgaaggaagtgtggttgtgttgagtggtaccactggacgtgttggtggttttgctgctgaagaagccatggaagatcctattccaatattgtagaaggaaacaaggggttttctagtgattttcttttaagtgttattgaattgactattgagtctcttatgattcgtattttgtactctaatctctttgtttctggataatgactgttcgggaaccacagagaatttcccacaaaaaaaaagaaagcaggatttggttagaattt

SEQ ID NO: 3263 - DNA, 3399 bp, Arabidopsis thaliana
ccgacggtggaatacacttatgagtaatctaacggctggtatgcaactttggtaggtgagtgtgtttaatctatgaagggcggcgatgcgagagaagataaagagagagagaatagagaaatctcttgtctcttgggtatcttcttcttcactttcctatctctttcccaataaaaggagtctctcgctttctccaacttcgctatccaaaggcgtcgacgcctccaacattgcatcatggcttggtcgatagctcttcttacacctcctttttttggtcccggaaggcatgtgcaggccaaagaatacagggaaccaagagggtgtgtgatgaagatgagcagtttaaaagcacctgttctgagaattcaggccacagaatacagagaaccaagagggcgtgtgaagatgatgtccagtttacaagcacctcttctgacaattcagagcttctcagggttaagggcccccagtgcattagattatttgggaaggcctagtccaggtttccttgttaagtataaacttgcaaaatcatctgggagagaaaaagctagccgatgtgtacccaaagcaatgtttgagcgttttaccgagaaagcaattaaggtcataatgctgtctcaagaggaagctcggagacttggccataactttgttgggactgagcaaatactgttgggtctaattggagaagggactgggattgccgccaaggttcttaaatccatggggatcaatcttaaagattcacgcgtggaagtagaaaagataattgggagaggcagtggattcgtggcagtggagattccatttactcctcgcgcaaagcgggtgctggagttgtcactagaggaagctcgacaacttgggcataactacattggttcagagcaccttttgcttggtctacttcgtgaaggggagggtgtggcagctcgtgtcttggagaatttgggtgcagatcctagtaatatacggacacaggttatacgtatggtcggggaaaacaatgaagtcacagcaagcgttggtgggggaagcagcggaaacagcaaaatgccaacacttgaagagtatgggactaacttaactaaactagcagaggagggtaaactggatccggttgttggaaggcagccacagatcgaacgagtggtccagatcttggctcgaagaaccaagaacaacccatgtcttattggagaacctggagttggtaagacggcaatagcagaaggacttgcacagcgaatagctagtggtgatgttcctgaaacaatcgaggggaagacggttataacccttgatatgggtcttctagtggctggaacgaaataccgtggagagttcgaggaaagattgaagaagcttatggaggaaatcaggcaaagtgatgagataattctgtttattgatgaagtgcacacgctcatcggtgcaggagccgctgaaggtgcgatcgatgctgctaacatcttaaagccagctctagcaagaggtgaattgcagtgtattggtgcaacaacaattgatgagtacaggaaacacattgagaaagatcctgcattggagagacggttccagcctgtgaaagtacctgaaccaactgtagaagaagctatacagattttgcaaggtctgcgtgagcgctatgagatccaccacaaacttcgatacactgatgaagccttggttgctgctgcacaattgtcacatcagtacatcagtgatcggtttcttcccgacaaagcgattgacttgattgatgaagctgggtctcgggttcgactacgccatgctcagcttcctgaggaagctagagagcttgaaaagcaactcaggcaaatcaccaaagagaagaatgaagctgtgcgaagccaagacttcgagatggctggttctcatcgtgaccgtgaaatagagctcaaggctgagatagctaatgttttatctcgaggcaaagaagtggccaaagccgagaatgaagctgaggaaggaggacctactgtcacagaatctgacatccaacacatcgtcgccacctggacaggaatcccggtagagaaagtctcgtctgatgaatctagccgtcttctccaaatggagcagacccttcacacaagagtcattggccaagatgaagccgttaaagcaatcagtcgggctatccgccgtgcccgtgttgggctcaaaaacccaaaccgtcctatcgccagtttcatcttctctggtccaactggtgttgggaaatcagagcttgctaaggccttggctgcttactacttcggttcagaagaagcaatgatccgtcttgacatgagtgagttcatggaacgacacactgtttcgaaactcatcggttcacctcctggttacgtaggatacacagaaggaggtcagttaacagaggcggttcgacgcaggccctacactcttgttctctttgacgaaattgagaaagcacatcccgatgttttcaacatgatgcttcagatcctagaagacggtagactaactgatagcaaaggaagaactgtcgatttcaagaacacgcttctgatcatgacttcaaacgtagggagcagcgtgatcgaaaaaggtggtagaagaattgggtttgatcttgaccacgacgagaaagacagcagttacaacagaatcaagagcttagtgactgaggaactaaaacagtatttcagaccagagttcttgaacaggttagatgagatgattgttttcagacagttaacaaagctggaagtcaaggagattgctgatataatgcttaaagaagtggtggcgagacttgaggtcaaagagattgagcttcaggtgactgagaggtttaaagagagagtggtggatgaaggattcgacccgagttatggtgcgaggccacttagacgtgcaataatgaggcttttggaggatagtatggcggagaagatgctttcaagggacattaaagaaggagattctgtgattgttgatgttgatgccgaaggaagtgtggttgtgttgagtggtaccactggacgtgttggtggttttgctgctgaagaagccatggaagatcctattccaatattgtagaaggaaacaaggggttttctagtgattttcttttaagtgttattgaattgactattgagtctcttatgattcgtattttgtactctaatctctttgtttctggataatgactgttcgggaaccacagagaatttcccacaaaaaaaaagaaagcaggatttggttagaatttcatcgagtcatataagtgtcaaaattgagaatctaatcacagattaacgaggttcaattcttctatcccatcctcaaaacatggtttataaaaacagtaagggtaacatgaatttttcgtgatcagtgttt

SEQ ID NO: 3264 - DNA, 3144 bp, Ceratodon purpureus
ggttggtgagtctcggtgacctcctcttccgcggcggcgttggtttcctcactgttggggtttgctgcttgttcgtggtcgccatcatcagccgaggcaggtgtgtaaatataaatatcaatagggattcaattgaaaatattcgagtttgaggccatcaagttgtttttgaagttgatgagcatcaagcagttgtgaaacaatcaagatggcggcagtagcgcagtctttgatagtaccggcagtgggagcatcccacgttggccaaattcactccagcgcaaagaagacgcggaccccagcaagcgcaggtccgttaggtcgcagaaatgtacaggcaaaggcttctttggtatcgtcatcaggattcaagtcgttcgccggaatgcgcaaggcttcggtgattgatgcactaactgtaaagcaaggacgggatttcaagtccactatggaagctgcactcgcagttggaaatcaaggatggactcccaagggtgtcacaacggcgatgttcgagcggtttactgagaaggcgatcaaggttatcatgcttgcacaggaagaggccaggcgtctgggacacaattttgttggtacagagcaaatacttttgggccttatcggggaggggactgggattgctgccaaggtgttgaaatctatgggagtaaaccttaaggaggcgcgtgtggaggttgagaagatcatcggacgtgggagtggctttgtcgctgtcgagattcccttcactcccagagcgaagcgagtgctggagctctcacttgaagaagccaggcaacttggtcacaattacataggaaccgagcatttgctcttgggtttgttgcgagagggtgaaggtgttgctgcacgtgttcttgagaatctcggagcagatcctagcaacatccgaactcaggttattcggatggtcggtgagagtaccgagtcagtgggtgctggagtgggcggtggaagtagcagcaacaagatgcctactctggaggagtatggtaccaacctaacgaagctagcagaagagggaaagttggaccctgttgttggaaggcagccacaaattgagcgtgtaactcagattttgggtagaaggacaaagaacaacccttgtctgattggagagcctggggttggaaagaccgccattgccgagggtttggcccagcgcattgcaactggagatgtgcctgaaactattgagggcaagaaggttatcactctagatatgggtttattggtagctggtaccaagtacaggggagaatttgaagagaggcttaagaaattgatggaagaaatcaagcaagctgatgacatcatccttgtgattgatgaggtgcatacacttattggtgctggtgcggctgagggtgccatcgatgcagctaacattttgaagcctgcacttgctcgtggtgaacttcagtgcattggagctactaccttggatgagtataggaagcatattgagaaggatcctgcgttggaacgtcgattccaacctgtgttggtcccagaacccactgttgatgaaactattcagatcctcaagggattgagggagagatacgaaattcatcacaagctgcgatacactgatgaggctttggtggcagccgcacaactttcttaccagtatatcagtgaccggtttttacctgacaaggccattgatttgatcgacgaagcgggatcacgtgtacgtctgaggcatgctcagctgcctgaggaagctagggagctcgacaaggagttgcgtggcgttaccaaggaaaaaaatgaggctgtccgtggacaagacttcgagaaggctggggagttgagggatcgggaaatggagctgaaggctcaaatctcgaccatcaccgaaaagggcaaagagcagttgaaggcagagagcgaggccggtgatactggtcctatggtggaagaatcagacatccaacatatcgtctcagcctggaccggtattcccgttgagaaagtctctagtgacgaatcagaccgtctgttgaagatggaggatactcttcatcaacgcgttgttggccaggacgaagccgtgaaggccataagccgcgctattcgcagagctcgcgttgggctgaagaatcctaaccgccctattgccagcttcattttctctggtcctactggagttggaaaatccgaattggctaaggctctcgcctcttactattttggatccgaagaagctatggttaggcttgacatgtccgagtttatggagaggcacacagtttctaaactgattggttctccgcccggttacgttggttacagcgagggagggcaattgacggaggctgtccgcaggaggccgtacactgtcgttcttttcgatgagatcgagaaggcacatcctgatgtgttcaacatgatgcttcagattctggaagatggtcgtcttacagatagcaagggaagaactgtcgatttcaagaataccctattgatcatgacctcgaacgtcggaagcagcgtcatcgagaagggaggaggtggtatcggtttccagctagactacggtgagaaagactccagttacaaccgaatcaagagcctcgtcaacgaggagctgaaacagtacttccggccagagtttttgaacaggttggacgagatcattgtcttcaggcagttgaccaaactggaggtcaaggaaattgctgatatcatgctgaaggaggtgtttgagcgcttgaagaagaaagaaatcgacctgcaggttactgagagattcagggaccgtgtggtggacgagggctacagtcccagctacggtgccagaccattgaggcgagcaattatgaggttactggaagatagcatggcagagcgtatgcttgcaggagagatcaaggagggagactcagccatcatcgatgtggacagtgaaggaggagtgacggtgttgaacggcaccacaggaacatcctccagcacagccatcaatgagactccagcaggcattgcctgagctatgtttgtagatttccggtttctagttaggtgacattttccaccaggcttaagtattagagtccctttgtaaacaatacctgaaaaggacttgtactaccaaaagaatattgtaaatcaaat

SEQ ID NO: 3265 - DNA, 3099 bp, Arabidopsis lyrata
ccattaaaaggagtctctcgctttctcgaacttctctatccaaaggcgtcgacgcctccaacacatcatggcttggtgtgtagctgttttgaaagctcctttatttggtcccggaaggcatgtgcaagccgaagaatacagaaaaccaagagggtgtgtgaagatgatgtgcaattttcaagcacctggtctgagaattcaggccaaagaatacagaaaaccaagagggtgtgtgaagatgatgtgcagtttacaagcacctgttctgaaaattcagagtttttcagggttaagggcccccagtgcattagattatatggcaaggcctagtccaggtttccttgttaagtttaaacgtgcaatatcatctcggagagaaaaggctagccgatgtgtacccaaagcaatgtttgagcgttttaccgagaaagcaattaaagtcataatgctgtctcaagaggaagctcggagacttggccataactttgttggaactgagcaaatactgttgggtctaattggagaagggactgggatagccgccaaggttcttaaatccatggggatcaatcttaaagattcacgcgtggaagtggaaaagataattgggagaggcagtggatttgtggcagtggagattccatttactcctcgcgcaaaacgagtactggagttgtcactagaggaagctcgacaacttgggcataactacattggttcagagcaccttttgcttggtctacttcgtgaaggggagggtgtggcagctcgtgtcttggagaatttgggtgcagatcctagtaatatccggacacaggttatacgcatggtcggggaaaacaatgaagtcacagcaagcgttggtgggggaagcagcggaaacagcaaaatgccaacactagaagagtatgggactaacttaactaaactagcagaggagggtaaactggatccggttgttggaaggcagccacagatcgaacgagtggttcagatcttggctcgaagaaccaagaacaacccgtgtcttattggagaacctggagttggtaagacagcaatagcggaaggacttgcgcagcgaattgctagtggtgatgttcctgaaacaatcgaggggaagacggttataacccttgatatgggtcttctagtggctggaacgaaataccgtggagaattcgaggaaagattgaagaagcttatggaggaaatcaggcaaagtgatgagataattctgtttattgatgaagtgcacacgctcatcggtgcaggagccgctgaaggtgcgatcgatgctgctaacatcttaaagccagctctagcaagaggtgaattgcagtgtattggtgcaacaacattggatgagtacaggaagcacattgagaaagatccggcattggagagacgtttccagcctgtgaaggtacctgaaccaactgtagaagaagctatacagatcttgcacggcctgcgtgagcgctatgagatccaccacaaacttcggtacactgatgaagccttggttgctgctgcacaattgtcacatcagtacatcagtgatcggtttcttcccgacaaagcgattgacttgattgatgaagctgggtctcgggttcgactacgccatgctcaggttcctgaggaagctagagagcttgaaaagcaactcaggcaaatcaccaaagagaagaatgaagctgtgcgaggccaagacttcgagatggctggttctcatcgtgaccgtgaaatagagctcagggctgagatagctaatgttttagctctaggcaaagaagtggccaaagccgagaatgaagctgaggaaggaggacctactgtcacggaatccgacatccaacacattgtcgctacatggacaggaatcccggtagagaaagtctcgtctgatgaatctagccgtcttctccaaatggagcagacccttcacacacgagtcattggccaagatgaagctgttaaagcaatcagtcgggctatccgccgtgcccgtgttgggctcaaaaacccaaatcgtcctatcgccagtttcatcttctctggtccaactggtgttgggaaatcagagcttgctaaggccttggctgcttactacttcggttcagaagaagcaatgatacgtctcgacatgagtgaattcatggaacgacacactgtttcaaaactcattggttcacctcctggttacgtaggatacacagaaggaggtcagttaacggaggcggttcgacgcaggccgtacacacttgttctctttgacgaaattgagaaagcacatcccgatgttttcaacatgatgcttcagatcctagaagacggtagactaactgatagcaaaggaagaactgtcgatttcaagaacactcttctcatcatgacttcaaatgtaggaagcagtgtgatcgaaaaaggtggtagaagaatcgggtttgatcttgaccatgatgagaaagacagcagttacaacagaatcaagagcttagtgactgaggaactaaaacaatatttcagaccggagttcttgaacaggttagatgagatgattgttttcagacagttgacaaagctggaagtcaaagagattgctgatataatgcttaaagaagtggtggcgagacttgaggacaaagagattgagcttcaggtaactgagaggtttaaagaacgagtggtggatgaaggatttgacccaagttatggtgcgaggccgcttagacgtgcgattatgaggcttttggaggatagtatggcggagaagatgctttcaagggacattaaagaaggagattctgtgattgttgatgttgatgcggaaggaagtgtggttgtgttgagtggtaacaacagtggacgtgctggtggttttactgctgaagaagccatggaagatccaattcctgtattgtagaaggaaacaagggtttttctagagattattgtttcaagtgttattgaattgactattaagtctcttttgattcgtattttgtactttaatctctttgtttctggataatgattgttcgggaaccatagagaatttcccacacaaaaaaaaataagcaagatttggttaga

SEQ ID NO: 3266 - DNA, 3278 bp, Arabidopsis lyrata
ccgagggtgtaaaagacttttgaagaatctaacggctgatatgcaactttggtaggtgagtgtgtttaatctatcaagggcggcgacgcgagagagataaaaagagagagaatagtgagaatctctttgtatcttcttcactttcctatctctatccccaattaaaaggagtctctcgctttctcgaacttctctatccaaaggcgtcgacgcctccaacacatcatggcttggtgtgtagctgttttgaaagctcctttatttggtcccggaaggcatgtgcaagccgaagaatacagaaaaccaagagggtgtgtgaagatgatgtgcaattttcaagcacctggtctgagaattcaggccaaagaatacagaaaaccaagagggtgtgtgaagatgatgtgcagtttacaagcacctgttctgaaaattcagagtttttcagggttaagggcccccagtgcattagattatatggcaaggcctagtccaggtttccttgttaagtttaaacgtgcaatatcatctcggagagaaaaggctagccgatgtgtacccaaagcaatgtttgagcgttttaccgagaaagcaattaaagtcataatgctgtctcaagaggaagctcggagacttggccataactttgttggaactgagcaaatactgttgggtctaattggagaagggactgggatagccgccaaggttcttaaatccatggggatcaatcttaaagattcacgcgtggaagtggaaaagataattgggagaggcagtggatttgtggcagtggagattccatttactcctcgcgcaaaacgagtactggagttgtcactagaggaagctcgacaacttgggcataactacattggttcagagcaccttttgcttggtctacttcgtgaaggggagggtgtggcagctcgtgtcttggagaatttgggtgcagatcctagtaatatccggacacaggttatacgcatggtcggggaaaacaatgaagtcacagcaagcgttggtgggggaagcagcggaaacagcaaaatgccaacactagaagagtatgggactaacttaactaaactagcagaggagggtaaactggatccggttgttggaaggcagccacagatcgaacgagtggttcagatcttggctcgaagaaccaagaacaacccgtgtcttattggagaacctggagttggtaagacagcaatagcggaaggacttgcgcagcgaattgctagtggtgatgttcctgaaacaatcgaggggaagacggttataacccttgatatgggtcttctagtggctggaacgaaataccgtggagaattcgaggaaagattgaagaagcttatggaggaaatcaggcaaagtgatgagataattctgtttattgatgaagtgcacacgctcatcggtgcaggagccgctgaaggtgcgatcgatgctgctaacatcttaaagccagctctagcaagaggtgaattgcagtgtattggtgcaacaacattggatgagtacaggaagcacattgagaaagatccggcattggagagacgtttccagcctgtgaaggtacctgaaccaactgtagaagaagctatacagatcttgcacggcctgcgtgagcgctatgagatccaccacaaacttcggtacactgatgaagccttggttgctgctgcacaattgtcacatcagtacatcagtgatcggtttcttcccgacaaagcgattgacttgattgatgaagctgggtctcgggttcgactacgccatgctcaggttcctgaggaagctagagagcttgaaaagcaactcaggcaaatcaccaaagagaagaatgaagctgtgcgaggccaagacttcgagatggctggttctcatcgtgaccgtgaaatagagctcagggctgagatagctaatgttttagctctaggcaaagaagtggccaaagccgagaatgaagctgaggaaggaggacctactgtcacggaatccgacatccaacacattgtcgctacatggacaggaatcccggtagagaaagtctcgtctgatgaatctagccgtcttctccaaatggagcagacccttcacacacgagtcattggccaagatgaagctgttaaagcaatcagtcgggctatccgccgtgcccgtgttgggctcaaaaacccaaatcgtcctatcgccagtttcatcttctctggtccaactggtgttgggaaatcagagcttgctaaggccttggctgcttactacttcggttcagaagaagcaatgatacgtctcgacatgagtgaattcatggaacgacacactgtttcaaaactcattggttcacctcctggttacgtaggatacacagaaggaggtcagttaacggaggcggttcgacgcaggccgtacacacttgttctctttgacgaaattgagaaagcacatcccgatgttttcaacatgatgcttcagatcctagaagacggtagactaactgatagcaaaggaagaactgtcgatttcaagaacactcttctcatcatgacttcaaatgtaggaagcagtgtgatcgaaaaaggtggtagaagaatcgggtttgatcttgaccatgatgagaaagacagcagttacaacagaatcaagagcttagtgactgaggaactaaaacaatatttcagaccggagttcttgaacaggttagatgagatgattgttttcagacagttgacaaagctggaagtcaaagagattgctgatataatgcttaaagaagtggtggcgagacttgaggacaaagagattgagcttcaggtaactgagaggtttaaagaacgagtggtggatgaaggatttgacccaagttatggtgcgaggccgcttagacgtgcgattatgaggcttttggaggatagtatggcggagaagatgctttcaagggacattaaagaaggagattctgtgattgttgatgttgatgcggaaggaagtgtggttgtgttgagtggtaacaacagtggacgtgctggtggttttactgctgaagaagccatggaagatccaattcctgtattgtagaaggaaacaagggtttttctagagattattgtttcaagtgttattgaattgactattaagtctcttttgattcgtattttgtactttaatctctttgtttctggataatgattgttcgggaaccatagagaatttcccacacaaaaaaaaataagcaagatttggttagagttgatttgagtcatataagt

SEQ ID NO: 3267 - DNA, 2834 bp, Distylium racemosum
gaggggtgattaaagctatgtttgagcgttttactgaaaaagctatcaaggtaattatgcttgcacaggaggaagcaaggcgccttggacacaactttgtaggtacagagcaaattttgttaggtcttattggtgaaggaacaggcattgcggccaaggtattgaagtcaatgggaattaatctcaaggaggctcgcattgaggttgagaaaattattggcagaggtggtggatttgttgctgtggaaattccatttactcccagagcaaaacgtgtgttagaactgtcacttgaggaagctcgacaacttggacacaactatataggatcagagcacttgcttttgggattgcttagggagggtgaaggtgttgctgcccgtgtgcttgaaaatctgggagcagacccgagcaacatccgcactcaagtaattcgcatggtaggagaaagtacagaagctgttggtgctggagtagggggtagcagcaatagcaacaagatgccaactcttgaagagtatggaacaaatttgaccagattggctgaggaggggaaacttgatccagtggttggaaggcagccacagatagaacgggttactcaaatattgggacgtcgcacaaagaacaatccatgtcttattggtgaaccaggtgttggaaagacagctattgctgagggtcttgcccagcgaattgcatcaggagatgttccagaaactatcgagggcaaaaaggtgattactttagatatgggcctgcttgtggctgggaccaagtaccgtggagagtttgaagaacgattgaagaaattaatggaggaagtcaagcaaagtgatgacatcatccttttcatagatgaagtacacactttaattggagcaggtgcagcagaaggcgcaatagatgctgctaatattttgaagccagcacttgcacgtggtgaactacagtgcattggagccaccacactcgatgaatacagaaaacacattgagaaggacccagctcttgaaagaagattccagccggttcaggtgccagaaccaacagttgatgaaaccatacagattttgggaggtttgcgtgaacgatatgagattcatcacaagctgcgctatactgatgaggcattgattgctgctgctcaattatctcatcagtatatcagtgatcgtttccttcctgataaggcaattgatctgcttgatgaggctggttctcgagtacgattgaggcatgcacagcttcctgaggaggctaaagagctagaaaaagaacttagacagataacaaaggaaaagaatgaagcagtccgaaatcaggactttgaaaaggctggagagttacgtgaccgggagatggagttgagggcacagattactgctgtaacagagaaggggaaggaaaaatcgaaggctgagactgaggtggctgatggcggtccaacagtaacagaggcagatattcaacaaattgtagctgcatggacaggcattcccgttcaaaaggtgtcaacagatgagtctgacaaacttttgaagatggaggacactcttcacaatcgtattatagggcaagatgaggctgtagtggcaatcagtcgagctatccgccgagcccgagttggtttgaagaatcccaacaggccaattgcgagctttattttctcgggtccaacaggtgttgggaagtcagagctcgccaaagcattagcaacttactattttggttcagaagaggcaatgatccggttagacatgagtgaatttatggagagacatactgtgtcaaagttgattggttcaccccctggatatgttggttacagtgaaggaggacaactgactgaagctgtaagaaggcgcccctatacggtggttctgtttgatgagattgagaaggctcatcctgatgtcttcaatatgatgcttcaaattctggaagatgggagattaacagatagtaaggggcgaactgtagattttaagaacactcttttaataatgacatctaatgtgggaagcagtgtgattgagaaaggaggtcgtcgtatggggttccagtttttgatgatgttgaggaggatacaggttatacgagaattaagagtcttgtgattgaagagatgaaaagatattttcgtccggagtttttgaatcgtttggatgaaataattgtgttcaggcagctcaccaagactgaagtcaaagagatttcagacattatgcttaaagaggtatttgaacgtcttaaaaagaaggagattgaactgcaagttacagagaagttcagagacagagtagtagaagaaggttatagtcccagctatggtgcaagacctttacgtagggcaatcatgagattgttagaagattgtatggctgaaaaaatgctctctggtgaaatcaaggagggtgattctgcaatagttgatgtagacaatgaaggaaatgtgactgtcttaagtgggtctagtggtaaatcagcatcaccaagcaccatggtagctgcctaggaaatgactacccatgtttaattgcttgcaagaaactgttttgtttgataaccttttcagacatgacggttcttggttcacacattacgattttcctccaattcagggattgtttggtatctctttgttcggagaaagcttgacatgatctatttcctcatagagatattacatatgtttcttttttgtacactactgatctctattttcatctgtagtgtgatggcatcattgataaaaagtttgatttattaactccaatccagagactgtttggtgtctttctggtcagagaaactttgaaatgatttattac

SEQ ID NO: 3268 - DNA, 2860 bp, Podocarpus macrophillus
cttggcaatcgacatatagttaaggaaaatcttaaagatggcgaaagcagtagcacaatcatctatcctatcagctaatataatagatgcaaaacttggtcaaattaagttatccaaaggatcaaggagtggtgtcaagatgattgcgaaaacatgtttcaaagctatcaacatgaggggttcttgtttacgtcaagcaacatccatagacatggttcgttattctcaaaaagactttaaggcagcagtagccgcatctctatgtctcccaggtgttaaggtaaaagcaagtcgtggggtggtgaaagctatgtttgagcgttttactgaaaaagctataaaggtaatcatgcttgctcaggaggaagcaaggcgccttggacacaactttgtaggtacggaacagattttattaggtctcattggtgaaggaacgggctatgcagccaaggtgttgaaaaatatgggaatcaatcttaaggaggcccgggctgaggttgagaaaatagttggtaaaggtagtggttttgttgctgtggagattccattcactcccagagcaaaacgtgtattagaactgtcacttgaggaagcacggcaacttggccacaaacatataggatctgagcatttacttttgggattgcttagggagggtgaaggtgttgcagctcgtgttcttgaaaatcttggagcagacccaagtagcatccgcactcaggtaattcgcatggtagcagaaaacgcggaccctgttacttcaggagtagatggtagcagcagtactagcaagatgccaacacttgaagagtatgggacaaatttaactaggttagcagaggaggggaaacttgatccagtggttggaaggcagccacagatagagcgtgttactcaaatactgggacgccgtacaaagaacaatccatgtctcattggggagccaggtgttggtaagacagctattgctgaaggtcttgcccagcgaattgcctctggagatgttccagaaactattgagggcaaaaaggtgattactctagatatgggtctgcttgtggctggaaccaagtaccgtggagagtttgaagaaagattgaagaagttaatggaggaagtcaggcaaagtgatgacataatcctcttcatagacgaagtacacactttaattggagcaggtgcagctgaaggtgcaatagatgcggctaatattttgaagccagcccttgctcgtggtgaactacagtgtattggagccaccactcttgatgaatacagaaaacatattgagaaggatccagctcttgagaggagatttcagccagttcaggtgccagagccaactgttgatgaagccatacaaattttgggaggattgcgtgaacgatatgagatccatcataagttgcgctatactgacgaggctttggctgctgctgctcaattatcgcatcagtatatcagcgatcgtttccttcctgataaggcgattgatttgattgatgaggctggctctcgcgtacgattgaggcatgcacagattcctgaagaggctaaagagctggaaaaagaacttagacagatatcaaaggaaaagaatgaagctgttcgaaatcaggactttgagaaggctggagagctacgtgaccgggagatggagttgagggcacaaattactgctgtaacagagaaggggaaagaagagtcaaaggctgagactgaggtggaagatggtggtccaacagtaacagaggcggatattcatgaaattgtagctgcatggacaggtattcctgtacaaaaggtgtcaacagatgagtctgacaaactcttgaagatggaggacacacttcaccaccgtattataggtcaggatgaggctgtagtagctatcagccgagctatccgtcgagctcgggttggtttaaagaatcccagtaggccaattgcgagttttattttctcaggtccaacaggtgttgggaagtcagagcttgccaaagcattggcagcttattattttggttcagaagaggcaatgatacggttagacatgagtgaatttatggagagacatactgtctcaaagctgattggttcaccaccagggtatgttggctacagtgaaggtggacaactgactgaagctgttagaaggcgtccctatacagtggttctatttgatgagattgagaaggctcatcctgatgtatttaatatgatgcttcaaattttggaagatggaagattgacagatagcaagggacgaactgttgattttaagaacactcttttgataatgacttctaatgtgggaagcagtgtgattgagaaaggaggttgtcgtatggggtttcagtttatggatgatgatgttgaggaggatgccaactacacaagaattaagagtcttgtgattgaagagatgaaaagatattttcgtcctgagttcttgaatcgtctagatgaaatcattgtgttcaggcagcttaccaagactgaggtgaaagagatttcagatattatgcttaaagaggtttttgaacgtctaaaactgaaggaaattgatcttcaagtaacagagaggttcagagacagagtagtagatgaaggttacagcccaagttatggtgctagacctttacgtagggcaattatgagactattggaagattgtatggctgagaaaatgctttctggtgaaatcaaggaaggtgattcagcaatagttgatgtagatcttgatggcaatgtgactgtcttgagtggatctagtggcaaatcagcatcaccatccaccatgattgtggcctagaaaatgactaggaaggtgaatagctggccagatactgttaactgg

SEQ ID NO: 3269 - DNA, 3340 bp, Sciadopitys verticillata
ccggcagcgaatgcaggagccattataattattttgcactgtattctccttcgccccatatctgcagcagcaaaaagattaaaaaaacagcttctattcagttcatcaagtggcataaaatcaaggtgaaccttaaagatggcgggaacactagcacaatcagctattctatcggctagtataatagatactaaacgaggtcaaattaagacatcgaaaatatcaagagctgtaaagattaccaatgcatatgcccgacctcttaacatgactagtttttctcggtttcctcgactaacatcaactggcattatttgttgtcctcaaaaggacttccgagcagcagtagcagcggcattatgtcttccagctacaaagaaaaagccaagtcgaggggtttgtgtggccatgtttgagcgttttactgaaaaagctattaaggtaattatgcttggtcaggaggaagcaaggcgccttggacacaaccacgtaggaacagagcagatattgttaggtatgattggtgaaggaacaggcattgcagccaaggtgttgaaatcaatgggaattaatctcaaggaggctcggattgaggttgagaaacttattggcaggggaaatggctttgttgccgtggaaattccatttactcccagagcaaaacgtgttttagaactggcctttgaggaagctcgacaactagggcatagctatataggatctgagcacttgcttttgggattgcttagggagggggaaggagttgctgctagtgtgcttgaaaaacttggagcagacccaagcaacatccgcactcaagtaattcgcatggtaggagaaagtgcagaagctgttggtgctggcgtaggaggtgccagcagtagcaacaagatgccaacacttgatgagtatgggacaaatttaaccaggttggccgaggaggggaaacttgatccagtggttggaaggcagccgcagatagaacgggttactcaaatcttgggacgtcgcacaaagaataatccatgccttattggtgagccaggggttggaaagacagctatcgctgagggtcttgcccagcgaattgtgtctggagatgttccagaaacggttgagggaaaaaaggtggttacattagatatgggcttacttgtggctggtactaagtaccgcggagagtttgaagaaagattgaagaagttaatggatgaagtcaaacaaagtgatgacataatcctcttcatagatgaagtacacacattaataggagcaggtgcagcagaaggtgctatagatgctgctaatattctgaaaccagcccttgcacgtggtgaactacagtgcattggagccactactcttgatgaataccgaaaacacatcgagaaggacccagcgcttgagaggaggttccaaccagttcaggtgccagaaccgactgtggatgagaccatacagatcttgggaggtttacgtgaacggtacgagatccaccacaagctgcgctataccgatgaggctttggttgctgctgctgaattgtctcatcagtatattagcgatcgtttccttcccgataaggcaattgatctgatcgacgaggctggttctcgagtgcgattgaggcatgcacagcttcctgaagaggccagagagctggaaaaagaatttagacaaataacaaaggaaaagaatgaagctgttcgaagtcaggacttcgaaaaggctagtgagctacgagaccgcgaggtggagttgaaggcacaaattgctgctgtaacagaaaaggggaaagaaaaatcaaaggctgagactgaggtgggtgatgctggtccaacagtaacggaggcagatatccaacaaattgtgtctgcatggacaggtattcctgtttccaaggtctcagcagacgagtctggcagacttatgaagatggaggaaacgcttcaccaacgtgttatagggcaagatgaggctgtaaaagcaatcagtcgagctatccgccgagcacgagttggtttgaagaatcccaataggcctattgcaagctttattttctcaggtccaacaggtgttgggaagtcagagcttgccaaaacattagcatcttactattttggttcagaggaggccatgatccggttagacatgagtgaatatatggagaggcatactgttgcaaagttgattggttcacccccaggatatgttggttattctgaaggcggacaactgactgaagctgttagaaggcgcccttatacggtggttctgtttgatgagattgagaaggctcatcctgatgtattcaatatgatgcttcaaattctggaagatggaagattaacagatagtaaggggaggactgtagattttaagaacactcttttgataatgacttctaacgtgggaagcagtgtgattgagagaggaggaaaaagaaaaaatatgtttatgtttgattttgaggaggatgaggaggatagcagctacacatcaattaaaagtcttgtgaatgaagagttgaaatcatattttcgaccagagttcttgaatcgtttagatgaaataattgtgtttaggcagcttaccaagcttgaggtgaaagagatttcagatattatgcttaaagaggtttttgaacgtcttaaacagaaggagattgatcttcaagtaacagagaggttcaaagacagagtagtaaatgaaggttatagccccacctatggcgcaagacctttacgtagggcaattatgagattgttagaagattgtatggctgaaaaaatgctttctggtgaaatcaaggagggcgattctgcaatagttgacgtggattctgaaggcaaagtaacagtgttgaatggaactagtggtgcagcagaaccatcaaccaccttgacacctgtataagaaatggctatgaccagaaaattttctggttgaaatcttattcaaatatagtaagtatattcactgcgcatgtaaggacatctccttccagttcatggaggctttgggttatattttgattgctttttgttcgtacactattagtgcaatggcatcaccaaaaaatagtttgatttgttgcacaaccctatgttttactgtaggtggaaattgttaacattgttagctggttggaagcaattatatttactagtaaatataaaatgctattagtttgaccctcgtattgaaaattagtaaacttagttatctacccaggatttgggttctcagtttatgattgccacatgcatttccatgttcgatatcatgtacttctgccatttcagagtttagcagctcatacaggtatgtgcgaaagtgc

SEQ ID NO: 3270 - DNA, 3279 bp, Cephalotaxus harringtonia
tgcccaggttttctctacctgacctagctgtttcagtgggcttaagatctgagtaaagatggcggggacattatcacagtttgcagttcttccttatagaataatcagtgcaagtcatggtcaaattcatagctctaaaagagtaaatcgagttccaaagatgatgggaaatacacaatcaaattcattaagaattaaaagctacattggtttgtgccaaccaacaggcctaggtaaggttgcatgtcctacaacaaaatttcatccggcagcagcagtctctactccagcaaggaaatccaggaaagccaggaaagataagaaaggggtggttacttgtatgtttgagcggtttacagagaaggccatcaaggtaatcatgctttctcaggaggaagcacggcgccttgggcacaactttgtaggtacagagcagattctgttgggactcattggtgaaggaactggtattgcagcaaaagtcttgaaatccatgggagtcaatttaaaggaggctcgtgtagaggttgagaaaatcattggcagaggtggtggttttgttgctgttgagattccattcactccaagagcaaagcgtgtgttagaacttgcgcttgaggaagctcgacaacttggacataactacataggatctgaacatttgcttttagggttgttgcgtgagggtgagggtgttgcagcccgtgtacttgagaaacttggagctgaccccagcaatattcgtacccaagtaattcggatggttggtgaaagtacagaagctgttggtgctggagtaggaggtggtagcagcagcaacaagatgccgactcttgaggaatatggaaccaatttgacaaaacttgcagaggagggcaagcttgatccagtggttggaaggcagccgcaaattgaacgggttactcaaatattggggcgccgcacaaagaacaatccttgccttattggtgagcctggtgtaggaaagacagctattgctgagggacttgcacagcgaatagctgctggagatgttccagaaacaattgagggtaaaaaggttattactttagatatggggctacttgtagcaggcactaagtatcgtggagagtttgaggaaaggttaaagaagctaatggatgagatcagacagagtgatgagattatactcttcatagatgaagtccatactttaattggagcaggagcagcagaaggggcaattgatgcagccaatatcctaaaaccagctcttgcacgaggggaactacagtgcattggggcgaccaccttggatgaatacagaaagcacattgaaagggaccctgctttagagaggagattccagcctgtacaagtgccagagccatctgtggatgagacaatacagatattgaaaggtctacgtgaacgatatgagattcatcataagcttcgttatactgatgaggccttagtgtctgctgctaagttatcatatcagtacatcagtgatcgtttcctcccagacaaagcaattgatctagttgatgaggctggttctcgtgtgcgccttcgccatgcccagcttcctgaagaagcgagagagctcgacaaagaactgaggcagatcacaaaagagaagaatgaagctgttcgaggccaagactttgagaaggctggagagctgcgggatcgtgagatggaactgaaggcacaaattacaactgtaacagagaaagggaaagagaaatcaaaggctgagaatgaagcaggggatgcaggcccaattgtaacagaggtagatatccaacaaattgtttcttcatggacagggattccagttgaaaaggtgtcatccgacgagtctgacaaactcttgaggatggaggatacactccatcaacgtgtcattggtcaagatgaagctgtcaaagctatcagtcgagccattcgccgtgcaagagttggtttgaagaacccaaacaggccaattgcaagcttcattttctcaggtcctacaggtgttggcaagtcagagcttgccaagacattggcaacatactattttggttctgaggaggcaatgataaggctggatatgagtgaatacatggagaggcacactgtttccaagctaattggttcacccccaggatacgtgggatacactgaaggaggccagctaacagaagctgttagaagacgcccttatactgttgtcctcttcgatgaaattgaaaaggctcatcctgatgtcttcaatatgatgcttcaaatccttgaagatggaagactgacagatagtaagggcaggactgtggactttaagaataccctattgatcatgacttctaatgttggtagcagcgtgattgagaagggaggtcgcagacatggattcctttttcacttcgaagatgatgaggaagataacagctacacaagaatcaaaagccttgtcttggaagagctgaagtcatattttcgtcccgagttcttgaatcgactagatgagacaattgtttttagacaactcaccaagtcagaggtgaaaaaaattgcaggtatcatgttgaaagaagtttatgaacgacttaaaattaaagaaattgatcttcaagtaacaccgcgctttgtagatagagttgtagatgaaggttacagttccacctatggtgcaagatcactacgcagagcaatcatgaggttgttagaagatagtatggctgagaagatgctttctggtgaaatcaaagagggtgattcagctatagttgatgtaaacgaggaagggaatgtgactgtattgaatggaaacagaagtagtggcacagtagctccatcaaccccggcagtagctccatcaaccccggcagtagctgtcatggaaaagacatcatagaatctgggccaaagactggtgaaagttaatttcatataaatgtaataagcacttccatattagaatttctgttttagttttataaatttcatataaaagtaataagttcttccatattagaatttctgttttagttttacttcatcttcattgcctacttgttagacgtgcaattaatgggctggcaattggagagaggacctgtatggtcagatcctcggggttaatattaagttctttaatgtataatattgcttcccatcggctatacacttccttgtcctggttacatgtgacggatattttagtttgtcactggtttatatccaccataatagaatgaatttctatcatattactagctttcttgaaaggaaagaaaaaaaaaaaaa

SEQ ID NO: 3271 - DNA, 3144 bp, Phalaenopsis aphrodite
agaaatcagacgctgctcttcttctacgagcttccatttatcacttcggggaggaagagataggtttctaccaaacctgcttcttgatcctctaggtacatatctgcagtttcttcatacccatcaaccaagatggctggggcgtgcgttcaatctgttacccttccagctggtttggctagcattggccgcagtcgaggctctaggggttcccgaagagccgccaggatgctctgtagtccacgtttatgtcctcttaggttccaaggatattctggattgcggtattctaatgtattagatcataattccaaatctggatatggttttcattcaatggtaggggcttatatctccgctccaaagggaaaagctataaggggcgttgctgtggctatgtttgagcgtttcactgagaaggcaattaaagttatcatgcttgcacaggaagaagctagaagattagggcacaatttcgtaggaactgaacagatattgctaggtcttattggtgaaggaacggggattgcggctaaagttctgaaatccatgggtataaatctgaaagatgctcgggttgaagtggaaaagattattgggagaggcagcgggtttgttgctgttgaaataccatttacaccacgtgcaaaacgggttctagaactctccttggaagaagcccgtcaactaggtcataattacataggttcagagcatttactacttggattgcttcgcgagggtgaaggtgtggcagctcgtgtgttggagagccttggagccgacccaagcaatattcggacacaggttattcggatggttggtgagagcacagaagctgttggtgctggagttggagggggaagcagtgggaataagatgccaacacttgaggagtatggcactaatcttacgaagttggctgaggagggtaagcttgatcctgttgtaggaaggcagcaacaaatagagagggttacccagattttaggtaggcgaacaaagaataacccttgcctaattggagagcctggagttggtaaaacagccattgcagaagggctagctcaacgcattgcaaatggggatgtgccagagacaattgaaggaaagaaggtgatcactcttgacatgggccttcttgttgccggcacaaaatatcgtggagaatttgaagaaaggttgaagaaattaatggaagaaatcaaacagagtgatgagattatactctttattgatgaggttcacacattaattggagcaggagctgcggagggtgcaattgatgccgcaaatatcttgaaacctgcacttgctagaggtgaactgcagtgcattggagccactacacttgatgagtatcgaaagcacatagagaaagatcctgcattggaaaggagatttcaacctgttaaagtacctgaaccaacggtcgatgaaacaattcaaattctaaaaggacttcgtgagcgctatgaaattcaccacaaacttcgctacacggatgaggctctcattgctgctgcacagttatcttatcagtatatcagcgaccgattcctaccagataaagcgatcgacttgatcgatgaggccggttctcgcgttcgacttcgacatgctcaactccctgaggatgccagagaactggacaaggagctccgacaaatcaccaaagataagaatgaagctgttcgcagccaggatttcgagaaggcgggtgagttgagagaccgagagatggagctgaaggcccaaatctctgccctcatcgacaaaggcaaggaaatcagcaaagccgagagtgaggccggcgacgccggccccatcgtcaccgaagtagatatccaacatatcgtatcctcttggaccggaattcctgtcgagaaggtctccagcgacgaatccgaccgccttctcaaaatggaggaaacacttcaccagcgcgtcattggccaagacgaggctgtcaaggctatcagtcgcgccattcgtcgtgctcgcgtcggcctaaaaaaccctaaccgccccattgctagcttcatcttctccggccccactggcgtcggcaagtcggagcttgccaaggcccttgccgcctactacttcggctccgaagatgccatgattcgcctcgacatgagcgagttcatggaacgccacaccgtctcgaagctcatcggctcgccgccaggctatgttggctacaccgaaggtggccaattgacggaagccgttcgccgacgtccatacaccgttgttctcttcgatgagattgagaaggctcacccggacgtcttcaacatgatgctccagatcctagaggacggccggctcaccgacagcaagggccgaaccgttgacttcaagaacacgcttctgatcatgacgtcgaacgtaggcagcagcgtgattgagaaaggagggcggagaatcggcttcgatctagactatgatgagaaggacagcagctataacagaatcaagagcctggtgactgaggagctgaagcagtatttccggccagagttcctgaaccggctcgacgagatgatcgtgttcaggcagctgacgaagctggaggttaaggagattgccgacatcatgctgaaggaggtgtcgagaggtgaagacgaaggacattgagttgcaggtgactgagaggttcagggatagggttgtggaagaagggtatagtccgagttatggggcgaggccattgaggagggcgattatgaggcttttggaggatagtttggctgagaggatgctttcgggggagataaaggaaggggattcagcgatcgtcgatgtcgattcagatgggaatgttacggtgttgaacggtagcagcgccccgccggagacgattagtccggcgatgtcaatctgatgcgatgcagcttttcggcgagatggggtgtggtttatgttgatgtagaatgaatgtgtagtaaactggttgtaaaacttttaattgagtgtggagaagagggttctatgtaagctggagatgagttctcgggttaggtttaaatagggtttaatgaaataataatgcagttaggtaaggtatggtgaatgatgatgatatttttatagttaaaagtttgttgttttaaagagtgcaatctttttattttg

SEQ ID NO: 3272 - DNA, 3122 bp, Zea mays
gctccccctgcacctccgctccatggcgcgatgcaggctggtatgaaccattgcactctcctttcatccgctctagatctgggaacgagcaatccccatgctctggatccccacactctggatctgggaacaagcaatctccgtggtcaacatcctacaatccccacgctctggatctgggaacgagcaatctctgcacatttgtgctggttcgtcctccatccgcacgcccccaatatcctacatcagcgcacgtatctttcaccgatatctgccccattccatctaacatggaaacccaaatccccaccacaatcagcgttcatcgtcgattcctacatccgcgccattccatcgaacatggaaacctcaatgcccacctcaatcagcgttcatcgtcgagtcccaccttccagtgcacactcggttccctcgacgctctcaacttctattaaaacacacgaccactgcgagggatgtagacaaatcccccatcaaacttcaacactcgttgtctgttcaacacccattacgatcgcagtgggcttcaacgccttcgccgggcataactatgtaggatctgaacacttgctccttgggctacttcgtgagggtgaaggtgttgctgctcgtgtgcttgaaagccttggcgctgatccaaacaacatccgcacccaggtcataagaatggttggggaaagcacagaagctgttggggctggagttggtggaggaagcagtggccagaagatgcccacacttgaagaatacggtactaatttgacaaaattagcagaagagggcaaattggacccagtcgttggtagacaagatcagattgagcgtgttactcagattttgggcaggcggacaaagaacaacccctgcctaattggagagcctggtgttggaaagactgctattgctgaggggcttgctcagcgtattgccaatggggatgttcctgaaacaattgaaggaaagaaggttattactcttgacatggggctccttgttgctggaactaaataccgaggagagtttgaagagagactaaagaaacttatggaggaaattaagcaaaatgaagacattattctctttattgatgaagtgcacacactgattggagcaggtgcagcagaaggtgcgattgatgctgctaatattttgaagccagctcttgctagaggtgaacttcagtgcattggtgccacaacactggatgagtataggaagcatatagagaaagatcctgccttggaaagaaggtttcaaccagttaaggttccagagcctactgtggatgaaacaatacagatcttaagaggacttcgtgagagatatgaacttcatcacaaactgagatacacagatgatgctttaattgctgctgcacagctgtcttatcagtatatcagcgatcgtttcctgcctgacaaagccattgacttgattgatgaagctggatctcgtgttaggctgaggcatgcgcagctccctgatgaagccaaagagctggacaaagagctgcggcagataaccaagcagaaaaatgaggctgtacgtggccaagatttcgagaaggctggcgaattaagggaccgagaaatggagcttaaggctcaaattacagccattattgacaagagcaaggaaatgattaaagcagagactgaatctggtgaagtcggtccgcttgttactgaggcagacattcaacatattgtctcctcttggactggaattcctgtggagaaagtgtcatcggatgagtctgaccgcctcctaaagatggaagagacgctgcatacacgtatcattggacaggatgaggctgtcaaagctattagccgtgctatccgccgtgctcgtgttggcctcaagaatccaaataggccaattgccagcttcatattctctggaccgactggagttggcaaatcagagcttgcaaaggccctggcggcctactactttggctcggaggaggctatgatcaggcttgacatgagtgagttcatggagcggcatactgtctccaaactcattggatcacctccaggttatgttgggtacactgagggaggccaactaactgaagcagtccgtcgccgcccgtacacagttgttctctttgatgagattgagaaggcacatccagatgttttcaacatgatgcttcagatcttagaagatgggcggttaactgatagcaaggggcgcactgttgatttcaagaacacactattgatcatgacatctaatgtcgggagcagtgtcattgagaagggaggtcgcaagattgggttcgaccttgattatgatgagaaagacacaagctataacaggatcaagagccttgtgactgaggagttgaagcagtacttccggccagagttcttgaacagattggatgagatgattgtattccggcagctgactaaattggaggtgaaagagattgcagacattatgctgaaagaagtgtttgacaggctgaaggccaaggacattaatctccaggtgacggagaagttccgagatagagttgttgacgaaggttataacccgagctatggtgccagacctttgcggcgtgctatcatgaggcttctggaggatagtctggcagagaagatgctggctggtgaggtgaaagaaggtgactctgccatcgttgatgtggattcagatggcaaggtaatagtcctgaatggtggtagcggtgttgctgagccactggaacctgctctcagtacctaaccgaggttaaaatctttgggccgaaatggccttctttacaagtcagctgggctcttcgtgatggtaaagtagactgttattacttggccgctccattagttgctttatctttcattgatttttttttgttggaagtgaggcagtagggtcactatggaaacgaatagacggagaggcattagccgaaatgaatgtttttcagtttgatgcacttgtattattaggccttgctagcaacaaggtgcagatgcctctccgtttgctgttgtactttagtgtaacttaccttccgaatgtattattaggcgttgctagcaacaagatacggaggttatacatttgattttcagtaaaaa

SEQ ID NO: 3273 - DNA, 4869 bp, Brassica rapa
acacgggccgaccattaaaagagagtctctctctcgctttctcgcacttctccatccaaagggccaaaggcgtagtagatagcctccaactcttgcatcatggctaggctcttggctaattctacatcccgttctttacttggttccggaagagactttcagtcagaagactacagaaaaccaagaagatgtgtgaagatgatgtacacttctcaaacatccgttttgagtatccagagcttctctggtttaagggcttccaatgcgctggatcgggtggcaaggcctagccacgactttttcggtaaggttaaccttcaaatgtcttcttcccggagagaaaaagctagccgaggtgtaacaaaagccatgtttgagcggtttaccgagaaagcaatcaaggtcatcatgctgtctcaagaggaagctcggaggcttggccataactttgttggcactgagcaaatactgttgggactgattggggaaggcactggaatcgctgcaaaggttcttaaatccatggggatcaatcttaaagattctcgtgtggaggtggaaaagatcattggaagaggcagtggttttgtggctgtggagatcccatttactcctcgtgcaaagcgtgtcctggagctctcacttgaggaagctcgccaacttgggcataactacattgggtcagagcatcttctgcttggtcttcttcgtgaaggggaaggtgttgcagctcgtgtcctggagaatttgggtgtagatgctagcaacatccggacgcaggttatacgtatggtgggagaaaacaatgaagtgacggcaagcgtgggtggaggatctagcggaaacagcaaaatgccaacactagaagagtatgggaccaacttaactaaactagcagaagagggtaaactggatccagttgttggaaggcagccacagatagaaagagtggtccagatcttggctcgaagaaccaagaacaacccttgtcttattggagaacctggagttggtaagacagcaatagctgaaggactcgcacagagaattgccagtggagatgtccctgaaacaattgaggggaagacggtgataacccttgatatgggtcttcttgtggctggaacgaagtaccgtggagaatttgaagaaaggttgaagaagctgatggaggagatcagacaaagtgatgacataatcctgtttattgatgaagtgcacactctgatcggtgcaggagccgctgaaggtgccattgatgctgctaacatcttaaagccagctcttgcaagaggtgaattgcagtgtattggtgcaacaacattggatgagtacaggaagcacattgagaaagatcctgcactggagagacggttccagcctgtcaaagtacctgaaccaactgtagacgaagctatacagatcttgcacggtctgcgtgagcgttatgagatccaccacaagctccgctacactgatgaagctttggttgctgctgcgcagttgtcacatcagtacatcagtgaccggtttcttcccgacaaagccattgacttgattgatgaagctggatctcgggttaggctgcgtcacgctcaggtccctgaggaagctagagagcttgaaaggcaactcagacagatcactaaggagaagaatgaagctgtaagaggccaagactttgagaaggctggttctcaccgggaccgggaaatagagcttagagccgagatagctgctgttttagccaaaggcaaagaagtgaacaaagctgagactgaagctggcgaggaagggggacctactgtcactgaatccgacatccaacacattgtctccacctggacaggaatcccagtagagaaagtctcctctgatgaatctagccgtcttctcaagatggagcagactcttcacacaagagtcattggccaagacgaagccgtcaaagccattagcagggccatccgacgtgcacgtgttggactcaagaacccgaaccggccaatagcaagtttcatcttctctggtccaaccggtgtggggaaatcagagcttgccaaagccttggctgcttactacttcggctcagaggaagcaatgatccgtctggacatgagtgagttcatggagcgacacaccgtttcgaaactcattggttcgcctcctggttacgtaggatacacggaaggaggtcagctaacggaggcggttagacgcaggccctacacgcttgtcctcttcgacgaaatagagaaagctcatcctgatgttttcaacatgatgcttcagatcctagaagatggcagactaactgacagcaaaggaagaacggttgatttcaagaacacgcttctgatcatgacatcaaacgtaggaagcagcgtgattgaaaagggtggtagaagaatcgggtttgatctcgactacgacgagaaagacagcagctacaacagaatcaagagcctagtgactgaggaactgaaacagtatttcagaccagagttcttgaacaggttggatgagatgattgttttcagacagttgacgaagctggaagtgaaggagattgctgatataatgcttaaagaagtggtggtgaggcttaaggacaaggagattgagcttcaagtgactgagaggtttaaggagagagtggtggatgaagggttcgacccgagctacggtgcaaggccgctgagaagagcgattatgaggctgttggaagatagcatggcggagaagatgctttcaagggagatttaagatggagactctgtgattgttgatgttgatgctgaaggaagtgtggttgtgttgaatggtaagaacggaagtggtgacggttttgttgctgaagaagccatggaggatccaattcctgtgttgtagaagggaagaggagagttctagagattttatttttcttcatctctttgaagtgttgttggttgaactgtctcatttgattttgtttttgcatttttaaattgtttctggatattgattgctcgggaaccatggggagcttccctcaacacgaaaaaatgaaatgagaataacatggtcagagctgaatcgagttattttctttaaccaaagcttgtagaacttaagttgcgaatttaagaataccaaagcttacacagtcggagtgtgaaaaaagagtacacagattcttcgtgaaacttgcatgaaaagaaagaaatatacaaaccgaaaatttcatataccgtagtgaggaagaagcaacaaattacaagagaggaaaaagcttcaactatggatcagcatcgagatcgtgattcgaaggagaagaagtgggagatggaagctgatcaatttctcttcgagaagcttcccataactgttgttctattcccagtttccttagctctatcaatcctctttccactgaaggaagacaaagaaaaatcgaaacatttcagcttcatcattgtgaatcgaaaagattttcaagcgataagtcagtaggtgtgatttttaccatccaaggaatcgtgagaagtagttgatttcccgttgctacggctgatccatagctggacacgttcttctgcgatgtcttcttccacacccagtaacttagctctgccccagaagtacatcagccatgcctggattatgtgaaattgtagcaatcaagaccatattttgattgaaacccgtgtatgttccattgctctacatgtctttctaagcaactgcaatcaggatacacgtgtatttgatgatgagaaagtacctgcttaaaggcaacatcttcttgttccgcttcacccaattctgcatttaaaaataagatgggaatattgtaaaaaataattaatgaaatggctgatgacattgacatgtgactattagtccgacgaaggcatatatcggcctagtgtctccaagttcttttttctcgaccactttctctactaaatcgacaactccacgcactatcaacatccaatggttgagggttcgacgccccaagaacctctacataagggtggatcacaaagagaagatcaaaagaacctgaaagttttttccttaccatatgcatctacaaatctggattctccatgacctttgtgatctgtaagacataggaaaaaacaaataatcacatttgcttttagctctgcaggatgccaaagatatatataccatcgtctggatgtgaccagagacatgccattactgaataataataatgataacttttgagcagaaaccggtgcagcttcattataagagcttatgtgtgtttctatagaagacaatgctcatagacatcttaagaatagaagcggagagaaagtgaaggatatattttggtgttaaaagctcgtaattccatacataccagaaacagtttgacgtatcaaacttggttttctctgctgggcaaatgcaagaacgatagcatcctcaacctgaatatttaaacataaaagaagatttttaaaacgttgtctttagagatctatagttaaaggtaacttagaatcaagagcggacacctttaatgatgctagctctctcaaacccatctcaactgaaagcatactttcaatatttccttctccagttagatcactcaaatctctagcagctctattccgatcattcccacctgcttcattgggaacaacaataagcaaggtatactttacagtttaaactaaagcagaatttagacgagcctttatcccaagataaatccttggccttctgtgctgcagaggtgacaagctcaaatggaagaggagccaacgccgaccaatgctcatgcctggatagtgctatatccgcaaaaatgtctacaaaaggatagaattggaagaaagcaca

SEQ ID NO: 3274 - DNA, 2825 bp, Sequoia sempervirens
aaagatggcagggacactagcacagtttgcagctcctccttatagaataatcagtacaagtcagggtaaaattcagacctctagaagaacaaaacaagttccaaagatgatgtgcaatatgcagtcacattcctttagaattagaagctacattggcttgtgccatgcaacagaccgaggtaaggttgcaagtcctacaacaaacttttatgcagcaggagcagtctctactctggcaaggaaagccaggaaagccaggaaagggtggttacttgtatgtttgagcggtttacagagaaggctattaaggtcattatgctttctcaagaggaagcgcggcgacttgggcacaactttgtaggtacagaacagattttgttgggtctcataggtgaagggactggtattgcagcaaaagttctgaaatccatgggagtcaatttaaaggaggctcgtgtagaggttgaaaaaatcattggcagaggcagtgggtttgttgctgtggagattccattcactccaagagcaaagcgtgtgttagaacttgcacttgaggaagcgcgacaacttggacataactacataggatctgaacacttgcttttagggttgttgcgtgaaggtgaaggtgttgcagctcgtgttcttgagaaactcggagttgaccctggaaatattcgaacccaagtaattcgaatggttggtgaaagttcagaagctgttggtgctggagtaggaggtggtaccagcagcaacaagatgcctactcttgaggaatatggaaccaatttgacaaaacttgctgaggagggcaagcttgatcctgtagttggaaggcagccacaaattgaacgagttactcaaatattggggcgtcgcacaaagaacaatccttgccttattggtgagcctggtgtaggaaaaacagctattgctgagggacttgcacagcgaatagcttctggagatgttccagaaacaattgaggggaaaaaggttattactttagatatggggctactggttgctggaactaagtatcgtggagagtttgaggaaaggttaaagaagctaatggatgaaatcaaacagagtgatgaaattatactctttatagatgaagtccatactttaattggagcaggtgcagcagaaggagcaattgatgcagccaatattttaaaacctgctcttgcacgaggggaactacagtgtattggggccaccaccttggacgaatataggaaacacattgagaaggaccctgcattagagaggagattccaacctgtacaagtgccagagccaactgtggatgatgcaatagagatattgaaaggtttacgtgaacgatatgagatctttcacaagcttcgttatactgatgaggctttggaatctgctgccaagttatcacatcaatacatcagtgatcgtttcctccctgacaaagcaattgatctaattgatgaggctggttctcgtgtgcaccttcgccactcacagcttcctgaagaagcgaaagagcttgaaagagaagtgaggcagattacaaaagagaagaatgaagctgttcgaggccaagactttgaaaaggctggagagctacgtgatcgtgagatggaattaaaggcacaaattacagctataacacagaaagggaaagagaaaacgaaggctgagcatgaagcaggagatggaggtgtagtcgtaactgaggtagatattcagcaaattgtatccttatggacaggcattccagttgaaaaggtatcatctgatgagtcagataaactcttgaagatggaagatacactgcatcaacgtgtcattgggcaagatgaagctgtcaaagctatcagtcgagccattcgccgtgcaagagttggcttgaagaatccaaacaggccaattgcaagctttattttctcaggtcctacaggtgtcggcaagtctgagcttgccaaagcattggcagcatactattttggttctgaggaagcaatgataaggctggatatgagtgaatacatggaaaggcacactgttccaagctgatggttcacccccaggatatgtgggatacaccgaaggaggccagctaactgaagctgttaggcgacgcccttatagtgtcgtcctctttgatgaaattgagaaggctcatcctgatgtattcaatatgatgcttcaaatccttgaagatggaagactgacagatagcaaaggtaggactgtggacttcaagattacccttttgatcatgacttctaatgttggtagtagtgtgattgagaagggaggtcgtagatctggattcctttttcaatttgatgaagatgaagaagataacagctacacaagaatcaaaagtcttgtcttggaagagctgaaagcctattttcgtccagagttcttgaatcggctagatgagacaattttttttagacagctcaccaagtcagaggtgaaagacattgcagctataatgctgaaagaagtctttgaacgccttaaaatcaaagaaattgatcttcaagtaacagatcgcttcagagacagagttgtagatgaaggttatagtcccacctatggtgcaagatcactacgcagagcaattatgagattgttagaagatagtatggctgaaaagatgctttctggtgagattaaagagggtgattcagctatagttgatgtaaacgaggacgggaatgtgactgtcttgaatggacgtaaggacacagtagctccattaacatcagcagcagctgtctaggaaaaggcatcatacatttgaatatttaggccaaagattggtgaaa

SEQ ID NO: 3275 - DNA, 3091 bp, Ceratodon purpureus
gttgctcagctgcaaggcggtgccaaaagcgggaggcggggtgctgcgagggagtcgctggcgggaaggaagagtgtgcagatagattctgcgagtttgtcaatctcgtttttccagtcctccgccggcatgcggaaggcctccgcgattgattcgttgagcgtgatgcaagggaaggagtttaggtccgtggtggcgaggtctactgcggtgtcgaagaaatccggggcgtcgagggcggtgacgacggcgatgttcgagcggttcaccgagaaggccatcaaggtgatcatgttggcacaggaggaggcgaggcggttggggcacaatttcgtgggaacggagcaggtattgttagggcttattggcgagggaaccggcattgctgcgaaggtgttgaagtcgatgggagttaatctgaaagaagcgcgtgtggaggtggagaagatcattggacgcggaagcgggttcgtggctgtggagatcccttttacgcccagggcgaagcgagtgctggagctgtcgctggaggaagccaggcagctcggccacaattacattggtaccgagcaccttctgctcggactgctacgagagggtgagggtgtggctgctcgagttctggagaatcttggagctgacccaagtaacattcggtctcaggtgattcgaatggtcggtgagaataccgaggccgtaggtgtcggtggtggcactagcagcagcggcaacaagatgcccactttggaggaatatggaaccaatttgaccaagctcgctgaagaggggaagcttgatccagtcgtcggaagagttccccagattgagcgggtgactcaaattctgggtcgtagaaccaagaacaacccttgtctgattggtgagcccggtgtgggaaagactgccgttgcggagggcttagcccagaggattgcatccggggacgtgcctgaaaccatcgagggcaagaaagtgatcactcttgacatggggttgttggttgcgggaacgaagtacagaggagagtttgaggagaggctgaagaagctgatggaggagattaagcaggcagacgatattatcttggtgatcgacgaggtgcacacgctgattggtgctggtgccgcagagggtgcaattgacgctgccaacattttgaagcctgcattggctcgtggtgaattgcagtgtattggagctacgactttggatgagtacaggaagcacatcgagaaggatcctgctttggagcgtcgttttcagcctgtgctggttccagagccgacggtggacgagactatcgagattctgaagggactgagggagagatacgagattcaccacaaattgcgttacactgatgaagcactggtggcagcagctcagctctcttaccagtacatcagtgaccgatttctacctgacaaggccattgatttgatcgatgaggctggttcccgagtgaggctgaaacacgcccagctacccgaagaggctagggaacttgataaggaactgcgggccgtgacaaaggagaaaaatgaagccgtccgtggtcaggacttcgagaaggccggagagttgagggaccgcgaaatggagttgaagtcacaaatatctgcctgcatcgagaagggcaaggagcacatgaaggccgagagcgagaccggtgatgttggtccgaccgtcgaagagtccgacattcagcagatcgtggctgcgtggaccggaatccctatggagaaggtatcgagcgatgagtcagatcgtctcttaaagatggaggacacgcttcacaacagggtgatcggtcaagacgaggctgtgaaggccatcagtcgtgccattcggagggcgcgtgttggactgaagaatccgaaccggccgattgccagcttcatcttctccggtcccacgggagtgggtaagtctgagctggccaaggccctggcctcgtactacttcggttccgaggaagcgatggtgaggctggacatgtcggagttcatggaaaggcacacggtgtcgaagctgatcggttccccacctggatacgtggggtacagtgaaggagggcagttgacagaagcagtgcggaggaggccgtacacggtggtgctgttcgacgagatcgagaaggcccatccagatgtcttcaacatgatgctccagatcttggaagatgggcggttgacggacagcaaggggcggacggtggacttcaagaacactctgctgatcatgacgtcgaacgtgggaagcagtgtgatcgagaagggcggaggtggcatcggttttcagctggactacggcgagaaggactcgagctacaaccggattaagagcctggtgaacgaggagctgaagcagtacttcaggcctgagtttttgaacaggctggacgagatcatcgtgttcaggcagctgacgaagctggaggtgaaggagattgcggacatcatgttgaaggaggtgttcgagcgtttgaagaagaaggagatagatctgcaggtgacggagagattcagggatcgcgtggtggacgaggggtacagcccgagctatggtgcgcggccgttgagaagagcgatcatgaggctgttggaagacagcatggcggagcgcatgctgtccggggagatcaaggagggagattcagcaatcatcgatgtggacagcgagggcagcgtgactgtattgaacgggtcgacaggaatgtcttctaacacacttatagatgtgaccccttctggcatcgcctaaaactccggaaggagatggggagttagtcttgttaggtaaagtggtcgtgtttcgttaagcttggtaggtgcaggaatctagtcaagaatccttcatgaacatattgaagggtggtgtggagtaggaagggaagggtgaaattggaattcatttctgtctgctgtcggcgagtgggaggtttttgcattgacctagtgtcgacctgctgtagattctggcaagtgatctgcaaggccattgcctggaatggtggagatttgacatattgtcgagtttgaagactctgctcttgaggaattgttgtgaggtgtaccgatcatgaataggg

SEQ ID NO: 3276 - DNA, 2850 bp, Setaria italica
caagctccttcaacatacaacctcatcagaaatgtcttccatggaagattaaacgtctaatcatttctaaacaatgtacttatcaaatacacgagtgcacaatctgacgaagacgactattaactaaatcgtaattgattgccgtgcggcaaccacaaactcaattcagtaataaaagcccaaattaactcgaagtgaacacccgtctaactctaaactcacgtgattaattaacgtaaacctgcactagaaaccccacccgcgaaacacggtcttaagtaaccgccaggtcagcatcaatgccctagttggcaatggtcatcgcataaccaccagccttccctttcccttcccgtccgtcccacccccctcccggatcctcccagacccgccaagcgccaccgccgtttcggatccgggcccgctagcgggtccgggaacacacccacccgctcctcgccggcgacccggcgccgcccccggagccatgaagcgcgcacgcagctccgaggtgttcgtcggcggcagccggctgcgcgcgcgccggcgcctggctcccctcctcgccgcggcggcgttcgcgtacctactcttcgtgtcagtcaagctcgccggcttcggcggcgctgggcccgcgggtgccgtcagccgcctgtccgccgcgggagcgggcgcgggcgagccgctgcgggggagggtcgagcagccggcggttccccgggcccgcgcgcgccccgcggcggccgtgtccgggtacggccgcatcaccggcgagatcctccggcggcaggagtccggcggggggcggcggaggcggtggggccagctggggaacttcacggagctggagcgcacggccgccgaggcgtgggcgctgggggccaaggcgtgggaggaggcgtccgcgttcgccggcgacgtcgactccatcgcctcccgcgacgcgggggagtgccccggctcgctggcgctcgggggcggcggggaggcggcggcgttcctgccgtgcgggctggcggccgggtcggcggtgacggtggtgggcacgccgcgggcggcgcggccggagtacgtcgaggcgctggagcggagcggcgcgggcaacgggaccgtgatggtggcgcagttcgcggtggagctccgcgggctgcgcgccgcagacggcgaggagccgcccaggatactgcacctcaacccgcggctgcgcggggactggagcggccggccagtgctcgagatgaacacctgcttcaggatgcagtggggcagggcgcagcgctgcgacggcaccccctcgagagatgacgctcaggttgatggattcagaaaatgtgagaaatggcagagacgggacatagttgaatcaaaagaaacaaagacaagctcatggttcaacaggtttatcggccgagcaaagaaaccagaaatgacatggccattcccattttcagagggcaagatgtttgttctcactatccaagctggtgttgaaggataccatatcaatgtgggaggccgccatgttgcctcgtttcctcataggatgggatttgctcttgaagatgctacaggtttagccgtaacagggggcatagatgttcactctgtgtatgcaacagcacttccgagggcccatcctagtttttctctacaacaagtcttggaaatgtctgaaaagtggaaggctcgccctgttccagtggaaccaattcagctttttgttggcattctctctgctacaaaccattttgctgagcgcatggctattcggaaaacctggatgcagtttccagcgatccaattgggaaatgtggttgctcggttctttgtcgcactgagccataggaaggagataaacgcagcactaaagaaggaagcagaatattttggagacatagtcattctgccatttatcgaccggtatgagctggtggttctgaaaacagttgcgatctgtcaatatggggtgcaaaatgttactgcggattatatcatgaagtgcgatgatgacacctttgtgcggcttgatatagtattgcaacaaatcactacctacaacagaaccttacctctttatctgggcaacttgaatctcctgcacaggcctctaagaaggggcaaatgggccgtgacctatgaggaatggcctgaagcggtgtatcccccgtacgccaatggacctggttatgtcctctcaatcgacattgcaagagacatcgcatcccggcatgcaaaccactccttaaggctgttcaagatggaggacgtgagcatgggaatgtgggtggaggactacaatgccactgcaccggtgcagtacatccacagctggaggttctgccagttcggctgcgtggataactacttcacggcacattaccagtctcccaggcagatgctatgcctctgggataaactgtcagccggccgagcacagtgctgtaactacagataacgcgacgctccaggggtgcaggtggaatcagatggctatccatgtggtatcctttgtcccacgatcatgtacaacaggagaatttcaggatctccactgcatcctttggcttcagctccatccgatccactaaccctagaaaccattttgacatctcatgttcaattctttgatctttatgagatttataggtgtggagatttataggtgtgtgggtgtgatcaactgcttcaccttcattgaggtggatgcaaagatgagggaggagtaatggaatccacgttggctgcttgtacaggggcaagttcatttgtaaaactgcaaatctgtatccactattggtggacagtaagtcagcatgacggcatgaatggaatgagaaactgtttccctat

SEQ ID NO: 3277 - DNA, 2857 bp, Setaria italica
caagctccttcaacatacaacctcatcagaaatgtcttccatggaagattaaacgtctaatcatttctaaacaatgtacttatcaaatacacgagtgcacaatctgacgaagacgactattaactaaatcgtaattgattgccgtgcggcaaccacaaactcaattcagtaataaaagcccaaattaactcgaagtgaacacccgtctaactctaaactcacgtgattaattaacgtaaacctgcactagaaaccccacccgcgaaacacggtcttaagtaaccgccaggtcagcatcaatgccctagttggcaatggtcatcgcataaccaccagccttccctttcccttcccgtccgtcccacccccctcccggatcctcccagacccgccaagcgccaccgccgtttcggatccgggcccgctagcgggtccgggaacacacccacccgctcctcgccggcgacccggcgccgcccccggagccatgaagcgcgcacgcagctccgaggtgttcgtcggcggcagccggctgcgcgcgcgccggcgcctggctcccctcctcgccgcggcggcgttcgcgtacctactcttcgtgtcagtcaagctcgccggcttcggcggcgctgggcccgcgggtgccgtcagccgcctgtccgccgcgggagcgggcgcgggcgagccgctgcgggggagggtcgagcagccggcggttccccgggcccgcgcgcgccccgcggcggccgtgtccgggtacggccgcatcaccggcgagatcctccggcggcaggagtccggcggggggcggcggaggcggtggggccagctggggaacttcacggagctggagcgcacggccgccgaggcgtgggcgctgggggccaaggcgtgggaggaggcgtccgcgttcgccggcgacgtcgactccatcgcctcccgcgacgcgggggagtgccccggctcgctggcgctcgggggcggcggggaggcggcggcgttcctgccgtgcgggctggcggccgggtcggcggtgacggtggtgggcacgccgcgggcggcgcggccggagtacgtcgaggcgctggagcggagcggcgcgggcaacgggaccgtgatggtggcgcagttcgcggtggagctccgcgggctgcgcgccgcagacggcgaggagccgcccaggatactgcacctcaacccgcggctgcgcggggactggagcggccggccagtgctcgagatgaacacctgcttcaggatgcagtggggcagggcgcagcgctgcgacggcaccccctcgagagatgatgctcaggttgatggattcagaaaatgtgagaaatggcagagacgggacatagttgaatcaaaagaaacaaagacaagctcatggttcaacaggtttatcggccgagcaaagaaaccagaaatgacatggccattcccattttcagagggcaagatgtttgttctcactatccaagctggtgttgaaggataccatatcaatgtgggaggccgccatgttgcctcgtttcctcataggatgggatttgctcttgaagatgctacaggtttagccgtaacagggggcatagatgttcactctgtgtatgcaacagcacttccgagggcccatcctagtttttctctacaacaagtcttggaaatgtctgaaaagtggaaggctcgccctgttccagtggaaccaattcagcttttcgttggcattctctctgctacaaaccattttgctgagcgcatggctattcggaaaacctggatgcagtttccagcgatccaattgggaaatgtggttgctcggttctttgtcgcactgagccataggaaggagataaacgcagcactaaagaaggaagcagaatattttggagacatagtcattctgccatttatcgaccggtatgagctggtggttctgaaaacagttgcgatctgtcaatatggggtgcaaaatgttactgcggattatatcatgaagtgcgatgatgacacctttgtgcggcttgatatagtattgcaacaaatcactacctacaacagaaccttacctctttatctgggcaacttgaatctcctgcacaggcctctaagaaggggcaaatgggccgtgacctatgaggaatggcctgaagcggtgtatcccccgtacgccaatggacctggttatgtcctctcaatcgacattgcaagagacatcgcatcccggcatgcaaaccactccttaaggctgttcaagatggaggacgtgagcatgggaatgtgggtggaggactacaatgccactgcaccggtgcagtacatccacagctggaggttctgccagttcggctgcgtggataactacttcacggcacattaccagtctcccaggcagatgctatgcctctgggataaactgtcagccggccgagcacagtgctgtaactacagataacgcgacgctccaggggtgcaggtggaatcagatggctatccatgtggtatcctttgtcccacgatcatgtacaacaggagaatttcaggatctccactgcatcctttggcttcagctccatccgatccactaaccctagaaaccattttgacatctcatgttcaattctttgatctttatgagatttataggtgtggagatttataggtgtgtgggtgtgatcaactgcttcaccttcattgaggtggatgcaaagatgagggaggagtaatggaatccacgttggctgcttgtacaggggcaagttcatttgtaaaactgcaaatctgtatccactattggtggacagtaagtcagcatgacggcatgaatggaatgagaaactgtttccctatatgcgca

SEQ ID NO: 3278 - DNA, 2339 bp, Panicum virgatum
ttcggtagtgcgggccccgcggcggccgtcggccgcctggcggccgccggcgcgggcgagccgctgcggcggcgggtggagcagccggctccccgcgcgcgagccgccgcggtgtccgggtacggccgcatcaccggggagatccttcgtcggcgggaggcgggcgaggggcggcggaggcggtgggggcagctggggaacttcacggagctcgagcgcgcggccgcggaggcgtgggcgctcggggccagggcgtgggaggcggcgtccgcgttcacgggcgacgtcgactccatcgcctcgctcgacgcgggggaggggccggccgagtgccccggctcgctggccctcggcggcggggagacgacggtggcgttcctgccttgcgggctggcggccgggtcggcggtgacggtggtgggcacggcgcgggcggcgcggccggagtacgtcgaggcgctggagcggagcggcgcggggaacggcaccgtgatggtggcgcagtttgcggtggagctgcgcggggtgcgcgccgccgacggcgaggagccgcccaggatactgcacctcaacccgcggctgcgcggggactggagcggccgacccgttctcgagatgaacacctgcttcaggatgcagtggggcagggcgcagcgctgtgatggcactccctcgagagacgatgaccaggttgatggattcagaaaatgtgagaaatggcagcgtcaggacatagttgaatcaaaagaaacaaggacaagctcatggttcaacaggtttatcggccgagcaaagaaaccagaaatgacatggccattcccattttcagagggcaatatgtttgttctaacaatccaagctggtgtggaaggatatcatattaacatgggaggccgccatgttgcctcatttcctcataggatgggatttgctcttgaagatgcgacaggtttagccgtgacagggggcatagacgttcactctgtgtatgcaacagctctcccaaggtctcatcctagtttttctctgcaacaagtattggaaatgtctgaaagatggaaggctcgccctgtaccagaggaaccaattcagcttttcattggcatcctctctgctacaaaccattttgctgagcgcatggctattaggaaaacctggatgcagtttccagccatccaattgggaagtgtagttgctcggttctttgtcgcgctgagccatagaaaggagataaatgcagccctaaagaaggaagcagaatattttggagatatagtcattctgccgtttatcgaccgatatgagctggtggttctgaaaacagttgcgatatgtcaatatggagtgcaaaatgttactgcagattatatcatgaagtgtgatgatgacacctttgtgcggctggatatcgtattgcaacaaatcactacctacaacagaaccttacctctttatcttggcaacttgaatctattgcacaggcctctaagaagtggcaagtgggctgtgacctatgaggaatggcctgaagctgtgtatcccccgtacgccaatggacctggttatgtcctctcaatcgacattgcgagagacatagcatcccggcatgcaaatcactccctgaggctgttcaagatggaggacgtgagcatgggcatgtgggtggaggactacaacgccactgcgcccgtgcagtacgtccacagctggaggttctgccagttcggctgtgtggattactacttcacagcacattaccagtcccccaggcagatgctatgcctctgggataaactctcagccggccaagcacgctgctgtaactacagataacaaggcgcttcaggggtgctggtggaattagatggctttccagccagtatccttcgtcacacaatcatgtacaagagggagaaattcaagacctccattgcatcctctgctttagttccagcggatccactaacggattaaccctagaaaccatcttgacgtcacatattctttgatctttacactgagatttatgggtgtgtgcgtggggacaactgcttcaccttcattgaggtggatgcatagatgaggcaggaatgagtggaatccacgttggctgcttgtacaggggcaggttcatttgtaacgatgcaaatctgtatccactatttgtggacactggccactgtgtctatgtcagaaactcatgaatggaatgagaaactgtttccctatctgtgtatcttgtgtgtttatgctctgtacatctgctatgcattgcatttccattttgatggattccatagtggcttgtgtgttcgcttggcttgtcagccaaccagcac

SEQ ID NO: 3279 - DNA, 2642 bp, Sorghum bicolor
tcaggaactcgaattctacgaaaaaatcatgtgccaatcctccaatccaaaagatacctatttgttttttttatctacttggccttttacttttgctcgaggctaacatccatgtaagcgtgcgttggtgaaggcccccgtctaaactccaaatctacgcaaacaacgaaacctacacctgaaaacacgagtaacggtaaaccagaaacccaacccaacccatcactttcccttcccgtctcggcgtctcgctccggatcccccactcccagacccgccaagcgccggccaccgccatttcggatccgggctcgctcgcggtcgcgggtccccgaacccggccgccgagctcctcgctgccgggcggcggcggcggccgccatgaagcgcgcgcgcagctccgagggattcctcggcgtgtgccggctgcgctcgcgccgcggcctggcgccgctcctcgccgcggcggcgttcgcctacctactgttcgtgtccgtcaagctcgctggactcagcggcgcggtggggaccgcgcctgccgtcggccgtcgcctcgccaccgccggcgcgggtaagctgccgccgctgcggcggcgggtcgacaagccgcccgcgcgcgcgatgggtggtacgagcggcgggggcgtgtccgggtacggccgcatcatcaacgagatgctccagcggcaggaggccgtctgggagcggcggaagcggtggggccggctggggaacttcacggagctggagcgcttggcggccaaggcgtgggccctcggggccgtcgcgtgggaggaggcctccgcgttcgccggcgacgtcgacgacatcgccggggacggggagggcgctgcggccaagtgccccggctcgctcacgctcaacgctggggagaccgaggcgttcctgccgtgcgggctggccgccgggtcggcggtgacggtggtcgggatggcgcgagaggcgcggcccgagtacgtcgaggcgctggagcggagcggcgcgggcaacgggacggtgctggtggcgcagttcgcggtggagctgcgtggcctgcgcgccgtcgacggcgaggagccgcctaggatactccacctcaacccgcggctgcgcggcgactggagcggccgttccgtgctggagatgaacacctgcttccgaatgcagtggggcagggcgcagcgctgcgacggcaccccctggccctccagtgatcttcacctggttgatggattcagaaaatgtgagggatgggagcgacaggacatagttgaatcgaaagaaacaaagacaagttcatggttcaacagattcatcgggcgggaaaagaaaccagaaatgacatggccattcccattttcagaggggaagatgtttgttctcactatccaagctggcgttgaaggatatcatattaatgtgggaggccgccatgttgcctcatttcctcataggatgggattcactctcgaagacgcaacaggtttagccgtaacagggggcatagatgttcactctgtgtatgcaacagcacttccaacggctcatcctagtttttctctccaacaagtcttggaaatgtctgaaaggaaaacttggatgcagtttccggctatccaatcggggaatgcagttgctcggttttttgtcgcgctgagccacagaaaggagataaacgcagcactaaagaaggaagcagaatattttggagacatagtcattctgccatttatggaccggtatgagctggtggttctgaagacagttgcgctatgtcaatacggggtgcaaaatgtcactgcagattacatcatgaagtgtgatgacgacacctttgtgaggctggatgtagtattgcaacagatcgctgcctacaacagaaccttacctctgtatctgggcaacctgaatctctaccacagtcctcaaagaagcgggaaatgggctgtcacctttgaggaatggcctgaagcggcgtatcccccgtacgccaatggacctggctacgttatctcggccgacatcgcgagagacatagcatcccggcatacaaatcactccctacggctgttcaagatggaggatgtgagcatgggcatgtgggtggaggacttcaacgcgagcgcccccgtgcagtacgtccacagctggaggttctgccagttcggctgcgtggatcactacttgacggcgcactaccagtccccctggcacatgctgtgcctctgggagaaactgtcagcagggcgccgggattgctgtaactacatataacatgaggctcccgggggagaggtggacatgatctttcgctccattcggccctggcttcagttccatatatagaatcatctgctcgacgactaactgcagaaaccgtcatctcgttcttgacatcacaatgttgtttggttctttatacattgaatgtatactagataagggtgtgatcaactgctgctgcatcttcagtttcttcactgaggggaatgcagacatgaggagagtaggtgggggaattcacattggctgcttgtacaggcgcctgcccatttgtaaaactgcaaatttgtgcccactgatttggtggactatctgaaatagtgaaatggaattgcaaatctatgcccactgattgtatg

SEQ ID NO: 3280 - DNA, 2935 bp, Hordeum vulgare
agacaataaatgctttaactcaaattaaacacatctcttgttctaactccaggtaataaacacttgaattaataactccatacatactccaaacaaaaccacgagaaagagtaaaaactcccactatctctccaagaaaccgccagctcagcaccaacaaccttcctccctatcactttccccttcccgttttattccccggctcttcgcggacccgctaccaccccggacccggtaacccacccgctcctcgccggcgcgccgccgccgccgccgccatgaagcgcgcgcgcagctccgagatcttcctcgtcggccgtgcgcgcgcgcgcaggcgcctggcgcccctcctcgccgcggcggccttcgcgtacctcgtcttcgtctccgtcaagctctccggcctcggcagctgggaggacgccgcgtccatcccacggccggagaccgccgcctcgcgaggcgagcttctgcagcgggacgtccccgagcgggctccccgcggccgccgcgccgctgcgggcggtgctgctgtcacggggtacggccgcatcaccggggagatcctccggcgccacgaagctcttggcggggggagtcggaggcggtggggcctgcggggcaacttctccgagctcgagcgcatggcgtcggaggcgtgggcgctcggggccaagtcgtgggaggaggcctccgcgttctccggcgacgtggacgccatcatctcgggcgacggcgcggcggtcaagtgccccgcctcgctcgagctcggcggcggcggggagggcgagacggccgcgttcctgccgtgcgggctggcggtggggtcggcggtgacggtcgtggcgacggcgcgcgcggcggtggcggagtacgtggaggcactggagcggagcgggagcgggaacggcacggtcatggtggcgcagttcgcggtggagctgcgcggcctgcgcgcctccgagggcgaggacccgcccaggatcctccacctcaacccgcggctccgcggggactggagccgtcggccggtgctggagatgaacacctgctttcgcatgcagtggggcaaggcgcagcgctgcgacggcaccccctccaaggacgacgaccatgttgatgggtttccaaaatgtgagaaatgggaacggagggacatggctgattcaaaagaaacaaaaacaagctcatggttcaacaggttcatcggccgagcaaagaaaccagaaatgacctggccgtacccatttttagaggggaagatgtttgttctcactatccaagctggtgttgaaggataccatattaatgtagggggtcgtcatgttgcctcatttcctcataggatgggattcactctcgaagatgcaactggtttggctgtaacaggcggcatagatgttcactcggtgtatgcaacctctcttccaaaggctcatcctagtttttctctgcaaaatgtcttggaaatgtctgataagtggaaggctcgccctgtgccagaggaaccgattcagctttttatcggcattctctctgctacaaaccattttgccgagcggatggctattagaaaaacttggatgcagtttcctgcaatccaattgggaaatgtggttgctcgattctttgtcgcactgagccatagaaaagagataaatgcagcactaaagaaggaagcagaatattttggagacgttgtcattctgccatttatcgaccggtatgagttggtggttctcaaaacagttgcgatatgtcagtacggggtgcaaaatgttaccgcggagtatatcatgaagtgcgacgatgatacctttgtgaggctggatgtagtgttgcaacaggtctctaccttcaacagaaccttgcctctttatcttggcaacctaaatctcttacacaggcctctccggagcggtaaatgggccgtgactttcgaggaatggccagaattggtgtatcccccctatgccaatgggcccggctacgtaatttcgattgatattgccagagacatcgcatcccgtcacgcaaatcagtcactaaggctgttcaagatggaggatgtgagcatgggcatgtgggttgaagactacaacactaccaccattgccgccccggtgcagtacatccacagctggaagttctgccagtacggctgcgtggacaactacttcacggcgcactaccagtcccccaggcagatgctgtgcctctgggacaaactgtcgttaggccgcgcgcaatgctgcaactacagatgacacggcgctcatccatgaccgcttcacgagggcaaccgacgacttaactaggcggcatccgccagtcccactgccgtagtgtcattttagaagaacaccagggaccaggccagcatgacaaccaccagaccgcccgggtgtccatcatccttaactcacagttccctacatctgctccatcggctgacggcggcggagaccatggacctcaccattgtctgctcctcagttgtacacaaacaagatacgccatcaatggtgcttcacctcctggagctcatacatttggatatgtggatggatgaatctacttgtagtggaagacgctatctgttgggttcattgattgaagatgactatgcaaacacgaggagccaaaatttgccgcgtgtaatgtacaggggggagtaattttgtactccggtttgtagggttgttgtgtcccttggcttgcagagggagctgatgtctcgttgatactgaattggtgtcgtgttctgtaggactaatataaaatggtttgctaattcttatagtcttctcatgagacatgtttcataatcttttaatcttcacgagacatgtactgaacctactgatgcaggtgtatagtttatggtccttgttcttgttttgtttttgaagaaacaaatccatgtgcaagtggg

SEQ ID NO: 3281 - DNA, 2742 bp, Oryza sativa
ctaaggttacccctccctttccgaatcccaaacccggaaaccgccaccccacccacccacctactcacctccattccggatcccgacccgctttccggacccggaatcccacccaccgcccactcctcgccggcgagcgccgccgccggtgacgccgccatgaagagggcgcgaagctccgaggtcttcctgggcggccgcgggcgcgcgcgccgccgcgtggcgcctctgctcgccgcggtggccttcgtgtacctcctgttcgtgtcattcaagctctccggcctcgccggcatcgccgacccggcggctgtcacccgcccggcgagcggcggcgcgggagaggtggtgatgccgcggcggctcgaggatccggcgccccgcgcgcggggtgatggggatggtgtcgccgtcgcggggtacggtcgcatcactggagagatccttcggcggcggtgggaagctggagggagggggcggaggcggtggggacgaggcgggaacttctccgagctcgagaggatggccgacgaggcgtgggagctgggcggcaaggcgtgggaggaggcgtgcgcgttcacgggcgacgtggactccatcctctcccgcgacggcgggggcgagaccaagtgccccgcgtcgatcaacatcggcggcggcgacggcgagacggtggcgttcctcccctgcgggctcgccgtgggttccgcggtgacggtggtggggacggcgcgggcggcgcgggcggagtacgtggaggcgctggagcggcgcggggaagggaacgggacggtgatggtggcgcagttcgccgtcgagctccgcggcctccgcgccgtcgagggggaggagccgcccaggatcctccacctcaacccgcggctgcgcggcgactggagccaccgccccgtgctggagatgaacacctgcttccgcatgcagtggggaaaggcgcaccgctgcgatggcaacccctccaaggatgacgaccaggtggatggattaattaaatgtgagaaatgggatcggagagacagtgttgattcaaaagaaacaaagacaggctcatggttgaacaggttcatcggccgagcaaagaaaccagaaatgagatggccatacccattttcagaggggaagatgtttgttcttaccatccaagctggtatcgaaggatatcacgttagcgtgggaggccgtcatgttgcctcatttcctcataggatgggattctctcttgaagatgccacaggtttagctgtgacaggcggcgtagacgttcactctatatatgcaacctctcttccaaaggtccatcctagtttctctctccagcaggtcttggaaatgtctgataggtggaaggctcgcccagtaccagaggaaccaattcaggtttttattggcataatctctgctacaaaccattttgctgagcgcatggctataagaaaaagctggatgcagttccctgccatccaactgggaaatgtggttgctcggttctttgttgcactgagtcatagaaaagagataaatgcagcacttaagacagaagcagattattttggagatgttgtcattctgccatttattgaccgatatgagctggtggttctgaaaacagtcgcaatatgtgaatttggggtgcaaaatgtaaccgcagagtatatcatgaaatgtgatgatgacacctttgtgaggctggatgtagtattgaaacagatctccgtctacaacagaaccatgcctctttatatgggtaacctaaacctgttacacagacctctccggcatggtaaatgggctgtgacgtacgaggaatggccagaatttgtgtatcctccatatgccaatggaccaggctatgttatttcaatcgacattgcaagagacatcgtatcacgccatgcaaatcactccctaaggttgttcaagatggaagatgtgagcatgggcatgtgggtcgaagacttcaacaccaccgcgccagttcagtacattcacagctggaggttctgccagttcggctgcgtgcataactacttcacggcgcattaccagtcaccttggcaaatgctgtgcctctggaacaaactgtcatcaggccgagcacactgctgtaactacagatgacgctcactcatccactccttcgatttcacaactgacagcaggcaacatcgatcgatccccccatgaaggcaatattttgtgccgcgcatacatggaccagggtctccatttgcttgacctgaattcgtcttgctcgactgacagcggataccatttcacaggagctcttctacgccaagataagtattatatcggtgggatatttactgcttcacctcccggagctcatgtggtatatatctaggagtaccatacagctgtgtttgggtgattgaggtgaatgcgaatgtgggtggggaaatgaaagcctgaggcagggacagaaatcacatttgcattttagctgctagaagtacggtacaggggcaaagcattttcttgtctgctatttatgcactaactggaggtggacagttttggatgagattatatcatttcttttgttggttgtatgccagtatgtgctggttctttgaatgtgccaactctatagcagtgcaaaggtttgaaagaaaaaaaaaacagagaagtcaattatgtcctgaaattagtaatgcatgctcggtagaaaaaagattgaatttcacgcagacgttatccttggat

SEQ ID NO: 3282 - DNA, 2653 bp, Oryza sativa
ctccattccggatcccgacccgctttccggacccggaatcccacccaccgcccactcctcgccggcgagcgccgccgccggtgacgccgccatgaagagggcgcgaagctccgaggtcttcctgggcggccgcgggcgcgcgcgccgccgcgtggcgcctctgctcgccgcggtggccttcgtgtacctcctgttcgtgtcattcaagctctccggcctcgccggcatcgccgacccggcggctgtcacccgcccggcgagcggcggcgcgggagaggtggtgatgccgcggcggctcgaggatccggcgccccgcgcgcggggtgatggggatggtgtcgccgtcgcggggtacggtcgcatcactggagagatccttcggcggcggtgggaagctggagggagggggcggaggcggtggggacgaggcgggaacttctccgagctcgagaggatggccgacgaggcgtgggagctgggcggcaaggcgtgggaggaggcgtgcgcgttcacgggcgacgtggactccatcctctcccgcgacggcgggggcgagaccaagtgccccgcgtcgatcaacatcggcggcggcgacggcgagacggtggcgttcctcccctgcgggctcgccgtgggttccgcggtgacggtggtggggacggcgcgggcggcgcgggcggagtacgtggaggcgctggagcggcgcggggaagggaacgggacggtgatggtggcgcagttcgccgtcgagctccgcggcctccgcgccgtcgagggggaggagccgcccaggatcctccacctcaacccgcggctgcgcggcgactggagccaccgccccgtgctggagatgaacacctgcttccgcatgcagtggggaaaggcgcaccgctgcgatggcaacccctccaaggatgacgaccaggtggatggattaattaaatgtgagaaatgggatcggagagacagtgttgattcaaaagaaacaaagacaggctcatggttgaacaggttcatcggccgagcaaagaaaccagaaatgagatggccatacccattttcagaggggaagatgtttgttcttaccatccaagctggtatcgaaggatatcacgttagcgtgggaggccgtcatgttgcctcatttcctcataggatgggattctctcttgaagatgccacaggtttagctgtgacaggcggcgtagacgttcactctatatatgcaacctctcttccaaaggtccatcctagtttctctctccagcaggtcttggaaatgtctgataggtggaaggctcgcccagtaccagaggaaccaattcaggtttttattggcataatctctgctacaaaccattttgctgagcgcatggctataagaaaaagctggatgcagttccctgccatccaactgggaaatgtggttgctcggttctttgttgcactgagtcatagaaaagagataaatgcagcacttaagacagaagcagattattttggagatgttgtcattctgccatttattgaccgatatgagctggtggttctgaaaacagtcgcaatatgtgaatttggggtgcaaaatgtaaccgcagagtatatcatgaaatgtgatgatgacacctttgtgaggctggatgtagtattgaaacagatctccgtctacaacagaaccatgcctctttatatgggtaacctaaacctgttacacagacctctccggcatggtaaatgggctgtgacgtacgaggaatggccagaatttgtgtatcctccatatgccaatggaccaggctatgttatttcaatcgacattgcaagagacatcgtatcacgccatgcaaatcactccctaaggttgttcaagatggaagatgtgagcatgggcatgtgggtcgaagacttcaacaccaccgcgccagttcagtacattcacagctggaggttctgccagttcggctgcgtgcataactacttcacggcgcattaccagtcaccttggcaaatgctgtgcctctggaacaaactgtcatcaggccgagcacactgctgtaactacagatgacgctcactcatccactccttcgatttcacaactgacagcaggcaacatcgatcgatccccccatgaaggcaatattttgcgccgcgcatacatggaccagggtctccatttgcttgacctgaattcgtcttgctcgactgacagcggataccatttcacaggagctcttctacgccaagataagtattatatcggtgggatatttactgcttcacctcccggagctcatgtggtatatatctaggagtaccatacagctgtgtttgggtgattgaggtgaatgcgaatgtgggtggggaaatgaaagcctgaggcagggacagaaatcacatttgcattttagctgctagaagtacggtacaggggcaaagcattttcttgtctgctatttatgcactaactggaggtggacagttttggatgagattatatcatttcttttgttggttgtatgccagtatgtgctggttctttgaatgtgccaactctatagcagtgcaaaggtttgaaagaaaaaaaaaacagagaagtcaattatgtcctgaaattagtaatgcatgctcggtagaaaaaagattgaatttc

SEQ ID NO: 3283 - DNA, 1468 bp, Oryza sativa
ctgcttgcccccccccccccccccgccccgccccgtgcgccgccgccatggcagccgcgacgacctcgctgctcctggaggccaccccgcgcctcctctcgctgccgccgcggcggcctgtgcagccccgtggtggcatcttcctcctcaagccgccgccgccgccgcctttcccctcccgccgcggggtggcagtggcggtggcaccgcccctccgcgcctcccacccggacacggcgcgccgggtgtccgtgtcccccgcggcggtggagccgccgcccaagccccgcgcgctgctcgacgcgatcaagaggtccctcctcgactcgctcgcggcgctcaagaagcccgcgctggcgctgctcctcgccggggcgctgctcgcggcagcggggccacaccacggcgccgcgctggcggcatcgggcggccgcgtcggcgggtcggcgttctcgtcgcggtcgtcgtcgccgccgtcgtcctacgggtacaccgcgccggcgccgaggggcgggtactcggccgcgcccttctactcgccctcgccgttcgtgtccgtcggcccggcggtcggcatcgggttcgggggatccagcttctttttcgtccttatggggttcgccgcgttcctttacctcgccgggttcctctccgattcctccggcggtagcgtgctcaccgagacggacaagaccaccgttctcaagctgcaggttggtttgctgggcatggccagatcatttcagaaagagcttgatcagatagctgagaaggcagatacttctaccccggcagggctgagctatgtgctaactgagacaacattggcattacttcggcatccagattgctgcatctcagcttactcatcagttgatgtgaaaagaagtatagatgatggggagaaacgttttaatcaactatcaattgaggaaagaggcaaatttgatgaagagacacttgtgaatgtgaacagcatcaagaggcagaaagcaggcagccaaagatcgagcggttttagcaacgagtacattgtgataaccatattggttgctgctgagggtgtacataagctacccagtataaatggcagcggtgacttgaagacagctctacagaagcttggtgccataccatcaagaaaaatactggcagttgaggtactatggactccacaaaatgagaatgacacattgtcagaacgagagctgctcgaagattacccgcttttaagacccctatgaaggatgcattttagattcatttttgccgtatttcagcttattaactatagctcaggttgtgttgtaaagataggtaacgtaaaaaaaattggcctacatcattctcgcaacaaaattgtacggtagtctttcctgacagtctttgtaaatagaatgccgacacatagttgaataccaattctgctcggtgcatccgccttcatggatatggtacttgaatctgt

SEQ ID NO: 3284 - DNA, 1122 bp, Avena sativa
ggccccaccacgacgcggcgctggccgcctccggcggccgcgtaggagggtccgccttctcctcctcgcggtcttcctcctcctcgcggtcctcctacggctacaccgcgccatctcccaggggaggaggagggtactcctccgcgcccttctactcgccttcgcccttcgtctccgtcggcccagccttcggcatcggcttcggcgggtccgggttcctcctgaccctcgtgggcttcgccgcgttcctctacctcggcgggttcctcaccgactcgtccgggggcggcagcgtgctcaccgacacgcagaagaccaccgtcctcaagctgcaggttggcttgctaggcttggcccgatcatttcaaaaggagcttgatcaaatagccgagaaggcagatacatcaaccccagctgggttgagctatgtactaacagagacaacattgtcactacttcggcatccagattgctgtatctcagcttactcaacagtggatgtgaaacgaagtatagatgatggagagaaacgcttcaatcaattgtcaattgaggaacgaggcaagtttgatgaagagacactcgtgaatgtgaacagtatcaagaggcaaaaagcaggcaatcaaagatcaactggttttagcaacgagtacattgtgattaccatattggttgctgccgagggagtacacaagatacctactataaatagcagttcggacctgaagacagctctacaaactcttggtggtctaccgtcaagcaaaatattggcggtcgaggtcttatggactccacaaaacgagaacgacacattgtctgagagggaactcctggaagattatccacttttgaggcccctatagaaggattaagatgtatactgccccctataaaacggatcaagtcgtggattcatttttgacagtccagtctgttaactatagcccagattttgtgtttgtaaaaatatgattgtaaatgaagtcgttcttagcagctactgtacatgaaagtttgctcgatgcaaccgtgctgcgttaatgaatctgacatagcattagtcttgtcaagttttcctgacacagctcaagtttgtaaataaatttcatctgcaagaac

SEQ ID NO: 3285 - DNA, 1703 bp, Triticum aestivum
tgcctccccgcgtagactgaaacttccacccaccgtgctcttctcttcacgcggcggaagaggacagacgcacacacacaagctccggcgccggtcatcctctccatcccgaccctccaccgccacacacttcccagaaagaaaagaaaaatcgcgccttgcgctccgccatggccgccgcctccctcctcgagcccgcccgcttcctctccccgcaccacccgcgctcgctccggcccccgccccgccgcggcccgcaccacctccgccgctcgccacttcccgcccacgcccgcttcccgcgcctccgcgcccacccgccagcccccatccccccgtgccccgtcgccgccgagccggcagcgaggccgccaccgccgcacccactactcgacgcgctcaagcggtccctcctcgactcgctcgcggcgctcaggaagcccgcgctggcgctcctcctggccggcgcgctgctcgcggccgcggcgccccaccacgcggcgctggcggcctccggcggccgcgtcggcgggtccgccttctcctcccgctcctcgcgctcctccccgtccccgtcctacgggtacaccgcgccggcgcccaggatggggggagggtactcctccgcgcccttctactcgccctcgcccttcgtgtccgtcggccccgccttcggcatcggcttcgggggctccggcttcctcctgaccctcgtcggcttcgccgcgttcctctacctcggtggcttcctcaccgactcctccgggggcggaagcgtgctcaccgacacgcagaagaccaccgtcctcaagctgcaggttggcttactaggcatggcccgatcatttcaaaaggagcttgatcaaatagccgagaaagcagatacgtcaaccccagctgggttgagctttgtactaacagagacaacattggcattacttcggcatccagattgctgtatctcagcttattcaacagtggatgtcaaacgaagcatggatgatggggagaaacgtttcaatcaactgtcaattgaggaacgaggcaagtttgatgaagagacactcgtgaatgtgaacagtatcaagaggcaaaaagcaggcactcaaagatcaagtggttttagcaacgagtacattgtgattaccatattggttgctgctgagggagtgtacaagctacctactataaacagcagcagtgacctgaagacagctctacaaatgcttggtggcgtaccgtcaagcaaaataatggcggtcgaggtcttatggacaccacaaaatgagaacgacacattgtcggagcgggaactcctggaagattacccacttttgaggcccctatagaaggatttaagatgtatactgccctgcccctacaaaggatttcatttttgacagtccagcttattaactatagctcaggttttgtgtttgtaaaaatataattgtaaatgaagtcacttgctcttagcagctacatgaaagtttgctcaacggaacagcacagcattcagaatctgacatagtatggtagtatcattcagtttttctgatgtgacccaagtttgtaagcaagtttcttctgcatgaacagattagtcgtactgccggtttgtcgcgtggcattttatttaccactgaatcatgttaagaaacattcatgaagaaacgaatatagtgacaaacctgcagatgaaa

SEQ ID NO: 3286 - DNA, 1000 bp, Secale cereale
gcccttctactcgccctcgcccttcgtctccgtcggccccgccttcggcgtcggcttcggcgggtcagggttcctcctcaccctcgtgggcttcgccgcgttcctctacctcggtggcttcctcaccgactcctccgggggcgggagcgtgctcaccgacacgcagaagaccaccgtcctcaagctgcaggttggcttactaggcatggcccgatcatttcaaaaggagcttgatcaaatagccgagaaagcagatacgtcaaccccagctgggttgagctttgtactagcagagacaacattggcattacttcggcatccagattgctgtatctcagcctattcaacagtggatgtcaaacgaagcatggatgatggggagaaacgtttcaatcaactgtcaattgaggaacgaggcaagtttgatgaagagacactcgtgaatgtgaacagtatcaagaggcaaaaagcaggcactcaaagatcaagtggttttagcaacgagtacattgtgattaccatattggttgctgctgagggggtgtacaagctacctactataaacagtagcagtgacctgaagacagctctacaaatgcttggtggcgtaccgtcaagcaaaataatggcggtcgaggtcttatggacaccacaaaatgagaacgacacattgtcggagcgggaactcctggaagattacccacttttgaggcccctatagaaggatttaagatgtatactgccctgcccctataaaggattcatttttgacagtccagcttattaactatagctcaggttttgtgcttgtaaaaatataattgtaaaaatgaagtcacttgctcttagcagctactgtacatgaaagtttgctcaccgcaacagcgcagcattcagaacctgacatagtatgctagtatcattcagtttttctgatgtgactcaagtttgtaagcaagtttcttctgcatgaacagattagccgtatcaccggtttgcc

SEQ ID NO: 3287 - DNA, 682 bp, Pennisetum glaucum
tacctcgccgggttcctgtcggattcgcccggcaatgggagtgtgctcaccgagacgcagaagaccaccgtcctcaagctacaggttggcttgctgggtatggcccgatcatttcagaaggagcttgatcaaatagctgagaaagcagatacatccaccccggctgggttgagctatgtgttgacagagacaacattggcattgcttcggcatccagattgctgtatctcagcttactcatcggtggatgtgaaacgaagtatggacgatggagagaagcgtttcaatcaactatcaattgaagagaggggcaagtttgatgaagagacgcttgtgaacgtgaacagcatcaagaggaataaagcaggcggccaaagatcaagtggctttagcaatgaatacattgtgataaccatactggttgctgccgagggagtatataaactacctgttataaatagcagcaatgacttgaagacagctctgcaaaatcttggtggcataccatcaagcaaaatactggcagtggaggtcctatggactccacaaaatgagaacgacacattgtcagaacgagagctccttgaagattaccgcttttgaggtcctctatagaaaaaaaaaggttccaaaattggtacctctaaagaagaacaaattctagattcagtttggcggtttt

SEQ ID NO: 3288 - DNA, 1370 bp, Amorphophallus konjac
gcggtggaagtggagcccgctcttccgcggcctccggctcccccggcgccctatcctcgtctccagcagcagcagaatggcgcggctctgcggatcgaacaccacacctgggctcgtcaccgcagccgtctcctccgcctcctgctgctcctcttcttcttctgcttcttcttcgtctagggaggtggtgatggtggaagagccgaagaggggtcccctgggtgggctcgtggacgcggtgctccgggcgctaaaggcgctgcgcaagccggccgccgctgtcgtgcttctcggcctcctcctcgcggttgatccctatgcggcgctggccgcatcggggggcaggatggggggcaggtccttctcgtcctccgcgccctcgttctcctcctccaggagctactcggtgccctccgggtcttccttctctttctcgacgccctattactatgccccgtcgccattcttcggcggcggggggggccgtctacgtggggttcggcgccggctccgggttcttccttctcatggcgggcttcgccgcggtggtgttgctctctggcttcctctccgaccgctccgatgacgggagcgtgctcacggccacccagaagaccagtgtgctcaaattacaggtgggtttattggggctggcacggacatttcagaaagaccttgatcagattgcggagaccgcagacacatctactccagagggattaagttatatactaacagagacaacattagcattacttcgtcaccctgactgttgcatctctggttattcatcagtggacattaagcgatctcttgaagatggggagaagcgcttcaatcagctttcaattgaggagcgtggtaaatttgatgaagagacgcttgttaatgtcaatagcattaagaggagaagttcgggtggttcgagatccaatgcattcagcaatgaatacattgtggtaacaattctagtggctgccgaaggagttcacaaaattcctgttatcaatggtagtgcagacttgaaagaagccttgcaaaagctgggttccattccctcgagcagaattatggctgttgaggtcctctggactccacaaaatgagaatgactcgctctctgaacgggaactacttgaagactatccgcttttgaggccattgtaattgtgagctagttttactgatgtacagcagcatgcaaaactctttgggacggaaaagaaaatgtcctccgtgaagttgcaattttcttgcaagagagcatctgtacattttttctaccgtacaatatattgtttctttcttggagtatgaaatacttcatctgtatgccgatctaatagtcataatccaaaaaggttcataaaa

SEQ ID NO: 3289 - DNA, 1205 bp, Cucumis sativus
ctttgctcgaaccccatccattaaaatggaacaaaacattccgagttcatttaccctcctctccttctccatcaacaagtggtcgctatcatctctgccgaccctttatcgtacccagaaatttgaaaatacatgattctagctctgtcaaataccctgttagatgcttcttttccgagaaagggaggagttcaacgacttccatttcgaattcttcttcggtggaattggttaatggagataaacccaaaagcccaatggaggtaattgggaattcgattattaatgccctcaaggcgttgcagaaacctgcaattgctgcggtgttgttgggattgctgttgatgtacgatcccaattctgcgttggccgcttctggtggacgagttggaggaaatgcgttttcgtctcgctcctcctcgtcttcgaggagttactcgactcccaggatgagttcggggttttcgtattctgcaccgtacacttctccgtcgatgtttggcggtggcgggatttatgttgggccggcagttggggttggactcggtgctggctcgagtttcgtcttcatattggcgggtttcgcggcgtttcttttggtctctggatttctctctgatcgttccgacactagtgttcttactgcctctgataaaactagcgtacttaaactacaagttgggctgttgggcatgggtcgaggactccaaagagatctaaatagaattgctgaaagtgctgatacatcaactcctgagggtttgtgctatgttttaactgaaacgattctagcgctgcttcggcatcctgattattgcatttcaggctactcatctattgatgtgaaacgtagtatagaagaaggagagaaacgtttcaataaattatcaattgaagagcgagggaaatttgatgaggaaactctcgtcaatgtgaatagcatcaaaagacagagcacaagcagccagaggacaagtggatttagcaatgagtacattgtgataacaatattggtggctgctgagggagttcataagctgcccactataaatggcagcggggacttgaaggaagctttgcaaaaacttgcatctattccttccagcaaaatattggctgttgaagttttgtggacaccacaaaatgaaaatgacacattgtccgagcgcgaactccttgaagattacccacttttaaggccttta

SEQ ID NO: 3290 - DNA, 1374 bp, Curcuma longa
atgggttccgcgtcgttgctggaaaccgtgtccgtcttgagggagccgcctaagcggccgcgccctcctctctacctcctccgatggcatcctctcctccggcttccgcagccgcgattcccccattatcgagctcgcaagcacgtcggattctccctcagatgtgctctcgtgccaccgtccggagccgaaggcaggagggataagaaggagggccttctagaggcggcgtggagcacggtgctcgaggccatggaaaggatcaaaaagccggcagctgcccttatcttgcttggtgttcttctcaccgctgatccccatggggccctcgcggcgtccggaggaaggatgggcgggagggctttctcctcttcgccctcccgttcgcactcttcctcttcctggagctattccgctcctcccagctcgagtttcttttactcggcgccctattatgcgccgtctccgttcggaggtgggttctacgtcgggtcggcttttggtgcgggatcggggttcttcctccttatgatggggtttgctgctgtgattcttctctctgggtttctctcggacagggacagtgatggaagcgtcctaacggccacgcagaagaccagcgtcataaagcttcaggttggcctattaggcatggcacgatcatttcagagggatcttgataacatcgctcaagctgcagatacatctacaccagagggattgaattatgttttgacagaaacaacattagctttgcttcgtcatcctgactgctgcatttctgcttattcttctgtggatataaagcgaagtatagaagatggggagagacgttttaaccagctttcaattgaggagcgcggtaagtttgatgaagagacactggtaaatgtgaacagcattagaaggcaaaagacaagtaatctaacattcaaaggtttcagcaatgagtatattgtggttacaattctggttgccgctgagggtgtatacaagcttcctgtcatcaacagcagcagtgacttgaaagaagcactgcagaagctcggttccattccttcaagcaaaacattggccgtggaggtcctatggacacctcaaaatgagaatgacacgctttcagaacgcgagctactggaggattatccattgttgaggcccctctgacatgaccgcaaacatgccatgataaggcgtatgccctctcaactatatacccgtctgagtcatctcttttgtttaattatatatgaaaggtttgttcataagatccaatgcaaaccatgaaatacctcgggtaattctagatggcaaattaccaatattcagtcccatttatactttcttcagaaggggttaaaaaccattaacatc

SEQ ID NO: 3291 - DNA, 1401 bp, Cucumis melo
ctttgctcgaaccccatccattaaaatggaacaaaacattcccacttcatttcgcctcctctccttctccatcaacaagtggtcgctatcatctctaccggccctttatcgtacccagaaatttgaaaatacatgattctagctctgtcaatcccgtgttagatgcttctttccgagaaagggaggagttcaacgactacgatttcgaattcttgttcggtggaattggttaatggagataaacccaaaagcccaatggaggtaattgggaattccattattaatgctctcaagacgttgcggaaaccggcaattgctgcggtgttgttgggattgctgttgatgtacgaccccaattccgcgttggccgcttctggtgggcgagttggagggaatgcgttttcgtctcgctcctcctcgtcttcgaggagttactcgactcccaggatgagttcggggttttcgtattctgcaccgtacacttctccgtcgatgtttggcggtggcgggatttatgttgggccggcagttggggttggagtcggtgctggctcgagtttcttcttcatattggcgggtttcgcggcgtttcttctggtctcgggatttctttctgatcgttccgacagtagtgttcttactgcttctgaaaaaactagcgtacttaaactacaagttgggctgttgggcatgggccggggactccaaagagatctaaatagaattgctgaaagtgctgatacatcaactcctgagggtttgtgctatgttttaactgaaacgattctagcgctgcttcgacatcctgattattgcatttcgggttactcatctatggatgtgaaacgtagtatagaagaaggagagaaacgtttcaataaattatcaattgaagagcgagggaaatttgacgaggaaactcttgtcaatgtgaatagcatcaaaagacagagcacaagcagccagaggacaagtggatttagcaatgagtacattgtgataacaatattggtggctgctgagggagttcataagctgcccactatcaatggcagcggggacttaaaggaagctttgcaaaaacttgcatctattccttccagcaaaatattggctgttgaagttttgtggacaccacaaaatgaaaatgacacattgtccgagcgcgagctccttgaagattacccacttttaaggcctctataagtatgtgcggaaacaatacttttatcatgctttactgattacacataatgattagaatatagagtgcctgtcttgacatagaaagtttgtatataatatacggaaattggacaaaaaattcaaatttagttttcatttagtggatgaaccttgcctttataccatgtactacttaacaattatagaatagttata

SEQ ID NO: 3292 - DNA, 6045 bp, Panicum virgatum
atcaccatcaccatccaatccagccatatctgcacgtcctcgtcctcgtcatcattgtacccccggaccatacagcgcagagaaacactagctcgcgtcgcgtcccatggctgatggctggttactggttactggttgacaccccagaagcaaagcaaaacaaagcatgcgagccaaaccccacgaggacgccagcccagcctcgcaacgcaaccggatcacacccatcactcgagtagtactcgactcgactcgactcgactggactggactccgccgtctcccccctccccgaaaaagctgaagcaaacaaacgcaaacggcctcatcccatcacatgattcccagctcccacctcaccgccgcatcgcgtcaccgcaatctcctcgtcctccccaattccccgtactgctcctccttcctgccagtaatggcttgatttctcggctcgcgttcgtcgctgcggcgcttggcactgacgccctcttccctgttttttcgcagcttcgcgtgccgtgagggatgagcctccgccgcaaccgccgcgccgcggcggcggcggcggcgggaggaggggggtacccggagccggcggcgtacaacatcatcccgatccacgacgtggtgatgcacggggagcacccgtcgctgcggttcccggaggtgcgcgcggccgtagaggcgctggcgcacgcggcggacctgccggcgccgccgctcgcccgcgcgtgggatgccctccgcgccgacctcttcgactggctcggcgccaccttcggcttccagctccacaacgtccgcaaccagcgggagcacctcgtgctcctcctcgccaacgcgcagctccgcgcgggcgggaccctccccccggaccaccccgccgacgtgctgcaccattccatcgcgcgcggcatccggaagaagctcctcaagaactacacgtcctggtgctcgtacctcggcaagaggccgcacgtctatgtgcccagcgccggccgccgcgttcagggggccggcccggacacgcgccgcgacctactgtacaccgcgctgtacctcctcatctggggggaggcggccaatttgaggttcatgcccgagtgcctctgctacatcttccactacatggcgctcgacctcaatcatgtcatagaccagtcggttgatatcgagacagggaggccatctattcctgcggtgcacggtgaggatgctttccttgagaaggtcgtgacgccgatttataatgtgctcaaggccgaggtggagtttagccggaatgggaccaaaccgcactcggcctggaggaattatgatgatgtgaatgagtacttctggagccgcagagttttcaagcggctccagtggcccctatctccggtgaggagtttctttatacagcctggaaatcctgggcgtattggcaagactggttttgttgagcagaggtcattctggaatgtttaccgcagctttgatcgggtatgggtgatgctcattctgttctttcaagcagctatgattgttgcatgggatggccgcactccttgggatagcctacgcttccgtgacatccaggtccgggtgctgtctgtgttcatcacctgggcagcgctgcgcattgcgcaggcagtgcttgatgcaggcacacaatacagtcttgtgaggcgggatactacattgctcgctgtccggatggtgctcaaggtgcttgttgctgttgggtggactatcacattcattgtgctctatgttcgaatgtgggatcagaggtggcgtgatcgcaggtggtcttttgctgccaattccagggtgttgaactacctggaggcagctgctgtgtttgtcatcccgcaggtgcttgcagttgtgctcttcattgtcccatggattcggaattttctggagaaaaccaactggcgaattctatatgttctcacctggtggttccaaacccgaacatttgttggacgtggtgtgagggagggcctcattgataacatcaaatataccacattctgggtgtgccttctcactgctaagttcggcttcagttactttctccagattaagccgatggtggggccaacaaagacaattctcagcctccatgacatccggcgcaactggtttgagtttatgcctcacacagagcggattgctgtaatcttgctgtggattccagttgtccttatttatctcatggatattcagatatggtatgcagtcttctcatcacttacgggggcactaattgggctgttctcgcatctgggggagattcgcagtgttgagcagctgcgtttgaggttccagttctttgcaagtgcgatgcaattcaatttgatgccagaggagcacctggatgctgtgcgtggtggcctccgaagcaagctgtatgatgcaatcaatcgtctgaagctgagatatggctttggtcgtccatataggaagattgaagctaatgaggtggaagctaagaggtttgccctgatatggaatgaaattattcagacatttagagaagaggacatcattagtgacaatgaagttgagcttcttgagctgccaccagttgtgtggaaaattcgtgtggtacggtggccatgcttcctgctaaataatgagctgcttctcgctctcagtcaggcaaaagagctggtagctgatgacaggacacactggacaaggatatgtaacaatgagtacaggcgatgtgctgtcattgaagcttatgacagtatacgtcacttactactggagataattgaggagagaactgttgagcacattattgtcagtcagctgttccttgcatttgatgctgaaatggataatgggaaattttctgaagaacataagctggagctgttacctgaaatccattcatctgtaatcaccttagtggaactgttactgaaggagaagaaggatcagaccaagatagttaataccttgcagactctttatgtctttgcaattcatgattttccaaagaaaaagatggacatggaacagctgaggcaagcaaagctagcaccatcaaaggcggaggaatccagtctcctctttgaggatgtcctaaaatgcccaagcaatgatgatgttagcttctacaaacaggtgaggcgcctccacacaattctcacatccagggattctatgagcaatgtcccaaagaatcccgaggcccgacgacgtataactttcttcagcaactctctattcatgaatatgcctcgtgctccaacagttgagaagatgatggcattcagtgttttaaccccatactacaatgaggatgtgatgtacaacagggaccagcttcgtcgtgagaatgaagatggtgtctcgattttgttttatctccaaaagatctatgaagacgattggcggaactttttagaacgtatgcgaagggaaggaatgactgatgatgatgaaatttggactgtgaaatatccggagcttcgactttgggcctcgtacagaggccagaccttagcacggactgttaggggaatgatgtattaccacagggctctcaagatgcttgcttttcttgatactgcctctgaggtagacattacagaggggacaaaacatcttgcatcctttggttcaattaggcatgagaatgatgtgtatcccatgaatgatggtttgctgcaacgacgacagaggaggctagacagaggaaccagtactgtaagccaattgttcaaaggccaggaagatggtgctgctctcatgaagtacacctatgtggtcgcttgccagatatatggaaaccagaaaatcgctagagatcaacgtgctgaagatattttgactctcatgaagaaaaatgaggcactccgagttgcttatgttgatgaggtccatcaccagggctatactcaatactattctgtcctggtaaagtttgaccagagcttacagagggaggttgagatataccgaattaggttaccaggtccgctgaagcttggggaaggaaagcctgaaaaccagaatcatgctattatattcacaagaggtgatgcagttcaaacaattgacatgaaccaggataattattttgaggaggcgcttaaaatgcgtaacctgctagagcagtacaactattatcatgggagcagaaaaccaacacttctgggagttcgagaacatgttttcactggatccgtatcttcactcgcttggttcatgtctgcacaggagacaagctttgttacccttggtcagcgggtcctagctaatccgttgaaggttcggatgcattatgggcatcctgatgtatttgatcgtctttggtttttgactcggggtggtataagtaaggcatcaagagtgatcaatatcagtgaggatatattcgctggtttcaactgtaccctgcgcggtggcaatgttagtcaccatgagtatattcaggtcggtaagggccgtgatgttggcctcaatcagatatcgatgttcgaagcaaaggtttccagtggcaatggtgagcagacccttagtagggatatctacagacttggtcatagactggatttcttccggatgctctctgtgttttatacaacagtagggttctacttcaacacgatgctggtggtcttgacagtttacacatttgtttggggacgcctgtatctagctctcagtggtcttgaggctggtatacagggcagtgctaattcaaccaacaacaaagccttgggtactgtgcttaatcaacaattcatcatacaaattggcctcttcactgccttgccaatgattatagagaactctcttgaacaaggttttctacctgctatctgggattttttcacaatgcaaatgaatttttcatctgtgttctacacattttccatgggaacgaagagccattactatggccggacaatccttcatggtggtgcaaaataccgtgctactggtcgtggttttgttgtgcaacacaagagttttgctgaaaattacaggctttatgctaggagccactttataaaggcaatagaacttggaataatattgactgtgtatgctgctcacagtgttattgccaggaatacacttgtttacataatcatgaatatatctagctggtttctggtggtatcatggattatggctccatttgcttttaatccgtctggctttgattggttgaaaacagtgtatgattttgacgatttcatgaactggatttggtatcctggtggtctcttttctaagcctgagcagagctgggaagtgtggtggtttgaggagcaagatcatctacggacaactggtctttggggaaagattttggaaatactgttagatctcaggtacttctttttccagtatggggttgtataccagctgaagatagcaaacaacagcaaaagtattgctgtttatctgctttcctggatatgtgtggctgtgatttttggcatgtttgtcttaatgtcctatgctcgagacaagtacgctgcaaagcagcacctttactacaggcttgtccaaactgccgtcatcattcttgtggtgcttgtgctgataatatttctgaagttcacaaaatttgaaatcgttgacatcttcactagtcttttggcattcattcctactggttggggcttgatttcgattgctcaagtaattcggccatttattgaatccaccgtggtgtggaacagtgttatttctgtggcacgtttatatgagatactgcttggggtgttcgttatggctccagttgcgtttttgtcatggttgccgggatttcaagagatgcagacgcgggtacttttcaatgaaggtttcagcaggggcctccagatatcccgcattcttactggcaaaaaagcgaatacagcttgaggtacttcacaattcacaacaaattttaatgaaagcctgacctctttacattttacagagtaaccatgaattttgtagactaatttacatgtatcactattgtgcattgtcgagcatgactgaaaatgtttcaagtgacctgacctctaatattttacgcct

SEQ ID NO: 3293 - DNA, 6588 bp, Panicum virgatum
actcgactggactccgccgtcttccccctccccgaaaaagctcaagtaaacaaacgcaaacggcctcatcccatcacattcccagctcccacctcacggccgcatcgcgtcaccgcaatctcctcgtcctccccaattctccgtaccgctcctcctgccggtaatggcttgatttctcggttcgcgctcgtcactggtggcgcttggcactgacgccctcttccctgtttttgcagcttcgcgtgccgtaagggatgagcctccgccgcaaccgccgcgcggcggcggccgcggcggcggcggcggcggaaggaggaggaggggggtacccggagccagcggcgtacaacatcatcccgatccacgacgtggtgatgcacggggagcacccgtcgctgcggttcccggaggtgcgcgcggccgtggaggcgctggcgcacgcggcggacctgccggcgccgccgctcgcccgcgcgtgggacaccttccgcgccgacctgttcgactggctcggcgccaccttcggattccagctccacaacgtccgcaaccagcgggagcacctcgtgctcctcctcgccaacgcgcagctccgcgcgggcgggaccctccccccggaccaccccgccgacgtgctgcaccactccatcgcgcgcaacatccggaagaagctcctcaagaactacaagtcctggtgctcgtacctcggcaagaggccgcacgtctatgtgcccagcgccggccgccgcgttcagggggttggcccggacacgcgccgcgacctactgtacaccgctctgtacctcctcatctggggggaggcggccaatttgaggttcatgcccgagtgcctctgctacatcttccactacatggcgctcgacctcaatcatgtcatcgaccagtcggttgatgtcgagacagggaggctatctattcctgcagtgcacggtgaggatgctttccttgagaagatcgtgacgccgatttataatgtgctcaaggccgaggtggagttcagccggaatgggaccaaaccacattcggcctggaggaattatgatgatgtgaatgagtacttctggagccgcagagttttcaagcggctccagtggcccctatctccggtgaggagtttctttatacagcctggaaatcccgggcgtattggcaagactggttttgttgagcagaggtcattctggaatgtttaccgcagctttgatcgggtatgggtgatgcttattctgttctttcaagcagctatgattgttgcatgggatggtcgcactccttgggatagccttcgcttccgtgacatccaggtccgggtgttgtctgtgttcatcacatgggcagcgctgcgcattgtgcaggcagtgcttgatgcaggcacacaatacagtcttgtgaggcgggagactacattgctcgctgtccggatggtgctcaaggtgcttgttgctgttgggtggactatcacattcattgtgctctatgttcgaatgtgggatcagaggtggcgtgatcgcaggtggtcttttgctgccaattccagggtgttgaactacctggaggcagctgctgtgtttgtcatcccgcaagtgcttgcagttgtgctcttcattgtcccatggattcggaattttctggagaaaaccaactggcgaattctatatgttctcacctggtggttccaaacccgaacatttgttggacgtggtgtgagggagggcctcattgataacatcaaatataccacattctgggtgtgccttctcactgctaagttcgtattcagttactttctccagattaaaccgatggtagggccaacaaagacaattctcagcctccatgacatccctcgcaactggtttgagtttatgcctcacacagagcggattgctgtaatcttgctgtggcttccagttgtccttatttatctcatggatattcagatatggtatgcagtcttctcatcacttactggggcactaattggtctgttctcgcatctgggggagattcgcagtgttgagcagctgcgtttgaggttccagttctttgcaagtgcgatgcaattcaatttgatgccggaggagcacctggatgctgtgcgtggtggcctccgaagcaagctgtatgatgcaatcaatcgtctgaagctgagatatggctttggtcgtccatataggaagattgaagctaatgaggtggaagctaagaggtttgccctgatatggaatgaaattattcagacatttagagaagaggacatcattagcgacaatgaagttgagcttcttgagctgccaccagttgtgtggaaaattcgtgtggtacggtggccatgcttcctgctaaataatgagctgcttcttgctctcagtcaggcaaaagagctggtagctgatgacaggacacactggacaaggatatgtaacaatgagtacagacgatgtgctgtcattgaagcttatgacagtatccgtcacttacttctggagataattgaggagagaactgctgagcgcattattgtcagtcagctgttccttgcatttgatgctgaaatggataatgggaaattttctgaagaatataagctagagctgttacctgaaatccattcatctgtaatcaccttagtggaactgttgcttaaggagaagaaggatcagaccaagatagttaataccttgcagactctttatgtctttgcaattcatgattttccaaagaaaaagaaggacatggaacagctgaggcaagctaagctagcaccatcaaaggcagaggaatccagtctcccctttgaggatgtcataaaatgcccgagcaatgatgatgttagcttctacaaacaggtgaggcgcctccatacaattctcacatccagggattctatgaacaatgtcccaaagaatcctgaggcccgacgacgtataactttcttcagcaactctctattcatgaatatgcctcgtgctccaaaagttgagaagatgatggcattcagtgttttaaccccatactacaatgaggatgtgatgtacaacaaggaccagcttcgtcgtgagaatgaagatggtgtctcaattttgttttatctccaaaagatctatgaagacgattggtggaactttttagaacgtatgcggagggaaggaatgaatgatgatgatgaaatttggactctgaaatatcaggagcttcgactttgggcctcatacagaggccagaccttagcacggactgttaggggaatgatgtattaccacaggggtctcaagatgcttgcttttcttgatactgcctctgaggtagacattacagaggggacaaaacatctagcatccttcggttcaattaggcatgagaatgatgtgtatcccatgaatggtggtttgcagcaacgacgacaaaggaggttagacagaggaaccagtactgtaagccaattgttcaaaggccaggaagatggtgctgctctcatgaagtacacctatgtggtcgcttgccagatatatggaaaccagaaaattgctagagatcaacgtgctgaagatattttgagtctcatgaagaaaaatgaggcactccgagttgcttatgttgatgaggtccatcaccagggctatacacaatattattctgtcctggtaaagtttgaccagagcttacagagggaggttgagatataccgaattaggttaccaggtccgctgaagcttggggaaggaaagcctgaaaaccagaatcatgctattatattcacaagaggtgatgcagttcaaacaattgacatgaaccaggataattattttgaggaggcacttaaaatgcgtaacctgctagagcagtacaactattatcatgggagcagaaaaccaacacttctgggagttcgagaacatgttttcactggatccgtatcttcactcgcttggttcatgtctgcacaggagacaagcttcgttacccttggtcagcgggtcctagctaatccattgaaggttcggatgcattatgggcatcctgatgtatttgatcgtctttggtttttgactcggggtggtataagtaaggcatcaagagtgatcaatatcagcgaggatatattcgctggtttcaactgtaccctgcgtggtggcaatgttagtcaccatgagtatattcaggtcggtaagggccgtgatgtcggcctcaatcagatatcaatgttcgaagcaaaggtttccagtggcaatggtgagcagacccttagcagggatatctatagacttggtcatagactggatttcttccggatgctctctgtgttttatacaacagtagggttctacttcaacacaatgctggtggtcttgacagtttacacttttgtttggggacgcctgtatctagctctcagtggtcttgaggctggtatacagggcagtgctaattcaaccaacaacaaagccttgggtactgtgcttaatcaacaattcatcatacaaattggcctcttcactgccttgccaatgattatagagaactctcttgaacaaggttttctacctgctatctgggattttttcacaatgcaaatgaatttttcatctctgttctacacattttcaatgggaacgaagagccattactatggccggacaatccttcatggcggtgcaaagtaccgtgctactggtcgtggttttgttgtgcaacacaagagttttgctgaaaattacaggctttatgctaggagccactttataaaggcaatagaacttggaataatattgactgtgtatgcttctcacagtgttattgccaagaatacacttgtttacataatcatgaatatatctagctggtttctggtggtatcatggattatggctccatttgcttttaatccgtctggctttgattggttgaaaacagtgtatgattttgacgatttcatgaactggatctggtatcctggtggtctcttttctaaggctgagcagagctgggaagtgtggtggtttgaggagcaagatcatctgcggaccactggtctttggggaaagattttggaaatactgttagatctcaggtacttctttttgcagtatggggttgtataccagctgaagatagcaaacaacagcagaagtattgctgtttatctgctttcctggatatgtgtggctgtgatttttggtgtgtttgtcctaatgtcctatgctcgagacaagtacgccgcaaagcagcacctttactacagggttgttcaaactgccgtcatcattcttgtggtgtttgtgctgataatatttctgaagttcacaaaatttgaaatcgttgacatcttcactagtcttttggcattccttcctactggttggggcttgatttcgatcgctcaagtaattcggccatttattgaatccactgtggtatggaacagtgttatttctgtggcacgtttatatgagatactacttggggtgtttgttatggttccagttgcgttgttgtcctggttgccgggatttcaagagatgcaaacaagggtacttttcaatgaaggtttcagcaggggcctccagatatcccgcattcttactggcaaaaaagcgaatacagcttgaggtatctaactggactgttgcggatttgcggtatagcagtgctccatctcctatgtacagcttcccgattcaatgtggaagggctttctgcttactgatatagcttagatccatattgaactattttggtagctgtcgctatctagtttaggcgtcctgatttgtgcttctggcaatgtaggtcttcattttttgtacttggtagagctagttgtgtgtagctgattcttttgcagcaccaccggtgagctctggtgaattatttgttggcctagccagatggttccatctttttgtgctagaaaatggtgtgtggatgataatgtttggctgagggtacaaaaggtttctgggaggaattttcctggaggtggctgatcatatgagcgacccatttatctgaagaaaccggcgcaaattcacatagccatcgtatttgtcggcccggtgtaacatgcgctactgatgctcgtttcagttatcgacgcatcatttcgacccacgggtctgcagttttgtaaagttcaatggacaaggtggggaatgggtggagccgtggaggtgatcccagttttctcagctccaaaccgaagctgccgacagcacccgcacccgttgcaggcgtgccggcggccactgctgagtgctgtgcactgcgcgcgctaactacagagctggttgccgggctttgccgcattggcgagcacgtgaccgtactgaccgctcggatgtgcacctcctgggcttacccaacacaccacggtggctatagtttcagggcccgttccgggcgtggaacgagggtcggaattgatcctcgtgattgagggccggaattaatcctcgtgattgaggacgtggaaataaacttgatgttccagctggaattgttccaagcaatcatttctaactaaacgaacggcccctcggaatccctaatggggcaagatcctcacat

SEQ ID NO: 3294 - DNA, 5987 bp, Setaria italica
ccgctcatcagattagccacctccaggaaaattccttccagcaaccttttataccttcagccgagcattatcatccacacaccattttctggcacaaaagatggaaccatctagcgaggccaacagataattcaccagagctcaccggtggcgcagcaacagaatcagctacacacaactagctctaccaatgtacaaaaaaaatgaagacctacattgcctaaagcgcaaatctggacacctaaactagatagctaaagctaacaaaggagttcaatagctatatcagtaaagcagaaagcccttccacattcaactgggaagctgtacataggagatggagcactgctacaccgcaagtccgcaacaatccgaggtcagtacctcaagctgtattcgcttttttgccagtaagaatgcgagatatctggaggcccctgctgaatccttcattgaaaagtacccttgtctgcatttcttgaaatcccggcaaccaggacagcaacgcaactggcgccataacgaacaccccaagcagtatctcatatagacgtgccacagaaataacactgttccacactacagtggattcaatgaatggccgaatcacttgagcaattgaaatcaagccccaaccagtaggaataaatgccaaaagactagtgaagatgtcaacaatttcaaattttgtgaacttcagaaatagtatcagcactagcaccgccagaatgatgaccgcagtttggacaacccggtagtaaaggtgctgctttgcagcatacttgtctcgagtataggacattaggacaaatacaccaaaaatcacagccacacatatccaggaaagcagataaacagcaatacttctgctatcatttgctatcttcagctggtatacaactccatactggaaaaagaagtacctgagatccaacagtatttccaaaatcttcccccaaagaccagtggtccgtagatgatcttgctcctcaaaccaccacacttcccagctctgatcaggcttagaaaagagactaccaggataccagatccagttcatgaaatcatcaaaatcatacactgttttcaaccaatcaaaacccaatgggttaaaagcaaatggagccataatccatgataccaccagaaaccagctagatatattcatgactatgtaaacaagtgtattcctggcaataacactgtgagcagcatacacagtcaatattattccaagttctattgcctttataaagtggctcctagcataaagcctgtaattttcagcaaaactcttgtgttgcacaacaaaaccacgaccagtagcacggtactttgccccaccgtgaagtattgtccggccatagtaatggctcttagttcccatggaaaatgtgtagaacagagatgaaaaattcatttgcattgtgaaaaaatcccagatagcaggtaggaaaccttgttcaagagagttttctataatcattggcaaggcagtgaagaggccaatctgtatgatgaattgctgattaagcacagtacccagggctttgttgttggttgaattagcactaccctgaataccagcctcaagaccactgagagctagatacaatcgtccccaaacaaatgtgtaaactgtcaagaccaccagcattgtgttgaagtagaaccctactgttgtataaaacacagagagcatccggaagaagtccagtctatgaccaagcctgtagacatccctactaagggtctgctcaccattgccactggaaacctttgcttcaaacattgatatctgattgaggccaacatcacgacccttaccaacctgaatatactcatggtgactaacattgccaccacgcagggtacagttgaaaccagcgaatatgtcctcgctgatattgatcactcttgatgccttacttaagccaccccgagtcaaaaaccaaaggcggtcaaatacatcaggatgcccataatgcatccgaaccttcaatggattagctaggacccgctggccaagggtaacaaagcttgtctcctgtgcagacatgaaccaagcaagtgaagagacagatccagtgaaaacatgttcccgaactcccagaagtgttggttttctgctcccatgataataatcgtactgctctaacaggttacgcattttaagggcctcctcaaagtaattatcctggttcatgtcaatcgtttgaactgcatcacctcttgtgaatataatagcatgattctggttttcaggttttccttccccaagcttaagtggacccggtaatctaatccggtatatctcaacctccctctgtaaaccctggtcaaacttcaccaggacagaatagtattgagtatagccctggtgatggacctcatcaacataagcaactcggagtgcctcatttttcttcatgagattcaaaatatcttcagcacgttgatctctagcaattttctggtttccatatatctggcaagcgagcacataggtgtacttcatgagagcagcaccatcttcctgccctttaaacaattggcttacagtactggttcctctgtctaacctcctttgtggtcgccgctgcaaaccaccattcatgggatacatgtcattctcatgcctaactgaaccaaaggatgcaagatgttttgtcccctctgtaatgtctacctcggaggcagtatcaagaaaagcaagcatcttcagagccctgtggtagtacatcattcccctaacagtccgtgctaaggtctggcctctatatgaggcccaaagtcggagctcctgatattttacagtccaaatctcatcatcatcagtcattccctccctccgcatacgttctaagaagttcccccaatcatcttcatagatcttttggagataaaacaaaattgagacaccatcttcattctcgcgacgaagctggtccctgttgtacatcacatcctcattgtagtatggggttaaaacactgaatgccatcatcttctcaactgttggagcacgaggcatattcatgaatagagagttgctgaagaaagttatacgccgttgagcctcaggattctttgggacattgttcatagaatccctggatgtgagaattgtatggaggcgcctcacctgtttatagaagctaatatcatcattgcttgggcattttatgacatcctcaaagaggagactggattcctgtggacttgatggcgctagcctctcttgcctcagctgttccatgcccttctttttctttggaaaatcatgaattgcaaatacataaagagtctgcaacgtattaactatcttggtctgatccttcctctcctgcagcagcagttccactaaggtgattagatatgaatggatttcaggtaacagttctagcttatattgttcagaaaaattcccatccttcattgcatcatcaaatgcaaggaacaactgactgacaataacgtgctcaacagttctctcctcaatgatctccagcagtaagtgacgtatactgtcataagcttcaattacagcacatcgcctgtactcattgttacatatccttgtccagtgtgccctgtcatcagctaccagctcttttgcctgactgagagcaagaagcagctcattatttagcaggaagcacggccaccgtaccacacgaattctccacaccaccggtggcagctcaagtagctcaacttccttgtcactaacgatgtcctcttctctaaatgtctgaataatctcattccatatcagggcaaacctcttagcttcgacctcattaccttcaatcttcctatatggccgaccaaagccatatctcagcttcagacgattgatagcatcatacagcttgcttcggaggccaccacgcacagcatccaggtgctcttctggcatcaaattgaactgcattgcactggcaaagaactggaacctcaagcgcagttgctcaacactgcgaatctcccccagatgtgagaatagcccaataagtgcccccgtaagtgatgagaagactgcataccatatctgaatatccatgagataaataaggacaactggaatccacagcaagattacagcaatccgctccgtgtgaggcataaactcaaaccagttacgccggatgtcatggaggctgagaattgtctttgtgggcgccaccatcggcttaatctggagaaagtaactgaagacaaacttagcagtgagaaggcacacccagaatgtgctatatttgatgttatcaacgaggccctccctcacaccacgtccaacaaatgttcgggtctggaaccaccaggtgagaacatatagaattcgccaattggttttctccaggagattgcgaatccatgggacgatgaagagcacaagagcaagcacctgcggaatgataaacacagcagctgcctcaaggtaattcaacaccctggtttcggcagcaaaagaccacctgcgatcacgccacctctgatcccacattcgaacatagagcacagtgaatgtgatagtccatccaacagcaacaagcaccttgagcaccatccggacagcgagcaatgtagtctccctcctcacaagactgtattgtgtgcctgcatcgagcactgcctgcacaatgcgcagtgcagcccaggtgatgaacacagacagcacccggacctggatgtcacggtagcgaaggctatcccaaggcttgcgaccatcccatgcaacaatcatcgctgcttgaaagaacagaatgagcatcacccaaacccgatcaaagctgcggtacacattccagaatgacctctgctcaacaaaaccagtcttgccaatacgcccagaatttcctggcggtataaaaaaattcctggtcggagacaggggccactggagccgcctgaaaactctgcggctccagaagtactcattcacatcatcataattcctccaggcggagtgtggtttggtcccattacggctaaattccacctcggccttgagcacattataaatcggcgtcacgaccttctcaaggaaagcatcctcaccgtgcaccgcaggaatagatggccgccctgtctcgacatcaaccgattggtcgatgacatgattgaggtcgagtgccatgtagtggaagatgtagcagaggcactcgggcatgaacctcaaattggccgcctccccccagatgaggaggtacagagcggtgtagagtaggtcgcggcgcgtgtcagggccgaccccctggacccggcggccgccgctgggcacgtagacgtgcggcctcttgccaaggtacgagcaccatgacttgtagttcttgaggagcttcttccggatgccgcgcgcgacggagtggtgcagcacgtcggcggggtggtcggtggggagggtcccgccggcgcggagctgcgcgttggcgaggaggagcatgaggtgctcccgctggttgcggacgttgtggagctggaagccgaaggtggcgccgagccagtcgaagaggtcggcgcggaaggcatcccagtcgcgggcgagcggcggcggcggcaggtccgcggcgtgcgccagcgcctccacggccgcgcgcacctccgggaaccgcagcgacgggtgctccccgtgcatcaccacgtcctggatcgggatgatgttgtacgccgccggctccgggtaccccgcacctcccaccgccgccgccgccgccgcggcggcggagcggcggttgcggcggaggctcatccctcacgcctcgcgaagctgcaaaaaacgggaagaggcgtcagtgccaagcgcctcggtgacgagcgcgaaccgagaaatcaagccattattggcaggaggaggagcagtacagggaattgggggaggaggactacgagattgcgatgacgcgatgcgggggtgaggtgggattgggagtaatcatgtgatgggatgagccgtttgcgtttgtttgcttcagctttttcag

SEQ ID NO: 3295 - DNA, 5843 bp, Setaria italica
ggcactgacgcctcttcccgttttttgcagcttcgcgaggcgtgagggatgagcctccgccgcaaccgccgctccgccgccgcggcggcggcggcggcggtgggaggtgcggggtacccggagccggcggcgtacaacatcatcccgatccaggacgtggtgatgcacggggagcacccgtcgctgcggttcccggaggtgcgcgcggccgtggaggcgctggcgcacgccgcggacctgccgccgccgccgctcgcccgcgactgggatgccttccgcgccgacctcttcgactggctcggcgccaccttcggcttccagctccacaacgtccgcaaccagcgggagcacctcatgctcctcctcgccaacgcgcagctccgcgccggcgggaccctccccaccgaccaccccgccgacgtgctgcaccactccgtcgcgcgcggcatccggaagaagctcctcaagaactacaagtcatggtgctcgtaccttggcaagaggccgcacgtctacgtgcccagcggcggccgccgggtccagggggtcggccctgacacgcgccgcgacctactctacaccgctctgtacctcctcatctggggggaggcggccaatttgaggttcatgcccgagtgcctctgctacatcttccactacatggcactcgacctcaatcatgtcatcgaccaatcggttgatgtcgagacagggcggccatctattcctgcggtgcacggtgaggatgctttccttgagaaggtcgtgacgccgatttataatgtgctcaaggccgaggtggaatttagccgtaatgggaccaaaccacactccgcctggaggaattatgatgatgtgaatgagtacttctggagccgcagagttttcaggcggctccagtggcccctgtctccgaccaggaatttttttataccgccaggaaattctgggcgtattggcaagactggttttgttgagcagaggtcattctggaatgtgtaccgcagctttgatcgggtttgggtgatgctcattctgttctttcaagcagcgatgattgttgcatgggatggtcgcaagccttgggatagccttcgctaccgtgacatccaggtccgggtgctgtctgtgttcatcacctgggctgcactgcgcattgtgcaggcagtgctcgatgcaggcacacaatacagtcttgtgaggagggagactacattgctcgctgtccggatggtgctcaaggtgcttgttgctgttggatggactatcacattcactgtgctctatgttcgaatgtgggatcagaggtggcgtgatcgcaggtggtcttttgctgccgaaaccagggtgttgaattaccttgaggcagctgctgtgtttatcattccgcaggtgcttgctcttgtgctcttcatcgtcccatggattcgcaatctcctggagaaaaccaattggcgaattctatatgttctcacctggtggttccagacccgaacatttgttggacgtggtgtgagggagggcctcgttgataacatcaaatatagcacattctgggtgtgccttctcactgctaagtttgtcttcagttactttctccagattaagccgatggtggcgcccacaaagacaattctcagcctccatgacatccggcgtaactggtttgagtttatgcctcacacggagcggattgctgtaatcttgctgtggattccagttgtccttatttatctcatggatattcagatatggtatgcagtcttctcatcacttacgggggcacttattgggctattctcacatctgggggagattcgcagtgttgagcaactgcgcttgaggttccagttctttgccagtgcaatgcagttcaatttgatgccagaagagcacctggatgctgtgcgtggtggcctccgaagcaagctgtatgatgctatcaatcgtctgaagctgagatatggctttggtcggccatataggaagattgaaggtaatgaggtcgaagctaagaggtttgccctgatatggaatgagattattcagacatttagagaagaggacatcgttagtgacaaggaagttgagctacttgagctgccaccggtggtgtggagaattcgtgtggtacggtggccgtgcttcctgctaaataatgagctgcttcttgctctcagtcaggcaaaagagctggtagctgatgacagggcacactggacaaggatatgtaacaatgagtacaggcgatgtgctgtaattgaagcttatgacagtatacgtcacttactgctggagatcattgaggagagaactgttgagcacgttattgtcagtcagttgttccttgcatttgatgatgcaatgaaggatgggaatttttctgaacaatataagctagaactgttacctgaaatccattcatatctaatcaccttagtggaactgctgctgcaggagaggaaggatcagaccaagatagttaatacgttgcagactctttatgtatttgcaattcatgattttccaaagaaaaagaagggcatggaacagctgaggcaagagaggctagcgccatcaagtccacaggaatccagtctcctctttgaggatgtcataaaatgcccaagcaatgatgatattagcttctataaacaggtgaggcgcctccatacaattctcacatccagggattctatgaacaatgtcccaaagaatcctgaggctcaacggcgtataactttcttcagcaactctctattcatgaatatgcctcgtgctccaacagttgagaagatgatggcattcagtgttttaaccccatactacaatgaggatgtgatgtacaacagggaccagcttcgtcgcgagaatgaagatggtgtctcaattttgttttatctccaaaagatctatgaagatgattgggggaacttcttagaacgtatgcggagggagggaatgactgatgatgatgagatttggactgtaaaatatcaggagctccgactttgggcctcatatagaggccagaccttagcacggactgttaggggaatgatgtactaccacagggctctgaagatgcttgcttttcttgatactgcctccgaggtagacattacagaggggacaaaacatcttgcatcctttggttcagttaggcatgagaatgacatgtatcccatgaatggtggtttgcagcggcgaccacaaaggaggttagacagaggaaccagtactgtaagccaattgtttaaagggcaggaagatggtgctgctctcatgaagtacacctatgtgctcgcttgccagatatatggaaaccagaaaattgctagagatcaacgtgctgaagatattttgaatctcatgaagaaaaatgaggcactccgagttgcttatgttgatgaggtccatcaccagggctatactcaatactattctgtcctggtgaagtttgaccagggtttacagagggaggttgagatataccggattagattaccgggtccacttaagcttggggaaggaaaacctgaaaaccagaatcatgctattatattcacaagaggtgatgcagttcaaacgattgacatgaaccaggataattactttgaggaggcccttaaaatgcgtaacctgttagagcagtacgattattatcatgggagcagaaaaccaacacttctgggagttcgggaacatgttttcactggatctgtctcttcacttgcttggttcatgtctgcacaggagacaagctttgttacccttggccagcgggtcctagctaatccattgaaggttcggatgcattatgggcatcctgatgtatttgaccgcctttggtttttgactcggggtggcttaagtaaggcatcaagagtgatcaatatcagcgaggacatattcgctggtttcaactgtaccctgcgtggtggcaatgttagtcaccatgagtatattcaggttggtaagggtcgtgatgttggcctcaatcagatatcaatgtttgaagcaaaggtttccagtggcaatggtgagcagacccttagtagggatgtctacaggcttggtcatagactggacttcttccggatgctctctgtgttttatacaacagtagggttctacttcaacacaatgctggtggtcttgacagtttacacatttgtttggggacgattgtatctagctctcagtggtcttgaggctggtattcagggtagtgctaattcaaccaacaacaaagccctgggtactgtgcttaatcagcaattcatcatacagattggcctcttcactgccttgccaatgattatagaaaactctcttgaacaaggtttcctacctgctatctgggattttttcacaatgcaaatgaatttttcatctctgttctacacattttccatgggaactaagagccattactatggccggacaatacttcacggtggggcaaagtaccgtgctactggtcgtggttttgttgtgcaacacaagagttttgctgaaaattacaggctttatgctaggagccactttataaaggcaatagaacttggaataatattgactgtgtatgctgctcacagtgttattgccaggaatacacttgtttacatagtcatgaatatatctagctggtttctggtggtatcatggattatggctccatttgcttttaacccattgggttttgattggttgaaaacagtgtatgattttgatgatttcatgaactggatctggtatcctggtagtctcttttctaagcctgatcagagctgggaagtgtggtggtttgaggagcaagatcatctacggaccactggtctttgggggaagattttggaaatactgttggatctcaggtacttctttttccagtatggagttgtataccagctgaagatagcaaatgatagcagaagtattgctgtttatctgctttcctggatatgtgtggctgtgatttttggtgtatttgtcctaatgtcctatactcgagacaagtatgctgcaaagcagcacctttactaccgggttgtccaaactgcggtcatcattctggcggtgctagtgctgatactatttctgaagttcacaaaatttgaaattgttgacatcttcactagtcttttggcatttattcctactggttggggcttgatttcaattgctcaagtgattcggccattcattgaatccactgtagtgtggaacagtgttatttctgtggcacgtctatatgagatactgcttggggtgttcgttatggcgccagttgcgttgctgtcctggttgccgggatttcaagaaatgcagacaagggtacttttcaatgaaggattcagcaggggcctccagatatctcgcattcttactggcaaaaaagcgaatacagcttgaggtttctaaccggattgttgcggacttgcggtgtagcagtgctccatctcctatgtacagcttcccagttgaatgtggaagggctttctgctttactgatatagctattgaactcctttgttagctttagctatctagtttaggtgtccagatttgcgctttaggcaatgtaggtcttcattttttttgtacattggtagagctagttgtgtgtagctgattctgttgctgcgccaccggtgagctctggtgaattatctgttggcctcgctagatggttccatcttttgtgccagaaaatggtgtgtggatgataatgctcggctgaaggtataaaaggttgctggaaggaattttcctggaggtggctaatctgatgagcggcccatttgtgtctgaagaaaccggtgtcaaatttacacgca

SEQ ID NO: 3296 - DNA, 6554 bp, Setaria italica
gtcaagaccactaaccaccctacttctgcagtgctactcacataaattcgctccaaatttgctaaaattcggcagcacttcctcaccctgatgaatttccaaaccccaacactttttacgcgcgccgaattaccaaatcagagggaagcacgaacatgacccagcaccagaacatcctcgaaaggattgggaaacactaccggaacatacagcgcacagaaacactagctcggcgtcgcatcccatattcccatggctggttagaaaccccagaagcaaagcaagccaaccaaaccaaaccccacgccagcccaccctcgcggccggatcacacttcactcgagtagcactcgactccgccgtctccccctccctgaaaaagctgaagcaaacaaacgcaaacggctcatcccatcacatgattactcccaatcccacctcacccccgcatcgcgtcatcgcaatctcgtagtcctcctcccccaattccctcttcgcgaggcgtgagggatgagcctccgccgcaaccgccgctccgccgccgcggcggcggcggcggcggtgggaggtgcggggtacccggagccggcggcgtacaacatcatcccgatccaggacgtggtgatgcacggggagcacccgtcgctgcggttcccggaggtgcgcgcggccgtggaggcgctggcgcacgccgcggacctgccgccgccgccgctcgcccgcgactgggatgccttccgcgccgacctcttcgactggctcggcgccaccttcggcttccagctccacaacgtccgcaaccagcgggagcacctcatgctcctcctcgccaacgcgcagctccgcgccggcgggaccctccccaccgaccaccccgccgacgtgctgcaccactccgtcgcgcgcggcatccggaagaagctcctcaagaactacaagtcatggtgctcgtaccttggcaagaggccgcacgtctacgtgcccagcggcggccgccgggtccagggggtcggccctgacacgcgccgcgacctactctacaccgctctgtacctcctcatctggggggaggcggccaatttgaggttcatgcccgagtgcctctgctacatcttccactacatggcactcgacctcaatcatgtcatcgaccaatcggttgatgtcgagacagggcggccatctattcctgcggtgcacggtgaggatgctttccttgagaaggtcgtgacgccgatttataatgtgctcaaggccgaggtggaatttagccgtaatgggaccaaaccacactccgcctggaggaattatgatgatgtgaatgagtacttctggagccgcagagttttcaggcggctccagtggcccctgtctccgaccaggaatttttttataccgccaggaaattctgggcgtattggcaagactggttttgttgagcagaggtcattctggaatgtgtaccgcagctttgatcgggtttgggtgatgctcattctgttctttcaagcagcgatgattgttgcatgggatggtcgcaagccttgggatagccttcgctaccgtgacatccaggtccgggtgctgtctgtgttcatcacctgggctgcactgcgcattgtgcaggcagtgctcgatgcaggcacacaatacagtcttgtgaggagggagactacattgctcgctgtccggatggtgctcaaggtgcttgttgctgttggatggactatcacattcactgtgctctatgttcgaatgtgggatcagaggtggcgtgatcgcaggtggtcttttgctgccgaaaccagggtgttgaattaccttgaggcagctgctgtgtttatcattccgcaggtgcttgctcttgtgctcttcatcgtcccatggattcgcaatctcctggagaaaaccaattggcgaattctatatgttctcacctggtggttccagacccgaacatttgttggacgtggtgtgagggagggcctcgttgataacatcaaatatagcacattctgggtgtgccttctcactgctaagtttgtcttcagttactttctccagattaagccgatggtggcgcccacaaagacaattctcagcctccatgacatccggcgtaactggtttgagtttatgcctcacacggagcggattgctgtaatcttgctgtggattccagttgtccttatttatctcatggatattcagatatggtatgcagtcttctcatcacttacgggggcacttattgggctattctcacatctgggggagattcgcagtgttgagcaactgcgcttgaggttccagttctttgccagtgcaatgcagttcaatttgatgccagaagagcacctggatgctgtgcgtggtggcctccgaagcaagctgtatgatgctatcaatcgtctgaagctgagatatggctttggtcggccatataggaagattgaaggtaatgaggtcgaagctaagaggtttgccctgatatggaatgagattattcagacatttagagaagaggacatcgttagtgacaaggaagttgagctacttgagctgccaccggtggtgtggagaattcgtgtggtacggtggccgtgcttcctgctaaataatgagctgcttcttgctctcagtcaggcaaaagagctggtagctgatgacagggcacactggacaaggatatgtaacaatgagtacaggcgatgtgctgtaattgaagcttatgacagtatacgtcacttactgctggagatcattgaggagagaactgttgagcacgttattgtcagtcagttgttccttgcatttgatgatgcaatgaaggatgggaatttttctgaacaatataagctagaactgttacctgaaatccattcatatctaatcaccttagtggaactgctgctgcaggagaggaaggatcagaccaagatagttaatacgttgcagactctttatgtatttgcaattcatgattttccaaagaaaaagaagggcatggaacagctgaggcaagagaggctagcgccatcaagtccacaggaatccagtctcctctttgaggatgtcataaaatgcccaagcaatgatgatattagcttctataaacaggtgaggcgcctccatacaattctcacatccagggattctatgaacaatgtcccaaagaatcctgaggctcaacggcgtataactttcttcagcaactctctattcatgaatatgcctcgtgctccaacagttgagaagatgatggcattcagtgttttaaccccatactacaatgaggatgtgatgtacaacagggaccagcttcgtcgcgagaatgaagatggtgtctcaattttgttttatctccaaaagatctatgaagatgattgggggaacttcttagaacgtatgcggagggagggaatgactgatgatgatgagatttggactgtaaaatatcaggagctccgactttgggcctcatatagaggccagaccttagcacggactgttaggggaatgatgtactaccacagggctctgaagatgcttgcttttcttgatactgcctccgaggtagacattacagaggggacaaaacatcttgcatcctttggttcagttaggcatgagaatgacatgtatcccatgaatggtggtttgcagcggcgaccacaaaggaggttagacagaggaaccagtactgtaagccaattgtttaaagggcaggaagatggtgctgctctcatgaagtacacctatgtgctcgcttgccagatatatggaaaccagaaaattgctagagatcaacgtgctgaagatattttgaatctcatgaagaaaaatgaggcactccgagttgcttatgttgatgaggtccatcaccagggctatactcaatactattctgtcctggtgaagtttgaccagggtttacagagggaggttgagatataccggattagattaccgggtccacttaagcttggggaaggaaaacctgaaaaccagaatcatgctattatattcacaagaggtgatgcagttcaaacgattgacatgaaccaggataattactttgaggaggcccttaaaatgcgtaacctgttagagcagtacgattattatcatgggagcagaaaaccaacacttctgggagttcgggaacatgttttcactggatctgtctcttcacttgcttggttcatgtctgcacaggagacaagctttgttacccttggccagcgggtcctagctaatccattgaaggttcggatgcattatgggcatcctgatgtatttgaccgcctttggtttttgactcggggtggcttaagtaaggcatcaagagtgatcaatatcagcgaggacatattcgctggtttcaactgtaccctgcgtggtggcaatgttagtcaccatgagtatattcaggttggtaagggtcgtgatgttggcctcaatcagatatcaatgtttgaagcaaaggtttccagtggcaatggtgagcagacccttagtagggatgtctacaggcttggtcatagactggacttcttccggatgctctctgtgttttatacaacagtagggttctacttcaacacaatgctggtggtcttgacagtttacacatttgtttggggacgattgtatctagctctcagtggtcttgaggctggtattcagggtagtgctaattcaaccaacaacaaagccctgggtactgtgcttaatcagcaattcatcatacagattggcctcttcactgccttgccaatgattatagaaaactctcttgaacaaggtttcctacctgctatctgggattttttcacaatgcaaatgaatttttcatctctgttctacacattttccatgggaactaagagccattactatggccggacaatacttcacggtggggcaaagtaccgtgctactggtcgtggttttgttgtgcaacacaagagttttgctgaaaattacaggctttatgctaggagccactttataaaggcaatagaacttggaataatattgactgtgtatgctgctcacagtgttattgccaggaatacacttgtttacatagtcatgaatatatctagctggtttctggtggtatcatggattatggctccatttgcttttaacccattgggttttgattggttgaaaacagtgtatgattttgatgatttcatgaactggatctggtatcctggtagtctcttttctaagcctgatcagagctgggaagtgtggtggtttgaggagcaagatcatctacggaccactggtctttgggggaagattttggaaatactgttggatctcaggtacttctttttccagtatggagttgtataccagctgaagatagcaaatgatagcagaagtattgctgtttatctgctttcctggatatgtgtggctgtgatttttggtgtatttgtcctaatgtcctatactcgagacaagtatgctgcaaagcagcacctttactaccgggttgtccaaactgcggtcatcattctggcggtgctagtgctgatactatttctgaagttcacaaaatttgaaattgttgacatcttcactagtcttttggcatttattcctactggttggggcttgatttcaattgctcaagtgattcggccattcattgaatccactgtagtgtggaacagtgttatttctgtggcacgtctatatgagatactgcttggggtgttcgttatggcgccagttgcgttgctgtcctggttgccgggatttcaagaaatgcagacaagggtacttttcaatgaaggattcagcaggggcctccagatatctcgcattcttactggcaaaaaagcgaatacagcttgaggtttctaaccggattgttgcggacttgcggtgtagcagtgctccatctcctatgtacagcttcccagttgaatgtggaagggctttctgctttactgatatagctattgaactcctttgttagctttagctatctagtttaggtgtccagatttgcgctttaggcaatgtaggtcttcattttttttgtacattggtagagctagttgtgtgtagctgattctgttgctgcgccaccggtgagctctggtgaattatctgttggcctcgctagatggttccatcttttgtgccagaaaatggtgtgtggatgataatgctcggctgaaggtataaaaggttgctggaaggaattttcctggaggtggctaatctgatgagcggcccatttgtgtctgaagaaaccggtgtcaaatttacacgcatcttatttgtcgtcccgatacaacgtgtgttactggtgctcgtttcggcccccgggtctgcagtttctaattctccgctgcaagccaaaggtgccacacccatagcaggcgtgtgccggccactgctgtgtgctgctgtgcactgcgcgcgctccatcaccaggcccggttgccgcacaggtggctcggccaaaacgggccatggaagccaaggaaagccgacgatggtggtggtgatggacgcacgcg

SEQ ID NO: 3297 - DNA, 5899 bp, Hordeum vulgare
tagcactaacgcctcctcctgttttgcagctgcgtgagacggatgagccagctgcgcaaccgccgcgccaccgccgcggcggcggcggcggcggcggagcagccgccgattcaggcgtcctacaacatcatcccgatccaggacgtggtgatgcacgggcagcacccgtcgctgcggttcccggaggtgcgcgcggcggtggaggcgctggcgcacgcggcggacctcccgcagccgccgctcacgcgcgcctgggacttccaccgcgccgacctcttcgactggctcggcgccacctttggcttccagctccacaacgtccgcaaccagcgggagcacctcgtgctcctcctcgccaacgcgcagctccgcgccggcggcaccctgcctaccgagcaccccgctgacgtcctccactcctccgtcgcccggaccatccggaagaagctcctcaggaactacactgcctggtgcgcctacctcggccagaggccgcacgtccacgtgcctaccgccggccgccggacgggcgccgcggccaccgtcggcgttgacacccgcagggacttgctctacacggcgctgtacctgcttatctggggggaggctgctaatttgaggttcatgccggaatgtctctgctacatcttccactacatggccctcgacctcagccatgtcatggaccgctctatcgatattgagacagggcggcctgcaatccctgctgtgtgcggtgaggatgctttcctgaacagcgtcgtcacgccgatttataatgtgctcaaggccgaggtggaggccagccggaatgggaccaaaccgcactcggcgtggagaaattatgatgatgtgaatgagtacttctggagccggcgagttttcaagaagctccggtggccactggagtcatcaaggggcttctttgtgccgccggggaagttaggccgtgttgggaagactggttttgtagagcagcggtccttctggaatgtctaccgcagcttcgatcggctatgggtgatgcttattctgttctttcaggcagcgatgatcattgcatgggagggtagcagcgctccatgggagagcctgaagcaccgcgacatccagatccgggtgctgtcagtgttcatcacttgggctgggctgcgctttatgcaggcgttgcttgatgcgggcactcagtacagtcttgtgtcgagggagactaagctgatctctgtccggatggtgctcaagatgtttgttgctgcagggtggactatcacattcagcgtgctttatgtgcggatgtgggatcagcggtggcgagatcgcaggtggtccttcgctgctgaaaccagggtgttgaatttccttgaggcagctgctgtgtttgtcatcccacaggtgcttgcgttggtgctgttcatcattccttgggttcggaattttacagagaaaacaaactggagaattctatatgtgctcacctggtggttccagacccgcacatttgtaggccgtggtctgagggaggggctaatagataacatcaagtattccctgttctggatctgccttcttgctgctaagtttagcttcagctacttcctccagattaagccgatggtgtcccccacgaagacaatattcagccttcatgacatccgacgtaactggtttgagttcatgccccacacggagcggattgctgtaatcatcctgtggctcccagttgtcctcatttatctcatggatatccagatatggtatgcagtattctcatcacttacaggggcacttattgggcttttctcgcatctgggggagattcgcagtgttgaacagctgcgattgaggtttcagttttttgcaagtgcaatgcagttcaatttgatgccagaggagcacctggacaagttgcatggtggcatccggagtaaactgtatgatgcgattcaccggctcaagctgagatacggttttggccgcccatataggaaaattgaagcaaacgaggtcgaagcaaagagatttgcactgatttggaatgagatcattctgacatttagggaagaagacattgtcagtgacaaggaagttgagcttcttgagcttccaccagttgtttggaaaattcgtgtggtacggtggccatgcttgctgctaaacaatgagctacttcttgctctcagtcaagcaaaagagctagtggctgatgacaggacacactggggtaggatatctagcattgagtacaggagatgtgctgtgattgaagcttatgacagcatacgccagttgctgctgacgatcactgaggagaggacggatgagcacattattgtcagtcagctgttccttgcatttgataatgcgatggaatatgggaaattcactgaagactacaggctagacttgttacctaaaatccattcatctgtaatcaccttagtggaactgctactgaaggaaaaaaaggatgagaccaagatagtcaataccttgcagactctctatgtccttgcagttcatgactttccaaagaacaggaagggtattgaacagctccggcaagaggggctagcaccatcaaggttgactgaatctgggctgctctttgaggatgccataagatgccctgatgagagtaaacttagcttctacaagcaggtgaggcgcctccatacgatcctcacatccagggattccatgaacaatgtccctaaaaaccctgaggctaggcggcgtatagctttcttcagcaactccctcttcatgaacatgcctcgtgctcccacagttgagaagatggtggcattcagtgttttgactccatattacaacgaagacgtcctgtacaacaaggaccagcttcgtcgtgaaaatgaagatggcatctcaatcttgttttatcttcagaagatttatgaagatgactgggcaaactttttagaacgtatgaggagggagggaatggttagtgatgatgatatttgggctgggaaatttcaggagctccgactttgggcctcgtataggggccagaccttatcacggactgttaggggaatgatgtactactacagggctctcaagatgcttgctttccttgatactgcctctgagatagacattacagaaggaacaaaacatctggctagctttggttccattaggcatgaaaatgatgtgtatcccatgaacaatggtttgcaacaacggcctcaaaggaggttgaacagaggagccagcactgtcagtcaattgtttaaaggccaggaagatggtgctgctcttatgaagtatacctatgtggtcgcttgccagatatacggaaaccagaaaaaggggaaagatccacgtgctgaagatatcctctctcttatgaagaaaaatgaagcccttcgtgttgcttatgttgatgaggtccatcacgagatgggtggtatacaatattattctgtcctcgtaaaatttgaccaggacttgcagaaagaggttgagatatacaggatcaggttgccaggcccactgaaacttggagaaggtaagcctgaaaaccagaaccatgccattatattcacaagaggcgatgcagtgcaaacaattgacatgaatcaggataattattttgaggaggctcttaagatgcgcaatctattacaacagtacaactattatcatgggagccaaaagccaaccctgttgggagttcgagaacatgttttcactgggtctgtctcgtcacttgcttggttcatgtctgcacaagagacaagctttgttacccttgggcagcgtgtgctagctaatccgctgaaggttcggatgcattacgggcatcctgatgtatttgatcgcctttggtttctgacccggggtggtttaagtaaggcatcgagagtaatcaatatcagcgaggacatatttgcaggtttcaactgcaccttacgtggtggaaatgttagccaccatgagtacatccaggttggcaaggggcgtgatgttgggcttaatcagatatcgatgtttgaagctaaggtatccagtggcaatggtgaacagacattgagtagggatatctaccggcttggtcatagaactgatttttttcggatgctttctgtgttttatacaacagtgggattctacttcaatactatgctggtggtcatgacagtttacacatttgtttgggggcgcctgtatctggctctgagtggtctggaggctggaattcagggcagtgctaatgctactaacaataaagccttgggtgctgtgctaaatcagcagtttgtcatacagctcggcttcttcactgccctgccaatgattttagagaattctcttgaactgggttttctacctgctgtctgggattttttcacaatgcagatgaacttttcatctgtcttctacacattttcaatgggaacaaaaagccattactatggccgaacaattcttcatggtggtgcaaagtatcgggctactggccgtggctttgttgtgcagcataagagtttcgctgaaaattacaggctatatgctaggagccacttcataaaggctatagagctcgggataatattgactgtgtatgccgttcacagtgtgattgccaggaacacacttgtttacatagtcatgatgatatctagctggtttcttgtggtgtcctggatcatggctccatttgcatttaatccgtctggttttgattggttgaaaactgtgtatgacttcgaagatttcatgacctggatctggtttccaggaggtatattttctaaggctgagcacagctgggaagtgtggtggtatgaggagcaagatcatctgcggactactggcctttgggggaagattttggaaatactgctagatctcagatacttcttttttcagtatggggttgtataccagctcaaaatcgcagacggaagcagaagcattgcggtgtatctgctttcctggatatgtgtggcagtgatctttggtgtttttgtcctaatgtcctatactcgggacacatatgctgcgaagcaacatctttactaccgggttgtccaaactgccatcatcattctgggagtgctggtgctgatattattcctgaagtttactgagtttcaaatcattgacatcttcactggtcttttggcattcattcctactggctggggcttgatttccattgctcaagtgatcaggccattcatcgaatccactgtggtgtggggcagtgttatttctgtggcgcgtttgtatgagatactgcttggagtgattgttatggcgccagttgcattgctgtcctggctgccagggtttcaagaaatgcagacaagggtactgttcaatgaaggtttcagcagaggcctccaaatatcccgcattcttgctggcaagaaaacgaacgcagtttgaggtactaaccaggttgtcagcggttgcagttaggcagtgatccggtcatctctgtacagcaccaatgcgtaaagcctttcgtgacatagcttagctccatattgctatcttttgctggctactggcgatctctctagttagatgttcattcagattcgtacaactttggtgatttaggcattgagtcttggactagctgcgtgttagagtagatgacgatgtatttgttggcctggctagaagttccatctcctgtgctgaagagaggtcgtgtgattgaggagtgatggaaactccccgctgtgattgatcagatcttgatctgcgtttccgttatgtgcacgctatttctttggttccattctctctgcatgggtttatctatcggctcgcgccgcgcacgaacagcaaaaggagattggcgctttgcaatccgtgcgagtacagtcggaatggattgtaataaagcgggttagtt

SEQ ID NO: 3298 - DNA, 6259 bp, Hordeum vulgare
attgatgagacagatgggacttgtgcagcgaccgtttaggagagaataaccaagctcccgagtgacggcccggccccatccaagagcatctcctctcctctcccccgcggcggacgacaaggggagaaacgtctcaaatgcgctagcggcagccgattcgtgagaagccgaggcacaacaacggcagcgggaagggagatcgaggagcaacaaacgcctgctcccgctccagctcgaaaagggctgtgaagaagaagaagaggaagattgagccgcagcgccggaagccaagggtctcgacggagacggagacggcgggcggccgcccctcgccgccgctcgatcgatcagctgcgtgagacggatgagccagctgcgcaaccgccgcgccaccgccgcggcggcggcggcggcggcggagcagccgccgattcaggcgtcctacaacatcatcccgatccaggacgtggtgatgcacgggcagcacccgtcgctgcggttcccggaggtgcgcgcggcggtggaggcgctggcgcacgcggcggacctcccgcagccgccgctcacgcgcgcctgggacttccaccgcgccgacctcttcgactggctcggcgccacctttggcttccagctccacaacgtccgcaaccagcgggagcacctcgtgctcctcctcgccaacgcgcagctccgcgccggcggcaccctgcctaccgagcaccccgctgacgtcctccactcctccgtcgcccggaccatccggaagaagctcctcaggaactacactgcctggtgcgcctacctcggccagaggccgcacgtccacgtgcctaccgccggccgccggacgggcgccgcggccaccgtcggcgttgacacccgcagggacttgctctacacggcgctgtacctgcttatctggggggaggctgctaatttgaggttcatgccggaatgtctctgctacatcttccactacatggccctcgacctcagccatgtcatggaccgctctatcgatattgagacagggcggcctgcaatccctgctgtgtgcggtgaggatgctttcctgaacagcgtcgtcacgccgatttataatgtgctcaaggccgaggtggaggccagccggaatgggaccaaaccgcactcggcgtggagaaattatgatgatgtgaatgagtacttctggagccggcgagttttcaagaagctccggtggccactggagtcatcaaggggcttctttgtgccgccggggaagttaggccgtgttgggaagactggttttgtagagcagcggtccttctggaatgtctaccgcagcttcgatcggctatgggtgatgcttattctgttctttcaggcagcgatgatcattgcatgggagggtagcagcgctccatgggagagcctgaagcaccgcgacatccagatccgggtgctgtcagtgttcatcacttgggctgggctgcgctttatgcaggcgttgcttgatgcgggcactcagtacagtcttgtgtcgagggagactaagctgatctctgtccggatggtgctcaagatgtttgttgctgcagggtggactatcacattcagcgtgctttatgtgcggatgtgggatcagcggtggcgagatcgcaggtggtccttcgctgctgaaaccagggtgttgaatttccttgaggcagctgctgtgtttgtcatcccacaggtgcttgcgttggtgctgttcatcattccttgggttcggaattttacagagaaaacaaactggagaattctatatgtgctcacctggtggttccagacccgcacatttgtaggccgtggtctgagggaggggctaatagataacatcaagtattccctgttctggatctgccttcttgctgctaagtttagcttcagctacttcctccagattaagccgatggtgtcccccacgaagacaatattcagccttcatgacatccgacgtaactggtttgagttcatgccccacacggagcggattgctgtaatcatcctgtggctcccagttgtcctcatttatctcatggatatccagatatggtatgcagtattctcatcacttacaggggcacttattgggcttttctcgcatctgggggagattcgcagtgttgaacagctgcgattgaggtttcagttttttgcaagtgcaatgcagttcaatttgatgccagaggagcacctggacaagttgcatggtggcatccggagtaaactgtatgatgcgattcaccggctcaagctgagatacggttttggccgcccatataggaaaattgaagcaaacgaggtcgaagcaaagagatttgcactgatttggaatgagatcattctgacatttagggaagaagacattgtcagtgacaaggaagttgagcttcttgagcttccaccagttgtttggaaaattcgtgtggtacggtggccatgcttgctgctaaacaatgagctacttcttgctctcagtcaagcaaaagagctagtggctgatgacaggacacactggggtaggatatctagcattgagtacaggagatgtgctgtgattgaagcttatgacagcatacgccagttgctgctgacgatcactgaggagaggacggatgagcacattattgtcagtcagctgttccttgcatttgataatgcgatggaatatgggaaattcactgaagactacaggctagacttgttacctaaaatccattcatctgtaatcaccttagtggaactgctactgaaggaaaaaaaggatgagaccaagatagtcaataccttgcagactctctatgtccttgcagttcatgactttccaaagaacaggaagggtattgaacagctccggcaagaggggctagcaccatcaaggttgactgaatctgggctgctctttgaggatgccataagatgccctgatgagagtaaacttagcttctacaagcaggtgaggcgcctccatacgatcctcacatccagggattccatgaacaatgtccctaaaaaccctgaggctaggcggcgtatagctttcttcagcaactccctcttcatgaacatgcctcgtgctcccacagttgagaagatggtggcattcagtgttttgactccatattacaacgaagacgtcctgtacaacaaggaccagcttcgtcgtgaaaatgaagatggcatctcaatcttgttttatcttcagaagatttatgaagatgactgggcaaactttttagaacgtatgaggagggagggaatggttagtgatgatgatatttgggctgggaaatttcaggagctccgactttgggcctcgtataggggccagaccttatcacggactgttaggggaatgatgtactactacagggctctcaagatgcttgctttccttgatactgcctctgagatagacattacagaaggaacaaaacatctggctagctttggttccattaggcatgaaaatgatgtgtatcccatgaacaatggtttgcaacaacggcctcaaaggaggttgaacagaggagccagcactgtcagtcaattgtttaaaggccaggaagatggtgctgctcttatgaagtatacctatgtggtcgcttgccagatatacggaaaccagaaaaaggggaaagatccacgtgctgaagatatcctctctcttatgaagaaaaatgaagcccttcgtgttgcttatgttgatgaggtccatcacgagatgggtggtatacaatattattctgtcctcgtaaaatttgaccaggacttgcagaaagaggttgagatatacaggatcaggttgccaggcccactgaaacttggagaaggtaagcctgaaaaccagaaccatgccattatattcacaagaggcgatgcagtgcaaacaattgacatgaatcaggataattattttgaggaggctcttaagatgcgcaatctattacaacagtacaactattatcatgggagccaaaagccaaccctgttgggagttcgagaacatgttttcactgggtctgtctcgtcacttgcttggttcatgtctgcacaagagacaagctttgttacccttgggcagcgtgtgctagctaatccgctgaaggttcggatgcattacgggcatcctgatgtatttgatcgcctttggtttctgacccggggtggtttaagtaaggcatcgagagtaatcaatatcagcgaggacatatttgcaggtttcaactgcaccttacgtggtggaaatgttagccaccatgagtacatccaggttggcaaggggcgtgatgttgggcttaatcagatatcgatgtttgaagctaaggtatccagtggcaatggtgaacagacattgagtagggatatctaccggcttggtcatagaactgatttttttcggatgctttctgtgttttatacaacagtgggattctacttcaatactatgctggtggtcatgacagtttacacatttgtttgggggcgcctgtatctggctctgagtggtctggaggctggaattcagggcagtgctaatgctactaacaataaagccttgggtgctgtgctaaatcagcagtttgtcatacagctcggcttcttcactgccctgccaatgattttagagaattctcttgaactgggttttctacctgctgtctgggattttttcacaatgcagatgaacttttcatctgtcttctacacattttcaatgggaacaaaaagccattactatggccgaacaattcttcatggtggtgcaaagtatcgggctactggccgtggctttgttgtgcagcataagagtttcgctgaaaattacaggctatatgctaggagccacttcataaaggctatagagctcgggataatattgactgtgtatgccgttcacagtgtgattgccaggaacacacttgtttacatagtcatgatgatatctagctggtttcttgtggtgtcctggatcatggctccatttgcatttaatccgtctggttttgattggttgaaaactgtgtatgacttcgaagatttcatgacctggatctggtttccaggaggtatattttctaaggctgagcacagctgggaagtgtggtggtatgaggagcaagatcatctgcggactactggcctttgggggaagattttggaaatactgctagatctcagatacttcttttttcagtatggggttgtataccagctcaaaatcgcagacggaagcagaagcattgcggtgtatctgctttcctggatatgtgtggcagtgatctttggtgtttttgtcctaatgtcctatactcgggacacatatgctgcgaagcaacatctttactaccgggttgtccaaactgccatcatcattctgggagtgctggtgctgatattattcctgaagtttactgagtttcaaatcattgacatcttcactggtcttttggcattcattcctactggctggggcttgatttccattgctcaagtgatcaggccattcatcgaatccactgtggtgtggggcagtgttatttctgtggcgcgtttgtatgagatactgcttggagtgattgttatggcgccagttgcattgctgtcctggctgccagggtttcaagaaatgcagacaagggtactgttcaatgaaggtttcagcagaggcctccaaatatcccgcattcttgctggcaagaaaacgaacgcagtttgaggtactaaccaggttgtcagcggttgcagttaggcagtgatccggtcatctctgtacagcaccaatgcgtaaagcctttcgtgacatagcttagctccatattgctatcttttgctggctactggcgatctctctagttagatgttcattcagattcgtacaactttggtgatttaggcattgagtcttggactagctgcgtgttagagtagatgatgattgcgcttcagcttacctttgagctctgacgatgtatttgttggcctggctagaagttccatctcctgtgctgaagagaggtcgtgtgattgaggagtgatggaaactccccgctgtgattgatcagatcttgatctgcgtttccgttatgtgcacgctatttctttggttccattctctctgcatgggtttatctatcggctcgcgccgcgcacgaacagcaaaaggagattggcgctttgcaatccgtgcgagtacagtcggaatggattgtaataaagcgggttagtttcggaa

SEQ ID NO: 3299 - DNA, 5910 bp, Brachypodium distachyon
tgaggctgtgtgttgagtactgacggttcctcccgttttgcagctgcgtaggagatgagcgtcctccgcaaccgccggccctccgtggcgggggcggggtcggggccggtggatccgcccgtgcaggcgtcctacaacatcatcccgatccagaacgtgctgatgcacggggagcacccgtcgctgcggttcccggaggtgcgcgcggcggtggaggcgctggcgcacgccgccgacctcccgccgccgccgttcgcccgcgcctgggagtcccaccgcgccgacctcttcgactggctcggcgccaccttcggcttccagcgccacaacgtccgcaaccagcgggagcacctcgtgctcctcctcgccaacgcccagctccgcgcggggggcaccctgcccaccgaccaccccgccgacgtactccactactccgttccccgggccatccggaagaagctcctcaagaactacacctcctggtgcgcgtacctcggccagaggccgcatgtctatgtgcccaccgccggccgccggaccggtgccgcggcgagcgttggccctgacatccgcagggacctcatgtacgcggctttgtacctgctaatctggggggaggctgccaatctgaggttcatgcccgaatgcctctgctacatcttccactacatggcgctcgacctcagccatgtcatcgaccgctccattgatgtcgagacggggcgacctgcaatccctgccgtgtgcggtgaggaggctttcctgaacagtgtggtcacgccaatttataatgcgctcaagggcgaggttgaggccagccggaatgggaccaagccgcactcagcttggagaaattatgacgatgtgaatgagtacttctggagccggcgagtcttcaagcggctccggtggccactggatccttcaaggggcttctttgtgccaccagggaagcctggccgtgttggcaagactggttttgtagagcagcgctcattctggaatgtgtaccgaagcttcgatcggttatgggtgatgcttattctcttctttcaggcagccatgattgttgcatgggatggccgtagtgttccatgggatagcctcagctaccgtgacatccagatccgtgtgctgtcagtgttcatcacctggggtggtctgcgctttctgcaggcgttgcttgacgctggcactcagtacagtcttgtgtcgagggaaactacatttattgctgtccggatggtgctcaaggcaattgttgctgcagggtggactattacatttagcgtgctttatgcgcgaatgtgggatcagcggtggcgagatcgcagatggtcctttgctgccaataccagggtgttaaattaccttgaggcagcagctgtgtttgtcattccacaggtgcttgcgcttgtgctgtttatcatcccttggataaggaattttctggagaaaaccaattggcggattctatatctgctcacctggtggttccagacccgcacatttgtaggacgtggtctgagggaggggcttattgataacatcaagtattcaattttctggatctgtctccttctagctaagtttagcttcagctacttcctccagattaagccgatggtggctccaacaaagacaatattcagcctccataacatctctcacaactggtttgagttcatgcctcacacagagaggcttgctgtaatcatcctgtggatcccagttatcctcatttaccttatggatatccagatatggtatgcaatcttctcatcactcacgggggcacttatcgggcttttctcacatttaggggagattcgcagtgttgagcagttgcgcttgaggttccagttttttgcaagtgcaatgcagttcaatttgatgccagaggagcacctcgataagttccgtggtggcatccgcagcagactgtatgatgcaattcaccggctgaagctgaggtatggttttggccgcccatataggaagattgaagcaaatgaggtggaagcaaagaggtttgcactgatttggaatgagatcattcagacatttagggaagaggacatcgttagcgacaaggaagttgagcttcttgagcttccaccagttgtgtggaagattcgcgtggtacggtggccatgcttgctgcttaataatgagctgcttcttgctctcagtcaagcaacagaactggtggctgatgacaagacacactggaacaggatatgtaacattgagtataggcgatgtgctgtgattgaagcttatgacagcatacgccagctgctgttggagattattgaggagaggactgttgagcacattattgttaatcagcttttccttgcatttgataatgcgatggaatatgggaaattcgctgaagaatacaggctaaccttgttaccccagattcattcatctgtaatcaccttagtggaactgctactgaaggaaaacaaggatcagaccaagatagtcaacacgttgcaaactctctatgttcttgtggttcatgattttccgaagaacaagaaggacatagaacagctgaggctagaggggctagcaccgtcaaggcctactgaatctgggttgctctttgaggatgccctgaaatgccctagtgagaacgatgttagcttctacaagcaggtcagacgcctccatacgattctcacatccagggattctatgaacaatgttccaaagaaccctgaggctcgacggcgtataactttcttcagtaactcgctattcatgaacatgcctcgtgctcccccagtggagaagatggtggcattcagcgtcttgactccatattacaatgaagatgtcttgtacagcaaggaccagcttcgccgtgaaaatgaagatggcatctcaatcttgttttatcttcagaagatctatgaagatgattgggcaaactttttagaacgtatgaggagagaaggaatggtcaatgatgatggtatttgggctggaaaatttcaggagctccgactttgggcctcctatagggggcagaccttagcacggactgttaggggaatgatgtactactacagtgctctcaagatgcttgcttttcttgataaggcctctgagatagacattacagaaggaacaaaacatctggctacctttggttcaattaggcatgagaatgatgtgtatcccaggaataatggtttccaacaacgtcctcagcggaggttaaacagaggagcgagtactgttagtcaattgtttaaaggcgaggaagatggtgctgctctcatgaagtacacctatgtggtcacatgccagatatacggaaaccagaaaatggcgaaagatcaacgcgctgaagatattctgactctcatgaagaaaaatgtggccctccgtgttgcttatgttgatgaggtccgtcatgagatgggtgatatgcaatattattctgtccttgtgaaatttgaccaggacttacagaaagaggttgagatataccggattaggttgccaggtcctctgaaacttggggagggtaaacctgaaaaccagaaccatgccatcatattcactagaggcgatgcagtgcaaacaatcgacatgaaccaggataattattttgaggaggctctcaagatgcgcaatctattagaacagtacaactattatcacgggagccaaaaaccaacactgttgggagttcgagaacatgttttcactggatctgtctcttcacttgcttggttcatgtctgcacaggagacaagctttgttacccttgggcagcgggttctagctaatccattgaaggttcggatgcattatgggcatcctgatgtatttgatcgcctgtggtttttgactcggggtggtttgagtaaggcatccagagtaatcaatatcagtgaggacatattcgcaggtttcaactgtactctacgtggtggcaatgttagtcaccatgaatacatccaggttggcaaggggcgtgatgttgggcttaatcaaatatcgatgtttgaagcaaaggtttccagtggcaatggagaacagaccctgagtagggatatctacagacttggtcatagagtggatttctttcggatgctttctgtgttttacaccactataggattttacttcaacacaatgctggtggtattgacagtctacacatttgcttggggacgcctctatctagctctgagcggtctggaggctggaatacagggcagtgctaatgttactaacaataaagccttgggtgccgtgctaaatcagcagtttgtcatacaactcggatttttcactgccttgccaatgattctagagaactcgcttgaacgaggttttctacctgctgtctgggagtttttcacaatgcaaatgaacttttcatctgtcttttacacattttccatgggaacaaaaagccattactatggccggacaattcttcatggcggtgcaaagtatcgtgcaactggacgtggctttgttgtgcaacataagagttttgctgaaaattacaggctgtatgccagaagtcacttcataaaggcgatagaactcggaataatattgaccgtgtatgcctttcacagtgtgattgccaggaacacacttgtttacataatcatgatgctatctagctggattctagtggtgtcgtggatcatggctccatttgcttttaatccgtctggctttgattggttgaagaccgtgtatgactttgacgatttcatgaactggatctggtatcctggtggtatattttccaaggctgagcacagctgggaagtgtggtggtatgaggagcaagatcatctacggacaactggcctttggggaaagattttggaaatactcttagatctcagatacttcttttttcagtatggggttgtgtaccagctcaaaatcgcagacggaagcagaagtattgcagtgtatctgctttcctggatatgtgtggcagtgattttcggtgtttttgtcctaatgtcgtatgctcgagacaagtattctgcaaagcaacatcttcactaccggcttgttcaatgtgctgtcatcattcttgcagcgctagtgctgatattattctttgagtttactgaatttcaaatcattgacatcttcactggccttttggcattcattcctactggttggggcttgatttccattgctcaagtgatcaggccattcattgaatctactgtggtgtgggccagtgttatttctgtggcacgtttgtatgagatactgcttggggtgattgttatggcaccagttgcattactgtcttggttaccaggatttcaagaaatgcagacaagagtactgttcaatgaaggtttcagcagaggtctccagatatcccgcattcttgctggcaagaaaacgaatgcagtttgaggttataaccaggttgtcgcagttaggcagtgatccgtcatctatctctgtacagcttcttattcaatgtggaaagctttggtggtggtggtggctactggcgatctagtttggagtagctgttaagatttgtataaccacgctggtggttttaggtattgagttttgcaccttcttagagctacttagtagggtgttgatgattctgctgtggcacataccacccgtgagatctgatgaatcatttgttgatgcggctagatgttgcatctttgtactggaaagagtcgcgcaattgatagctggatattctcctttgtggctggtcaatcaaaccagtgcctcaggtcgtctgaacaaacagctgccaatttttgcggtgttgcagctgattgtttctcgactacatggtttggcgtgtagaaactttatcatgaggggggggtgcttgatatgcctcctagttttgactgttgg

SEQ ID NO: 3300 - DNA, 6670 bp, Brachypodium distachyon
ggagtgatggggttctcaagtctcgaactctcaatgcacttatgcacgaccaaaagtatcctacttcacgaattcgcttggattctccaaagatgacaaagtgccaatcctgttactcacccagatttcatagctttatgataccaaaaaattctctcattttattttattttctgccattggaaccggctggataaagaggatgagactcatcacatcaatctgacattcccttttcgtaaagtacatcacctcgttctcactcgcatcatcatcatcgtcaattcgtcatcattatcccactggaagacacagcgcacggaaacactagtttggtttagaaaccccagaagcaaagcaaagaccagcccccccaaaccccacaccggagaaaaacaaatcaaacaagcaaacaaaagctccatcgcccacgtgatcctcttctaagtcctaatactgtgtatgcacttcctcctctctgaatctctgatgatgatgaggctgtgtgttgagtactgacggttcctcccgttttgcagctgcgtaggagatgagcgtcctccgcaaccgccggccctccgtggcgggggcggggtcggggccggtggatccgcccgtgcaggcgtcctacaacatcatcccgatccagaacgtgctgatgcacggggagcacccgtcgctgcggttcccggaggtgcgcgcggcggtggaggcgctggcgcacgccgccgacctcccgccgccgccgttcgcccgcgcctgggagtcccaccgcgccgacctcttcgactggctcggcgccaccttcggcttccagcgccacaacgtccgcaaccagcgggagcacctcgtgctcctcctcgccaacgcccagctccgcgcggggggcaccctgcccaccgaccaccccgccgacgtactccactactccgttccccgggccatccggaagaagctcctcaagaactacacctcctggtgcgcgtacctcggccagaggccgcatgtctatgtgcccaccgccggccgccggaccggtgccgcggcgagcgttggccctgacatccgcagggacctcatgtacgcggctttgtacctgctaatctggggggaggctgccaatctgaggttcatgcccgaatgcctctgctacatcttccactacatggcgctcgacctcagccatgtcatcgaccgctccattgatgtcgagacggggcgacctgcaatccctgccgtgtgcggtgaggaggctttcctgaacagtgtggtcacgccaatttataatgcgctcaagggcgaggttgaggccagccggaatgggaccaagccgcactcagcttggagaaattatgacgatgtgaatgagtacttctggagccggcgagtcttcaagcggctccggtggccactggatccttcaaggggcttctttgtgccaccagggaagcctggccgtgttggcaagactggttttgtagagcagcgctcattctggaatgtgtaccgaagcttcgatcggttatgggtgatgcttattctcttctttcaggcagccatgattgttgcatgggatggccgtagtgttccatgggatagcctcagctaccgtgacatccagatccgtgtgctgtcagtgttcatcacctggggtggtctgcgctttctgcaggcgttgcttgacgctggcactcagtacagtcttgtgtcgagggaaactacatttattgctgtccggatggtgctcaaggcaattgttgctgcagggtggactattacatttagcgtgctttatgcgcgaatgtgggatcagcggtggcgagatcgcagatggtcctttgctgccaataccagggtgttaaattaccttgaggcagcagctgtgtttgtcattccacaggtgcttgcgcttgtgctgtttatcatcccttggataaggaattttctggagaaaaccaattggcggattctatatctgctcacctggtggttccagacccgcacatttgtaggacgtggtctgagggaggggcttattgataacatcaagtattcaattttctggatctgtctccttctagctaagtttagcttcagctacttcctccagattaagccgatggtggctccaacaaagacaatattcagcctccataacatctctcgcaactggtttgagttcatgcctcacacagagaggcttgctgtaatcatcctgtggatcccagttatcctcatttaccttatggatatccagatatggtatgcaatcttctcatcactcacgggggcacttatcgggcttttctcacatttaggggagattcgcagtgttgagcagttgcgcttgaggttccagttttttgcaagtgcaatgcagttcaatttgatgccagaggagcacctggataagttccgtggtggcatccgcagcagactgtatgatgcaattcaccggctgaagctgaggtatggttttggccgcccatataggaagattgaagcaaatgaggtggaagcaaagaggtttgcactgatttggaatgagatcattcagacatttagggaagaggacatcgttagcgacaaggaagttgagcttcttgagcttccaccagttgtgtggaagattcgcgtggtacggtggccatgcttgctgcttaataatgagctgcttcttgctctcagtcaagcaacagaactggtggctgatgacaagacacactggaacaggatatgtaacattgagtataggcgatgtgctgtgattgaagcttatgacagcatacgccagctgctgttggagattattgaggagaggactgttgagcacattattgttaatcagcttttccttgcatttgataatgcgatggaatatgggaaattcgctgaagaatacaggctaaccttgttaccccagattcattcatctgtaatcaccttagtggaactgctactgaaggaaaacaaggatcagaccaagatagtcaacacgttgcaaactctctatgttcttgtggttcatgattttccgaagaacaagaaggacatagaacagctgaggctagaggggctagcaccgtcaaggccgactgaatctgggttgctctttgaggatgccctgaaatgccctagtgagaacgatgttagcttctacaagcaggtcagacgcctccatacgattctcacatccagggattctatgaacaatgttccaaagaaccctgaggctcgacggcgtataactttcttcagtaactcgctattcatgaacatgcctcgtgctcccccagtggagaagatggtggcattcagtgtcttgactccatattacaatgaagatgtcctgtacagcaaggaccagcttcgccgtgaaaatgaagatggcatctcaatcttgttttatcttcagaagatctatgaagatgattgggcaaactttttagaacgtatgaggagagaaggaatggtcaatgatgatggtatttgggctggaaaatttcaggagctccgactttgggcctcctatagggggcagaccttagcacggactgttaggggaatgatgtactactacagtgctctcaagatgcttgcttttcttgataaggcctctgagatagacattacagaaggaacaaaacatctggctacctttggttcaattaggcatgagaatgatgtgtatcccaggaataatggtttccaacaacgtcctcagcggaggttaaacagaggagcgagtactgttagtcaattgtttaaaggcgaggaagatggtgctgctctcatgaagtacacctatgtggtcacatgccagatatacggaaaccagaaaatggcgaaagatcaacgcgctgaagatattctgactctcatgaagaaaaatgtggccctccgtgttgcttatgttgatgaggtccgtcatgagatgggtgatatgcaatattattctgtccttgtgaaatttgaccaggacttacagaaagaggttgagatataccggattaggttgccaggtcctctgaaacttggggagggtaaacctgaaaaccagaaccatgccatcatattcactagaggcgatgcagtgcaaacaatcgacatgaaccaggataattattttgaggaggctctcaagatgcgcaatctattagaacagtacaactattatcacgggagccaaaaaccaacactgttgggagttcgagaacatgttttcactggatctgtctcttcacttgcttggttcatgtctgcacaggagacaagctttgttacccttgggcagcgggttctagctaatccattgaaggttcggatgcattatgggcatcctgatgtatttgatcgcctgtggtttttgactcggggtggtttgagtaaggcatccagagtaatcaatatcagtgaggacatattcgcaggtttcaactgtactctacgtggtggcaatgttagtcaccatgaatacatccaggttggcaaggggcgtgatgttgggcttaatcaaatatcgatgtttgaagcaaaggtttccagtggcaatggagaacagaccctgagtagggatatctacagacttggtcatagagtggatttctttcggatgctttctgtgttttacaccactataggattttacttcaacacaatgctggtggtattgacagtctacacatttgcttggggacgcctctatctagctctgagcggtctggaggctggaatacagggcagtgctaatgttactaacaataaagccttgggtgccgtgctaaatcagcagtttgtcatacaactcggatttttcactgccttgccaatgattctagagaactcgcttgaacgaggttttctacctgctgtctgggagtttttcacaatgcaaatgaacttttcatctgtcttttacacattttccatgggaacaaaaagccattactatggccggacaattcttcatggcggtgcaaagtatcgtgcaactggacgtggctttgttgtgcaacataagagttttgctgaaaattacaggctgtatgccagaagtcacttcataaaggcgatagaactcggaataatattgaccgtgtatgcctttcacagtgtgattgccaggaacacacttgtttacataatcatgatgctatctagctggattctagtggtgtcgtggatcatggctccatttgcttttaatccgtctggctttgattggttgaagaccgtgtatgactttgacgatttcatgaactggatctggtatcctggtggtatattttccaaggctgagcacagctgggaagtgtggtggtatgaggagcaagatcatctacagacaactggcctttggggaaagattttggaaatactcttagatctcagatacttcttttttcagtatggggttgtgtaccagctcaaaatcgcagacggaagcagaagtattgcagtgtatctgctttcctggatatgtgtggcagtgattttcggtgtttttgtcctaatgtcgtatgctcgagacaagtattctgcaaagcaacatcttcactaccggcttgttcaatgtgctgtcatcattcttgcagcgctagtgctgatattattctttgagtttactgaatttcaaatcattgacatcttcactggccttttggcattcattcctactggttggggcttgatttccattgctcaagtgatcaggccattcattgaatctactgtggtgtgggccagtgttatttctgtggcacgtttgtatgagatactgcttggggtgattgttatggcaccagttgcattactgtcttggttaccaggatttcaagaaatgcagacaagagtactgttcaatgaaggtttcagcagaggtctccagatatcccgcattcttgctggcaagaaaacgaatgcagtttgaggttataaccaggttgtcgcagttaggcagtgatccgtcatctatctctgtacagcttcttattcaatgtggaaagctttggtggtggtggtggctactggcgatctagtttggagtagctgttaagatttgtataaccacgctggtggttttaggtattgagttttgcaccttcttagagctacttagtagggtgttgatgattctgctgtggcacataccacccgtgagatctgatgaatcatttgttgatgcggctagatgttgcatctttgtactggaaagagtcgcgcaattgatagctggaaattctcctttgtggcgggtcaatcaaaccagtgcctcaggtcgtctgaacaaacagctgccaatttttgcggtgttgcagctgattgtttctcgactacatggtttggcgtgtagaaactttatcatgaggggggggtgcttgatatgcctcctagttttgactgttggctgagtacgagttccttttgtatttcaacaactccgcatcgctaggttcctcgacggaaccgaccttgtcttgggtttatttagccggcctcccacctgataaaaagcccccaattccccgtattataagcttattcacaactcttttacctttacctacccttgtttcctctcactcgttttttcttcgtccccatggctagttggctacggcgacggcgaagcggaagccagtgttcgtgaaagtgaaccaactcaggccag

SEQ ID NO: 3301 - DNA, 6649 bp, Oryza sativa
actagtatggtcttacctttatcttctttcatcgattcctaccacaccagatgccatacaacacaagctaacaaaacctgagtgcgagtggatggtgagatttactccagaccattacaccaatctgtcccattcacttgtagacttgctttgctgacctccccttttttttgcttacagtgcatcagtaatccgtagcctaccagtagatcacaaatccattgcatatccctcctccaaaaaaggagtcacatcttctcatcgccatcatcattagttcattttgcccccaccggaaaatccagcgcacagaaacactagcggcatggttagaaaccccacaagcaaagcaaccaaaccgagccccaaacccacacccgcctactaggcggcggctatgatgcaaactgttgaagcgatcacgcacgcctcgcttccgcctaatccgaaggagacaagcaaatcaaacaagcgaacaaaagcggcagcccgaataaaccagctgcgcagcatgtgattcccacctaggttcctcccatcatcccgtgtacttcttcgcttcaaagggctcacactcgtcgagtgatttttttgcagctggctgcgtgagacggggagatgagcttgctgcggaaccgccgcgccgcggcggcggcgggttcgggggagcagacggtggtgcaggcggcgtacaacatcatcccgatccaggacgtggtgatgcacggggaccacccgtcgctgcaggtgccggaagtgcgggcggcggtggaggcgctgtcgcacgcgtcggacttcccggcgccgccgctggcccgcgtctgggacccgcaccgcgccgacatcttcgactggctcggcgccaccttcgggttccaggcggacaacgtccggaaccagcgggagcacctggtgctcctcctcgccaacgcgcagctccgcgccgcgccgggattccccaaggaccaccccatcgacgtcctccacctcaccgtcgcccgcggcatccgcaggaagctcctcaagaactacacctcctggtgcgcctacctcggccagaagcgccacttccgcgtgcccagcggcggcggcggcggccgccgcaccggcgccgccaccggcaacgacgtccgcatggacctcctctacacggcgctgtacctgctcatctggggggaggccgccaacctgaggttcatgccggagtgcctctgctacatcttccactacatggccctcgacctccaccacgtcgtcgagcagtccatcgacatcgagacagggcggcctgcgatgcccgccgtgtgcggcgaggacgccttcctcatccgcgtggtgactccgatctacaacgtcctcaagaacgaggtggaggccagccggaacgggaccaagccgcactcggcgtggaggaattacgacgatgtcaacgagtacttctggagccgacgagttttcaagcggctccggtggccgctggatccatcgaggagcttctttgtggagcctggaaagactgggcgcattggcaagactggctttgttgagcagcggtcattctggaatgtctaccgaagtttcgatagggtatgggtgatgcatattctgttctttcaagctgcgatgattgttgcatgggatggtaaaaccccatgggttagcctcagattccgggacatccaggtccgggtgctgtctgtgttcatcacttggggtggactgcgctttgttcaggcaatgcttgatgcgggtactcagtacagtctcgtgtcgagggagacaaaaacagtggctgttcggatggtgctcaaggtgcttgttgctgcagggtggacaatcacattcagtgtgctctataagcgaatgtgggatcagcggtggcgagatcgcaggtggtcctttgctgccaataccagagtgctgaattaccttgaggcagctgctgtgtttgtcatcccgcaagtgcttgcgattgtgctcttcatcatcccttggattcgaaattttctggagaaaaccaattggaaaattctatatgtgctgacctggtggttccaaacacgtacatttgttggccgtggtctgagggaaggtctcattgataacatcaagtactccatattctgggtgtgcctccttgtttctaagtttagcttcagctactttctccagattaagccgatggtggggccaacaaaggtaatcttcaaactccatgacatcaagcgtaactggtttgagttcatgcctcacacagagcgccttgcagtaatcatcctgtggctcccagttattatcatttacctcatggatatccagatatggtatgcagtcttctcatcactaacaggggcgcttatcggccttttctcgcatctgggggagattcgcagtgttgagcagctgcgcttgaggttccagttctttgcaagtgcaatgcagttcaatttaatgccagaggagcacctggataccgttcatggtggcatccgcagcaagttctatgatgcaatcaatcggctgaagctgagatatgggtttggccgtccatataggaagattgaagcaaacgaggtggaagctaagaggtttgcactggtttggaatgagatcattcaaacatttagggaagaggacatcattagtgataaagagcttgggcttcttgagctgccggcagttgtgtggagaattcgtgtggtacggtggccttgtttgctgctaaaaaatgagcttcttcttgctctcagtcaggcagcagagctggtggctgatgacaggacacattggaacaagatatgtaacaacgagtacaggcgatgtgcagtaattgaagcttatgacagcatacgtcacttgctgctggaaataatcaaggagagaactaatgaacacattattgtcaatcagctattccttgcatttgatggtgcaatggaatatggaaagttcactgaagaatataggctaaccttattacctcaaattcataagtatgtaatctccttagtggagcagcttctattgaaggacaaggatcagatcaagatagttcgtaccttgcaggatctgtatgatcttgcagtgcatgattttccaaaaatcaagaaggactttgaacagctgaggcgagaggggctagcactatcaagaccaaccgaatctcagctgctttttcaggatgccataaaatgcccagatgacaatgatgttagcttctataagcaggtgagaagactccatacgattctcacatccagggattctatggacgatgttccaaagaaccccgaggctcgtcggcgcataactttcttcagcaactccctgttcatgaacatgcctcgtgctcccaccgttcagaggatgatggcattcagtgttttaaccccatattacaatgaagatgttctgtacaacaaggaccagcttcgtcgtgagaatgaagatggcatctcaatcttgttttatcttcaaaagatttatgaagatgattggaaaaactttttagagcgcatgcaaagggaaggaatggctagtgatgatggcatttgggctggaaaattccaggatctccgactttgggcctcgtacagggggcagaccttagcacggactgtgaggggaatgatgtactactacagggctctcaagatgcttgcttttcttgataatgcatctgaagtagaaattacagagggaacaaaacagctggcttcttttggttcagttcagtatgagaatgatgtatatcccatgaacgggggtttatcacaacgacctcgaaggaggttagagagaggaacaagtactgtaagtcaattgtttaaaggccaggaagatggtgctgctatcatgaagtacacctatgtggtcgcttgccaaatatatggaaaccagaaaaaggcgaaagatcaacgtgctgaagatatcctaactcttatgaagaaaaatgatgccctccgtgttgcttatgtcgatgaggtccatcctgagattggtgatacgcaatactattctgtccttgttaaatttgatcctgtcttacagagagaggttgagatataccgtattaggttgccaggtcaactgaaacttggggagggaaaacctgaaaatcagaaccatgccatcatattcacacgaggtgatgctgtgcaaacgattgatatgaaccaggataattattttgaggaggccctcaagatgcgtaacctactagaacagtacgactattatcatggaagccagaaaccaacgcttttgggcgtccgggagcatgtttttactggatcggtgtcttcacttgcttggttcatgtctgcacaagaaacaagctttgttacccttggacagcgagttctagctaatccgttgaaggttcggatgcattatgggcatcctgatgtatttgatcgcctttggtttttaacccgaggtggtataagcaaggcatccagagtaatcaatatcagcgaggacatatttgcaggtttcaactgtaccctacgcggtggcaatgttagccaccatgagtatatccaggttggtaagggacgtgatgttgggctcaatcagatatcgatgtttgaagcaaaggtttctagtggcaatggtgaacagaccctaagtagggatatctacagacttggtcataggctggatttctttaggagtctttctgtgttctatacaacagtaggattctacttcaacacaatgatggtggtcttgacagtttatacatttgtttggggacgcctctatctagctctgagtggtcttgaggctggaattcagggtagcgctaatgctaccaacaataaagccttgggtgccgttctgaatcagcaatttgtcatacagcttggcctcttcactgccttgccaatgattatagagaactctcttgaacagggttttctgcctgctgtctgggattttttcactatgcaaatgatgttttcgtccgtgttctacacattttccatggggacgaaaagccattactatggccggacaattcttcatggcggtgctaagtatcgtgctactggccgtggttttgttgtgcagcataagagttttgctgaaaattacaggctgtatgctaggagccacttcataaaggcaatagaacttggaatagtattgactgtgtatgcagctcacagtgtgattgcaagggatacacttgtttacataatcatgatgatatctagctggtttctagtggtatcatggatcatggctccatttgcttttaatccatctggctttgattggttgaaaacagtgtatgactttgatgatttcatgaactggatctggtaccctggtagtatcttttctaaggctgaacacagctgggaagtttggtggtttgaggagcaggatcatctacgaacaactggtctttggggaaagattttagaaatattgttagatctcagatacttcttttttcagtatggggttgtataccagttgaagatcgcaaatgaaagcagaagtattgctgtttatctgctttcctggatttgtgtggctgtgattttcggcatttttgtcctaatgtcatatgctcgagacaagtatgctgcaaaacaacacctttactaccgggtcatccaatctggtgtcattattcttgcagtgctagtgctgataatatttctgaaatttactaaatttcaaatcattgacatcttcacaagccttttggcattcattcctactggttggggcttgatttccattgctcaagtgattagaccattcattgagtctactgtggtctgggccagtgttgtttctgtggcacgtttgtatgagatactgcttggggtgtttgttatggcgccagttgcattcttttcctggttgcctggatttcaggaaatgcagacgagggtacttttcaatgaagctttcagcagaggcctccagatatcccgcattcttgctggcaagaaaacaattgcagtttgaggctctaacaaggttatcgcagttaggccgtcctccgtcacctctgtacagcttcttatgcaatgtggaaggctttctgtttactgatatagcttagatccatattgaaccttttagatggctgattagcttcagtcatcttactctagatgttcagatttgtactgagtaatttaggcctctccagttttgcaccttcttagagctagttgtatgtagatgattctgttgcagcattacccgtgaactctaatggcttgtttgttaacctggctggatgttccattttttgcgcctggaaaatcaaagtgcaattgccctccttctgaaggttcacctttgggtgtcatttctctcatttcctgggaagatgttggaatgatgctgcctggtggtgttagccaacgttggcctgaaagatttgcctcattggcagaatgcagcgagtattctatcgtctgtaactgtaagcacaaatgcttcgaagtattgctttaaatgaaaattagtagaggcacaattggtgcttcgatgggcaaccttggactttcggtgcagcttggtgccttggtcgagcataataacaacacgtaaggtacgggtttaggttgattgcccttcccttgcacgcaaagatgctaataagagttaatgatgg

SEQ ID NO: 3302 - DNA, 6332 bp, Oryza sativa
aagcaaccaaaccgagccccaaacccacacccgcctactaggcggctagtatgatgcaaactgttgaagcgatcacgcacgcctcgcttccgcctaatccgaaggagacaagcaaatcaaacaagcgaacaaaagcggcagcccgaataaaccagctgcgcagcatgctgcgtgagacggggagatgagcttgctgcggaaccgccgcgccgcggcggcggcgggttcgggggagcagacggtggtgcaggcggcgtacaacatcatcccgatccaggacgtggtgatgcacggggaccacccgtcgctgcaggtgccggaagtgcgggcggcggtggaggcgctgtcgcacgcgtcggacttcccggcgccgccgctggcccgcgtctgggacccgcaccgcgccgacatcttcgactggctcggcgccaccttcgggttccaggcggacaacgtccggaaccagcgggagcacctggtgctcctcctcgccaacgcgcagctccgcgccgcgccgcgattccccaaggaccaccccatcgacgtcctccacctcaccgtcgcccgcggcatccgcaggaagctcctcaagaactacacctcctggtgcgcctacctcggccagaagcgccacttccgcgtgcccagcggcggcggcggcggccgccgcaccggcgccgccaccggcaacgacgtccgcatggacctcctctacacggcgctgtacctgctcatctggggggaggccgccaacctgaggttcatgccggagtgcctctgctacatcttccactacatggccctcgacctccaccacgtcgtcgagcagtccatcgacatcgagacagggcggcctgcgatgcccgccgtgtgcggcgaggacgccttcctcatccgcgtggtgactccgatctacaacgtcctcaagaacgaggtggaggccagccggaacgggaccaagccgcactcggcgtggaggaattacgacgatgtcaacgagtacttctggagccgacgagttttcaagcggctccggtggccgctggatccatcgaggagcttctttgtggagcctggaaagactgggcgcattggcaagactggctttgttgagcagcggtcattctggaatgtctaccgaagtttcgatagggtatgggtgatgcatattctgttctttcaagctgcgatgattgttgcatgggatggtaaaaccccatgggttagcctcagattccgggacatccaggtccgggtgctgtctgtgttcatcacttggggtggactgcgctttgttcaggcaatgcttgatgcgggtactcagtacagtctcgtgtcgagggagacaaaaacagtggctgttcggatggtgctcaaggtgcttgttgctgcagggtggacaatcacattcagtgtgctctataagcgaatgtgggatcagcggtggcgagatcgcaggtggtcctttgctgccaataccagagtgctgaattaccttgaggcagctgctgtgtttgtcatcccgcaagtgcttgcgattgtgctcttcatcatcccttggattcgaaattttctggagaaaaccaattggaaaattctatatgtgctgacctggtggttccaaacacgtacatttgttggccgtggtctgagggaaggtctcattgataacatcaagtactccatattctgggtgtgcctccttgtttctaagtttagcttcagctactttctccagattaagccgatggtggggccaacaaaggtaatcttcaaactccatgacatcaagcgtaactggtttgagttcatgcctcacacagagcgccttgcagtaatcatcctgtggctcccagttattatcatttacctcatggatatccagatatggtatgcagtcttctcatcactaacaggggcgcttatcggccttttctcgcatctgggggagattcgcagtgttgagcagctgcgcttgaggttccagttctttgcaagtgcaatgcagttcaatttaatgccagaggagcacctggataccgttcatggtggcatccgcagcaagttctatgatgcaatcaatcggctgaagctgagatatgggtttggccgtccatataggaagattgaagcaaacgaggtggaagctaagaggtttgcactggtttggaatgagatcattcaaacatttagggaagaggacatcattagtgataaagagcttgggcttcttgagctgccggcagttgtgtggagaattcgtgtggtacggtggccttgtttgctgctaaaaaatgagcttcttcttgctctcagtcaggcagcagagctggtggctgatgacaggacacattggaacaagatatgtaacaacgagtacaggcgatgtgcagtaattgaagcttatgacagcatacgtcacttgctgctggaaataatcaaggagagaactaatgaacacattattgtcaatcagctattccttgcatttgatggtgcaatggaatatggaaagttcactgaagaatataggctaaccttattacctcaaattcataagtatgtaatctccttagtggagcagcttctattgaaggacaaggatcagatcaagatagttcgtaccttgcaggatctgtatgatcttgcagtgcatgattttccaaaaatcaagaaggactttgaacagctgaggcgagaggggctagcactatcaagaccaaccgaatctcagctgctttttcaggatgccataaaatgcccagatgacgatgatgttagcttctataagcaggtgagaagactccatacgattctcacatccagggattctatggacgatgttccaaagaaccccgaggctcgtcggcgcataactttcttcagcaactccctgttcatgaacatgcctcgtgctcccaccgttcagaggatgatggcattcagtgttttaaccccatattacaatgaagatgttctgtacaacaaggaccagcttcgtcgtgagaatgaagatggcatctcaatcttgttttatcttcaaaagatttatgaagatgattggaaaaactttttagagcgcatgcaaagggaaggaatggctagtgatgatggcatttgggctggaaaattccaggatctccgactttgggcctcgtacagggggcagaccttagcacggactgtgaggggaatgatgtactactacagggctctcaagatgcttgcttttcttgataatgcatctgaagtagaaattacagagggaacaaaacagctggcttcttttggttcaattcagtatgagaatgatgtatatcccatgaacgggggtttatcacaacgacctcgaaggaggttagagagaggaacaagtactgtaagtcaattgtttaaaggccaggaagatggtgctgctatcatgaagtacacctatgtggtcgcttgccaaatatatggaaaccagaaaaaggcgaaagatcaacgtgctgaagatatcctgactcttatgaagaaaaatgatgccctccgtgttgcttatgtcgatgaggtccatcctgagattggtgatacgcaatactattctgtccttgttaaatttgatcctgtcttacagagagaggttgagatataccgtattaggttgccaggtcaactgaaacttggggagggaaaacctgaaaatcagaaccatgccatcatattcacacgaggtgatgctgtgcaaacgattgatatgaaccaggataattattttgaggaggccctcaagatgcgtaacctactagaacagtacgactattatcatggaagccagaaaccaacgcttttgggcgtccgggagcatgtttttactggatcggtgtcttcacttgcttggttcatgtctgcacaagaaacaagctttgttacccttggacagcgagttctagctaatccgttgaaggttcggatgcattatgggcatcctgatgtatttgatcgcctttggtttttaacccgaggtggtataagcaaggcatccagagtaatcaatatcagcgaggacatatttgcaggtttcaactgtaccctacgcggtggcaatgttagccaccatgagtatatccaggttggtaagggacgtgatgttgggctcaatcagatatcgatgtttgaagcaaaggtttctagtggcaatggtgaacagaccctaagtagggatatctacagacttggtcataggctggatttctttaggagtctttctgtgttctatacaacagtaggattctacttcaacacaatgatggtggtcttgacagtttatacatttgtttggggacgcctctatctagctctgagtggtcttgaggctggaattcagggtagcgctaatgctaccaacaataaagccttgggtgccgttctgaatcagcaatttgtcatacagcttggcctcttcactgccttgccaatgattatagagaactctcttgaacagggttttctgcctgctgtctgggattttttcactatgcaaatgatgttttcgtccgtgttctacacattttccatggggacgaaaagccattactatggccggacaattcttcatggcggtgctaagtatcgtgctactggccgtggttttgttgtgcagcataagagttttgctgaaaattacaggctgtatgctaggagccacttcataaaggcaatagaacttggaatagtattgactgtgtatgcagctcacagtgtgattgcaagggatacacttgtttacataatcatgatgatatctagctggtttctagtggtatcatggatcatggctccatttgcttttaatccatctggctttgattggttgaaaacagtgtatgactttgatgatttcatgaactggatctggtaccctggtagtatcttttctaaggctgaacacagctgggaagtttggtggtttgaggagcaggatcatctacgaacaactggtctttggggaaagattttagaaatattgttagacctcagatacttcttttttcagtatggggttgtataccagttgaagatcgcaaatgaaagcagaagtattgctgtttatctgctttcctggatttgtgtggctgtgattttcggcatttttgtcctaatgtcatatgctcgagacaagtatgctgcaaaacaacacctttactaccgggtcatccaatctggtgtcattattcttgcagtgctagtgctgataatatttctgaaatttactaaatttcaaatcattgacatcttcacaagccttttggcattcattcctactggttggggcttgatttccattgctcaagtgattagaccattcattgagtctactgtggtctgggccagtgttgtttctgtggcacgtttgtatgagatactgcttggggtgtttgttatggcgccagttgcattcttttcctggttgcctggatttcaggaaatgcagacaagggtacttttcaatgaagctttcagcagaggcctccagatatcccgcattcttgctggcaagaaaacaattgcagtttgaggctctaacaaggttatcgcagttaggccgtcctccgtcacctctgtacagcttcttatgcaatgtggaaggctttctgtttactgatatagcttagatccatattgaaccttttagatggctgattagcttcagccatcttactctagatgttcagatttgtactgagtaatttaggcctctccagttttgcaccttcttagagctagttgtatgtagatgattctgttgcagcattacccgtgaactctaatggcttgtttgttaacctggctggatgttccattttttgcgcctggaaaatcaaagtgcaattgccctccttctgaaggttcacctttgggtgtcatttctctcatttcctgggaagatgttggaatgatgctgcctggtggtgttagccaacgttggcctgaaagatttgcctcattggcagaatgcagcgagtattctatcgtctgtaactgtaagcacaaatgcttcgaagtattgctttaaatgaaaattaatagaggcacaattggtgcttcgatgggcaaccttggactttcggtgcagcttggtgccttggtcgagcataataacaacacgtaaggtacgggtttaggttgattgcccttcccttgcacgcaaagatgctaataagagttaatgatggctatgaagataagtttatctgatggatgcttttagaagtgatgctcgaaaactctattcgaaagtgtcgtcctatcatatccaactcgaatcaaataatcacatcattattcgcgag

SEQ ID NO: 3303 - DNA, 1750 bp, Sorghum bicolor
ccaccatatggtcgttcaaatcattaggaaatttcaccatctccttctcatcttctactatcatcatactgtagagtatgacacaagcttccattattctctcaatcctcttctttttccacagcagtgatggatgatcccgcaatcctgcgtccaccactcatcactccccagtccccccactcctctctctcctcccccgccaccgccagtccgccagcgatggccgccttgtgcgccgccgggacctccacggccacggccttcgcgtcgggccgtctctcggccacttccaccgcgcgggcgcggggggcctccgcctcgacgtcgctgccgtcgtcgtccttcgtcggcgcgttcccgcgcgcggtcgccgcgaggaggaggcggcgcgcggcgccggcccgggcgggcgtcaaggtgcgcgcggaggcggccaagaagcagagcgtgctgatcgtgaacaccaacagcggcgggcacgccgtcatcgggttctacttcgccaaggagctgctcgcggcgggccacgccgtcaccgtgctcaccgtcggcgacgagggctccgacaagatgaagaagcccccgttctctcgcttctcggagctgacgagcgccggcgggaagacggtgtggggtgacccggcggacgtcggcgcggccgtgggaggcgcgttgttcgatgtcgtcctcgacaacaacggcaaggacctcgacgccgtcaagccggtggcggactgggcgaagtcggccggcgtggggcagttcctgttcatcagcagcgccggcatctacaagccgacggaggagccgccgcacgtcgagggggacgccgtgaaggagagcgccggccacgtcgccgtggagaagtacatcgcggagcagttcggcagcagctgggcgtcgttccggccgcagtacatgatcggctccggcaacaacaaggactgcgaggagtggttcttcgacaggatcgtgcggaaccggccggtgccgatcccggggaacgggatgcagctgacgaacatcgcgcacgtccgggacctgtcgcggatgctgtcgctggccgtggagaagcccggcgcggcgtcgggcaagatcttcaactgcgtctcggaccgcgccgtgacgctgagcggcatggcgaagctgtgcgcggcggccgcgggcgccgacgccgtggagatcgtcctctacgaccccgccgccgccggcgtcgacgccaagaaggccttcccgttccgcaacatgcatttctacgcggagccccgggcggcgaaggcggcgctggggtggacgagcagcaccaacctgccggaggacctcaaggagcggtacgccgagtacgccgccagtggccgtggggagaagcccatgaacttcgacctcgacgacaagatcctcgccgccgtcggcaaggcggcgccggcgagcgtcgccgtataagcccaccatcatcgtcctcgtatataaagagtacattttttttttgtgtgtggatgcactaacagctcttcttgccatgcacgcacgtagcaaacggacgctacaaaatacgacaaacatttttttttattttgccttgatttctagttctgtacaaggatgaagagagagagaaaaaaaattgtttgttccctgaccatgcctattgtgaaacgtggttgggcagatggctgtggattgataggatctcctgcggattcttgtacaaaaatggggtggtggcgcagttggctagcgcgtaggt

SEQ ID NO: 3304 - DNA, 2010 bp, Sorghum bicolor
tgatgatccaccatatggtcgttcaaatcattaggaaatttcaccatctccttctcatcttctactatcatcatactgtagagtatgacacaagcttccattattctctcaatcctcttctttttccacagcagtgatggatgatcccgcaatcctgcgtccaccactcatcactccccagtccccccactcctctctctcctcccccgccaccgccagtccgccagcgatggccgccttgtgcgccgccgggacctccacggccacggccttcgcgtcgggccgtctctcggccacttccaccgcgcgggcgcggggggcctccgcctcgacgtcgctgccgtcgtcgtccttcgtcggcgcgttcccgcgcgcggtcgccgcgaggaggaggcggcgcccggcgccggcccgggcgggcgtcaaggtgcgcgcggaggcggccaagaagcagagcgtgctgatcgtgaacaccaacagcggcgggcacgccgtcatcgggttctacttcgccaaggagctgctcgccgcgggccacgccgtcaccgtgctcaccgtcggcgacgagggctccgacaagatgaagaagcccccgttctctcgcttctcggagctgacgagcgccggcgggaagacggtgtggggtgacccggcggacgtcggcgcggccgtgggaggcgcgtcgttcgatgtcgtcctcgacaacaacggcaaggacctcgacgccgtcaagccggtggcggactgggcgaagtcggccggcgtggggcagttcctgttcatcagcagcgccggcatctacaagccgacggaggagccgccgcacgtcgagggggacgccgtgaaggagagcgccggccacgtcgccgtggagaagtacatcgcggagcagttcggcagcagctgggcgtcgttccggccgcagtacatgatcggctccggcaacaacaaggactgcgaggagtggttcttcgacaggatcgtgcggaaccggccggtgccgatcccggggaacgggatgcagctgacgaacatcgcgcacgtccgggacctgtcgcggatgctgtcgctggccgtggagaagcccggcgcggcgtcgggcaagatcttcaactgcgtctcggaccgcgccgtgacgctgagcggcatggcgaagctgtgcgcggcggccgcgggcgccgacgccgtggagatcgtcctctacgaccccgccgccgccggcgtcgacgccaagaaggccttcccgttccgcaacatgcatttctacgcggagccccgggcggcgaaggcggcgctggggtggacgagcagcaccaacctgccggaggacctcaaggagcggtacgccgagtacgccgccagtggccgtggggagaagcccatgaacttcgacctcgacgacaagatcctcgccgccgtcggcaaggcggcgccggcgagcgtcgccgtataagcccaccatcatcgtcctcgtatataaagagtccattgttttttttgtgtgtggatgcactaacagctcttcttgccatgcacgcacgtagcaaacggacgctacaaaatacgacaaacattttttttttattttgccttgatttctagttctttacaaggatgaagagagagagaaaaaaaattgtttgttccctgaccatgcctattgtgaaacgtggttgggcagatggctgtggattgataggatctcctgcggattcttgtacaaaaatggggtggtggcgcagttggctagcgcgtaggtctcatagctggaaaatgcgagtgatcctgaggtcgagagttcgagcctctctcaccccagagcgatgacagatttacgcgctcaccgtgattggtttgggtccatcacaaccgtctgattctacagacgacaagacgcgcatctgagctcaactttttaattttttttttgttttatttcctgtatacacacctattcgaagctcacaacgtacatccttttccacatgtttttagagaaatataattccg

SEQ ID NO: 3305 - DNA, 1574 bp, Setaria italica
atccccctaatcctgcgtccaccactcatcactccgctctctcatctctcctcctcccggccaccaatggccctctccgccgccgccggggccaccacggcgaccgcgttcgcgtcgggtcggcgcctctcggtctcctccccgtgcccctccgcgtcggcgtcgctgccgtccttcctcgccggcgcgttcccgtgtgcggtcgccgcgaggcggcgcgcggcgccggcggcccgtgcggcggtctccgtgcgcgcggaggccaagaagagcgtgctgatcgtgaacaccaacagcggcgggcacgccgtgatcggtttctacttcgccaaggagctgctcgccgccgggcacgccgtcactgtgctcaccgtcggggacgagggctccgacaagatgaagaagccgcccttctcccgcttctcggaactgacgggagctggcgggaagacggtgtggggtgacccggcggacgtcggcgcggccgtcagcggcgcgtcgttcgacgtcgtgctcgacaacaacggcaaggacctcgacgccgtcaagccggtggcggactgggcgaaggcgtccggcgtggggcagttcctgttcatcagcagcgccggcatctacaagccgaccgacgagccgccgcacgtcgaaggggacgcggtgaaggagagcgcggggcacgtgggcgtggagaagtacatcgcggagcagttcagcagctgggcgtcgttccggccgcagtacatgatcggctccggcaacaacaaggactgcgaggagtggttcttcgacaggatcgtgcggggccggccggtgccgatcccgggcaacgggatgcagctgaccaacattgcgcacgtccgggacctctccagcatgctggcgctcgccgtcgagaaccccggcgcggcggccggcaagatcttcaactgcgtctccgaccgcgccgtcacgctcgacggcatggcgaggctgtgcgcggccgcggccggcgccgccgtggagatcgtgcactacgaccccgccgccgtcggcgtcgacgccaagaaggccttccccttccgcaacatgcatttctacgcggagccccgggcggcgaaggaggcgctggggtgggcgagcacgacgaacctgccggaggacctcaaggagcggtacgccgagtacgccgccagcggccgcggcgacaaggacatggccttcgacctcgacgacaagatcctcggcgccgtcgggattgtgccggccagcgccaccgtgtaggaggaagcaggcagtatcaaaagacaagttttgtggatatatatacgctagcaggtcctcctggcacgtcgccaaagaggcaaagacgctacataaacacgagaaacatttttttttttgttttgtgcaatgaaagagagaatatatacgacatgcatgataatgatgctttcctgtaagtcttgctgtaagtaatagaagaccgtgcagtttcggacaacaacggggtggtggcgcagttggctagcgcgtaggtctcatagctgaaagcgagtgatcctgaggtcgagagttcgagcctctctcaccccaga

SEQ ID NO: 3306 - DNA, 1694 bp, Setaria italica
cgcgcgtgcagacggggtggctaataattaatgtagcgctagcagctccgaactttaaacctttttgtgaaactttaaatccccctaatcctgcgtccaccactcatcactccgctctctcatctctcctcctcccggccaccaatggccctctccgccgccgccggggccaccacggcgaccgcgttcgcgtcgggtcggcgcctctcggtctcctccccgtgcccctccgcgtcggcgtcgctgccgtccttcctcgccggcgcgttcccgtgtgcggtcgccgcgaggcggcgcgcggcgccggcggcccgtgcggcggtctccgtgcgcgcggaggccaagaagagcgtgctgatcgtgaacaccaacagcggcgggcacgccgtgatcggtttctacttcgccaaggagctgctcgccgccgggcacgccgtcactgtgctcaccgtcggggacgagggctccgacaagatgaagaagccgcccttctcccgcttctcggaactgacgggagctggcgggaagacggtgtggggtgacccggcggacgtcggcgcggccgtcagcggcgcgtcgttcgacgtcgtgctcgacaacaacggcaaggacctcgacgccgtcaagccggtggcggactgggcgaaggcgtccggcgtggggcagttcctgttcatcagcagcgccggcatctacaagccgaccgacgagccgccgcacgtcgaaggggacgcggtgaaggagagcgcggggcacgtgggcgtggagaagtacatcgcggagcagttcagcagctgggcgtcgttccggccgcagtacatgatcggctccggcaacaacaaggactgcgaggagtggttcttcgacaggatcgtgcggggccggccggtgccgatcccgggcaacgggatgcagctgaccaacattgcgcacgtccgggacctctccagcatgctggcgctcgccgtcgagaaccccggcgcggcggccggcaagatcttcaactgcgtctccgaccgcgccgtcacgctcgacggcatggcgaggctgtgcgcggccgcggccggcgccgccgtggagatcgtgcactacgaccccgccgccgtcggcgtcgacgccaagaaggccttccccttccgcaacatgcatttctacgcggagccccgggcggcgaaggaggcgctggggtgggcgagcacgacgaacctgccggaggacctcaaggagcggtacgccgagtacgccgccagcggccgcggcgacaaggacatggccttcgacctcgacgacaagatcctcggcgccgtcgggattgtgccggccagcgccaccgtgtaggaggaagcaggcagtatcaaaagacaagttttgtggatatatatacgctagcaggtcctcctggcacgtcgccaaagaggcaaagacgctacataaacacgagaaacatttttttttttgttttgtgcaatgaaagagagaatatatacgacatgcatgataatgatgctttcctgtaagtcttgctgtaagtaatagaagaccgtgcagtttcggacaacaacggggtggtggcgcagttggctagcgcgtaggtctcatagctgaaagcgagtgatcctgaggtcgagagttcgagcctctctcaccccagagcgatgacagaattctgtgctcccgtgattggttgggtccat

SEQ ID NO: 3307 - DNA, 1776 bp, Panicum virgatum
cgggacagaggttgaagatgacaggctatgttgttgcagtgtctaaccactacagtattgcgtcaacagtcaacagatgttgttgtgccactacactacaatggctcgctgccatggcaaccaagctaggctcctcctttcttctttctagcctcacagcacctcccaaatcccctcgatcccgcgtccaccactcatcgcctcacccgccctcatctctgatcttctcctcccggccaccgatggctttcgccgccgccgcggcctccacggccaccgcgctcgcgtccggccgcctctcggcctcgtccgcgcagcagcgacggccctcctcgcgggcgtcgttctccccgggagcgtcaccgcgcgcggtggccgcgaggcggcgcgcggcgccggctgcccgggcggccgtctcggtgcgcgcggaggccgggaagaagcgcgtgctggtcgtcaacaccaacagcggcgggcacgccgtcatcgggttctacttcgccaaggagctgctcgccgccgggcacgccgtcaccgtgctcaccgtcggggacgaggcctccgacaagatgaagaagccgcccttctcccgcttctcggagctgacgagcgccggcgggaagacggtgtggggcgacccggcggacgtcggcgcggccgtcggcggcgcgtcgttcgacgtcgtgctcgacaacaacggcaaggacctcgacgccgtcaagccggtggtggactgggccaagtcgtccggcgtggggcagttcctgttcatcagcagcgccggcatctacaggccgaccgaggagccgccgcacgtcgagggggacgcggtgaaggagagcgcggggcacgtgggcgtggagaagtacctcgcggagcagttcgccggcggttgggcgtcgttccggccgcagtacatgatcggctccggcaacaacaaggactgcgaggagtggttcttcgacaggatcgtgcgggggcggccggtgccgatcccgggcaacgggatgcagctgaccaacatcacgcacgtccgggacctcgccagcatgctggcgcttgccgtggggagccccggcgcggcggcggggcgggtcttcaactgcgtctccgaccgcgccgtcacgctggacggcatggcgaggctgtgcgcggcggcggccggcgccgctgccgtggagatcgtccactacgaccccgccgccgccggcgtcgacgccaagaaggccttccccttccgcaacatgcatttctacgcggagccccgggcggcgaaggaggcgctggggtgggcgagcacgacgaacctgccggaggacctcaaggagcgctacgccgagtacgccgccagcggccgcggcggcaaggccatggccttcgacatcgacgacaagatcctcgccgccgtcgggaaggcgccgccgtgtagggatcggacttctaaataggggacgatgcgatcgagggcagcaacggggtggtggcgcagttggctagcgcgtaggtctcatagctgaattgcgagtgatcctgaggtcgagagttcgagcctctctcaccccacggagcgatgacaggatatgtgtgcgcccgtgattggttggggtccatcacagccgtctgattccagacgacgagacgcacatctgagctctccttttcttttttggttttgttctgttcaaaatttttgcttgctaaataaatccgctgtgttctgaagagctcttacacctcttttcttttcctctttttaagaaaaaaatcaaatttacc

SEQ ID NO: 3308 - DNA, 1992 bp, Panicum virgatum
cccctcaatagtcaatcccgcgtccaccactcatcgccccacccgctctcatccttcctcccggccaccgatggccttcgccgcctccacggccaccgcgctcgcgtccggccggctctccgcctcctccgcgcgcccgcgccggccctcctcgcggccgtccttctccctgcgcgcggcgccggcggcccgcgcggcggtctcggcgcgcgcggaggccaagaagagcgagctggtcgtcaacaccaacagcggcgggcacgccgtcttcgggttctacttcgccaaggagctgctcgccgccgggcacgccgtcaccgtgctcaccgtcggggacgaggcctccgacaagatgaagaagccgcccttctcccgcttctcggaactgacgagcgccggcgggaagacggtgtggggcgacccggcggacgtcggcgcggcggtcggcggcgcgtcgttcgacgtcgtgctcgacaacaacggcaaggacctcgacgccgtcaagccggtggtggactgggccaagtcgtccggcgcggggcagttcctgttcatcagcagctccggcatctacaggccgaccgacgagccgccgcaagtcgagggggacgcggtgaaggagagcgcggggcacgtgggcgtggagcggtacatctcggagcagttcgccggcagctgggcgtcgttccggccgcagtacctgatcggctccggcaacaacaaggactgcgaggagtggttcttcgacagaatcgtgcgggggcggccggtgccgatcccgggcaacgggatgcagctgaccaacatcacgcacgtcagggacctcgccagcatgctggcgctggccgtcgggcgccccggcgcggcggcggggcgggtcttcaactgcgtctcggaccgcgccgtgacgctggacggcatggcgaggctgtgcgcggcggccgcgggcgccgccgccgtggagatcgtccactacgaccccgccgccgccggcgtcgacgccaagaaggccttccccttccgcaacatgcacttctacgcggagccccgggcggcgaaggaggcgctggggtgggcgagcacgaccaacctgccggaggacctcaaggagcgctacgccgagtacgccggcagcggccgcggcgacaagcccatggccttcgacctcgacgacaagatcctcgccgccgtcgggaaggcgcccgccggcgccatcgtgtagggaggtctcgaaatagctgaacgcgactgatcctgaagacgtgtctagacgaagcgaggtgtccaagggtccgcacatggatccatcgtacgtgtgcatcctagtactccgatttcgaaaaaagaaacaacaccgcttggtcgtgtcgtgtcgcctccagcgtccaacacctgcctgccgccgccccctacgtgtgccggcggccacctcgctctacaaagctcgccggcacgagcctcgccctcgcatcgcagcggcgagagtccaagaccacggcacgcagtaggtagagtcaggcgagcgggccggggagatcgaggcggaggggcgatggcgaggagcggcgcgggggaggagtggcgccggagcgcggacaccaagacgagcgaggcggctgtggaggcgtcgacgcggccgccgggccgcggagccggggaggtgccgcaccagcgcgcccggctgccgtacgggccgggcgccgatcggatcgtcggcgccatcggctacctcgtgctgtgccagaaggccaggcccggcacgcccgccgccgaggtggccaaggtggccgtcgggcacggggaccccgccgccggccgtgaccccgagaagcgcgcgcgcggagggtactagaacaggcgcagctctgggtgcttgctgctctgtttttctcgggtgtcaactggttgtgatcttgtacatctgtcagtcgacgtccgtgatgggttgatactacgttatgtgtgtgatcatcaggtgcgctgctgagtgtt

SEQ ID NO: 3309 - DNA, 1177 bp, Sorghum bicolor
gaaaaagtaccggacggcgccgtgccatgcagccttgttcagacatcagagcaacttgagctagagaacgaaggagcgctcaaaagatctctccccctccagaagctcgaatttcaccatccactccaattcggccaagtggcgtcttggccatctcaagataagccctcctctcctaccaccggcgcctcttcttctcttcctcttcctactccgcaatcaccaatcaggagagaagtgaagctagcattcaacaaaggaagaagcgagcgagctgacaaaatcgactgaccatccatccatggctctggcgccggcgcctctccagtgcttcctcacgggcagcagcagaccggtgtgcacggcgacgccgcccaagcacgcgaggaggccgtcgaggatctcgtgcaaggcgtccggcgacgacaaggacaaggtcccgtcgggagggaatgatcttggggtcaagctcgggaagctggccatggtcgcgctggccgccggcgtgctggcgctcggccccgtcgacggcgccttggcggccaagtccggcggcagggtcggcgggcaggccttccggtccgcgccacgatcgtccggccctcggataaacaactccaggacgaacatctacatcaacccgccggtggcgccgcctctgggcggatacggctacgggagcccgttcttcggcggctacggctacgggtggtcgccgttcagcttcttcgcgcccgggccgagcgtcgccgtcggggtcggcggcggcttcgacacgctcgtcctcttcttggtgctgggcgccgtcgtcggagctgtcaggcggtttctcaacaggaacaacgatgattacgacgactactgattatcaaagctagatgatgtagcgaatgtcatccttcaccttcatgtgtaatatatggcgagattttttttttcgtgtggaatcctaggaacagagtgtactgatgcatcaggaagtgtatgtaataattttgttcagtgaaatgtaatgagaataacatctatagttagggacagttgcaaacagccaaatactctaagcatcgatcgagccatcgactacactgtgtgtgtaacaggaacatggagttaaagttggcgtcgacaaagtttaacttccgtcacatcgaatatttggacacatatatggagt

SEQ ID NO: 3310 - DNA, 1075 bp, Sorghum bicolor
tctctccccctccagaagctcgaatttcaccatccactccaattcggccaagtggcgtcttggccatctcaagataagccctcctctcctaccaccggcgcctcttcttctcttcctcttcctactccgcaatcaccaatcaggagagaagtgaagctagcattcaacaaaggaagaagcgagcgagctgacaaaatcgactgaccatccatccatggctctggcgccggcgcctctccagtgcttcctcacgggcagcagcagaccggtgtgcacggcgacgccgcccaagcacgcgaggaggccgtcgaggatctcgtgcaaggcgtccggcgacgacaaggacaaggtcccgtcgggagggaatgatcttggggtcaagctcgggaagctggccatggtcgcgctggccgccggcgtgctggcgctcggccccgtcgacggcgccttggcggccaagtccggcggcagggtcggcgggcaggccttccggtccgcgccacgatcgtccggccctcggataaacaactccaggacgaacatctacatcaacccgccggtggcgccgcctctgggcggatacggctacgggagcccgttcttcggcggctacggctacgggtggtcgccgttcagcttcttcgcgcccgggccgagcgtcgccgtcggggtcggcggcggcttcgacacgctcgtcctcttcttggtgctgggcgccgtcgtcggagctgtcaggcggtttctcaacaggaacaacgatgattacgacgactactgattatcaaagctagatgatgtagcgaatgtcatccttcaccttcatgtgtaatatatggcgagattttttttttcgtgtggaatcctaggaacagagtgtactgatgcatcaggaagtgtatgtaataattttgttcagtgaaatgtaatgagaataacatctatagttagggacagttgcaaacagccaaatactctaagcatcgatcgagccatcgactacactgtgtgtgtaacaggaacatggagttaaagttggcgtcgacaaagtttaacttccgtcacatcgaatatttgg

SEQ ID NO: 3311 - DNA, 1153 bp, Panicum virgatum
accagacggggccgtgccatgcagccgtgttcagacatcggagcaacgtgagctagagaacaaaaccagcgctcaaaagatctctcacccctccagaagctttcaccatccactccaattcggccaagtggccgcttcgccgtctcaagataagccctcctctcctaccaccatcgcctcttcttttccctactcagcaaccgcagcaaatcaagaagcaagctggtgttcaagttcagcaaaggaagaaacgaccgatcgagtacggccatggctctggcacccacgcctctccagtgcttcctcacgggcaggccggtgtgcacggcgacgctgcccaggctcgcgaggaggccgtcgaggatctcgtgcaaggctaccggcgatgagaaggacaagctcacgtcgggaggcgatggtcttgggttgaagctcgggaagctggcgatggtcgcgctggccgccggcgtgctggcgctcgggcccgtcgacggcgccatggcggccaagtccggcggcagggtcggcgggcaggcgttccggtccgcgccacggtcgtcgggccctcggataaacaactccaggacgaacatctacatcaacccgccggtggcgccgcctctgggcgggtacggctacgggagcccgttcttcggcggctacgggtggtcgccgttcaccttcttcgcgcccggcccgagcgtcgccgtcggggtcggcggcggcttcgacacgctcgtcctcttcttggtgttgggcttcgtcgtcggagctgtcaggcggtttctcaacaggaacgatgacgattacgacgactactgatcatcgatgctagctagggtgtatgagtatgtaacgaacctcatccttgatcctcatgttgaacatggcgaacttttttcttgttaatatccaggaatggaacttgacaagtcatgtatggaggcaagaggaaactgtacttataattttgtttagtgaaatgaaatgagaatatcatctagagtgactactaattgttaaaacaaattgtatatagtgtcaaactacaaagccctggattcgaattctctttttttttaagaacgaataggcacgaattgtgcctatttcattgatataggagaaaagaggagtacaactagaatttgta

SEQ ID NO: 3312 - DNA, 1487 bp, Panicum virgatum
ttggggtatatgttgtgactggaattattacgctcccatgtaatttgccaaaaccagcagactaagcaagtagatgtgcgcttcttgttaaagtatcctctcagtctcgataaatttcagtgtaaattaaactctacagtcctcacaaacgtgtggtctgcatttgcactgagtgccaagtatgaatgttgaaagtgtggaaaatgaaaaagtctatttgaattccaaatcggttttgagatcgattcatattcacactacccggcacagtagaattcagaaatcctttggtctgaccaaaatgcaaatgaaaaaaaaaagataaaagaaccggttgcaggtgcgccaagcaacatgttcagagcaacttgagctagagaacaaaccagcgctcaaaagatctctcccccgtccagaagctttcaccatccactccaattcgtccaagtggccgctttgccatctcaagataagccctcctgtcctaccaccatcgcctcttcttcctactcagcaaccgcagcaaatcaagaagcaaactggtgttcaagttcagcaaaggaagaaacgcgcagagcgagcgagcgaactgagaagaccgatcgagtacggccatggctctggcacccacgcctctccagtgcttcctcactggtagaccggtgtgcacggcgacgctgcccaggctcgcgaggaggccgtcgaggatctcgtgcaaggcggccggcgatgagaaggacaaagtcacgtcgggaggggacgatggtcttggggtgaagctcgggaagctggcgatggtcgcgctggccgccggcgtgctggcgctcgggcccatcgacggcgccatggcggccaagtccggcggcagggtcggcgggcaggcgttccggtccgcgccacggtcgtccggccctcggataaacaactccaggacgaacatctacatcaacccgccggtggcgccgcctctgggcgggtacggctacgggagcccgttcttcggcggctacgggtggtcgccgttcaccttcttcgcgcccggcccgagcgtcgccgtcggggtcggcggcggcttcgacacgctcgtcctcttcttggtgttgggctttgtcgtcggagccgtcaggcggtttctcaacaggaacgatgacgattacgacgactactgatagatcatcgatgctggctagggtgtaggagtatgtaacgaatttcatcctcaatcctcgtgttgaatatggcgaatctttttcttgttaatttccaggaatggaacttgacaagttggcgaggcgggaggaaactgcacttaaaattttgttaaattaaagcaaaggtactaattgtatagtatcaacaacaaagtcctggatattggagtttgcagtgcaatctgacctgacctgacctgttatacccatgagccggcaccctatcaagcctagattcaccggagcccagccaaccaagatcttagatctaattta

SEQ ID NO: 3313 - DNA, 1095 bp, Setaria italica
tttcaccatccagtcatccactccaattcggccaagtggccgctttgccatctcaagataagcccctcctctcctaccaccatctcctcctcttcttcctacacagcatccgccgcggcaaatcaagaaagaatcttgctggtgtttgagttcgacaaaggaagaagcgcacagagcgagcgagcgtgctgactgctgagaagagaagagatcgagtacggccatggctctggcacccgcatctctccagtgcttcctcacgggcagaccggtgtgctcggcgacgctgcccaagctcgcgaggaggccgtcgaggatctcgtgcaaggcggccggcgatgagaaggtcccgttgggaggggatggtcttggggtgaagctcgggaagctggcgatggtcacgctggccgccggcgtgctggcgctcgggcccgtcgacggcgccatggcggccaagtccggcggcagggtcggcgggcaggcgttccggtcagcgccacggtcgtccggccctcggataaacaactccaggacgaacatctacgtcaacccgccggtggcgccgccgctgggcgggtacggctacggcggctacggcagcccgttcttcggcggctacgggtggtcgccgttcaccttcttcgcgcccggcccgagcgtcgccgtcggtgtcggcggcggcttcgacacgctcgtcctcttcttggtgctgggcgccgtcgtcggagccatcaggcggtttctcaacaggaacaatgatgattacgacgactattgattattactatactacctactagtagtaacgtaacgaatctcatgcttaatcttcatctgtagtatggcgagatccttttcttgttgatttccaggaatagaatatgctgctgcacaagggaattgtacgtatgattttgcttaatgcaatcagagtagcaaagaattgtaaccccgctccacgacgcggcgcctgtagtggtttttttattgtagaaaaataggaatccagtgccataattgttgcttgtgttgtgtctatgtcaatgagctcaaattagagcacctatacttaaaatagattgctatatcttaaaa

SEQ ID NO: 3314 - DNA, 1081 bp, Setaria italica
tccactccaattcggccaagtggccgctttgccatctcaagataagcccctcctctcctaccaccatctcctcctcttcttcctacacagcatccgccgcggcaaatcaagaaagaatcttgctggtgtttgagttcgacaaaggaagaagcgcacagagcgagcgagcgtgctgactgctgagaagagaagagatcgagtacggccatggctctggcacccgcatctctccagtgcttcctcacgggcagaccggtgtgctcggcgacgctgcccaagctcgcgaggaggccgtcgaggatctcgtgcaaggcggccggcgatgagaaggtcccgttgggaggggatggtcttggggtgaagctcgggaagctggcgatggtcacgctggccgccggcgtgctggcgctcgggcccgtcgacggcgccatggcggccaagtccggcggcagggtcggcgggcaggcgttccggtcagcgccacggtcgtccggccctcggataaacaactccaggacgaacatctacgtcaacccgccggtggcgccgccgctgggcgggtacggctacggcggctacggcagcccgttcttcggcggctacgggtggtcgccgttcaccttcttcgcgcccggcccgagcgtcgccgtcggtgtcggcggcggcttcgacacgctcgtcctcttcttggtgctgggcgccgtcgtcggagccatcaggcggtttctcaacaggaacaatgatgattacgacgactattgattattactatactacctactagtagtaacgtaacgaatctcatgcttaatcttcatctgtagtatggcgagatccttttcttgttgatttccaggaatagaatatgctgctgcacaagggaattgtacgtatgattttgcttaatgcaatcagagtagcaaagaattgtaaccccgctccacgacgcggcgcctgtagtggtttttttattgtagaaaaataggaatccagtgccataattgttgcttgtgttgtgtctatgtcaatgagctcaaattagagcacctatacttaaaatagattgctatatcttaaaaac

SEQ ID NO: 3315 - DNA, 931 bp, Pennisetum glaucum
ctcttcttcttcctactcagcaaccgccgcggcaaatcaagaaagaagctatagcgagctggtgcttgcgttcgacaaaggaagaagcccacagagcgagcgtgctgagaagagaagagaagagatcgagtacggccatggctctggcacccgcatctctccagggcttcctcacgggcaggccggtgtgcacggcgacgctgcccaagctcgcgaggaggccgtcgaggatctcgtgcaaggcggccggcgatgagaaggtcccgtcgggaggggatggtctcggggtcaagctcggcaagctggcgatggtcgcgctggccgccggcgtgctggtgctcgggcccgtcgacggcgccatggcggccaagtccggcggcagggtcggcgggcaggcgttccggtccgcgccacggtcgtccggccctcggataaacaactccaggacgaacatctacatcaacccggcgccgccgctgggcgggtacggctacggcggctacgggagcccgttcttcggcggctacgggtggtcgccattcaccttcttcgcgcccggcccgagcgtcgccgtcggggtctcgacacgctcgtcctcttcttggtgctgggcgccgtcgtcggagccgtcaggcggtttcttaagaggaacgacgatgattacgacgactactgattgtcgatgacactagtacctaggggtgtagtaggagtgtgtatcgagtctcatgcttgatcctcatgtttaatatggcgaaatcaaaattttttccttgcttgttgatgatgcccaggaatggaacttgacaagtcatggattgaagcacgaggaaattgtatgtataattttgtttagtgaaatgaaatgaggacatcatctagagtgacggacaattgtaaaaacagaatactgtatgtatgtatatatagt

SEQ ID NO: 3316 - DNA, 792 bp, Cynodon dactylon
ccggggagaaaaaaaatagtgttcaacaagggacaaagcagagcaagcaagcgaggtaagcagagtagccatggctatggcacctgcatctttccagtgcttcctctcgggcaggccggtatgcacgccgatgctgcctcggctgactaggagaccgtcgaggatctcatgcaaggcgacttccgacgagaaggacaagctcccttccggaggcaacgatcttggggtgaagctcgggaagctggctatggtcgctctggccgccggcgtgctggcgctcgggcccgtcgacggcgccatggcggcgaagtctggcggcagggtcggcgggcaggcgttcaggtcggcgccacggtcgtccggccctcggataaacaactccaggacgaacatctacatcaacccgccggtggcgcctcctctgggcggctacgggtacggcggctacggcagcccgttcttcggcggctggggctggtcaccgttcacattcttcgcccctggcccgagcgttgccgtcggggttggcggcggcttcgacacgcttgtcctcttcatggtgttgggggcggtcgtcggcgccataagggggtttctcaatcggaacaatgacgattacgatgactactgattgagtgattgtatattttctacaagttggagagtctgatgaatctccgtgtgtagcatgatgagatactatttctcttgattttcagggatagaactagacgactaaatgttcgaggaaaatgtatgtatgattttgcacttgtgaaatagaattcgatg

SEQ ID NO: 3317 - DNA, 1987 bp, Saccharum officinarum
actacgagtcggaatcccgggtccacccacgcgtccggcaccttccactccagccaagtcaggcgaggcgagggtggggcgcggcgccgcttcatcgtcatcagaatcagaagaaaaaaaaaggattcttgatttcctcctcgggggttggggccatggcggcagcggcgctggcaatggcagagcaggtggtgtccgacctccgagcgaagtgcgagacgccgccgtcgatgctgcgcgaggtggcggcggaaatggctcgcgagatgggggcgggactggaaaaggaaggcgggagcagggtcaagatgctcctctcctacgtcgataagctccccacagggggagaggagggattattctatggattggatctaggaggaacgaacttccgcgtcttgaaagtggaactgggtgggaatgagaagcatgtcgtggaccgtgactccagagaagtcggtattcctccacatttgatgtcagggaaatcctcggagctttttggtttcattgcttctgaattggccaagtttgttaatgatgaggagaagtgcactaacatttcgaatggaaagaagagagaactagggttcacattttcattcccagtgaagcagcgttctgttgcttccggtacgcttgtcaagtggacaaaggcattttccattaatgatgctgtaggtgaagatgtggtggctgaactgcaaacagctatggggaagcaaggtctggacatgcatgtagctgcattgattaatgatgctgttgggactctggctggagcaaggtactacgacaaagatgttgtcgctggtgtaatatttggcactggcacaaatgcagcatatgttgagaaggcaaatgctattccaaaatggaagggtgagctgcccaattcaggagacatggtcatcaacatggaatggggtaacttctgctcagttcatctccccatcactgaatatgatcaggaattagataaggagagcttaaatccaggagagcagatttatgagaagttaacatcaggaatgtatttgggtgaaattgtaaggagggtgctccttaaaatatcattgcagtccgcgatttttggcaatattgaccacactaagctcgaaacccctttccttctgcggactccacatatttctgcaatgcaccatgatgaaacacctgatctgaagattgtggctgaaaaactggaagaaagcctagagattacaggcgcatccttagaggctcgaaaattggtggttgaaatttgtgacattgtggcaacaagagctgcccggctggctgctgcagggcttgcagggatcctcatgaagctcggcagagattgcagtgtcaaggatcaacgatcagtcatcgccatcgatggaggattgttcgagcactacaccaaattccgccaatgcttggagaccacactgggtgagctgctaggagatgaggtgtctaaggcggtggccgtcaagcatgcagatgacggttcaggaataggtgctgccctgattgcagcttcacaatctcagtacaaaaatgacttagtggccgtcaagcatgcagatgacaagcacgcagatgacggttcaagagtcaagcatgaagatgcagatgacaagcatgaaaatgacggtaaaggagtcaagcatgcagatgacggttcagaaataggtgctgccctgattgcagcctcgcaatctcagtagagaaatgtcctcgaaatctcagaagagaaatttcgagtgatatagtagtatctgccatgggtgcttaccatagatgtaggaaagattagctagcaagtagctataatgtctttccaacatcttaacagtccggcatctgcagttaacatgctagagctggatgcaacctataaccaaaacgaggcttggcagctggatgcaatctgtaaccaaaacaaggcttgggaagtgctgttcatagttccaaacttccaataaaagcggagttgcag

SEQ ID NO: 3318 - DNA, 2337 bp, Sorghum bicolor
cagttgccaatgaaagcgtgcatgacacgttcatgttttcatggctttacctgtcatggtatacaagccatctgtctatcgcccttaacccacgtagcacctggctaacgcgcactctagcatcagcaatccaacgcgacctccataaatccacgagacccccagcggatccggcagtcccccaagatcacagtcacagcacagacgctcccagccaagccagcagccaggcgaggcgagggcgagggtggggcgcggcgcggcgcggcgccgctccatccatatcatcagaaagaaaaaggattcttgatttgctcctcgggggttggggccatggcggctgctgcgctggcaatggcagagcaggtggtggccgacctccgagcgaagtgtgaggcgccgccgccgatgctgcgcgaggtggcggcggagatggcccgcgagatgggcgcgggactggagaaggaaggcgggagcagggtcaagatgctcctctcctacgttgataagctccccacagggggagaagagggattattctatggattggacctaggagggacgaacttccgcgtcttgaaagtggaactgggtgggaatgagaagcacgtcgtggaccgtgactccagagaagtcattattcctccacatttgatgtcagggagctcctcggagctttttggtttcattgcttctgaattggccaagtttgttgttgatgatgagaagttcatcaatgttttgaatggaaagaagcgagaactagggttcacattttcattcccagtgaagcagcgttctgttgcttccggtacgcttgtcaagtggacaaaggcattttccattaatgatgctgttggtgaagatgtggtggctaaactgcaaacagctatggagaagcaaggtctggacatgcatgtagctgcattgattaatgatgctgttgggactctggctggagcaaggtactacgacaaagatgttgtcgctggtgtaatatttggcactggcacaaatgcagcatatgttgagaaggcaaatgctattccaaaatgggagggtgagctgcccaattcaggagatatggtcatcaacatggaatggggtaacttctgctcagcctatctcccaatcactgaatatgaccaagaattagataaggagagcttaaatccaggagaacagatttatgagaagttaacatcagggatgtatttgggcgaaattgtaaggagggtgctccttaaaatatcattgcagtctgcgatttttggcaatattgaccacactaagctcgaaaccccgttccttctgcggactccacatatttctgcaatgcaccatgatgaaacacctgatctgaagattgtggcaaaaaaactggaagaaaacctagagattacaggcgcatccttagaggctcgaaaattggtggttgaaatttgtgacattgtggcaacaagagctgcccggctggccgctgcagggcttgcagggatcctcatgaagctcgggagagattgcagtgtcgaggatcaacgatcagtcatcgccatcgatggaggattgttcgagcactacaccaaattccgccaatgcttggagaccacactgggcgagctgctaggagatgaggcgtctaaggcggtggccgtcaagcatgcagatgatggttcaggaataggtgctgccctgattgcagcttcacaatctctgtacaaaaatgacttagtggccgtcaagcatgcagatgacaagcatgcagatgacaagcatgaagatgcagatgacaagcatgaagatgacggtaaaggagtcaagcatgcagatgacggttcagaaataggtgctgccctgattgcagcctcgcaatctcagtagagaaatgtcctcgaaatctcagtagagaaatttcgagtgatatagtagtatcagccatgggtgcttaccatagatgtaggaaagactagctagcaagtagctataatgtctttccaacatcttaacagtccggcatctgcagttagcatgctggacctggatgtaatctataaccaaaacgaggcttggcagctggatgcaatctgtaaccaaaacgaggcttgggaagtgctgttcatagttccaaacttccaataaaagcggagttgcagatgtctcctaattcgacaatcctaaaactttctgatgtttaaccattagagcttcttctatatgcactgaaccatcgactgttaaacttctgaacaaggtaatttctatgttacttttctcatccttatcaaagctccacaaaccaacctgtgtaaaagctaatacgatgatgattatacggac

SEQ ID NO: 3319 - DNA, 2467 bp, Sorghum bicolor
caccgccgcaccggagtaccggaccatccccggccaacctctccgttcatctccatgccgaactgactcatcagtatgataagatccatgtgatcccgagcctaatccgaacatcccttctcccctttcgctgcacagctcccgagaaggaaccaaacaaagccacgcacgaacacacccggcggcaggcgccacccggtccttttcctgccttttccccgtcgagttgatccatccagtacccgaaagcttgctaaatttcacgtgcctcgccttgagtcgtccctaatccaaagatgccttgttcctcctcctaaaaaaacccaaacatcctgactttctcttggtgctagcctccttttcccttcccccttgaatcgaactgttgggagctcttcgctgtcctaccattcccccctcgctcttttttagcattttgcttgggctctcgactcctccgaaaatccagccttttgtttgcttttctgtctcctgctgattggtgtccccggatccaggattcttgatttgctcctcgggggttggggccatggcgactgctgcgctggcaatggcagagcaggtggtggccgacctccgagcgaagtgtgaggcgccgccgccgatgctgcgcgaggtggcggcggagatggcccgcgagatgggcgcgggactggagaaggaaggcgggagcagggtcaagatgctcctctcctacgttgataagctccccacagggggagaagagggattattctatggattggacctaggagggacgaacttccgcgtcttgaaagtggaactgggtgggaatgagaagcacgtcgtggaccgtgactccagagaagtcattattcctccacatttgatgtcagggagctcctcggagctttttggtttcattgcttctgaattggccaagtttgttgttgatgatgagaagttcatcaatgttttgaatggaaagaagcgagaactagggttcacattttcattcccagtgaagcagcgttctgttgcttccggtacgcttgtcaagtggacaaaggcattttccattaatgatgctgttggtgaagatgtggtggctaaactgcaaacagctatggagaagcaaggtctggacatgcatgtagctgcattgattaatgatgctgttgggactctggctggagcaaggtactacgacaaagatgttgtcgctggtgtaatatttggcactggcacaaatgcagcatatgttgagaaggcaaatgctattccaaaatgggagggtgagctgcccaattcaggagatatggtcatcaacatggaatggggtaacttctgctcagcctatctcccaatcactgaatatgaccaagaattagataaggagagcttaaatccaggagaacagatttatgagaagttaacatcagggatgtatttgggcgaaattgtaaggagggtgctccttaaaatatcattgcagtctgcgatttttggcaatattgaccacactaagctcgaaaccccgttccttctgcggactccacatatttctgcaatgcaccatgatgaaacacctgatctgaagattgtggcaaaaaaactggaagaaaacctagagattacaggcgcatccttagaggctcgaaaattggtggttgaaatttgtgacattgtggcaacaagagctgcccggctggccgctgcagggcttgcagggatcctcatgaagctcgggagagattgcagtgtcgaggatcaacgatcagtcatcgccatcgatggaggattgttcgagcactacaccaaattccgccaatgcttggagaccacactgggcgagctgctaggagatgaggcgtctaaggcggtggccgtcaagcatgcagatgatggttcaggaataggtgctgccctgattgcagcttcacaatctctgtacaaaaatgacttagtggccgtcaagcatgcagatgacaagcatgcagatgacaagcatgaagatgcagatgacaagcatgaagatgacggtaaaggagtcaagcatgcagatgacggttcagaaataggtgctgccctgattgcagcctcgcaatctcagtagagaaatgtcctcgaaatctcagtagagaaatttcgagtgatatagtagtatcagccatgggtgcttaccatagatgtaggaaagactagctagcaagtagctataatgtctttccaacatcttaacagtccggcatctgcagttagcatgctggacctggatgtaatctataaccaaaacgaggcttggcagctggatgcaatctgtaaccaaaacgaggcttgggaagtgctgttcatagttccaaacttccaataaaagcggagttgcagatgtctcctaattcgacaatcctaaaactttctgatgtttaaccattagagcttcttctatatgcactgaaccatcgactgttaaacttctgaacaa

SEQ ID NO: 3320 - DNA, 1788 bp, Panicum virgatum
ctgagcattttgcttcggttctcgagtataaaaatcccgccttttgttgccttcgtgtctcctcccggttcgagtccccggatccacgattctagattggcgagttgggagttggggtcatggaggcagccgcggcggtggcaatggcggagcaggtggcggcggacctccgagagaagtgtgagacgccaccggcgctgctgcgcgaggtggcgtcggcgatggcccacgagatgggcgcgggactggagaaggaaggcgggagcagggtcaagatgcttctctcctacgttgacaagctccccacagggagagaggaaggatcgttctatggattggacctaggaggaacaaacttccgcgtcttgagggtgcagttgggtgggaatgagaagcatgtcgttaaccgtgagtccagagaagtcagtattcctccacagttgatgtcagggagctcctcggagctttttggtttcattgcttctgaactggccaaatttgttgccgatgaggagaacagcgctaacatatcaaatggaaagaagcgagaactagggttcacattttcattcccagtgaagcaacgttcagttgcttcgggtaccctagtcaagtggacaaaggcattttccattgatgatgctgtaggtgaagatgtagtggctgaattgcaaacagctatggagaagcaaggtctggatatgcacgtagctgcattgattaatgatgctgttggaactctggctggagcaagatactatgacaaagatgttgttgctggtgtcatatttggaactggcactaatgcagcatatgttgagaaggcaaacgccattccaaaatgggaaggcgagttgcccaattcgggggatatggtcatcaacatggaatggggtaacttctgttcatcccatcttcctatcactgaatatgatcaagaattggatgaggagagcctgaatccgggagagcagatctacgagaagttaatgtcaggaatgtatttaggtgaaattgtaaggagggtgctccttaaaatatcattgcactcctcaattttcggcaatattgatcacgccaagctcaaaacccatttcctcctgcggactccacatatttctgcaatgcaccatgatgaaacacctgatctgaagattgtggctgaaatactggaagaaaatctagagataacaggcacatccttggagacgcgaaaattggttgtcgaaatctgtgacatcgtggcaagaagggcagcccggctggctgctgcagggcttgcagggatcctcaaaaagctcgggagagtttgcaacgcccaggagcaacgatcagtcattgccattgacggaggattgttcgagcactacaccagattccgcgaatgcttggagagcacactgggcgagttgctgggagaggaggcgtccaagtcagtggccgtcaagcacgcagatgacggttcaggaataggtgctgccctcatagcagcttcgcagtctcagtacagaaacgttgtgtgatatagtaatagctggcaaaagtgtttgccatacatgtagggaagattaactagctagtagctcgaatttcttccccgcaacttaacagtccagcatgtggttcacaatgctgagctggaagcaatctgtaaccgaaacgaagtttgacgaagtgactatacatagttccaataacagcagagttgcagagatctccaaatcatgcaatctcgcacttttgaacttttaatcatttcttttatgcatgagctgaaggattccggac

SEQ ID NO: 3321 - DNA, 2070 bp, Setaria italica
caacaaaacaaggccatacccacccacacaggagcacacgcggcgccgccgtccttttcctgccttttccccccgtccagcactccagttgatcaatcagtcgccaaaagcttgccaaatttcacgtgtctcgctgtcttttgatgaggatccataaatcgctgttccgaaccccaaatattccacactttcacattttcatccccaagaaaatcccgaggatcctgactttcgcttgttgcttgcctttcccctgatcgagctggtctgagctcttcgatgtcctgccatttctccccggtttcttgagcatcttccttcggttctccagtataaaaatcccgccttttgctaccttcctgccttttccctccccgttcgagttcccggatccaagattctagattggcgagttgggagttggggtcatggcggcagccgaggccgtggcaatggcggagcaggtggtggcggacctccgggagaagtgtgagacgccgccggagctgctgcgcgaggtggcgtcggcgatggcccacgagatgggcgcggggctggagaaggatggcgggagcagggtcaatatgcttctctcctacgtcgataagttaccaacagggagagaggaaggtttgttctatggattggacctaggaggaacaaatttccgtgtcttgagggtgcagttgggtgggattgagaagcatgttgttaaccgtgagtccagagaagtcagtattcctccacagttgatgtcagggagctcctcggagctttttggtttcattgcttctgaattggctaagtttgttgctgatgaggagaagtgcgctaacgtattatcaaatggaaaaaagcgagagctagggttcacattttcattcccagtgaagcaacgttcagttgcttcgggtacccttgtcaagtggacaaaggcattttccattgatgatgctgtaggtgaagatgttgtggctgaattgcaaacagctatggagaagcaaggtctcgacatgcatgtggctgcactgattaatgatgctgttggaactctagctggagcaagatactatgacagagatgttgttgctggtgtgatatttggaactggcacaaatgcagcatatgttgagaaggcaaactccattccaaaatgggaaggtgaattgcccaattcgggggatatggttatcaacatggaatggggtaacttctgttcatcccatcttcctgtcactgaatatgatcgagagttagataaggagagcttaaatccgggagagcagatctacgagaagttaatgtcaggaatgtatttaggcgaaattgtaaggagggttctccttaaaatgtcgttgcaatcctcaattttcggcaatattgatcacactaagctcaaaacccatttccttttgcggaccccacatatttctgcaatgcaccatgatgaaacgcctgatctcaagattgttgctgaaaaactggaagaaaacctagagataacaggtacatccttggagactcgaaaattggtcgtcgaaatttgtgatatcgtggcaagaagggcagcccggctggctgctgcaggtcttgcagggatcctcaagaagcttgggagagatggcaatgcccaggagcaacgatcagtcatcgccattgatggaggactgttcgagcactacaccaaattccgcgaatgcttggagatcacactgggcgagttgcttgcagagtatgcctccaagtcagtggccgtcaagcatgcagatgacggttcaggaataggtgctgccctgattgcagcttcgcaatctcagtacagaaatgttgagtgatatagcaatagctggcaaaagtatttgccacacatgtagggaagattaactagcaaagcagctggaatttctttcccacatcttaacagtccagtatgtgcagttcacaatgctggagctgaagcaatctgtaaccgaaacgaggcttgacgaagtgactttgcatagttccaataacagcggagttgcagagattttctaatcatgaaatctcataacttttgaccttttaacc

SEQ ID NO: 3322 - DNA, 2264 bp, Setaria italica
catccgcggtgagggcgagcattcccggccaacttctcctttcacccccacgccgacctgacgcagaagactccatgtgatccccaacccaatccgccgaccggctcgcccctggatggaatctattcccggagagcgctagcatgatccgcccctgcgcatgtcgctctgcaggtcccgagaaggtatagcaacaaaacaaggccatacccacccacacaggagcacacgcggcgccgccgtccttttcctgccttttccccccgtccagcactccagttgatcaatcagtcgccaaaagcttgccaaatttcacgtgtctcgctgtcttttgatgaggatccataaatcgctgttccgaaccccaaatattccacactttcacattttcatccccaagaaaatcccgaggatcctgactttcgcttgttgcttgcctttcccctgatcgagctggtctgagctcttcgatgtcctgccatttctccccggtttcttgagcatcttccttcggttctccagtataaaaatcccgccttttgctaccttcctgccttttccctccccgttcgagttcccggatccaagattctagattggcgagttgggagttggggtcatggcggcagccgaggccgtggcaatggcggagcaggtggtggcggacctccgggagaagtgtgagacgccgccggagctgctgcgcgaggtggcgtcggcgatggcccacgagatgggcgcggggctggagaaggatggcgggagcagggtcaatatgcttctctcctacgtcgataagttaccaacagggagagaggaaggtttgttctatggattggacctaggaggaacaaatttccgtgtcttgagggtgcagttgggtgggattgagaagcatgttgttaaccgtgagtccagagaagtcagtattcctccacagttgatgtcagggagctcctcggagctttttggtttcattgcttctgaattggctaagtttgttgctgatgaggagaagtgcgctaacgtattatcaaatggaaaaaagcgagagctagggttcacattttcattcccagtgaagcaacgttcagttgcttcgggtacccttgtcaagtggacaaaggcattttccattgatgatgctgtaggtgaagatgttgtggctgaattgcaaacagctatggagaagcaaggtctcgacatgcatgtggctgcactgattaatgatgctgttggaactctagctggagcaagatactatgacagagatgttgttgctggtgtgatatttggaactggcacaaatgcagcatatgttgagaaggcaaactccattccaaaatgggaaggtgaattgcccaattcgggggatatggttatcaacatggaatggggtaacttctgttcatcccatcttcctgtcactgaatatgatcgagagttagataaggagagcttaaatccgggagagcagatctacgagaagttaatgtcaggaatgtatttaggcgaaattgtaaggagggttctccttaaaatgtcgttgcaatcctcaattttcggcaatattgatcacactaagctcaaaacccatttccttttgcggaccccacatatttctgcaatgcaccatgatgaaacgcctgatctcaagattgttgctgaaaaactggaagaaaacctagagataacaggtacatccttggagactcgaaaattggtcgtcgaaatttgtgatatcgtggcaagaagggcagcccggctggctgctgcaggtcttgcagggatcctcaagaagcttgggagagatggcaatgcccaggagcaacgatcagtcatcgccattgatggaggactgttcgagcactacaccaaattccgcgaatgcttggagatcacactgggcgagttgcttgcagagtatgcctccaagtcagtggccgtcaagcatgcagatgacggttcaggaataggtgctgccctgattgcagcttcgcaatctcagtacagaaatgttgagtgatatagcaatagctggcaaaagtatttgccacacatgtagggaagattaactagcaaagcagctggaatttctttcccacatcttaacagtccagtatgtgcagttcacaatgctggagctgaagcaatctgtaaccgaaacgaggcttgacgaagtgactttgcatagttccaataacagcggagttgcagagattttctaatcatgaaatctcataacttttgaccttttaaccatt

SEQ ID NO: 3323 - DNA, 1986 bp, Panicum virgatum
gacgaaatcccaaggttccttttgcttactgttagagtagctttcccccccttgatcgagcagttctgagctcttcgatgccccaccacttcaccccgcttttctgagcattttgcttcggttctcgagtataaagatcccgccttttgttgccttcgtgtctcctcccggttcgagtcccccggatccacgattctagattggcgagttgggagttggggtcatggaggcagccgcggctgtggcaatggcggagcaggtggtggcggacctccgagagaagtgtgagacgccggcggcgctgctgcgcgaggtggcgtcgtcgatggcccacgagatgggcgcgggactggagaaggaaggcgggagcagggtcaagatgcttctctcctacgttgacaagctccccacagggagagaggaaggattgttctatggattggacctaggaggaacaaacttccgcgtcttgagggtgcagttgggtgggaatgagaagcatgtcgttaaccgtgagtccagagaagtcagtattcctccacagttgatgtcagggagctcctcggatctttttggtttcattgcttctgaactggccaagtttgttgctgatgaagagaagtgcgataacatatcaaatggaaagaagcgagaactaggattcacattttcattcccagtgaagcaacgttcagttgcttcgggtacccttgtcaagtggacaaaggcattttccattgatgatgctgtaggtgaagatgtagtggctgaattgcaaacagctatggagaagcaaggtctggatatgcatgtagctgcattgattaatgatgctgttggtactctagctggagcaagatactatgacaaagatgttgttgctggtgtcatatttggaactggcacaaatgcagcatatgttgagaaggcaaacgtcattccaaagtgggaaggcgagttgcccaattcaggggatatggtcatcaacatggaatggggtaacttctgttcatcccatcttcctgtcactgaatatgatcaagaattggatgaggagagcctgaatccgggagagcagatctacgagaagttaatgtcaggaatgtatttaggtgaaattgtaaggagggtgctccttaaaatatcattgcactcctcaattttcggcaatattgatcacactaagctcaaaacccacttcgtcttgcggactccacatatttctgcaatgcaccatgatgaaacacctgatctgaagattgtggctgaaaaactggaagaaaacctagagataacaagcacatctttggagactcgaaaattggttgtagaagtctgtgacatcgtggcaagaagggcagcccggctggctgctgcagggcttgcagggatcctcaaaaggctcgggagagattgcaacgcccaggagcaacgatcagtcattgccattgacgggggattattcgagcactacaccaaattccacgaatgcttggagagcacactgggcgagttgctgggagaggaggcgtccaagtcagtggccgtcaagcacgcagatgacggttcaggaataggtgctgccctgattgcagcttcgcagtctcagtacagaaatgttgagtgatatagtaaaagctggcaaaagtatttgccatacatcttgggaagattaactagcaagtagctcgaaattcttccccacatcttaacagtccagcatgtgcagttcacaatgctgagctggaagcaatctgtaaccgaaatgaggcttgaggaagtgactatgcatagttccaataacagtggagttgcagaggtctcctaatcataaatttagacctattaactattttttttatgcatgaaccatcgactgtaaagttgctgaacaatgtgatttcatgttttctttttctcatccttatgaaagctccacaaaaacgcccatgtaaaagctagtaataaacatggatttcagacaag

SEQ ID NO: 3324 - DNA, 2106 bp, Pennisetum glaucum
cgacgcgcttccgatctaaacaaaggccatacgcacccacactgtgacacaggatcacacacacgcggcgacaccgtccttttcctgcccagcaccactccagttgatcaatcagtcgcggccgaatttcatgtgtctcgctgtcttttgatgaggatcctatgaatcgctgctccgaacacgaatattccacactctcacagtttcaccactcaagaagacttccgcttgctgctagcttccccccctcctgagcgagctgttttgagttcttcgatgtgatgagctgccatttctccccggtttcttgagcatttcccttcggttctctagtgcaaaaaccccgcctttttgtggccttcttgccacctcccctgttccagtccccggatccaagatcctagattggcgcgagttggtcatggcgacagccgaggcggtggcaatggcggagcaggtggtggcggacctccgggagaggtgcgagacgccgccggagctgctgcgcgaggtggcgtcggagatggcccacgagatgagcgcagggctggagaaggaaggcgggagcagggtcaagatgcttctctcctacgttgataagctacccacagggagagaggaaggattgttctatggattggacctgggaggaacaaatttccgcgtcttgagggtgcagttgggaggaaatgagaagcatgtcgttaaccctcctaagtccaaagaaatcagtattcctcaaaagttgatgtcagggagctcctcggagctttttggtttcattgcttctgaattggcccagtttgttgctgatgagaagtgtgataacgtgttatcaaatggaaagaagcgagagctagggttcacattttcattcccagtgaagcaacgctcggttgcttcaggtacccttgtcaagtggacaaaggcattttccattgatgatgctgtaggtgaagatgtagtggttgaattgcaaacagctatggaaaagcaaggtcttgacatgcatgtagctgctctgattaatgatgctgttggaactctggctggagcaagatacaatgacaaagatgttgtcgctggtgtgatatttggaactggcacaaatgccgcatatgttgagaaggcaaacaccattccaaaatgggaaggtgaattgcccatttcgggggatatggtcatcaacatggaatggggtaacttctattcaacccatcttcctgttaccgaatatgatgaagagttagataaagagagcttaaatccgggagagcagatctacgagaagttaatgtcaggaatgtatttaggcgaaattgttaggagggtgctccttaaaatatcactgcaatcctcaatttttggcaatattgatcacactaagctcaaaacccatttccttttgcggactccacatatttctgcaatgcaccatgatgaaacgcctgatctcaagattgtggctgaaaaactggaagaaaacctagagataacaggcacatccttagagactcgaaaactggttgtcgaaatttgtgacatcgtcgctagaagggcaacccggcttgcagctgctgggcttttagggatcctcaggaagcttgggagggatggcaatgcccaggagcaacgatcagtcatcgccattgatggaggactgttcgagcactacaccaaattccgcgaatgcttggagatcacactgggtgagctgctgggagaggaggcatccaagtcagtagccgtcatgcactctggggacggttcaggaataggtgctgccctaattgcagcttctcaatctcagtacagaaatgttgagtgatatagtaatagccggcaaagtatttgccatacttgtagggaagattttaactagcaactagctgggatttctttcccgcatcttaacagtctagtatgtccagttcacaatgctagagctggaagcaatctgtaaccgaaacgaggcttgacgaagtgactttgcatagttccaataacagcggagttgcagagattttcaatcaattcatataatttcataacttttgaaccggttaaaaaaataaaaaaaaaaaagtaaaaaaactactagacgtt

SEQ ID NO: 3325 - DNA, 1134 bp, Trifolium pratense
ttcaattcaacatcattctctcatcaaacgccactactatccttctgaaactgctcctccatccacactttcatcctcacttttcctcaaaccaaccaccaccaacataaccctctctcactcttccacttccaattcctctatcacattctctctctcccaaacaacatcctccactccatcatcaacctctcaaaacagttcctttgaactccttcagaagcatctctcagacaaaaacttccgacaagccgatgaagagacaaggcgtcttctcatcgtcttagcaggtgaagccgctcagaagcgcggctatgtttttttctcagaggtccagttcatctcagaaacagacctccaaacaattgaccagctatggagggaccatagtaacaacaagtttggatacagtgtccaaaagaaactatttggtaaggctaaaaaagactttaccaagttcttcatcaaggttggctggatgaagaagcttgacactgaaatggagcaatataactataggtcttttcctacagaatttatatgggagctcaatgatgacaccccagagggtcatttacctttgacaaatgcactcagaggaacacagttgcttagtaatattttcaaccatccagcttttgattcagtcccagaagaagttgaagtttcatatgctgagggaaatggagcactcaaagggttaaaagattcatcaaagccattagctcagaagatcttcaaatcagactatagtttttgatgagttcaaagaagtttacaataagcctgctgaaagcatagagaatgtaacttaaattgtgttttaaatttaaagtatatacatagtcattattaattcatcatcaatagatgagggtagttgcttgaattgtatcttttttacttaataaggaaaaggataactgtgttttagaaactctttaaactgaaggttcatatgttgactgtcataatttaaaagggggttaaagtagaataatgttgtgtgaatctttgtgcacattaaattacaaagcctgtcatctttgtttataacgtccgtttctatagtgacaactgttaattcagttgcaacttgcaacggaactcaaacacaaagacaaaaattgaatg

SEQ ID NO: 3326 - DNA, 1728 bp, Cicer arietinum
ctcacttgaaatcttgaacacaatttttgctaaagaagggtatatccttccatattcattgtttctcaaaaaagaaaagaagtgtatttcatgttagaaagatattaattgtgtttagaaagagagtgaagtagggacagatggggtgtgatccaacctcaccctatttcagccaatcacaaactcttattatattactttcgatgagcccttcacattcactgtccctccctacatattcccttatctccaactcctactaaccactcaagcaactttgcacacaacaatatcaaagccttcaaatttcttcatatcatattcatccatttccttctacacacttttcaataacccttctcctttgttatcctaaactaactatacaatattgtagtatactctctgaactcaaatggcaactaattctcttcattcaattcaacaccattctctcagcaaacgccactactacccttctgagactgttccatccacactttcatcttcactctttctcaaaccaaccacaatcaacaccagcataactatctctcactcttcttccaccacattctctagtctctcacaaacaacatcctccacaccatcatcaacctctcaaatcatctcctttgaactcctccaacagcttctcaaagccaaaaactttcaacaagccgacgaagagacaaggcgccttattatcgtccttgcgggtgaagcggctcaaaagcgcggctatgttttcttctcagaggtccagttcatatcagaaacagacctgaaaacaattgaccagctttggagagagcatagtgacaacaagttcggttacagtgtccaaaagagaatatttggtaaggttaaaaaagacttcacaaaattcttcattaaggttggttggatgaagaagcttgacactgagatggaacaacataactataggtcttttcctacagagtttatatgggagctcaatgatgacacaccagagggtcatttgcctctgacaaatgcactcagaggaacacagttgctgaataatatttttacccatccggcttttgatgaagtacaagaaggcgaagtttcaattggtgaggaaaatggggcactcaaagggttaaaagattcatcaaagccattggttcagaagatcttcaagacagactatagtttctgataacttcagacaagtttacaataagcctgttgagtgcatacagaatgtaacttactttgtgttttactttttaagtatatacatagtaattattaattcatcaccaatagatgaaggtagttgcttgaattgtattttttttttttcttcacttataaattataaggatagctgcattttagaaactctttaaaccgaaggttaattaatatgttggctgtcataatttaaaaggagttagaaaacatgttgtgaatacttgtgcacataatggacaaaataacaaagcatggcatcttgtttataccgtcagtttctagtgacagctgctaattccgttgcaacttgcaacagaactgtaacacagacaaaaattgactgctgcaacttgtgcatttttctatgttgttttcttataaagagtttctcactttagttttcccgccatggcttcatttctctttttcttttccccccacaccaaaacaaaacctattaacatcattacaatttttaaataattatgaatgattatatttgct

SEQ ID NO: 3327 - DNA, 1468 bp, Trigonella foenum-graecum
tcacatggatcaccatgattctcacaatacaaccatgataccaaaataggttacatacccacatagtgacccacactaatatgaagattagttgacaatgattgattatttaggactaatattaataccagttctgaatttataacaagttagcatcgtgtttatctaaaaatctagaaatggcagccacattgcaaactccgctctatgcaactatctcttcctcctctgccgcatcatcatcatcttcaattcgcacaagatcatccttctcctccctccgttcaacatcgccaccaactcttctcttcaacttcaaaaactccttctctccaattcgctcttcctccactgacactgctatcactgaattggacgctgtttccgctttcagcgagatcgttccagataccgttattttcgatgatttccaaaagtttcctccaactgctgctactgttagttcatcgcttattttgggaatatgtggtcttccagatactatttttaggaatgctgtggaaatggctttggctgattctgaatgttatggacttgaagatcctaatgcaagattatcttgtttcgccaccaaggctttagtgaatgttggtagtgacatgaccaagcttgtccctggtcgtgtttcaacagaagtggatgcgcgtcttgcttatgacacacatggcattatcaggaaggtgcatgatctgttgaagttgtacaatgatagtaatgtccctcctgaacgtctgctttttaaaattccctcaacttggcaaggaatagaggctgcaagattgctggaatctgagggcatacagacacatttgacttttgtttacagctttgcccaagctgctgctgctgctcaagctggtgcttctgttattcaaatatttgttggccgtgtcagggactgggcgcgtaatcattctggtgacaaagagatagaatctgcccagctaaatggagaggatcccgggttggcactggtcacaaaggcttacaattatattcacaaatatggacataagtcaaagttaatggcagccgcagttcgcaataagcaggacctatttagtcttctcggggttgactacatcatagctccactgaaggtgttgcagtctctcaacgaatctgttgcttctcctgatgagaagtactcttttgttaggaggttatcaccacagtctgctggccgctacgtgtttagtgatgaagagcttgttaaatgggaccaaatgagccttacaaatgccatggggccagcagcggtacaacttctgacttctgggctggatggttatgctgatcaagcaaagcgtgtggaagatttattcgggaaaatttggccaccaccaaatgtataatttgacctctttatgttgctcgatagatgtttagcctgatgtaataaacagaacatacaagtacaacagatgaagggaatctgtttgttttt

SEQ ID NO: 3328 - DNA, 1926 bp, Cicer arietinum
agttaactaattgtgaagattagttgatagtaagttgacaattttgtttgaaaagaattatgagtatatattagtaatacataaatggtagttaagagctggttacatttaagtctaagaatccagaaatggcattaaccttgcaaactccgctttatgcagctgtttcttccattcccacaagaacatccttctcccttcgttcaacaccgccaccaactcttctcatcaactaccggaactccttcccccgaattcacgcttcctccaatatcgacactgcaatcactgaattggatgctgtatccgccttcagcgagatcgttccagataccgttattttcgatgatttccaaaagtttcctccaactgctgctactgtcagttcatcgcttcttttgggtatatgtggtcttccagatactatttttaggaatgctgtggaaatggctttggctgatgctgaatgttatggacttgaagatcctaatacaagattatcttgtttcgcaaccaaggctttagtgaatgttggtagtgacatggcaaagcttgtccctggtcgtgtttcaacagaagtggatgcccgtctggcttatgacacacatggcattatcaggaaggtgcatgacctgttgaagttgtaccatgatagtaatgtccctcctcaacgtcttctatttaaaattccttcaacttggcaaggaatagaggctgcaagattgctggaatctgagggcatacagacacatttgacttttgtttacagctttgcccaagctgctgctgctgctcaagctggtgcttcagttattcaaatttttgttggtcgtgtcagggactgggcacgtaatcattctgatgaccaagagatagaatctgccaagctaaatggagaggatcctggattggcattggccgcaaaggcttacaactatattcacaaatatggacataagtcaaagttgatggcagccgcagtccgcaacaagcaggacctatttagtcttctgggggttgactacatcatagctccattgaaggtgttgcagtctctcaaagaatctgttgcttctcctgatgagaagtactcttttgttaggaggctatcacctcagtctgctcggagctacatgtttagtgatgaagagctaattaaatgggaccaaatgagccttgcaaatgctatggggccagcagcggtgcagcttctgactgctgggctagatggttatgtcgatcaagcaaagcgggtggaagatttatttgggaaaatttggccaccaccaaatgtataatttgacttctttatgttgctctatagatgttaagcctgatggaataaacagatcatacatcagatgaagggaatcttccgtttgtattttcatttctcccttgagctcctgaacatttccgatttacttctaaagcacccggttccttaaaagcatcacttattatctttacatacatcattttgttgcagttgttgttgtcttggccttattttcgggaagattatagtttgtctttcggtacaccttcgttttaatgccaggtagaaatgcatagtagtataagacctaaattaggactcgacatcgttcctaaaaatcttaccgaacttgcacaataatgatagaaaaaatgaaacaccaagtgttattacgggatgtaagcgctgggaagatgattggcgcagctgcagagattcatgtccatgcgagataggatagggttgtccacaaaggccatgttatcgtggccaaggtgatcatggctttggaacacatgcatacctgtggcgaaggacagaggagcaagccatcttttctatctcatatattgtctgtcatatttaatacttttctctagtctatcgtactttcttatttcctctcttgtgttgcccatggctgagga

SEQ ID NO: 3329 - DNA, 1490 bp, Cajanus cajan
aatgtgataatagtaagttagtgagtggattttggatctggcctattattccatcactgctagttactaatccagaagttgtactcgagttggagtgtgactgagtttggtgtcttaatctctaaccgaaaatgtcactcaccttgcaaactccgccccctgcagctctctcgtctgctgcatcgtcttcttcctccattcaccgaacaacgagatccaccttctccttctccctccgctccacaccttctctaactctccactcccttcctcaaactcgcgcttcagcttcctccatcaataccgcgtcgactaccgaactcgatgctgtgtccgccttcagcgagatcgttccggacaccgtcattttcgatgatttcgaaaagtttcctccaactgctgctactgtcagttcatcgcttctcttgggaatttgtggccttccggacaccatatttaggaatgctgtggagatggctctggctgattccgagtgttatggacttgaaaatcctaacgcgcgattgtcttgttttgtcaacaaggccttcgcgaatgttggtagtgacttggcaaagcttgtgcctggccgtgtttcgacggaagtggatgcacggcttgcttatgacacgcatgccattatcaggaaggtgcatgacctattaaagttgtacaatgatagtaatgtacctcctcatcgtctgctgtttaaaattccttcaacttggcaaggaatagaggctgctaggttgctggaatctgaaggcatacagacacatttgacctttgtctacagctttgctcaagctgccgcagcagctcaagctggtgcttctgttattcaaatttttgttggtcgcataagggattgggctcgcaatcattctggtgatacagagatagaatctgcccaactaagaggagaggatccagggttggcattggtgacaaaagcttacaattatattcacaaatatggacataagtcaaagttgatggcagcagcagttcgcaacaaacaggatctatttagtcttctggggattgactatatcatagctcctttaaaggtattgcagtctctcaaagaatctgttgcttctcctgatgagaagtactcttttgataggaggttatcccctcagtctgctgtcaagcacgtgtttagtgatgaagagcttgttaaatgggaccaagatagcctcgcaaacgccatggggcctgctgctgtgcagcttctggctgctggtctggatggtcatgctgatcaagcaaagcgggtggaagatttgtttgggaaaatttggcccccaccaaatgtatgatttcacttctctatgtcgcacgatagtcttttttcccaatagaataaacataatacacaacaaatgacgggaaccttcctttatgtttctttccctttaaccatgaactctcaaacagtttccttaatgtaagctggcagttcctaaaagcacattttgttgtta

SEQ ID NO: 3330 - DNA, 1518 bp, Phaseolus vulgaris
gagtcttaacctctaatctcaaaatgtcactcactttgcaaactccgtcctctacaacgctctctcctgcaacatccattcactcaacaacaacaagatccactttctccttctcgcctcgttccacgctttccccaaaaaccctccatttcaattaccacaggtccctccctcgaactcgcgcttctgcttcctctatcaatatcgcttccaccactgaactcgatgctgtgtccgccttcagcgagatcgtccccgacaccgtcgttttcgatgatttcgaaaaatttcctccaactgctgctactgtcagttcatcacttctcttggggatatgtggccttccagacaccatttttaggaatgctgtggagatggctttggctgattctgagtgttatggaattcaaaatcctaatgcgcgattgtcttgttttgtcagcaaggcttttgcgaatgtgggtagcgacttggcaaagcttgtccctggccgtgtttcaacagaagtggatgcgcggcttgcttatgatacacacgccattatcaggaaggtgcatgacttgttaaagttgtacaatattagcaatgtacctccgcaacgtctgttgtttaaaattccttcaacttggcaaggaatagaagctgcaaggttgctggaatctgaaggcatacaaacacatttgacctttgtctacagttttgctcaagccgctgctgcagctcaagctggtgcgtctgttattcaaatttttgttggtcgtacaagggattgggcacgtaatcattctggtgacaaagaaatagaatctgccctgctaagaggagaggatccagggttggcattggtgacgaaagcttacaattatattcacaaatatgggcataagtcaaagttgatggcagcagcagttcgcaacaagcaggatctatttagtcttctgggggttgactatatcatcgctcctttaaagatattgcagactctcaaagaatctgttgcttctcctgatgagaagtactcttttgttaggaggttatcccctcagtctgctgcacagtacaaatttagtgatgaagagcttgttaaatgggaccaacatagcttggcaaatgccatggggcctgcagctgtgcagcttttggctgctggactggatggtaatgctgatcaagcaaagcgggttgaagatttatttgggaaaatttggccaccaccaaatgtatgatttcacttttttatgtcgcacgacagtattttgcctgaaggaataatcgtgaagcgaacagatgaagggaatattccgttgtttttctttccctctgacctttgaagtcttgaacacgcggttcctaaatgcactttttttttcagttttgcagttgcatttcatagtatgatttttagagagatattattatactgtgtgtatctttggtgtacacttaaatttccggaacttttattccgttttaatagtaaataaaaccggatactcctacaaagtaaggcgcaagaaa

SEQ ID NO: 3331 - DNA, 1662 bp, Phaseolus vulgaris
cagagagagaaaaaatagaaatctgacatcactgtgtccaaaattagagaggtgaatgtggttttggatttggatctggtctattactgtgagttattaattcagaagtggtaacggagcttagagtcttaacctctaatctcaaaatgtcactcactttgcaaactccgtcctctacaacgctctctcctgcaacatccattcactcaacaacaacaagatccactttctccttctcgcctcgttccacgctttccccaaaaaccctccatttcaattaccacaggtccctccctcgaactcgcgcttctgcttcctctatcaatatcgcttccaccactgaactcgatgctgtgtccgccttcagcgagatcgtccccgacaccgtcgttttcgatgatttcgaaaaatttcctccaactgctgctactgtcagttcatcacttctcttggggatatgtggccttccagacaccatttttaggaatgctgtggagatggctttggctgattctgagtgttatggaattcaaaatcctaatgcgcgattgtcttgttttgtcagcaaggcttttgcgaatgtgggtagcgacttggcaaagcttgtccctggccgtgtttcaacagaagtggatgcgcggcttgcttatgatacacacgccattatcaggaaggtgcatgacttgttaaagttgtacaatattagcaatgtacctccgcaacgtctgttgtttaaaattccttcaacttggcaaggaatagaagctgcaaggttgctggaatctgaaggcatacaaacacatttgacctttgtctacagttttgctcaagccgctgctgcagctcaagctggtgcgtctgttattcaaatttttgttggtcgtacaagggattgggcacgtaatcattctggtgacaaagaaatagaatctgccctgctaagaggagaggatccagggttggcattggtgacgaaagcttacaattatattcacaaatatgggcataagtcaaagttgatggcagcagcagttcgcaacaagcaggatctatttagtcttctgggggttgactatatcatcgctcctttaaagatattgcagactctcaaagaatctgttgcttctcctgatgagaagtactcttttgttaggaggttatcccctcagtctgctgcacagtacaaatttagtgatgaagagcttgttaaatgggaccaacatagcttggcaaatgccatggggcctgcagctgtgcagcttttggctgctggactggatggtaatgctgatcaagcaaagcgggttgaagatttatttgggaaaatttggccaccaccaaatgtatgatttcacttttttatgtcgcacgacagtattttgcctgaaggaataatcgtgaagcgaacagatgaagggaatattccgttgtttttctttccctctgacctttgaagtcttgaacacgcggttcctaaatgcactttttttttcagttttgcagttgcatttcatagtatgatttttagagagatattattatactgtgtgtatctttggtgtacacttaaatttccggaacttttattccgttttaatagtaaataaaaccggatactcctacaaagtaaggcgcaagaaacgtccctctaagtgtgcccaa

SEQ ID NO: 3332 - DNA, 1470 bp, Lotus japonicus
gttattgtttattttaaggaactggtcctgttcggctgaatttgtaacagagctcacaagagtttgtcactgagttagcagaaatgcctgtcaccttgcaatctccgccttcagcagcagcgttctcttccgccgctgcatcatcttccattcaccggaggatccattccactccgccgccgactctacccttcaaatcccaaaggtccttccctctcattcgcgcttcctcttcctccatcaacaccgcttcgatcactgaattggatgctgtatctgccttcagcgagatcgttccagacactgtcatcttcgatgatttccaaaagtttcctccaactgctgccactgtcagttcatcgcttctcttgggtatatgtggacttccagataccgttttcaggaatgctgtggatatggctttggctgactctgaatgtaatgggctgcaaaatcctgaggcaagactgtcttgttttgtcaacaaggccttagtgaatgtcggtactgacttggcgaagcttgtccctggccgtgtttcaacagaagtggatgctcgtcttgcgtatgacacacatgacataattagaaaggtgcatgacctgttgaagttgtacaatgataataatgttcctcctcaacgtctgttgtttaaaatcccctcaacatggcaaggaatagaggctgcaagattgctggaatccgaaggaatacagacacatttgacttttgtttacagctttgctcaagctgctgctgcggctcaagctggtgcttctgttatacaaatttttgttggccgcatcagggactgggcacgtaatcattcggatgacaaagagatagaatcttccaagctaagaggagaagatcccgggttgacattggttacaaaagcttacaattatattcacaagtatggacataagtcaaagttgatggcagcagcagttcgcaacaagcaggatctatttagtcttctgggggttgactatatcatagctccgttgaaggtgttgcagtctctcaacgaatctgttgcttttcctgatgagaagtactcttttgttaggaggctatcccctgagtctgcttcccgctacttgtttagtgatgaagagcttattaaatgggaccaaactagccttacagaagccatggggccagcagctgtgcagcttctggctgctggactggatggttatgctgatcaagcaactcgggtggaagagtactttcggaaaatttggccaccaccaaatgtataatttgacttctttatgtcgctcgagtagaacttttgcctgatggaataacagaatgtacaacaaatgaaagggaatcatccttcctttgttttttttattttcccctttaaccttgaactcttgaacatttccttccatgtaaagcacacggttccttaaatctaaatcccatcaacttgaggaagaatgggaaaaatatcat

SEQ ID NO: 3333 - DNA, 1617 bp, Glycine max
gattagatgtggcctagtactgttatttaattcaaaagatactataatataagagagtgtgactgagtttggcgtcttaatctctctataaaaatgtcaatcaccttgcgaactccgccttctacaactctctcttctgctgcatcttccattcacagaacaagatccaccaccttctccttctcgctttgttccccaccaactcttcgcttcaattcccacagctccctctctcttactcgcgcttccgcttcctctatcactaccgcttcgaccactgagctggacgctgtgtcctccttcagcgagatcgttcccgacaccgtcgttttcgatgatttcgaaaagtttcctccaactgctgctactgtcagttcctcgctcctcttgggaatatgtggccttccagacaccatttttaggaatgccgtggaaatggctttagctgattctgagtgttatggacttgaaaatcctaacgcgcgattgtcttgttttgtcaacaaggcttttgcaaatgtcggtagtgacatggcaaagcttgtccctggccgtgtttcgacggaagtggatgcgcggtttgcttatgacacacctgccattatcaggaaggtacatgacctgttgaagttgtacaatgatagcaatgtacctccgaaacgtctgttgtttaaaattccttcaacttggcaaggaatagaggctgcaaggttgctggaatctgaaggcatacagacacatttgacctttgtctacagttttgctcaagctgctgctgcagctcaagctggtgcttctgtcattcaaatttttgttggtcgcataagggattgggcacgtaatcattctggtgacacagagatagaatctgcccagctaagaggagaggatccagggctggcattggtgacaaaagcttacaattatattcacaaatatggacataagtcaaagttgatggcagcagcagttcgcaacaaacaggatctatttagtcttctgggggttgactatatcatagctcctttaaaggtattgcagtctctcaaagaatctattgcttctcctgatgagaagtactcttttgttaggaggttatctgctcagtctgctgccaagtacacatttagtgatgaagagcttgttaaatgggacgaagatagcctcacaaaagccatggggcctgcagctgtgcagcttctggctgctggactggatggccatgctgatcaagcaaagcgggtggaagagttatttgagaaaatttggccaccacctaatgtatgattcgacttctttatgtcgcacgagagtcttttgcctgatggatcaataaacataacacacaacagatgaagggaatattccattgtttttctttccctcttaaccttgaattcttgaacaatttagcacgcggttcctaaatgcacattttgttctttttcttttctttcttttgttgcaattgcatttgtctacttcttatactgtgactctcgtctatctttggtgtaccatactatcattcactaaaattcccggagcttatattttgttttaatttaaattaaaacccgaatactgcataattcggaatgtaaaatcacatttcac

SEQ ID NO: 3334 - DNA, 1462 bp, Glycine max
ggcgtcttaatctctctataaaaatgtcaatcaccttgcgaactccgccttctacaactctctcttctgctgcatcttccattcacagaacaagatccaccaccttctccttctcgctttgttccccaccaactcttcgcttcaattcccacagctccctctctcttactcgcgcttccgcttcctctatcactaccgcttcgaccactgagctggacgctgtgtcctccttcagcgagatcgttcccgacaccgtcgttttcgatgatttcgaaaagtttcctccaactgctgctactgtcagttcctcgctcctcttgggaatatgtggccttccagacaccatttttaggaatgccgtggaaatggctttagctgattctgagtgttatggacttgaaaatcctaacgcgcgattgtcttgttttgtcaacaaggcttttgcaaatgtcggtagtgacatggcaaagcttgtccctggccgtgtttcgacggaagtggatgcgcggtttgcttatgacacacctgccattatcaggaaggtacatgacctgttgaagttgtacaatgatagcaatgtacctccgaaacgtctgttgtttaaaattccttcaacttggcaaggaatagaggctgcaaggttgctggaatctgaaggcatacagacacatttgacctttgtctacagttttgctcaagctgctgctgcagctcaagctggtgcttctgtcattcaaatttttgttggtcgcataagggattgggcacgtaatcattctggtgacacagagatagaatctgcccagctaagaggagaggatccagggctggcattggtgacaaaagcttacaattatattcacaaatatggacataagtcaaagttgatggcagcagcagttcgcaacaaacaggatctatttagtcttctgggggttgactatatcatagctcctttaaaggtattgcagtctctcaaagaatctattgcttctcctgatgagaagtactcttttgttaggaggttatctgctcagtctgctgccaagtacacatttagtgatgaagagcttgttaaatgggacgaagatagcctcacaaaagccatggggcctgcagctgtgcagcttctggctgctggactggatggccatgctgatcaagcaaagcgggtggaagagttatttgagaaaatttggccaccacctaatgtatgattcgacttctttatgtcgcacgagagtcttttgcctgatggatcaataaacataacacacaacagatgaagggaatattccattgtttttctttccctcttaaccttgaattcttgaacaatttagcacgcggttcctaaatgcacattttgttctttttcttttctttcttttgttgcaattgcatttgtctacttcttatactgtgactctcgtctatctttggtgtaccatactatcattca

SEQ ID NO: 3335 - DNA, 1874 bp, Glycine max
cagaagatgtaaccgagtgacagtgtgattgagtttggctgtcataatctctctctcatccgaaaatgtcactcaccttgcaaactccgccttctacaactctctcttctgcatctcccattcacagaacaataacaagatacaccacattctccttctcgcttcgtcctccaacaactcttcacttcaatccccacaggtccctccctctaattcgcgcttccaattcttctatcaatgccgcttcgaccactgaactggacgctgtgtccgccttcagcgagatcgttcccgacaccgtcgttttcgatgatttcgaaaagtttcctccaactgctgctactgttagttcatcgcttctcttgggaatatgtggccttccagacaccatttttaggaatgctgtggaaatggctttagctgattctgagtgttatggacttgaaaatcctaacgcgcgattgtcttgttttgtcaacaaggctttcgcgaatatcggtagtgacatggcaaagcttgtccctggccgtgtttcgacagaagtggatgcgcggcttgcttatgacacacatgccattatcaggaaggtgcatgacctgttgaagttgtacaatgatagcaatgtacctccgcaacgtctgttgtttaaaattccttccacttggcaaggaatagaggctgcaaggttgctggaatccgaaggcatacagacacatttgacctttgtctacagttttgctcaagctgcagctgcagctcaagctggtgcttctgtcattcaaatttttgttggtcgcataagggattgggcacgtaatcattctggtgacacagagatagaatctgctcagctaagaggagaggatccagggttggcattggtgacaaaagcttacaattatattcacaaatatggacataagtcaaagttgatggcagcagcagttcgcaacaaacaggacctatttagtcttctgggggttgactatatcatagctcctttaaaggtattgcagtctctcaaagaatctgttgcttctcctgatgagaagtactcttttgttaggaggttatcccctcagtctgctgccaagtacacatttagtgatgaagagcttgttagatgggacgaagatagcctctcaaaggccatggggcctgcagctgtgcagcttctggctgctggactggatggccatgctgatcaagcaaagcgggtggaagagttatttgggaaaatttggccaccaccaaatgtatgattcgacgacttctttatgtcgcacgagagtcttttgcctgatggatcaataaacataatacacgactgatgaagggaatatttcgttggttttctttccctcttaaccatgaagtcttgaacaatttccttaatgtgaagcacgcggttcctaaatgcacattttgttatttttctctttcgtttgttgcagttgcatttgtcttattgactgtctatctatggttattctctaagtaaggtcggatactcgtacaaactaaggccgtaggtagggtcggtcaaaacccggcctttccagtgttacctattgaccaggcctggacagcagttaattgggtcacacttgggctggctttgtcgaagcacataaaatgattggcaattgcttcctgcacctccattttgcttcctgtgcctaatctctggaaatgtaaaatcaaacataaaaataattctaggtagtaaaataaaaagggagaagtttaggtaggaaaatcaaaatagacattattacatgtatgaaaaatatatttcaattttttttttttatcatgggtattgaccaattatgctaagcactttcaatttcgttatttgtaattcatttggg

SEQ ID NO: 3336 - DNA, 1799 bp, Glycine max
aaccgagtgacagtgtgattgagtttggctgtcataatctctctctcatccgaaaatgtcactcaccttgcaaactccgccttctacaactctctcttctgcatctcccattcacagaacaataacaagatacaccacattctccttctcgcttcgtcctccaacaactcttcacttcaatccccacaggtccctccctctaattcgcgcttccaattcttctatcaatgccgcttcgaccactgaactggacgctgtgtccgccttcagcgagatcgttcccgacaccgtcgttttcgatgatttcgaaaagtttcctccaactgctgctactgttagttcatcgcttctcttgggaatatgtggccttccagacaccatttttaggaatgctgtggaaatggctttagctgattctgagtgttatggacttgaaaatcctaacgcgcgattgtcttgttttgtcaacaaggctttcgcgaatatcggtagtgacatggcaaagcttgtccctggccgtgtttcgacagaagtggatgcgcggcttgcttatgacacacatgccattatcaggaaggtgcatgacctgttgaagttgtacaatgatagcaatgtacctccgcaacgtctgttgtttaaaattccttccacttggcaaggaatagaggctgcaaggttgctggaatccgaaggcatacagacacatttgacctttgtctacagttttgctcaagctgcagctgcagctcaagctggtgcttctgtcattcaaatttttgttggtcgcataagggattgggcacgtaatcattctggtgacacagagatagaatctgctcagctaagaggagaggatccagggttggcattggtgacaaaagcttacaattatattcacaaatatggacataagtcaaagttgatggcagcagcagttcgcaacaaacaggacctatttagtcttctgggggttgactatatcatagctcctttaaaggtattgcagtctctcaaagaatctgttgcttctcctgatgagaagtactcttttgttaggaggttatcccctcagtctgctgccaagtacacatttagtgatgaagagcttgttagatgggacgaagatagcctctcaaaggccatggggcctgcagctgtgcagcttctggctgctggactggatggccatgctgatcaagcaaagcgggtggaagagttatttgggaaaatttggccaccaccaaatgtatgattcgacgacttctttatgtcgcacgagagtcttttgcctgatggatcaataaacataatacacgactgatgaagggaatatttcgttggttttctttccctcttaaccatgaagtcttgaacaatttccttaatgtgaagcacgcggttcctaaatgcacattttgttatttttctctttcgtttgttgcagttgcatttgtcttattgactgtctatctatggttattctctaagtaaggtcggatactcgtacaaactaaggccgtaggtagggtcggtcaaaacccggcctttccagtgttacctattgaccaggcctggacagcagttaattgggtcacacttgggctggctttgtcgaagcacataaaatgattggcaattgcttcctgcacctccattttgcttcctgtgcctaatctctggaaatgtaaaatcaaacataaaaataattctaggtagtaaaataaaaagggagaagtttaggtaggaaaatcaaaatagacattattacatgtatgaaaaatatatttcaattttttttt

SEQ ID NO: 3337 - DNA, 1726 bp, Lupinus angustifolius
cactctctcattaatctcaatctggagtcttcgagttgttagcttctgtatctctaaaattacagaaatgtcattcaccttgaaaattacgccttctgtttcaacccctctctcctcttcatccattcacacaacaaaatctactttttctctccattccacactgctttttaactcccaaatccatcacaattctctccaccatgttcagattcgtgcttcctccaccgatactgcttccaccactgaattagaagctgtctcagccttcagccagatcgttccagacactgtcatttttgatgatttccaaaagtttcctccaacagctgctactgttagttcatcgcttctattgggtatatgtggcctcccagataccatctttaggaatgctgtggaaatggctttggctgattctgagtgttatggacttgaaaattctgacacaagattgtcttgtttcttcaacaaggctttagtaaatgtgggtggtgacatgacaaaactagtgcctggtcgtgtttcaaccgaagtggatgcacgccttgcttacgatacacatgccattatcaggaaggtgcatgacctgttgagattatacaatgatattaatgtgcctcctcaacgtctattgtttaaaattccttcaacttggcaaggaatagaggctgcaagattgctggaatctgagggcatacagacacatttgacttttgtttacagctttgctcaagctgctgctgcagctgaagctggtgcatctgttatacaaatttttgttggccgcatcagggactgggcacgcaatcattcggatgacccagagatagaatcggcccagctaagaggagaggatcctgggttggcattggtgatgaaagcatacaattatattcacaaatatggatataagtcaaagttgatggcagcagcagttcgcaacaaacaagacctatttagtcttctgggggttgactatatcatagctccactgaaggtattgcagtctctcaaagaatctgttgcttctcccgatgagaaatactcgtttgttaggaggctatctcctcagtctgctgcgaaatacgtgtttagtgatgaagagcttgttaaatggaaccaaactagccttacagaagcaatggggccagcagctgttcagcttctagcttctggactggatggttatgctagtcaagcaaatcgagtggaagagttatttgggaaaatttggccacccccaaatgtatgattttatttctttaagggtctatttacgagttgagttttagagagaaaaaagagaaatagaatgcttagaagccataaaatcatctgaggtgattctgaagtttttcctctaaaatccaactcacaaattgaccgtacctttctcactgatctcttgccagatggaataaacaatgttttagttttcctctaatgttgaagccatgaacaatctcgttccatgtaaatcagtgttacttaaaagcatatctggtttctctttctccctccatctctctggctaaggaactcagaaattatatattggttagagacaatatacagcggatataagctatcaactgattttgcttaaaaggttatggttagttgataatgtggatgatattagatgaactgttacatcaaagtgattgttgaaccaaagttatagtaaattaaataatgtggatgttatgagataattgcgtca

SEQ ID NO: 3338 - DNA, 1504 bp, Sorghum bicolor
atttttttgactaaacaagtccggttttcttcgctcgcgactgcgccatacgtccaggttcagtgcaccgcgacgccttccgctctccgcgggaggcgacgaggagcgcggcgtggatcttgcgttgcgtagctgccgaccgcgcgcatcttgccgctttgcaaccgggagagagccgtaccacacttgggctacttgacactccgttctgcaaaaaaaaaaacaaatggccgcgttatcccagaaagaatattagaaaatctcagcacggtccttggaagaatcgaattttcagtattctccttgggcctagatgcacaaatcccagccgaagccaccgtattagtagtactaacagttcttcctgagatttcgagttcgaggggaggaggtccgagtttatttcccgatacgaaaggagagcacgaatcaaggaccgagtttcaagttccaacatggaaaccgagttccaggatggtaagcaggaggttattgaagcatggtacatggacgatagtgaagaagaccagaggcttcctcatcaccgtgatcccaaagaattcattcctcttgataagctttcagaactgggaatcatcagctggcgcctgaatcctgacaactgggagaatgatgagaacctcaagaaaatccgtgaagccagagggtactcttacatggacatttgtgatgtatgcccagagaagctgccaaattatgagattaagataaagaatttctttgaagagcacctgcatactgatgaagaaatacgctattgccttgaagggagtggatactttgatgtgagggacgaaaatgaccagtggatccgtgtagcagtgaagaaaggaggcatgattgttcttcctgcagggatgtatcaccgcttcacattggacaatgagaactatatcaaggcaatgcgtctctttgttggcgagcctgtttggacgccgtacaaccgtccccatgatcatctgccagcgagaaaggagtatctggacaagctcctcaagccagaaggccaagctgttgaagctcgttgagacaatttgaaagctacctgttggcctctttccaccctgcgtcctgtgtcgtataacctgaataagatgttgtatgtccctaatctagtactagtgtcctggccaatttgaagtgaacactgtaactactgtctatcaggatcaggtgaggtcatctggcttaaatacctgcaatatatatactgtaaacatatatctaataaatagaaacgggtgcatctttctatgaagtattgaagtggatgaaggtgcgttttaccaaaacagtttgtaactttattctaataaagcttcctcttggaaatgcttgtgcacactaatttccctcgagttctgtattgattgctgatattttttttctcaattcctatgaaattcatgtcttctcttgttatctccaacaacttggtatttcaacatgctatcctaccaaatttgctaaaagcataaaaatc

SEQ ID NO: 3339 - DNA, 1241 bp, Saccharum officinarum
cagattccccgtcacatcgaatctttggacacatgcatgaaacattaaatattgattaaaaataaaactaattacacagtttagacgaaatggatgagacgaatcttttaagcctaattagaccatgattggacaatatttaccaaataacaccgaaaacgctacagtgcccattttgcaaaaaaatttgcatctaaaccgggccctagttgcgcttgcacaaccacaaacccgtattaacagtccttgctgctgtttcgagttggaggggaagttccaagtttctttccgacgatacgaaaggagagcacgaatcaaggaaaccgagttccaagttctaacatggagaccgagttccaggatggtaagcaggaggttattgaagcatggtacatggatgatagtcaagaagaccagaggcttcctcatcatcgtgatcccaaagaattcattcctcttgagaagctttcagaactgggaatcatcagttggcgcctgaatcctgacaactgggagaatgatgagaacctcaagaaaatccgtgaagccagagggtactcttacatggacatttgtgatgtatgcccagagaagctgccaaattatgagactaagataaagaatttctttgaagagcacctgcatactgatgaagaaatacgctattgcctcgaagggagtggatactttgatgtgagggatgaaaatgaccagtggatccgtgtagcagtgaagaaaggaggcatgattgttcttcctgcagggatgtatcaccgcttcacattggacaatgacaactacatcaaggcaatgcgtctctttgttggtgagcctgtttggacaccatacaaccgtccccatgaccatctgccagcgagaaaggagtatctggacaagctcctcaagccagaaggccaagctgtcgaagctcgttgagaccatttgaaagctatctgttgggctcttccaccctgtgccctgtgctgtataaccagaataagacgttgtatgtccctaatctagtactagcgtcctggccaatttgaagtgaacactgtaactactgtctatcagtgtcaggtcgtctggcttgaatacctgcattatatatactgccacatatatctaataaatagaaacgggtgcatctttctatgaagtattgaagtgggtgaaggtgcgtgttgccaaaacagtttgtaactttgttctaaagcttcctcttggaaatgcttgtgcgc

SEQ ID NO: 3340 - DNA, 970 bp, Triticum aestivum
ttcccgatacgaaaggagagcacgaatcaaggaccgagtttcaagttccaacatggaaaccgagttccaggatggtaagcaggaggttattgaagcatggtacatggacgatagtgaagaagaccagaggcttcctcatcaccgtgatcccaaagaattcattcctcttgataagctttcagaactgggaatcatcagctggcgcctgaatcctgacaactgggagaatgatgagaacctcaagaaaatccgtgaagccagagggtactcttacatggacatttgtgatgtatgcccagagaagctgccaaattatgagattaagataaagaatttctttgaagagcacctgcatactgatgaagaaatacgctattgccttgaagggagtggatactttgatgtgagggacgaaaatgaccagtggatccgtgtagcagtgaagaaaggaggcatgattgttcttcctgcagggatgtatcaccgcttcacattggacaatgagaactatatcaaggcaatgcgtctctttgttggcgagcctgtttggacgccgtacaaccgtccccatgatcatctgccagcgagaaaggagtatctggacaagctcctcaagccagaaggccaagctgttgaagctcgttgagacaatttgaaagctacctgttggcctctttccaccctgcgtcctgtgtcgtataacctgaataagatgttgtatgtccctaatctagtactagtgtcctggccaatttgaagtgaacactgtaactactgtctatcaggatcaggtgaggtcatctggcttaaatacctgcaatatatatactgtaaacatatatctaataaatagaaacgggtgcatctttctatgaagtattgaagtggatgaaggtgcgttttaccaaaacagtttgtaactttattctaataaagcttcctcttggaaatgcttgtgcacactaaaaaa

SEQ ID NO: 3341 - DNA, 868 bp, Pennisetum glaucum
gaatatagattctaccgaggggaaccaaaagcaagagcgcgcgcgcatcaaggaattctatctatccagcatggagaccgagttccaggatggaaagcaagaggttattgaagcatggtacatggatgacagtcaagaggaccagaggcttcctcatcaccgtgagcccaaagaattcattcctctggacaagctttcagaactaggaatcatcagctggcgcctaaaccctgataactgggagaaagatgagaacctcaagaaaatccgtgaagcaagaggctactcctacatggacatttgtgatgtatgcccagagaagctgccaaattatgaggttaagataaagaatttctttgaagagcacctgcatactgatgaagaaatacgctattgccttgaagggagtggatactttgatgtgagggatgaaaatgataagtggatccgtgtagcagtgaagaaaggaggcatgattgttttgcctgcagggatgtatcatcgcttcacattggacactgacaactacatcaaggcgatgagactcttcgttggcgagcctgtttggacgccgtacaaccgtccccatgatcatctgccagcaaggcaggagtatttggacaagcttgtcaaggcagaaggtgtgaatcaagctgttgaagctcgctgaggccattccggacctatagtacttgttaggttgctccattgtgtcctatgtacaccttgaataagatgttgtgtttccctacttatgtggtgcgttctggtcagtttgaagtggacatgtcattctgtcaacataaagtgtgtattatcggttcggctggcctgtacccctacattatatatttatatcacatactgt

SEQ ID NO: 3342 - DNA, 1304 bp, Panicum virgatum
tctcttctcccgttccggttccgtccgtcgcttcgcttccattccagttccacggtggcggcgtgagttgaaacggaacgctctgctgccgtcagacgtctaccccaagggcccaagccaccgtacaaaaaatctcgctgcgcttctactcgaggaagtagattcgacgaggaaacccaaagcgggagcgcgcgcgcatcaaggagttcttctatctacccagcatggagaccgagttccaggatggcaagcaggaggttattgaagcatggtacatggatgacagtcaagaagaccagagacttcctcatcaccgtgaacccaaagaattcattcctctggagaagctttcagaactaggaatcgtcagctggcgcctaaaccctgataactgggagaatgatgagaacctcaagaaaattcgtgaagccagaggttactcttacatggacatttgtgatgtatgcccggagaagctgccaaattatgagactaagattaagaatttctttgaagagcacctgcatactgatgaagaaatacgctattgccttgaagggagtggatactttgatgtgagggatgaaaatgatcagtggatccgtgtagcagtgaagaagggaggcatgattgttctgcctgcagggatgtatcaccgcttcacattggacactgacaactacatcaaggcaatgcggctcttcgttggtgatcctgtttggacgccgtacaaccgtccccatgatcatctgccagagggaaggagtatctggacaagcttgtcaaggcagaaggtggagatcaagctattgaagctcgctgaggccactttgaacctacctgttgggctgttccgatgcgtactatgtacaatctgaataagatgttgcatgtccttacttatgtagtgtgttctggtcagttttaagtgaatctgtgaacatggttcctgtcaactgtgtgtatcggttcagctggcctgacccctacattatattgctgtccatatcttgaataaatagaaacgggtgccgctatagatgaaggtgcgtgatgctggaagatcaaaagcttcctctgggaaatgccttctgtttggattgtgtaaacttttcctcgtccctgttaacttctgaaattcctgtgttctgatttcgctgaacctgtataatgtgagagttggtttaggtctcgttcgtttccgctggattgggccgtttcggggctcattctaggtggattggtctggcccggttcgaagttaggtgcgaattgggattgggcggttccggggctcattctag

SEQ ID NO: 3343 - DNA, 1188 bp, Setaria italica
gttgggaatctatcttgcaagcccaaaccattgctaattcgtgtagccattaagtccaaggccatgaattgaattttcagtgttccacagggatctacatacacaaatccatcccaagcccatcgataaaaaaatctcgatgcgctttccttgcaggaatagattcgagtactccgtatcaaggaaccgaaaacaagagcgcgcccgcatcaaggagggagttctatccgtccagcatggagaccgagttccaggatggcaagcaggaggttattgaagcatggtacatggatgacagtcaagaggaccagaggcttcctcatcaccgtgaacccaaagaattcattcctctggagaagctttcagaactaggaatcatcagctggcgcctaaaccctgataactgggagaaagatgagaacctcaagaaaatccgtgaagcaagaggctactcttacatggacatttgtgatgtatgcccagagaagctgccaaattatgaggctaagataaagaatttctttgaagagcacctgcatactgatgaagagatacgctattgccttgaagggagtggatactttgatgtgagggatgaaaatgataagtggattcgcgtagcagtgaagaaaggaggcatgattgttcttcctgcagggatgtatcaccgcttcacattggacacagacaactacatcaaggcaatgcggctctttgttggtgagcctgtttggacaccgtacaaccgtccccatgatcatctgccagcgaggcaggagtatctggacaagcttgtcaaggcagaaggtgtgaatcaagctgttgaagctcgctgaggccattctgaacctacctgttaggctgttccagtgtgttctatgtacaccttgaataagatgttgtgtgtccctacttatgtagtgcgttctggtcagtttgaagtgaacatgtgaaacatgatttctctcaactgtgtgtatcggttcagctggcctatacccctacattatattactgtccatatatcttgaataaatagaaacgggtgcttcaatagatgaaggtgcgccatgttgaaagatgatcaaaagcttcccctgggaaatgtgttgtgtttggattgtggaaatttttcttggtccctattaacttctgaaattctagcggttctgaattttctgaacctgt

SEQ ID NO: 3344 - DNA, 1182 bp, Setaria italica
aatctatcttgcaagcccaaaccattgctaattcgtgtagccattaagtccaaggccatgaattgaattttcagtgttccacagggatctacatacacaaatccatcccaagcccatcgataaaaaaatctcgatgcgctttccttgcaggaatagattcgagtactccgtatcaaggaaccgaaaacaagagcgcgcccgcatcaaggagggagttctatccgtccagcatggagaccgagttccaggatggcaagcaggaggttattgaagcatggtacatggatgacagtcaagaggaccagaggcttcctcatcaccgtgaacccaaagaattcattcctctggagaagctttcagaactaggaatcatcagctggcgcctaaaccctgataactgggagaaagatgagaacctcaagaaaatccgtgaagcaagaggctactcttacatggacatttgtgatgtatgcccagagaagctgccaaattatgaggctaagataaagaatttctttgaagagcacctgcatactgatgaagagatacgctattgccttgaagggagtggatactttgatgtgagggatgaaaatgataagtggattcgcgtagcagtgaagaaaggaggcatgattgttcttcctgcagggatgtatcaccgcttcacattggacacagacaactacatcaaggcaatgcggctctttgttggtgagcctgtttggacaccgtacaaccgtccccatgatcatctgccagcgaggcaggagtatctggacaagcttgtcaaggcagaaggtgtgaatcaagctgttgaagctcgctgaggccattctgaacctacctgttaggctgttccagtgtgttctatgtacaccttgaataagatgttgtgtgtccctacttatgtagtgcgttctggtcagtttgaagtgaacatgtgaaacatgatttctctcaactgtgtgtatcggttcagctggcctatacccctacattatattactgtccatatatcttgaataaatagaaacgggtgcttcaatagatgaaggtgcgccatgttgaaagatgatcaaaagcttcccctgggaaatgtgttgtgtttggattgtggaaatttttcttggtccctattaacttctgaaattctagcggttctgaattttctgaacctgt

SEQ ID NO: 3345 - DNA, 1036 bp, Pennisetum glaucum
ggagaaggcaaggaagcaagcgaaaccgcacacaaaaacttccgatatggaggaccagttccaggatggcaaggaggaggtcatccaagcttggtacatggatgacagcgaagaggaccagaggcttccacatcatcgtgagcctaaagagttcattcctcttgacaaactttctgagctaggaatattaagctggcgcctaaatcctgatgactgggagaatgatgaaaaccttaagaaaattcgtgaagccaggggttactcttacgtggacatttgtgatgtgtgtccagagaagttgccaaactatgaggctaagataaagaatttctttgaagaacacttgcatactgatgaagagatacgttactgtcttgagggtagcggctacttcgacgtgagggaccaaaatgatcagtggatccgcatagcagtgaagaaagggggcatgattgttctgcctgcaggaatgtatcaccgctttacattggacacggacaactacatcaaggcaatgcgcctctttgttggtgagcctgtttggacgccatacaatcgcccccatgaccatctcccggctaggaaggagtatgtcgatagaatcatcaaccgaggtggaaaccaagctgttgaagctcgttgaatgttgtctgccgactctgcctgttgagctacaccatacaagtattgccgaataagatctgctaccgcaaactgctcataccaccatcatgctcatgtgccagtcaatagtttgcacaaaacctgtttcaaatctcccgtagatattttgtaatgtggtatgattgtatgaatgatgtggtctttggtgaatgatgaaggtcgaaaccccctgcccgtctcaaatctgtgcaaattgcgcgcaatgattggcttgccgttgccgaaagggttgcttgaaaattcctcataccaactctcaccctaactggcgtggttcaactgctgtccaacattacttctgtaatgatgtagtcatagtacagttctgttactgattgacgaaaagttcgct

SEQ ID NO: 3346 - DNA, 1344 bp, Sorghum bicolor
cccagttccgctgctccaattccactcggcatggctccgcaggcgtgggtcgtggcggagaacggcgaggacctccaacgacccagggaattcgtgcctctttctgagctcgaagatgttggcgtgttgtattggcatttggaccctaagaaatctgaaagcgaggaggagctagcgaaaatccgcaaagacagaggatacagttacatggatcttattgagatatgtcccgacaaactggaaaactatgaggagaaggtgaagaacttcttccgtgagcacatgcatcctgacgaggagatccgctattgcttggagggcagtgggtactttgatgtccgtgacaaagatgacaagtggattcggatctggataaaggaaggagacatgatcatcctaccagctggaatttatcatcgattcacccttgacagtgccaaatacacgaagctcatgaggcttttcattggggtacctgtttggacagcatttaaccggcctcaggaggaccatccggcgaggcaggagtatgtcaagaatgatggtaagcaggaggttattgaagcatggtacatggacgatagtgaagaagaccagaggcttcctcatcaccgtgatcccaaagaattcattcctcttgataagctttcagaactgggaatcatcagctggcgcctgaatcctgacaactgggagaatgatgagaacctcaagaaaatccgtgaagccagagggtactcttacatggacatttgtgatgtatgcccagagaagctgccaaattatgagattaagataaagaatttctttgaagagcacctgcatactgatgaagaaatacgctattgccttgaagggagtggatactttgatgtgagggacgaaaatgaccagtggatccgtgtagcagtgaagaaaggaggcatgattgttcttcctgcagggatgtatcaccgcttcacattggacaatgagaactatatcaaggcaatgcgtctctttgttggcgagcctgtttggacgccgtacaaccgtccccatgatcatctgccagcgagaaaggagtatctggacaagctcctcaagccagaaggccaagctgttgaagctcgttgagacaatttgaaagctacctgttggcctctttccaccctgcgtcctgtgtcgtataacctgaataagatgttgtatgtccctaatctagtactagtgtcctggccaatttgaagtgaacactgtaactactgtctatcaggatcaggtgaggtcatctggcttaaatacctgcaatatatatactgtaaacatatatctaataaatagaaacgggtgcatctttctatg

SEQ ID NO: 3347 - DNA, 1581 bp, Sorghum bicolor
gacaaagaagcggaacaatctggtttcgcagaccgcaggaagccaggaacccactccacgccaggggtagccatccatcctccattcgttgatttatatacgcgcacagggcagcgcatcccaatccaaaagccaagcgagcgagttcccagttccgctgctccaattccactcggcatggctccgcaggcgtgggtcgtggcggagaacggcgaggacctccaacgacccagggaattcgtgcctctttctgagctcgaagatgttggcgtgttgtattggcatttggaccctaagaaatctgaaagcgaggaggagctagcgaaaatccgcaaagacagaggatacagttacatggatcttattgagatatgtcccgacaaactggaaaactatgaggagaaggtgaagaacttcttccgtgagcacatgcatcctgacgaggagatccgctattgcttggagggcagtgggtactttgatgtccgtgacaaagatgacaagtggattcggatctggataaaggaaggagacatgatcatcctaccagctggaatttatcatcgattcacccttgacagtgccaaatacacgaagctcatgaggcttttcattggggtacctgtttggacagcatttaaccggcctcaggaggaccatccggcgaggcaggagtatgtcaagaatgatggtaagcaggaggttattgaagcatggtacatggacgatagtgaagaagaccagaggcttcctcatcaccgtgatcccaaagaattcattcctcttgataagctttcagaactgggaatcatcagctggcgcctgaatcctgacaactgggagaatgatgagaacctcaagaaaatccgtgaagccagagggtactcttacatggacatttgtgatgtatgcccagagaagctgccaaattatgagattaagataaagaatttctttgaagagcacctgcatactgatgaagaaatacgctattgccttgaagggagtggatactttgatgtgagggacgaaaatgaccagtggatccgtgtagcagtgaagaaaggaggcatgattgttcttcctgcagggatgtatcaccgcttcacattggacaatgagaactatatcaaggcaatgcgtctctttgttggcgagcctgtttggacgccgtacaaccgtccccatgatcatctgccagcgagaaaggagtatctggacaagctcctcaagccagaaggccaagctgttgaagctcgttgagacaatttgaaagctacctgttggcctctttccaccctgcgtcctgtgtcgtataacctgaataagatgttgtatgtccctaatctagtactagtgtcctggccaatttgaagtgaacactgtaactactgtctatcaggatcaggtgaggtcatctggcttaaatacctgcaatatatatactgtaaacatatatctaataaatagaaacgggtgcatctttctatgaagtattgaagtggatgaaggtgcgttttaccaaaacagtttgtaactttattctaataaagcttcctcttggaaatgcttgtgcacact

SEQ ID NO: 3348 - DNA, 1457 bp, Panicum virgatum
tttcaataggatggcaagcaggaggttattgaagcatggtacatggatgacagtcaagaagaccagagacttcctcatcaccgtgaacctaaagaattcattcctctggagaagctttcagaactaggaatcgtcagctggcgcctaaaccctgataactgggagaatgatgagaacctcaagaaaatccgtgaagccagaggctactcttacatggacatttgtgatgtatgcccagagaagctgccaaattatgagactaagattaagaatttctttgaagagcacctgcatactgatgaagaaatacgctattgccttgaagggagtggatactttgatgtgagggatgaaaatgatcagtggatccgtgtagcagtgaagaaaggaggcatgattgttctgcctgcagggatgtatcaccgcttcacattggacactgacaactacatcaaggcaatgcggctcttcgttggtgatcctgtttggacgccgtacaaccgtccccatgatcatctgccagagaggaaggagtatctggacaagcttgtccaggcagaaggtggaaatcaggctattgaagctcgctgaggccacttggaacctacctgttgagctgttccgatgcatattatgtacaatctgaataagatgttgtacgcccttacttatgtagtgtgttctgtcagttttaagtgaatctgtgaacatggttcctatcaactgtgtgtatcggttcagctgacctaacccctacattatattactgtccatatcttgaataaatagaaacgggtgccgctatagatgaaggtgcgtgatgccggaagatgatcaaaagcttcatctgagaaatgccttctgtgtaaacatttcctgttcctttttttttgcgaggattcctggtccctgttaacatctgaaattcctgtgttcagatttcgctgaacatgtgtaatgtgagagttggtttacggaatacacctatgtaggcaacgtggtcaacccactctcaatttttgccgaacaaatcggtgggtttggattgttacagtttccaggcaatccagtgccagtggccttggagtggaggtgaagtgcatcctgcttcctaattagagacctcctgcagccaccgacttgtccttttttttgttgggtgttttggacttgcccgaacaaagatatgttattacagagtacaaactctccctcaaagcagtactgtagctttgttcaagcagataccaatagctttggtcaatgacaggcttgagtactaactacacgtaatatatactataattttttttttgaaaaacacccagagcattggggaatcatataaaaactcaattgggtacctacgctaaccgcgcgctcaacgcaaatggactgccaggaagtccgaagacacacctaccgaagcttaaacacgcccacaccacacacctata

SEQ ID NO: 3349 - DNA, 1039 bp, Cenchrus ciliaris
cgagaaagacgaaggcaaagagcaagcgattccgcacacaaacttctgatatggaggaccagtttcaggatggcaaggaggaagtcatccaagcttggtacatggatgacagcgcagaggaccagaggcttccgcatcaccgggagcctaaagagttcattcctcttgacaaactttctgagctaggaatattaagctggcgtctaaatgctgatgactgggagaatgatgaaaaccttaagaaaattcgtgaagccaggggttactcttacgtggacatttgtgatgtgtgtccagagaagttgccaaactatgaggataaaataaagaatttctttgaggaacatttgcatactgatgaagagatacgctactgtcttgagggtagtggctacttcgacgtgagggaccaaaatgatcagtggatccgcatagcagtgaagaaaggaggcatgattgttctgcctgcaggaatgtatcaccgctttacattggatacggacaattacatcaaggcaatgcgtctctttgttggagaacctgtttggacaccatacaatcgcccccatgaccatctccctgctaggaaggagtatgtcgatagaatcatcaaccgaggtggaaaccaagctgtcgaagctcgttgaatgcgtacaagcatctctgcatatttgccgtcgagcctccctgttgtactgcaccctacaagtattgccgaataagatcttctgccgcaatctactcataccaccatcatgctcgtgtgccagtcagtagtttgcacaaaacctgcttcaaatctttcgtagatattttgtaatatggtgggaatgatgtggtctttgatgaatgatgaagattcaaaccctctgctcgtctcaaatctatgaaaagcttgcacgccatgattggcttgccgatgcttgaaaacatcctcttaccaactctcaccatgattgactggcgcgtggttcaactttttttgtacgaccggatcttggtaatgatgttctattactgattaacgaaaagttcgctc

SEQ ID NO: 3350 - DNA, 1043 bp, Cenchrus ciliaris
  misc_feature (873)..(873): n is a, c, g, or t
  misc_feature (921)..(921): n is a, c, g, or t
attcgagaaagacgaaggcaaagagcaagcgattccgcacacaaacttctgatatggaggaccagtttcaggatggcaaggaggaagtcatccaagcttggtacatggatgacagcgcagaggaccagaggcttccgcatcaccgggagcctaaagagttcattcctcttgacaaactttctgagctaggaatattaagctggcgtctaaatgctgatgactgggagaatgatgaaaaccttaagaaaattcgtgaagccaggggttactcttacgtggacatttgtgatgtgtgtccagagaagttgccaaactatgaggataaaataaagaatttctttgaggaacatttgcatactgatgaagagatacgctactgtcttgagggtagtggctacttcgacgtgagggaccaaaatgatcagtggatccgcatagcagtgaagaaaggaggcatgattgttctgcctgcaggaatgtatcaccgctttacattggatacggacaattacatcaaggcaatgcgtctctttgttggagaacctgtttggacaccatacaatcgcccccatgaccatctccctgctaggaaggagtatgtcgatagaatcatcaaccgaggtggaaaccaagctgtcgaagctcgttgaatgcgtacaagcatctctgcatatttgccgtcgagcctccctgttgtactgcaccctacaagtattgccgaataagatcttctgccgcaatctactcataccaccatcatgctcgtgtgccagtcagtagtttgcacaaaacctgcttcaaatctttcgtagatattttgtaatatggtgggaatgatgtggtctttgatgaatgatgaagattcaaaccctntgctcgtctcaaatctatgaaaagcttgcacgccatgattggcttgcngatgcttgaaaacatcctcttaccaactctcaccatgattgactggcgcgtggttcaactttttttgtacgaccggatcttggtaatgatgttctattactgattaacgaaaagttcgctca

SEQ ID NO: 3351 - DNA, 892 bp, Cynodon dactylon
cgagaagctgcaacagaaacaaggagcgcgcatcgacaagcaaattccatcatggagactgagttccaggatggcaaggcagaggttattgaagcgtggtacatggatgatagccaagacgatcagagacttcctcatcaccgtgaacctaaagaattcattcctcttgagaagctttcagaactaggaattgtcagctggcgcttaaaccctgataactgggagaatgatgagaacctcaagaaaatccgtgaagccagaaactactcttacatggacatttgtgatgtatgccctgagaagctgccaaattatgagaccaagataaagaatttcttcgaagaacacctgcatactgacgaagaaatacgctattgtcttgaggggagtggatactttgatgtgagggaccagaatgaccagtggatccgtgtagcagtgaagaaaggaggcatgattgttcttccttctgggatgtatcatcgcttcacattggacagtaacaattacatcaaggcgatgcggctctttgttggtgagcctgtttggacaccgtacaaccgtccccatgatcatctgccagagagaaaggagtatctggacaaacttctcaagacggagagcggaaaccaacctgtcgaagctagttgaagacatctatccggacgttgcaatgtgtcctgtgcgcaacctaaataaaaggggcaaattaaagtgtaatttgttcgtgtcgcagacgggtctttgtctgtaccgtcacatgtgagatgcgattctatcttatcttacagtaaaaaaatagaaatcagagctggtagggatgcaatgtggttgatgccaacaattgataccgttgtgtatctgtatcgcctaaatccacaattcagacacc

SEQ ID NO: 3352 - DNA, 1026 bp, Setaria italica
caggctttcgggaggattcgagaaagacgaaggcaggcaaagagcaagcgataccgcacacaaactgccgatatggaggaccagttccaggatggcaaggaggaggtcatccaagcttggtacatggatgagagtgaagaggaccagaggcttccacatcatcgtgagcccaaagagttcatccctcttgacaaactctcagagctaggaatattaagctggcgtctaaatgctgatgactgggagaatgatgaaaacctcaagcaaattcgtgaagccaggggttactcttacgtggacatttgtgatgtgtgtccagagaagttgccaaactatgaggctaagataaagaatttctttgaagaacacttgcatactgatgaagagatacgctattgtcttgagggtagcggctactttgacgtgagggaccaaaatgatcagtggatccgcatagcagtgaagaaaggaggcatgattgttctgcctgcaggaatgtatcaccgctttacattggatacggacaactacatcaaggcaatgcgtctctttgttggagagcctgtttggacgccatacaatcgcccccatgaccatctcccggctaggaaggagtatgtcgatagaatcatcaaccgaggtggaaaccaagctgttgaagctcgttgaatgtgcactagcatatcggcatgtttgctatcgagtctgcttgttgtgctacaccttacaagtgttgccgaataagatgtgctaccgcaatctgctcataccacaatcatgctcgtgtgccattcagtagtttgcacaaaacctgcttcaaatctttcgtagatattttgtaaaatggtatgaatgatgtggtctttgatgaatgatgaagattcaaaccctctgctcgtctcaaatctgtgaaaagcttgcgcgcaataattggcttgccgaaagggatgcttgaaagttcctcataccaactctcagcctgattgactggcgtggttcaattgctttgctgtccaacattttttt

SEQ ID NO: 3353 - DNA, 1006 bp, Setaria italica
agttcataagaaacgcaggccccttgtttcagattccaggctttcggggaggattcgagaaagacgaaggcaggcaaagagcaagcgataccgcacacaaactgccgatatggaggaccagttccaggatggcaaggaggaggtcatccaagcttggtacatggatgagagtgaagaggaccagaggcttccacatcatcgtgagcccaaagagttcatccctcttgacaaactctcagagctaggaatattaagctggcgtctaaatgctgatgactgggagaatgatgaaaacctcaagcaaattcgtgaagccaggggttactcttacgtggacatttgtgatgtgtgtccagagaagttgccaaactatgaggctaagataaagaatttctttgaagaacacttgcatactgatgaagagatacgctattgtcttgagggtagcggctactttgacgtgagggaccaaaatgatcagtggatccgcatagcagtgaagaaaggaggcatgattgttctgcctgcaggaatgtatcaccgctttacattggatacggacaactacatcaaggcaatgcgtctctttgttggagagcctgtttggacgccatacaatcgcccccatgaccatctcccggctaggaaggagtatgtcgatagaatcatcaaccgaggtggaaaccaagctgttgaagctcgttgaatgtgcactagcatatcggcatgtttgctatcgagtctgcttgttgtgctacaccttacaagtgttgccgaataagatgtgctaccgcaatctgctcataccacaatcatgctcgtgtgccattcagtagtttgcacaaaacctgcttcaaatctttcgtagatattttgtaaaatggtatgaatgatgtggtctttgatgaatgatgaagattcaaaccctctgctcgtctcaaatctgtgaaaagcttgcgcgcaataattggcttgccgaaagggatgcttgaaagttcctcatacc

SEQ ID NO: 3354 - DNA, 853 bp, Brachypodium distachyon
ccctgtgttttgcttgcagtggcgtttccgcgagggtttccgagaacagagggggaagatatcaccgcacgaggctgctgatatggagaccgagttccaggatggcaaggaggaggtcatccaaggatggtacatggatgacagtgaagaggaccagaggctccctcatcatcgtgagcccaaagagttcattcctcttgacaagctttcagagttaggagtaataagctggcgcctaaatgctgatgactgggagaaagatgagaacctcaagaaaatccgcgaggccaggggatactcttatgtggacatatgcgacgtgtgtccagagaagttaccaaactacgaggccaagctgaagaatttctttgaagaacacttgcatactgacgaagagatacgttattgtcttgagggcagtggatacttcgatgtgagggaccaaaacgaacagtggattcgtatagcagtgaagaaagggggcatgattgttttgcctgcgggaatgtatcaccgctttacgctggacagtgacaactacatcaaggcaatgcggctcttcgtgggtgagcctgtctggacgccgtacaaccgcccccatgaccatctcccagctagaaaggagtacgtggacaaaattatcaacagaggtgggaatcaaactgtcgaagctcgttgacggcatctgtaatgctaggctgagtgtttcttctgtatgtattactccccccaaataccaaataagacgtgtgattggctgtcataatgtaatcctaccatcctgtatcagtacacagtggtagtctgaacaaaaatcggtttaatagtctttcctgaaaacttagcaagcccg

SEQ ID NO: 3355 - DNA, 1024 bp, Festuca arundinacea
tcaggctttcgcgagggttcggtccagagcgaggaggaagacagagagcagcgcgcgcgagaccgcaagaggctgcggacatggagaacgagttccaggatggcaaggaagaggtcatcgaagcatggtacatggatgacagtgaagaagaccagaggcttcctcatcaccgtgagcccaaagagttcattcctctcaacaaactttcagagttgggtgtagtaagctggcgcctgaatgccgatgactgggagaaagatgagaatctcaagaaaatccgtgaggccaggggatattcttatgtggacatttgtgatgtgtgtcccgagaagttgccaaactatgaggccaagataaagaatttcttcgaagagcatttacatactgatgaagagatacgctattgtcttgagggcagtggttactttgatgtgagggatgaaaacgaacagtggatccgtgtagcagtgaagaaggggggcatgattgttttgcctgcaggaatgtatcaccgctttacattggatagtgacaactatatcaaggcaatgcggctctttgtgggggagcctgtgtggacaccgtacaatcgcccccatgaccatctcccagctagaaaggagtatgtcgacaaaatcatcaacagaggtgggaatcaaactgtggaagctcgttgatgggacctataatgctaggctgagtgagtttcctgtatgtataacacctacatgaaataccgaataagatgtgccaacggccggcgcattgtactcctaccaccatcctgtatcagtaagcagtagtttgcacaagacctgcttaaaatcatccctggaaacttgtttgtagtataataataagatccccatagtccagtgtcagcaatggtgtaatgtttctgcattatacttatatggatataatggattgaaaacccgttttgatctctgaaaaatgtttctgcataatgtttactggaatgatggttgtatacaaaaaaaaaaaaaaaaaaaaaaaaaaaaaa

SEQ ID NO: 3356 - DNA, 1070 bp, Lolium multiflorum
ctaatacgactcactatagggctcgacggccgcccgggcaggtacgcggggacctctccttgtttccgtccagcttcatcaggctttcgctcgcgagggttcggtccagagcgaggaggaagacagagcagcagcgcgcgcgagaccgcgagaggccgcggacatggagaacgagttccaggatggcaaggaagaggtcatcgaagcatggtacatggatgacagtgaagaagaccagaggcttcctcatcaccgtgagcccaaagagttcattcctctcaacaaactttcagagttgggtgtagtaagctggcgcctgaatgctgatgactgggagaaagatgagaatctcaagaaaatccgtgaggccaggggatattcttatgtggacatttgtgatgtgtgtcccgagaagttgccaaactatgaggtcaagataaagaatttcttcgaagagcacttacatactgatgaagagatacgctattgtcttgagggcagtggttactttgatgtgagggatgaaaacgaacagtggatccgtgtagcagtgaagaaggggggcatgattgttttgcctgcaggaatgtatcaccgctttacattggatagtgacaactacatcaaggcaatgcggctctttgtgggagagcctgtgtggacaccatacaatcgcccccatgaccatctcccagctagaaaggagtatgtcgacaaaatcatcaacagaggtgggaaccaaactgtggaagctcgttgattggacctgtaatgttaggctgagtgagtttcctgtatgtataacacctccataaataccgaataagatgtgaggacggctgtcacagtgtacttctaccaccatcctgtatcagtaagcagtagtttgcgcaagacctgcttaaaatcatccctggaaacttcacatgccaatgtttgtagtagtacaataataagatccccacagtccagtgtcagcaatggtgtaatgttgatcattttacctatatggatacaatggattgatatcccgttttgatctctgaaaatgtttctgcatgatgtttact

SEQ ID NO: 3357 - DNA, 1127 bp, Brachypodium distachyon
aacccaaagcagtcgtcaaggggggtttgcaggaatatcagaaccccaaccggcctccctgtgttttgcttgcagtggcgtttccgcgagggtttccgagaacagagggggaagatatcaccgcacgaggctgctgatatggagaccgagttccaggatggcaaggaggaggtcatccaaggatggtacatggatgacagtgaagaggaccagaggctccctcatcatcgtgagcccaaagagttcattcctcttgacaagctttcagagttaggagtaataagctggcgcctaaatgctgatgactgggagaaagatgagaacctcaagaaaatccgcgaggccaggggatactcttatgtggacatatgcgacgtgtgtccagagaagttaccaaactacgaggccaagctgaagaatttctttgaagaacacttgcatactgacgaagagatacgttattgtcttgagggcagtggatacttcgatgtgagggaccaaaacgaacagtggattcgtatagcagtgaagaaagggggcatgattgttttgcctgcgggaatgtatcaccgctttacgctggacagtgacaactacatcaaggcaatgcggctcttcgtgggtgagcctgtctggacgccgtacaaccgcccccatgaccatctcccagctagaaaggagtacgtggacaaaattatcaacagaggtgggaatcaaactgtcgaagctcgttgacggcatctgtaatgctaggctgagtgtttcttctgtatgtattactccccccaaataccaaataagacgtgtgattggctgtcataatgtaatcctaccatcctgtatcagtacacagtggtagtctgaacaaaaatcggtttaatagtctttcctgaaaacttagcaagcccgtgtttagttaataaggacacaccccacatttcagtgtcagcaagggtgtttgtttatggcgatcaaatgtacttgtggtgtctgatggctatggtggtccgaaatcccatcttatatctgaataatgtttggatacctgtgttcatttcctcctacctaatctcgtgccattgcatttcgtggttcacctgttgacctttgtaccattaatgcagtgc

SEQ ID NO: 3358 - DNA, 911 bp, Festuca arundinacea
  misc_feature (464)..(464): n is a, c, g, or t
  misc_feature (617)..(617): n is a, c, g, or t
  misc_feature (647)..(647): n is a, c, g, or t
  misc_feature (659)..(659): n is a, c, g, or t
  misc_feature (690)..(690): n is a, c, g, or t
  misc_feature (692)..(692): n is a, c, g, or t
  misc_feature (694)..(694): n is a, c, g, or t
  misc_feature (723)..(723): n is a, c, g, or t
  misc_feature (737)..(738): n is a, c, g, or t
  misc_feature (743)..(743): n is a, c, g, or t
  misc_feature (751)..(751): n is a, c, g, or t
ggcacgaggagagagcagcgcgcgcgagaccgcaagaggctgcggacatggagaacgagttccaggatggcaaggaagaggtcatcgaagcatggtacatggatgacagtgaagaagaccagaggcttcctcatcaccgtgagcccaaagagttcattcctctcaacaaactttcagagttgggtgtagtaagctggcgcctgaatgccgatgactgggagaaagatgagaatctcaagaaaatccgtgaggccaggggatattcttatgtggacatttgtgatgtgtgtcccgagaagttgccaaactatgaggccaagataaagaatttcttcgaagagcatttacatactgatgaagagatacgctattgtcttgagggcagtggttactttgatgtgagggatgaaaacgaacagtggatccgtgtagcagtgaagaaggggggcatgattgttttgccngcaggaatgtatcaccgctttacattggatagtgacaactatatcaaggcaatgcggctctttgtgggggagcctgtgtggacaccgtacaatcgcccccatgaccatctcccagctagaaaggagtatgtcgacaaaatcatcaacagaggngggaatcaaactgtggaagctcgttgatgngacctataatgntaggctgagtgagtttcctgtatgtataacncntncatgaaataccgaataagatgtgccaacngccggcgcattgtnntcctnccaccatnctgtatcagtcagcagtagtttgcacaaaacctgcttaaaatcatccccggaaacttcacatgccaatgtttgtagcataataataatgtccctgcagtcgagtgttagcagtggtgtaatgttgatcattttacttatggatattatggtatgaatccc

SEQ ID NO: 3359 - DNA, 929 bp, Secale cereale
agagcagggcgcgggagactgcaagcggccgccgccatggagaacgagttccaggatggcaaggaggaggtcatccaagcatggtacatggatgacagtgaggaggatcagaggcttcctcaccaccgtgagcccaaagagttcattcctcttgccaaactttcagaattaggtgttgtaagctggaacctaaatgctgataactgggagaaagacgagaatctcaagaaaatccgtgaggccaggggatactcttatgtggacatctgcgacgtatgtccggagaagttgccaaactacgaggccaagctgaagaatttctttgaagagcatttgcatactgatgaagagatacgctattgtcttgagggcagtggatactttgatgtgagggaccaaaacgaacagtggatccgtatagcagttaagaaaggtggcatgattgttttgcctgcaggaatgtatcaccgctttacactcgatagtgacaactacatcaaggcaatgcggctctttgtgggagagcctatctggacgccatacaaccgtccccactgaccatctcccagctagaaaggagtacgtcgacaaggttatcaacagaggtgggaaccaaaccgtcgaagctcgttgatggcttctacagtggtcggcagcgagtgagtcttctgtatgtatctacatgtcacaccaaaattcaccgaataagatgtgtgtgattggctttcgccctgtactcataccagcatccatcctgtatcacttgtgtggttagtttgcgccatacccgctcgaaaatctttgctgaaacttctattgcgcctggcgatgatgcctgtactgaataataatgatccagtgtcagcaacggtgtaacgaaatcgtattcatgttcgtctaaatctgtgagaaatgtcgcgtaatgattg

SEQ ID NO: 3360 - DNA, 1071 bp, Secale cereale
ggaaggaaggaaagcagagagagcagagcagggcgcgggagactgcaagcggccgccgccatggagaacgagttccaggatggcaaggaggaggtcatccaagcatggtacatggatgacagtgaagaggatcagaggcttcctcaccaccgtgagcccaaagagttcattcctcttgccaaactttcagaattaggtgttgtaagctggaacctgaatgctgataactgggagaaagacgagaatctcaagaaaatccgtgaggccaggggatactcttatgtggacatctgcgacgtatgtccggagaagttgccaaactacgaggccaagctgaagaatttctttgaagagcatttgcatactgatgaagagatacgctattgtcttgagggcagtggatactttgatgtgagggaccaaaacgaacagtggatccgtatagcagttaagaaaggtggcatgattgttttgcctgcaggaatgtatcaccgctttacactggatagtgacaactacatcaaggcaatgcgggctctttgtgggagagcctatctggacgccatacaaccgtccccatgaccatctcccagctagaaaggagtacgtcgacaaggttatcaacagaggtgggaaccaaaccgtcgaagctcgttgatggcttctacagtgttcggcagcgagtgagtcttctgtatgtatctacatatcacaccaaaattcaccgaataagatgtgtgtgattggctttcgccctgtactcataccagcatccatcctgtatcacttgtgtggttagtttgcaccatacccgctcgaaaatcttaccagaaacttgttcgcctggcgatgatgcctgtactgaataataatgatccggtgtcagcaacggtgtaacgaaatcatatttcatgttcgtctaaatctgtgagaaatgtagcgtaatgattgctaagtaaaaaaaaaaaaaaaaacaaaaacggtcttcgtctcggttacgataacccccgttccgttccttgacgacgttcgcccgtaaggccacgaccgtaggggtagtaggcgccgccg

SEQ ID NO: 3361 - DNA, 934 bp, Secale cereale
agagagagcagagcagggcgcgggagactgcaagaggctgccgccatggagaacgagttccaggatggcaaggaggaggtcatccaagcatggtacatggatgacagtgaagaggatcagaggcttcctcaccaccgtgagcccaaagagttcattcctcttgccaaactttcagaattaggtgttgtagctggaacctaaatgctgataactgggagaaagacgagaatctcaagaaaatccgtgaggccaggggatactcttatgtggacatctgcgacgtatgtccggagaagttgccaaactacgaggccaagctgaagaatttctttgaagagcatttgcatactgatgaagagatacgctattgtcttgagggcagtggatactttgatgtgagggaccaaaacgaacagtggatccgtatagcagttaagaaaggtggcatgattgttttgcctgcaggaatgtatcaccgctttacactggatagtgacaactacatcaaggcaatgcggctctttgtgggagagcctatctggacgccatacaaccgtccccatgaccatctcccagctagaaaggagtacgtcgacaaggttatcaacagaggtgggaaccaaaccgtcgaagctcgttgatggcttctacagtggtcggcagcgagtgagtcttctgtatgtatctacatatcacaccaaaattcaccgaataagatgtgtgtgattggctttcgccctgtactcataccagcgtcgatcctgtatcacttgtgtggttagtttgcgccatacccgctcgaaaatctttgctgaaacttcttcgcctggcgatgatgcctgtattgaacaataatgatccagtgtcagcaacggtgtaacgaaatcatatttcatgttcgtctaaatctgtgagaaatgtcgcgtaatgattg

SEQ ID NO: 3362 - DNA, 785 bp, Secale cereale
agagagagcagagcagggcgcgggagactgcaagcggccgccgccatggagaacgagttccaggatggcaaggaggaggtcatccaagcatggtacatggatgacagtgaagaggaccagaggcttcctcaccaccgtgagcccaaagagttcattcctcttgccaaactttcagaattaggtgttgtaagctggaacctgaatgctgataactgggagaaagacgagaatctcaagaaaaatccgtgaggccaggggatactcttatgtggacatctgcgacgtatgtccggagaagttgccaaactacgaggccaagctgaagaatttctttgaagagcatttgcatactgatgaagagatacgctattgtcttgagggcagtggatactttgatgtgagggaccaaaacgaacagtggatccgtatagcagttaagaaaggtggcatgattgttttgcctgcaggaatgtatcaccgctttacactggatagtgacaactacatcaaggcaatgcggctctttgtgggagagcctatctggacgccatacaaccgtccccatgaccatctcccagctagaaaggagtacgtcgacaaggttatcaacagaggtgggaaccaaaccgtcgaagctcgttgatggcttctacagtgttcggcagcgagtgagtcttctgtatgtatctacatatcacaccaaaagttccgaataagatgtgtgtgattggctttcgccctgtactcataccagcgtcgatcctgtatcacttgtgtggttagtt

SEQ ID NO: 3363 - DNA, 893 bp, Festuca arundinacea
cagcttcaggctttcgcgagggttcggtacagagcgaggaggaagacagagagcagcgcgcgagaccgcaagaggctgcggatatggagaacgagtttcaggatggcaaggaggaggtcatcgaagcatggtacatggatgacagtgaagaagaccagaggcttcctcatcaccgtgagcccaaagagttcattcctctcaacaaactttcagagttaggtgtagtaagctggcgccttaatgctgatgactgggagaaagatgagaatctcaagaaaatccgtgaggccaggggatactcttatgtggacatctgcgatgtgtgtcccgagaagttgccaaactacgaggtcaagataaagaatttctttgaagagcacttgcataccgacgaagagatacgctattgtcttgagggcagcggatactttgatgtgagggatgaaaacgaacagtggatccgtgtagcagttaagaaggggggcatgattgttttgcctgcaggaatgtatcaccgctttacactggatagtaacaactacatcaaggcaatgcggctctttgtgggagagcctgtctggacaccatacaatcgtccccatgaccatctcccagctaggaaggagtatgtcgacaagatcatcaacagaggtgggaatcaaactgtggaagctcgttgattggacctataatgttaggctgagtgagttttctgtatgtataacagttcaataaataccgaataagatatgcggacggctgtcacagtgtactcctaccaccatctgtatcagtaagcagtagttttcacaaaacctgcttataattatcctttggaaacttcgcatgccaatgtttgtagtataataaggtgtaatggtgtaatgtcgatc

SEQ ID NO: 3364 - DNA, 1106 bp, Oryza sativa
agattgcgttgagctgaagctgttcgtgtgactcttctacaccttccaggctatccggaatcgggagggtttcccaataggaaagcaactcaggactcaggagcggcgtctgagaggtttcagagatggagaaccagttccaggatggcaaggaggaggtcatcgaagcttggtacatggatgacagtgaagaggaccagaggcttcctcatcatcgtgagcccaaagaattcattcctcttagcaaactttcagagttaggaatattaagctggcgcctgaatgctgatgactgggagaatgatgagaacctcaagaaaatccgtgaggccaggggatactcttacatggatatttgtgatgtgtgtccagaaaagctgccaaactatgaggctaagctgaaaaatttctttgaagaacacttgcatactgatgaagagatacgctattgtcttgagggaagtggatacttcgatgtcagggaccaaaatgatcagtggatccgtgtagcagtgaagaaagggggcatgattgttttgcctgcgggaatgtatcaccgcttcacattggacagtgacaactacatcaaggcaatgcggctctttgtgggagagcctgtctggacgccgtacaaccgtccccatgaccatctgccagctagaaaggagtatgtcgaaaaaattatcaacaggggtggaactcaagctgtcgaagctcgttaaaggcatatcaagatgtgcttcctagttcggtgttctgttacactctacagatactgaataaactgtgctatcagctgttgcaatgggctcctaccgacatcttacatcatttggcagtattttgcacaaacccgcttaaaatctccctgaaaatacgcacgtcaccatgtcagagtgtttatatacaataatgacacttcagtccacagtcagcaagggactaatgacaatcattgtacttgtggtgtgtgtgatgaaaccacaatgatcaaaccgagtgtctgaatctctgaattgttttttttagcacaatgattgtgtaccaaaccctctgttgctgtgtgcggtggctggctcacctgatggcctttgtgctactcctgt

SEQ ID NO: 3365 - DNA, 1178 bp, Brachypodium distachyon
cagatagatatacgaggggcttatctctaaattaaagaacttggggagcatgtcggcaaaaccatctgatcgcgtgaagccaaagccggtttcataatagatccttctcccctgctgttgtttgcagcttcaacgagggttcagagagggggagaagacaaatttctcttgagaagcgcgagagaccgcagaaggctgcggatatggagcacgagttccaggatggcaaggaggaggtcatccaagcgtggtacatggatgacagtgaagaagaccagaggcttcctcatcaccgtgagccgaaagagttcattcctctcgacaaactttcagagttaggagtagtaagctggcggctaaatgctgatgactgggaaaaagatgagaacctcaagaaaatccgtgaggccaggggatactcttacgtggacatttgcgacgtgtgtccagagaagttgccaaactatgaggccaaactgaagaatttctttgaagagcacttgcatacagacgaagagatacgctattgtcttgagggcagtggatactttgatgtgagggaccaagatgagcagtggatccgtatagcagtgaagaaagggggcatgattgttttgcctgcaggaatgtatcaccgctttacgttagatagtgacaactacatcaaggcaatgcggctctttgtgggagagcctgtctggactccgtacaatcgtcctcatgaccatctcccagctagaaaggagtatttttccaaaattatcaacagaggtgggaatcaaactgttgaagctcgttgatgttgtctaatgtttggccgattgggtcttctgtatgtactactcccaaaatactgaataagacatgtgattgtctgtcacaatgtaatcctaccaacatcctgtatcagtcagtggtagtctgaacaagtctttcctgaaaacttagcatatgctagtgtttaattaataagtacacgcccgcatttcagtgtcagcaagggtgttagtggcgatcaatgtacttgtggtgtctgatgatatggtggttcggaatcccatctcaaatctgaataatgtttcgttccctgcattcatttcctccagcaggacgtcatatcgttgaccatggccttgatccattgatggagtgccctcgtcttattcgagctactccca

SEQ ID NO: 3366 - DNA, 1397 bp, Brachypodium distachyon
actccggattgttgtgagaaactacagccagatagatatacgaggggcttatctctaaattaaagaacttggggagcatgtcggcaaaaccatctgatcgcgtgaagccaaagccggtttcataatagatccttctcccctgctgttgtttgcagcttcaacgagggttcagagagggggagaagacaaatttctcttgagaagcgcgagagaccgcagaaggctgcggatatggagcacgagttccaggatggcaaggaggaggtcatccaagcgtggtacatggatgacagtgaagaagaccagaggcttcctcatcaccgtgagccgaaagagttcattcctctcgacaaactttcagagttaggagtagtaagctggcggctaaatgctgatgactgggaaaaagatgagaacctcaagaaaatccgtgaggccaggggatactcttacgtggacatttgcgacgtgtgtccagagaagttgccaaactatgaggccaaactgaagaatttctttgaagagcacttgcatacagacgaagagatacgctattgtcttgagggcagtggatactttgatgtgagggaccaagatgagcagtggatccgtatagcagtgaagaaagggggcatgattgttttgcctgcaggaatgtatcaccgctttacgttagatagtgacaactacatcaaggcaatgcggctctttgtgggagagcctgtctggactccgtacaatcgtcctcatgaccatctcccagctagaaaggagtatgtggacaaaattatcaacagaggtgggaatcaaactgttgaagctcgttgatggtgtctaatgtttggccgattgggtcttctgtatgtactactcccaaaatactgaataagacatgtgattgtctgtcacaatgtaatcctaccaacatcctgtatcagtcagtggtagtctgaacaagtctttcctgaaaacttagcatatgctagtgtttaattaataagtacacgcccgcatttcagtgtcagcaagggtgttagtggcgatcaatgtacttgtggtgtctgatgatatggtggttcggaatcccatctcaaatctgaataatgtttcgttccctgcattcatttcctccagcaggacgtcatatcgttgaccatggccttgatccattgatggagtgccctcgtcttattcgagctactcccatctcaatggacattcttcctacacgtttttgtccatttgtgtgtccatcttgtagcactggttcccagtctggtcactcacgaaccgctgccaaacactttgtgttgcgaattgggaaggtgtggcatggacgtgggctgaaataatttgagtacaaacataagttatttggcccagctctagtaagagag

SEQ ID NO: 3367 - DNA, 933 bp, Cynodon dactylon
ccgggggcttccaggctttcaggaaagttccattcacaagagaggaggaagggaaaacgagcggcgagaccacaagaggctgcagatatggagaacgagttccaggatggcaaggaggaggtcatccaagcatggtacatggatgacagtgaagaggaccagaggcttcctcatcatcttgagcccaaagaattcatcccgcttgacaagctttcagagttaggaatactgagctggcgtctaaatgctgatgattgggagaatgatgagaggctcaagaaaattcgtgaagccaggggctactcttacatggacatttgtgatgtgtgtccagagaagttaccaaattatgatgctaagctgaagaatttctttgaagaacacttgcatactgacgaagaaatacgctactgccttgagggtagtggatactttgatgtgagggaccaaaatgatcagtggatccgtatagcagtgaagaaagggggaatgattgtcttgccagcaggaatgtatcaccgcttcacattggacactgacaactacatcaaggcaatgcggctctttgttggtgagcctgtctggacgccgtacaatcgtccccatgaccatcttcctgctaggaaggagtacgttgagaaaatcatcaacagaggtggaagtcaagctgttgaagctcgttgatggaatcccccgccaagcttgccccttgtactacagtgcgattactaataaataagatctgccaatgcattctactcattccagcatcgtatatcagctaagagtttgtgcaagcatgctacaaaatccagtatgaagttttgtgtggcagttcctgttgtactgaataatggcatccacagcatctgtacgtggtatttgatggtaaattgatagcaatggttcaaactacctgcccgttctcaaaaa

SEQ ID NO: 3368 - DNA, 954 bp, Pseudoroegneria spicata
gttttccaaccagaggagagagcacggcgcgagagactgcaggaggccgccgccatggagaacgagttccaggatggcaaggaggaggtcatccaagcatggtacatggatgacagtgaagaggatcagaggcttcctcaccaccgtgagcccaaagagttcattcctcttgccaaactttcagaattaggtgttgtaagctggaacctaaatgctgataactgggagaaagacgagaatctcaagaaaatccgcgaggccaggggatactcctacgtggacatctgcgacgtatgtcctgagaagttgccaaactatgaggccaagctgaagaatttctttgaagagcacttgcatactgatgaagagatacgctattgtcttgagggcagtggatactttgatgtgagggaccaaaacgaacagtggatccgtatagcagttaagaaaggtggcatgattgttttgcctgcaggaatgtatcaccgctttacattggatagtgacaactacatcaaggcaatgcggctctttgtgggagagcctatctggacgccgtacaaccgtccccatgaccatctcccagctagaaaggagtacgtcgacaagattatcaacagaggtgggaaccaaaccgtcgaagctcgttgatggcttctacagtgttcggcagcgagtgagtcttctgtatgtatctacatatcacaccaaaagttaccgaataagatgtgtgtgattggctttcgccgtgtactcgtaccagcatcgatcctgtatcacttgtgtggttagtttgcaccattacccgctcgaaaatctttcctgaaacttcttcgcctggcgatgatgcctgtattgaataataatgatccagtgtcagcaacggtgtaacgaaaacagatgcatgttcgtctaaatctgtgagaaatgttgcgtaatgattgctgaaagcta

SEQ ID NO: 3369 - DNA, 2849 bp, Oryza sativa
cgacgctcctccgtggcggccggcggtcggcggccaccggcgctgctcgtcgctgccccttcccatggccacgcgaggagagcaccaagctaactatgggtggtcgccgcggcagcatccttttctaatgaaagcgacctcgcccgctctggcgcggcagcgtggagcggcggttgctcgcggcgtgtttgacgaaatgccgcgccgggacgacgacgccatggccggggcatccacctctgggaccgcgcgacgcgacgagtcttctcgcgtctgcagcggaaactccgtggtctccgcatgattcgtgtcttcgtgagtccggaccaccggaggggaggcggcatggacttcttcaggccggcgccagcgcacatcgtgattcatgcagcgtgtgcgaagtacaccagatctcagcaaacttttgtcaaactcaaacacgacgccttgttccaggggtgtcaatataaatagcaaaaaattgggggaccgtaccagcaaaaatctcagattgcgttgagctgaagctgttcgtgtgactcttctacaccttccaggctatccggaatcgggagggtttcccaataggaaagcaactcaggactcaggagcggcgtctgagaggtttcagagatggagaaccagttccaggatggcaaggaggaggtcatcgaagcttggtacatggatgacagtgaagaggaccagaggcttcctcatcatcgtgagcccaaagaattcattcctcttagcaaactttcagagttaggaatattaagctggcgcctgaatgctgatgactgggagaatgatgagaacctcaagaaaatccgtgaggccaggggatactcttacatggatatttgtgatgtgtgtccagaaaagctgccaaactatgaggctaagctgaaaaatttctttgaagaacacttgcatactgatgaagagatacgctattgtcttgagggaagtggatacttcgatgtcagggaccaaaatgatcagtggatccgtgtagcagtgaagaaagggggcatgattgttttgcctgcgggaatgtatcaccgcttcacattggacagtgacaactacatcaaggcaatgcggctctttgtgggagagcctgtctggacgccgtacaaccgtccccatgaccatctgccagctagaaaggagtatgtcgaaaaaattatcaacaggggtggaactcaagctgtcgaagctcgttaaaggcatatcaagatgtgcttcctagttcggtgttctgttacactctacagatactgaataaactgtgctatcagctgttgcaatgggctcctaccgacatcttacatcatttggcagtattttgcacaaacccgcttaaaatctccctgaaaatacgcacgtcaccatgtcagagtgtttatatacaataatgacacttcagtccacagtcagcaagggactaatgacaatcattgtacttgtggtgtgtgtgatgaaaccacaatgatcaaaccgagtgtctgaatctctgaattgttttttttagcacaatgattgtgtaccaaaccctctgttgctgtgtgcggtggctggctcacctgatggcctttgtgctactcctgtcgtcttcaaagtatctgacggtgctgaccaaaatctttgaaatgatagtgctaatgctgttgattaccgaaaagttggggcacattgatggcagataacctagtactgtgggtttctatggaccagagaactgcaaggaagattgtattgtatgctagtgagattgaacacgttcatgtgtacttttggttgccacttgcccagttgcgagtccggccaacggtggaacaactattttcagggtttcagaaagattgatcctgacagatgggaattcgcgaatgatggtttcctgagaggccagaggcatcttctaaagatgattaagaggaggagaccattgtcttatctccctggatctcagcaggcacttggcacctgccttgaggttggtcagttcggattagatgaagagatcgacaggctaaagcgtgacaagaacatcttactcgcggaggttgtgaaactaaggcacaagcagcaaagcacgaaagccaatatgcgagccatggaagagaggctgcaacatgcggagcagaagcaggtccagatgatgggtttcttggcaagagcaatgcagaaccctgacttctttcaccagttgattcaccagcaggataaaatgaaggggctcgaggacacattctcgaagaagaggacgaggtcgatagacatagtgccatttctcaaccccggggaggtcagccagggcgatcaactcgagtcgacattgctgtttgatccaaggccatttgctgaactgaatgatgagcctgcaaagtctgaactggagaatttagcactgaacatccagggtcttgggaagggcaagcaggatgtcaacaggactcgaaatcagccacgaaatcaggctagcaacgaaaccgagttaaccgacgacttctgggaggagcttctgaatgaaggagcaagagatgatgctgggattccagggatggagcgaagaagacctagatatgtcgatgcattagcgcagaagctgggttatctaagcaatagtagccaaaagtagatcaagtggctccgatttgtccaaccatttttgtgatagctcttattgtatatcggtgtaattgtattatagtgatagttttatagcgataggtccaatttatattgcggatccggcgtgctgtgtagtatatgtctggtgatgtaaagttgagccatcattcttaatggtatatattgacaattttttgcattgttgtggc

SEQ ID NO: 3370 - DNA, 954 bp, Secale cereale
gactgaaggaaggaaagcagagagagcagagcagggcgcgggagactgcaagaggccgccgccatggagaacgagttccaggatggcaaggaggaggtcatccaagcatggtacatggatgacagtgaagaggatcagaggcttcctcaccaccgtgagcccaaagagttcattcctcttgccaaactttcagaattaggtgttgtaagctggaacctgaatgctgataactgggagaaagatgagaatctcaagaaaatccgtgaggccaggggatactcttatgtggacatctgcgacgtatgtccggagaagttgccaaactacgaggccaagctgaagaatttctttgaagagcatttgcatactgatgaagagatacgctattgtcttgagggcagtggatactttgatgtgagggaccaaaacgaacagtggatccgtatagcagttaagaaaggtggcatgattgttttgcctgcaggaatgtatcaccgctttacactcgatagtgacaactacatcaaggcaatgcggctctttgtgggagagcctatctggacgccatacaaccgtccccatgaccatctcccagctagaaaggagtacgtcgacaaggttatcaacagaggtgggaaccaaaccgtcgaagctcgttgatggcttctacagtgttcggcagcgagtgagtcttctgtatgtatctacatatcacaccaaaagttaccgaataagatgtgtgtgattggctttcgccctgtactcataccagcgtcgatcctgtatcacttgtgtggttagtttacgccatacccgctcgaaaatctttgctgaaacttcttcgcctggcgatgatgcctgtattgaacaataatgatccagtgtcagcaacggtgtaacgaaatcatatttcatgttcgtctaaatctgtgagaaatgtcgcgtaatgattgt

SEQ ID NO: 3371 - DNA, 972 bp, Secale cereale
aggaaagcagagagagcagagcagggcgcgggagactgcaagcggccgccgccatggagaacgagttccaggatggcaaggaggaggtcatccaagcatggtacatggatgacagtgaagaggatcagaggcttcctcaccaccgtgagcccaaagagttcattcctcttgccaaactttcagaattaggtgttgtaagctggaacctgaatgctgataactgggagaaagacgagaatctcaagaaaatccgtgaggccaggggatactcttatgtggacatctgcgacgtatgtccggagaagttgccaaactacgaggccaagctgaagaatttctttgaagagcatttgcatactgatgaagagatacgctattgtcttgagggcagtggatactttgatgtgagggaccaaaacgaacagtggatccgtatagcagttaagaaaggtggcatgattgttttgcctgcaggaatgtatcaccgctttacactcgatagtgacaactacatcaaggcaatgcggctctttgtgggagagcctatctggacgccatacaaccgtccccatgaccatctcccagctagaaaggagtacgtcgacaaggttatcaacagaggtgggaaccaaaccgtcgaagctcgttgatggcttctacagtggtcggcagcgagtgagtcttctgtatgtatctacatgtcacaccaaaattcaccgaataagatgtgtgtgattggctttcgccctgtactcataccagcatccatcctgtatcacttgtgtggttagtttgcgccatacccgctcgaaaatctttgctgaaacttctattgcgcctggcgatgatgcctgtactgaataataatgatccagtgtcagcaacggtgtaacgaaatcgtattcatgttcgtctaaatctgtgagaaatgtcgcgtaatgattgctgaaagctacgcctgtgttcataacg

SEQ ID NO: 3372 - DNA, 883 bp, Secale cereale
gcgggagactgcaagcggccgccgccatggagaacgagttccaggatggcaaggaggaggtcatccaagcatggtacatggatgacagtgaagaggatcagaggcttcctcaccaccgtgagcccaaagagttcattcctcttgccaaactttcagaattaggtgttgtaagctggaacctgaatgctgataactgggagaaagacgagaatctcaagaaaatccgtgaggccaggggatactcttatgtggacatctgcgacgtatgtccggagaagttgccaaactacgaggccaagctgaagaatttctttgaagagcatttgcatactgatgaagagatacgctattgtcttgagggcagtggatactttgatgtgagggaccaaaacgaacagtggatccgtatagcagttaagaaaggtggcatgattgttttgcctgcaggaatgtatcaccgctttacactcgatagtgacaactacatcaaggcaatgcggctctttgtgggagagcctatctggacgccatacaaccgtccccatgaccatctcccagctagaaaggagtacgtcgacaaggttatcaacagaggtgggaatcaaaccgtcgaagctcgttgatggcttctacagtgtttggcagcgagtgagtcttctgtatgtatctacatatcacaccaaaagttaccgaataagatgtgtgtgattggctttcgccctgtactcataccagcgtcgatcctgtatcacttgtgtggttagtttgcgccatacccgctcgaaaatctttgctgaaacttgttcgcctggcgatgatgcctgtattgaacaataatgatccagtgtcagcaacggtgtaacgaaatcatatttcatgttcg

SEQ ID NO: 3373 - DNA, 875 bp, Secale cereale
ggttttccggcgtgaggaaggaaggaaagcagagagagcagagcagggcgcgggagactgcaagcggccgccgccatggagaacgagttccaggatggcaaggaggaggtcatccaagcatggtacatggatgacagtgaagaggaccagaggcttcctcaccaccgtgagcccaaagagttcattcctcttgccaaactttcagaattaggtgttgtaagctggaacctgaatgctgataactgggagaaagacgagaatctcaagaaaatccgtgaggccaggggatactcttatgtggacatctgcgacgtatgtccggagaagttgccaaactacgaggccaagctgaagaatttctttgaagagcatttgcatactgatgaagagatacgctattgtcttgagggcagtggatactttgatgtgagggaccaaaacgaacagtggatccgtatagcagttaagaaaggtggcatgattgttttgcctgcaggaatgtatcaccgctttacactcgatagtgacaactacatcaaggcaatgcggctctttgtgggagagcctatctggacgccatacaaccgtccccatgaccatctcccagctagaaaggagtacgtcgacaaggttatcaacagaggtgggaaccaaaccgtcgaagctcgttgatggcttctacagtggtcggcagcgagtgagtcttctgtatgtatctacatatcacaccaaaattcaccgaataagatgtgtgtgattggctttcgccctgtactcataccagcgtcgatcctgtatcacttgtgtggttagtttgcgccatacccgctcgaaaatctttgctgaaacttcttcgcctggcgatgatgcctgta

SEQ ID NO: 3374 - DNA, 1120 bp, Secale cereale
ctccagcttcgaggttttccggcgtgcggaaggaaggaaagcagagagagagcagagcagggcgcgggagactgcaagaggctgccgccatggagaacgagttccaggatggcaaggaggaggtcatccaagcatggtacatggatgacagtgaagaggatcagaggcttcctcaccaccgtgagcccaaagagttcattcctcttgccaaactttcagaattaggtgttgtaagctggaacctaaatgctgataactgggagaaagacgagaatctcaagaaaatccgtgaggccaggggatactcttatgtggacatctgcgacgtatgtccggagaagttgccaaactacgaggccaagctgaagaatttctttgaagagcatttgcatactgatgaagagatacgctattgtcttgagggcagtggatactttgatgtgagggaccaaaacgaacagtggatccgtatagcagttaagaaaggtggcatgattgttttgcctgcaggaatgtatcaccgctttacactggatagtgacaactacatcaaggcaatgcggctctttgtgggagagcctatctggacgccatacaaccgtccccatgaccatctcccagctagaaaggagtacgtcgacaaggttatcaacagaggtgggaaccaaaccgtcgaagctcgttgatggcttctacagtgttcggcagcgagtgagtcttctgtatgtatctacatatcacaccaaaattcaccgaataagatgtgtgtgattggctttcgccctgtactcataccagcatccatcctgtatcacttgtgtggttagtttgcaccatacccgctcgaaaatcttaccagaaacttgttcgcctggcgatgatgcctgtactgaataataatgatccggtgtcagcaacggtgtaacgaaatcatatttcatgttcgtctaaatctgtgagaaatgtagcgtaatgattgctgaaaagaaactaaaaaaaaaaaaagaaaaaaaaaaaagaaaaaaaaaaaagaaaaaaaaaaagaaaaaaaaagaaaaaaacaaaaaataaagaagtagtaatactatactatactatagactacgacacgacgacgacg

SEQ ID NO: 3375 - DNA, 1032 bp, Secale cereale
aggaaagcagagagagcagagcagggcgcgggagactgcaagaggccgccgccatggagaacgagttccaggatggcaaggaggaggtcatccaagcatggtacatggatgacagtgaggaggatcagaggcttcctcaccaccgtgagcccaaagagttcattcctcttgccaaactttcagaattaggtgttgtaagctggaacctaaatgctgataactgggagaaagacgagaatctcaagaaaatccgtgaggccaggggatactcttatgtggacatctgcgacgtatgtccggagaagttgccaaactacgaggccaagctgaagaatttctttgaagagcatttgcatactgatgaagagatacgctattgtcttgagggcagtggatactttgatgtgagggaccaaaacgaacagtggatccgtatagcagttaagaaaggtggcatgattgttttgcctgcaggaatgtatcaccgctttacactggatagtgacaactacatcaaggcaatgcggctctttgtgggagagcctatctggacgccatacaaccgtccccatgaccatctcccagctagaaaggagtacgtcgacaaggttatcaacagaggtgggaatcaaaccgtcgaagctcgttgatggcttctacagtgtttggcagcgagtgagtcttctgtatgtatctacatatcacaccaaaagttaccgaataagatgtgtgtgattggctttcgccctgtactcataccagcgtcgatcctgtatcacttgtgtggttagtttgcgccatacccgctcgaaaatctttgctgaaacttgttcgcctggcgatgatgcctgtattgaacaataatgatccagtgtcagcaacggtgtaacgaaatcatatttcatgttcgtctaaatctgtgagaaatgttgcgtaatgattgctgaaaaaaaaaaaaaagaaaaaaaaagaaaaaaaaagaaaaagaagaagagacgacgacgacacacggaggagagaggaggggggggg

SEQ ID NO: 3376 - DNA, 890 bp, Secale cereale
agagcagggcgcgggagactgcaagcggccgccgccatggagaacgagttccaggatggcaaggaggaggtcatccaagcatggtacatggatgacagtgaagaggatcagaggcttcctcaccaccgtgagcccaaagagttcattcctcttgccaaactttcagaattaggtgttgtaagctggaacctgaatgctgataactgggagaaagacgagaatctcaagaaaatccgtgaggccaggggatactcttatgtggacatctgcgacgtatgtccggagaagttgccaaactacgaggccaagctgaagaatttctttgaagagcatttgcatactgatgaagagatacgctattgtcttgagggcagtggatactttgatgtgagggaccaaaacgaacagtggatccgtatagcagttaagaaaggtggcatgattgttttgcctgcaggaatgtatcaccgctttacactcgatagtgacaactacatcaaggcaatgcggctctttgtgggagagcctatctggacgccatacaaccgtccccatgaccatctcccagctagaaaggagtacgtcgacaaggttatcaacagaggtgggaaccaaaccgtcgaagctcgttgatggcttctacagtgttcggcagcgagtgagtcttctgtatgtatctacatatcacaccaaaagctaccaaataagatgtgtgtgattggctttcgccctgtactcataccaacatcgatcctgtatcacttgtgtggttagtttgcgccacacccgctcgaaaatcttacctgaaacttgttcgcctggcgatgatgcctgtattgaacaataataataatgatccagtgtcagcagcggtgtaacgaaatcatatt

SEQ ID NO: 3377 - DNA, 1099 bp, Saccharum officinarum
agattccacgctcaggagcattcgagaagacgaagaaatacgccgacgaggagaagccgagcagcgacactgcatacgggcttccgacatggagggccagttccaggatggcaaggaggaggtcatccaagcatggtacatggatgacagtgaagaggaccagaggctgcctcatcatcgagagcccaaagaattcattcctcttgacaaacttttagagctaggaatattaagctggcgcctaaatgctgatgattgggagaatgatgagaacctcaagaaaattcgtgaagccaggggttactcttacatggacatttgtgatgtgtgcccagagaagttgccaaattacgaggctaagataaagaatttctttgaagaacacttgcatactgatgaagagatacgatattgtcttgagggtagcggctactttgatgtgagggaccaaaatgatcagtggatccgtgtagcagtgaagaaagggggcatgattgttttgcctgcaggaatgtatcaccgctttacattggatgccgacaactacatcaaggcaatgcggctctttgtgggcgagcctgtctggacgccatacaatcgtccccatgaccatctcccggctaggaaggagtatgttgagaaaatcatcaaccgaggtggaagccaagccgtcgaagctcgttgagtgtgtcaattctacatgtcttgccgagcctacctgtcgcgctacactacaactcaaaagtactgccgaataagatttgctattgcaatctgctcatgcatgtgccagctaacagtctgcacaaaacctgcttgaaatcttacttagatattttgtaatacgaatgatgtggtgtttgatgaatgatgaaacaatgatgattcaacccacctgtccttcacaggttcgatgaaacgttgcacaaaatggtttactgaaagggatgcttgaattcctgtaccaaccctcagtctgactgaatgtcgtggttcaactgctgaccaacattttgtttgcacgagtatctactgtcgttctcacagtaggacgagcagggttttgtaatgatgtactcattcacagtaccgttcttat

SEQ ID NO: 3378 - DNA, 1171 bp, Triticum aestivum
agtcgcgttaatccaaagcggttcataagaaacgcacacccacctcccctgtttctccagcttcgaggttttccggcgtgaggaaggaaggaaggcagcgagagcagggcgcgggagactgcgagaggctgccgccatggagaacgagttccaggatggcaaggaggaggtcatccaagcatggtacatggatgacagtgaagaggatcagaggcttcctcaccaccgtgagcccaaagagttcattcctcttgccaaactttcagaattaggtgttgtaagctggaacctaaatgctgataactgggagaaagacgagaatctcaagaaaatccgtgaggccaggggatactcctatgtggacatctgcgacgtatgtcctgagaaattgccaaactatgaggccaagctgaagaatttctttgaagagcacttgcatactgatgaggagatacgctattgtcttgagggcagtggatactttgatgtgagggaccaaaatgaacagtggatccgtatagcagttaagaaaggtggcatgattgttttgcctgcaggaatgtatcaccgctttacattggatagtgacaactacatcaaggcaatgcggctctttgtgggagagcctatctggacgccttacaatcgtccccatgaccatctcccagctagaaaggagtatgtcgacaagattatcaacagaggtgggaaccaaaccgtcgaagctcgttgatggctcctacagtgttcggcagcgagtgagtcttctgtatgtatctacatatcacaccaaaaggttaccgaataagatgtgtgattggctttcgccgtgtacccataccagcatcgatcctgtatcacttgtgtggtagtttgcacaaaacctgcttgaaaatgtttcatggaaacttctttgcctggcgatgatgcctgtattgaataataaatgattcagtgtcaacaacggcgtaatgaaaacggattcatgtccatccaaatccctgagaaatgttgcgcaattattgctgaaagctatacttgtgttcttgatcaatccccctaccagatcttgcgttaatacctttcctgcttcacatggctgaccttgtcccgtcgtattcagagagacgactaaatcttggcaaattgtactgtgattgccaagtttgtt

SEQ ID NO: 3379 - DNA, 885 bp, Secale cereale
gccgccatggagaacgagttccaggatggcaaggaggaggcatccaagcatggtacatggatgacagtgaagaggatcagaggcttcctcaccaccgtgagcccaaagagttcattcctcttgccaaactttcagaattaggtgttgtaagctggaacctgaatgctgataactgggagaaagacgagaatctcaagaaaatccgtgaggccaggggagtactcttatgtggacatctgcgacgtatgtccggagaagttgccaaactacgaggccaagctgaagaatttctttgaagagcatttgcatactgatgaagagatacgctattgtcttgagggcagtggatactttgatgtgagggaccaaaacgaacagtggatccgtatagcagttaagaaaggtggcatgattgttttgcctgcaggaatgtatcaccgctttacactcgatagtgacaactacatcaaggcaatgcggctctttgtgggagagcctatctggacgccatacaaccgtccccatgaccatctcccagctagaaaggagtacgtcgacaaggttatcaacagaggtgggaaccaaaccgtcgaagctcgttgatggcttctacagtggtcggcagcgagtgagtcttctgtatgtatctacatatcacaccaaaagttaccgaataagatgtgtgtgattggctttcgccctgtactcataccagcatcgatcctgtatcacttgtgtggttagtttgtgccatacccgctcgaaaatctttgctgaaacttctattgcgcctggcgatgatgcctgtactgaataataatgatccagtgtcagcaacggtgtaacgaaatcgtattcatgttcgtctaaatctgtgagaaatgt

SEQ ID NO: 3380 - DNA, 846 bp, Festuca arundinacea
cagcttcaggctttcgcgagggttcggtccagagcgaggaggaagacagagagcagcgcgcgagaccgcaagaggccggggacatggagaacgagttccaggacggcaaggaggaggtcatcgaagcatggtacatggatgacagtgaagaggaccagaggcttcctcatcaccgtgagcccaaagagttcattcctctcaacaaactttcagagttaggcgtagtaagctggcgcctaaatgccgatgactgggagaaagatgagaatctgaagaaaatccgtgaggccaggggatactcttatgtggacatctgtgatgtgtgtcctgagaagttgccaaactatgaggtcaagataaagaatttcttcgaagagcacttgcatactgatgaagagatacgctactgtcttgagggcagtggatactttgacctgagggatgaaaacgaacagtggattcgtgtagcagtgaagaaggggggcatgattgttttgcctgcaggaatgtatcaccgctttacgttggacagtaacaactatatcaaggcaatgcggctctttgtgggagagcctgtctggacaccgtacaatcgcccccatgaccacctcccagctagaaaggagtatgtcgacaaaatcatcaacagaggcgggaatcaaactgtggaagctcgttgatgtgacctataatgttaggctgagtgagtttcctgtatgtataacgcttccatgaaataccgaataagatgtgccaacagccggcgcattgtgttttcctgccaccatactgtatcagtcagcagtagtttgcacaaaacctgcttaaaatcatccccggaaactt

SEQ ID NO: 3381 - DNA, 899 bp, Zea mays
accgcgctcaggagcattcgagaagccgaagaaaattcgaagacgaggaccagctacactgcggacggacttcgggcatggagggccagttccaggttggcaaggaggaggtcatccaagcatggtacatggacgacagtgaagaggaccagaggcttcctcatcatcgcgagcccaaagaattcattcctctcgacaaactttccgaactaggaatattaagctggcgcctaaatgctgatgattgggagaatgatgagaacctcaagaaaattcgtgaagccaggggttactcttacatggacatttgtgatgtgtgcccagagaagttgccaaattacgaggctaagataaagaatttctttgaagaacacttgcatactgatgaagagatacgatattgccttgagggtagcggctactttgatgtgagggaccaagatgatcagtggatccgtgtagcggtaaagaaagggggcatgatcgttttgcctgcaggaatgtatcatcgctttacgttggatagtgacaactacatcaaggcaatgcgtctatttgtgggtgagcctgtctggacaccatacaatcgtccgcatgaccatctcccggctaggaaggagtacgtcgagaaaatcatcaaccgaggtggaaaccaagccgtcgaagctcgttgagcgtgtccactctacatgtcctcctgccgtctcagcctcttgtgttttacaccctacaactcctagtaccgccgaataagatttgctatctgcaatgtgctcatgccaccgctgtgtgtgccagttaacagtttgcacgaaacccgcttaaaatcttccctagatattttgttgtacgaatgaatgacatgtggtgtttgataaatgatgaaacgatgatggttc

SEQ ID NO: 3382 - DNA, 1010 bp, Sorghum bicolor
ggacataagaaacgcaggcccctcgttccagattccacgttcaggagcattcgagaacacgaagaaatacgacgacaaaggagaagccgagcagcgacactgcatacggactttagacatggagggccagttccaggatggcaaggaggaagtcatccaagcatggtacatggatgacagtgaagaggaccagaggcttcctcatcatcgcgagcccaaagaattcattcctctcgacaaactttcagagctaggaatattaagctggcgcctaaatgctgatgattgggagaatgatgagaagctcaagaaaattcgtgaagccaggggttactcttacatggacatttgtgatgtgtgcccagagaagttgccaaattacgaggctaagataaagaatttctttgaagaacacttgcgtactgatgaagagatacgatattgtcttgagggtagtggctactttgatgtgagggacgaaaatgatcagtggatccgtgtagcagtgaagaaagggggcatgattgttttgcctgcaggaatgtatcaccgctttacattggataccgacaactacatcaaggcaatgcggctctttgtgggcgagcctgtgtggacgccatacaatcgtccccatgaccatctcccggctaggaaggagtatgttgagaaaatcatcaacagaggtggaaaccaagccgtcgaagctcgttgagcatgtcaaactctacatgtcctgcggagcctacctgttgcactacactttacaactcctggtgctgtagaataagatttgctattgcaatcagctcatgccaccaccatgttgtcagttaacagtttgcacaaagcctgcttaaaatcttgcctagatattttgtaataggaatggtgtggtgtttgatgaatgttgaagtgatgatgattcaacccatgtgtccttcacaggttcgatgaaacgttgcacacaatgatttactgaaaatcatgcttggattcctgtaccaacc

SEQ ID NO: 3383 - DNA, 1391 bp, Zea mays
cctgcccgggcggagggaggcgcggcgcaacggacttcatgctgccacccgccgacccgcacctcaccggctcacctacaccctcctcttcgttcgtctcttatccatgcaatgcatcgtctgaccttgccttttgtcttttacaaacactgccatcagcaaatcatgctatttttatgccgtcacgtttcatgcagctatgtgtaaataaataaaacgtatataacgcattttaatcatagatccccgacgcaacaacaattgcagccacacccccgcggagccatcacctttcactctaattagaaacatcgacctgctcaacccaccgaggaatatagactgtttttttttctatgtggaaataccaagtagtagtgccaaacgctaaaagggtatgcatcttaattgatgagctgtgagggtgcaatctacaagagtgcgggttcgcgttcagtccaagctgaacataaacgcaacgcaaggcccctcgacgcagataccgcgctcaggagcattcgagaagccgaagaaaattcgaagacgaggaccagctacactgcggacggacttcgggcatggagggccagttccaggttggcaaggaggaggtcatccaagcatggtacatggatgacagtgaagaggaccagaggcttcctcatcatcgcgagcccaaagaattcattcctctcgacaaactttccgaactaggaatattaagctggcgcctaaatgctgatgattgggagaatgatgagaacctcaagaaaattcgtgaagccaggggttactcttacatggacatttgtgatgtgtgcccagagaagttgccaaattacgaggctaagataaagaatttctttgaagaacacttgcatactgatgaagagatacgatattgccttgagggtagcggctactttgatgtgagggaccaagatgatcagtggatccgtgtagcggtaaagaaagggggcatgatcgttttgcctgcaggaatgtatcatcgctttacgttggatagtgacaactacatcaaggcaatgcgtctatttgtgggtgagcctgtctggacaccatacaatcgtccgcatgaccatctcccggctaggaaggagtacgtcgagaaaatcatcaaccgaggtggaaaccaagccgtcgaagctcgttgagcgtgtccactctacatgtcctcctgccgtctcagcctcttgtgttttacaccctacaactcctagtaccgccgaataagatttgctatctgcaatgtgctcatgccaccgctgtgtgtgccagttaacagtttgcacgaaaccctagatattttgttatacgaatgaatgacatgtggtgtttgataaatgatgaaacgatgatggttcaaatca

SEQ ID NO: 3384 - DNA, 760 bp, Secale cereale
ggaaggaaggaaagcagagagagcagagcagggcgcgggagactgcaagcggccgccgccatggagaacgagttccaggatggcaaggaggaggtcatccaagcatggtacatggatgacagtgaagatgatcagaggcttcctcaccaccgtgagcccaaagagttcattcctcttgccaaactttcagagttaggtgttgtaagctggaacctaaatgctgataactgggagaaagatgagaatctcaagaaaatccgtgaggccaggggatactcttatgtggacatctgcgacgtatgtccggagaagttgccaaactacgaggccaagctgaagaatttctttgaagagcatttgcatactgatgaagagatacgctattgtcttgagggcagtggatactttgatgtgagggaccaaaacgaacagtggatccgtatagcagttaagaaaggtggcatgattgttttgcctgcaggaatgtatcaccgctttacactggatagtgacaactacatcaaggcaatgcggctctttgtgggagagcctatctggacgccatacaaccgtccccatgaccatctcccagctagaaaggagtacgtcgacaaggttatcaacagaggtgggaaccaaaccgtcgaagctcgttgatggcttctacagtggtcggcagcgagtgagtcttctgtatgtatctacatgtcacaccaaaattcaccgaataagatgtgtgtgattggctttcgccctgtac

SEQ ID NO: 3385 - DNA, 1361 bp, Sorghum bicolor
ctaaactgatgaactgcgagggggcaatctacaaaagtgtgggttcgcgttcagtccaagcggacataagaaacgcaggcccctcgttccagattccacgttcaggagcattcgagaacacgaagaaatacgacgacaaaggagaagccgagcagcgacactgcatacggactttagacatggagggccagttccaggatggcaaggaggaagtcatccaagcatggtacatggatgacagtgaagaggaccagaggcttcctcatcatcgcgagcccaaagaattcattcctctcgacaaactttcagagctaggaatattaagctggcgcctaaatgctgatgattgggagaatgatgagaagctcaagaaaattcgtgaagccaggggttactcttacatggacatttgtgatgtgtgcccagagaagttgccaaattacgaggctaagataaagaatttctttgaagaacacttgcgtactgatgaagagatacgatattgtcttgagggtagtggctactttgatgtgagggacgaaaatgatcagtggatccgtgtagcagtgaagaaagggggcatgattgttttgcctgcaggaatgtatcaccgctttacattggataccgacaactacatcaaggcaatgcggctctttgtgggcgagcctgtgtggacgccatacaatcgtccccatgaccatctcccggctaggaaggagtatgttgagaaaatcatcaacagaggtggaaaccaagccgtcgaagctcgttgagcatgtcaaactctacatgtcctgcggagcctacctgttgcactacactttacaactcctggtgctgtagaataagatttgctattgcaatcagctcatgccaccaccatgttgtcagttaacagtttgcacaaagcctgcttaaaatcttgcctagatattttgtaataggaatggtgtggtgtttgatgaatgttgaagtgatgatgattcaacccatgtgtccttcacaggttcgatgaaacgttgcacacaatgatttactgaaaatcatgcttggattcctgtaccaaccctcagtctgactgaatgtcgtggtccaactactgaccattattatttttgcatgagtatctactgtcgttcttgcagtaggacgaccaggctttgtaatgatgtactcattcacagtacggttcttattaccaaaaagtttgtgcagattgataatgacgctaggtggctcttgtctcgtactaggtctactggggaaaatgtgtggcaagtgaaatgaacacgttctgtctctgacatctaagaacatttgtgatcccggtgaaatacttagtgtgcagttgcattacc

SEQ ID NO: 3386 - DNA, 1381 bp, Triticum aestivum
tacatggcagtgtcctacatcgaaattgagcaaacctcagtgtccttatcggtaaaagcttcgagtcgcgttaatccaaagcggttcataagaaacgcacatccacctcccctgtttctccagcttcgaggttttccagggagaggaaggaaggcagagagagcagggcgcgagaggctgcaagcggccgccgccatggagaacgagttccaggatggcaaggaggaggtcatccaagcatggtacatggatgacagtgaggaggaccagaggcttcctcatcaccgtgagcccaaagagttcattcctcttgccaaactttcagaattaggtgttgtaagctggaacctgaatgctgatgactgggagaaagacgagaatctcaagaaaatccgtgaggccaggggatactcttatgtggacatttgcgacgtatgtccagagaagttgccaaactatgaggccaagctgaagaatttctttgaagagcacttgcatactgatgaagagatacgctattgtctcgagggcagtggatactttgatgtgagggaccaaaacgaacagtggatccgtatagcagttaagaaaggtggcatgattgttttgcctgcaggaatgtatcaccgctttacattggatagtgacaactacatcaaggcaatgcggctctttgtgggagagcctatctggacgccatacaatcgtccccatgaccatctcccagccagaaaggagtacgtcgacaagattatcaacagaggtgggaaccaaactgttgaagctcgttgatggcttctacagtgttcggcagcgagcggagtcttctgtatgtatctacatatcacaccaaaagttaccgaataagatgtgtgattggctttcgccgtgtactcgtaccagcatcgatcatgtatcagttgtgtggttagtttgcgccatacccgctcgaaaatctttgctgaaacttcttcgcctggcgatgatgcctacattgaataataatgatccagtgtcagcaacggtgtaacgaaaacagatgcatgttcgtctaaatctgtgggaaatgttgcgtgataattgctgaaagcatgcctgtgttcatgatcaatcccctacctgatctcgcgttaatacttttcgtgtctcacctgctgaccttgtgtccttgtcccgtcgtattcagagggactactaaatctttgcaattgtactgtgataagttagtttgtccacacgtctataaacactcttattgctgtgggctgtacggagaagggaagctgctagagcaaattgtactgtgagttgtactatgagagtgactgaacatgtttctgtccattcctagagccgacttccggcactggtttccggtccc

SEQ ID NO: 3387 - DNA, 994 bp, Avena sativa
gttcccgtgttcccgtccagcttcatcaggcttccgcgagggctcgttccggagcgaggaggaagacagcgagcagctgcgcgcgagaaccgcggacatggagaacgagttccaggatggcaaggaggaggtcatccaagcatggtacatggatgacagtgaagaagaccagaggcttcctcatcaccgtgagcccaaagagttcattcctctcaacaagctttcagagttgggtgtagtaagctggcgcctgaatgctgatgactgggagaaagatgagaatctcaagaaaatccgtgaggccaggggatactcttatgtggacatttgcgatgtgtgtcccgagaagttgccaaactatgaggtcaagataaagaatttctttgaagagcacttgcatactgacgaagagatacgctattgccttgagggcagtggatactttgatttgagggatgaaaacgaacagtggatccgtgtagcagtgaagaaggggggcatgattgttttgcctgcaggaatgtatcaccgctttactttggatagtgacaactacatcaaggcaatgcggctctttgtgggtgagcctgtctggacaccgtacaaccgtccccatgaccatctcccagctaggaaggagtacgtagacagagtcatcaaccgaggtgggaatcaaactgtcgaagctcgttgatggcgttcagtgttagaccgagtgagtcttctgtatgtaactatgtattacaccccgcagttactgaataagatgtgcgtactgctgtcgcggtgtactcctacacatatacgctcctaccaactgtatcagtgagcagtagtttgcacaaaacctgtaatactccgtttaataatggcacccccacataccggtgtcagcagtgttgtaatgtcgatcaattttgcttgttgtgtccaatgatatgatggttcaaactccgtttgatatctagaaaaaagtttctgcttagtgaccaca

SEQ ID NO: 3388 - DNA, 981 bp, Avena sativa
tcatcaggcttccgcgagggctcgctccggagcgaggaggaagacagcgagcagcagcgcgcgagaaccgcggacatggagaacgagttccaggatggcaaggaggaggtcatccaagcatggtacatggatgacagtgaagaagaccagaggcttcctcatcaccgtgagcccaaagagttcatttctctcaacaagctttcagagttgggtgttgtaagctggcgcctgaatgctgatgactgggagaaagatgagaatctcaagaaaatccgtgaggccaggggatactcttatgtggacatttgcgatgtgtgtcccgagaagttgccaaactatgaggtcaagataaagaatttctttgaagagcacctgcatactgacgaagagatacgctattgccttgagggcagtggatactttgatttgagggatgaaaacgaacagtggatccgtgtagcagtgaagaaggggggcatgattgttttgcctgcaggaatgtatcaccgctttactttggatagtgacaactacatcaaggcaatgcggctctttgtgggtgagcctgtctggacaccgtacaaccgtccccatgaccatctcccagctaggaaggagtacgtagacagagtcatcaaccgaggtgggaatcaaactgtcgaagctcgttgatggcgttcagtgttagaccgagtgagtcttctgtatgtaactatgtattacaccccgcagttactgaataagatgtgcgtactgctgtcgtggtgtactcctacccatatatgctcctataccaacaccctgtatcagtgagcagtactgtagtttgcacaaaacctgcttaaaatcgtccctggaaacttcacatgccaatgtttgtaataccccgtctaataatgacacccccacattccggtgtcagcagtgttgtaatgtcgatcaattttgcttgttgtgtccaatgatatgatggttcaaaac

SEQ ID NO: 3389 - DNA, 2115 bp, Panicum virgatum
tactaacataggatggcaaggaggaggtcatccaagcatggtacatggatgacagcgaagaggaccagaggcttcctcatcatcgcgagcccaaagagttcattcctctagacaaactctcagaactaggaatattaagctggcgcctaaatgctgatgactgggagaatgatgagaacctcaagaaaattcgtcaagccaggggttactcttacatggacatttgtgatgtgtgtccagagaagttgccaaactacgaggctaagataaagaatttctttgaagaacacttgcatactgatgaagagatacgctattgtcttgagggtagcggctacttcgacgtgagggaccaaaatgatcagtggatccgtatagcagtgaagaaagggggcatgattgttttgcctgcaggaatgtatcaccgctttacattggatacagacaactacatcaaggcaatgcgtctctttgtgggagagcctgtctggacgccatacaatcgtccccatgaccatctccctgctaggaaggagtatgtcgagagaatcatcaaccgaggtggaaaccaagctgttgaagctcgttgagtgtatactagcgtctctgcatgtttgcctgttgcgaggtggaaaccaagctgtcgaagttcgttgagtgtataccagcatctctgcatgtttgcttccagtctgcctgttgcgctacaccctagaagtactgctgaataagatcttctaccacaatcagcgcatgccaccatcatgctcgtgtgcgagtcaatagtttgcacaaaacctagatatttgtaatgtgaataatgtggcctttgatgcttgtgcacaatgattggcttgaggagaaggatgcttgaattcctcatagcaactctcctctcggcctggcgtggttcaactgctgactaacagtttttgtctgcacccggtcaaggtcattctcaaagtagcacgaccagatctccgaaatgatgtaatcacagtacagtcctacttgatcaccaaaacgtcagtgcagattgatgacacacctggaatgattgcatgctaggtccgtactagtagaaaatgtgtgccaacaaaggtgaacacgttttatgcctgccgtctggtcactttgcgagcattggtcggcagccgatcaccagccaagaacacttgtgatgccggtggattacttatgtgtgctactacaaggccacacaaaaaccttcagtattgctcatgcctgtcttctttttcgacagaaaaactaggagaatcaatcatatgatcaactgatcatgattcctgttcgcaggtacgttctaccaaacatctccagatgcattatatttcgtagtagcgacaacggacatgaggagtagggtgatgccggacacctttcgagaggccaaaaagatcagatcagatcagatcagatcgaagaaaaaggaacgtccttttcgccgcgaacgcgcggcgtatctcgccggcggatcggcgcggcaagttgcagccaatcacgagccgggcagcacatcccggagcccacgggcgatcgggaaaaccggcctcgagctgtcgccgtcgtcgtcctccctgtcggcggcggtcgattcgggaggcgcctccccccacttgcgccgggcgcgccaaccgccacacccccgcggcgtcctccagaaccttccgagccccgcgctctagaacgttccattcccctcctgaccagtctcgtagtacagagaggtaaagctgcctggtatttagcgccgccgccccccgcggttagcaggggcttctcttcccgcgcgcgccgcgccacgcacccggcgtcgctgcgtcactgtagcagcgtcagcgagcggcgactcttgttggttctcgggatcgccagcgctctggattcgacgatcgcagcagcagcggaattcgcctggggatcgtttgggttggttggcggcggccggtatagtggcacgatggacccgctgctgccgggggtggtgaccgtgaaggaggagtggccgccgagctcgccgccgccggaggaggaggtggaggacgtggacgcggcgggggcgccgcggccgatggaggggctgcacgaggtcgg

SEQ ID NO: 3390 - DNA, 935 bp, Secale cereale
agagagagcagagcagggcgcgggagactgcaagcggccgccgccatggagaacgagttccaggatggcaaggaggaggtcatccaagcatggtacatggatgacagtgaagatgatcagaggcttcctcaccaccgtgagcccaaagagttcattcctcttgccaaactttcagagttaggtgttgtaagctggaacctaaatgctgataactgggagaaagatgagaatctcaagaaaaatccgtgaggccaggggatactcttatgtggacatctgcgacgtatgtccggagaagttgccaaactacgaggccaagctgaagaatttctttgaagagcatttgcatactgatgaagagatacgctattgtcttgagggcagtggatactttgatgtgagggaccaaaacgaacagtggatccgtatagcagttaagaaaggtggcatgattgttttgcctgcaggaatgtatcaccgctttacactggatagtgacaactacatcaaggcaatgcggctctttgtgggagagcctatctggacgccatacaaccgtccccatgaccatctcccagctagaaaggagacgtcgacaaggttatcaacagaggtgggaatcaaaccgtcgaagctcgttgatggcttctacagtgtttggcagcgagtgagtcttctgtatgtatctacatatcacaccaaaagttaccgaataagatgtgtgtgattggctttcgccctgtactcataccagcgtcgatcctgtatcacttgtgtggttagtttgcgccatacccgctcgaaaatctttgctgaaacttgttcgcctggcgatgatgcctgtattgaacaataatgatccagtgtcagcaacggtgtaacgaaatcatatttcatgttcgtctaaatctgtgagaaatgttgcgtaatgattg

SEQ ID NO: 3391 - DNA, 783 bp, Cenchrus ciliaris
gaggttattgaagcatggtacatggatgacagtcaagaggaccagaggcttcctcatcaccgtgaacccaagaattcattcctctggagaagctttcagaactaggaatcatcagctggcgcctaaaccctgataactgggagaaagatgagaacctcaagaaaatccgtgaagcaagaggctactcctacatgggacatttgtgatgtatgcccagagaagctgccaaattatgaggttaagataaagaatttttttgaagagcacctgcatactgatgaagaaatacgctattgccttgaagggagtggatactttgatgtgagggatgaaaatgataagtggatccgtgtagcagtgaagaaaggagggatgattgttttgcctgcagggatgtatcatcgcttcacattggacactgacaactacatcaaggcgatgcggctctttgttggcgagcctgtttggacgccgtacaaccgtccccatgatcatctgccagcgaggcaggagtatctggacaagcttatcaaggcagaaggtgtgaatcaagctgttgaagctcgctgaggccattccaaacctagtacttgttaggttgctccagtgtgtcctatgtacaccttgaataagatgttgtgtttccctacttatgtggtgcgttctggtcagtttgaagtggacatgtcattctgtcaacataaagtgtgtattatcggttcggctggcctgtacccctacattatatatttatatcacatactgtccatatctttgaataaa

SEQ ID NO: 3392 - DNA, 762 bp, Leymus cinereus x Leymus triticoides
  misc_feature (721)..(722): n is a, c, g, or t
agagagcagggcgcgacagaccacaagaggctgccgccatggagaacgagttccaggatggcaaggaggaggtcatccaagcatggtacatggatgacagtgaggaggaccagaggcttcctcatcaccgtgagcccaaagagttcattcctcttgccaaactttcagaattaggtgttgtaggctggaacctaaatgctgatgactgggagaaagacaagaatctcaagaaaatccgtgaggccaggggatactcttatgtggacatttgcgacacatgtccagagaagttgccaaactacgaggccaagctgaagaacttctttgaagagcacttgcatactgatgaagagatacgctattgtcttgagggcagtggatactttgatgtgagggaccaaaacgaacagtggatccgtatagcagttaagaaaggtggcatgattgttttgcctgcaggaatgtatcaccgctttacattggatagtgacaactacatcaaggcaatgcggctctttgtgggagagcctatctggacgccgtacaatcgtccccatgaccatctcccagctagaaaggagtacgtcgacaagattatcaacagaggtgggaaccaaaccgtcgaagctcattgatggcttctacagtgttcggcagcgattgagtcttctgtatgtatctacatatcacaccaaaagttactgaataagatgtgtgtgannggctttcgccgtgtactcgtaccagcatcgatcatgtatc

SEQ ID NO: 3393 - DNA, 739 bp, Avena sativa
ttccgcgagggctcgttccggagcgaggaggaagacagagagcagtagcgcgctgagaccgcacgaggccgcggatatggagaacgagttccaggatggcaaggaggaggtcatccaagcatggtacatggatgacagtgaagaagaccagaggcttcctcatcaccgtgagcccaaagagttcattcctctcaacaaacttaaagagctgggtgtagcaagctggcgcctgaatgctgatgactgggagaaagatgagaatctcaagaaaatccgcgaggccaggggatactcttatgtggacatttgtgacgtgtgtcctgaaaagttgccaaactatgaggtcaagataaagaatttctttgaagagcacttgcatactgacgaagagatacgctattgtcttgagggcagtggatactttgatctgagggatgaaaaggagcagtggatccgtgtagcagtgaagaaggggggcatgattgttttgcctgcaggaatgtatcaccgctttactttggatagtgacaactacatcaaggccatgcggctctttgtgggtgagcctgtctggacaccgtacaaccgtccccatgaccatctcccagctaggaaggagtatgtagacagagtcatcaaccgaggtgggagtcaaactgtcgaagctcgttgatggcgttcagtgttagaccgagtgagtcttctgtatgtaactatgtattacactccgcagttactg

SEQ ID NO: 3394 - DNA, 938 bp, Ananas comosus
gacggtgcgatagtttttacggagaagagggcgagggtgagggcgaaatcgaggagagagagagagagagagagagagatggagcacgagtttcaggaaggcaaggaggaggttatccaagcctggtatatggacgatagtgatgaggaccaaagacttcctcatcatcgcgagcccaaggaatttattcccttggacaaacttgcagagctaggattacttagctggcgtctggatgctgacaaatatgagactgatgagaaccttaaaaaaattcgtgaagccaggggttattcttacgtggacatttgtgatgtgtgccctgagaagttgccaaactatgaggccaagttgaagagcttctttgaagagcacctgcacactgatgaagaaatacgttattgtctcgagggaagtggatattttgatgtgagggaccaggatgatagatggattcgtgtagcagtgaagaaagggggcatgatcgtcttgcctgcaggaatttaccatcgttttacattggatacaaacaactacattaaggcaatgcggctcttcgtgggtgagcccatttggactccttataatcgtccccacgaccatctcccggctaggaaggagtatcttgatgcactgaccaagaaggaaggtgcaaagcaggctgtggaagctctttaactgcattatagtattattattatcacttttaccttatatatagttctctctaagactgaataaaagttgtcagtttgtgtcacattccatatgagtgttattggcttgcatcaacttattggaatttgaggtcgtgctatttgaatctaaatttactactggtggcattttgttgtactttaaatctcgatcttgattgcttgacactggaatgaggaacaattgtgatattataagaaaataagtgaaataatttaatt

SEQ ID NO: 3395 - DNA, 748 bp, Secale cereale
agagcagggcgcgggagactgcaagaggccgccgccatggagaacgagttccaggatggcaaggaggaggtcatccaagcatggtacatggatgacagtgaagaggatcagaggcttcctcaccaccgtgagcccaaagagttcattcctcttgccaaactttcagaattaggtgttgtaagctggaacctgaatgctgataactgggagaaagacgagaatctcaagaaaatccgtgaggcccgggggatactcttatgtggacatctgcgacgtatgtccggagaagttgccaaactacgaggccaagctgaagaatttctttgaagagcatttgcatactgatgaagagatacgctattgtcttgagggcagtggatactttgatgtgagggaccaaaacgaacagtggatccgtatagcagttaagaaaggtggcatgattgttttgcctgcaggaatgtatcaccgctttacactcgatagtgacaactacatcaaggcaatgcggctctttgtgggagagcctatcgtggaccgccatacaacccgtccccatgaccatcctcccagctagaaaggagtacgtcgacaaggttatcaacggaggtcgggaaccaaaccgtcgaagcttcgttgatggcttctacgagtggttaggcagcgagtgtagtcctgtgtatgtatctacatgtcacacaaatcaaccgaatagatgtgtgtgtattcggtctttccgccttgtact

SEQ ID NO: 3396 - DNA, 855 bp, Cenchrus ciliaris
tcatccaagcttggtacatggatgacagcgaagaggaccagaggcttccacatcatcgtgagcctaaagagttcattcctcttgacaaactttctgagctaggaatattaagctggcgcctaaatcctgatgactgggagaatgatgaaaacctcaagaaaattcgtgaagccaggggttactcttacgtggacatttgtgatgtgtgtccagagaagttgccaaactatgaggctaagataaagaatttctttgaagaacacttgcatactgatgaagagatacgctactgtcttgagggtagcggctacttcgacgtgagggaccaaaatgatcagtggatccgcatagcagtgaagaaagggggcatgattgttctgcctgcaggaatgtatcaccgatttacattggatacggacaactacatcaaggcaatgcgcctctttgttggtgagcctgtttggacgccatacaatcgcccccatgaccatctcccggcaaggaaggagtatgtcgatagaatcatcaaccgaggtggaaaccaagctgttgaagctcgttgaatgttgtctgccgagtctgcctgttgagctacaccatacaagtattgccgaataagatctgctaccgcaaactgctcataccaccatcatgctcatgtgccagtcaatagtttgcacaaaacctgtttcaaatctcccgtagatattttgtaatgtggtatgattgtatgaatgatgtggtctttggtgaatgatgaaggttgaaaccccctgcccgtctcaaatctgtgcaaattgcgcgcaatgattggcttgccgttgccgaaagggttgcttgaaaattcctcatacc

SEQ ID NO: 3397 - DNA, 1104 bp, Eragrostis curvula
  misc_feature (11)..(11): n is a, c, g, or t
  misc_feature (22)..(22): n is a, c, g, or t
  misc_feature (463)..(463): n is a, c, g, or t
  misc_feature (532)..(532): n is a, c, g, or t
  misc_feature (538)..(538): n is a, c, g, or t
  misc_feature (545)..(545): n is a, c, g, or t
  misc_feature (567)..(568): n is a, c, g, or t
  misc_feature (586)..(586): n is a, c, g, or t
  misc_feature (591)..(591): n is a, c, g, or t
  misc_feature (604)..(604): n is a, c, g, or t
  misc_feature (612)..(612): n is a, c, g, or t
  misc_feature (622)..(622): n is a, c, g, or t
  misc_feature (628)..(628): n is a, c, g, or t
  misc_feature (631)..(631): n is a, c, g, or t
  misc_feature (641)..(642): n is a, c, g, or t
  misc_feature (647)..(647): n is a, c, g, or t
  misc_feature (650)..(650): n is a, c, g, or t
  misc_feature (674)..(674): n is a, c, g, or t
  misc_feature (677)..(677): n is a, c, g, or t
  misc_feature (691)..(693): n is a, c, g, or t
  misc_feature (695)..(695): n is a, c, g, or t
  misc_feature (698)..(698): n is a, c, g, or t
  misc_feature (700)..(701): n is a, c, g, or t
  misc_feature (707)..(708): n is a, c, g, or t
  misc_feature (710)..(710): n is a, c, g, or t
  misc_feature (715)..(715): n is a, c, g, or t
ggaggggaagnaaagcagcaancaagcgcgcatcgagaaatgctgcagcatggagacggatttccaggatggtaaggcacaagttattgaggcatggtacatggatgatagccaagaggatcagaggcttcctcatcaccgtgaacctaaagaattcattcctcttgagaagctttcagaactaggaattgtcagctggcgattaaaccctgataactgggagaatgatgataacctcaagaaaatccgtgaagccagaggctactcttatatggacatttgtgatgtatgccctgagaagctgccaaattatgagaccaagataaagaatttctttgaagaacacctgcatactgacgaagaaatacgctattgtcttgagggaagtggatacttcgatgtgagagaccagaatgaccagtggattcgtgtagcagtgaagaaaggaggcatgattgttttncctgctggaatgtatcatcgcttcacattggacagtaacaactacattaaggcaatgcggctctttgtnggtgancctgttnggacacgtacaaccgtccccannatcatctgccagagaganaggantatctggacaaanttctcaantcggaaactngaaacntanccgttgaagnncgttnagngcgcctgaaccgagtgatcagganatngtgtgaacatcctnnntnagnanntcatanngncttcnggtcaccttcaacttgtacccctacatattcatatcttcaataaatactagggggaatcaggagctgatatggatgttaggtgcctgatggtgaacaaaaatgatacacatgctgacatgcactctgattccttgagtatgtactttttgtttggagatccacttggattatagtcaaaattttctcggttcctattgagcgtaatagggtagaaagctgtcctcccttgctaccacgctgaatctgggggaagttgagattacttgctgatagttcctgtgaacgaaagtgttccaaccattttctggaacagctcggtacacttcaggtccaatgtttaacctgtctgtgcatccttcccaattgaaaaagggttaggctcccaagg

SEQ ID NO: 3398 - DNA, 1085 bp, Musa acuminata
ctcatccttcatccgccgatacatcaacagattcatcggtgtcaagcctaaggcgacaagagtatgcttcacgttaactatcgctatccgacggaacaacggaatcgagtggcccggctacttcttatgtggttcgacgtcctcggcgtcccctcaacgcgaccgataagctgggaaggaagcgagatggagacggcgtttcaggatggcaaggaggaagttatccaagcttggtatatggatgacagtgaggaagaccagagacttccccatcaccgtgaacccaaggaatttgtttcattggacaagcttgcagaactgggaattgtcagctggcgcctgaatcctgatgactatgagaatgatgaggatttgaaaaagatccgtgaagccaggggatattcttacacggatatatgtgatgtgtgcccagaaaagttgccaaattatgaggctaagctgaagagtttctttgaagagcacctgcatacagatgaagaaatacgttattgccttgaaggaagtggttattttgatgtgagagacaaaaatgaatgctggataaggatagcagtgaaaaaaggaggcatgatcgtcttacctgctggaatctatcatcgtttcacacttgatacgaacaactatattaaggcgatgcggctctttgtcggtgagccagtttggacaccctataaccgtccccatgatcatctccctgccaggcaagaatatcttaactcttttgttatcaatgaagctggtgaccgggctgtcgaagctcgttgatgtctacggaggaccaaatcccggaccattaaatgtgaagcccgaagaaaatgtgcttaaataataataacaacttgttttttatgtctatgaagttgttgaatttgatggcaaatatcaacctatttaaaaactgcttgtggtcattaatgtagttcatgttatggagtggtttgctaaaggaatggtgatgtttgtatgctatatcctatgccatagttaggacagcagagttttctatctgctctgtagagtaattattgtagccttagaaatctaactcgagtcagtgtacttta

SEQ ID NO: 3399 - DNA, 2172 bp, Brachypodium distachyon
ttgtccttattttctatgcttgcataagcacttgccagcccattccagacttccagttccagttcgcccgcttcacaaatatagcagccggggcaaggaggggagaggcagagtctggggggggggggagacttcaaccccaaggacgccacaagggaaggggacaatttatatataggtgaggcattgcagttgggtagagcattgcttctgtgtggtggtggtggtgcagacagaactagctaagctctgcttggggagtaagaggagaggagcatatagaagttttgggaagatggccggaggcggtgtgggcgcgctgggagtgaagaaggagagggcggcggagtacaagggccgcatgacatgggccgtcgccatggcctgcctcgtcgccgccgtcgggggcgccatcttcggctacgacatcgggatctccggaggagtgacctccatggacccgttcctggagaagttcttcccggtggtgttccggcggaagaactcgggccaccagaacaactactgcaagtacgacaaccagggcctctcggccttcacctcctccctgtacctcgcaggcctcgtctcctccctcgtcgcctcgcccgtgacgaggaattacggccggcgcgccagcatcgtctgcggcggcgtcagcttcctcatcggcgccgtcctcaatgtggccgccgtgaacctcgccatgctcatcctcggccgcatcatgctcggcgtcggcatcggttttggcaaccagggcgtgccgctgtacctgtcggagatggcgccggcgcacctccggggcgggctgaacatgatgttccagctggcgacgacgctgggcatcttcacggcgaacatgatcaactacggcacgcagaacctcaagccctgggggtggcgcctctcgctgggcctcgctgcggctccggcgctgctgatgaccgtgggcgggctgctccttccggagacgcccaacagcctgatcgagcgcgggcgcgcccaggaagggcggcgcgtgctggagcgcatccggggcacggcggacgtggacgcggagttcacggacatggcggaggccagcgagctggccaacacgatcgagcacccgttccggaacatcctggagccccggaaccggccgcagctggtgatggcggtgtgcatgccggcgttccagatcctgacggggatcaactccatcctcttctacgcgcccgtgctgttccagaccatgggcttcggcgccgacgcctcgctctactcctccgtcatcaccggcgccgtgctcttcttctccacgctcatctccatcgccaccgtcgaccgcctcggccgccgcaagctcctcatcagcggcggcatccagatgatcgtctgccaggtgatcgtggcggtgatactaggggtgaagttcgggacggacaagcagctgacacggagctactcggtggcggtggtggtggtgatctgcctgttcgtgatggcgttcgggtggtcgtgggggccgctggggtggacggtgccgagcgagatcttcccgctggagacccggtcggcggggcagagcatcacggtggccgtcaacctcttcttcaccttcgtcatcgcgcaggccttcctctcgctgctctgcgccttcaagttcggcatcttcctcttcttcgccggctggatcgccgtcatgaccgtcttcgtctacgtcttcctgccggagaccaagggcgtgcccatcgaggagatggtgctgctctggaggaagcactggttctggaagaaggtcatgccggacatgccgctccacgaggaggacgggtggggtggagcaggggatggtgcgcgtgctcatcacaagtgaacacacaagagtacatagtacaacattagctgaggagttgtgcatttatatggttcggtttatgtgtatgttgtagtggtgtaacttggagttaatcttccctttcaaaagaaaaagtaacttgtagtagttcttgttgttacttgtgacagaaggaaattcgaaggtagcatcttcaggtatgatcatattcaccccctttgtatccacatttcacaccctgtctgtttaaaactttatgatgtgcttgtacatttagaaagtaaaatactgcgaattgggattatgacttgagttgaaagttgcgacaa

SEQ ID NO: 3400 - DNA, 2103 bp, Brachypodium distachyon
cttccagttccagttcgcccgcttcacaaatatagcagccggggcaaggaggggagaggcagagtctggggggggggggagacttcaaccccaaggacgccacaagggaaggggacaatttatatataggtgaggcattgcagttgggtagagcattgcttctgtgtggtggtggtggtgcagacagaactagctaagctctgcttggggagtaagaggagaggagcatatagaagttttgggaagatggccggaggcggtgtgggcgcgctgggagtgaagaaggagagggcggcggagtacaagggccgcatgacatgggccgtcgccatggcctgcctcgtcgccgccgtcgggggcgccatcttcggctacgacatcgggatctccggaggagtgacctccatggacccgttcctggagaagttcttcccggtggtgttccggcggaagaactcgggccaccagaacaactactgcaagtacgacaaccagggcctctcggccttcacctcctccctgtacctcgcaggcctcgtctcctccctcgtcgcctcgcccgtgacgaggaattacggccggcgcgccagcatcgtctgcggcggcgtcagcttcctcatcggcgccgtcctcaatgtggccgccgtgaacctcgccatgctcatcctcggccgcatcatgctcggcgtcggcatcggttttggcaaccagggcgtgccgctgtacctgtcggagatggcgccggcgcacctccggggcgggctgaacatgatgttccagctggcgacgacgctgggcatcttcacggcgaacatgatcaactacggcacgcagaacctcaagccctgggggtggcgcctctcgctgggcctcgctgcggctccggcgctgctgatgaccgtgggcgggctgctccttccggagacgcccaacagcctgatcgagcgcgggcgcgcccaggaagggcggcgcgtgctggagcgcatccggggcacggcggacgtggacgcggagttcacggacatggcggaggccagcgagctggccaacacgatcgagcacccgttccggaacatcctggagccccggaaccggccgcagctggtgatggcggtgtgcatgccggcgttccagatcctgacggggatcaactccatcctcttctacgcgcccgtgctgttccagaccatgggcttcggcgccgacgcctcgctctactcctccgtcatcaccggcgccgtgctcttcttctccacgctcatctccatcgccaccgtcgaccgcctcggccgccgcaagctcctcatcagcggcggcatccagatgatcgtctgccaggtgatcgtggcggtgatactaggggtgaagttcgggacggacaagcagctgacacggagctactcggtggcggtggtggtggtgatctgcctgttcgtgatggcgttcgggtggtcgtgggggccgctggggtggacggtgccgagcgagatcttcccgctggagacccggtcggcggggcagagcatcacggtggccgtcaacctcttcttcaccttcgtcatcgcgcaggccttcctctcgctgctctgcgccttcaagttcggcatcttcctcttcttcgccggctggatcgccgtcatgaccgtcttcgtctacgtcttcctgccggagaccaagggcgtgcccatcgaggagatggtgctgctctggaggaagcactggttctggaagaaggtcatgccggacatgccgctccacgaggaggacgggtggggtggagcaggggatggtgcgcgtgctcatcacaagtgaacacacaagagtacatagtacaacattagctgaggagttgtgcatttatatggttcggtttatgtgtatgttgtagtggtgtaacttggagttaatcttccctttcaaaagaaaaagtaacttgtagtagttcttgttgttacttgtgacagaaggaaattcgaaggtagcatcttcaggtatgatcatattcaccccctttgtatccacatttcacaccctgtctgtttaaaactttatgatgtgcttgtacatttagaaagtaaaatactgcgaattgggattatgact

SEQ ID NO: 3401 - DNA, 2102 bp, Setaria italica
ggccatcccatattcccatcccccaacttgccgctggcagtagcggctacgctgtccgcgttcacttcactcgccttcgcctggcattatcatctctgcctgagccggtcaagagctgccagggaggtcaagccctgccggtctgctcctcctacatatatccgcgggggggcttgccgttggttggaccactgcttcggtgtggcgttggcgcggttggtagctcgcttcttcatcctcggtccagagccagcaggccagttcttggagagcagaggagaggcggaggagcgagctcgcggcaaaaggcggagagatggcgggcggcggggtggccgcgctgggggtgaacacggagcgcgcggcgcagtacaagggccgcatgacgctcgccgtcgccatgacctgcctcgtcgccgccgtcgggggagccatcttcggctacgacatcggcatctccggaggagtgacatcgatggacccatttctgaagaagttcttcccggcggtgtaccataggaagaactccggcagccagaacaactactgcaagtacgacaaccagggcctggcggcgttcacctcctcactgtacctcgccggcctcgtctcctccctcgcggcgtcccccgtcacgaggaactacggccgcaaagccagcatcgtctgcggcggcatcagcttcctcgtcggcgccacgctcaacgtcgccgccgtgaacctggccatgctcatcctcggtcgcatcatgctcggcgtcggaatcggtttcggcaaccaggctgtgccgctgtacctgtcggagatggcgccggcgcacctccgcggcgggctgaacatgatgttccagctcgcgacgacgctgggcatcttcacggcgaacctgatcaactacggcacgcagaacatcaagccgtggggttggcggctgtcgctgggtctggcggcggcgccggcgatgctgatgaccctgggcgggctgctcctcccggagacgcccaacagcctcatcgagcgcgggcgcgtggaggaggggcggcgcgtgctggagcgcatccgcggcacggccgacgtggacgccgagttcacggacatggtggaggcgagcgagctggccaacaccatcgagcacccgttccggaacatcctggagcggcgcaaccggccgcagctggtgatggccgtgtgcatgccggcgttccagatcctgacgggcatcaactccatcctcttctacgcgcccgtcctgttccagagcatgggcttcggcgggaacgcgtcgctctactcctccgtgctcaccggcgccgtgctcttctcctccacgctcatctccatcggcaccgtcgaccgcctcggccgccggaagctcctcatcagcggcgggatccagatgatcgtctgccaggtgatcgtggcggtgatcctgggcgtgaagttcggggcggacaagcagctgtcccggagctactcgatcgcggtggtggtggtgatctgcctgttcgtgctggcgttcgggtggtcgtggggcccgctggggtggacggtgccgagcgagatcttcccgctggagacgcggtcggcggggcagagcatcacggtggccgtgaacctgctcttcaccttcgccatcgcgcaggcgttcctgtcgctgttgtgcgccttcaagttcggcatcttcctcttcttcgcggggtggatcaccgtcatgaccgtcttcgtatacgtcttcctcccggagaccaagggcgtgcccatcgaggagatggtgctgctctggcgcaagcactggttctggaagaaggtcatgccggacatgccgcttgaggacggctggggcgcggctgggggtcacgctgccaataacagccacaagtgaagaagcatacgagtggtttcatgtagtactccctagatgacgaggcagagtgagctgtaggaggaatggaggatgtttatcattgtatccagcttatgtgaaagttgtatgtagtttcatggtgtgcgtggcgacagcggtaaaagtgcaagcatcttcagtcattctttttttcctcacctacattaccatagttgcagagacatacacttcatactcatat

SEQ ID NO: 3402 - DNA, 2128 bp, Setaria italica
ccatattcccatcccccaacttgccgctggcagtagcggctacgctgtccgcgttcacttcactcgccttcgcctggcattatcatctctgcctgagccggtcaagagctgccagggaggtcaagccctgccggtctgctcctcctacatatatccgcgggggggcttgccgttggttggaccactgcttcggtgtggcgttggcgcggttggtagctcgcttcttcatcctcggtccagagccagcaggccagttcttggagagcagaggagaggcggaggagcgagctcgcggcaaaaggcggagagatggcgggcggcggggtggccgcgctgggggtgaacacggagcgcgcggcgcagtacaagggccgcatgacgctcgccgtcgccatgacctgcctcgtcgccgccgtcgggggagccatcttcggctacgacatcggcatctccggaggagtgacatcgatggacccatttctgaagaagttcttcccggcggtgtaccataggaagaactccggcagccagaacaactactgcaagtacgacaaccagggcctggcggcgttcacctcctcactgtacctcgccggcctcgtctcctccctcgcggcgtcccccgtcacgaggaactacggccgcaaagccagcatcgtctgcggcggcatcagcttcctcgtcggcgccacgctcaacgtcgccgccgtgaacctggccatgctcatcctcggtcgcatcatgctcggcgtcggaatcggtttcggcaaccaggctgtgccgctgtacctgtcggagatggcgccggcgcacctccgcggcgggctgaacatgatgttccagctcgcgacgacgctgggcatcttcacggcgaacctgatcaactacggcacgcagaacatcaagccgtggggttggcggctgtcgctgggtctggcggcggcgccggcgatgctgatgaccctgggcgggctgctcctcccggagacgcccaacagcctcatcgagcgcgggcgcgtggaggaggggcggcgcgtgctggagcgcatccgcggcacggccgacgtggacgccgagttcacggacatggtggaggcgagcgagctggccaacaccatcgagcacccgttccggaacatcctggagcggcgcaaccggccgcagctggtgatggccgtgtgcatgccggcgttccagatcctgacgggcatcaactccatcctcttctacgcgcccgtcctgttccagagcatgggcttcggcgggaacgcgtcgctctactcctccgtgctcaccggcgccgtgctcttctcctccacgctcatctccatcggcaccgtcgaccgcctcggccgccggaagctcctcatcagcggcgggatccagatgatcgtctgccaggtgatcgtggcggtgatcctgggcgtgaagttcggggcggacaagcagctgtcccggagctactcgatcgcggtggtggtggtgatctgcctgttcgtgctggcgttcgggtggtcgtggggcccgctggggtggacggtgccgagcgagatcttcccgctggagacgcggtcggcggggcagagcatcacggtggccgtgaacctgctcttcaccttcgccatcgcgcaggcgttcctgtcgctgttgtgcgccttcaagttcggcatcttcctcttcttcgcggggtggatcaccgtcatgaccgtcttcgtatacgtcttcctcccggagaccaagggcgtgcccatcgaggagatggtgctgctctggcgcaagcactggttctggaagaaggtcatgccggacatgccgcttgaggacggctggggcgcggctgggggtcacgctgccaataacagccacaagtgaagaagcatacgagtggtttcatgtagtactccctagatgacgaggcagagtgagctgtaggaggaatggaggatgtttatcattgtatccagcttatgtgaaagttgtatgtagtttcatggtgtgcgtggcgacagcggtaaaagtgcaagcatcttcagtcattctttttttcctcacctacattaccatagttgcagagacatacacttcatactcatatcatggcataggaaacaaaggtaaaatattcttc

SEQ ID NO: 3403 - DNA, 2065 bp, Setaria italica
tctctgcctgagccggtcaagagctgccagggaggtcaagccctgacggcctgccctcgaacgggggagagggaagaagggagatacaccccgctcctcctacatatatccgcgggggggcttgccgttggttggaccacagcttcggtgtggcgttggcgcggttggtagctcgcttcttcatcctcggtccagagccagcaggccagttcttggagaccagaggagaggcggaggagcgagctcgcggcaaaaggcggagagatggcgggcggcggggtggccgcgctgggggtgaacacggagcgcgcggcgcagtacaagggccgcatgacgctcgccgtcgccatgacctgcctcgtcgccgccgtcgggggagccatcttcggctacgacatcggcatctccggaggagtgacatcgatggacccatttctgaagaagttcttcccggcggtgtaccataggaagaactccggcagccagaacaactactgcaagtacgacaaccagggcctggcggcgttcacctcctcactgtacctcgccggcctcgtttcctccctcgcggcgtctcccgtcacgaggaactacggccgcaaagccagcatcgtctgcggcggcatcagcttcttcgtcggcgccacgctcaacgtcgccgccgtgaacctggccatgctcatcctcggccgcatcatgctcggcgtcggaatcggtttcggcaaccaggctgtgccgctgtacctgtcggagatggcgccggcgcacctccgcggcgggctgaacatgatgttccagctcgcgacgacgctgggcatcttcacggcgaacctgatcaactacggcacgcagaacatcaagccgtggggttggcggctgtcgctgggcctggcggcggcgccggcgatgctgatgaccctgggcgggctgctcctcccggagacgcccaacagcctcatcgagcgcgggcgcgtggaggaggggcggcgcgtgctggagcgcatccgcggcacggccgacgtggacgccgagttcacggacatggtggaggcgagcgagctggccaacaccatcgagcacccgttccggaacatcctggagcggcgcaaccggccgcagctggtgatggccgtgtgcatgccggcgttccagatcctgacgggcatcaactccatcctcttctacgcgcccgtcctgttccagagcatgggcttcggcgggaacgcgtcgctctactcctccgtgctcaccggcgccgtgctcttctcctccacgctcatctccatcggcaccgtcgaccgcctcggccgccggaagctcctcatcagcggcgggatccagatgatcgtctgccaggtgatcgtggcggtgatcctgggcgtgaagttcggggcggacaagcagctgtcccggagctactcgatcgcggtggtggtggtgatctgcctgttcgtgctggcgttcgggtggtcgtggggcccgctggggtggacggtgccgagcgagatcttcccgctggagacgcggtcagcggggcagagcatcacggtggccgtgaacctgctcttcaccttcgccatcgcgcaggcgttcctgtcgctgctgtgcgccttcaagttcggcatcttcctcttcttcgcggggtggatcaccgtcatgaccgtcttcgtatacgtcttcctcccggagaccaagggcgtgcccatcgaggagatggtgctgctctggcgcaagcactggttctggaagaaggtcatgccggacatgccgcttgaggacggctggggcgcggctgggggtcacgctggcaacaacagccataagtgaagaagcataagagtggtttcatgtagttctccctagatgacgaggcagagtgagctgccagcttatgtgaaagttgtatgtagttccatggtgtgcgtggcgacagcggtaaaagtgcaagcatcttcagtcattcttttttttttcctcacctacattaccatagttgcagagaaatacacttcatatccatatcatggcataagaaacaaaggtaaaatattcttcaaaatttgat

SEQ ID NO: 3404 - DNA, 2382 bp, Setaria italica
tgagagaattcactcgtcatttattgagcggagagtgagagacacgcgcatcaccctcgctcggcatcgctggccacggtgaggtgcccgagccgcgggagatgggtcaaggtcaacgctcaacggccgggcagaacgtatctctacagccaggccgacgcacgcgttcactgtccgcgcctgctctggctcgcggcttacgtaggcaaccgcagcccccatccggcgaccatcccatcccccaacttgccgctggcagtagcggctacgctgtccgcgttcacttcactcgccttcgccttcgcttggcattatcatctctgcctgagccggtcaagagctgccagggaggtcaagccctgacggcctgccctcgaacgggggagagggaagaagggagatacaccccgctcctcctacatatatccgcgggggggcttgccgttggttggaccacagcttcggtgtggcgttggcgcggttggtagctcgcttcttcatcctcggtccagagccagcaggccagttcttggagaccagaggagaggcggaggagcgagctcgcggcaaaaggcggagagatggcgggcggcggggtggccgcgctgggggtgaacacggagcgcgcggcgcagtacaagggccgcatgacgctcgccgtcgccatgacctgcctcgtcgccgccgtcgggggagccatcttcggctacgacatcggcatctccggaggagtgacatcgatggacccatttctgaagaagttcttcccggcggtgtaccataggaagaactccggcagccagaacaactactgcaagtacgacaaccagggcctggcggcgttcacctcctcactgtacctcgccggcctcgtttcctccctcgcggcgtctcccgtcacgaggaactacggccgcaaagccagcatcgtctgcggcggcatcagcttcttcgtcggcgccacgctcaacgtcgccgccgtgaacctggccatgctcatcctcggccgcatcatgctcggcgtcggaatcggtttcggcaaccaggctgtgccgctgtacctgtcggagatggcgccggcgcacctccgcggcgggctgaacatgatgttccagctcgcgacgacgctgggcatcttcacggcgaacctgatcaactacggcacgcagaacatcaagccgtggggttggcggctgtcgctgggcctggcggcggcgccggcgatgctgatgaccctgggcgggctgctcctcccggagacgcccaacagcctcatcgagcgcgggcgcgtggaggaggggcggcgcgtgctggagcgcatccgcggcacggccgacgtggacgccgagttcacggacatggtggaggcgagcgagctggccaacaccatcgagcacccgttccggaacatcctggagcggcgcaaccggccgcagctggtgatggccgtgtgcatgccggcgttccagatcctgacgggcatcaactccatcctcttctacgcgcccgtcctgttccagagcatgggcttcggcgggaacgcgtcgctctactcctccgtgctcaccggcgccgtgctcttctcctccacgctcatctccatcggcaccgtcgaccgcctcggccgccggaagctcctcatcagcggcgggatccagatgatcgtctgccaggtgatcgtggcggtgatcctgggcgtgaagttcggggcggacaagcagctgtcccggagctactcgatcgcggtggtggtggtgatctgcctgttcgtgctggcgttcgggtggtcgtggggcccgctggggtggacggtgccgagcgagatcttcccgctggagacgcggtcagcggggcagagcatcacggtggccgtgaacctgctcttcaccttcgccatcgcgcaggcgttcctgtcgctgctgtgcgccttcaagttcggcatcttcctcttcttcgcggggtggatcaccgtcatgaccgtcttcgtatacgtcttcctcccggagaccaagggcgtgcccatcgaggagatggtgctgctctggcgcaagcactggttctggaagaaggtcatgccggacatgccgcttgaggacggctggggcgcggctgggggtcacgctggcaacaacagccataagtgaagaagcataagagtggtttcatgtagttctccctagatgacgaggcagagtgagctgccagcttatgtgaaagttgtatgtagttccatggtgtgcgtggcgacagcggtaaaagtgcaagcatcttcagtcattcttttttttttcctcacctacattaccatagttgcagagaaatacacttcatatccatatcatggcataagaaacaaaggtaaaatattcttcaaaatttgat

SEQ ID NO: 3405 - DNA, 2239 bp, Sorghum bicolor
cgcctgtccgcttgctcgcggcttatgtaggcaaccgcagacccatcctcagcttgctggctctgtctgtctgctgtccccattcacttcccttcactcgccttcgccaagacccaggagtagtgttgagagtggcaggtcaagaaggcaagacggaagagccagccaaccgaaggatcaacaacgctgcatcacgccgagaccggcacggcaggctccgtttctacatatacttgtggtctgcgcggaggggcggtcgtcagttagagcattgcttccgtgtggtgtggtgtggtgtggctggtagctcggctcgtctttgagcagagcagagcagagagagaaagggagggagccagcagcacccggcagcagcgatggcgggcggcgggatggcggcgctgggcgtgaagacggagcgcgcggcgcagtacaagggccgcatgacgctggccgtcgccatgacctgcctcgtcgccgccgtcgggggcgccatcttcggctacgacatcggcatctccggaggagtgacatccatggacccatttctggagaaattcttcccggtggtgttccacaggaagaactccggcgggaagaacaactactgcaagtacgacaaccaggggctggcggcgttcacctcctcgctctacctcgccggcctcgtggcctccctggtggcgtcccccgtgactcggaactacggccgcaaagccagcatcgtctgcggcggcgtcagcttcctgatcggcgcggcgctcaacgtggccgccgtgaacctggccatgctcatcctcgggcgcatcatgctgggcgtcggcatcggtttcggcaaccaggccgtgccgctgtacctgtcggagatggcgccggcgcacctccgcggcgggctgaacatgatgttccagctcgcgacgacgctgggcatcttcacggcgaacctgatcaactacggcacgcagaacatcaagccgtgggggtggcgtctgtcgctgggcctggcggcggcgccggcgctgctgatgacgctggccgggctgttcctcccggagacgcccaacagcctcatcgagcgcgggcgcgtggaggagggccggcgcgtgctggagcgcatccggggcaccgccgacgtggacgccgagttcacggacatggtggaggcgagcgagctggccaacaccatcgagcacccgttccggaacatcctggagccccgcaaccggccgcagctggtgatggccgtgtgcatgccggcgttccagatcctgacggggatcaactccatcctcttctacgcgccggtgctgttccagagcatgggcttcggcagcaacgcgtccctctactcctccgtgctcaccggcgccgtgctcttctcctcgacgctcatctccatcggcaccgtcgaccgcctcggccgccggaagctcctcatcagcggcgggatccagatgatcgtctgccaggtgatcgtggcggtgatcctgggcgccaagttcggggcggacaagcagctgtcgcggagctactcgatcgcggtggtggtggtgatctgcctgttcgtgctggcgttcgggtggtcgtggggcccgctggggtggacggtgccgagcgagatcttcccgctggagacgcggtcggcggggcagagcatcacggtggccgtgaacctgctcttcaccttcgccatcgcgcaggcgttcctgtcgctgctgtgcgccttcaagttcggcatcttcctcttcttcgccgggtggatcaccgtcatgaccgtcttcgtctgcgtcttcctgccggagaccaagggcgtgcccatcgaggagatggtgctgctctggcggaagcactggttctggaagaaggtcatgccggcggacatgccgctcgaggatggctggggcgccgcacctgccaccaacaatcacaagtgaagacagcatgcgtgcttgctttcgtggacattattacagtataaccaaagaaaacgaggcacacacactgacatgtactcctaggcggatgcttattcatattgtaatctgtatgtaagcaggttgtgtggtgatacgcgaatgagacgttcggtttgtgcgtgcttgttctttacttttttttaacaatatataaattagacacacataacctatacactccacactcgtcacaccacatgcgtctgttttcccctttccccatttttataaagggtgaccggcgatttctagggttggtcgag

SEQ ID NO: 3406 - DNA, 2235 bp, Sorghum bicolor
gcctgtccgcttgctcgcggcttatgtaggcaaccgcagacccatcctcagcttgctggctctgtctgtctgctgtccccattcacttcccttcactcgccttcgccaagacccaggagtagtgttgagagtggcaggtcaagaaggcaagacggaagagccagccaaccgaaggatcaacaacgctgcatcacgccgagaccggcacggcaggctccgtttctacatatacttgtggtctgcgcggaggggcggtcgtcagttagagcattgcttccgtgtggtgtggtgtggtgtggctggtagctcggctcgtctttgagcagagcagagcagagagagaaagggagggagccagcagcacccggcagcagcgatggcgggcggcgggatggcggcgctgggcgtgaagacggagcgcgcggcgcagtacaagggccgcatgacgctggccgtcgccatgacctgcctcgtcgccgccgtcgggggcgccatcttcggctacgacatcggcatctccggaggagtgacatccatggacccatttctggagaaattcttcccggtggtgttccacaggaagaactccggcgggaagaacaactactgcaagtacgacaaccaggggctggcggcgttcacctcctcgctctacctcgccggcctcgtggcctccctggtggcgtcccccgtgactcggaactacggccgcaaagccagcatcgtctgcggcggcgtcagcttcctgatcggcgcggcgctcaacgtggccgccgtgaacctggccatgctcatcctcgggcgcatcatgctgggcgtcggcatcggtttcggcaaccaggccgtgccgctgtacctgtcggagatggcgccggcgcacctccgcggcgggctgaacatgatgttccagctcgcgacgacgctgggcatcttcacggcgaacctgatcaactacggcacgcagaacatcaagccgtgggggtggcgtctgtcgctgggcctggcggcggcgccggcgctgctgatgacgctggccgggctgttcctcccggagacgcccaacagcctcatcgagcgcgggcgcgtggaggagggccggcgcgtgctggagcgcatccggggcaccgccgacgtggacgccgagttcacggacatggtggaggcgagcgagctggccaacaccatcgagcacccgttccggaacatcctggagccccgcaaccggccgcagctggtgatggccgtgtgcatgccggcgttccagatcctgacggggatcaactccatcctcttctacgcgccggtgctgttccagagcatgggcttcggcagcaacgcgtccctctactcctccgtgctcaccggcgccgtgctcttctcctcgacgctcatctccatcggcaccgtcgaccgcctcggccgccggaagctcctcatcagcggcgggatccagatgatcgtctgccaggtgatcgtggcggtgatcctgggcgccaagttcggggcggacaagcagctgtcgcggagctactcgatcgcggtggtggtggtgatctgcctgttcgtgctggcgttcgggtggtcgtggggcccgctggggtggacggtgccgagcgagatcttcccgctggagacgcggtcggcggggcagagcatcacggtggccgtgaacctgctcttcaccttcgccatcgcgcaggcgttcctgtcgctgctgtgcgccttcaagttcggcatcttcctcttcttcgccgggtggatcaccgtcatgaccgtcttcgtctgcgtcttcctgccggagaccaagggcgtgcccatcgaggagatggtgctgctctggcggaagcactggttctggaagaaggtcatgccggcggacatgccgctcgaggatggctggggcgccgcacctgccaccaacaatcacaagtgaagacagcatgcgtgcttgctttcgtggacattattacagtataaccaaagaaaacgaggcacacacactgacatgtactcctaggcggatgcttattcatattgtaatctgtatgtaagcaggttgtgtggtgatacgcgaatgagacgttcggtttgtgcgtgcttgttctttacttttttttaacaatatataaattagacacacataacctatacactccacactcgtcacaccacatgcgtctgttttcccctttccccatttttataaagggtgaccggcgatttctagggttggtc

SEQ ID NO: 3407 - DNA, 1659 bp, Saccharum officinarum
cagcgatggcgggcggcgggatggcggcgctgggcgtgaagacggagcgcgcggcgcagtacaagggccgcatgacgctcgccgtcgccatgacctgcctcgtcgccgccgtcgggggcgccatcttcggctacgacatcggcatctccggaggtgtgacatccatggacccatttctggagaaattcttcccggtggtgttccacaggaagaactccggcgggaagaataactactgcaagtacgacaaccaggggcttgcggcgttcacctcctcgctctacctcgccggcctcgtggcgtccctcgtcgcgtcccccgtgacgaggaactacggccgcaaagccagcatcgtctgcggcggcgtcagcttcctcatcggcgcggcgctcaacgtggccgccgtgaacctggccatgctcatcctcgggcgcatcatgctcggcgtcggcatcggtttcggcaaccaggccgtgccgctgtacctgtcggagatggcgccggcgcacctccgcggcgggctgaacataatgttccagctcgcgacgacgctgggcatcttcacggcgaacctgatcaactacggcacgcagaacatcaagccgtgggggtggcgtctgtcactgggcctcgccgcggcgccggcgctgctgatgacgctggccgggctgttcctcccggagacgcccaacagcctcatcgagcgcgggcgcgtggaggagggccggcgcgtgctggagcgcatccggggcaccgccgacgtggacgcggagttcacggacatggtggaggcgagcgagctggccaacaccatcgagcacccgttccggaacatcctggagccgcgcaaccggccgcagctggtgatggccgtgtgcatgccggcgttccagatcctgacggggatcaactccatcctcttctacgcgccggtcctgttccagagcatgggcttcggcgggaacgcgtccctctactcctccgtgctcaccggcgccgtgctcttctcctcgacgctcatctccatcggcaccgtggaccgcctcggccgccggaagctcctcatcagcggcgggatccagatgatcgtgtgccaggtgatcgtggcggtgatcctgggcgccaagttcggggcggacaagcagctgtcgcggagctactcgatcgcggtggtggtggtgatctgcctgttcgtgctggcgttcgggtggtcgtggggcccgctggggtggacggtgccgagcgagatcttcccgctggagacgcggtcggcggggcagagcatcacggtggccgtgaacctgctcttcaccttcgccatcgcgcaggcgttcctgtcgctgctgtgcgccttcaagttcggcatcttcctcttcttcgccgggtggatcaccgtcatgaccgtcttcgtctgcgtcttcctgccggagaccaagggcgtgcccatcgaggagatggtgctgctctggcggaagcactggttctggaagaaggtcatgccggtggacatgccgctcgaggatggctggggcgccgcacctgccagcaacaatcacaagtgaagactgaggctgtgttcagatccaaaatttggtctaaagttgtcatcacatcgaatgtaatatagataaaaaaataactaatttcacagttaagtag

SEQ ID NO: 3408 - DNA, 2506 bp, Hordeum vulgare
ggatttgactcgggcaagcccaagccatcccgaaacgtggcatcactggcaaaactccacgactgccagcccgatcgccgctgtacacgtactgcagtgagcaaccaaccaactgtaaattttatacaagaagcgatttaatttgccgagagatcactccaagtcaacaaattacccacttggctgggtgtatatcttaccaatttattatgcagttggagccccgggtagattttatctggggctcgtctacgggtggaggcacacacagtgacatgtgtatctatctgcctgcagacgtcggccgccgagctgcacccgggtgactgacagcgggcccgcaccgcagccccccgccctcaggataggggtcaacgtcaacgcccggggctgcttatcgtctccaacgcacgcacagcatgctccggccttaacatcctgcaagaaatcgccgccagcccgctccctcactaatcatagtcatagagcctcacatcccggacaaggagaggagaggggagcaaggccaaggccaagggcatacagatacacggggggagagagacatctcacatctatatatggccgtggagtcgtagttggttgaagcattgcttcttcgtgccgagctctcctcctcccccttgcctcggcctcggcccttgctcgagctctcggagggaggatggcgggcggcggggtggccgcgctgggcgtgaagaaggagagggcggccgagtacaaggggcgcatgacgctggccgtcgccatggcctgcctcgtcgccgccgtcgggggctccatcttcggctacgacatcgggatctccggaggagtgacctccatggacccattcctggagaagttcttcccggtggtattccggcggaagaactccggccaccagaacaactactgcaagtacgacaaccagggcctctcggcattcacctcgtctctgtacctggccggcctggtctcctccctcgttgcctcgccggtgacgaggaactacggccgacgcgccagcattgtctgcggcggcatcagcttcctcatcggcgcgatcctcaacgtggcggccgtgaaccttgagatgctgatcctcggccgtatcatgctcggcgttggcatcggtttcggcaatcagggtgtgccgctgtatctgtcggagatggcgccggcgcacctccgcggcgggctgaacatgatgttccagctcgcgacgacgctcggcatcttcacggcgaacatggtgaactacggcacgcagaacctcaagccgtgggggtggcgcctctcgctcggcctcgcggcggcgccggcgctgctgatgaccgtgggcgggctgctcctgccggagacgcccaacagcctcatcgagcgcggtcgcgccgaggagggccggcgcgtcctggagcgcatccgcggcaccgcggacgtggacgccgagttcatggacatgtcggaggccagcgagctagccaacaccatcaagaacccgttccggaacatccttgagccgcgcaaccggccgcagctggtgatggccgtgtgcatgccggcgttccagatcctgacgggcatcaactccatcctgttctacgcgccggtgctgttccagaccatgggcttcggcgccagcgcggcgctctactcctccgtgatcaccggcgcggtgctcttcttgtctaccctcatctccatcgccaccgtcgaccgcctcggccggaggaagctcctcatcagcggcggcattcagatgatcgtttgccaggtgatcgtggcggtgatacttggggtgaagttcgggacggacaagcagctgtcgcggagctactcgatcgtggtggtggtggtgatctgcctgttcgtgatggcgttcgggtggtcgtgggggccgctggggtggacggtgccgagcgagatcttcccgctggagacgcggtcggcggggcagagcatcacggtggccgtcaacctcttcttcaccttcgtcatcgcgcaggcgttcctgtcgatgctctgcgccttcaagttcggcatcttcctcttcttcgccggctggatcacggtcatgaccgtgttcgtctacattttcctgccggagaccaagggcgtgcccatcgaggagatggtgctgctgtggaggaagcactggttctggaagaaggtgatgccggacatgccgctcgaggacgggtggggggaaggggacggcggccgtgctgacaacaagggacactagtgactagtgtgtgagtgaagatcatttggaatgggttgtgcattgtttgttggttgattagatcctgtaagacacagtttaacatgtactactacacatttggagtaggaggaatgccttttatatgcagtaatgcagcttatatatactatatactaaagccgcagcaattcggttttcctgatttttttgactttttttttaacattcactgttcatttttcacgtccatgtcaacatcagtgaacagtaatccag

SEQ ID NO: 3409 - DNA, 1860 bp, Triticum aestivum
gagaggatggcgggcggcggcatggccgcgctgggcgtgaagaaggagagggcggcggagtacaagggccgcatgacgctcgccgtcgccatggcctgcctcgtcgccgccgtcgggggctccatcttcggctacgacatcgggatctccggaggagtgacctccatggacccattcctggagaagttcttcccggtggtgttccggcggaagaactccggccaccagaacaactactgcaagtacgacaaccagggcctctcggccttcacctcctctctgtacctggccggcctggtctcctccctcgtcgcctcgccggtgacgaggaactacggccgacgcgccagcattgtctgcggcggcatcagcttcctcatcggcgcgatcctcaacgtggcggccgtgaacctcgagatgctgatcctcggtcgtatcatgctcggcgttggcatcggcttcggcaatcagggtgtgccgctgtacctgtcggagatggcgccggcgcacctccgcggcgggctgaacatgatgttccagctcgcgacgacgctcggcatcttcacggccaacatggtcaactacggcacgcagaacctcaagccgtgggggtggcgcctctcgctcggcctcgcggcggcgccggcgctgctgatgaccgtgggcgggctgctcctgccggagacgcccaacagcctcatcgagcgcgggcgcgccgaggagggccggcgcgtcctggagcgcatccgcggcacggcggacgtggacgcggagttcatggacatgtcggaggccagcgagctggccaacaccatcaagaacccgttccggaacatcctcgagccgcgcaaccggccgcagctggtgatggccgtgtgcatgccggcgttccagatcctgacgggcatcaactccatcctcttctacgcgccggtgctgttccagaccatgggcttcggcgccagcgcgtcgctctactcctccgtgatcaccggcgcggtgctcttcttgtctaccctcatctccatcgccaccgtcgaccgcctcggccggaggaagctcctcatcagcggcggcattcagatgatcgtttgccaggtgatcgtggcggtgatactcggggtgaagttcgggacggacaagcagctgtcgcggagctactcgatcgtggtggtggtggtgatctgcctcttcgtgatggcgttcgggtggtcgtgggggccgctggggtggacggtgccgagcgagatcttcccgctggagacgcggtcggcggggcagagcatcacggtggccgtcaacctcttcttcaccttcgtcatcgcgcaggcgttcctgtccatgctctgcgccttcaagttcggcatcttcctcttcttcgccgcctggatcacggtcatgaccgtgttcgtctacgtcttcctgccggagaccaagggcgtgcccatcgaggagatggtgctgctgtggaggaagcactggttctggaagaaggtgatgccggacatgccgctcgaggacggctggggagaaggggacggcgggcgtgctgacaacaaggctcaccagtgactagtgagtgaagatcatttggaatgagttgttgtgcattgttgctggttggttagatcctgtaagacacagtttaacatgtaagtaggcggaatgctttgtatatgcagcaatgcagcgtatgtttatgttatactgtaacttgtaccgtagtaacttagtacgtatactttatagtgcgcttggtgtgagcctggctttatatataaagccaaagcgtcaaaactgatacaaaatgatgagaaaatccgatacagatagatcaaaagaaaaatgatattcgagagg

SEQ ID NO: 3410 - DNA, 1926 bp, Secale cereale
gactgcgtgagttcttctccgttctcccctcgcctcgattcttgcttcggcggttcttggagaagagggcgcagagcttcgaggagagagatggcgggcggcggcatggccgcgctgggcgtgaagaaggagcgggcggcggagtacaagggccgcatgacgctggccgtcgccatggcctgcctcgtcgccgccgtcgggggctccatcttcggctacgacatcgggatctccggaggagtgacctccatggacccattcctggagaagttcttcccggtggtgttccggcggaagaactccggccaccagaacaactactgcaagtacgacaaccagggcctctcggcgttcacctcgtctctgtacctggccggcctggtctcctcccttgtcgcctcgccggtgacgaggaactacggccgacgcgccagcattgtctgcggcggcatcagcttcctcatcggcgcgatcctcaacgtggcggccgtgaaccttgagatgctgatcctcggtcgtatcatgctcggcattggcatcggtttcggcaatcagggcgtgccgctgtacctgtcggagatggcgccggcgcacctccgcggcgggctgaacatgatgttccagctcgcgacgacgctcggcatcttcacggcgaacatggtcaactacggcacgcagaacctcaagccgtgggggtggcgcctctcgctcggcctcgcggcggcaccggcgctgctgatgaccgtgggtgggttgctcctgccggagacgcccaacagcctcatcgagcgcgggcgcgccgaggagggccggcgcgtcctggagcgcatccgcggcaccgcggacgtcgacgccgagttcatggacatgtcggaggccagcgagctggcgaacaccatcaagaacccgttccggaacatcctcgagccgcgcaaccggccgcagctggtgatggccgtgtgcatgccggcgttccagatcctgacgggcatcaactccatcctgttctacgcgccggtgctgttccagaccatgggcttcggcgccagcgcgtcgctctactcctccgtgatcaccggcgcggtgctcttcttgtctaccctcatctccatcgccaccgtcgaccgcctcggccggaggaagctcctcatcagcggcggcattcagatgatcgtttgccaggtgatcgtggcggtgatactcggggtgaagttcgggacggacaagcagctgtcgcggagctactcgatcgtggtggtggtggtgatctgcctgttcgtgatggcgttcgggtggtcgtgggggccgctgggatggacggtgccgagcgagatcttcccgctggagacgcggtcggcggggcagagcatcacggtggccgtcaacctcttcttcaccttcatcatcgcgcaggcgttcctgtcgatgctctgcgccttcaagttcggcatcttcctcttcttcgccgcctggatcacggtcatgaccgtcttcgtctacgttttcctgccggagaccaagggcgtgcccatcgaggagatggtgctgctgtggaggaagcactggttctggaagaaggtgatgccggacatgccgctcgaggacggctggggaggaggggacggcgcgcgtgctgacagcaagggtcactagtgactagtgagtggtgaagatcatttggtatgagttgtgcattgttcgttagttagatcctgtaaacacagtttaacatgtaggcggaatgctccgtttgtatatgcaccaatgcagcgtatctttatgtttatgttaaaagttataacttgtacaccgtagtacagtacgtatagtttaccgaaaagtgattccccactttgtatttcaaagcaaccaacattgtacacattgcattaccgagacgagcaacacatcaagccaacaacagtc

SEQ ID NO: 3411 - DNA, 2077 bp, Zea mays
gtagacccatccccaacatgctggctctctgtgtcccccattcacttcacactctagactctagttcgccccatgagtctggcaggtcaaagaagggaagagacaaccgaaggatcaacggatcaagcgaggtagtcgactccgcgtctaattaaacctgtggtctgcggacgggcggtcgtcggttagagcattgcttccgtgtggtgcggttgatagctcggatcttctgctggccgagttcgtcttggaggagaagagagagagagagagagagagagagcgccgggatcggagccaggaagcatccagcagcgatggcgggcggaggggtggcggcgctgggcgtgaagacggagcgcgcggcgcagtacaaggggcgcatgacgctcgccgtcgccacgacctgcctcgtggccgccgtcgggggcgccatcttcggctacgacatcggcatctccggaggcgtgacatccatggacccattcctggagaaattcttcccggtagtgttccaccggaagaactccggcgggaagaacaactactgtaagtacgacaaccagggactagcggcgttcacatcgtcactctacctcgccggcctcgttgcctccctcgtcgcgtcccccgtgacgaggaactacggccgcaaagctagcattgtctgcggcggcgtgagcttcctcatcggcgcggccctcaacgtggccgccgtgaatctggctatgctcatcctcgggcgcatcatgctcggcgtcggcatcggttttggcaaccaggctgtgccgctgtacctgtcggagatggcgccggcgcacctccgcggcggcctgaacatgatgttccagctcgcgacgacgctgggcatcttcacggcgaacctgatcaactatggcacgcagaacatcaagccgtgggggtggcggctgtcgctgggcctcgcggcggtgccggcgctgctgatgacgttgggcgggctctttcttccggagactcccaacagcctcattgagcgcgggcgcgtggaggagggtcggcgcgtgctggagcgcatccggggcacggccgacgtggacgccgagttcacggacatggtggaggcgagcgagctggccaacaccgtcgagcacccgttccggaacatcctgcagccgcgcaaccggccgcagctggtgatggccgtgtgcatgccggcgttccagatcctgacgggcatcaactccatcctcttctacgcgccggtcctgttccagagcatgggtttcggcgggaacgcgtccctctactcctccgtgctcaccggcgccgtgctcttctcctcgacgctcatctccatcggcatcgtcgaccgcctcggccgccggaagctcctcatcagcggcgggatccagatgatcgtctgccaggtgatcgtggcggtgatcctgggcgtgaagttcggggcggagaagcaactggcgcggagctactcggtcgcggtggtggtggtgatctgcctgttcgttctggcgttcgggtggtcgtggggcccgctgggatggacggtgccgagcgagatcttcccgctggagacgcggtcggcggggcagagcatcacggtggccgtgaacctgctcttcaccttcgccatcgcgcaggcgttcctgtcgctgctgtgcgccttcaagttcggcatcttcctctttttcgcggggtggatcaccgtcatgaccgtgttcgtctacgtcttcctgccggagaccaagggcgtgcccatcgaagagatggtgctgctatggcggaagcactggttctggaagaaggtcatgccggacatgccgctcgaggatggctggggcgcggctgagggtcatgcggcacctgccagcaacaatcacaagggatgactggagtgaagcatgcatggttgcctggttggtttcgtggacactttatataataactgaagaaaacaagacacacactaacatgtaggcggctgcttattcttattgtattttgtataaagcaggctgtgtgatatgcagggataaaaacgaacgagatcgttccaaataacctctcttttgttttc

SEQ ID NO: 3412 - DNA, 2096 bp, Zea mays
gacccatccccaacatgctggctctctgtgtcccccattcacttcacactctagactctagttcgccccatgagtctggcaggtcaaagaagggaagagacaaccgaaggatcaacggatcaagcgaggtagtcgactccgcgtctaattaaacctgtggtctgcggacgggcggtcgtcggttagagcattgcttccgtgtggtgcggttgatagctcggatcttctgctggccgagttcgtcttggaggagaagagagagagagagagagagagagagcgccgggatcggagccaggaagcatccagcagcgatggcgggcggaggggtggcggcgctgggcgtgaagacggagcgcgcggcgcagtacaaggggcgcatgacgctcgccgtcgccacgacctgcctcgtggccgccgtcgggggcgccatcttcggctacgacatcggcatctccggaggcgtgacatccatggacccattcctggagaaattcttcccggtagtgttccaccggaagaactccggcgggaagaacaactactgtaagtacgacaaccagggactagcggcgttcacatcgtcactctacctcgccggcctcgttgcctccctcgtcgcgtcccccgtgacgaggaactacggccgcaaagctagcattgtctgcggcggcgtgagcttcctcatcggcgcggccctcaacgtggccgccgtgaatctggctatgctcatcctcgggcgcatcatgctcggcgtcggcatcggttttggcaaccaggctgtgccgctgtacctgtcggagatggcgccggcgcacctccgcggcggcctgaacatgatgttccagctcgcgacgacgctgggcatcttcacggcgaacctgatcaactatggcacgcagaacatcaagccgtgggggtggcggctgtcgctgggcctcgcggcggtgccggcgctgctgatgacgttgggcgggctctttcttccggagactcccaacagcctcattgagcgcgggcgcgtggaggagggtcggcgcgtgctggagcgcatccggggcacggccgacgtggacgccgagttcacggacatggtggaggcgagcgagctggccaacaccgtcgagcacccgttccggaacatcctgcagccgcgcaaccggccgcagctggtgatggccgtgtgcatgccggcgttccagatcctgacgggcatcaactccatcctcttctacgcgccggtcctgttccagagcatgggtttcggcgggaacgcgtccctctactcctccgtgctcaccggcgccgtgctcttctcctcgacgctcatctccatcggcatcgtcgaccgcctcggccgccggaagctcctcatcagcggcgggatccagatgatcgtctgccaggtgatcgtggcggtgatcctgggcgtgaagttcggggcggagaagcaactggcgcggagctactcggtcgcggtggtggtggtgatctgcctgttcgttctggcgttcgggtggtcgtggggcccgctgggatggacggtgccgagcgagatcttcccgctggagacgcggtcggcggggcagagcatcacggtggccgtgaacctgctcttcaccttcgccatcgcgcaggcgttcctgtcgctgctgtgcgccttcaagttcggcatcttcctctttttcgcggggtggatcaccgtcatgaccgtgttcgtctacgtcttcctgccggagaccaagggcgtgcccatcgaagagatggtgctgctatggcggaagcactggttctggaagaaggtcatgccggacatgccgctcgaggatggctggggcgcggctgagggtcatgcggcacctgccagcaacaatcacaagggatgactggagtgaagcatgcatggttgcctggttggtttcgtggacactttatataataactgaagaaaacaagacacacactaacatgtaggcggctgcttattcttattgtattttgtataaagcaggctgtgtgatatgcagggataaaaacgaacgagatcgttccaaataacctctcttttgttttcatttttacattttatttgggaa

SEQ ID NO: 3413 - DNA, 1916 bp, Secale cereale
gactagcgtgagttcttctccgttctcccctcgccccgattcttgcttcggcgctccttggagaggcgcgtagcttcgaggagagaggatggcgggcggcggcatggctgcgctgggcgtgaagaaggagagggcggccgagtacaagggccgcatgacgctggccgtcgccatggcctgcctcgtcgccgccgtcgggggctccatcttcggctacgacatcgggatctccggaggagtgacctccatggacccattcctggagaaattcttcccggtggtgttccggcggaagaactccggtcaccagaacaactattgtaagtacgacaaccagggcctctcggcattcacctcgtctctgtacctggccggcctggtctcctccctcgtcgcctcaccggtgacgaggaactacggccgacgcgccagcattgtctgcggcggcatcagcttcctcatcggcgcgatcctcaacgtggcggccgtgaaccttgagatgctgatcctcggtcgtatcatgctcggcattggcatcggtttcggcaatcagggtgtgccgctgtacctgtcggagatggcgccggcgcacctccgcgcgggctgaacatgatgttccagctcgcgacgacgctcggcatattcacagcgaacatgatcaactacggcacgcagaaaatcaagccgtgggggtggcgcctctcgctcggcctcgtagcggcgccggcgctgctgatgacggtgggcgggatcctcctaccggagacaccgaacagcctgatcgagcgcgggcacgtggaggagggccggcgcgtgctggagctgatacgcggcaccacggacgtcgacgccgagttcacagacatgacggaggctagtgaactggccaacacaatcaagcacccgttccggaacattctggagcggcgcaaccgtccgcagctggtgatggccgtgtgcatgccggcgtttcagatcctgacgggcatcaactccatcctgttctacgcaccggtgctgtttcagagcatgggcttcggcgccagctggtccctctactcgtctatgctcaccggcgccgtgctcttgttctcgacgctcatttccatcgccaccgtcgaccgcctcggcaggaggaagctcctcatcagcggcggcatccagatgatcgtttgccaggtgatcgtggcggcgatactgggggtaaagttcggctcagacaagcatctatcgcggggctgctcgatcgctgtggtgtcagtgatctgcctcttcatgctcgcgttcgggtggtcgtggggtcctctggggtggacggtgccgagcgagatctttccgctggagacgcggtcggcggggcagagcatcacggtggccgtcaacctcttcttcaccttcatcatcgcgcaggcgttcctgtcgctgctctgcgtcttcaaatacgccatcttcatcttcttcgccggctggatagccgtcatgaccgccttcgtctatgtcttcctgccggagacaaagggcgtgccgatcgaggagatggtgctgctctggagcaagcatagattctggaagaacatcatgccggcaatgccgacgatgccgctcgaggacggctggggacccggtgacggccgtggggatagtgctcttgcaggagctgattgcaacgttcataagtgaagatcattatcaacgaacaacgactgttttgataggagcacatgcacgcgtcgtacgtacgcttagatagcatgcgcagggcgtgatcaactgatcaccatttgtcctagcgtgcctaaggagacgcacatgcacatatatagtggtacaagtgtggtgttagtcatctccagtattttgtacgggcagtttgtgtatttgacctgtgctctctcggtctctttcgatcgatggag

SEQ ID NO: 3414 - DNA, 2067 bp, Panicum virgatum
tgcaagattctccaaatgtacggataggggaaaaaatagatatcttttatccccctctgttccaaatacacgacgcaaagaatgacaaaaggatgataaagtagacaaatgaatgaacaagcaaccaagagagtttttcattgatcctgagttcatatatatacatgacaaagggacaccatgaatgggtgcgtatgcacgcacacggcaaccgctcccaaggagcgggcgcttgctgcctcctgacaaacgtgtcaaggatgaggccatttgcgaatatctacagtgttccacatgccatgatttgtgatctctgatcctctaccaatctgactggccgaatgctgcaggaggagtgacctcgatggacccatttctggagaagttcttccccgcggtgttccataagaagaactccggcagcaagaacaactactgcaagtacgacaaccagggcctggcggcgttcacctcctcgctctacctcgccggcctcgtcgcctccctcgcggcgtcccccgtcaccaggaactacggccgcaaagccagcattgtctgcggcggcgtcagcttcctcgccggcgccacgctcaacgtcgccgccgtgaacctgcccatgctcatcctcgggcgcatcttgctcggcgtcggcatcggtttcggcaaccaggccgtgccgctgtacctgtcggagatggcgccggcgcacctccgcggcgggctgaacatgatgttccagctcgcgacgacgctgggcatcttcacggcgaacctgatcaactacggcacgcagaacatcaagccgtgggggtggcgcctgtcgctcgggctggccgcggtgccggcgctgctgatgaccctgggcgggctgctcctcccggagacgcccaacagcctcatcgagcgcgggcgcgccgaggagggccggcgcgtgctggagcgcatccgcggcaccgccgacgtggacgccgagtacacggacatggtggaggcgagcgagctggccaacaccatcgagcacccgttccggaacatcctggagcggcgcaaccggccgcagctggtgatggccgtgtgcatgccggcgttccagatcctgacgggcatcaactccatcctcttctacgcgccggtgctgttccagagcatgggcttcggcgggaacgcgtccctctactcctccgtgctcaccggcgccgtgctcttctcctccacgctcatctccatcggcaccgtcgaccgcctcggccgccggaagctcctcatcagcggcgggatccagatgatcgtctgccaggtgatcgtggcggtgatcctgggcgtcaagttcggggcggacaagcagctgtcccggagctactcaatcgcggtggtggtggtgatctgcctgttcgtgctggcgttcgggtggtcgtggggcccgctggggtggacggtgccgagcgagatcttcccgctggagacgcggtcggcggggcagagcatcacggtggccgtgaacctgctcttcaccttcgccgtcgcgcaggcgttcctgtcgctgctgtgcgccttcaagttcggcatcttcctcttcttcgccgggtggatcaccgtcatgaccgtcttcgtgtacatcttcctccccgagaccaagggcgtgcccatcgaggagatggtgctgctctggcgcaagcactggttctggaagaaggtcatgccggacatgccgctcgaggacggctggggcgcagctgagggcaacgctgcgcctgccgacaagaatcacaagtgacatagatagacttatgtgaaagctgagggggcagactgagcctgtagctgtaggaggatgtttactgtatccagcttatgtgtagttttcatgctggtgtgcatacttgtgcgtggcggcagcagtaagagtgtaaacatcttcagttgttctttttctcctcacctatattatcatagttgcggggggcatacatatacttcatacacatatcatgctgccataggaaacaaggcagaaatgctcttcaagccttgatgattttgtcattttgaattgaaagaaaaatttgt

SEQ ID NO: 3415 - DNA, 1920 bp, Hordeum vulgare
agcgcgcgcttcacttatgctgctatgtgtatagagagagagggagggagagagagctcttgttccttgggcttaacataggtacaaccctagcttgactgcaattccaggagaggagcaggagacgagacgagaggagaggagcaggagatatggctggcagcatggctccgctgggagtgaagaaggagagggcggcgcagtacaagggccacatgacgttcgccgtcgccatggcctgcatcgtcgccgccgtcgggggttccatcttcggctacgacatcgggatctccggagtgaacaccatggacccgttcctcgagaggttcttcccggcagtgttccggcggaagaacttggtgactcttaacaactactgtaagtacgataaccaagccctctccgccttcacctccatcctctacctctccggccaagtctctacacttgcggccgctcccgtgacaaggaactacgggcgccgcgccagcattatctgcgggggcatcagcttcctcatcggcgcagccctcaacgctgccgctgcgaacctcacgacgttgatcctcggccgcgtcatgcttggcgtcggcatcggtttcggcaatcaggctgtgccgctgtacttgtcggagatggcaccggcgcacctccgcggcgggctgaacatgatgttccagctcgcgacgacgcttggcatcttctcggcgaacatgatcaactacggaacgcagaaaatcaagccgtgggggtggcgcctctcgctcggcctcgtggcggcgccagcgttgctgatgactgtaggcgggctgctcctgccggagacaccgaacagcctcatcgagcgcgggcacgtcgaggagggccggcgcgtgctggagctgatccgcggcaccacggacgtcgacgccgagttcacagacatgacggaggcgagtgaactggcaaacacaatcaagcacccgttccggaacatcctggagcggcgcaaccgtccgcagctggtgatggccgtgtgcatgccggcgtttcagatcctgacgggcatcaactccatcctgttctacgcgccggtgctgttccaaagcatgggttttggggccagctggtccctctactcgtctatgctcaccggcgccgtgcttttgttctcgaccctcatttccatcgccaccgtcgaccgcctcggcaggaggaagctcctcatcagcggcggcatccagatgatcgtttgccagctgatcgtggcggcgatactgggggtaaagttcggctcagacaagcatctatcgcggggctgctcggtcgcggtggtgttcgtgatctgcctcttcatgctggcgtttgggtggtcgtggggtccgctagggtggacggtgccgagcgagatctttccgctggagacgcggtcggcggggcagagcatcacggtggccgtcaacctcttcttcaccttcgtcatcgcacaggcgttcctgtcgctgctctgcgtcttcaagtacgccatcttcatcttcttcgccggctggattgccatcatgaccgccttcgtctatgtcttcctgccggagaccaagggggtgcccatcgaggagatggtgctgctgtggagcaagcataggttctggaagaacatcatgccggcaatgccgacgatgccgctcgaggacggctggggacccggtgacgaccgtggggatagcgctgttgcggctgattgcagcatccacaaatcacaagtgaagatcattgtcgatgaacaatgaatgtgttgatcgaagcagatacacgcgtcgtacgcttggatagcatgcgatcgagatgcgtggttaatagtttgttattttcctagtgtgctaagagcatctacatcagacacgcgctagcgcggcatgtttaaaaaaatatacaactctgaaa

SEQ ID NO: 3416 - DNA, 1821 bp, Cucumis sativus
taaaagaaaggttcaagagaattgaaggttgaactgaggaagtcgtgaattttgtagagaagggaagaaaatggcaggtggatcttttgctcctgcaggagtggccaaggagagagcagagcagtacaaaggaagagtgacgccttatgtggttattgcttgtcttgtggctgccattggtggctcaatttttggttatgatattggaatttcaggtggggtgacatcgatgaatccgttccttaaaaaattctttccaacggtgtacagaaacaagatgcgtgcacacgaaaacaattactgcaagtacaataatcaagggcttgcagcatttacctcatccctatatcttgctggactagtttcctcattggtggcctcccccatcaccaggaactatgggcgccgtgcaagtatagtctgcggtggaattagctttcttgttggggcaactttaaatgcagccgccgtcaatattgaaatgctcatcctaggaagaataatgcttggtgtaggcattggctttgggaatcaggcagttccactctacttatcagagatggcaccaactcatcttcgaggaggcctgaacatgatgtttcagttggcaactactcttgggatcttcacggcaaacatgatcaattatggtacacagaagattgatccatggggatggaggctctccttgggtttggctgcatttccagctttgttgatgacagtgggaggcttacttctacctgagacacccaacagtttaatggagagaggagcaaaagaaaaaggaagaaaaaccttagagaaaattagaggaacaaacgatgtgaatgcagagtatgaagacatccaagaagcaagtgaatttgctaattctatcaaacatccttttagaaacatctttcaaaagagaaacagaccacagttggtaatggcattcttcatgccaacgtttcagattctcacaggcataaattcaatcctattttatgctccagtattgtttcagagcatggggtttggaggagatgcagctctctactcctcagctctaacaggagcagttctagcatcttcaactctgatttcaatagcaaccgtcgatagattaggccgaagagtactactaatctcaggtggaatacaaatgataacatcaggtggtggtcgccattatcctgggggtaaaatttggaaacaatgaagaactatcaaaagggttttcgattttggtggtgatagtgatttgtctattcgttttagcctttggatggtcatgggggccactgggttggacaataccgagcgagatattcccgttagaaacaagatcagcgggacaaagcatcacagtggcagtgaatcttcttttcacatttgtaattgcacagtcgtttctctcattgctatgcgcattgaagtacggaatatttctgttcttcgccggctggatcattgtgatgacggtgttcgtttatatattcttgccggaaaccaaaggagttcccattgaagagatgatactaatgtggagaaagcattggttttggaagaacgttatgccttcaaatgtcgacaatgatcaaagtaatgctaatgctatctaattctttttcaaccttctcaaatcatcaatgatcagtttgcaattatgctaaatttgcaagggcagaagatttaaaaaaaatcatcgtgaaaattattataatgtttaaattctgacgaaaacattgatgtgttactttgtgaattgtcaatataaatgtgatagaatgttgatatagttaacaaaaacgttcctaataaataagtttagatcag

SEQ ID NO: 3417 - DNA, 1788 bp, Musa acuminata
gagagagagagagagagagagagatggcaggaggtggtgtggttcatgggccggtgggggtggccaaggagagggcgcagcagtacaagggaagggtaacgccgttcgtcgtcatggcctgcttggtcgctgcagtcggtggatccatctttggctacgacatcggcatctcaggaggtgtcacaagcatggacccgttcctgaagaagttcttccctgtcgtctaccgcaagaagaactcgcagtcccacaacaactactgcgagtacgacaaccagggcctcgccgccttcacctcctctctctacctcgccggcctcgtcgcctcccttgcggcctcccccgtcaccaggaagcacggccgccgcgccagcatcgtctgtggcggcatcagttttctcgtcggagccaccctcaactccgccgccgtcaacctgccgatgctgatcctcggccgtatcatgctcggcatcggtatcgggttcgggaatcaggcagttcctctctacctctccgagatggcgccggcgcacctccgcggcggcttgaacatgatgttccagctcgcgacgaccctcggaattttctccgccaatatgatcaactacggcaccgagaagatcaagccgtgggggtggcgtctttccctcggcctggcagcggcccccgcgatcctgatgaccatcggaggcgccctcctgccggagacccccaacagcctcgtcgaacaagggcgggccgaggaaggccgccgcgtcctggagaagatccgcggcaccaacgacgtggacgccgagctccaagacatagtcgaagccagcgagctcgccaactcgatcgagcaccccttccggaacatactggagcgccggaaccggcctcagctcatcatggccatcctcatgcccacgttccagatcctgacgggcatcaactccatcctcttctacgcgccggtgctgttccagagcatgggcttcggtgggaacgcggcgctctactcctccgtcatgaccggcgccgtgctcgcctcttccacgcttgtttccatcgccaccgtcgacaggtgggggagaagaccgctgctgatcggcggcggattacagatgatcgtgtgtcaggttgcagtggccgtcatactaggcgtcaagttcggcggcgacaagcagctgtcgaaagacttctccatcgtcgtcgtcgtggtgatctgcctcttcgttgccgccttcgggtggtcgtgggggccgctggggtggacggtcccgagcgagatattcccgctggagacgaggtcggccgggcagagcatcacggtgtcggtgaacctcctcttcacctttgccatcgcccagtccttcctcagcctcctctgctccttcaagttcggcatcttcctcttcttcgccggttggatcaccataatgaccgtcttcgtctacgtcttcctcccggagaccaaaggggtgcctatcgaggagatgatactgctgtggaggaagcactggttctggaagagagtcatgccacctatcgaagtggcggatgaaggcggaccagcagaagcagagttgcctgatacgaggctttaatcaaaattagagcactgtcgttcgagagtattgttgctaccgatgcactgttcaagtgctatgcaagcatcacttagttgtacgttatcactaagctaacatgtaagaagtacagtccatgcaaatttatcatgagtaaattgactactgcaaacagatagttgatttagttcatgttaacctactattgagtttttag

SEQ ID NO: 3418 - DNA, 1702 bp, Citrullus lanatus
gaaggcttcaagtgttgagaattgaaggttgaattgaggaagtagacaattttgttgagaagggaaggtcggtgaagatggcaggtgggtcttttgctccagcaggagtggccaaggagagagcagagcagtacaaaggaagagttacgccttttgtggttattgcttgtcttgtggctgctgttggtggctcaatttttggttatgatatcggaatttcaggtggggtgacatcgatgaatcccttccttaaaaaattctttccaacggtgtacagaaacaagatgcgtgcacacgaaaacaattactgcaagtacaataatcaagggctagcagcatttacctcatccctatatcttgctggattagtttcctcattggtagcctctcccatcacccggaactatgggcgccgtgcaagcatagtctgcggaggaattagctttcttgttggggcaactctaaatgctgccgccgtcaatattgaaatgctcatcctaggaagaataatgcttggtgtaggcattggctttgggaatcaggcagttccactctacttatcagagatggcaccaactcatcttcgaggaggcctgaacatgatgtttcagctggcaactactcttgggatcttcacggcaaacatgatcaattatggtacacagaagattgatccatggggatggaggctctccttgggtttggctgcatttccagctttgttgatgacagtgggaggcttacttctacctgagacacccaacagtttaatggagagaggagcaaaagaaaaaggaagaaaaatcctagagaaaattagagggacaaacgatgttaatgcagagtatgaagacatcctagaagcaagtgaatttgctaattctatcaaacatccttttagaaacatctttaaaagaagaaacagaccacagttggtcatggcattcttcatgccaacatttcagattctcacaggcataaattcaatcctattttatgctccagtattgtttcagagcatgggatttggtggagatgcagctctctactcctcagccctaacaggagcagttctagcattttcaactctaatttcaatagcaaccgtcgacagattaggccgaagagtactgctaatttcaggtggattacaaatgataacatgccaggtggtggtcgccattatcctgggagtgaaatttgggaacaatgaagaactgtcaaaagggttttcgattttggtggtgatagtgatttgcctattcgttttggccttcggatggtcatgggggccactaggttggacgataccgagcgagattttcccgctagaaacaagatcggcaggacaaagcatcacagtagcagtgaatcttcttttcacattcgtaatcgcacagtcgtttctttcattactctgcgctttgaagtacggaatcttcctgttcttcgctggttggatcattgtgatgacggtgttcgtttacgtattcttgccggaaaccaaaggagttcccattgaagagatgatactgatgtggagaaagcattggttttggaagaacgtaatgccttcaaatgcagacgatgatcaaagcaatgctaatgccatctaattctctctcaccctctcaacaaggatcagtttacaattatgctaatttgcaagggcataaaataaagataaaaatttggcaaatat

SEQ ID NO: 3419 - DNA, 2725 bp, Zea mays
acctggaacacacgcaccgtcccaagttaacctctcgtgctcgggcactttctttttccttcccccctgtgcgctcggccgcctccgccgctgcctcgctccctccgcgcccaccacggaggcgcacgcgcgggcgcagcgtccctcgcgtgcctcgccttccgcactgctctgtccgcccgcctggctcctgcctcctcctcctcctcctcctctagggttagggcacgcgtcgcgggggcccgtggcgcccggcgcaatgcggaggccgtcgggggccggcgtgccgagccgccgccgccgcgcgatccaggtgctcgtggcggtctccctcgcctacgcggtcgccgtgctgctcctcgagtcgcccctcgtgtccacgtcgctgcccggggcgggggcgtccgccgcggcgtcgcggaagctccacctcgacggcgcgtgggagggcgcgggacgagcagcgccggcgcgccccgcgaagcacccgcacagggagaccctctcggcggacgcggggcggggacgggcgcgccggttggcggggatcgtctctggcctcgagctccgccacctcaactccacccgctccggctcgctccgcaaggtcgccgcggaggccgccgagtcaggggcccgcgtgttctccgacctggaggctctagcgacggccttgactttctcgggcgattcgtcaggggaggaggaggagaagagcaagtgcccgcactcgatcgtcctcagcggcgacgagttccgggagagggggcgggcggtggagctgccgtgcgggctcacgctgggttcgtatatcacggtcgccgcgacgccgcacgaggcgcaccctgagcgggatcctaagatcacgctgctcagggagggggaagagccgatcatggtgtcgcagttcatgatggagctgcaggggctcaagacggtggacggcgaggatccgcccaggattctccacttcaacccccgcctccgcggcgactggagcggcaagccggtgatcgagcagaacacctgctaccgcatgcagtggggcactccgctccgctgcgatggctggaggtcccgtgccgacgaggagactgtggatgggttggccaagtgtgagaagtggattcgggatgatgaagggcggtccgaggagtcgaaaacatcatggtggctgaaccggctcattggccgtacgaagaccgtctccgttgattggccatacccattcgtggagaaccacctgtttgttctaactctcactgctggattggaaggttaccatgtgaatgttgatggacggcatgtgacatcatttccataccgcactggatttgttcttgaggatgctactggcttatcattgaatggggacctggatgtgcaatcagtgttcgcggggactctgcccactacacatcctagcttttctccacagaaacatctagagttgttacccagttggcaggcccctccccttccagacgaaccagttgagattttcatcggtatcctgtcagcaggcaaccattttgctgagcgtatggctgcaagaaagacatggatgtctgctgctcagaagtcgtcgaatgttgtggcccgtttttttgttgccctgcatggcagaaatgaggttaatgtggagctgaaaaaagaggctgagttttttggtgacattgttattgtcccattcatggatagctatgatttggttgttctcaagacaattgccatatgcgagtatggggtccatgttgtatctgctagatacataatgaagtgtgatgatgatacttttgttagacttgattcagtaatggctgaagtgaagaaaatccagaatggtgaaagtctctatatagggaacatgaattatcaccacaagccattacgtgatgggaaatgggctgttacttacgaggaatggccagaagaggattatcccatctatgcaaatggtcctggatatgttatatcctctgatattgcaggttccattctatcggaatttttaaagcataaattaaggcttttcaaaatggaggatgtgagcatgggcatgtgggtagagcggttcaacaacaccagacttgttaaatatgtccacagcatcaaattttgtcaatttggatgcatagatgattattacactgcacactaccaatcaccaaggcagatgttgtgtttgtgggacaaactgcaggctggaaaagcccaatgctgcaatatgagatagcaagaatggatgtggtggtactggtaagcttttctgtggtggtagtgcccatcctaattcacgaaggagttgagaacctaatagccccaagattaacttcaagaatattggctggaaataaattaagcccttgagatgactaacaaatggacatttaacggaattcttttggtatagctgaccaggtggtgtttgagctggaaatggaaacaaggggaacagacagcagcctgtaacgcctttccctcttcttttctcaacgtatagaccgagttctttgagcagtatgagacctgcttggggacttgatttgtaaatggaacggttagaaagcttagttaaataactgttactttttggcaccattggctgtggttgctgtcagacaacccagctggtacacatgagcgatcttggtggacaagaattttgctgtgtaacttctcttaacatggtcataatttatgatttgatcagttggtggatgta

SEQ ID NO: 3420 - DNA, 2697 bp, Zea mays
aagttaacctctcgtgctcgggcactttctttttccttcccccctgtgcgctcggccgcctccgccgctgcctcgctccctccgcgcccaccacggaggcgcacgcgcgggcgcagcgtccctcgcgtgcctcgccttccgcactgctctgtccgcccgcctggctcctgcctcctcctcctcctcctcctctagggttagggcacgcgtcgcgggggcccgtggcgcccggcgcaatgcggaggccgtcgggggccggcgtgccgagccgccgccgccgcgcgatccaggtgctcgtggcggtctccctcgcctacgcggtcgccgtgctgctcctcgagtcgcccctcgtgtccacgtcgctgcccggggcgggggcgtccgccgcggcgtcgcggaagctccacctcgacggcgcgtgggagggcgcgggacgagcagcgccggcgcgccccgcgaagcacccgcacagggagaccctctcggcggacgcggggcggggacgggcgcgccggttggcggggatcgtctctggcctcgagctccgccacctcaactccacccgctccggctcgctccgcaaggtcgccgcggaggccgccgagtcaggggcccgcgtgttctccgacctggaggctctagcgacggccttgactttctcgggcgattcgtcaggggaggaggaggagaagagcaagtgcccgcactcgatcgtcctcagcggcgacgagttccgggagagggggcgggcggtggagctgccgtgcgggctcacgctgggttcgtatatcacggtcgccgcgacgccgcacgaggcgcaccctgagcgggatcctaagatcacgctgctcagggagggggaagagccgatcatggtgtcgcagttcatgatggagctgcaggggctcaagacggtggacggcgaggatccgcccaggattctccacttcaacccccgcctccgcggcgactggagcggcaagccggtgatcgagcagaacacctgctaccgcatgcagtggggcactccgctccgctgcgatggctggaggtcccgtgccgacgaggagactgtggatgggttggccaagtgtgagaagtggattcgggatgatgaagggcggtccgaggagtcgaaaacatcatggtggctgaaccggctcattggccgtacgaagaccgtctccgttgattggccatacccattcgtggagaaccacctgtttgttctaactctcactgctggattggaaggttaccatgtgaatgttgatggacggcatgtgacatcatttccataccgcactggatttgttcttgaggatgctactggcttatcattgaatggggacctggatgtgcaatcagtgttcgcggggactctgcccactacacatcctagcttttctccacagaaacatctagagttgttacccagttggcaggcccctccccttccagacgaaccagttgagattttcatcggtatcctgtcagcaggcaaccattttgctgagcgtatggctgcaagaaagacatggatgtctgctgctcagaagtcgtcgaatgttgtggcccgtttttttgttgccctgcatggcagaaatgaggttaatgtggagctgaaaaaagaggctgagttttttggtgacattgttattgtcccattcatggatagctatgatttggttgttctcaagacaattgccatatgcgagtatggggtccatgttgtatctgctagatacataatgaagtgtgatgatgatacttttgttagacttgattcagtaatggctgaagtgaagaaaatccagaatggtgaaagtctctatatagggaacatgaattatcaccacaagccattacgtgatgggaaatgggctgttacttacgaggaatggccagaagaggattatcccatctatgcaaatggtcctggatatgttatatcctctgatattgcaggttccattctatcggaatttttaaagcataaattaaggcttttcaaaatggaggatgtgagcatgggcatgtgggtagagcggttcaacaacaccagacttgttaaatatgtccacagcatcaaattttgtcaatttggatgcatagatgattattacactgcacactaccaatcaccaaggcagatgttgtgtttgtgggacaaactgcaggctggaaaagcccaatgctgcaatatgagatagcaagaatggatgtggtggtactggtaagcttttctgtggtggtagtgcccatcctaattcacgaaggagttgagaacctaatagccccaagattaacttcaagaatattggctggaaataaattaagcccttgagatgactaacaaatggacatttaacggaattcttttggtatagctgaccaggtggtgtttgagctggaaatggaaacaaggggaacagacagcagcctgtaacgcctttccctcttcttttctcaacgtatagaccgagttctttgagcagtatgagacctgcttggggacttgatttgtaaatggaacggttagaaagcttagttaaataactgttactttttggcaccattggctgtggttgctgtcagacaacccagctggtacacatgagcgatcttggtggacaagaattttgctgtgtaacttctcttaacatggtcataatttatgatttgatcagttggtgg

SEQ ID NO: 3421 - DNA, 2516 bp, Zea mays
gcccccttccccttcctgtccacgtggcatcggcccgccctccctacgccgcccgcgcccgcaagacggggcccagggctctatgccatgcgccgaacgcacgcggccttcttgcgccacgatcacgcaaaatgttacatttccgcacggctttttaaaatcagggaaggcccagattacgttctataggagggaatttcccgtccaatttattaacatatcgggctccggctcggccacttcgtttgcaccccccgctcggccgcctccaccgctgcctcgctccctccgcgcccaccacggagagcacgcgcggcgtgcagcttccctcgcgcgcctcgccttcccgctgctctgtccgttcacctgcgctcctcctcctagggttaggtcacgcgtcgccgtgggccgcggcgcccggcgcaatgcgaaggccgtcgggggccggcgcgccgtgccgcagccgcgcgatccaggtgctcgtggcggtctccttcgcctacgcgctcgccgtgctgctcctcgagtcgccgttcgtgtccacgtccctgctcggggcgggggcgtccgccgcggcttcgcggaagctccacctcgccggcgcgtgggagggcgtgaggcgcgccgtgccggcgcgccccgccaaacacccgcacagggagaccctctcgtcggacgcggggcgaggacgggcgcgccggttggcagggatcgtctctggcctcgagctctgccacctcaactccacccgctccggctcgctacgcaaggtcgccgccgaggctgccgagtcaggggcccgcgtgttctccgacctggaggctctagcgacggccctggcgtcctcgcgtgattcgtcaggggaggaagagaagagcaagtgccctcactcgatcgtcctcagcggcgacgagttccgggagagggggcgggcggtggagctgccgtgcggcctgacgctgggttcgtatatcacggtcgtcgcgacaccgcacgaggcgcaccctgagcgggatcctaagatcacgctgctcagggagggtgaagagccgatcatggtgtcgcagttcatgatggagctgcaggggctcaagacggtggacggcgaggatccgcccaggattctccacttcaacccgcgcctccgcggcgactggagcggcaagccggtgatcgagcagaacacctgctatcgcatgcagtggggcactccgctccgctgcgaaggctggaggtcacgtgccgacgaggagactgtggatgggttggtgaagtgtgagaagtggattcgggatgatgaagggcggtcggaggagtcaaaaacgtcatggtggctgaaccggcttattggccgcacaaagacagtctccgttgattggtcatacccattcgtcgaggaccgcctgtttgttctcactctcactgctgggttcgagggttaccatgtgaatgttgatggacggcatgtgacatcatttccataccgcactggatttgttcttgaggatgctactggcttatcattggatggggaccttgatgtgcaatcagtgtttgcggggactctgcccaccacacatcctagcttttctccacagaaacacctagagatgttacccagttggcaggctcctccccttccagacgaaccagttgagattttcatcggtatcctgtcagcaggcaaccattttgctgagcgaatggctgtgagaaagacatggatgtctgctgctcagaagttgccgaatgttgtggcccggttttttgttgccctgcatggcaggaacgagattaatgcagagctgaaaaaggaggctgagtttttcggggacattgttattgtgccattcatggatagctatgatttggttgttctcaagacaattgccatatgcgagtatggggtccatgttgtatatgctagatacataatgaagtgtgatgatgatacttttgttagacttgattcagtaattgctgaagtgaagaaaatccagaacggtgaaagtctctatatagggaacatgaattatcgtcataagccattgcgtgatggtaaatgggctgttacttatgaggaatggccagaagaggattatcccatctatgcaaatggtcctggatatgttatatcctctgatattgcagactccattctatcagaatttttaaaccttaaattaaggcttttcaaaatggaggatgtcagcatgggcatgtgggtcgagcggttcaacagcaccagacttgttaaatacgtccacagcgtcaaattttgtcaatttggatgcatagatgattattacactgcacactaccaatcaccgaggcagatgttgtgtttgtgggacaagctgcaggctggaaaagctcaatgttgcaatatgagatagcaacattggaggtggtggtactggtaggcgtttctgtggtggtagtgcctatccttattcatgaaggagaacctagaagccttgaaaataaattaaaccctcgagatgactaacaaattg

SEQ ID NO: 3422 - DNA, 2595 bp, Zea mays
accccccgctcggccgcctccaccgctgcctcgctccctccgcgcccaccacggagagcacgcgcggcgtgcagcttccctcgcgcgcctcgccttcccgctgctctgtccgttcacctgcgctcctcctcctagggttaggtcacgcgtcgccgtgggccgcggcgcccggcgcaatgcgaaggccgtcgggggccggcgcgccgtgccgcagccgcgcgatccaggtgctcgtggcggtctccttcgcctacgcgctcgccgtgctgctcctcgagtcgccgttcgtgtccacgtccctgctcggggcgggggcgtccgccgcggcttcgcggaagctccacctcgccggcgcgtgggagggcgtgaggcgcgccgtgccggcgcgccccgccaaacacccgcacagggagaccctctcgtcggacgcggggcgaggacgggcgcgccggttggcagggatcgtctctggcctcgagctctgccacctcaactccacccgctccggctcgctacgcaaggtcgccgccgaggctgccgagtcaggggcccgcgtgttctccgacctggaggctctagcgacggccctggcgtcctcgcgtgattcgtcaggggaggaagagaagagcaagtgccctcactcgatcgtcctcagcggcgacgagttccgggagagggggcgggcggtggagctgccgtgcggcctgacgctgggttcgtatatcacggtcgtcgcgacaccgcacgaggcgcaccctgagcgggatcctaagatcacgctgctcagggagggtgaagagccgatcatggtgtcgcagttcatgatggagctgcaggggctcaagacggtggacggcgaggatccgcccaggattctccacttcaacccgcgcctccgcggcgactggagcggcaagccggtgatcgagcagaacacctgctatcgcatgcagtggggcactccgctccgctgcgaaggctggaggtcacgtgccgacgaggagactgtggatgggttggtgaagtgtgagaagtggattcgggatgatgaagggcggtcggaggagtcaaaaacgtcatggtggctgaaccggcttattggccgcacaaagacagtctccgttgattggtcatacccattcgtcgaggaccgcctgtttgttctcactctcactgctgggttcgagggttaccatgtgaatgttgatggacggcatgtgacatcatttccataccgcactggatttgttcttgaggatgctactggcttatcattggatggggaccttgatgtgcaatcagtgtttgcggggactctgcccaccacacatcctagcttttctccacagaaacacctagagatgttacccagttggcaggctcctccccttccagacgaaccagttgagattttcatcggtatcctgtcagcaggcaaccattttgctgagcgaatggctgtgagaaagacatggatgtctgctgctcagaagttgccgaatgttgtggcccggttttttgttgccctgcatggcaggaacgagattaatgcagagctgaaaaaggaggctgagtttttcggggacattgttattgtgccattcatggatagctatgatttggttgttctcaagacaattgccatatgcgagtatggggtccatgttgtatatgctagatacataatgaagtgtgatgatgatacttttgttagacttgattcagtaattgctgaagtgaagaaaatccagaacggtgaaagtctctatatagggaacatgaattatcgtcataagccattgcgtgatggtaaatgggctgttacttatgaggaatggccagaagaggattatcccatctatgcaaatggtcctggatatgttatatcctctgatattgcagactccattctatcagaatttttaaaccttaaattaaggcttttcaaaatggaggatgtcagcatgggcatgtgggtcgagcggttcaacagcaccagacttgttaaatacgtccacagcgtcaaattttgtcaatttggatgcatagatgattattacactgcacactaccaatcaccgaggcagatgttgtgtttgtgggacaagctgcaggctggaaaagctcaatgttgcaatatgagatagcaacattggaggtggtggtactggtaggcgtttctgtggtggtagtgcctatccttattcatgaaggagaacctagaagccttgaaaataaattaaaccctcgagatgactaacaaattgccatttaacggatttttttggtatagctgaacaggcggtgtttcagctggaaatggaaacagggggaatgggcagcggcctgtaacgactttctgattgagcttgcggcgctcttctttctcgacgtatagacggagttctgtgagcagtatggaacctgcttgggtcttgatttgtaaatgggacgggtagaaagcttagtcaaataactattgcttttggcacttatggctgtggttgcatttataggcaacccagttgtacagatggtagtgtacaagaattttgctgtgctcttaacatggtcataagttatggtttgattagc

SEQ ID NO: 3423 - DNA, 2783 bp, Setaria italica
aaccaacacgtccgcccaaagttaaccccggctctttccttttccttccccttcgcttcgttggctcggccgcctccgccgctgcctcgctcccaccgcgcccaccaccacagagcccgagccgagccggggaacgcgggggcgcagcgtcgcgcacctcgccatcctgccacccgcgcgcgcgagagagctcgctcgctcctccgcctagggttagggttcgcgcgctgcggtgtgggggagggccgcgggcgcgcccggcgcaatgcggaggtcgcctgggcccggcgcgccgtgccgccgccgagcgatccaggggttcgtggcgctctttctcgcgtacgcgctcgtcgtgctgctcctcgagtcgcccctcgtgtccacgtccctgcccggggcggcgggggcgtccgctgcggcgtcgcggaagctccacctcgacggcgcgtgggagggcgggcgcgcggcgccggcgcgaccgtcgaagcacccgcacagggagaccctctcggcggacggggggcgccggcggtcggggatcgtctccggcctcgagctccgccacctcaactccacacgctctggttcgctgcgcaaggtcgccgccgaggccgcggagttaggggcgcgcgtgttctccgacctgcagactctcgcgacgaccctgccgtccttggaggattcgtcagacgaggaggagaagagcaagtgcccgcactcgatcgtcctcagcggcgacgagttccgggagagggggcgggcggtggagctgccgtgcgggctgacgctgggctcgcatatcacggtggccgcgacgccgcacgaggcgcaccctgagcgggatcctaagatcacgctgctgaaggatggggaggagccgatcatggtgtcgcagttcatgatggagctgcaggggctcaagacggtggacggcgaggacccgcccaggattctccacttcaacccccgcctccgcggcgactggagtggcaagccggtgatcgagcagaacacctgctaccgcatgcagtggggcactccactccgctgcgagggctggaggtcccgtgccgacgaggagactgttgatgggttggtgaagtgtgagaagtggattcgggatgacgaaaggcggttggaggagtcaaagacgtcatggtggctgaaccggctcattgggcgcacaaagactgtctccgttgattggccatacccattcgtggaggaccgcctgtttgttcttactctcactgctggattggaaggttaccatgtgaatgttgatggacggcatgtgacatcatttccataccgcactggatttgtgcttgaggatgctactggcttatcattgaatggggaccttgatgtgcaatcagtgtttgcggggactttgcccactacacatcctagcttttctccacagaaacacctagagatgttacccagttggcaggcccctcccctcccagacgaaccagttgagattttcatcggtatcctgtcagcgggcaaccattttgctgagcgtatggctgcgagaaagacatggatgtctgctgcacataagtctttgaatgtcgtggcccgcttttttgttgccctgcatggcagaaatgaagttaatgctgagctgaaaaaggaggctgagttttttggggacattgttattgtgccattcatggatagctatgatttggttgttttgaagacgattgccatatgcgaatatggggtccgtgttgtatctgctagatacataatgaaatgtgatgatgatacttttgttagacttgaatcagtaattactgaagtgaggaaaatccggaacggtgaaagtctctatatagggaacatgaattatcaccacaagccattacgcaatgggaaatgggctgttacttacgaggaatggccagaagaggattatccaatctacgcaaatggtcctggatatgttatatcctctgatattgcagattccatactatcggaatttgtaaaccataaattgaggcttttcaaaatggaggatgtgagcatgggcatgtgggtcgagcggttcaacaacactagacttgttaaatatgttcacagcgtcaaattttgtcaatttggatgcatagatgattattacactgcacactaccaatcaccgaggcagatgttatgtttgtgggacaaactgcaggctggaaaagcacaatgttgcaatatgagatagcaataatggaggtggtggtacttgaacatttaaatggtagtggcgcccatccttatttgcagaggagttagatgacctggaagacccaagattcaagaaatgctgacgataaattaagccctccagatgactaacaaatggccatttaacggatttttttggtacagctgaccagactctgtttcagctggaaacaaagggaatgggtgtagtgcagcctgtaacgcctttcatgactgagcttctggtgctcgttttaatctcaacacatggacgaaagttctgtgggcagtatgagcgctgctttaggacttcttttgtaaatgcgaagggtagaaagtttagttaaattatacttctgcttttggtacgattggctgtggttgcaatcataaacaagtaaacaacccagctgagctggtacagatgagcgatcttggtagtgtaacagaattttgctgtgcattctctttaacatggtcataagtaatgacttgatttagcaggcagacttgtcattatctcccacgttaatgtagttcgggactttggctttatt

SEQ ID NO: 3424 - DNA, 2836 bp, Setaria italica
caaagttaaccccggctctttccttttccttccccttcgcttcgttggctcggccgcctccgccgctgcctcgctcccaccgcgcccaccaccacagagcccgagccgagccggggaacgcgggggcgcagcgtcgcgcacctcgccatcctgccacccgcgcgcgcgagagagctcgctcgctcctccgcctagggttagggttcgcgcgctgcggtgtgggggagggccgcgggcgcgcccggcgcaatgcggaggtcgcctgggcccggcgcgccgtgccgccgccgagcgatccaggggttcgtggcgctctttctcgcgtacgcgctcgtcgtgctgctcctcgagtcgcccctcgtgtccacgtccctgcccggggcggcgggggcgtccgctgcggcgtcgcggaagctccacctcgacggcgcgtgggagggcgggcgcgcggcgccggcgcgaccgtcgaagcacccgcacagggagaccctctcggcggacggggggcgccggcggtcggggatcgtctccggcctcgagctccgccacctcaactccacacgctctggttcgctgcgcaaggtcgccgccgaggccgcggagttaggggcgcgcgtgttctccgacctgcagactctcgcgacgaccctgccgtccttggaggattcgtcagacgaggaggagaagagcaagtgcccgcactcgatcgtcctcagcggcgacgagttccgggagagggggcgggcggtggagctgccgtgcgggctgacgctgggctcgcatatcacggtggccgcgacgccgcacgaggcgcaccctgagcgggatcctaagatcacgctgctgaaggatggggaggagccgatcatggtgtcgcagttcatgatggagctgcaggggctcaagacggtggacggcgaggacccgcccaggattctccacttcaacccccgcctccgcggcgactggagtggcaagccggtgatcgagcagaacacctgctaccgcatgcagtggggcactccactccgctgcgagggctggaggtcccgtgccgacgaggagactgttgatgggttggtgaagtgtgagaagtggattcgggatgacgaaaggcggttggaggagtcaaagacgtcatggtggctgaaccggctcattgggcgcacaaagactgtctccgttgattggccatacccattcgtggaggaccgcctgtttgttcttactctcactgctggattggaaggttaccatgtgaatgttgatggacggcatgtgacatcatttccataccgcactggatttgtgcttgaggatgctactggcttatcattgaatggggaccttgatgtgcaatcagtgtttgcggggactttgcccactacacatcctagcttttctccacagaaacacctagagatgttacccagttggcaggcccctcccctcccagacgaaccagttgagattttcatcggtatcctgtcagcgggcaaccattttgctgagcgtatggctgcgagaaagacatggatgtctgctgcacataagtctttgaatgtcgtggcccgcttttttgttgccctgcatggcagaaatgaagttaatgctgagctgaaaaaggaggctgagttttttggggacattgttattgtgccattcatggatagctatgatttggttgttttgaagacgattgccatatgcgaatatggggtccgtgttgtatctgctagatacataatgaaatgtgatgatgatacttttgttagacttgaatcagtaattactgaagtgaggaaaatccggaacggtgaaagtctctatatagggaacatgaattatcaccacaagccattacgcaatgggaaatgggctgttacttacgaggaatggccagaagaggattatccaatctacgcaaatggtcctggatatgttatatcctctgatattgcagattccatactatcggaatttgtaaaccataaattgaggcttttcaaaatggaggatgtgagcatgggcatgtgggtcgagcggttcaacaacactagacttgttaaatatgttcacagcgtcaaattttgtcaatttggatgcatagatgattattacactgcacactaccaatcaccgaggcagatgttatgtttgtgggacaaactgcaggctggaaaagcacaatgttgcaatatgagatagcaataatggaggtgttggtacttgaacatttaaatggtagtggcgcccatccttatttgcagaggagttagatgacctggaagacccaagattcaagaaatgctgacgataaattaagccctccagatgactaacaaatggccatttaacggatttttttggtacagctgaccagactctgtttcagctggaaacaaagggaatgggtgtagtgcagcctgtaacgcctttcatgactgagcttctggtgctcgttttaatctcaacacatggacgaaagttctgtaggcagtatgagcgctgctttaggacttcttttgtaaatgcgaagggtagaaagtttagttaaattatacttctgcttttggtacgattggctgtggttgcaatcataaacaagtaaacaacccagctgagctggtacagatgagcgatcttggtagtgtaacagaattttgctgtgcattctctttaacatggtcataagtaatgacttgatttagcaggcagacttgtcattatctcccacgttaatgtagttcgggactttggctttattatgttttatcaccaggaactattttatctcctagcagtcttgtgcaatgttcacatatgtgtattattt

SEQ ID NO: 3425 - DNA, 2532 bp, Panicum virgatum
gtggcgggggaggccgcgggcgccgggcgcaatgcggaggccgcctggggccggcgcgccgtgccgccgccgcgcgatccaggggttcgtggcgctcttcctcgcctacgcgctcttcgtgctgctcctcgagtcgccgctcgtgtccacgtcgctgcccggggcgggggcctccgccgccgcggcgtcgcggaagctccacctcgacggcgcgtgggagggagggcgcgccgcgccggcgcggccctcgaagcacccccaccgggagaccctctcggcggacgggggccgcgggcgggcgcgccggttgtcgtggttcgtctccggcctcgagctccgccacctcaactccacccgctccggctcgctgcgcaaggtcgccgccgaggcggcggagtcaggggcccgcgtgttcgccgaccttcatactctcgcgacgaacctgacgttctcgcaggattcgccagacgaggaggagaggagcatgtgtccgcactcgatcgccctcagcggggacgagttccgggagagggggcggacggtggagctgccgtgcgggctgacgctgggttcgtatatcacggtggccgcgacgccgcacgaggcgcaccctgagcgggatcctaagatcacgctgctcaaggagggggaagagccgatcatggtgtcgcagttcatgatggagctgcaggggctcaagacggtggacggcgaggatcctcccagaattctccacttcaacccccgcctccgcggcgactggagtggcaagccggtgatcgagcaaaacacctgctaccgcatgcagtggggcactccccttcgctgtgagggctggaggtcccgtgctgacgaggagaccgttgatgggttggtgaagtgtgagaagtggattcgggatgatgaaggccggtcggaggagtcaaaaacgtcatggtggttgaaccggctcattgggcgcacaaagactgtctcaattgattggccatacccatttgtggaggaccacctgtttgttcttacactcaccgctggattggaaggttaccatgtgaatgttgatggacgtcatgtgacatcatttccataccgcactgggtttgtgcttgaggatgctactggcttatcattgaatggggaccttgatgtgcaatcagtgtttgcggggtctttgcccactacacatcctagcttttctccacagaagcacctagagatgttacccagttggcaggcccctcccctcccagacgaaccggttgaaattttcattggtatcctgtcagcgggcaaccattttgctgagcgtatggctgtgagaaagacatggatgtctgcttcccagaagtcatcgaatgttgtggcccgtttttttgttgccctgcatggaagaaatgaaattaatgtggagctgaaaaaggaggctgagttttttggggacattgttattatgccattcatggacagctacgatttggtggttctgaagacgattgccatatgcgagtatggggtccatgttgtatctgctagatacataatgaagtgcgatgatgatacttttgttagacttgaatcagtaatggctgaagtgaagaaaatccggaacggtgaaagtctctatatagggaacatgaattatcaccacaagccattgcgcgatgggaaatgggctgttacatatgaggaatggccagaagaggattatccaatctatgcaaatggtcctggatatgttatatcttctgatattgcagatgccattctgtcagaatttttaaaccataaattaaggcttttcaaaatggaggatgtgagcatgggcatgtgggttgagcggttcaacagcactagacctgttaaatacgtccacagcatcaaattttgtcaatttggatgcatagatgattattacactgcacactaccaatcaccgaggcagatgttatgtttgtgggacaagctgcaggctggtaaagcacaatgttgcaatatgagatagcaatggtggatgtgttggtacttgagcatttctctggtagtagcgcctatctatattcgtgcagaagttgatatcctggaagaccacaagattaactgacggtaaattaagccctccagaagtccagatgactaacaaatggccatttaatggttttttttttcggtatagctgaccaggctatgtttcagctggaaacaagggaatggacacaacagcctgtaacgcctttagcctctggtgctcgttttaatctcaacatatagacgaagttctatgggcagtatgagcgctgctataggacttcatttgtaaatgtgaagggtaggaatcctagtcaagttactggcttactccagcttttggtacgattggctgtggttgcaatcataatcaacccagctggtacagttgagcgatcttggtcgtgtacaagaattttgctgtgcattctctttaacatggtcctaaattatgacttgatttagcaggcggacatttgacattttctcgctgttcacgacttcctt

SEQ ID NO: 3426 - DNA, 2907 bp, Panicum virgatum
cccttcgctggctcggccgcctccgccgctgcctcgctgcctccgcgcccaccacagagcccgagagccgagccgcacgcgcgggcgcggcagcttcgcgcacctcgtcctcccgcccccgcgcgcgcgcgagctcctcctcgcctagggttagggttcgcgctgcggcctgcggggggagggccgcgggcgccgggcgcaatgcggaggccgcctggggccggcgcgccgtgccgccgccgcgcgatccaggggttcgtggcgctcttcctcgcctacgcgctcttcgtgctgctcctcgagtcgccgctcgtgtccacgtcgctgcccggggcgggggcctccgccggcgtcgcggaagctccacctcgacggcgccacccccaccgggagaccctctcggcggacggggggcgcgggcgagcgcgctggttgtcggggttcgtctccggcctcgagctccgccacctcaactccacccgctccggctcgctgcgcaaggtcgccgccgaggcggcggagtcaggggcccgcgttttcgccgacctgcagactctcgcgacgaacctgacgtcctcgcgggattcgccagacgaggagcagaggaacaagtgtccgcactcgatcgtcctcagcggcgacgagttccgggagagggggcggacggtggagctgccatgcgggctgacgctgggttcgtatatcacggtggccgcgacgccgcacgaggcgcaccctgagcgggatcctaagatcacgctgctcaaggagggggaagagccgatcatggtgtcgcagttcatgatggagctgcaggggctcaagacggtggacggcgaggatcctcccagaattctccacttcaatccccgcctccgcggcgactggagtggcaagccggtgatcgagcagaacacctgctaccgcatgcagtggggcactccccttcgctgcgagggctggaggtcccgtgctgacgaggagactgttgatggattggtgaagtgtgagaagtggattcgggatgatgaaggccggtcggaggagtcaaaaacatcatggtggctgaaccggctcattgggcgcacaaagactgtctcaattgattggccatacccattcgtggaggaccacctgtttgttcttacactcaccgctggattggaaggttaccatgtgaatgttgatggacgtcatgtgacatcatttccataccgcactggatttgtgcttgaggatgctactggcttatcattgaatggggaccttgatgtgcaatcagtgtttgcagggtctttgcccactacacatcctagcttttctccacagaagcacctagagatgttacccagttggcaggcccctcccctcccagacgaaccagttgagattttcattggtatcctgtcagcgggcaaccattttgctgagcgtatggctgcaagaaaaacatggatgtctgctgcccagaagtcatcgaatgttgtggcccggttttttgttgccctgcatggaagaaatgaaattaatgtggagctgaaaaaggaggctgagttttttggggacattgttattgtgccattcatggacagctacgatttggtcgttctgaagacgattgccatatgcaagtatggggtccatgttgtatctgctagatacataatgaagtgtgatgatgatacttttgttagacttgaattagtaatggctgaagtgaagaaaatccggaacggtgaaagtctctatatagggaacatgaattatcaccacaagccattgcgcgatgggaaatgggctgttacatatgaggaatggccagaagaggattatccaatctatgcaaatggtcctggatatgttatatcttctgatattgcagatgccgttctctcagaatttttaaaccataaattaaggcttttcaaaatggaggatgtaagcatgggcatgtgggttgagcggttcaacagcaccagacctgttaaatacgtccacagcatcaaattttgtcaatttggatgcatagatgattattacactgcacactaccaatcgccgaggcagatgttatgtttgtgggacaagcttctggctggtaaagctcaatgttgcaatatgagatagcaatagtggtggatgtgttgctacttgagcatttctgtggtggtagcgcccatcaatattcgtggataagttgataccctggaagaccccaacattcaagaatattagctgacggtaaattaagcccaccagatgactaacaaatggccatttagtggtttttttttggtatagctgaccaggttgtgtttcagctggaaacaagggaatggacacaacagcctgtaacgcctttagcctctggtgctcgttttaatcccaacatatagacgaagttctgtggacagtatgagcgctgctataggacttcatttgtaaaggtgaagggtaggaatcttagtcaagtttactggcttactactgcttttggtacgattggctgtggttgcaatcataaacaacccagctggtacagttgagcgatcttggtagtgtacacgaattttgctgtgcattctctttaacatggtcctaaattatgacttgatttagcaggtggattttgacattatctcgccgttcacgacttatggtctgtttggtggagttaaagttgagtgctaaattttagcacctattagcactcatacatttgctaaagttttaaatcttaactaagctttagctgaccctattagcactcttgataagacataccagtgctagtgtttggatacactagtgttaaagttaacactttcactgattagcacttgaatccaaacagaccttaggctatacgatgtttttcagcaactatttcgttcgatgttagtttta

SEQ ID NO: 3427 - DNA, 2259 bp, Pennisetum glaucum
cggggcggcgggggcgtccgcggcggcgtcgcggaagctacacctggacggggcgtgggagggcgcgcgggccgcgccggcgcggccttcgaagcacccgcaccgggagaccctctcggcggacggggggcgccggctgtcggggatcgtctccggcctcgagctccgccacctcaactccacacgctctgggtcgctgcgcaaggtcgccgcggaggcggcggagttgggggctcgcgtgttctccgacctgcagactctcgcgacgaccctgccgtcctttgaggattcgtcggacgaggaggagaagagcaagtgcccgcactcgatcgtcctcagcggcgacgagttccgggagagggggcgggcggtggagctgccgtgcgggctgacgctgggctcgcatatcacggtggccgcgacgccgcacgaggcgcaccctgagagggatcctaagatcacgctgctgaaggatggggaggagccgatcatggtgtcccagttcatgatggagctgcaggggctcaagacggtggacggcgaggacccccccaggattctccacttcaacccccgcctccgcggcgactggagcggcaagccggtgatcgagcagaacacctgctaccgcatgcagtggggcactccactccgctgcgagggctggaggtcccgtgccgacgaggagactgttgatgggctggtgaagtgtgagaagtggatccgggatgacgaagggcggtcggaggagtcaaagacgtcatggtggctgaaccggctcattgggcgcacaaagactgtctccgttgattggccatacccattcgtggaggaccgcctgtttgttcttactctcactgctggattggaaggttaccatgtgaatgttgatggacggcatgtggcatcattcccataccgcactgggtttgtgcttgaggatgctactggcttatcattgaatggggaccttgatgtgcaatcagtgtttgtggggactttgcccactacacatcctagcttttctccacagaaacacctagagatgttacccatttggcaggcccctccccttccagacgaaccagttgagattttcatcggtatcctgtcagcgggcaaccattttgctgagcgtatggctgcgagaaagacatggatgtctgctgctcataagtcttcgaatgttgtggcccgcttttttgttgccctgcatggcagaaatgaagttaatgcggagctgaaaaaggaggctgagtttttttggggacattgttattgtgccattcatggatagttatgatttggttgttctgaagacaattgccatatgcgagtatggggtccatgttgtatctgctagatacataatgaagtgtgatgatgatacctttgtcagacttgaatcagtaatgactgaagtgaggaaaatctggaacggtgaaagtctctatatagggaacatgaattatcaccacaagccattacgcgatgggaaatgggctgttacttacgaggaatggccggaagaggattatccaatctatgcaaatggtcctggatatgttatatcctctgatattgcagattccattctattggaatttgtaaaccataaattaaggcttttcaagatggaggatgtgagcatgggcatgtgggttgagcggttcaacaacaccagactcgttaaatacgtccacagtgtcaagttttgtcaatttggatgcatagatgattattatactgcacattaccaatcgccaaggcagatgttatgtttgtgggacaagctgcaggctggaaaagcacaatgttgcaacatgagatagcaataatggaggtggtggtactagaacatttaaatggtagtggcgcccattcttatttgcagaggagttagatgacctggaagacccaagattcaagaaatgctgacgataaattaagccctccagatgactaacaagtgaccatttaatggactttcttttggtatagctgaccagattctgtttcagctggaaacaaagggaatgggtgtagtgctagtgcagcctgtaacgcctttcatgactgagcctctggtgtgctcgttttaatctcaacacagatgaaagatatgtgggcagtatgagcgctgctttaggacttcttttgtaaatgcgaagggtagaaagcttagttaaattatactgctgcttttggtaccattgactgtggttgcagtcataacaacccagctggtacaatgatctt

SEQ ID NO: 3428 - DNA, 2914 bp, Oryza sativa
gaatttttaacgaaaccgtcattaataaactaacacgtccttccccttcgctgtgtgttgggttcggttcgcttggccgcctccgcctccgcctccgccgccgcctcgccccctcctcgcgcgcggcggaagccggcggccatccaccacacggctccggctgcggctgcgcccgaccatcctcctcctcgtactctagggttagggtttccagcgccgggccggaggggaccgtccgtcgaggtttgccgaggcgggcgcgcgtcgaaatgcggaggccaccggctgccggcgcgacgtgccggcgtttcgcgatccgggggttcgtggcggtgttcctcgtgtacgtgctcgcggcgctcgcgctcgagtcgccgctgctggtggtgcccacgcccgtgccgggagccggggcggccaccgcggcgtcgcggccgcttcacctcgatggctcgggcgagcgcgggcgcggcagcgcgccggcccggccgttgaagcgtccccaccgggagacgctctcggcggcggggaggtcgtcgaggcggctgcccgggatcgtctccgggctcgacctccgccgcctcaacgcgacccgctccggctcgctccgcaaggtcgccgcggaggccgctgcggccggggctcgcgtcttctccgagctgcaaaccctcgcgggcaccgtgactgagctggatgcgaccggggaggaggagaggagcaggtgccctcactcgatcgtcctcaccggcgacgagttccgggtgaaggggcggaccgtggagctgccgtgcgggctgacgctcgggtcgtacatcacggtggccgccacgccgcgcgcggcgcatgccgaccgagatcctaaaatcacgctggtgcgggagggggacgagccgatcatggtgtcgcagttcatgatggagttgcaggggctcaagacggtggacggtgaggacccgccaagaatcctccacttcaatcctcgcctccgcggcgactggagtggcaagcctgtgatcgagcagaacacatgttaccgaatgcagtggggaacttctctccgctgcgagggctggaggtcccgtgctgatgaggagaccgtggatgggatggtgaagtgtgagaaatggattcgagatgacgaggagaggtcagaacaatcaaagacgtcatggtggctcaaccgcctcattggccgaacaaagaaggtctctgttgattggccatacccgtttgtggaggactgcatgttcgttcttactcttaccgccgggttggagggttaccacgtgaacgttgatggacgacacgtcacatcatttccgtaccgcactggatttgtgcttgaagatgccactggcttatcattgaatggggatcttgatgtgcaatcggtgtttgcagggactttgcccactgcacaccctagcttttcacctcagaaacacctagagatgttgcctatttggcaggcccctccccttccagacgaaccaattgagattttcattggcatcctgtcagcaggcaaccattttgctgaacgtatggctgtgaggaagacatggatgtctgctgcccagaagtcctcgaatgtcgtggcccgtttttttgttgccctgaacagcagaaaagaagtcaatgcagaattgaagaaagaggcagagttttttggggacattgttattgtgccattcatggacagctatgacttagttgttctaaagactgtggcaatatgtgaatatggggtgcgtgttgtttccgctcgatatataatgaagtgtgatgacgataattttgttagacttgaatcagtgaaggatgaacttaagaaaataccaagaggtaaaagtctctatgtgggaaacatgaattatcaccacaagccattgcgcactgggaagtgggctgtcacttatgaggagtggccagaagaggattacccaacatatgcaaatggtcctggctacgttatatcttctgatattgctgcttccattgtgtcagaatttacagctcataaattaaggctcttcaagatggaagatgtgagcatgggcatgtgggttgagcggttcaataacaccagacatgttcaatatgttcacagtatcaagttctgccaatttggatgcatagatgattactacactgcacattaccagtcaccgaggcaaatgctatgtttgtgggataagctgcagtctgggaaagcacaatgttgcaatatgagatagcgacaatgaaactggcagcatcgatccccttcgattgtgttagtggtcattcttctttgctacatgatgatcctgagcccaagatcgaaggactgttttgcgatgataaattaagtcctcagatgactaacaaatggccatagtttcttgcttttcatgtagagatgaccgtcgaaactttcagctagaaaccaactcagggaatgaatacgaagttcagtgggcactaatagaactgctcaaggacttcatctgtacatgtgaagggtagaaagcttagttgaaattgttgctactcttgatatgcctgattgtggttgaaagtcatgaacaacccatcaggtacgtagaacatcttggcgttttactcaatttgtcgcagaatttttgatttgacatggtcataagttatgacatgtatttagttctggctgcaaacatcttgcatgagttcatggagtatcagatttttcttttccttcttgtttttagattcaggttgtatcgctgcagctcgagtgttcatacgtattaatttgaaatgtacgtacatataatatttttgtcgagaaatacagtataaatacatgtgcgccacccctatatacgcatacaagtatcatgtttccttgaatgttgtggataaatatactccagttgctagattagtatagagt

SEQ ID NO: 3429 - DNA, 2781 bp, Oryza sativa
gtgttgggttcggttcgcttggccgcctccgcctccgcctccgccgccgcctcgccccctcctcgcgcgcggcggaagccggcggccatccaccacacggctccggctgcggctgcgcccgaccatcctcctcctcgtactctagggttagggtttccagcgccgggccggaggggaccgtccgtcgaggtttgccgaggcgggcgcgcgtcgaaatgcggaggccaccggctgccggcgcgacgtgccggcgtttcgcgatccgggggttcgtggcggtgttcctcgtgtacgtgctcgcggcgctcgcgctcgagtcgccgctgctggtggtgcccacgcccgtgccgggagccggggcggccaccgcggcgtcgcggccgcttcacctcgatggctcgggcgagcgcgggcgcggcagcgcgccggcccggccgttgaagcgtccccaccgggagacgctctcggcggcggggaggtcgtcgaggcggctgcccgggatcgtctccgggctcgacctccgccgcctcaacgcgacccgctccggctcgctccgcaaggtcgccgcggaggccgctgcggccggggctcgcgtcttctccgagctgcaaaccctcgcgggcaccgtgactgagctggatgcgaccggggaggaggagaggagcaggtgccctcactcgatcgtcctcaccggcgacgagttccgggtgaaggggcggaccgtggagctgccgtgcgggctgacgctcgggtcgtacatcacggtggccgccacgccgcgcgcggcgcatgccgaccgagatcctaaaatcacgctggtgcgggagggggacgagccgatcatggtgtcgcagttcatgatggagttgcaggggctcaagacggtggacggtgaggacccgccaagaatcctccacttcaatcctcgcctccgcggcgactggagtggcaagcctgtgatcgagcagaacacatgttaccgaatgcagtggggaacttctctccgctgcgagggctggaggtcccgtgctgatgaggagaccgtggatgggatggtgaagtgtgagaaatggattcgagatgacgaggagaggtcagaacaatcaaagacgtcatggtggctcaaccgcctcattggccgaacaaagaaggtctctgttgattggccatacccgtttgtggaggactgcatgttcgttcttactcttaccgccgggttggagggttaccacgtgaacgttgatggacgacacgtcacatcatttccgtaccgcactggatttgtgcttgaagatgccactggcttatcattgaatggggatcttgatgtgcaatcggtgtttgcagggactttgcccactgcacaccctagcttttcacctcagaaacacctagagatgttgcctatttggcaggcccctccccttccagacgaaccaattgagattttcattggcatcctgtcagcaggcaaccattttgctgaacgtatggctgtgaggaagacatggatgtctgctgcccagaagtcctcgaatgtcgtggcccgtttttttgttgccctgaacagcagaaaagaagtcaatgcagaattgaagaaagaggcagagttttttggggacattgttattgtgccattcatggacagctatgacttagttgttctaaagactgtggcaatatgtgaatatggggtgcgtgttgtttccgctcgatatataatgaagtgtgatgacgataattttgttagacttgaatcagtgaaggatgaacttaagaaaataccaagaggtaaaagtctctatgtgggaaacatgaattatcaccacaagccattgcgcactgggaagtgggctgtcacttatgaggagtggccagaagaggattacccaacatatgcaaatggtcctggctacgttatatcttctgatattgctgcttccattgtgtcagaatttacagctcataaattaaggctcttcaagatggaagatgtgagcatgggcatgtgggttgagcggttcaataacaccagacatgttcaatatgttcacagtatcaagttctgccaatttggatgcatagatgattactacactgcacattaccagtcaccgaggcaaatgctatgtttgtgggataagctgcagtctgggaaagcacaatgttgcaatatgagatagcgacaatgaaactggcagcatcgatccccttcgattgtgttagtggtcattcttctttgctacatgatgatcctgagcccaagatcgaaggactgttttgcgatgataaattaagtcctcagatgactaacaaatggccatagtttcttgcttttcatgtagagatgaccgtcgaaactttcagctagaaaccaactcagggaatgaatacgaagttcagtgggcactaatagaactgctcaaggacttcatctgtacatgtgaagggtagaaagcttagttgaaattgttgctactcttgatatgcctgattgtggttgaaagtcatgaacaacccatcaggtacgtagaacatcttggcgttttactcaatttgtcgcagaatttttgatttgacatggtcataagttatgacatgtatttagttctggctgcaaacatcttgcatgagttcatggagtatcagatttttcttttccttcttgtttttagattcaggttgtatcgctgcagctcgagtgttcatacgtattaatttgaaatgtacgtacatataatatttttgtcgagaaatacagtataaatacatgtgcgccac

SEQ ID NO: 3430 - DNA, 2434 bp, Brachypodium distachyon
ctagggtttgggctcgcgccgtcgggtcgcaatgcggaggccaccggcggcggcggccggcgcgtcctcctgccgccgccgcgcggtccaggggttcgtggcgctcgccttcctcgcgtacgcgctgctcgtgctgtccctcgggtcgcgaggggccgcgcacgcgtccctgcccggcggcaaggggtcggcgtcgtcgcggccgctccacctcgacggcgacggcgagcggggcgcgccggcgcggccctcgaagcgcgcccaccgggagaccctggaggcggcgccggggatcgtctccgggctcgacctccgccgcctcaattcctcccgctccggctcgctccgcaaggtcgccgccgaggccgcggccgccggggcccgcgtcttctccgagctgcaggctctcgcggggaccctgtcggcttcgtcggacgaggaggagaggagcaagtgcccccactcgatcgtcctcaccggcgacgagttccgggcgagggggcgggcggtggagctgccgtgcgggcttacgctgggctcgtacatcaccgtggccgcgacgcccaacgcggcgcaccccgagcgggaccctaagattaccctgctgaaggagggggacgagccgatcatggtctcgcagttcatgatggagctgcaggggcttaagacggtcgacggggaggatccaccgaggatcctccacttcaatccccgcctccgtggggactggagcggcaagcctgtgatcgagcagaacacctgctaccgcatgcagtggggcaccccgcttcgctgcgagggctggatgtcccgggctgacgaggagactgtggatgggatggcgaagtgtgagaagtggattcaagacgaagggtccaaggagtcaatgacatcatggtggctgaaccggctcattgggcggacgaagaaggtttctgttgattggccatacccatttgtggaggatcgcctgtttgttcttactctgactgctggattagagggttatcatgtgaatgtcgacggcaggcatgtcacatcattcccgtaccgaattgggtttgtgcttgaggatgcgactggcttatctttgaatgggaaccttgatgtgcaatcagtgtttgctgggactttgcccactacacatcctagctttgcaccgcagaaacaccttgagatgttgccagtttggcaggcccctcccttaccagatggaccggtcgaaatttttgtcggtatcttgtcagcgggtaaccattttgctgagcgtatggctgtgaggaagacatggatgtctgctgcccagaagtcttcgaatgtcgtggcccgattttttgttgcgctgaacggcaggaaagaagtgaatatggagttgaaaaaagaggcagagttttttggggacattgttattgtgccattcatggacagctatgatttggttgttctgaagactgttgcgatatgcgaatatggggtccgcatctctgcgagatatataatgaagtgtgatgatgatacttttgttagacttgaatcagtaatggctgaagtgaagagaataccgagcagtaaaagtctttatatagggaacatgaattatcgccattatccattgcgcaatgggaaatgggctgttacttacgaggagtggccagaagaggattatccaacatatgcaaatggtcctggatatgttatatcttctgatattgcagattccattgtatcagaatttacaaaccataaattaaggcttttcaaaatggaagacgtaagcatgggaatgtgggttgagcgattcaacaagaccagacctgttgagtatgtgcacagtgtcaagttctgtcaatttggatgcatagatgattactacactgcgcattaccaatcaccaaggcagatgctatgtttgtgggacaagctgcaggctgggagaccaaggtgttgcaatatgagatagcaatataggaactggtggtattcgaccctttttttggcattactaatcatccatatttgccgaaaggtaagctgatgatgctgaccccgagattgaaggaatactttatggtggtaatttaagcagctagaagactatccatttcactagagatgtccggggcgagtttcagctataaaaactcagggaatgaacagccagcttgcagggctccattttttagagctcttcttccccgcttatttttatatagaagaagctccatgggctaacggaactgctcaaggacttaagttgtaaatgtgaagggtagaaagcttaggcaagtggtatgactggttgtggttgtagtcttgaacaaacagcccatcaggcactgaagaggaatcttgtcaggttatacaaattctatttcgcaacttctcgactaaactggttttgatatcattactcaaaaggactgagttacacgat

SEQ ID NO: 3431 - DNA, 5461 bp, Brachypodium distachyon
gttttttctcgttcgtcctgatcgatcccctgctgagccgcatcacgatccccctgccgagccgcatcatgatcccgagccaaatcaccgccgccgcccaacacacgtcccccgaatcctgatccaaacaaccgccgcctgtcgttcgtgcttgcgcacgcgagccaacgacctcgcggacggagatccccttgaggatggagcatccggcggcggaggaggagggggagaagcctgcggccgttatggatgctgctgctgctttagctgcgggcgacagggggcaaaggcgccaccagcatggacacgccactcgccttcccggagcacggcatcggacgacgaacacaccctgggggcccgcttcctcgacgcggaggacgacgcgctcgacctcctcctcgacgagctcgacacggagccgctgatatcgtctatactggatggggacgccgtccggcgcgtggtgtccctgctcgtcgaggcggaggaggcggtcgactcgaggtcgccggccgctaccagcgcccgttcggccctttgggtggtggaagtactcgatcgtcgtgccacggttccagtacaacccaatcaagaaagtgttctacgagtatgtacatgcagctacttcctcaattttagatcttgggattgatagtttcctcttttattttgccgttttactgttgtgtcattcttgaacatttgctatattctccaaattgagtgctcacaggtggatgtttttggaagctggttgtcacttcactgactgatttgcctaaatattggtaataattaaatgaaacttgatgagagattgataattcacagaatggatgcagatcattatttcaagggtagaactccttttttcttagcttagtgaaaatgttttcaaaacaccttccatcctttcactaaattgtgcttgaatatagttctgacaattcgttagctcggacatgaggattgaatctgtttttaaaactcaacttgttttctttctaggaggcatacattaattcagtatgtcacataggtccccctttaatgttagactagaacacatgacttgctaaaacagcctttgttcatgccttaaccacctatttgattatttcacggagacgcaaagatggcgaatgacctttcagatcttcggtttgttgattttatgttcaattattatgtttatatatgcacacgggcatattagcaatccatggagaatctggcgataaaggtgccctttacggggataggtatcaagtgcttcttcagaggctcgctcgtgataaatatttctccaagccagcctttgagactgatgactgaaaaggatagttgtgaggtatttctcctaatgtgtgatgtgtttattctattctggattgatttgcgtgatcccaatccgttgcagttgtccggaagaacctttggtgcggtctcttttgtttcttgatatattttagttttcgtatatggaattacttataatattttgcctccttcatgtacataacttctatagtctttaattgggtgcactgggcggagatggattatgggggtcatatcgcagttgaaggaacgtccgttctacttggaggatcttactggagcagttccaactgacttatcaaatgcaatatactgagaatcattgtcatgttatcttaatttaatttggttctcttactttattacagttgtaattgtaacattagcgaattgtccgtagcaacgcacaggcgaaaaaatatcttttagaaaatgtgaaatggagcgaacagccgtgacagcgcacgggcattttggctattacagcacataataggagtataaaaataatcataattaaatatgctgggcccacggaatctccgacagattaacaaaatcaaatcaatgtaactgtaacaaaagcaccgtgcgcgactcagtttggttgtaaaaaaataaatgggttaatttgtatatgccaatttcgttgatttcaaagaatgccactataattttcatgttttcaaaaatgcaattgcaaatctgcatcaaaaaattccactagtgacatttttcaaataatgagaatttcactagcttttcacgaaatcgccaaaattacggtgccatatatcaaattagcccaaattatattgtcatgtagcgttgctcttctgatgcattcggttttaatccattcctgctcgatttggattcacgtgcaattttcaactctttcctcaggtagcacggggtcaaaccggcggcccccaccgcccgggattcgccggcacgcaccgcattcatccacgcgtacacttggtccatgaacacggtccatacgccagcgtactccatccctacttctcgcttacacggcaacagcaacatccccctgcaccgagcccgcgcaaccctaccccgcccgcactcacggcgcccacgcggtattttgggcgtgctgctttttaggatttttattatagaaaaaaatataatatcttaaaaactaagcgcattggttcgaacgaaaccgtcgattggaataacgcaaacacgtccggctccttcctttttggctttggctccggctttgggagtttccagtttcccttccctttttcccctgagccgccctcctcctcttcctccggctcgctctcccacgccgcccgcgcccgaccacctcgtcgcgccccgggcccctggattcctagggtttgggctcgcgccgtcgggtcgcaatgcggaggccaccggcggcggcggccggcgcgtcctcctgccgccgccgcgcggtccaggggttcgtggcgctcgccttcctcgcgtacgcgctgctcgtgctgtccctcgggtcgcgaggggccgcgcacgcgtccctgcccggcggcaaggggtcggcgtcgtcgcggccgctccacctcgacggcgacggcgagcggggcgcgccggcgcggccctcgaagcgcgcccaccgggagaccctggaggcggcgccggggatcgtctccgggctcgacctccgccgcctcaattcctcccgctccggctcgctccgcaaggtcgccgccgaggccgcggccgccggggcccgcgtcttctccgagctgcaggctctcgcggggaccctgtcggcttcgtcggacgaggaggagaggagcaagtgcccccactcgatcgtcctcaccggcgacgagttccgggcgagggggcgggcggtggagctgccgtgcgggcttacgctgggctcgtacatcaccgtggccgcgacgcccaacgcggcgcaccccgagcgggaccctaagattaccctgctgaaggagggggacgagccgatcatggtctcgcagttcatgatggagctgcaggggcttaagacggtcgacggggaggatccaccgaggatcctccacttcaatccccgcctccgtggggactggagcggcaagcctgtgatcgagcagaacacctgctaccgcatgcagtggggcaccccgcttcgctgcgagggctggatgtcccgggctgacgaggagactgtggatgggatggcgaagtgtgagaagtggattcaagacgaagggtccaaggagtcaatgacatcatggtggctgaaccggctcattgggcggacgaagaaggtttctgttgattggccatacccatttgtggaggatcgcctgtttgttcttactctgactgctggattagagggttatcatgtgaatgtcgacggcaggcatgtcacatcattcccgtaccgaattgggtttgtgcttgaggatgcgactggcttatctttgaatgggaaccttgatgtgcaatcagtgtttgctgggactttgcccactacacatcctagctttgcaccgcagaaacaccttgagatgttgccagtttggcaggcccctcccttaccagatggaccggtcgaaatttttgtcggtatcttgtcagcgggtaaccattttgctgagcgtatggctgtgaggaagacatggatgtctgctgcccagaagtcttcgaatgtcgtggcccgattttttgttgcgctgaacggcaggaaagaagtgaatatggagttgaaaaaagaggcagagttttttggggacattgttattgtgccattcatggacagctatgatttggttgttctgaagactgttgcgatatgcgaatatggggtccgcatctctgcgagatatataatgaagtgtgatgatgatacttttgttagacttgaatcagtaatggctgaagtgaagagaataccgagcagtaaaagtctttatatagggaacatgaattatcgccattatccattgcgcaatgggaaatgggctgttacttacgaggagtggccagaagaggattatccaacatatgcaaatggtcctggatatgttatatcttctgatattgcagattccattgtatcagaatttacaaaccataaattaaggcttttcaaaatggaagacgtaagcatgggaatgtgggttgagcgattcaacaagaccagacctgttgagtatgtgcacagtgtcaagttctgtcaatttggatgcatagatgattactacactgcgcattaccaatcaccaaggcagatgctatgtttgtgggacaagctgcaggctgggagaccaaggtgttgcaatatgagatagcaatataggaactggtggtattcgaccctttttttggcattactaatcatccatatttgccgaaaggtaagctgatgatgctgaccccgagattgaaggaatactttatggtggtaatttaagcagctagaagactatccatttcactagagatgtccggggcgagtttcagctataaaaactcagggaatgaacagccagcttgcagggctccattttttagagctcttcttccccgcttatttttatatagaagaagctccatgggctaacggaactgctcaaggacttaagttgtaaatgtgaagggtagaaagcttaggcaagtggtatgactggttgtggttgtagtcttgaacaaacagcccatcaggcactgaagaggaatcttgtcaggttatacaaattctatttcgcaacttctcgactaaactggttttgatatcattactcaaaaggactgagttacacgatagatattcgtgccatgactcaggggccacctttaaatctgcttgggttgttacccttttctttttaggggaagtagaacggccaggctgctgctaccgagtcaccaaggcaaggtggtgaacatgtgcagtgcgactcaaaggttcggtcagtggtccgcatgccctggagcctctcaacgttcgtagtcttttttaattaaacacagtacagatgcatatgtacacacgtactctcaccactaagaatacatgcatgcacaccctatcctatcagcacctacgagagactggttcgacacattatct

SEQ ID NO: 3432 - DNA, 2512 bp, Glycine max
aacctgtcataagcaatgttggcgaggaaaaccccaaactcattttcttcttcttccaaattcgttggacttaagttgttacttgcaagacccaattacctactgcccgaaagtgggccaaagccacaaccagcaaaatatttttgtaaaaagttactactcttgctaaagaagataatcatgtcctaaaatgtgtccgccatggctactaccaaatcacacaaagtggaaactccgtactctttgcccagctgtcactccccgtcccctttataaacccccattaattgaccactccttcctactctcaacaaattcaaaacctctgttttctctctccacactctgcctctaacttgaaaaaaaaactcaaacactctgttctcgtcgcatgcacataaacaataacaaatggcttccacaactatgttgttgctggtcgtgttcatgattctatgtatatcacacccctcatttcaaatggttcttgtgcctttaacacacacactttccaaagcccaattcaacagcacccaccaccttctcaaatccacttccacccgttccgcaaaacgcttccgccgccaactctccctcccactctccccgggcagcgactacactctctccttcaacctgggcccgcaggcccaggcccagcccattacgctctacatggacactggcagcgacttagtctggttcccctgcgccccttttaaatgcatactctgcgagggaaagcccaacgagcccaacgcctctcccccaaccaacatcactcaaagcgtcgccgtttcgtgcaagtcccccgcgtgctccgcagcgcacaacttagcccctccctccgatctctgcgccgccgctcgttgtcctctcgaatcaatcgaaacctccgattgcgcaaatttcaagtgtccaccgttttattatgcttacggtgatggaagcttaatcgcgcgtctctatcgtgacacgctttctctctcttctttgtttctcagaaatttcacgttcggttgcgctcacactaccctcgccgaacctactggagtcgccggattcggtcgtggtttgctctctctcccggcgcagctggccacgttatctcctcaactcggaaaccggttttcgtattgtttggtttctcactcgttcgattcggagcgagtgagaaaaccgagtccactaattcttggacgctacgaggagaaggagaaggagaagattggtggtggagtggcggagtttgtttacacgtctatgcttgaaaaccctaagcatccttatttttataccgttagcttaatcggaatcgccgtcgggaaaaggactattccggcgccggagatgctacggcgggtgaacaatcgaggtgacggcggcgtggttgtggattccggcacgacgttcacgatgttgccggcggggttttataactcggtggtggacgagtttgaccgccgagtcgggcgagacaacaagcgcgcgcgtaagattgaagagaaaacgggactcgcgccgtgctattatttgaactccgtggcggacgtaccagctctgacgctgcgttttgctgggggaaagaattcgagtgtggtgcttcctaggaagaactatttctacgagttttcggacggtagtgatggagcgaaggggaagaggaaggtggggtgcttgatgctgatgaacggtggggatgaagcggatttgagtggtgggcccggggccacactcgggaattaccaacagcaagggtttgaggttgagtatgacttggaagagaagcgcgtggggttcgcaaggaggcagtgcgcgttgctttgggagagactcaatcgcgacaaaaactagcgtaaggtatcgtgcactgaacatactagattccctcccctgctttctgtcacgggtcgggttctttctgtaaattttgaaataaggcgggctttcgggccatgcgcttgtatgtctactaatagtaaggaaagctgtacactatcttttttaaaaaaaaaaaagaagaagcctgaattgtattgtaagaattgtaagtaaacgtaaatgattgaaaataatattttttttagggctcgaattgatgtagtactttcttactttttttgaatggtaagttcaagttgtgttggagttgatgatgaacagtgatgtcatgggatgaaggaatctgtccaaaattcagctgtgacaaaccagccatgtagataatccaccgttctttatggaagtgggattcgatttcgaactgcctggttaatttcttttaattcagctttggccatgtctttgtagaagttgggaccattactgtttttgagtttggccaggacaataagaaagattcttgtcatccatgtcatcatcaatcacggattcttctagtttaaatgtaatttttatccatttaatataaataatgtatgaaatactatgatgtcccatatgtaaaatattggatttggtggtgttaataacatacattacattataatca

SEQ ID NO: 3433 - DNA, 2506 bp, Glycine max
gtcataagcaatgttggcgaggaaaaccccaaactcattttcttcttcttccaaattcgttggacttaagttgttacttgcaagacccaattacctactgcccgaaagtgggccaaagccacaaccagcaaaatatttttgtaaaaagttactactcttgctaaagaagataatcatgtcctaaaatgtgtccgccatggctactaccaaatcacacaaagtggaaactccgtactctttgcccagctgtcactccccgtcccctttataaacccccattaattgaccactccttcctactctcaacaaattcaaaacctctgttttctctctccacactctgcctctaacttgaaaaaaaaactcaaacactctgttctcgtcgcctgcacataaacaataacaaatggcttccacaactatgttgttgctggtcgtgttcatgattctatgtatatcacacccctcatttcaaatggttcttgtgcctttaacacacacactttccaaagcccaattcaacagcacccaccaccttctcaaatccacttccacccgttccgcaaaacgcttccgccgccaactctccctcccactctccccgggcagcgactacactctctccttcaacctgggcccgcaggcccaggcccagcccattacgctctacatggacactggcagcgacttagtctggttcccctgcgccccttttaaatgcatactctgcgagggaaagcccaacgagcccaacgcctctcccccaaccaacatcactcaaagcgtcgccgtttcgtgcaagtcccccgcgtgctccgcagcgcacaacttagcccctccctccgatctctgcgccgccgctcgttgtcctctcgaatcaatcgaaacctccgattgcgcaaatttcaagtgtccaccgttttattatgcttacggtgatggaagcttaatcgcgcgtctctatcgtgacacgctttctctctcttctttgtttctcagaaatttcacgttcggttgcgctcacactaccctcgccgaacctactggagtcgccggattcggtcgtggtttgctctctctcccggcgcagctggccacgttatctcctcaactcggaaaccggttttcgtattgtttggtttctcactcgttcgattcggagcgagtgagaaaaccgagtccactaattcttggacgctacgaggagaaggagaaggagaagattggtggtggagtggcggagtttgtttacacgtctatgcttgaaaaccctaagcatccttatttttataccgttagcttaatcggaatcgccgtcgggaaaaggactattccggcgccggagatgctacggcgggtgaacaatcgaggtgacggcggcgtggttgtggattccggcacgacgttcacgatgttgccggcggggttttataactcggtggtggacgagtttgaccgccgagtcgggcgagacaacaagcgcgcgcgtaagattgaagagaaaacgggactcgcgccgtgctattatttgaactccgtggcggacgtaccagctctgacgctgcgttttgctgggggaaagaattcgagtgtggtgcttcctaggaagaactatttctacgagttttcggacggtagtgatggagcgaaggggaagaggaaggtggggtgcttgatgctgatgaacggtggggatgaagcggatttgagtggtgggcccggggccacactcgggaattaccaacagcaagggtttgaggttgagtatgacttggaagagaagcgcgtggggttcgcaaggaggcagtgcgcgttgctttgggagagactcaatcgcgacaaaaactagcgtaaggtatcgtgcactgaacatactagattccctcccctgctttctgtcacgggtcgggttctttctgtaaattttgaaataaggcgggctttcgggccatgcgcttgtatgtctactaatagtaaggaaagctgtacactatcttttttaaaaaaaaaaaagaagaagcctgaattgtattgtaagaattgtaagtaaacgtaaatgattgaaaataatattttttttagggctcgaattgatgtagtactttcttactttttttgaatggtaagttcaagttgtgttggagttgatgatgaacagtgatgtcatgggatgaaggaatctgtccaaaattcagctgtgacaaaccagccatgtagataatccaccgttctttatggaagtgggattcgatttcgaactgcctggttaatttcttttaattcagctttggccatgtctttgtagaagttgggaccattactgtttttgagtttggccaggacaataagaaagattcttgtcatccatgtcatcatcaatcacggattcttctagtttaaatgtaatttttatccatttaatataaataatgtatgaaatactatgatgtcccatatgtaaaatattggatttggtggtgttaataacatacattacattataatc

SEQ ID NO: 3434 - DNA, 1915 bp, Phaseolus vulgaris
actctgttttggttcatgcacattaacaaatgacttctacgatgttgttgttggttttgttgatgatattatgtatttcacatccctccttccaaatgctactcttgccacttacacacactctttcccaagcccaattcaacagcacccaccaccttttgaaatccacctccacccgttccgccgcccgcttccgccgccaactttcccttcccctctcaccaggcagcgactatactctctccttcaacctgggcccccatgcccagcccataaccctctacatggacacaggcagtgacttagtctggttcccctgcgcccctttcaaatgtattctctgcgagggaaagcccaacgagcccaacgcctctcccccaaccaacatcacccgaagtgtcgccgtttcgtgcaagtctctcgcatgctccgcagcgcacaacttagcctcctcttccgatctctgcgcaatggctcgttgccctctcgaatcaatcgaaacctccgactgcgccaatttcaagtgtccaccgttttactacgcctacggcgacggaagcttagtcgcgcgtctatatcgtgacacgctctctctctcttctctgtctcttagaaacttcaccttcggttgcgctcacacagccctcgccgagcctactggagtcgccggattcggccgcggtttgctctctctcccggcgcagctagctactctctctcctcagctcggaaaccgcttttcttattgccttgtttctcactcgtttgactctgaccgagttcgaaaaccaagtccactcattctcggccgttacgaggagaaggaaaaggagaagatcagtggaggtggaatggttgagttcgtgtacacgtctatgcttgaaaatcctaagcatccttatttttataccgttggcttaatcggtatctccgttgggaaaaggactattccggcgccggagatgctgcggcgggtgaacaatcgaggagacggtggagttgttgtggattccggcacgacgttcacgatgttgccggaggaattttataactcggtggttgacgagttcgaccgccgagtcgggcgagtcaacaagcgcgcgcgtaaggttgaagaaaaaactggactcgcgccgtgctattatttgaatgcggtggcggaagtgccggttgtgacgctgcgttttgctggagggaattccagtgtggtgctgcctaggaagaattatttctacgagtttttggacggtagcggtgagaggaaggggaagaggagggtggggtgtttgatgctgatgaacggtggagatgagggtgaattgagtgggcccggggccacactcgggaattaccagcagcaaggatttgaggttgtgtatgagctggaagagaagcgcgtgggattcgccaagaggcattgcgcgtcgctttgggagagactgaatcgtgacaagaactagcgcatgctgcactccatacactggattccctccctgctcctgtcacgggtcgggccttctgtaaattgaaataaggcgggcttttgggccatgcggttgtgtgtctacataataggaaagctgtacactctttctttccaaactctagatagctgtggatttctgttctaaaaattgtaagtaaaaattcagaataatatttattgaggcctgcaatttctgtacttctttaattatttggatggaaatttgcgtgggagttgctgatgaacagtgatgtcatgggatgaaggaacctgtccaaaattccagctgtgagaaaccaggcatgtagataatccaaggagttgtttggttaatttcttctaattcagttttggccatctctttgaagttgggaccatttctgctttgagtctggacacaaaaatataaaaattattgtttatcacgaa

SEQ ID NO: 3435 - DNA, 2062 bp, Phaseolus vulgaris
ttcaacaaattaaaaaagttcctcttctaactccaaactcattactctgttttggttcatgcacattaacaaatgacttctacgatgttgttgttggttttgttgatgatattatgtatttcacatccctccttccaaatgctactcttgccacttacacacactctttcccaagcccaattcaacagcacccaccaccttttgaaatccacctccacccgttccgccgcccgcttccgccgccaactttcccttcccctctcaccaggcagcgactatactctctccttcaacctgggcccccatgcccagcccataaccctctacatggacacaggcagtgacttagtctggttcccctgcgcccctttcaaatgtattctctgcgagggaaagcccaacgagcccaacgcctctcccccaaccaacatcacccgaagtgtcgccgtttcgtgcaagtctctcgcatgctccgcagcgcacaacttagcctcctcttccgatctctgcgcaatggctcgttgccctctcgaatcaatcgaaacctccgactgcgccaatttcaagtgtccaccgttttactacgcctacggcgacggaagcttagtcgcgcgtctatatcgtgacacgctctctctctcttctctgtctcttagaaacttcaccttcggttgcgctcacacagccctcgccgagcctactggagtcgccggattcggccgcggtttgctctctctcccggcgcagctagctactctctctcctcagctcggaaaccgcttttcttattgccttgtttctcactcgtttgactctgaccgagttcgaaaaccaagtccactcattctcggccgttacgaggagaaggaaaaggagaagatcagtggaggtggaatggttgagttcgtgtacacgtctatgcttgaaaatcctaagcatccttatttttataccgttggcttaatcggtatctccgttgggaaaaggactattccggcgccggagatgctgcggcgggtgaacaatcgaggagacggtggagttgttgtggattccggcacgacgttcacgatgttgccggaggaattttataactcggtggttgacgagttcgaccgccgagtcgggcgagtcaacaagcgcgcgcgtaaggttgaagaaaaaactggactcgcgccgtgctattatttgaatgcggtggcggaagtgccggttgtgacgctgcgttttgctggagggaattccagtgtggtgctgcctaggaagaattatttctacgagtttttggacggtagcggtgagaggaaggggaagaggagggtggggtgtttgatgctgatgaacggtggagatgagggtgaattgagtgggcccggggccacactcgggaattaccagcagcaaggatttgaggttgtgtatgagctggaagagaagcgcgtgggattcgccaagaggcattgcgcgtcgctttgggagagactgaatcgtgacaagaactagcgcatgctgcactccatacactggattccctccctgctcctgtcacgggtcgggccttctgtaaattgaaataaggcgggcttttgggccatgcggttgtgtgtctacataataggaaagctgtacactctttctttccaaactctagatagctgtggatttctgttctaaaaattgtaagtaaaaattcagaataatatttattgaggcctgcaatttctgtacttctttaattatttggatggaaatttgcgtgggagttgctgatgaacagtgatgtcatgggatgaaggaacctgtccaaaattccagctgtgagaaaccaggcatgtagataatccaaggagttgtttggttaatttcttctaattcagttttggccatctctttgaagttgggaccatttctgctttgagtctggacacaaaaatataaaaattattgtttatcacgaattgttttccatctaattaattgatgttccatatgtagattattcagtttggtgctgcaaacatcttatttatactctcttgtataagtttttttcatttatatt

SEQ ID NO: 3436 - DNA, 2071 bp, Cajanus cajan
ccttcaacaaattcaaaaacactctctgctttcaacttcaatactctgtttcccttgcatgcactgcacataatcaagtgatttctttcaatatgtggctgttgctcttgttcactatgctctcttttccacacccttcatgccaaatgctactcttgcccctaacccacactctttcccaagcccaagcccaagcccaagcccaattcaacgccactcaccacctcttgaaatccacctccacccgttccgcggcccgtttccggcgccaactctccctccccctctccccgggcagcgactacacactctccttcaacctgggccggcaggcccagcccataacactctacatggacaccggcagcgacctagtctggttcccctgcgccccttttaaatgcatcctctgcgagggaaagcccaacgagcccaacgcctctccccccaccaacatcacccgaagcgtcgccgtttcatgcaagtcccccgcatgcgccgcagcgcacaacgccgcctccacctccgatctctgcaccatggctcgttgtcctctcgaatccatcgaaacctccgattgcgcctctttcaagtgtccaccgttttactacgcctacggcgacggaagcttaatcgcgcgtctctatcatgacacgctttccctctcctcgttgtttctcactaacttcaccttcggttgcgctcacaccacgctcgccgaacctaccggcgtcgccggcttcggccgcggattactctctctccccgctcagctagctacgctctctcctcaactcggaaaccgcttctcctattgtttagtctctcactcgttcgactcggagcgggttcggaaaccgagtccactcatcctcggccgttaccacgagaaggataagaatattcgcggtggcgatgaagtggttgagtttgtgtacacgcctatgcttgaaaaccctaagcatccttacttctactgcgttggcttaaccggaatatccgtcgggaagaggattattccggcgccggagattctgcggcgggtgaacgcgcgaggcgacggcggcgttgtggtggactccggcacgactttcacgatgttgccggcgggattctacaactcggtggtggcggagttcgagcggcgagtggggcgagtgaactcgcgcgcgcgtggggtggaggagagaacgggactggcgccgtgttattatttaaaagcgggggcggaggtgccacgcgttacgctgcgtttcgcgggggcgaattcgagtgtggtgctgcccaggaagaactatttctacgagtttttggagggtggtgatggggcgaggaggagggtggggtgtctgatgatgatgaacggtggagatgagagtgagttgagcggtgggcccggggccacgctcgggaattaccagcagcaggggtttgaggttgagtatgacttggaagccaagcgcgtggggttcgctaagaggcagtgcgcgtctctttgggagagactcaatcgcgacaaaaactagcgtacgctgcactgcacacaccggattccctcacgggtcgggtctttctgtaaattcaaataacgcggcctttggagccatgcatgcgcttgtgtgtctactaaataggaaagttgtacactagtatatttttaaaaaccctattgtaaaaaggaaaaattgtaagtaaacatcaaatggttgagattgagagtaatatatttttatttttttatgtgagaatgatatctcgaaatgatgatgaagggatctgtccaaaatccagctgtgataagggagccacgaagatatataatacaactaagcaatgggattctaaatgctaggttcagtttggaccatgtcttaaaagttgggaccattgctgttttgagtttagacaggaggacaatttaaaggattcttgccgtttgtgccatcgttcacggattcttcacgtttaaatgttgtactactagttattatccatttcaacaagttaatgtatgaaatatgatgttccatattcatattgtatttggtggtggtaataacttacaggcagg

SEQ ID NO: 3437 - DNA, 2015 bp, Glycine max
ccacaacacaggccaaaacccaaaccttgacttggctcgccactccacacgccattgcaagtcccgtgctctctcgctccttcaccttctactccccaaactcgaaaccccacttactgaactttgttaaagttcataaatttcacaaaatttttcgaccttctttgcttcaaaatctacttccttcaaaatctacttcctctcctatcactaaccgtttcaattttgatttttgggctccatagcttggaaggcagaagaagatggagaagcttaacttggcccttgtgtcttccccaaagcctttgatgttgggacatgttcctgcaatagacgccacatccagagacgttttcagaagaaagcacttctcttttgggagggtcttaattgctcctcatcgttgcagattccgtgtttctgcactctcttcctcccatcgtaatccgaaatctgtgcaggagaagctgatagtaaagcattttgctagtatttcttcttcgaatactcaagaagcgacgtcaactggagttaacccacaattatcaccatcttcaactatagggtcacctctcttctggattggtgttggtgttgggctttctgcactgttttcagtggtagcttcaagattaaagaaatatgcaatgcaacaagctttcaagaccatgatgggccagatgaattcacaaaataaccaatttggcaatgctgccttttctccgggatctccttttccctttccaatgcctacagcagcagggcccactgcacctgctagttctgcaactactcaatctcgagcaccttcagcatctagtgcatctcaatccactatcacagtagatatacctgcagcaaaagtagaagttgctccaactactaatgttaaagatgaagtcgaagtaaagaatgaacccaaaaaaattgcttttgtagatgtttctccagaagaaactgtgcaggagagtccttttgaaagttttaaagatgatgaatcaagttccgtcaaggaagctcgggttccagatgaagtttctcaaaatggagccccctctaaccaaggttttggtgattttcctggttctcaatctacaaaaaaatcagtcttgtcagtggatgctttggagaaaatgatggaggacccaacagtgcagaagatggtttatccctatttacccgaggagatgaggaaccctactaccttcaaatggatgctgcagaatccacagtaccgtcaacaacttgaagaaatgctaaacaacatgggtggaagcacagaatgggacagccgaatgatggataccttaaagaattttgaccttaatagtcctgaagttaagcagcaatttgatcaaattgggctttctccagaagaagtcatttcaaagattatggccaatcctgaggttgcaatggcatttcaaaatcctagagttcaagcagctatcatggattgttcgcagaatccaatgaatattactaaataccaaaatgataaggaggttatggatgtcttcaataaaatatcagaactcttccctggagtaggttcaccttgatgcatttgtgtgttgttgctgtttgctgggtcaagttatgcatccctttcctgatgaccaatgaagattagctcggcctaaccacacggaaccatgcaaaactcttatgctcatggctgtatactgcaggctcgcggttacagctccattgtgacatgcggatagtaactgtgtcttcttcgctgggctaaaataatgccacagttggatttttttgtttcactaaaatagttgagattgtgtagattgatgttttatgttttcattaaatattttgtttgaggcattgtatttgcagtgtggtttttggttgagtattcaggtgcagtaaaaatgtgaatgcttcgtataataatttcataaagtataatctgagattaggggccagtttgtttttttatttgttaaaataagcgtttattttaatgaaataaatagttttctattttttta

SEQ ID NO: 3438 - DNA, 1988 bp, Glycine max
cccaaaccttgacttggctcgccactccacacgccattgcaagtcccgtgctctctcgctccttcaccttctactccccaaactcgaaaccccacttactgaactttgttaaagttcataaatttcacaaaatttttcgaccttctttgcttcaaaatctacttccttcaaaatctacttcctctcctatcactaaccgtttcaattttgatttttgggctccatagcttggaaggcagaagaagatggagaagcttaacttggcccttgtgtcttccccaaagcctttgatgttgggacatgttcctgcaatagacgccacatccagagacgttttcagaagaaagcacttctcttttgggagggtcttaattgctcctcatcgttgcagattccgtgtttctgcactctcttcctcccatcgtaatccgaaatctgtgcaggagaagctgatagtaaagcattttgctagtatttcttcttcgaatactcaagaagcgacgtcaactggagttaacccacaattatcaccatcttcaactatagggtcacctctcttctggattggtgttggtgttgggctttctgcactgttttcagtggtagcttcaagattaaagaaatatgcaatgcaacaagctttcaagaccatgatgggccagatgaattcacaaaataaccaatttggcaatgctgccttttctccgggatctccttttccctttccaatgcctacagcagcagggcccactgcacctgctagttctgcaactactcaatctcgagcaccttcagcatctagtgcatctcaatccactatcacagtagatatacctgcagcaaaagtagaagttgctccaactactaatgttaaagatgaagtcgaagtaaagaatgaacccaaaaaaattgcttttgtagatgtttctccagaagaaactgtgcaggagagtccttttgaaagttttaaagatgatgaatcaagttccgtcaaggaagctcgggttccagatgaagtttctcaaaatggagccccctctaaccaaggttttggtgattttcctggttctcaatctacaaaaaaatcagtcttgtcagtggatgctttggagaaaatgatggaggacccaacagtgcagaagatggtttatccctatttacccgaggagatgaggaaccctactaccttcaaatggatgctgcagaatccacagtaccgtcaacaacttgaagaaatgctaaacaacatgggtggaagcacagaatgggacagccgaatgatggataccttaaagaattttgaccttaatagtcctgaagttaagcagcaatttgatcaaattgggctttctccagaagaagtcatttcaaagattatggccaatcctgaggttgcaatggcatttcaaaatcctagagttcaagcagctatcatggattgttcgcagaatccaatgaatattactaaataccaaaatgataaggaggttatggatgtcttcaataaaatatcagaactcttccctggagtaggttcaccttgatgcatttgtgtgttgttgctgtttgctgggtcaagttatgcatccctttcctgatgaccaatgaagattagctcggcctaaccacacggaaccatgcaaaactcttatgctcatggctgtatactgcaggctcgcggttacagctccattgtgacatgcggatagtaactgtgtcttcttcgctgggctaaaataatgccacagttggatttttttgtttcactaaaatagttgagattgtgtagattgatgttttatgttttcattaaatattttgtttgaggcattgtatttgcagtgtggtttttggttgagtattcaggtgcagtaaaaatgtgaatgcttcgtataataatttcataaagtataatctgagattaggggccagtttgtttttttatttgttaaaataagcgtttattttaatgaaataaatagttttct

SEQ ID NO: 3439 - DNA, 2010 bp, Phaseolus vulgaris
actgaaaacaaacaatagcacaaagaaaaaaaaggtcagcaaaaattctatagacgacatcgttcaaatagtatttgcaaagttcaactttttatgttgttacttatccctacaacacaacccaaaacctcaaaccttcattagccactccatactccatttcaagcttgccccttctcttcccacaccccaaactccgtagcccacaaaccgaaatatcttcaagtttcaaaatttcccataattttcgcccccctttgcgtccaaatccactgccactcctattattactgattgcaacagtttcagttctttgtttgctcttaatttctgcgtctttttattctgggttacatatcttggaatcaagaagaagatggagaaccttaacttggcccttgtgtcttcctctaaacctttgatgttgggacatgttcctgcaagagacgccacagacagagacgttttaagaagaaagcccttctctcttgggagggtcttgattgctcctcaccgtttcagataccgtgtttctgcactctcttcctcccatcatagcccgaaatctgtgcaggataagctgatagtaaaacattttgctagtatttcttcttcaaatactcaagaaacaacatcaattggagttaacccacaattatcaccacctccgtcctcaactatagggtcacctctcttttggattggtgttggtgttgggctttctgcactgttttctatggtagcttcaagattaaagaaatatgctatgcaacaagctttcaagaccatgatgggccagatgaattcaccaaataacgattttggcaatgctgcattttctccggggtctccttttcccttttcaatgccttcagcagcagggcccactgcaactgctcaatatggagcaccttccacatctagtggatctcaatccactgtcacagtagatattcctgcaacaaaagtagaagctacacgaactactgatattaaagatgaagtagaagtacagaacaaacccaaaaaaattgcttttgtagatgtttctcctgaagaaactgtgcagaagagtccttttgaaagtgttaaagataatgaatcaagttctgtcaaggaggaagcacgggttcctgatgaagtttctcaaaatggagctccctttaaccaaggttttggtggttttccaggttctcaatctacaaaaaaatcggccttgtcagtggatgctttggagaaaatgatggaggacccaacagtgcagaagatggtttatccccatttaccagaggaaatgaggaatcctgataccttcaaatggatgctgcaaaatccacagtaccgtcaacaactggaagcaatgctaagcaacatgggtggaagtactgaatgggacaatcgaatgatggataccttaaagaattttgaccttaatagtcccgaagttaagcagcaatttgatcaaatcgggctttctcccgaagaagtcatttcaaagatcatggccaatcctgaagttgcaatggcttttcaaaatcctagagttcaagcagctatcatggattgttcacagaatccgatgaatattactaaatatcaaaatgataaagaggttatgaacgtgttcaataaaatatcagaactcttccctggaatgggttcaccatgattcatttatgcgttgctgtttgctgggtcaagttatgagatgaaccttgcctaaccaactacatggaaccatgcaaaacactcgtgctcacggttacagctccattgtgacatgcggatactaactgtgtctggcctgggccaattattgccatagttggatcttttttgtttcactaaatagttgagatcgtacattgatatttaaagttttagcaaatattttgttttgaggaattgtatctgcagtgtgtttttgagtattattcaggtcccgtaaaattgtgaatgcttcacataataatctttcacaaatcataagctaattaaactttctctggg

SEQ ID NO: 3440 - DNA, 2020 bp, Phaseolus vulgaris
gaaaacaaacaatagcacaaagaaaaaaaaggtcagcaaaaattctatagacgacatcgttcaaatagtatttgcaaagttcaactttttatgttgttacttatccctacaacacaacccaaaacctcaaaccttcattagccactccatactccatttcaagcttgccccttctcttcccacaccccaaactccgtagcccacaaaccgaaatatcttcaagtttcaaaatttcccataattttcgcccccctttgcgtccaaatccactgccactcctattattactgattgcaacagtttcagttctttgtttgctcttaatttctgcgtctttttattctgggttacatatcttggaatcaagaagaagatggagaaccttaacttggcccttgtgtcttcctctaaacctttgatgttgggacatgttcctgcaagagacgccacagacagagacgttttaagaagaaagcccttctctcttgggagggtcttgattgctcctcaccgtttcagataccgtgtttctgcactctcttcctcccatcatagcccgaaatctgtgcaggataagctgatagtaaaacattttgctagtatttcttcttcaaatactcaagaaacaacatcaattggagttaacccacaattatcaccacctccgtcctcaactatagggtcacctctcttttggattggtgttggtgttgggctttctgcactgttttctatggtagcttcaagattaaagaaatatgctatgcaacaagctttcaagaccatgatgggccagatgaattcaccaaataacgattttggcaatgctgcattttctccggggtctccttttcccttttcaatgccttcagcagcagggcccactgcaactgctcaatatggagcaccttccacatctagtggatctcaatccactgtcacagtagatattcctgcaacaaaagtagaagctacacgaactactgatattaaagatgaagtagaagtacagaacaaacccaaaaaaattgcttttgtagatgtttctcctgaagaaactgtgcagaagagtccttttgaaagtgttaaagataatgaatcaagttctgtcaaggaggaagcacgggttcctgatgaagtttctcaaaatggagctccctttaaccaaggttttggtggttttccaggttctcaatctacaaaaaaatcggccttgtcagtggatgctttggagaaaatgatggaggacccaacagtgcagaagatggtttatccccatttaccagaggaaatgaggaatcctgataccttcaaatggatgctgcaaaatccacagtaccgtcaacaactggaagcaatgctaagcaacatgggtggaagtactgaatgggacaatcgaatgatggataccttaaagaattttgaccttaatagtcccgaagttaagcagcaatttgatcaaatcgggctttctcccgaagaagtcatttcaaagatcatggccaatcctgaagttgcaatggcttttcaaaatcctagagttcaagcagctatcatggattgttcacagaatccgatgaatattactaaatatcaaaatgataaagaggttatgaacgtgttcaataaaatatcagaactcttccctggaatgggttcaccatgattcatttatgcgttgctgtttgctgggtcaagttatgagatgaaccttgcctaaccaactacatggaaccatgcaaaacactcgtgctcacggttacagctccattgtgacatgcggatactaactgtgtctggcctgggccaattattgccatagttggatcttttttgtttcactaaatagttgagatcgtacattaatatttaaagttttagcaaatattttgttttgaggaattgtatctgcagtgtgtttttgagtattattcaggtcccgtaaaattgtgaatgcttcacataataatctttcacaaatcataagctaattaaactttctctgggtgtttggttgtgc

SEQ ID NO: 3441 - DNA, 1837 bp, Vigna unguiculata
gctgccatacccctaagtccaaacccacttaccgaaatttcttgaagttcaaaaatttcccataaattgtacccctttgcttctaaatccactgccactcccatcactattgatttcaactgtttcggttcattgtttgctcttaatctctgtttctttttgattttgggttacatatattggaagcgagaagaagatggagaaccttaacttggcccttgtgtcttcctctaaacctttgatgttgggacgtgttcctgcaagagacgctgcagacagagacgtgttaagaagaaaacccttctcttttgggagggtcttgattgctcctcaccgttgtcgatatcgtgtttctgcgctttcttcctcccatcatggcccgaagtctgtgcaggagaaggtggtagtaaatcattttgcaagtgtttcttcttcaaaaactcaagaaacgacatcagttggagttaacccacaattatcaccacctccgtcctcaactatagggtcacctctcttttggattggtgttggtgttgggttttctgcactgttttctatggtagcttcaagattaaagaaatatgcaatgcaacaagctttcaagaccatgatgggccagatgaattcacaaaataaccaatttggcaatgctgccttttctccggggtctccttttcccttttcaatgccttcagcagcagggcccactgtacctgctggttctgcaactgctcaatctcgagcaccttcaacatctagtagatctcaatccaccatcaccgtagatatccctgcaacaaaagtagaagctacaggaactgctgatattaaagatcaagtggaagtacagaacgaacccaaaaaaattgcttttgtagatgttactcctgaagaaactgtgctgaagagtccttttgaaagtgttaaagatgatgaatcaagttctgtcaaggagaaagcccgggttcctgatgaagtttctcaaaatggagttccctttaaccaaggttttggtggttttcctggttctcaatctacaaaaaaatcagtcttgtcagtggatgctttggagaaaatgatggaggacccaacagtacagaagatggtttatccctatttacgtgaggagatgaggaatcctgataccttcaaatggatgctgcagaatccacagtaccgtcaacaactggaagaaatgctaagcaacatgggtggtactgaatgggacagccaaatgatggataccttaaagaattttgacctcaatagtccccaagttaagcagcaatttgatcaaattgggctttctcctgaagaagtcgtttcaaagattatggccaatcctgacgttgcaatggcttttcaaaatcctagagttcaagcagctatcatggattgttcacagaatccgatgaatattaccaaatatcaaaatgacaaagagattatggatgtcttcaataaaatatcagaactcttccctggagtaggttcaccatgattcatttgagttgctgtttgctgggtcaagttatgagaacacctcttcctaaccaaccacatgttatcatgcaaagctctcatgctcacggttacaactccattgtgacatgcggatactaactgtgtctggcctgggccaaatattgccattttttttttcactaaatagttgcgaatgtacattgatgtttgaaatttcggccaatattttgttttgaggaattttatctgcagtttgtttttgtgtactcaggttccgtaaaattgtgaatgtttcacataataaattttcataaatcattagctgagttaaactaaaaaaaaaaaaaaaaaa

SEQ ID NO: 3442 - DNA, 2088 bp, Cajanus cajan
gttctaatatttgtaaagttcgtagtttttgttttgttatatttttttacttatccctaccaaccaaaactaaaaccttcactcgccacttcccaaacttgaaaccccatttattcaaatctcttaaagttcataaatttcgcaaaaattggaatccccttttaattccaaaacccaccactgtcactcctatcactactgatttccaccgattcaatccatttgttgttctaaatttctgtgttgtttgactttgggttccatagcttggaagccaaaagaagatggagaagcttaacttggcccttgtgtcttccccaaaacctttgatgttgggtcatgcttctgctaaagacgcttcagccagagacgtttttgggagaaagcctttctcttttgggagggccttagttgctcctcaccgttgcagattccgtgtttctgcactctcttcctcacatcatggcgcaaaatctgtgcaggagaagctgatagtgaagcgttttgctagtgtttcttcttcaaggggtcaagaaacaacatcaattggagttaatccacaattagcaccacctccgtcttcaactatagggtcacctctcttctggattggtgttggtgttggattttctgcactgttttcaatggtagcttcaagattaaagaaatatgcaatgcaacaagctttcaagaccatgatgggccagatgaattcacaaaataaccaatttaacaatgctgccttttctcctggatctccttttcccttttcaacgccttcagcatcagggcccactacacctgctagttctgcagctacacaataccaagtacctccagcatataatgcatctcaatctactgtcacagtagatatacctgcaaccaaagtagaaccttccccaactactaatattaaggatgaagaggaagtaaagaacgaacccaaaaaaattgcttttgtagatgtttctcctgaggaaactgcgcagaagagtccttttgaaaattttaaagatgttgatgaatcaagttcagtcaaggaagcccgggttccagatgaagtttctcaaaatggagcaccctctaaccaaggttttggtaatttttctggttctcaatctacaagaaaatcagtcttgtcagtggaagctctggaggaaatgctggaggacccaacagtgcagaagatgatttttccctatttacccgaggaaatgaggaaccctgctaccttcaaatggatgcttaagaatccacagtaccgtcaacaacttgaagaaatgctaaacaacatgagtggaaacactgaatgggacagccgaatgatggacaccttaaagaattttgaccttaatagtcctgaagtcaagcagcaatttgatcaaattgggctttctccagaagaagtcatttcaaagattatggcaaatcctgatgttgcaatggcatttcaaaatcctagagttcaagcagctatcatggattgttcacagaatccgatgaatattactaaataccaaaatgataaggaggttatggatgtcttcaataaaatatcagaactcttccctggagtaggttcaccttgatgcatctgtgcgttgttgctgtttactgggtcaagttatgcatgccttttctgatgagcaatgagattagctctgcctaaccacaagaaactaagcaaaactcatgctcatggctgtatactgcaggctcatggttacagcatccattccgacacgccgacagtgactgtatggcctgggctaaaatgttgccatagttggattttttttgtttcactaaagtagttgagattgtaaattgatgttttatgtttcattgaatattttgttggaggcattgcacctgcaatgtggtttttgagtacttacgtgccgttaaaaatgtgaatgccacgcataatcttttatttttattttttattgtttcacataatctttaaataaagcacaagttgcatgagattaaactattatgtaagcgaccaaataagttccaactattgaatactcaatgatgaaccgtataatcaagggctatgcattggagtgcacattt

SEQ ID NO: 3443 - DNA, 2131 bp, Cicer arietinum
tcctcttttcttaaatcttttacctaaattttatttcctatttcctattacccaaattccaaataataaagttgcggtttttcacttatctctaccgcagaagctaaaacccaaactccccaccaccccccactccgccttacacccactctactctcttcaacttcgctaatttcgcccaattttcaaaccctttttttacttccctaattccccaccactaccaatttctccgtttccgattccgtcgctttaaaatggagaatcttaacttagcccttgtttcttcccctaaacctttgcttctgggacattcttcttcaagaaacgttttcactagaagaaagcctttcacttttgggaagttctttgtttctgccaattcttcatcctctcatgtgaccagggctgctcctaaatctcaccaaaatcctaaatctgtgcaggggaagctgatagtgcataattttgctagcatttcttcttcaaatagtcaagaaaccacatcagttggagttagcccccagttatcaccacctccatcttcgactgtagggtcaccgctcttttggattggtgttggagttgggttttctgcactattttcaattgtagcatcaagattaaagaaatatgcaatgcaacaagctttcaagaccatgatgggccagatgaatacacaaaataatccatttgacagtgctgccttttcccctggatctcctttcccctttccaatgccttcatcatcagggcctgctgcacctgctagttctgctggtactcaatctcaatcaacttctgcacgaactgcatctcagtccactgtaacagtagacatacctgcaacaaaagtagaagcagccccatcaaccaatgctaaagatgaagtggaagtaaagaatgaacctaaaaaaattggttttgtagatgtttctccagaagaaagtgtacagaagagtccttttgaaagctttaaagatgttgatgaatcaagttcattcaaggaagcccgggctccagcagaagcttttcaaaatggagctccctctaaccaaggctttggcaattcaccaggttctcaatctggcggaaaatcagtcttatcagtggaagctttagagaaaatgatggaggacccaacagtgcagaagatggtttatccctatttacctgaggagatgaggaacccttctaccttcaaatggatgctgcagaatcctcagtaccgtcaacaacttgaagaaatgctaaacaacatgggtggaagcactgaatgggacagtcgaatgatggacaccttaaaaaattttgacctcaatagtcccgatgttaaacaacaattcgatcaaatcgggctttctccagaagaagtcatttcaaagattatggccaatcctgaagttgcaatggcatttcaaaatcctagagttcaagcagctattatggattgttcatcaaatccactgaatattgccaaatatcaaaatgataaggaggtcatggacgtcttcaataaaatatctgaactcttccccggagtgtcaggccccccttgattcatttgtttgtcagtcaagtttagatattcgcgaagttattcatgcctttcctgatgagcaacgaaaagtagctagttgtgtcttgccttaaggaactgtgcaaaactcttctgctcatgactgtatactgcagactcgttacagctccattgtgacatacggataataataactgtggcttggtctaaattgttgccatagttggatttttgttttgccaaaatagttgagattgtatattgatatttaaattttattttcgaggcactgcatcttagtgtagttttttttattttcttgtgcgagttcctagatttggctaattcagacttctaagtacctggaaaacaaatgaagtgaacgcttcacataatcgtttataagcttatgctgcatgagtttgaactactttgcaataagtgaccaaataaacaagggttatttgctggattggacataacaatggtctccttatttttgttgattaactgtgcatgggtgcttcagcaaccttgtgagtttgtaagggcaattcttagacgtgaccaataacaaatgttacatgttgc

SEQ ID NO: 3444 - DNA, 1303 bp, Cajanus cajan
gagacaaatcaagaagaaaagtcttctattctgactccccaacctacttgattcaataattttagtcatcactcagtgtgtacataacttcatccaaaacaaacaatcaattccctttctccttccaaaatccaaatattgatactgcacaaggtagtaacatttcattccaaaacaatgatcaacaaagtagcagtcctaccagttcttttgctttttatcattgctgctttggcttctgatcctgatccagtcatggacttttgcatagccaaaccagcagataacagcttcacttgcaagaacgcatccactgcaacagtggaagatttcacctattctggcattaaggttcctgggaacttcaagcaaactggattttcttctatggcagtgaattctaatgtctttccgggtttgaacactcttggagtatcatttgtgagagcagattttggtgttggtggtgtcaatgtgccccactttcatccaagagcaactgaggttgcttttgtgcttgagggaagggtttattcaggatttgttgacaccaagaacaaggtctttgccaaagtgttggagaaaggagaagtcatggtgttcccaagaggccttgtgcactttcagatgaatgttggggatgggcctgctactattttgggcagttttgacagccaaaatcctggcctaatgagaattccaaatgcagtttttggttctgacataaaggaggagcttttggaaaaggcttttggattgagttctaaagagctttccaagttgaagaagaggttttctcctagttaaaatgccctttatgcttatgaagacaagggttcaaataaaaacattgaaccttatgtgtttgaatcagaatttgagatccacaaagcacagtgaaaagtttaatgattattggattgatttgtagtcaattattttaataattcagcccgtctgacttaaagggctgattttagagctacagttatttagtatagaagtgcttccattttaaaattcacttcccttcagttaaggaaggagcttaagtggcagttgaactgattacaactttatttccaacttaaatcttttgtttgctgtccatattttgatgtcaacacaatcataagcatttggttcagttatacacgtttggtacaaaagctaaaaataaaaaaggagtggttgggggcatgtttgtatgtgtctttactctttactttttcattttgttacacattgcttctgccagggtgcttttatccagcaatatcattttaaagaggttgtaattgct

SEQ ID NO: 3445 - DNA, 1681 bp, Lupinus angustifolius
gtcacatgaaaaatacaattccttataaatattactagtgttcaataattgatactgcaatttgtgatgcaaagtcctttgactctacaactcattcaacccaacataatctcaattttgtttttgcaattcataatctcattgattttacacatcactgtgtaaaaaacttcatccaaaacattcaatcccttttttatcttctaaatattgatgctacaagagatagttagattatattacaatgttcaacaaagtagcatttctattagttcttttgcattttatcatcattactattgcttctgatccagatccaatcaatgacttctgcataccaaaatcagaagataacagctttagttgcaagaactcttccactgcaacagtggaagatttcatcttctcaggaataaagttaccagggaacttcaaaaaaactggcttttcttctatgggagtgaattccaatgtcttcccaggtttgaacactcttggtgtatcatttgtgagagcagattttgatgttggtggtgtcaatgtgcctcactttcatccaagggcaacagaggttgcttttgtggtggaagggaaaatttattcaggatttgttgacacaaagaacaaggtttttgccaaagtgttggagaaaggagaggttatggttttcccaagagggttggtgcattttcagatgaatgttggagatgggcctgctactatttttggaagttttgatagccaaaatcctgggttgatgagaattccaaatgcagtttttgggtctgaaataaaggaggagcttttggaaaaggcttttggattgagttcaaaggagctttccaagttgaagaagaggttttctcttagttaaaaatgcttttttttatgtttagggagacaaaggttcaataaagttattgaggataataatccacatcatgcacagaagaaaattctacatgatatttatagcagaatgttacagaagaatgatggttagttgaaaataattcatccattgtaagtaactttatccgccgactccacctaacgatattaagacttggttgttgtatcgaaagtcggttgactgattggtagtttattattttaaatttcatgtgccttaattatagtgccaccataacttagaaaaaaatactcttgggcatattacttgtgatagaagtatttttatatgggaatgtctttacattggtaagtactgtacatcatattctaaaaaatgtactcaaaatcacatgggactcaaaataatagtgagatgattattttcctttctcacttgtctctttactttcccattcaactaggcttttctcctgccagggtgttcttatctaacaacatcatttcaaagaggttgtaacttgtaactgccccaaaagctacgttgttaaacgattatcttgcacccatttgtgtgaagggtctcaaaggaaggaaggtttagaagggccctatgttaacaaaaaaaggtgcttcatcaatggatttctgggccatggaaatatgtcaccttatacttattgccattgctgtagtctgcagactctagtaattgatatctgtagcacttttcttccctttacctatatgtgcttagattattctacatgatatcaaatataatgagaaaaaagaaagttatctctcc

SEQ ID NO: 3446 - DNA, 1090 bp, Phaseolus vulgaris
gagacaaattgagaacaaaagtcttctattctgactccacaacccacttggttcacaccaactcaattacactatccatcattgtgtacattacttcatccaaaacaaccaaccagttccttaattttcaatatcaccttccaaatgttgatactgcaaaagatagcagttcttctagtttctttgcttttcaccactggtgttctggcttctgatcctgatcccctcatggacttttgtatagccaaatcagcagagagcagcttaacctgcaagaactcttccacagcaacagtggaagatttcacctattctggcataaagtttcctgggaacttcaagcaaactggcttttcttccaagggagtgaattcaaatgtgtttccgggtttgaacactcttggagtgtcatttgttagagcagattttggtgttggtggtgtcaatgtgccacacttccatccaagagcaacagaggttggttttgtgctggagggaaagatttattcaggatttgttgacagcaataacaaggtttttgccaaagtgttggagaaaggagaggtcatggtgttcccaagaggcctagtgcactttcaaatgaatgttggagatggccctgctaccattttgggaagttttgacagccaaaatcctggtctgatgagaattcctaatgcagtttttggttctgacataaaggaggagcttttggagaaggcttttggactgagttccaatgagctttccaagttgaagaagaggttttcttctatttaaaatgtttttttcgattatgattcaatactagcaggccagaaaagcagtagacctttataagaagggcataagtatcttcagtaggaatgcatggagtctcaagaaggtgcagatatgtggattctgcctccttgtattgaagcttttgcccaaaagcatctatcagtaaattatagcaaattacatctggtttgtaggagctccttagcagtattcatctgcatatctgcacagttttttctgttatcaaataccaaaacaaactaataacttccttaaacaaaaacaaaaatttagtatcacttcccta

SEQ ID NO: 3447 - DNA, 639 bp, Lotus japonicus
acaaagatgaagaaagtagcagtcatgttaattctcttgtttttcatcattgctgcttttgcttctgatccagatccagttatggattactgcatagccaaatcaccagacaacaaaagcttcacttgcaagaactcatccaaagcaacagtggaagatttcaccttctctggtataaagctcccagggaacttcaaggaaactggcttttctggtatggcagtgaactcaaatgtctttccaggtttgaacactcttgggatgtcatttgtgagagcagattttgatgttggtggtgtcaatgtgcctcacttccatccaagagcaactgaggttgcttttgtgcttgagggaaagatttattcaggatttgttgacaccaagaacaaagtttttgccaaagtgttggagaaaggagaggtcatggtgtttccaagagggcttgtgcactttcagatgaatgttggagatgggcctgcaactattttgggcagttttgatagccaaaaccctggcgcacagaagattccaaatgcaatttttggttctgatatcaaagaggagcttttggagaaggcttttgggttgagttctaaggagctttccaagttgaagaagagattttcctcatagctaaaa

SEQ ID NO: 3448 - DNA, 1428 bp, Cicer arietinum
cccctttatagttgtgtacagaggatttttagtgtatcaacaaaaaagttgtcagataaaatgattatcttcaaaaatatagaaaattgaatatgcactttaatataacttaattttacacaaacattcaataaattttttatattctatagttattttaaaattgcagttataaagtcagaacatgtgaaaatatcaagcgttctcatttgaggttgttttacaccaaccacacatcttcattaaactcaaaaaatatccctataaatatggtactcaataattgatggaacaatttgtgaagcatatagtcttttgactcaacaaactcattcatccgaaacaaccgtacacacctctttccaataacatctatattgatactacaacaaatagttaagtttcaagaacaatgatcaataaagtgattatccttttagttattatgcttttcaccatttctgcattttgttctgatccagatccagttatggatttctgcatagccaaatcaacagacaacagtttcacctgcaaaaactcatcaacagcaacggttgaagatttcaccttctctggtataaaagttccaggaaatttcaaagaaactggttttgcttcaatgggagtgaattcaaatatttttccaggtttaaacacacttggaatgtcttttgttagagcagattttgatgttggtggtgtcaatgttccacactttcatccaagagcaacagaggttgcttttgttcttgagggaaaaatttattcaggatttgttgatactaaaaacaagatttttgctaaagttttggagaaaggagaggttatggtttttccaagaggacttgtgcattttcaaatgaatgttggagatgttcctgctactattttggggagctttgatagtcaaaatcctggtttgatgaaaattccaaatgttgtttttggatctgagattaaagatgagcttttggaaaaggcttttggattcacttctaaggagctttctaagttaaagaagaggttttctccaagctaaaaaatgcaatttttatgtttatggtagaaatttttatatgatatactttttgtataataacattcttgtgactatagttgaaaaatacatcatcacagtggaaaattattagattgatttgtagttaattgttttattaattcattccttcaggaactgtattttatttataataactgagttaaaaagattagaaatttgagttgaagtgttattttttaagcgacaagtagtaaagtgttggagtttgtttccaagcttctggaattttgtgttcatattttatagttattaaagtcaataatatttgctttttttttttgtgttcatattttataagtcatcaaatgatcaaagtcaataattatacacgtttggcacaaaag

SEQ ID NO: 3449 - DNA, 3515 bp, Lupinus angustifolius
aaattttgatggaaaataatattagtatagttgcagagtgatggacggagaaaacaatggcggaactgtaacctacttcccccaactgctataggaaactctattctctccgcttacttcacaaaactcttcacttttatctgtttcactcaaaatgattcaccaatctcttttcaaacatagttcaatctcattctcaaccccatttcccacaccaccaaaacggtaccgttttcatgtccattttccttcaacaattcgatgcaatgcttcagattcatcgttatctccgccatcagtaacggtgacggaatcggagcacaaaagtgggtcctatcctggaggattgggtccgtacactggaagagaccctaatgtgaagaaacctgagtggttgaggcagaaagctcctcaaggtgaacgatttcaacagattaagggatctttgtcacatttgaagcttaacactgtttgcgaagaagcacagtgccctaatattggagagtgttggaatggaggtggggatggtattgcaactgcaacaatcatgcttcttggtgatacttgcactcgcggatgcagattttgtgctatcaagaccagtaaaaatccaccacctcctgatcctatggaaccaataaacactgctatggccattgcaagttggggagtggattatattgttctaactagtgtggatcgtgatgatatacctgatggaggaagtgggcattttgctcagactgtcaaagctatgaaggatctcaaacctgagatcatggttgagtgtttaacctctgattttcggggtgacctcaaggctgtagaaactctggctcattcaggtttagatgtttttgctcacaatgttgagacagtcaaacgcctccaaagaattgttagagatcctagggctgggtacgagcaaagcttgtcagttctaaaccatgcaaaacgtagcaaggcgggtatgataacaaaaacttctataatgctgggccttggagaaactgatgatgaggtgaaggaagcaatggctgatttaagggccatagatgttgatattctgacttttggtcagtatttgcagccaactcccttgcacttgactgtcaaagagtatgttactcctgagaaatttgctttctggaaagaatatggggagtctattggttttcgttatatagccagtgggccattggtgcgatcttcatacagggctggggagctatttgtcaagacaatggtacgagaaaaggtcaagaatgatggggacacattggtgtaacttttggttttgcaggttatgtatattaagcaaacagcagatctcaagatttttgcacatgcagttagttcccagggtggaaatggttatcagggaaggagagtttaatacttttgatttcaaatagatatttaaactggttttacattgtcttttgaccagtaatgtttctaaaaaaatccattcatagataatttacactacatgtaggttaaagtttatagtaagaaagaacaacattggaacataatttacttatggaggggtgtttttttctcattgtatttggttgttggtgactattgctgctttggggggggttaagatgtgtaatttccattcttgtttcttttctcttattatttgataacatttggctagctcatttctgacatgaaacaaagtttaacattctttcccggtttgagtttggatgtgtcagccatttctttattgaaattgagttttctgatatcagactatgtctggtcaagtagtttgcgaagtagtttgttccatggttttcaaaactccatatgaaataatctcttggactataaataatctatatccaagtactacattcctaagtaaccaaagggcatactttttgttcaaaagattcttgtgtactttttgataaaggaaataatttgaggtctcagattaaagtttagttgctttattttttgcaaggtgtgacggagacgataacgttaatcaaggagattatagacacgtgaagaccaaaaaacgagaaacctttgttccaatttatatggggatgcatacaaacttagtggattctattaatgacagaccctgatctttattattttctaaagttgtcagctttttttggttattagcttttcttttccaactaaacatatattctccccttaatctcaaatattgtgaaactgattttctttcagtttggagcaataaagagtgggtgaatatgctcattctcttatagaaaggttttctttaagcaataatcaaacaaatggaaatgcaagcaactcatgacaaccacttttgcttataaaacaggtcaaaagcaatagcaatgaataaagcaaaagatgagtagttgatgctgtcatctagtgccccaactagccctcctttattctaaagcaaagtttctaaacaaaaatacagtctctgataaatgctactagtgttcaataatagatactgcaatttgtgatgcaaggtcctttgactctacaacataatctcattgcttttacacatcattgtgtagaaaatttcatccaaaacattcaatcctttttatcttctaaatactgatactgcaagagataattagattctattacaatgttgaagaaagtagcagtcctattggtacttgtgccttttatcattgttgttatggcttctgatccagatccaatcaatgacttctgcatagccaactcagcagacaacagcttcagttgcaataactcttccacagcaacagtggaagatttcaccttctctgggataaagtttccagggaacttcaaaaaaactggtttttattctgtggcagtgaattccaatgtctttccaggtttaaacactcttggtgtgtcatttgtgagagcagattttgatgttggtggtgtcaatgtgcctcactttcatccaagggcaacagaggttgcttttgtgctagaggggaaaatctattcaggatttgttgacacaaagaacaaggtttttgccaaagtgttggagaaaggagaggtcatggttttcccaagagggttggtgcattttcagatgaatgttggagatgggcatgctactatattgggcagctttgatagccaaaatcctgggttggtgagaattccaaatgcagtttttggttctgaaataaatgaggagcttttggagaaggcttttggactgagttctaaggagctttccaggttaaagaagaggttttctgctagctaaattgttttcttatgtttatggagaaaatgtttcaagtaaagtcattgaggattaatgatccacatcatgcacagtgttaaattttacatgatatttattccaatacagtaacattactgaagaataatgatgattagttgaaaaaattgtggttacttcataatcgtttagttgcagtttggcctaaattgcagctatgattactttgcatataccagaattgtgtcactgatgcgatcacaat

SEQ ID NO: 3450 - DNA, 1004 bp, Medicago truncatula
ctcaataattgatgaaacaatatgtgaagcaaagtcattcaaccaaacacattatttggttcctgcaagaaatagttaagtttcaaaaccatgatcaacaacaaagtaaccattcttttagttcttatgtgtttcatcattgctgttttttgttctgatcctgatccagttatggattactgcatagccaaatcagaagacaacaaattcagttgcaaaaactcatccacagcaacagttgaagatttcaccttttcaggtataaaactaccaggaaacttcaaagatactggattttcttcaatgggagtgaattcaaatgtgtttccaggtttaaacactcttggagtttcatttgttagagcagattttgatgctggtggtgttaatgttcctcactttcatccaagagcaacagaagttgctattgtgttggagggaaaaatttattcaggatttgttgataccaagaacaagatttttgctaaagttttggagaaaggtgaggttatggtttttccaagaggacttgtgcattttcagatgaatgttggtgatgttcctgctactatttttggtagttttgatagtcaaaatcctggtttgatgaaaattccaaatgttgtttttggatctgagattaaagatgagcttttggaaaaggcttttggacttaattctaaggagctttctaagttaaagaagaggttttctccaagctaaatttctttttttaatgttgagaattgttattttagtttttatatgtatttttgaaaagtggaatagatataaatacatacgatttcaccgatcatatcggtatttagatgttgaaataacacatttattttatgtttagtaacggtgattcaatcttcaatgaaaacaacgacgattgaaaagtgaaatctaagttaagaccacattatacatggtaaaagaaattatataatatttttgtataacatttctcgtgaccagttgaaaacaccccattagtg

SEQ ID NO: 3451 - DNA, 1015 bp, Phaseolus vulgaris
gagacaaattgagaacaaaagtcttctattctgactccacaacccacttggttcacaccaactcaattacactatccatcattgtgtacattacttcatccaaaacaaccaaccagttccttaattttcaatatcaccttccaaatgttgatactgcaaaagattgtcacattcccttccaaaacaatcatcaacaaaatagcagttcttctagtttctttgcttttcaccactggtgttctggcttctgatcctgatcccctcatggacttttgtatagccaaatcagcagagagcagcttaacctgcaagaactcttccacagcaacagtggaagatttcacctattctggcataaagtttcctgggaacttcaagcaaactggcttttcttccaagggagtgaattcaaatgtgtttccgggtttgaacactcttggagtgtcatttgttagagcagattttggtgttggtggtgtcaatgtgccacacttccatccaagagcaacagaggttggttttgtgctggagggaaagatttattcaggatttgttgacagcaataacaaggtttttgccaaagtgttggagaaaggagaggtcatggtgttcccaagaggcctagtgcactttcaaatgaatgttggagatggccctgctaccattttgggaagttttgacagccaaaatcctggtctgatgagaattcctaatgcagtttttggttctgacataaaggaggagcttttggagaaggcttttggactgagttccaaggagctttccaagttgaagaagaggttttcttctatttaaaatgtttttttcgattatgattcaatactagcaggccagaaaagcagtagacctttataagaagggcataagtatcttcagtaggaatgcatggagtctcaagaaggtgcagatatgtggattctgcctccttgtattgaagcttttgcccaaaagcatctatcagtaaattatagcaaattacatctggtttgtagga

SEQ ID NO: 3452 - DNA, 981 bp, Arachis hypogaea
ggggaagttgtgaagctaagtttagccatcagtgagtagaaaatttcagacataacattcaatgttttcttgataccatcatctaaactttgataccagtactacaagagatagttagatacttagattccaagaaaatgttgaaagaagtttcagtgctgttacttcttttggtattcattattgctgctatggcttctgatccagatccagtgatggacttctgcgtagccaaatcaccagaaaacgtcttcgaatgcaagaactcgtccgcggcaaccatagaagatttcaccttctctgggataaagtttccagggaacttcaaaaaaactggtttttcttctgtggctgtgaattcaaatgtgtttccgggtttgaacacactgggggtgtcatttgtgagagcagattttgatgttggtggtatcaatgttcctcactaccatccaagagcaacagaggttgcttttgtgctggaggggaagatttattcaggatttgttgacacgaagaacaaggtttttgccaaagttctggagaaaggggaggtaatggtttttccaagaggaatgctgcattttcagttgaatgttggagatggccctgctactattttgggaagctttgatagccagaatcctggtttgatgagaattccaaatgcagttttggttctgatataaaggtggagcttttggagaaggcttttggattgaattctaaggagcttgctaagttgaagaagaagttttcttcttagatatgttctttctcttaatgaaaaaaaattttgaggcctgataaattgaatgatcaaggtgtaatcacatcatgcacagtggaattttttatgtattgcagaacattgctgaccattagctgaaatttttaatttcccatcagtgagaagttatttgattaatttgtactttattaattttgataattgatcccaatatttgaagggcctacttcatc

SEQ ID NO: 3453 - DNA, 534 bp, Glycine max
atgatcaacaaagtagcagttctattagttgttttgcttttcatcattgctgctttggcttctgatcctgatccagtcatagacttttgcatagccaaatcaccagacaatagcttcagttgcaagaactcatccacagcaacagtggaagatttcacatattctggcataaagtctcctgggaacttcaagcaaactggtttttcttctatggcagtgaattcgaatgtctttccaggtttcaacactcttagcgtgtcattcgtagcaacagaggttgcttttgcgctggaaggaaaaatttattcaggatttgtggataccaagaacaaggtttttgccaaagtgttggagaaaggagaggtcatggtgttcccaagaggcctagtgcactttcagatgaatgttggagatgggcctgctaccattttgggcatttttggttctgacataaaggaggagcttttggagaaggcttttggactgagttctaaggaactttccaagttgaagaagaggttttctcctagttaa

SEQ ID NO: 3454 - DNA, 1027 bp, Glycine max
gaaaagtcttctattgtgactcctcaatccacttgattcaccccaaacttaagccaaaaacaaccaaccaattatcttcaatatcaccttccatatattgatgctgcaaaagatagtaacatatcattccaaaaaacaatgatcaacaaagtagcagttctattagttgttttgcttttcatcattgctgctttggcttctgatcctgatccagtcatagacttttgcatagccaaatcaccagacaatagcttcagttgcaagaactcatccacagcaacagtggaagatttcacatattctggcataaagtctcctgggaacttcaagcaaactggtttttcttctatggcagtgaattcgaatgtctttccaggtttcaacactcttagcgtgtcattcgtagcaacagaggttgcttttgcgctggaaggaaaaatttattcaggatttgtggataccaagaacaaggtttttgccaaagtgttggagaaaggagaggtcatggtgttcccaagaggcctagtgcactttcagatgaatgttggagatgggcctgctaccattttgggcatttttggttctgacataaaggaggagcttttggagaaggcttttggactgagttctaaggaactttccaagttgaagaagaggttttctcctagttaaaacgcattttctgtttatggagatagtggaaaatttaatatgatacctattattgcagaatgttgctgatgattagataaaaatacccacatcaatagaaagctattggattgatttgtagttagtaattattttgataattcagcctttcttacttaaagggctgattttagagctacggttatttagtatagaaatacttccattttaaaattcacttcccttcagttaaggaaggagcttgaactgattagaactttatttccaacttcttgcttttgtcttctggatatattttaaagtcaacacaatcattgacatttggttctattacacgtttgacacaagctaaaaa

SEQ ID NO: 3455 - DNA, 3298 bp, Solanum phureja
tattcgcattaacccttctctcttttttagcctgaaagctgccttcctctttctccctctatataacatccgtcactctatactctacagataattattcattctctctttcaattttaaccacatttcaaatttcagaatctaatcattcatcgctcctcttcaatttcagacttgcagaagcactttctgcgcggtgtttgagaatctaaacaatcatcgatctctctattaaattcatcataggaggtcttgttctagacagatgccagggaacaagtataccggcaaccaagcggttgctagcactcgattggagaggctattgagagaaagagagctaagaaaaagtagcaaagtttctcactttccaaatgaatctactgataacaataggggaaatgagctctctgacaatgattttcgccaaggagaagctgataatggaggagtttcatatgtcgaacagtatctggaaggagctgcactagcatataatgaaggatgggagcggcctgatggaaagcccaccagacaacgactcttggttgtggcaaataggttacctgtctctgcagtaaggagaggcgaggaatcctggtctctagagataagtggtggaggtctcgttagtgctcttcttggtgtgaaggagtttgaggctagatggattggttgggcaggtgtgaatgtgccagatgaggctgggcagagggcacttactaaggcactggcagaaaagaggtgtatccctgtattcctggatgaagaaattgttcatcagtattacaacggttattgcaacaacatattgtggcctcttttccattatcttggacttccgcaagaagaccgccttgcgactaccagaagtttccagtctcagtttgctgcttataagaaagcaaatcaaatgtttgctgatgttgtgaatgaacattatgaagaaggtgatgtggtatggtgtcatgactaccatctcatgttcctgccaaaatgtctcaaggattacaacagccaaatgaaagtcggttggtttctacacacaccctttccatcctcggaaatacacaggacattgccttctagatcagagctgctccgagcagttcttgctgctgatttggttggttttcatacctatgactatgcaaggcattttgttagtgcatgtactcgtatcctgggacttgaaggaactcctgaaggagtagaagatcaaggtagactgacccgcgttgctgcgtttcccattggtatagattcagaacgatttattcgagcacttgaagttgctcaagttcaggaacacataaaagaactaaaagagagatttgctgggagaaaggttatgctaggagttgatcgccttgatatgattaaaggaattccccagaagatcctggcatttgagaagttccttgaagaaaatccgtactggcgtgataaagtggttttgcttcaaattgctgtgccaacaagaacagatgttcctgaataccaaaaacttaccagtcaagttcatgagattgttggacgcatcaatggtcggtttggaactttgactgcagtgcctattcatcatctggaccgttctcttgattttcatgcattatgtgcactgtatgctgtaactgatgtagcgttggttacctctttaagagatggcatgaacctcgtcagctatgaatttgtagcctgccaagagttgaaaaaaggggtccttattctcagcgaatttgcaggtgctgcacaatcgttaggtgctggagcaattctggtgaatccatggaatataacagaggttgctgcgtcgattgggcaagctttaaatatgtcagctgaagaaagagaaaaacgccacaggcataactttctgcatgtgactacccatactgctcaagaatgggctgagacttttgtgagtgaactaaatgatactgttattgaagctcaacagaggataagaaaagttccgccccggcttaacatcagtgatgcaattgagcgctattcgttttccaataatcgtctactaatattgggtttcaattctacactgacagaatcggtggatacccctggaagaagaggtggagatcaaatcaaagaaatggaactgaaattgcatcctgagttgaaagaatcattgctcgcgatttgtaacgacccaaagacaacagtcgttgtcctcagtggaagtgacagaaacgtcttagatgataacttcagcgagtacaacatgtggttagcagcagaaaatggaatgtttttgcgatctacaaacggtgtatggatgacaaccatgccagaacacctaaacatggactgggttgatagtgtaaagcacgtcttcgagtacttcactgaaaggacaccgagatctcactttgaacaacgtgaaacttcacttgtttggaattacaagtatgcagatgttgaatttggaagattgcaagctagagacatgcttcagcatctctggacaggtccaatatcaaatgcatctgttgatgttgtacaaggactccgctccgttgaggtccgagcagttggtgttacaaagggagcagcaatagatcgtatactgggggagatcgtacacagtaaagccattgcaacaccaattgattacgttttatgcatagggcattttctagggaaggatgaggatgtatatacattttttgagccagagcttccttctgactgcattggtatgccaagaagtaaggtcagtgatgcacctaaggtgcccggggaaaggcgatcagttccaaaactcccttctagtcgaactagctcaaagtcatctcagaataggaacaggccagtttcaaactcggataagaaaacttccaatggacgacggccctcacctgaaaatgtgtcatggaatgtgctggatctgaagaaggagaattacttctcttgtgcagttggcaggactcgtacaaatgctcggtatctgctcaatacgcctgacgatgttgttgcttttctaagggaactagctgaagcacctatttcaaatgggacatcatgaaaaagaaggatagatgatgctggttgcatcaagtgatgaatgatcggtaccaagttcttgattgagggagatttgtatgggatgatattgaataaacgttttataccttctttgctttggatatagatgtttgcattcaatagtctacaaagtaaagaaaataaccttcatgctagcacatactccatccgtgtcaattattctgtctaatcttttgacttggcacgaagttttagaaaattttgtagtctt

SEQ ID NO: 3456 - DNA, 3215 bp, Nicotiana benthamiana
tctgagcgtagtataattcttcatatgcgcgcgcacgtacacatttcactgaagcagtgaatttcaatttttttaaaaaaaaaccataaagctgccttttcctttcatttgctttttgcctctctttttattctcgagccttctctttcttagcctgaaagctgccttcctctctccctctatagcactggtcagtggccactctctatatatgctctgcaaaacatcttttctctctttcaatttcagccacatttccaatttgagaatctaaacattcatctgctcaactttcagggacaacagaactctattaaattcatcctaggaggtcatattctagatagatgccaggaaacaagtacaacggaaaccaaacggttgccaccactcgattggagaggctattgagagaaagagagctaaggaaaactagcagaacttctcaccaaacaagcgattcaactgatagcaacaggggcaatgagctctctgaccatgattttcgccaaggagaagctgataatgcaggagtttcatatgtcgaacagtacctagaaggagttgcacgagcatatagtgagggatgggagcggcccgatggacggcccgccagacaacgactcctggttgtggctaataggttacctgtctctgcagtaagaaggggtgaggaatcctggtctctggagataagtggtggaggtctagttagtgctcttcttggtgtgaaggagtttgaggctagatggattggttgggcgggtgtgaatgtgccagatgaggcggggcagagggcacttactaaagcactggcagaaaagaggtgtatccctgtgttcctggatgaagaaattgttcatcagtattacaacggttattgcaacaacatattgtggcctctttttcattatcttggacttccgcaagaagaccgcctcgcgactaccagaagtttccagtctcagtttgctgcttataagaaagcgaatcaaatgtttgccgatgttgtgactgaacattatgaagaaggtgatgtagtctggtgtcatgactaccatctcatgttccttcctaaatgtctcaaggagtacaacagccaaatgaaagttgggtggtttctacacacaccctttccatcctcagaaattcacaggacattgccatctagatcggagctgctccgagcagttctcgcggctgatttggttggttttcatacctatgactatgcaaggcattttgttagtgcatgtactcgtatccttggacttgaaggaactcccgaaggagtagaagatcaaggtagactgacccgtgtcgctgcgttccccattggtatagattcagagcgattcattcgagcacttgaacttcctcaagttcaggaacatattaaagaactaaaagatagatttgctgggagaaaggtgatgttaggagttgatcgccttgatatgattaaaggaattccccagaagatcctagcatttgagaagttccttgaagaaaacccgtactggcgtgataaagtggttttgctgcaaattgctgtgccaacaagaacagatgttcctgaataccaaaaacttactagtcaggttcatgagattgttggacgcatcaatggccgatttggaactttgactgcagtgcctattcatcatctggatcgatctcttgactttcatgcattatgtgcactatatgctgtaactgatgtagcgctggttacctccttaagggatggcatgaaccttgtcagctatgaattcgtggcctgccaggagtcgaaaaaaggggtccttattctcagtgaatttgcaggtgctgcacagtccttaggtgctggagcaattctggtgaatccatggaatatcacagaggtcgctgcgtcgattgggcaagctttaaatatgtcagccgaagaaagagaaaaacgccacaggcataactttctgcatgtgactacccatactgctcaagaatgggctgaaacttttgtgagtgaactaaatgatactgttattgaagctcaacagaggataagaaaagttccaccccgacttaacatcagtgatgcaattgaccgctatttgttgtccaataatcgtctactaatattgggtttcaattctgcgctgacagaatcggtggatacccctggaagaagaggtggagatcaaattagagagatggaactgaaattgcatcccgaactgaaagaaccattgaccgcaatctgcaacgacccaaagacaacagttgttgtcctcagtggaagtgacagaaatgtcttagatgataacttcagtgagtacaacatgtggttagcagcagaaaatggaatgtttttgcgatctacaaatggtgtatggatgacaactatgccagagcatctaaatatggattgggttgatagtgtgaagcacgtcttcgagtacttcactgaaaggacaccgagatctcactttgaacaacgtgaaacttcacttgtttggaattacaagtatgcagatgttgaatttggaagattgcaagctagagacatgctgcagcatctctggacaggcccaatatcaaatgcatctgttgatgttgtacaaggactccgctccgttgaggttcgagcagtaggtgttacaaagggagcagcaattgatcgtatactgggggagatagtacatagtaaagccattgcaacaccaattgattacgtcttgtgcattgggcatttcttggggaaggatgaggatgtatatacatttttcgagccagagcttccttctgattgcattggtattccaaggggtaaggtctctgatgcactgaaggtaccaggggaaaggcgatcggcgccaaaagttccgtccagccgaactagctcaaaatcatctcagaacaggaataggcctgtatcgaactcggagaagaaaacttccaatggtggtggacgtagccgaactggttcaaaatcatctcagaacaggaataggcctgtatcgaattcggagaagaaaacttccaatggtggtggacgacggacctcacctgaaaatgtgtcatggaatgtgctggatctgaagaaggagaattacttctcttgtgcagttggcaggactcgtacaaatgctcggtatttgctcagtacacctgacgacgttgttgcttttctaaaggaattagctgaagaatctatctcaaatgcgccatta

SEQ ID NO: 3457 - DNA, 3527 bp, Nicotiana benthamiana
gcaaaatctccttttcgctattctgagcacaatataattcttcatatgcgcgcgcacgtacacatttcactgaagctgcgaattgcaatttttttaaaaaaaaaaacataaagctgccttttcctttcatttgccttttgcctctctttttattctcgagccttctctttcttagcctgaaagctgccttcctctccctctatagcactggtcagtggccactctatatatatgctctgcaaatcatcttttctctctttcaatttcagccacatttccaatttgagaatctaaacattcatcgctcgtcgctgctcaactttcagggacaacagaactctattaaattcatcctaggaggtcttattctagatagatgccagggaacaagtacaacggaaaccaaacggttgccaccactcgattggagaggctattgagagaaagagagctaaggaaaactagcagaacttctcatcaaacaagcgattctaggctattgagagaaagagagctaaggaaaactagcagaacttctcaccaaacaagcgattcaactgatagcaacaggggcaatgagctctctgaccatgattttcgccaaggagaagctgataatgcaggagtttcatatgtcgaacagtacctagaaggagttgcacgagcatatagtgagggatgggagcggcccgatggacggcccaccagacaacgactcctggttgtggctaataggttacctgtctctgcagtcagaaggggtgaggaatcctggtctctggagataagtggtggaggtctagttagtgctcttcttggtgtgaaggagtttgaggctagatggattggttgggcgggtgtgaacgtgccagatgaggcggggcagagggcacttactaaagcactggcagaaaagaggtgtatccctgtgttcctggatgaagaagttgttcatcagtattacaacggttattgcaacaacatattgtggcctctttttcattatcttggacttccacaagaagaccgcctcgcgactaccagaagtttccagtctcagtttgctgcttataagaaagcgaatcaaatgtttgccgatgtcgtgaccgaacattatgaagaaggtgatgtagtctggtgtcatgactaccatctcatgttccttcctaaatgtctcaaggagtacaacagccaaatgaaagttgggtggtttctgcacacaccctttccatcctcagaaatccacaggacattgccatctagatcggagctgctccgagcagttctcgcggctgatttggttggttttcatacctatgactatgcaaggcattttgttagtgcctgtactcgtatccttggacttgaaggaactcccgaaggagtagaagatcaaggtagactgacccgtgtcgctgcgttccccattggtatagattcagagcgattcattcgagcacttgaacttcctcaagttcaggaacatattaaagaactaaaagatagatttgctgggagaaaggtgatgttaggagttgatcgccttgatatgattaaaggaattccccagaagatccttgcatttgagaagttcctcgaagaaaacccgtactggcgtgataaagtggttttgctgcaaattgctgtgccaacaagaacagatgttcctgaataccaaaaacttactagtcaggttcatgagattgttggacgcatcaatggccgatttggaactttgactgcagtgcctattcatcatctggatcgatctcttgactttcatgcattatgtgcgctatatgctgtaactgatgtagctctggttacctccttaagggatggcatgaaccttgtcagctatgaatttgtggcctgccaggagtcgaaaaagggggtccttatactcagcgaatttgcaggtgcggcacagtccttaggtgctggagcaattctggtgaatccatggaatatcacagaggtcgctgcgtcgattgggcaagctttaaatatgtcagccgaagaaagagaaaaacgccacaggcataactttctgcatgtgactacccatactgctcaagaatgggctgaaacttttgtgagtgaactaaatgatactgttattgaagctcaacagaggataagaaaagttccaccccgacttaacatcagtgatgcaattgaccgctatttgttgtccaataatcgtctactaatattgggtttcaattctgcgctgacagaatcggtggatacccctggaagaagaggtggagatcaaattagagagatggaactgaaattgcatcccgaactgaaagaaccattgaccgcaatctgcaacgacccaaagacaacagttgttgtcctcagtggaagtgacagaaatgtcttagatgataacttcagtgagtacaacatgtggttagcagcagaaaatggaatgtttttgcgatctacaaatggtgtatggatgacaactatgccagagcatctaaatatggattgggttgatagtgtaaagcacgtcttcgagtacttcactgaaaggacaccgaggctgaagttggtcactctgccacaagcactatgcgatgagaatccaaaagcaaataatgttgaatttggaagattgcaagctagagacatgctgcagcatctctggacaggtccaatatcaaatgcatctgttgatgttgtacaaggactccgctctgttgaggtccgagcagttggtgttacaaagggagcagcaattgatcgtatactgggggagatagtacatagtaaagccattgcaacaccaattgattacgtcttatgcattgggcatttcttagggaaggatgaggatgtatatacatttttcgagccagagcttccttctgattgcattggtattccaaggggtaaggtctctgatgcactgaaggtaccaggggaaaggcgatcggcgccaaaagttccgtccagccgaactagctcaaaatcatctcagaacaggaataggcctgtatcgaattcggagaagaaaacttccaatggtggtggacgacggacctcacctgaaaatgtgtcatggaatgtgctggatctgaagaaggagaattacttctcttgtgcagttggcaggactcgtacaaatgctcggtatttgctcagtacacctgacgacgttgttgcttttctaaaggaattagctgaagaatctatctcaaatgcgccattatgaaaaggataaatgatgctggttgcatcaagtgatgaaggatcagtaccatgtttttgattgagggagatttgtatggaggatattgagcaacgtttatacctgatttgcgttggatatatagatgtctggattcaatattctacaaagtaaagaaagaacctttctgctagctaataatactccctctctctcttccgacccgtagatgtttttggccgttggaacttcaacatacgtattgagcagttcaaaatcacaagcactactcacaaccatcacttatggagtcactcgttaa

SEQ ID NO: 3458 - DNA, 3286 bp, Panax ginseng
tctccgactcagaagcagtggtatcaacgcagagtacgcggggatggctgtaaggctttatatatgtattgagcttaagcgagcgaccaaacgtttgctcaccatgacaaatctttgctgcctaccatttttaggtaccgattcccctctcttcctccctcctaccgcacccagttgctcttcctatgtccacctgcaaatcttccattgcagtggattgagatataactgaacatcatctcaagaattggtaattggatcaattagaaccactgtttttgaggaactttacaactcatattaaagtcggtctggagatagtgttgtaaacacagcccgtatgccaaggaacaagtacaacggcaactcatccatcccctcaagtcgaatagagaggctcttacgggaaagagagctaagaaagaacagcaaggcttcttattcaaatgaggctagtgatggtaacagaagttccgagctctctgagcttgaattgcggtcacgcgatggggatggcctagcagtttcctatgtcgaacaatatctggaaggggcattggctgcccatgcacttactgatggattggataggccggatggggggcctttcagacaacgactgttggtggtggctaataggctaccagtctctgcagttaggagaggagaggagacctggtcactggaaataagtgctggtggtctagtgagtgctcttttgggtgtgaaggaagttgaggcaaaatggataggttgggcaggtgtaaatgtgccagatgaggctgggcaaaacgcactcacaaaagcactggccgagaagaggtgtatacctgtattccttgatgaagagattgttcatcagtattacaatggctattgcaacaacatattatggcctctcttccattatcttggtctcccccaagaagatcgtcttgcgacaaccagaagtttccagtctcagtttgctgcatatgaaaaagcaaatcaaatgtttgctgatgtggtaaataagcattatgaggagggcgacgttgtgtggtgccatgactaccatctaatgttcctgcccaaatgcctaaaggaatacaacagcaaaatgaaagttggttggtttctccacacactatttccctcttctgaaatccacaggacgctgccatctcgatcagagctgcttcgtgcagttcttgctgctgatttagtaggtttccatacatatgactatgctaggcactttgttagtgcttgtactcgtattcttggactggagggtacacctgatggagtagaagatcaaggaaggctgactcgtgtggctgcgtttcctattgggatagattcagaacggttcattcgtgcgcttgaggttcctcaagtccaagaacacatcaaagaattaaaagagagattttctgggcgaaaggtgatgttaggtgttgatcgccttgatatgattaaaggaattccccaaaagatactggcgtttgaaaagtttcttgaagaaaacgcatactggcgtgataaagttgttttactgcagatagctgtgccaacaagaacagatgttcctgaatatcaaaaacttacaagccaggttcatgaaattgttgggcgcatcaatggtagatttggaactttaaccgctgttccaatacatcatctggatcgatctctcgacttttatgcactatgtgcactatatgctgtcactgatgtagcacttgtcacatctttgcgggatggaatgaatcttgttagctatgagtttgtggcatgccaagattcaaagaaaggagttctcattctgagtgaatttgcaggagctgcacagtctcttggtgctggagcactcctggtgaatccttggaacatcacagaagtagcttcttcaattggccaagctttaaatatgacagctgatgaaagagaaaaacggcatcgccataacttccaacacgtcacaactcatactgctcaagagtgggctgaaacatttgtcagtgaattgaatgatactgtagtcgaagctcagcaaaggataagagaagtgccgcccgtacttccagtaaaagatgcaatcaaacactacttgcagtccaataaccgtttactcatactgggattcaatgccacattgactgaaccagttgatactcctggtagaagaggttgagatcaaatcagagaaatggaacttaaattgcatccagatttaaaagaacccctaatggaactatgcagagatccaaagacaactattgttgtcctcagtggaagtgacagaactgtcttagatgataacttttgtgagtacaacatgtggttagcggcagagaacgggatgtttttgcgcgttacgagtggagaatggatgacaacaatgccagagcatttaaatatggattgggttgacagcgttaagcatgtctttgagtatttcaccgaaagaacgcctcgatctcattttgaactccgtgagacttcacttgtatggaattacaagtacacagatgttgaatttggaaggttgcaagccagagacatgctgcagcatctctggacaggaccaatatccaatgcgtcggttgatgttgttcaaggtagccggtcggttgaggttcgagcagttggtgttacaaagggtgcggcaattgaccgaatactgggagaaatagtacacagtaaatccatttcaacaccaatcgattatgttctgtgcgtagggcacttcctcgggaaggacgaggatgtttatagttttttcgagcctgagccctctgaagccatgggtatcccaagagccaaaataagtgatcctttaaagttgcctggagagagaagagctggattaaagctgcaaaatagcagaagcggctcaaaaccatctcaaaggagtcaacgacctctcccaaacccagaaaagaagaacacccacacaaatggacggcgtcagtcatcagagaagatatcgtggaatgtgctcgatctcaagggggagaattacttctcctgtactgttggccgaactcgctccaatgctcggtaccttcttggaacatctgatgatgttgtttcatttctcaagaaattagctgcggcagcttcatccagccaaggaatataccatggtctggcatcctttgatgcatctaggtcttgtgctgaataacccaggcatgatgatggctaggtgatcttatctgaaccttgtaacatttttcagacactaaaataacttgttcaaggtcttgggctgtttcaatcttccattgcgaaatatttt

SEQ ID NO: 3459 - DNA, 2801 bp, Manihot esculenta
cgtatgcctggaaaccagtataacgggaactcaaccccttacccaagtcgtactcaacggctcttgagagagagagagttaaagaaaagcagcagggcttcccattcaaatgaggtgactgataatcacggggggactgaaccatgcgagcacgatttgcgcttgagagaacgtgacaactcaaacaattcgtatattgaccaatacgtagaaggggctattgcagctacaaggcaacttgctgagggatgtgaaaagcaggatggaaggcctttaaggcagcggctgctggtggtggctaacagattgcctgtctctgcagttaggagaggcgaggactcatggtctttggagataagtgctggaggccttgtcagtgctcttctaggtgtgaaagagtttgaggcgaggtggattggttgggctggtgtaaatgtgcctgatgagattggccagaaggcacttactaaagctttggctgagaagagatgcataccagtattccttgatgaagagattgttcatcaatattacaatggctactgcaacaacatgttatggcctctttttcattatcttggacttccacaagaagatcgccttgccacaactagaagtttccagtctcaatttgctgcatataagaaggctaatcaaatgtttgctgacgtggtgaataagcactatgaagagggtgacgttgtttggtgccatgattaccatctaatgttcctcccaaaatgcttaaaagaatacaacagtaatatgaaagttggttggtttctacacacgcccttcccttcttctgaaatccataggacactaccatctcgatcagagctgctgcgttcagttcttgctgctgatttagttggatttcatacctatgactatgcaaggcattttgttagtgcttgtactcgtattcttggactagagggcacacctgaaggagttgaggatcaaggaaggctgactcgagttgctgctttccctattgggatagattctgatcgtttcataagagcattggaggccccacaagtccaggaacatatcaaagatttgaaagaaagatttgctggacgaaaggtaatgttaggtgttgatcgacttgatatgattaaaggaattccacagaagatacttgcatttgaaaaatttctggaggaaaactctcattggcgtgataaagttgttctgctgcagattgctgtgccaacacgtactgatgttcctgagtatcaaaagcttacaagtcaagttcatgaaattgttgggcgcattaatggtagatttggaacattgactgctgttccaatacatcatttggatcgctctcttgactttcatgccttatgtgcattatatgctgttactgatgttgcacttgttacttctttgagggatggaatgaatcttgtcagttatgaatttgtggcatgccaagatgcaaagaaaggcgttctcattcttagtgagtttgcaggagcagcacagtctctgggtgctggagcaatccttgtgaacccttggaatatcactgaagttgctgattcaatacgccaagctttgactatgtcatgtgaagagagagagaagcgacatcaccataattttgcacatgtcacaacccatactgctcaagaatgggctgaaacttttgtgagtgaactaaatgatacagttattgaggctcagttaaggactaggcaagttccacctattcttcctgaagaagatgcaattaaacgatatttgcagtctaataatcggttgctcatactgggattcaatgcaacattgactgaaccagtagacactccagggagaagagttgatcaaattaaagaaatggaacttaagttgcacccagagttgaaagaaactttggtagcactgtgcagtgatccaaagacaaccattgttgttctaagtgggagtgacagtaatgtcttagataagaactttggtgagtttgatatgtggttggcagcagaacatggaatgtttttacgctttaccaagggagagtggatgacaacgatgccagaacacttaaacatggaatgggttgacagtgtcaagcatgtttttgagtacttcacagaacggacacccagatcacattttgaacttcgtgaaacatcacttgtatggaattacaagtatgcagatgttgaatttggaagacttcaagctagggacatgttgcagcatctctggacaggcccaatttctaatgcatctgttgatgtcgtccaaggtggccgatcagtcgaggttagagcagttggtgttacaaagggtgctgctattgatcgaatactgggagaaattgttcacagtaaatccatgacgacaccaattgattatgtcctgtgtattgggcattttctgggaaaggatgaagatgtgtacaccttctttgagccggtgctaccttctgatggcataggtattgcaagagccaagcaaactgatggattaaaatcaccaggtgagaggcgtccctctttgaagcttccagctagtaaaagtgggtcaaaatcatctcaaggtaagacacaacgaccttcccccaatcctgacaagaaacttaacaaccacagctgtgggagtggccgacggcagtcacctgaaaagatttcgtggaatgttcttgatctcaagggagataattatttctcctgttctgttgggcgaactcgaacaaatgctcgctatctactacactcatcagatgatgtcgtctcctttctgaagaagctagccagggcatcttcttgagaaaaatattg

SEQ ID NO: 3460 - DNA, 3092 bp, Panax ginseng
tcctccctcctaccgcacccagttgctcttcctatgtccacctgcaaatcttccattgcagtggattgagatataactgaacatcatctcaagaattggtaattggatcaattaggaccactgtttttgaggaactttacaactcatattaaagtcggtctggagatagtgttgtaaacacagcccgtatgccaaggaacaagtacaacggcaactcatccatcccctcaagtcgaatagagaggctcttacgggaaagagagctaagaaagaacagcaaggcttcttattcaaatgaggctagtgatggtaacagaagttccgagctctctgagcttgaattgcggtcacacgatggggatggcctagcagtttcctatgtcgaacaatatctggaaggggcattggctgcccatgcacttactgatggattggataggccggatggggggcctttcagacaacgactgttggtggtggctaataggctaccagtctctgcagttaggagaggagaggagacctggtcactggaaataagtgctggtggtctagtgagtgcgcttttgggtgtgaaggaagttgaggcaaaatggataggttgggcaggtgtaaatgtgccagatgaggctgggcaaaacgcactaacaaaagcactggccgagaagaggtgtatacctgtattccttgatgaagagattgttcatcagtattacaatggctattgcaacaacatattatggcctctcttccattatcttggtctcccccaagaagatcgtcttgcgacaaccagaagtttccagtctcagtttgctgcatatgaaaaagcaaatcaaatgtttgctgatgtggtaaataagcattatgaggagggcgacgttgtgtggtgccatgactaccatctaatgttcctgcccaaatgcctaaaggaatacaacagcaaaatgaaagttggttggtttctccacacaccatttccctcttctgaaatccacaggacgctgccatctcgatcagagctgcttcgtgcagttcttgctgctgatttagtaggtttccatacatatgactatgctaggcactttgttagtgcttgtactcgtattcttggactggagggtacacctgaaggagtagaagatcaaggaaggctgactcgtgtggctgcgtttcctattgggatagattcagatcggttcattcgtgcgcttgaggttcctcaagtccaagaacacatcaaagaattaaaagagagattttctgggcgaaaggtgatgttaggtgttgatcgccttgatatgattaaaggaattccccaaaagatactggcgtttgaaaagtttctcgaagaaaacgcatactggcgtgataaagtcgttttactgcagatagctgtgccaacaagaacagatgttcctgaatatcaaaaacttacaagccaggttcatgaaattgttgggcgcatcaatggtagatttggaactttaaccgctgttccaatacatcatctggatcgatctctcgacttttatgcactatgtgcactatatgctgtcactgatgtagcacttgtcacatctttgcgggatggaatgaatcttgttagctatgagtttgtggcatgccaagattcaaagaaaggagttctcattctgagtgaatttgcaggagctgcacagtctcttggtgctggagcactcctggtgaatccttggaacatcacagaagtagcttcttcaattggccaagctttaaatatgacagctgatgaaagagaaaaacggcatcgccataacttccaacacgtcacaactcatactgctcaagagtgggctgaaacatttgtcagtgaattgaatgatactgtagtggaagctcagcaaaggataagagaaaagccgcccatacttccagtaaaagatgcaatcaaacactacttgcagtccaataaccgtttactcatactgggattcaatgccacattgactgaaccagttgatactcctggtagaagaggtggagatcaaatcagagaaatggaacttaaattgcatccagatttaaaagaacccctaatggaactatgcagagatccaaagacaactattgttgtcctcagtggaagtgacagaactgtcttagatgataacttttgtgagtacaacatgtggttagcggcagagaacgggatgtttttgcgcgttacgagtggagaatggatgacaacaatgccagagcatttaaatatggattgggttgacagcgttaagcatgtctttgagtatttcaccgaaagaacgcctcgatctcattttgaactccgtgagacttcacttgtatggaattacaagtacacagatgttgaatttggaaggttgcaagccagagacatgctgcagcatctctggacaggaccaatatccaatgcgtcggttgatgttgttcaaggtagccggtcggttgaggttcgagcagttggtgttacaaagggtgcagcaattgaccgaatactgggagaaatagtacacagtaaatccatttcaacaccaatcgattatgttctgtgcgtagggcacttcctcgggaaggacgaggatgtttatagttttttcgagcctgagccctctgaagccatgggtatccccagagccaaaataagtgatcctttaaagttgcctggagagagaagagctggattaaagctgcaaaatagcagaagcggctcaaaaccatctcaaaggactcaacgacctctcccaaacccagaaaagaagaacacccataataatgtgcacgcaaatgggcggcgtcagtcatcagagaagatatcgtggaatgtgctcgatctcaagggggagaattacttctcctgtactgttggccgaactcgctccaatgctcggtaccttcttggaacatctgatgatgttgtttcatttctgaaggaattagctgcggcagcttcatcgagccaaggaatataccatggtctggcatcctttgatgcatctaggtctagtgctgaataacccatgttctggataaggcatgatggctaggtaatcttatctgaactttgtaacattttt

SEQ ID NO: 3461 - DNA, 2799 bp, Manihot esculenta
cgtgcgtatgcctggaaaccagtacaacagtaactcaaccccttacccaagtcgtacacaacggctcttgagagaaagagagctgaagaaaagcagcaggtcttcccattcaaatgaggctactgataatcatagggggattgaaccatgtgaacatgatttgcgcttgagagaaggtgacgactcaaacaattgctatattgagcaagaccttgaaggggctattgcagctacgaagacacttgctgagggatgtgaatatcaggatgccaggcctttaaggcaacggctgctggtggtggctaacaggctgcctgtctctgcagttagaaggggtgaagattcatggtcattggagataagtgctggaggcctagttactgcccttttaggtgtgaaggaatttgaggcaagatggattggttgggctggtgtaaatgtgcctgatgagattggtcagaaggcacttactagagctttggcggaaaagagatgcataccagtattccttgatgaagagattgttcatcaatattataatggctactgcaacaatatattatggcctctttttcattatcttggacttccacaagaagatcgccttgccacaacaagaagttttcagtcacaatttgctgcatataagaaggctaatcaaatgtttgctgatgtggtgaataaacactatgaagagggtgatgttgtgtggtgccatgattatcatctaatgttccttccaaaatgcttaaaagaatacaacagtaatatgaaagttggttggtttctccacacaccctttccttcttctgaaatccacaggactcttccatctcgatcagagctactgcgttcagttcttgctgctgatttagttggatttcatacctatgactatgcaaggcattttgttagtgcttgtactcgtatccttggactggagggcacacctgaaggagttgaggaccaggggaggctgactcgagttgctgctttccctattgggatagactctgatcgtttcataagagcactggaggtccctcaagtccaggatcatatcaaagaattgaaagaaagattttctggccgaaaggtaatgttaggtgttgatcgccttgatatgattaaaggaattccacagaagatacttgcatttgaaaagtttcttgaagaaaactctcattggcgtgataaagttgtcctgctacagattgcagtgccaacccgtactgatgtacctgagtatcaaaaactcacaagccaagttcatgaaattgttgggcgcattaatggtagatttggaactttgactgctgttccaatacatcatttggatcgctctctggacttccatgccttatgtgcgttgtatgctgttactgatgttgcacttgtaacttctttgagggatggaatgaatcttgttagttatgaatttgtagcatgccaagattcaaagaaaggtgtactcattcttagtgagtttgctggagcagcacaatctctgggtgctggtgcaatccttgtgaatccttggaatatcactgaagttgctgattcaatacgccaagctttgactatgtcatgtgaggagagagagaagcgacatcggcataattttgcacatgtgaaaacccacactgctcaagaatgggctgaaacttttgtgagtgaactaaatgatactgttattgaggctcagctaaggactaggcaagttccacctattcttccagaagaagatgcaattgaacgctatttgcagtctaataaccggttgctcatactgggattcaatgcaacgttgactgaaccagtagacactcctgggcgaagaggtgatcaaattaaagaaatggaacttaagttgcatcctgagctgaaagaaacattggtagcactatgtagtgatccaaagacaaccattgttgttttaagtgggagtgagagaaatgtcttagatgagaattttggggagtttgacatgtggctggcagcagaacatggaatgtttttacgtcttaccaaggcagagtggatgacaacaatgccagatcacttgaacatggaatgggttgacagtgtgaagcatgtctttgagtacttcacagaacggacacccagatcacactttgaacttcgtgaaacatcacttgtatggaattacaagtatgcagatgttgaatttggaagacttcaagctagggatatgttgcagcatctctggacaggcccaatttctaatgcatctgttgatgtcatccagggtagcagatcagttgaggttagaccagttggtgttacaaagggtgctgctattgatcgaatactaggagagatcgttcacagtaaatccatgacaacaccaattgattttgtcctgtgtgttgggcattttctgggaaaggatgaagatgtgtacaccttctttgagccggtgctaccttctgatggcgtaggtattgcaagaaccaagcaaactgacggcttgaagtcgccaggggaaaagcgtcctcctccgaagcttccagctaaaagtgggtccaaatcgtctcaaggtaagtcacgaccttcaccaaatcttgacaagaaaatgaccaacaatagctgtgcgagtggtcggaggcagtcaccagagaagatttcatggaatgttcttgatctcaagggagataattacttctcttgtgctgtcggacgaactcgaacaaatgctcgctatctacttcaatcttcagatgatgttgtctcctttctgaagaaactagccaatgcatctccttgagactatttaca

SEQ ID NO: 3462 - DNA, 3119 bp, Eucalyptus grandis
aggatactcaagttttctgagcaaagctgttaacgaaggttgaataaattgtgagcgtatgcctggaaacaagtacaacggtaacactgtccattttcctggtcgtgtagaacggctcctaagagaaagagagctcagaaaaagcagcagggctacccattcaaatgagacaactgaggctgagctagaacatgggctgcgctttagagatggagaaaactcggggatatctaatgttgaacagtttttggaaggggccgccgccgccagggcatttactgagggctttgaaaggccagatgggaggtcttccagacaaagactcttggtggtggctaatagactgcctgtctctgcagtcagaagaggggaagactcatggtctctcgagatgagttctggggggctagttactgctcttctgggtgtgaaggggttcgaggcaagatggataggatgggctggcgtaaatgtgcccgatgagattggacagagggctcttactgatgctttggctcaaaaaaagtgtatcccagtgttccttgatgaggagattgttcatcaatactacaatggctattgcaacaatatattatggcctctttttcattatcttggacttccacaagaagatcgcctagcaactacaagaagttttcagtctcagttttttgcatatcagaaagcaaatcaaatgtttgctgatgttgtaaataagcactatgaagaaggtgatgtagtctggtgccatgattaccatcttatgtttctgccgaaatgcctgaaggaatataacagccaaatgaaagttggatggttcctccatacaccatttccttcctctgaaattcacaggactctgccatcacggtccgagcttctgcgtgctgttcttgccgctgatttagttggtttccatacctatgactatgcaaggcactttgtgagcgcttgtactcgtattcttgggcttgagggtacaccggaaggagttgaagatcaagggaggctgacgagggtagctgcgtttcctattgggatagatgctgatcgtttcatccgagcacttgacacccaaccagttcaggaccacataaaagaactcaaagagagatttgctggtcgtaaggtgatgttaggtgtcgatcgactggatatgatcaaggggattccccaaaagatactggcatttgagaaatttcttgaagagaattcaaattggcatgacaaagttgttttgctgcaaattgctgtaccaacaagaacagatgttcctgaatatcaaaaacttacaagccaagtccatgaaattgttggacgcatcaatggaagatttgggacattgacggctgttcctatacatcacctggatcgttctcttgacttccataagctatgtgccctttacgcagttactgatgttgcacttgtcacttcattgagggatggcatgaatcttgttagttatgagtttgttgcatgtcaagattcaaagaaaggggttctaattctcagtgagtttgctggtgcggctcagtctctaggtgctggtgcaattctagtgaacccttggaacatcacagaggttgctgtttctatagcccaagctttaaatatgcctgccgaagagagggaaaagcgtcatcgacataattatgcacatgtgacaacccatactgcacaagaatgggccgaaatgttcgtaagtgaactaaatgatactgttgttgaggcccagctaaggacaaaacaagtaccacctcttcttccagtacaagatgccattggacgatatctattatccaacaatcgcttactcattctggggttcaacgcaacattgactgagccagtggacactccagggagaaggggtgaccagattaaagaaatggatctcaaattgcaccccgaattgaaagagcccttgacagcactttgcagtgactcgaggacaacagtggttgtcctcagtgggagtgacagaattgtcttagatgataactttgctgagtacaacatgtggttggcagctgagaatgggatgtttttacgtcttacaaagggagattggatgacaacgatgccagagcatttaaacatggaatgggttgacagtgtaaagcatgtctttgagtatttcacagaaaggactcctcgttcacattttgaacaccgagaaacctcgcttgtatggaactacaaatatgcagatgttgaatttggaagactccaagcacgagatatgttgcaacatctttggacaggtcctatatctaatgcatctgttgatgttgtccaaggtagccgttcagttgaggtgcgagcagttggtgtaacaaaaggagcagcaattgaccgtatattgggtgagattgttcacagtaaatccatgacaacaccgattgactatgttctctgtataggtcatttcctaggaaaggatgaagatgtctacacatttttcgagccagaacttccttgtgatgctctagggattcccagaaccaaggctactgatggactgaagtctccaggggagaaacgatcttcattgaagcttcaagctagtaaaagcgggtcaaaagcgtctgcggtgaagacacaacgacctttaccaaaccctgagaaaagaactaacaaccatgccagtggtagtgggaggaggtcatctccggataaaatatcttggaatgtgctcgatctcaagggggaaaactatttctcatgcgctgttgggcggacccgtacaaatgctcgctacatgcttacatcctctgacgacgtagtctcgtttctcaaggaactggcaagtgcctcactttttgaggagtaagacaacaaaagctgatttctggaggatatgttggcactgcaagccgaggttctgccttcccattacgaatatcaatctctctatatttctaatttctccgtgtacctcccgtgtttgtgggctgtctcatacctaagtcgagtgccccatcctcgatatggctttgagctggcagttttcgactacaacaaggtcatgaactgggaatttactttgatctacaattgagaaaatcaatctgtcgaaaatagtaataaatacagccttttgctctctgaaaaaa

SEQ ID NO: 3463 - DNA, 3402 bp, Prunus mume
agagaaaacaaacactgcgctgcatgcgtatcatatgactttcttacatttccattggcctattcgtccatttagctactcacatgtttatggttctttgtcactctctttttcttttgctttttcataaaacaaaaaaaagagagagaaaagaagaaggaaaagcatatctttatcattcaaaagatatttacaaagttcagtggcattgttccaagccaaaaggtttctttctccttttttaaacaagtcaatcgatgaaggacacagttgccccaggaccctagtgctaatattagtagaaccgaaggttcattactagagagagcatatgcctggggataagtacaacagtaattcatcccacatcccaaatcgacttgaacggctcttgagagaaagggagctaaggaagaatatcagggcctcccacttgaatgaagcacatgataacaatagggtgactcaaccatttgagcctgacttacagttaagagaagatgaaaactcaaaagttgcctatgttgaacaattcttggaaggggctgcagctgcaagggcgcttactgatggatgtgaaaagcaagaagggcagcctctcagacaacgacaacgactgttggttgtggccaacaggttacccgtctctgcagttaggagaggtgaagattcatggtctctggacataagtgctgggggtctggtcagtgcccttttaggtgtaaaggagtttgaagcaaggtggattggttgggcaggggtaaatgtgccagatgaaattgggcagaaggcacttactaaagctctagctgaaaagaggtgtatccctgtttttcttgatgaggagattgttcatcaatattacaatggatattgcaacaacattttgtggccccttttccattaccttggacttccacaagaagatcgacttgctaccacccggagtttccagtctcagtttgctgcatataagaaggcaaatcaaatgtttgctgatgtggtcaatgagcactatttggagggtgatgtagtttggtgccatgattaccatcttatgtttcttccaaaatgcctgaaggattacaacagcaaaatgaaagttggttggtttctccacaccccatttccttcttctgaaatccataggacactgccatcacgatcagaacttctccgttcagttcttgcagctgatttagtcggttttcacacttatgactatgcacggcactttgttagtgcttgcactcgcattcttggacttgagggtacacctgaaggagttgaggatcaagggaggcttactcgagtggctgcgtttcctattggaatagattcagagcgcttcatacgtgcactggaggttcctcaagtccaagaacacattagagaattgaaagaaagatttgctgggcgaaaggtaatgttaggtgtcgatcgacttgatatgattaaaggaattccacaaaagatactggcatttgaaaagtttcttgaggaaaacccaagttggcgtgacaaagtggttttactgcaaattgcggtgccaacaagaacggatgttccagagtatcaaaaacttacaagccaggttcatgaaattgttgggcgaattaatggcagatttggaactttgactgctgtcccaatacatcacctggatcgttcccttgactttcaggcattatgtgcactatatgctgttacagatgtagcacttgtcacgtccctgagagatggaatgaatcttgtcagttatgagtttgtggcatgccaagatgcaaagaaaggggtcctcattcttagtgagtttgctggtgccgcacagtctctaggtgctggagcaattctagtgaacccatggaacatcacagaagttgccaattcaattgcccaagcattaaatatggactctgaagaaagagagaagcggcataagcataactttatacatgtgacaacccacactgcccaggaatgggccgaaacgtttgtaagtgaacttaacgacactgtcgtagaggcacaaataaggactagacaggtgccaccaccacttccaaacaaggaggcgattgaaagatattcgaaagcaagtaatcgattgatcatactgggattcaacgcaacattaactgaaccagtgcacacacctgagagacgaggtgatcaaataaaagaaatggaacttaaactgcacccagagttgaaagaacccttgtcagcactctgcaatgatccacaaacaactattgttgtcctcagcgggagtgccacagaagttttagatgataacttcggggagcttgacatgtggttggcagctgaaaatgggatgtttttgcgcctaacaaagggaaaatggatgacaacaatgcccgaacatttgaatatggaatgggttgagagtgtgaagcatgtttttgagtatttcacggagagaacaccccggtcacatttggatgaccgtgcaacttcgcttgtgtggaattataaatatgcagatgttgattttggaagacttcaagcaagagatatgctgcagcatctctggactggtccaatttctaatgcatctgttgatgttgttcaaggtagccggtctgtcgaggtgcgaccagttggtgtcacaaagggtgcagcaattgaccgtatattgggagagatagttcacagtaaatctatgactacacccattgattatgtgctgtgtattggacattttcttggaaaggatgaagatgtatacaccttttttgagccagatcttccgcctgagccgatgggtcttccaagaaagatgactgatggacaaaagttacctagtgagagaagatcttcattgaaggttccatcaaataaaaatgcctcaaaatcagctcagagcaagacacaacgacctttaccaaatggtgagaagaagaatgccaatcacagcaatgggaatccaagatggccgtctcctgagaagacttcatggaatgtacttgacctgaagagggagaactactactcttgtactgtcgggcggacgcgtacaaatgctcgatatctgcttcagtcttcagatgatgttgtctcatttctgaaggagctggctggtgcctcttcggcaagttcttaatctcaagattgagagatataatgctctcaagttttcggaaagtgtaccttcgctttacctagtagccgtagtttcgcttttgaacactattgcattgtagatattttactgcttcaattgaaatattagatttactcttagaataggtactgaaaaggcatctaaaccacagtgatggtcaaagatttaggaagaacaaaatgagaaactcagagcatccttgaatattcagtaattattaatctaaaccacagagatggtcaaagttttacgta

SEQ ID NO: 3464 - DNA, 3681 bp, Populus trichocarpa
tttatacagccgtagaaatgtgtttcactctgttttttaagatgtgacaatgatttgatgtagttctcttagtgtcttacttactaggactgagatttttgtgtggcttatagggattactgagcacttaatttactttcaaacaaaaatgtaggagattcaattgctctgaaaacaccattatcccatcaaattgttgattggaggttgggttactaaagttgtgagcgtatgcctggaaaccagtacaacggtaactctacccttaactcaggtcgtgtcggacggctcttaaagataagagagcaaaggagaagtatcaggtctgcctattcaaatgaggtaactgataaccatagaggaactgaagcatgtgaaaatgatttgcgcacgcgagaaggtgacagcttaaacaattcatttatcgaacaatacttggaaggtgctatcgcagagggatatgaaaagctggatgtcaggcctttaaggcaacggctgttggtggtagctaatagactacctgtatctgcagttagaagaggtgaagactcatggtctttggagataagtgctgggggcttagtcactgctcttctaggtgtaaaggagtttgaggcgaaatggattggttgggctggagttaatgtgccagatgaagttggccagaaggcgcttactgaagctttggctgaaaagaggtgtattccggtattccttgacgaagagattgttcatcaatattataatggctactgcaacaatatattgtggcccctctttcattaccttgggcttccacaagaagatcgacttgccacgaccagaagtttccagtctcagtttgctgcatataagaaggcaaaccaaatgtttgctgatgtggtgaatcagcactatgaggagggtgatgttgtctggtgccatgattaccatttgatgtacctcccaaaatgccttaaggaatacaataataatatgaaagttggttggtttctccacacaccctttccttcttctgaaatccataggacgctgccatctcgatcagacctactacgttctgttcttgcagccgatttagttgggtttcacacctatgactatgcaagacattttgttagtgcttgtactcgtattcttgggctagagggcacacctgaaggcgttgaggatcaagggaggctgactcgagttgctgcgtttcccattgggatagactcagatcggttcataagagctcttgaactccctcaagtccaggaacacatcaaagaactgaaggaaagatttgctggccgaaaggtaatgctaggtgttgaccgccttgatatgattaaaggaattccacagaagattcttgcatttgaaaaatttctcgaggagaattccgcctggcgtgataaagttgttctactgcagattgctgtgccaacaagaacagatgttcctgagtatcaaaaacttacaagccaagttcatgaaattgttggacgcattaatggcagatttggaacattaactgctgttccaatacaccacctggatcgctctctcgacttccatgccttgtgtgctttatatgcagttaccgatgttgctcttgtaacttctttaagggatggaatgaatctcgtcagttatgagtttgtagcatgccaagattcgaagaaaggtgtgctcattcttagtgagtttgcaggtgcagcccaatctctaggtgctggagcaatccttgtgaatccttggaacatcactgaagttgctgattcaatacgccaagctctaactatgtcccctgaagaaagagagaagcgacatcgccacaactttgtccatgtgacaacccacactgctcaagaatgggctgaaacttttgtgagtgaactagatgatacagttatcgaggcacaactaaggaccaagcaagtgccacctgcacttccagaagaagatgcaattagtcgttatttgcagtctactaatcgattgctcatactgggattcaatgcaacattgactgagccagcggacactcctgggagaagagctgatcaaattaaagaaatggaacttaaattgcacccagagttaaaagaagcattgacagcactttgcagtgatagaaagacaaccattgttgttctcagtgggagtgaccgaaaaacattagatgataactttggggagtatgacatgtggttggcagcagaacatggaatgtttttgcgacttacaaagggagaatggatgacaacaatgccagaacacttaaatatggaatgggttgacagtgtgaagcatgtttttgagtacttcacagaacgtactccccgatcacattttgaacgctgtgaaacatcacttgtatggaattacaagtatgcagatgttgaatttgggaggcttcaagcaagggatatgttgcaacacctctggacgggcccaatttcaaatgcctctgttgatgtggtccaagggaatcgatcagttgaggttcgagcagttggtgttacaaagggtgctgctattgatcgtatactgggagagattgtccatagtaaatccatgacaacaccaattgattatgtcctatgcattggccattttctgggaaaggatgaagatgtgtacaccttctttgagccagagctcccttctgatagcttagctgttgcaagaactaagcaaaatgatggactaaaatcgcccattgatagacgaccttctatgaagcttccagccattagaagcgtgtctaaatcatctcaaggtaaggcacagcgacctttactaaatcccgagaagagaacagctaaccacggctgtgggagtgggcgacggccatcagcagaaaagatttcatggaacgtgcttgatctcaagggagataattacttctcctgtgctgttggtcgaactcgcacaaatgctcgctatctacttggatcatcagatgatgtcgtgtccttcctcatgaaattagccaatgcatctacgtgagacgagtagtgctgaagtcgagaaatgtttctctcctgcaaatggtaaagcatccactcagagttcaagaaccaggtgtggttcttgaaggcaggaatggtgaggcaacagaaacagtcctctataggttcgaatgttgtaacatcaatagttagcctcacataagcaaaggcatggtaccgagaaccaagaaaaagataaaagataaaaaacaagaagaaaagaaagagcagcaagccaccgcagtgagacctttgttgaaagatttgaggaagagaactcttatagcctcagcttcttcatttccgttcttttgcttctatcgttccatatgtttatttttgtcccagattttggaatgagtactcgcaaaagagcagttatgttagtaaatgaagcttgtttgcttctcctggcgtatgtacagtgtgtataagagctgtcataccctttagttttatccattaaagaaatactgatatccctatgtaatgcttgcgtgctttgagtcctgaaaacagtgataccgtccttcagggaccgggcagacatttagcctgttaaagtgggcatgttttcgggtgcgaatacgatgtgtaaaaaccaagagaacaattgcacaagaagttaatatttatgtgacttttatacttcgattgcataatgaaatttttttatttt

SEQ ID NO: 3465 - DNA, 2793 bp, Cucumis sativus
cgtatgcctgggaataagtataacggtaattcaaacgatagttcagaccgtatacctggtcgactggaaaggctcttgcgagagagaaaactaagaaaaagctctaaggattcatactcaaacgaagtaaatgactacagtaaggagtctgaactaattgaaaatgaccatcgtttgaaagaagaagaaaccgttggaattccctgtaaattttccgaagcttctgtagcctcaaggacctttggcgaaggatgtgacaagcaagatggcaagccacccagacaacggttgctggttgtggccaataggttacccgtctctgcagttaggaggggtgaagattcctggtctctagagatcagtgctggaggcctagtgagtgcacttctgggcgtgaaggaatttgaggcgagatggattggttgggctggtgtaaacgtacccgatgaggtgggacaaaaggcactgactgaagctttggctgaaaagaggtgtatccctgttttccttgatgaagagattgttcatcaatactacaatggctattgtaacaacattttatggcctctgtttcattaccttggccttcctcaagaagatcgtcttgccaccacccgtagctttcagtctcagtttgccgcatacaagaaggcaaaccaaatgtttgcggatgtagttaacaagcactatgaggagggtgatgtcgtttggtgccatgattatcatcttatgttccttccaaaatgtctcaaggaacataatcgtaagatgaaagtcggctggtttctccatacaccttttccctcctctgaaatccacagaacccttccatcccgatcagagcttctgcgttcagtacttgctgctgatctggttggttttcacacatatgattatgcgcgtcatttcgtaagtgcttgtactcgtattcttggacttgagggtacaccagaaggagttgaggaccaaggaaagctaacgcgggtggctgcatttcctattggtatcgactcggaacgattcatacgtgcccttaagattcctgaagtccaagtacatattgaagagttaaaggaaagattcaaaggtcgaaaggtaatgttaggggttgatcgtcttgatatgattaaaggaatacctcaaaagatattagcatttgaaaaattcttggaggaaaacccttattggcgtgataaagttgttttgctacaaattgcagtgccaacaagaacagatgtgccagaataccaaaagcttacaagccaagttcatgaaatagttgggcgtattaatgggagatttggaacactgactactgtgcctatacatcacctggatcgctccctcgattttcatgcactgtgtgcactatatgctgtaacagatgttgcacttgtcacatctttgagggatggaatgaatctcgtcagttatgaatttgttgcttgccaggatgcaaagaaaggagttctaattcttagcgagtttgctggtgctgcacaatccctgggtgctggagcacttttggtcaacccctggaacataacagaagttgcaaaatcaattgatcgagcattaaatatggaagctgaagaaagagaaaagcgccataggcataattttctccatgtgactacacacactgctcaggaatgggcagaaacttttgtgagtgaacttaacgatacagtcgttgaagctgaactgaggattcgacaatgtccgcccccgcttccgtttgataatgcaattaaacattatgagcaatctactaatagattacttatactggggttcaattcaacattaactgaaccggtagacacacctgagagacgaggtgatcagattagagaaatggatctgaaactacacccagatttgaaagaaccattgacagcaatttgcaatgacccaaacacgacagtagtcattctcagtgggagtgacagaactgtcttggatgataactttggggagtatgacatgtggttggctgctgaaaatggaatgtttctacgcttcacaaggggggactggatgactacaatgcctgagcatttgaatatggaatgggtcgacagtgtgaagcatgtgtttgagtacttcacagagagaactccccgttcccattatgagctccgggaaacttcacttgtttggaactataaatatgcagatgttgagtttggaaggcttcaagcacgggatatgctacagcatttatggacgggtccaatttctaatgcatcagttgatgttgttcaaggtagccgatctgttgaggtgcgagctgttggcgttaccaagggatcagcaattgaccgaatattgggagaaatagttcacagcaagtccatgacgactccaatagactatgtcttgtgtgtaggccattttcttgggaaggatgaagatgtctacactttcttcgagccagaacttccatcggatactataggcatgccaagagccaagggaaccgatggacttaaattaacgggtgagagaaaaccttccatcaaagttcctctaaacaggaatgggtcaaaatcgccacacaataagggtcggtcgagctcggagaagaaaacttcaaatcataactgtgcaaacggtcgtaaaccatcaccggagaagattcaatggaatgtgcttgatctcaaggctgagaactacttctcttgtgctgttggaagagctcgaacaaatgctcggtatctgctcggatcatcagatgaagtggtggcattcctaaaggagttggcagatgcaaatgcattttcttgagac

SEQ ID NO: 3466 - DNA, 3056 bp, Prunus persica
catatgcctggggataagtacaacagtaattcatcccacatcccaaatcgagttgaacggctcttgagagaaagggagctaaggaagaatagcagggcctcccacttgaatgaagcacaaccatttgagcctgacttacagttaagagaagatgaaaactcaaaagttgcctatgttgaacaattcttggaaggggctgcagctgcaagggcgcttactgatggatgtgaaaagcaagaagggcggcctctcagacaacgacaacgactgttggttgtggccaacaggttacccgtctctgcagttaggagaggtgaagattcatggtctctggacataagtgctgggggtctggtcagtgcccttttaggtgtaaaggagtttgaagcaaggtggattggttgggcaggggtaaatgtgccagatgaaattgggcagaaggcacttactaaagctctagctgagaagaggtgtatccctgtttttcttgatgaggagattgttcatcaatattacaatggatattgcaacaacattttgtggccccttttccattaccttggacttccacaagaagatcgacttgccaccacccggagtttccagtctcagtttgctgcatataagaaggcaaatcaaatgtttgctgatgtggtcaatgagcactatttggagggtgatgtagtttggtgccatgattaccatcttatgtttcttccaaaatgcctgaaggattacaacagcaaaatgaaagttggttggtttctccacaccccatttccttcttctgaaatccataggacactgccatcacgatcagaacttctccgttcagttcttgcagctgatttagtcggttttcacacttatgactatgcacggcactttgttagtgcttgcactcgcattcttggacttgagggtacacctgaaggagttgaggatcaagggaggcttactcgagtggctgcgttccctattggaatagattcagagcgcttcatacgtgcactggaggttcctcaagtccaagaacacattagagaattgaaagaaagatttgccgggcgaaaggtaatgttaggtgtcgatcgccttgatatgattaaaggaattccacaaaagatactggcatttgaaaagtttcttgaggaaaacccaagttggcgtgacaaagtggttttactgcaaattgcggtgccaacaagaacggatgttccagagtatcaaaaacttacaagccaggttcatgaaattgttgggcgaattaatggcagatttggaactttgactgctgtcccaatacatcacctggatcgttcccttgactttcatgcattatgtgcactatatgctgttacagatgtagcacttgtcacttccctgagagatggaatgaatcttgtcagttacgagtttgtggcatgccaagatgcaaagaaaggggtcctcattcttagtgagtttgctggtgccgcacagtctctaggtgctggagcaattctagtgaacccatggaacatcacagaagttgccaattcaattgcccaagcattaaatatggcctctgaagaaagagagaagcggcataagcataactttatacatgtgacaacccacactgcccaggaatgggccgaaacgtttgtaagtgaacttaacgacactgtcgtagaggcacaaataaggactagacaggtgccaccaccgcttccaaacaaggaggctattgaaagatattcgaaagcaagtaatcgattgatcatactgggattcaacgcaacattaactgaaccagtggacacacctgagagacgaggtgatcaaataaaagaaatggaacttaaactgcacccagagttgaaagaacccttgtcagcactctgcaatgatccacaaacaactattgttgtcctcagcgggagtgccacagaagttttagatgataacttcggggagcttgacatgtggttggcagctgaaaatgggatgtttttgcgcctaacaaagggaaaatggatgacaacaatgcccgaacatttgaatatggaatgggttgagagtgtgaagcatgtttttgagtatttcacagagagaacaccccggtcacatttggatgaccgtgcaacttcgcttgtgtggaattataaatatgcagatgttgattttggaagacttcaagcaagagatatgctgcagcatctctggactggtccaatttctaatgcatctgttgatgttgttcaaggtagccggtctgtcgaggtgcgaccagttggtgtcacaaagggtgcagcaattgaccgtatattgggagagatagttcacagtaaatctatgactacacccattgattatgtgctgtgtattggacattttctaggaaaggatgaagatgtttacaccttttttgagccagatcttccgcctgagccgatgggtcttccaagaaagatgactgatggacaaaagttacctagtgagagaagatcttcattgaaggttccatcaaataaaaatgcctcaaaatcagctcagagcaagacacaacgacttttactaaatggtgagaagaagaatgccaatcacagcaatgggaatccacgatggccgtctcctgagaagatttcatggaatgtacttgacctgaagagggagaactactactcttgtactgtcggccggacgcgtacaaatgctcgatatctgcttcagtcttcggatgatgttgtctcatttctgacggagctggctggtgcctcttcggcaagttcttaatctcaagattgagagatataatgctctcaagttttcggaaagtgtaccttcgcttagccgtaatttcgcttttgaatactattgcattgtagatattttactgcttcaattgaaatattagatttactcttagattaggtactaaaaaggcatctaaaccacagtgatggtcaaagatttaggaagaacaaaatgagaaactcagagcatccttcttgaatatgcagtaattcccttattattaatctaaaccacagtgatggtcaaagttttacata

SEQ ID NO: 3467 - DNA, 2996 bp, Fragaria vesca
cgaccgtatgcctgggaacaagtacaacagtaattcagcccacattccaaatcgagttgaacggctcttgagagtaagggagcttaggaagaataatagagcatcatcacaattaaatgaagcaaatgataataatagtgaaaaagaagaggaaagctcaagaaattcttatttcgaaaaatacttggatggggctgcagctgtaagggcacttaatgaggggcctgaaaaccaagaagcaaggcctcttaggcaaaggctgttggttgtggccaacaggttacccgtgtctgctgttaggagaggtgaagattcatggtctttggagataagtgctgggggtctggtcagtgcccttttaggtgtaaaggagtttgaggcaaggtggattgggtgggctggggtaaatgtaccagatgatattggacagcaggcacttacaaaagctctagctgaaaagagatgtattcccgtcttccttgatgaggagattgtccatcaatattacaatggctattgcaacaatattttatggccccttttccattaccttgggctcccacaagaagatcgacttgccaccactcggagtttccagtcacagttttctgcatataagaaggcgaatcaaatgtttgcagatgtagttaatgcacattatgaagagggtgatgttgtttggtgccatgactaccatcttatgtttcttccaaaatgcttgaaggaatataacagcaaaatgaaagtcggttggtttctccacactccatttccttcctctgaaattcataggacgctgccatcacgatcagaactcctgcgctcagttcttgcagctgatttggttggttttcacacttatgactacgcacgacactttgttagtgcttgcactcgcattcttgggcttgagggtacacctgaaggagttgaggatcaagggaggcttactcgagtggctgcgtttcctattggaatagattcagatcgcttcatacgagcacttgaggttcctcaagtccaagaacacattagggaactgaaagaaagatttgcagggcgaaaggtaatgttgggtgttgatcggcttgatatgattaaaggaatccctcaaaagatactggcgtttgaaaagtttcttgaggaaaaccctatctggcgtgacaaagtggttttgctgcaaattgcagtgccaacaagaaccgatgttcctgagtatcagaaacttacaagtcaggttcatgaaattgttggacgaattaatggcagatttggaagtttgactgctgtccctatacatcacctggatcgttctctcgactttcatgcattatgtgcactgtatgctgttacagatgtagtacttgtcacatccctcagagacggaatgaatcttgtcagttatgaatatgtggcttgccaagatgcaaagagaggggtccttatccttagtgagtttgctggtgccgcacagtctctaggtgccggagcaattctagtgaacccatggaacatcacagaagttgccaattcaattgcccaagcactgaatatgtcctctgaagaacgagagaagcgacataggcataactttttacatgtgacaacccacactgcccaggaatgggctgaaacttttgtaagtgagctgaacgatactgttgtagaggcgcaattgcggacaagacaagtaccaccaccactgccaaacagggaggcaattcaacgttacttacgagcaaataaccgattgcttatactgggattcaatgcgactttaactgaaccagtggacactcctgagagacgaggtgatcaaataaaagaaatggaacttaaattgcatccggatttgatagaacccttgacagcactctgcaatgatccaaacacaaccattgttgtcctcagtgggagtgacaggaatgtcttagatgataactttggggagcttgacatgtggttggcagctgaaaatggaatgtttctacgggccacaaagggacaatggatgacaacgatgcctgaacatttgaatatggaatgggtcgaaagtgtgaagcatgtctttgaatatttcacagagagaacaccccggtcacactttgaacttcgtgaaacttccctcgtttggaattacaaatatgcagatgttgattttggaagacttcaagcgagagatatgttgcagcatctctggactggtccaatctctaatgcatctgttgatgttgttcaaggtagccggtctgtggaggtgcgagcagttggtgtcacaaagggtgcagcaattgaccgtatattgggagagatagttcacagtaaatccatgacatcccccattgattatgtactgtgcatggggcattttcttgggaaggatgaagatgtgtacacctttttcgagccggatctgtcgactgacaataatggtcttccaagaagcaagataactgatggactaaggtcatctggtgagagaagatcttctccgaagcttctggcaaacaaaagtgggtcaaaatcatcgcaaaacaagacacaacgacctttaccaaatcctgagaagaaagctgctgtcaaccataaatctgggaatgtaaggtcgccatctcctgataagatttcttggaatgtacttgacctcaagaaggagaactactactcttgttctgttgggaggactcgtacaaatgctcgatatctacttcagtcatcagatgatgtagtctcatttctgaaggagttggctgatgcatcttcagattttgagtaacaatgttctcacatttcggagatagtgtaggagaactactactcttgttctgttgggatgcctcgtacaaatgcttaatatctacctcagtcgttagatgtaatctcatttctgaaggaattggctgatgcatcttcagattgagagatataatgttctcatatttcagagaagtgtatttctgatttcatctgcattgtagatattccaagtttccaac

SEQ ID NO: 3468 - DNA, 3016 bp, Citrullus lanatus
ttattaaattataggacacactgtgcgattggtctaaaggctgaattgctctcaagcagatatttgaaggaggtaggctctaaagtaatcgtatgcctgggaataagtataacggtaactcaaacgatatttcagaccgtataccaggtcgagtggaaaggctcttgcgcgagagaaagctaaggaaaagctgtaaggattcatattcaaacgaggtaaacgactacattaaggagtctgaactaattgaaaatgaccttcgtttgaaagaagaagaaaccgttggaactccctgtaaattttcggaagcttctgtagcctcgagggcctttgccgaaggatgtgacaagcaagatggcaagcctcccagacaacggctgctggttgtggccaataggctgcccgtctctgcagttaggaggggtgaagattcctggtctctggagattagtgctggaggtttagtgagtgcacttctgggggtgaaggaatttgaggccagatggattggttgggctggtgtaaatgtaccagatgaggtgggacaaaaggcactgactgaagctttggctgaaaagaggtgtatacctgttttccttgatgaagagattgttcatcaatactacaatggttactgcaacaacattttatggcctctgtttcattaccttggccttcctcaagaagatcgtcttgccaccacccgtagctttcagtctcagtttgccgcatacaagaaggcaaaccaaatgtttgctgatgtagttaacaagcactatgaggagggtgatgttgtttggtgccatgattatcatcttatgttccttccaaaatgcctcaaggaacataatcgtaagatgaaagtcggctggtttctccatacaccttttccttcctctgaaatccacagaacccttccgtctcgatcagagcttctgcgctcagtacttgctgcagatctggttggctttcacacatatgattatgcccgtcattttgtgagtgcttgtactcgtattcttggacttgagggtacaccagaaggagttgaggaccaaggaaagctaacacgagttgctgcattccctattggtatagactcggatcgattcatacgtgcactcaagattcctgaagtccaggaacatattgaagagctaaaggaaagattcaaaggtcgaaaggtaatgctaggggttgatcgtcttgatatgattaaaggaatacctcaaaagatattagcatttgaaaaattcttggaggaaaacccttattggcgtgataaagtggttttgctgcaaattgcagtgccaacaagaacagatgtgccagaataccaaaagcttacaagccaagttcatgaaatagttggacgtattaatgggagatttggaacattgactactgtgccgatacatcatctggatcgctcccttgattttcatgcactatgtgcactatatgctgtaactgatgtagcacttgtcacatctttgagggatggaatgaatctcgtcagttatgagttcgttgcttgccaggatgcaaagaaaggggttttaattcttagcgagtttgctggtgctgcacaatctcttggtgctggagcacttttggtcaacccctggaacataacagaagtcgccaaatcaatcgatcgagcattaaatatgggtgctgaagaaagagaaaaacgccacaggcataattttctccatgtgacgacgcacactgcccaggaatgggcagaaacttttgtgagtgaacttaatgatacagtcgttgaagctgaactgaggattcgacaatgtccgcccctgcttccatttgacaatgcaattaaacattatgtgcaatctactaatcgattacttatactggggttcaattcaacattaactgaaccagtggacacacccgagagaagaggtgatcagattagagaaatggatctgaaactacacccggagttgaaagaaccattgacagcaatttgcaacgacccaaatacgacagtagtcattctcagtgggagcgacagaactgtcttggatgataacttcggggagtatgacatgtggttggcagctgagaatgggatgtttctacgcttcacaaggggggactggatgactacaatgcctgagcatttgaatatggaatgggtcgacagtgtgaagcatgtttttgagtacttcacagagagaactccccgttcccattttgagcttcgggaaacttcacttgtttggaactataaatatgcagatgttgagtttggaaggcttcaagcaagggatatgttgcagcatttatggacaggtccaatttctaatgcatcggttgatgttgttcaaggtagccgatctgttgaggtgcgagctgttggtgttaccaagggatcagcaattgaccgaatattgggagaaatagttcatagcaagtccatgacgactccaatagactatgtcttgtgtgtaggccattttcttgggaaggatgaagatgtctacactttctttgagcctgaacttccgtcggatactataggcatggcaagaaccaagggaaccgatggacttaagttaacgggtgagagaagaccttccatcaatgttcctctaaataggaatggatcaaaatcgcctcacaataagggtcggtcgagctcggagaagaaaacttcaaatcataactgtgcaaacggtcgtaaaccatcacccgagaagattcaatggaatgtgcttgatctgaaggctgagaactacttctcttgtgctgttggacgatctcggacgaatgctcggtatctgctcggatcatcagatgacgtggtgacattcctaaagaagttggtaggtgcaaatgcattttcttgagaccaagtatgcttttgcttccttgctttctttctcaatgtttatgtagaaactgctgatcatgctatataaaaaaattgtgggtctgatgacttttgtttcataatagcttctttgttatgttctctaatttgctt

SEQ ID NO: 3469 - DNA, 3655 bp, Theobroma cacao
cttcgatagatttcgttcttcgaatttccctagcattagcggtttctccaagtctctggcttctcgtccactttgcagggttagttttctctttctctttctctctcgatcttttctttttctgtttgttttgttttgagtttgagtttggaaaacgtgatcagttttgtgttacaaatttcgaaaacttgtcatactattcgctcgattgtcatatcttcgttttgtgatgctttgttctttttagaatttgcttgagaaacgaattttttttctttctttctttcctgctctgtttggttgctgtgaagcgagggaggagaaattagaaacgtcttaccaggttaggtgtctcagccttctaatcatacagtaaaagttggtggcaaatcattttccatcatcaggacatacaattggactgagagctcataaaattggtattggcggttgggttctagagtgagcgtatgcctgagaacaagtacaacggtaattcgacccatataccaactcgtctcgaacgcctcttgagggaaagagaacgcctcttgagggaaaaagagctaagggagcaaaggaaaagcagcagggcttcccattcaaatgaggtgattgataatcataggggggttgaagaatctgagaatggcccacgttttagagaaggtgaccactctggggttgctttggtcgaacaatacttggaagaggctgcagctgcaagggcactggttgagggatgcgaaagaccagatggaaggcctgaaaggcaacgactgttggtagtggccaataggcttccagtttctgcagttaggagaggtgaagactcatggtctctggatataagtgctggaggtctagttactgctctattgggtgttaaggagtttgaggcaaggtggattggatgggctggcgtaaatgttccagatgagattggacagaaggcacttactaaagctttagctgaaaagaggtgtatccctgtcttccttgatgaagagattgttcatcagtactacaatggttattgtaacaacatcttgtggcctctttttcactaccttggacttccacaagaagatcgccttgctaccacaaggagtttccagtctcagtttgctgcatacaagaaagcaaatcaaatgtttgctgatgttgtaaatacgcactatgaagagggtgatgttgtctggtgccatgattaccacctcatgtatcttccagaatgcctgaagaaatacaacacgaagatgaaagttggttggtttctccatacgccattcccttcttctgaaattcataggacactgccatccagatctgagctgttgcgttcagttcttgctgctgacttggttggttttcatacctatgactatgctagacattttgttagtgcttgtactcgaattctgggacttgaggggacacctgaaggggttgaggatcaggggaggctgactcgtgttgctgcttttcctattgggatagactcagatcgtttcatacgtgcacttgagcttcctcaagtccaggaacacatcaaagaattaaaagaaaggtttgctggaagaaaggtaatgcttggtgttgatcgtcttgatatgattaaaggaatcccccaaaagatattggcatttgaaaagttccttgaggaaaattctacctggcgtgataaagtggttttgctgcaaattgcagtgccaacaagaactgatgttcctgagtaccaaaaacttacaagccaggttcatgaaattgttggccgtattaatggtcgatttgggacattgactgcagttccaatccatcacctggatcgttctcttgactttccgaaactctgtgcattatatgctgttacggatgtagcacttgtcacatctttaagggatggcatgaaccttgtcagttatgagtttgttgcttgccaagatgcaaagaaaggggtcctcattctcagtgaatttgcaggtgctgcacagtctctgggtgctggagctatcttggtaaatccttggaacatcactgaagtggctgcttcaattggccaggctttgaatatgcaccctgaagaaagggagaagcgacatcgccacaattttcatcatgtgacaacccacacagctcaagaatgggctgaaacatttgtaagtgaactgaatgataccgttgttgaagctcaactaaggacaagcaaagtgcctcctgagcttccacaaaatgatgcaatggaatgttatttacagtctagcaatcgattgctgatactgggttttaatgcaacattaactgaaccggtggatactcctgggagtagaggtgatcaaatcaaagaaatggaacttaaattgcatccggaaataaaagtacccttaacagcactctgtaatgatccaaagacaacagtagtcgtcctcagtgggagtgacagccgtgtcttggataagaactttggggagtatgacatgtggttggccggagaaaatgggatgtttctacgccatacaaagggagactggatgacaaccatgccagagctcttgaatatggaatgggttgacagtgtgaagcatgtttttgaatatttcacagaaagaacacctagatcacatttcgacttccgtgatacatcacttgtatggaattacaagtatgcagacgttgagtttggaagaattcaagcaagggatatgctgcagcatctctggactggcccaatttctaatgcatctgttgatgttgttcaaggaagccgatcagttgaggtgcgagcagttggtgttacaaagggggcagctattgatcgtattctaggagagatagttcacagtaaatcaatgacaacaccaattgattatgtcctttgtgttggacattttctggggaaggacgaagatgtgtacacctttttcgagccagagctgccttctgacgtgacaagtataacaagaaccaagccaactgacggaccaaggttacctgcagagagaagagctgctttgaagcttccagcaagcagaagtggggcaaaatcatctcaaacaaagacacagcgaccacagccggctcctgatagaagaactggcaataatcatagtagtgggagtttgcggcgtccatcaccggaaaagatttcctggagtgtactcgatctcaaaggagataactacttctcctgtgctgttgggcggactcgcacatgtgctcgatatctgctcgggtcatcagatgatgttgtctcatttctgaacagactggcaaatgcctcttcatcatgcaattcgttttcaggtttacatgagtaaacaggagtcttccttaaatgttggggaccgatcctccacccttctcagagcaactctccgggctgaagaaaactcttgttaaatcacttgcataacagaaaagcttagtatttttcaaactgaaattacatgaaccacagcattgttgtcagttcatagatgttgaaggaaaccaattctatagtgacaattcctgcatccaattaattacacaagcacagttgttttactagcatttcaaagcatttgaatggtattcacttgagattttgatagaacacggtatatgcttcacatgccaactcgagtatccaactatgatgtaaaggaagataggc

SEQ ID NO: 3470 - DNA, 3677 bp, Theobroma cacao
ctctccagaactctcttactctgttttcctttccttttctctgtctctctctctctttctctctttacatgtgcttcgcatttaaccttcgatagatttcgttcttcgaatttccctagcattagcggtttctccaagtctctggcttctcgtccactttgcagggttagttttctctttctctttctctctcgatcttttctttttctgtttgttttgttttgagtttgagtttggaaaacgtgatcagttttgtgttacaaatttcgaaaacttgtcatactattcgctcgattgtcatatcttcgttttgtgatgctttgttctttttagaatttgcttgagaaacgaattttttttctttctttctttcctgctctgtttggttgctgtgaagcgagggaggagaaattagaaacgtcttaccaggttaggtgtctcagccttctaatcatacagtaaaagttggtggcaaatcattttccatcatcaggacatacaattggactgagagctcataaaattggtattggcggttgggttctagagtgagcgtatgcctgagaacaagtacaacggtaattcgacccatataccaactcgtctcgaacgcctcttgagggaaagagaacgcctcttgagggaaaaagagctaagggagcaaaggaaaagcagcagggcttcccattcaaatgaggtgattgataatcataggggggttgaagaatctgagaatggcccacgttttagagaaggtgaccactctggggttgctttggtcgaacaatacttggaagaggctgcagctgcaagggcactggttgagggatgcgaaagaccagatggaaggcctgaaaggcaacgactgttggtagtggccaataggcttccagtttctgcagttaggagaggtgaagactcatggtctctggatataagtgctggaggtctagttactgctctattgggtgttaaggagtttgaggcaaggtggattggatgggctggcgtaaatgttccagatgagattggacagaaggcacttactaaagctttagctgaaaagaggtgtatccctgtcttccttgatgaagagattgttcatcagtactacaatggttattgtaacaacatcttgtggcctctttttcactaccttggacttccacaagaagatcgccttgctaccacaaggagtttccagtctcagtttgctgcatacaagaaagcaaatcaaatgtttgctgatgttgtaaatacgcactatgaagagggtgatgttgtctggtgccatgattaccacctcatgtatcttccagaatgcctgaagaaatacaacacgaagatgaaagttggttggtttctccatacgccattcccttcttctgaaattcataggacactgccatccagatctgagctgttgcgttcagttcttgctgctgacttggttggttttcatacctatgactatgctagacattttgttagtgcttgtactcgaattctgggacttgaggggacacctgaaggggttgaggatcaggggaggctgactcgtgttgctgcttttcctattgggatagactcagatcgtttcatacgtgcacttgagcttcctcaagtccaggaacacatcaaagaattaaaagaaaggtttgctggaagaaaggtaatgcttggtgttgatcgtcttgatatgattaaaggaatcccccaaaagatattggcatttgaaaagttccttgaggaaaattctacctggcatgaaaaagtggttttgctgcaaattgcagtgccaacaagaactgatgttcctgagtaccaaaaacttacaagccaggttcatgaaattgttggccgtattaatggtcgatttgggacattgactgcagttccaatccatcacctggatcgttctcttgactttcatgcactatgtgcattatatgctgttacagatgtagcacttgtcacatctttaagggatggcatgaaccttgtcagttatgagtttgttgcttgccaagatgcaaagaaaggggtcctcattctcagtgaatttgcaggtgctgcacagtctctgggtgctggagctatcttggtaaatccttggaacatcactgaagtggctgcttcaattggccaggctttgaatatgcaccctgaagaaagggagaagcgacatcgccacaattttcatcatgtgacaacccacacagctcaagaatgggctgaaacatttgtaagtgaactgaatgataccgttgttgaagctcaactaaggacaagcaaagtgcctcctgagcttccacaaaatgatgcaatggaatgttatttacagtctagcaatcgattgctgatactgggttttaatgcaacattaactgaaccggtggatactcctgggagtagaggtgatcaaatcaaagaaatggaacttaaattgcatccggaaataaaagtacccttaacagcactctgtaatgatccaaagacaacagtagtcgtcctcagtgggagtgacagccgtgtcttggataagaactttggggagtatgacatgtggttggccggagaaaatgggatgtttctacgccatacaaagggagactggatgacaaccatgccagagctcttgaatatggaatgggttgacagtgtgaagcatgtttttgaatatttcacagaaagaacacctagatcacatttcgacttccgtgatacatcacttgtatggaattacaagtatgcagacgttgagtttggaagaattcaagcaagggatatgctgcagcatctctggactggcccaatttctaatgcatctgttgatgttgttcaaggaagccgatcagttgaggtgcgagcagttggtgttacaaagggggcagctattgatcgtattctaggagagatagttcacagtaaatcaatgacaacaccaattgattatgtcctttgtgttggacattttctggggaaggacgaagatgtgtacacctttttcgagccagagctgccttctgacgtgacaagtataacatcaaccaagccaactgacggaccaaggttacctgcagagagaagagctgctttgaagcttccagcaagcagaagtggggcaaaatcatctcaaacaaagacacagcgaccacagccggctcctgatagaagaactggcaataatcatagtagtgggagtttgcggcgtccatcaccggaaaagatttcctggagtgtactcgatctcaaaggagataactacttctcctgtgctgttgggcggactcgcacatgtgctcgatatctgctcgggtcatcagatgatgttgtctcatttctgaacagactggcaaatgcctcttcatcatgcaattcgttttcaggtttacatgagtaaacaggagtcttccttaaatgttggggaccgatcctccacccttctcagagcaactctccgggctgaagaaaactcttgttaaatcacttgcataacagaaaagcttagtatttttcaaactgaaattacatgaaccacagcattgttgtcagttcatagatgttgaaggaaaccaattctatagtgacaattcctgcatccaattaattacacaagcacagttgttttactagcatttcaaagcatttgaatggtattcacttgagattttgat

SEQ ID NO: 3471 - DNA, 3845 bp, Populus trichocarpa
aagaaatttgagcaccaaaccttcttgcatgcgtgacaaatttatggttttgctgcaaattcgtgggtgtttgttggtcttcacgggctctcctactctagaatcccaagtgactgacagcagcaatgatactcaagtccacttgccttcgtttagcagagaaaaaaccaagctgcatgccagtctttttctgtcaatatctgattttgtttgcacttcctttggcctattcattcatttagtcacatgtgttatggtacttgtcttctaagtacaagcggtggagaagagtgttacttgtattcagagatgtttctgttcacttctcaggactgaaagagtttttcccctgcatcaacatgtcaatgaaggaggctcaattgctctagaaacaccaggagcccataaaattggtgattggagtttgggctgctaaagtgagcgtatgcctggaaaccaggacaacggtaattccatccataactcaggtcgtgtcggacggctcttaaaactaagagagctaaggcgaaacatcaggtctgcctattcaaatgagttaactgataatcatagaggaactgaaccatgtgaatatgatctacgagcgcgggaaggtgacagcttgaacaattcctttatcgaacaattcttggaaggggctattgcgcagggatgtgaaaagccagatgccaggcctttaaggcaacgcctattggtggtagctaacagactgcctgtatctgctgttagaagaggtgaagactcatggtctttggagatgagtgctgggggcctagtcagtgctcttctaggtgtgaaggagtttgaggcgagatggattggctgggctggggttaacgtgccagatgaagttggccagaagtcgcttactaaagctttggctgaaaagaggtgcattccggtattccttgatgaagagattgttcatcaatattataatggctactgcaacaatatactgtggcctctctttcattatcttgggcttccacaagaagatcgactcgccacaaccagaagtttccagtctcagtttgctgcatataagaaggcaaatcaaatgtttgctgatgtggttcaccagcattatgaggagggtgatgttgtctggtgccatgattaccatttgatgtttctcccaaaatgcctgaaggaatacaacaataatatgaaagttggttggtttctccatacaccctttccttcttctgaaatccacaggacactgccatctcgatcagacctattacgttctgttcttgctgccgatttagttggatttcacacctatgactatgcaagacattttgttagtgcttgtactcgcattcttgggctagagggcacacctgaaggcgttgaggatcaagggaggctgacacgagttgctgcgtttccaatcgggatagactcagatcggttcataagagctcttgaactccctcaagtccaggatcacattaaagaactgaaggaaagatttgctggccgaaaggtgatgctaggtgttgaccgccttgatatgattaaaggaattccacagaagattcttgcttttgaaaaatttctcgaggagaattctcactggcgtgataaagttgttctactgcaaattgctgtgccaacaagaacagatgttcctgagtatcaaaagttgacgagccaggttcatgaaattgttggacgcattaatggcagatttggaacattaactgctgttccaatacatcacctggatcgatctctcgacttccacgccttgtgtgcattatatgcagttactgatgttgctcttgttacttctttgagggatggaatgaatcttgtcagttatgagtttgtagcatgccaagattcaaagaagggtgtgctcattcttagtgagtttgcaggtgcagcccaatccttgggtgctggagcaatccttgtgaacccttggaacatcactgaagttgctgattcaatacgccaagctctaactatgttacctgaagaaagagagaagcgacaccggcacaactttgtccatgtgacaacccacactgctcaagaatgggctgaaacttttgtgagcgaactaaatgatacagttatcgaggcacagctaaggacccggcaagtgccaccttcacttccagaagataatgcaattagatgttatttgcagtctactaaccggttgctcatactgggattcaatgcaacattgactgagccagcggacactcctgggagaagagctgatcaaattaaggaaatggaacttaaattgcacccagagttaaaagaagcactgacagcactttgcagtgatcgaaagaccaccattgttgttctcagtgggagtgacagaaaagcattagacaaaaactttggagagtatgacatgtggttggcagcagaacatggaatgtttttgcgacttacaaagggagattggatgacagcaatgcctgaacacttaaatatggaatgggttgacagtgtgaagcatgtttttgagtacttcacagaacgtacaccccggtcacattttgaactccgtgaaacattacttgtatggaattacaagtatgcagatgttgaatttggaaggcttcaagcaagggatatgttgcaacacctctggacaggcccaatttcaaatgcctctgttgatgtggtccaagggagtcgatcagttgaggttcgatcggttggtgttacaaagggtgctgctattgatcgtatactgggagagattgtccacagtaaatccatgacaacaccaattgattatgtcctatgcattggccattttctgggaaaggatgaagatgtgtacaccttctttgagccagagctcccttctgatgccctagttgctgcaagaacaaagcaaaatgatgggctaaaattacccaatgaaagacgacctcctatgaagcttccagccagtagaagcgggccaaaatcatctcaaggtaaggcacaacgtgctttaataaatcccgagaagggaactcctaaccacagctgtgggaattcgcgacggccatcagcagaaaagacttcatggaacgtgcttgatctcaagggagataactacttctcctgtgctgttggtcgaactcgtaccaatgctcgctatctactgggatcatcagatgatgtcgtgtccttcctaaggagactagccaatgcatccacgtgagacacatagtgttgaagtcgataaaatgtctcgctcctgccaattgcaatgcatatatgcaaagttcaagaaccaggtctggtttttgaaggcaagcatggcgaggcaactttaaaggtctgaatgttgttgtaacatcactagttagcctagaatacttgaggaagtgaattcggtgatggaatcaaacctgagcctaacattaccagaggcatcaaaccaataaccaaaagagagagagagacgagaagagagagcagcaaaccattgcagtgacctttgttgaaagattgaggaagtgaattcttaaagcctcgatttcttcatttccgttcttttgcatgtatcgttgctgatgtttatttttggtgtaaaatgtgaagaactaatggtaaaaaaacaaaacggagtttttctgttaggttaggttttcgtctaaattgaagttagtatttattacactaaaaatggcccttaacatgtgtgattcacatgtgtatttttgggtcgcgtgctagtaaggctacaaaactagctccgatttgaatgaaaacctaatctaatgcaacaaaaagactagttattatctgctttgaataaatcagatagagattatttgcgtttttataaa

SEQ ID NO: 3472 - DNA, 3122 bp, Flaveria ramosissima
agagcaacaagtgctttgggaatattgtccacttctgttgaggttggttagaaaacaagtatgcctggaaataagtacaacaacaacgccaactcatcatcggttccatcaagtcgaatagagagacttttaagggaaagagagctaagaaagaacagcagagcttcatattctaatgaaataacaactaatgatggctatgaatttagtgataatttgttggaacaatatctagaaggatcagcatctgctgcacgtgagggttgggagaaaccagatggtggactttttacccaacggctactggttgttgctaatagactgcctgtttctgctgtcagaagaggtgaagaaagttggtctcttgaagttagtgctggcggcctagtcagcgccctccttggtgttaaggaggttgaagcaaaatggatcgggtgggcaggtgtaaatgtgcctgatgagcccgggcagcgagcactgactaaagcactggcagagaagaggtgtataccagtgtttcttgatgaagaagtcgtgcatcaatactataatggttattgtaacaacatattgtggccactttttcattaccttggacttccacaagaagaccgtttggcaactactagaagcttccaatcacagtttgcagcatacaagaaagcaaatcaaatgtttgctgatgtggtaaatgaacattatgaagaaggtgatgttgtttggtgccatgattaccatcttatgtttcttccaaaatgtctaaaagatcacaacagcaacatgaaagttgggtggtttcttcatacaccatttccatcgtctgaaattcataggacattgccttctcgttctgagcttttacgtgctgttcttgctgctgacttggttggtttccatacgtatgattatgcaagacactttgttagtgcttgtactcgtatacttggactcgaaggtactcctgaaggtgtagaggaccaagggagactcacccgtgttgctgcgtttccaattggtatagattcagatcgcttcattcgtgcactcgagaatccacaagttcaagaacatatgaaagaattgaaagagagattttctgggagaaaggtaatgttaggtgttgaccggctagatatgatcaaagggattccccaaaagatacttgcatttgagaagtttctagaagagaatcaatattggcgtgataaagtggttttgctacagattgcagtaccaacaagaacagatgttcctgagtatcagaaactcacaagtcaggtccatgaaattgtgggccgaataaatggaagatttgggacactgacaactgttccaattcatcatctggatcgatctctggattttcaggctttatgtgcactatatgctgtcactgatatagcaatcgtcacatctttgagggatggaatgaatcttgtcagttatgagtttgtggcatgccaagacgctaaaagaggggtgcttattttaagtgagtttgcaggtgctgcacaatcccttggtgcaggggctattcttgttaacccatggaacataactgaagttgcagcttcaatagggcaagctttgaatatgagcgctgaagaaagagaaaaacgtcatcgccacaacttcttacatgtcacaacccatactgctcaagaatgggctgaaacttttgtaagtgaactgaacgatactgtagttgaagcacaacaaaggataagacaagttccaccaccactgccagttgaagaggctattgaacgttatttgcagtcaagtaatcggttaatcatactgggattcagtgctacattaactgaaccggttgatacccccgataggcgtggaggtgatcagataagagaaatggatctcaaattgcaccctgaaataaaagaaccacttactaagctttgcaatgatccaaatacaaccgtcgtcgtcctcagtggaagtgatcggactgtattggatgataactttggtgagtataacatgtggttggcggctgagaatggaatgtttctgcgatccactaaaggaacatggatgacgactatgcctgagcattcaaatatggaatgggttgacagcgtaaagcatgtctttgagtacttcactgaaagaacacctcgatcacattttgaactccgtgagacatcacttgtttggaattacaagtacgcagatgttgaatttgggaggcttcaagccagagatatgctgcagcatttgtggacaggcccgatatctaatgcatccgttgatgttgtacaaggtagccggtccgttgaggttcgagcagctggtgtaactaagggtatcacaattgtgcgtatattaggggagatagttcatagcaaatcgatttcatccccaatcgattatgtcctatgtatcggccattttctggggaaggacgaagatatttacacctttttcgagcctgaacttccctacaatggcatgggtatcccacgacccaaactaaatgatgctgcaaaggggtctggagacaaaaagtccggtaaaagcgggtcaaaaccatctcaaaagcaacgagtacctcaaagtccagataacaaacgaacaactaacaataacaaaaataacggttttgagaatggtggaaaacgctcatccgggtcagcagacaaagtgtcatggaatgttctagatcttaaagcagataactacttctcgtgtgccgtgggacggacacgtacaaacgcgcgctaccttttacagtcatcggatgacgtggtttcgtttctgaaagagcttactgaagcttcttgagcatgtgtaggaatatagttttggtataaagtcctctattgtttgagattagttctatatcattcatatgtgtttgggcacaactggtatgtatgaacaataaaagaagtatgaacaaaaagaagaatttgtgttactcaattgtgggttaactgccgctacaacgaacaatttttatggtagttacttttacagttaaggacttgtactatagaactttacattactagtccttcatagtttgtatcgactaagggtgccaattgtgtcggattgaccggcttatgggtttcgggtgagtgggttgtaattcttct

SEQ ID NO: 3473 - DNA, 3421 bp, Vitis vinifera
cacaaccaaaggcaaagagcagccaaaagatgaatcatacataacctgtctgccaaaacccagtgtttctctcaatctcagcctctcaatttttctcaaaaaccccagaaaaatctctcccaatctatcccaagaaagcccataagctgccaaaagttcaggacacacaattgttcctctcagaggaacccaggaactgtaaactcggtgtttgaaggttggattgcagtttgaccttatgcccgggaacaagtacaacggtatttccagcgtccccaccagcagagtagagaggctcttgagggacagagagttaaggaagagcagcagggcatctcatccaaatgaggcaaatgatacaaacaggggaacagaggttttggaacatgaaggtgataacttggggtcttcccatgtggaacagcattcagaaacagctgcaatccgaggagtgcttagtgaggaatgtgaaaaacaagagaccaggcctgccagacagagacttctggtggtggctaacaggctgccggtgtctgcaattaggagaggtgaggaatcatggtccctagagataagtgccgggggtctagtcagtgctcttctgggtgtaaaggagtttgaagcaagatggattggatgggcaggtgtaaatgtgcctgatgaggctggacagagggcacttaccaaagctttagctgaaaagatgtgtatcccagtatttcttgatgaagatattgttcatcaatattataatggctactgcaacaacattttgtggcctcttttccattaccttggacttccgcaagaagatcgacttgccaccactagaagctttcagtctcagtttgccgcatataagaaggcaaatcaaatgtttgctgatgtggtaaataaacattatgaagaaggtgatgttgtttggtgccatgattaccatctcatgtttcttccaaaatgcctgaagaaatataacagtgaaatgaaagttggctggtttctccacacaccatttccttcttctgaaatccacaggacacttccgtctcgatctgagctgctgcattcggttcttgcagctgatttagttggtttccatacttacgattatgcaaggcatttcgttagtgcttgtactcgtattcttgggcttgagggtacacctgaaggagtagaggatcaaggaagactgactcgtgtggctgcttttcctattggcatagattcgcatagattcattcgagcacttgatgctccacaagttcaggatcgcattaatgaattaaagcgaacatttacagggcgaaaggtgatgttaggcgtcgatcgccttgatatgattaaaggaattcctcaaaagatactggcatttgaaaagtttcttgaggaaaactcagagtggcaacagaaagtagttttgctgcaaattgccgtgcctacaagaacagacgttcccgagtatcaaaaacttacaagtcaggttcatgaaattgttggacgcattaatggcagatttggaaccttgacagctgttccaatacatcacctggatcgttctcttgacttttatgcattatgtgcactatatgctgttacagatgtggcactcgtaacatctttgagggacggaatgaatctggtcagctatgagtttgtggcttgccaagaatctaagaaaggggttctcatccttagtgaatttgctggtgcagcccaatccttgggtgccggagcaatcctagtgaacccttggaacatcacagaagttgcttcttcaattgctcaggctttgaatatgccacctgaagaaagagaaaaacggcatgagcataactttgagcatgtgaaaaaccacactgctcaagaatgggctgaaacttttgtaagtgagttgaatgatacagttgttgaggcagatcttaggaaaaggaaggtcccgccaagacttacacctgaaaatgcaattaaatgttatctgcagtccaataatcgattactcatattgggattcaatgtaacattaactgaaccagtggatactcctgggagtagagggggggatcaaattaaagaaatggatcttaaactgcacccagagttgaaggggcccttgacagcactcggcaatgatccaaagacaaccatcgttgttcttagcggaagtgacagaactgtcttggatgataacttcggggagtttgacatgtggttagcagcagaaaatgggatgtttttacgtcacacaaaaggagaatggatgacaacaatgcctgagcatttaaacatggagtgggttgacagtgtaaagcatgtttttgagtatttcactgaaagaacgcctcgatcacaacttcaaaaacgtgaaacttcacttgtatggaattacaagtatgcagatgctgaatttggaaagcttcaagctagggatatgttgcagcatctctggacaggtccaatttcaaatgcatctgttgacgttgtccagggtagtcgctctgtggaagtgcgtgcagttggtgttacaaagggtgcagccattgatcgtatattaggagagatagttcacaataaatccatgacctcaccaattgactatgttttatgcgctggccattttctggggaaggatgaagatgtgtacacattttttgagccagagctgccttctgataacataagcatggcaaaaagcagagcgatcgatgcatttaagttatctggtgagaggaaatcttctttgaagcttccagctaacaagagtgggtcaaagtcatctcatggtaagacacagcggcctttgccaaacccagataagaaaaccccagaccatagcagtgggagtgggagtgggaggcggccatcaccagagaagacatcatggaatgtgcttgatctcaagggggagaactacttctcttgtgcagtagggcgaactcgtaccaaggctcgcttcacctttggatcatcagacgaagtcgtctcatttctaaaggaactggctggagccaagtcttctttttaaagtcttgacaaatttgcagagctagtttaatcgtctcaatagagtttttggatttagttttaacatagactgaatgcatctgaaaccacaggatgattgaaaatctgatgttccatgttgaggaaaaaggtgttatagagccgatgtcttttgtgatgtaaataatacctgcagatttatgtcggtgcccattgtggaaaagtgcaggaattcaactgatattttgcatggtgtttggttgcaataactccagtgaggaccaccaccaaggaagggaaaggtcagtctgagaaaagccatttatgttctttctttcctattggccaaatggttggcgcaaatctaaaacactatgttgatgatgaatagaatagctaccacatggattttctgtttttc

SEQ ID NO: 3474 - DNA, 3059 bp, Castanea mollissima
cttagacccaatgttctttcttggtacctcaattggggaatattcagagcttctgagttatgatgcttttccaagacttaatttacattgaacaaaatgtaggacacaatttttctgaggaaaacatctggtgcaggtcgattctttggtgttgaaggtttgtttctagagtgatcgcatgcctgggaacaagtacatcagtagttcaaaccatgtcggtgctccaaaccatattccaggtcgtgtagagcggcttttgagagatagagagataaggaaaaacaataggacttctcattcgaatgacttaaatgataatatcagcagggggagtgagtcatttgagcatgagttgcggttaagagaagtcgacaacgggcatgctggccaatgcttggaagggcctgaaaacgaaaggttgcatctggagggacgtgaaagactagatgggaggccgtggagacaacgactgttggtggtggctaacaggctgccagtatctgcagttaggagaggtgaagactcgtggtcattggagataagtggtggtggtctggtcagtgcacttcttggtgtgaaggagtttgaggcacgatggattggttgggctggtgtgaatgtgccagatgaggttggacagaaggcgcttacgaaggccttggctgaaaagaggtgcattccggtattccttgatgaagatattgttcaccaatattataatggctattgcaacaacattttatggcctctttttcattaccttggccttcctcaagaagatcgccttgccactacccgaagcttccagtctcaatttgctgcatataagaaggcaaatcaaatgtttgctgatgtggtcaacaagcactatgaagagggtgatgttgtttggtgccatgattaccatctcatgtttctcccgaaatgcttaaaggaatataacagcaaaatgaaagttggctggtttcttcacaccccatttccctcttctgaaattcataggacactgccatctcggtcagagctcctgcgttctgttcttgctgctgatttagttggttttcacacctatgattatgcgaggcatttgttagtgcttgtactcgtattcttggacttgagggtacacctgagggagttgaggatcaagggaggctgactcgagtggctgcttttccaattgggatagattcagataggtttatacgtgcacttgatgccgctccggtccaggataacatcagagaattagcagaaagatttaaaggccgaaaggtaatgttaggtgttgatcgtcttgatatgatcaaagggattcctcaaaagatattagcctttgaaaaatttcttgaggaaaacccagattggcgtgataaagtagtgttgctgcaaattgctgtgccaacaagaacagatgttccagagtatcaaaaacttacaagccaggttcatgaaatagttggacgcataaatggcagatttggaacgttgtcagcagttcccatacatcacctggatcgttctttggactttcatgcattatgtgctctgtatgctattacagatgtagcactagtcacatctctaagggatggaatgaaccttgtcagctatgagtttgtggcatgccaagatacaaagaaaggggttcttatacttagtgaatttgctggcgctgcacaatctctgggtgctggggcaatactagtgaacccctggaacattacggaagttgcagcttctattgcccaagctttgaatatgccacctgatgaaagagagaagcgacataaacataactttgcacatgtgaccagccacactgctcaagaatgggctgaaacttttgtgagtgaactaaacgatactgtggtagaggcacaactaaggacaagacaagttccaccttctctaccaaacaaggatgcaatcaatcgttatttacaatctaataatcgattgcttatattgggattcaatgcaacattaactgaaccagtggacactcctgggaggagaggtgatcaaattaaagaaatggatcttaaagtgcatccaggtctaaaagaacccttgaaggtgctttgcagtgatccaaatacaacaattgttgtactcagtgggagcgacagaagtgtcttagatgataactttggagagtatgacatgtggttggcagcagagcatgggatgtttctacgccttacaaagggggaatggatgacaacaatgccagagcatttgaatatggaatgggttgacagtgtcatgcatgtattggaatacttcacggaaagaactccccgatcacattttgaacgtcgtgcaacttcacttgtatggaattacaaatatgcagatgttgagtttggaagacttcaagcaagggatatgctgcagcatctctggacaggcccaatttcaaatgcatctgttgatgttgttcaaggtggccgatctgttgaggtgcgagcagttggtgtcacaaagggtgcagcaattgaccgcatacttggagagatagttcacagtaaatccatgacaacaccaatagactatgtcctgtgtatcggacattttctgacaaaggatgaagatgtgtacaccttttttgagccagagcttccttctgatcccattgctattgcaagaaccaaggcaaatgatggactcaagctacttagtgagagaagatcttctttgaagcttccagccaacagaagcgggtcaaaatcatcttcatctcaaagtaagactcaacgaccttcactgaatcctgacaagagaattaccaatcatacctgtgggagtgggcggcggccatcaccagaaaaggtttcgtggaatgtgcttgatctaaagggagagaactatttctcttgtgctgtgggacgaactcgtacaaatgctcggtatacacttggatcatcagatgatgttgtctcctttctgaaagaactggctgatgcttctcttttaggttcattaagttgagcaatgttatgctttcctatcttgtagtgcacccgcttcaagattcaacgcccaacttagttagg

SEQ ID NO: 3475 - DNA, 3085 bp, Panax ginseng
aggaccactgtttttgaggaactttacaactcatattaaagtcggtctggagatcgtgttgtaaacactgcccgtatgccaaggaacaagtacaacggcaactcatccatcccctcaagtcgaatagagaggctcttacgggaaagagagctaagaaagaacagcaaggcttctgaaggggatggcccagaagtttcctatgtcgaacaatatctggaaggggcattggctgctcatgcacttactgatggattggataggccagatggggggcctttcagacaacgactgttggtggtggctaataggctgccagtctctgcagtcaggagaggagaggagacctggtcactggaaataagtgctggtggtctagtgagtgctcttttgggtgtgaaggaagttgaggcaaaatggataggttgggcaggtgtaaatgtgccagatgaggctgggcaaaacgcactcacaaaagcactggccgagaagaggtgtatacctgtattccttgatgaagagattgttcatcagtattacaatggctattgcaacaacatattatggcctctcttccattatcttggtctcccccaagaagatcgtcttgcgacaaccagaagtttccagtctcagtttgctgcatatgaaaaagcaaatcaaatgtttgctgatgtggtaaataagcattatgaggagggtgacgttgtgtggtgccatgactaccatctaatgttcctgcccaaatgcctaaaggaatacaacagcaaaatgaaagttggttggtttctccacacaccatttccctcttctgaaatccacaggacgctgccatctcgatcagagctgcttcgtgcagttcttgctgctgatttagtaggtttccatacttatgactatgctaggcactttgttagtgcttgtactcgtattcttggactggagggtacacctgaaggagtagaagatcaaggaaggctgactcgtgtggctgcgtttcctattgggatagattcagaacggttcattcgtgcgcttgaggttcctcaagtccaagaacacatcaaagaattaaaagagagattttctgggcgaaaggtgatgttaggtgttgatcgccttgatatgattaaaggaattccccaaaagatactggcgtttgaaaagtttcttgaagaaaacgcatactggcgtgataaagttgttttactgcagatagctgtgccaacaagaacagatgttcctgaatatcaaaaacttacaagccaggttcatgaaattgttgggcgcatcaatggtagatttggaactttaaccgctgttccaatacatcatctggatcgatctcttgacttttatgcactatgtgcactatatgctgtcactgatgtagcacttgtcacatctttgcgggatggaatgaatcttgttagctatgagtttgtggcatgccaagattcaaagaaaggagttctcattctgagtgaatttgcaggagctgcacagtctcttggtgctggagcactcctggtgaatccttggaacatcacagaagtagcttcttcaattggccaagctttaaatatgacagctgatgaaagagaaaaacgacatcgccataacttccaacacgtcacaactcatacagctcaagagtgggctgaaacatttgtcagtgaattgaatgatactgtagtcgaagctcagcaaaggataagagaagtgccgcccgtacttccagtaaaagatgcaatcaaacactacttgcagtccaataaccgtttactcatactgggattcaatgccacattgactgaaccagttgatactcctggtagaagaggtggagatcaaatcagagaaatggaacttaaattgcatccagatttaaaagaacccctaatggaactatgcagagatccaaagacaactattgttgtcctcagtggaagtgacagaactgtcttagatgataacttttgtgagtacaacatgtggttagcggcagagaatgggatgtttttgcgcgttacgagtggagaatggatgacaacaatgccagagcatttaaatatggattgggttgacagcgttaagcatgtctttgagtatttcacggaaagaacgcctcgatctcattttgaactccgtgagacttcacttgtatggaattacaagtacgcagatgttgaatttggaaggttgcaagccagagacatgctgcagcatctctggacaggaccaatatccaatgcgtcggttgatgttgttcaaggtagccggtcggttgaggttcgagcagttggtgttacaaagggtgcagcaattgaccgaatactgggagaaatagtacacagtaaatccatttcaacaccaatcgattatgttctgtgcgtagggcacttcctcgggaaggacgaggatgtttatagttttttcgagcctgagccctctgaagccatgggtatcccaagagccaaaataagtgatcctttaaagttgcctggagagagaagagctggattaaagctgcaaaatagcagaagcggctcaaaaccatctcaaaggagtcaacgacctctcccaaacccagaaaagaagaacacccacataataatgtgcacgcaaatgggcggcgtcagtcatcagagaagatatcgtggaatgtgctcgatctcaagggggagaattacttctcctgtactgttggccgaactcgctccaatgctcggtaccttcttggaacatctgatgatgttgtttcatttctcaaggaattagctgcggcagcttcatccagccaaggaatataccatggtctggcatcctttgatgcatctaggtcttgtgctgaataacccatgttctggataaggcatgatggctaggtgatcttatctgaaccttgtaacatttttcagacactaaaataacttgttcaaggtcaatgttttcatttgcacctctccctctctacccagagtcatattttgtattatagatcatgataatctgggctggttcaatcttcttccattgcggaacaatgcgaaagaattaataaagaatataaacaattacatgaaaa

SEQ ID NO: 3476 - DNA, 3194 bp, Arabidopsis thaliana
gattgggccataaaccagagacaaggctcaagccaactctgcttctatctatctctcactctactcataaaaatctccatatacgcttcttcttcgttctctgatttgctggtgcgcttctccgtcatcgttcgccgatcatagtcgatcccgccgcttccaggttaccgttgatagagtggtgttttggttctgttttggtgtgagcgtatgcctggaaataagtacaactgcagttcttctcatatcccactctctcgaacagaacgcctcttgagagatagagagcttagagagaagaggaagagcaaccgagctcgtaatcctaatgacgttgctggcagttccgagaactctgagaatgacttgcgtttagaaggtgacagttcaaggcagtatgttgaacagtacttggaaggggctgctgctgcaatggcgcacgatgatgcgtgtgagaggcaagaagttaggccttataataggcaacgactacttgtagtggctaacaggctcccagtttctgccgtgagaagaggtgaagattcatggtctcttgagatcagtgctggtggtctagtcagtgctctcttaggtgtaaaggaatttgaggccagatggataggatgggctggagttaatgtgcctgatgaggttggacagaaggcacttagcaaagctttggctgagaagaggtgtattcccgtgttccttgatgaagagattgttcatcagtactataatggttactgcaacaatattctgtggcctctgtttcactaccttggacttccgcaagaagatcggcttgccacaaccagaagctttcagtcccaatttgctgcatacaagaaggcaaaccaaatgttcgctgatgttgtaaatgagcactatgaagagggagatgtcgtctggtgccatgactatcatcttatgttccttcctaaatgccttaaggagtacaacagtaagatgaaagttggatggtttctccatacaccattcccttcgtctgagatacacaggacacttccatcacgatcagagctccttcgctcagttcttgctgctgatttagttggcttccatacatatgactatgcaaggcactttgtgagtgcgtgcactcgtattcttggacttgaaggaacacctgagggagttgaggatcaaggcaggctcactcgtgtagctgcttttccaattggcatagattctgatcggtttatacgagcacttgaggtccccgaagtcatacaacacatgaaggaattgaaagaaagatttgctggcagaaaggtgatgttaggtgttgatcgtcttgacatgatcaaagggattccacaaaagattctggcattcgaaaaatttctcgaggaaaatgcaaactggcgtgataaagtggtcttattgcaaattgcggtgccaacaagaactgacgttcctgagtatcaaaaactcacaagccaagttcatgaaattgttggacgcattaatggtcgttttgggacactgactgcagttccaatacatcatctggatcggtctctggactttcatgctttatgtgcactttatgccgtcacagatgttgcgcttgtaacatctttgagagatgggatgaatcttgtcagttatgagtttgttgcttgccaagaggccaaaaagggcgtcctcattctcagtgaatttgcaggtgctgcacagtctctgggtgctggagctattcttgtgaatccttggaacatcacagaagttgctgcctccattggacaagccctaaacatgacagctgaagaaagagagaaaagacatcgccataattttcatcatgtcaaaactcacactgctcaagaatgggctgaaacttttgtcagtgaactaaatgacactgtaattgaggcgcaactacgaattagtaaagtcccaccagagcttccacagcatgatgcaattcaacggtattcaaagtccaacaacaggcttctaatcctgggtttcaatgcaacattgactgaaccagtggataatcaagggagaagaggtgatcaaataaaggagatggatcttaatctacaccctgagcttaaagggcccttaaaggcattatgcagtgatccaagtacaaccatagttgttctgagcggaagcagcagaagtgttttggacaaaaactttggagagtatgacatgtggctggcagcagaaaatgggatgttcctaaggcttacgaatggagagtggatgactacaatgccagaacacttgaacatggaatgggttgatagcgtaaagcatgttttcaagtacttcactgagagaactcccaggtcacactttgaaactcgcgatacttcgcttatttggaactacaaatatgcagatatcgaattcgggagacttcaagcaagagatttgttacaacacttatggacaggtccaatctctaatgcatcagttgatgttgtccaaggaagccgctctgtggaagtccgtgcagttggtgtcacaaagggagctgcaattgatcgtattctaggagagatagtgcatagcaagtcgatgactacaccaatcgattacgtcttgtgcattggtcatttcttggggaaggacgaagatgtttacactttcttcgaaccagaacttccatccgacatgccagccattgcacgatccagaccatcatctgacagtggagccaagtcatcatcaggagaccgaagaccaccttcaaagtcgacacataacaacaacaaaagtggatcaaaatcctcatcatcctctaactctaacaacaacaacaagtcctcacagagatctcttcagtcagagagaaaaagtggatccaaccatagcttaggaaactcaagacgtccttcaccagagaagatctcatggaatgtgcttgacctcaaaggagagaactacttctcttgcgctgtgggtcgtactcgcaccaatgctagatatctccttggctcacctgacgacgtcgtttgcttccttgagaagctcgctgacaccacttcctcaccttaatatcccgagacagtgtcaagtgagttcatgtaacccaataaaaactattgttttgtaacaaaaagcagccattaccagactctttagtggtttgattctaatataataagagtagagcaacttatgacacaaatgagaacaagctcttattacat

SEQ ID NO: 3477 - DNA, 3190 bp, Arabidopsis thaliana
gggccataaaccagagacaaggctcaagccaactctgcttctatctatctctcactctactcataaaaatctccatatacgcttcttcttcgttctctgatttgctggtgcgcttctccgtcatcgttcgccgatcatagtcgatcccgccgcttccaggttaccgttgatagagtggtgttttggttctgttttggtgtgagcgtatgcctggaaataagtacaactgcagttcttctcatatcccactctctcgaacagaacgcctcttgagagatagagagcttagagagaagaggaagagcaaccgagctcgtaatcctaatgacgttgctggcagttccgagaactctgagaatgacttgcgtttagaaggtgacagttcaaggcagtatgttgaacagtacttggaaggggctgctgctgcaatggcgcacgatgatgcgtgtgagaggcaagaagttaggccttataataggcaacgactacttgtagtggctaacaggctcccagtttctgccgtgagaagaggtgaagattcatggtctcttgagatcagtgctggtggtctagtcagtgctctcttaggtgtaaaggaatttgaggccagatggataggatgggctggagttaatgtgcctgatgaggttggacagaaggcacttagcaaagctttggctgagaagaggtgtattcccgtgttccttgatgaagagattgttcatcagtactataatggttactgcaacaatattctgtggcctctgtttcactaccttggacttccgcaagaagatcggcttgccacaaccagaagctttcagtcccaatttgctgcatacaagaaggcaaaccaaatgttcgctgatgttgtaaatgagcactatgaagagggagatgtcgtctggtgccatgactatcatcttatgttccttcctaaatgccttaaggagtacaacagtaagatgaaagttggatggtttctccatacaccattcccttcgtctgagatacacaggacacttccatcacgatcagagctccttcgctcagttcttgctgctgatttagttggcttccatacatatgactatgcaaggcactttgtgagtgcgtgcactcgtattcttggacttgaaggaacacctgagggagttgaggatcaaggcaggctcactcgtgtagctgcttttccaattggcatagattctgatcggtttatacgagcacttgaggtccccgaagtcatacaacacatgaaggaattgaaagaaagatttgctggcagaaaggtgatgttaggtgttgatcgtcttgacatgatcaaagggattccacaaaagattctggcattcgaaaaatttctcgaggaaaatgcaaactggcgtgataaagtggtcttattgcaaattgcggtgccaacaagaactgacgttcctgagtatcaaaaactcacaagccaagttcatgaaattgttggacgcattaatggtcgttttgggacactgactgcagttccaatacatcatctggatcggtctctggactttcatgctttatgtgcactttatgccgtcacagatgttgcgcttgtaacatctttgagagatgggatgaatcttgtcagttatgagtttgttgcttgccaagaggccaaaaagggcgtcctcattctcagtgaatttgcaggtgctgcacagtctctgggtgctggagctattcttgtgaatccttggaacatcacagaagttgctgcctccattggacaagccctaaacatgacagctgaagaaagagagaaaagacatcgccataattttcatcatgtcaaaactcacactgctcaagaatgggctgaaacttttgtcagtgaactaaatgacactgtaattgaggcgcaactacgaattagtaaagtcccaccagagcttccacagcatgatgcaattcaacggtattcaaagtccaacaacaggcttctaatcctgggtttcaatgcaacattgactgaaccagtggataatcaagggagaagaggtgatcaaataaaggagatggatcttaatctacaccctgagcttaaagggcccttaaaggcattatgcagtgatccaagtacaaccatagttgttctgagcggaagcagcagaagtgttttggacaaaaactttggagagtatgacatgtggctggcagcagaaaatgggatgttcctaaggcttacgaatggagagtggatgactacaatgccagaacacttgaacatggaatgggttgatagcgtaaagcatgttttcaagtacttcactgagagaactcccaggtcacactttgaaactcgcgatacttcgcttatttggaactacaaatatgcagatatcgaattcgggagacttcaagcaagagatttgttacaacacttatggacaggtccaatctctaatgcatcagttgatgttgtccaaggaagccgctctgtggaagtccgtgcagttggtgtcacaaagggagctgcaattgatcgtattctaggagagatagtgcatagcaagtcgatgactacaccaatcgattacgtcttgtgcattggtcatttcttggggaaggacgaagatgtttacactttcttcgaaccagaacttccatccgacatgccagccattgcacgatccagaccatcatctgacagtggagccaagtcatcatcaggagaccgaagaccaccttcaaagtcgacacataacaacaacaaaagtggatcaaaatcctcatcatcctctaactctaacaacaacaacaagtcctcacagagatctcttcagtcagagagaaaaagtggatccaaccatagcttaggaaactcaagacgtccttcaccagagaagatctcatggaatgtgcttgacctcaaaggagagaactacttctcttgcgctgtgggtcgtactcgcaccaatgctagatatctccttggctcacctgacgacgtcgtttgcttccttgagaagctcgctgacaccacttcctcaccttaatatcccgagacagtgtcaagtgagttcatgtaacccaataaaaactattgttttgtaacaaaaagcagccattaccagactctttagtggtttgattctaatataataagagtagagcaacttatgacacaaatgagaacaagctcttattacat

SEQ ID NO: 3478 - DNA, 3066 bp, Tripterygium wilfordii
gcctcgaactcataaattgacattggagatcagttttagagcgagcgtatgcctacaaacaagtacaacggcaattcaactcatttccctagtcgtgttgagcggctcttgagagaaagaaagctaaggaagagcagtagagacacacatccaaatgaggtgactgataatcacaagggcaatgaagtatatgaaaacgacctgcaatctagagaagacaataacttgccaaattcatatattgaaaaattcttggacggggctgtggctacaagggcactttccgaagtatgtgagaaggaagacagtagaccttccaggcaacgacttttggttgtggctaataggctgcctgtatctgcagttcggagaggtgaagatgcatggtctctagagataagtggagggggtctagtaagcgctcttctgggtgtgaaggactttgaggcaagatggatagggtgggcgggtgttaatgtgccagatgagattgggcagaaggcacttacaaaagctttggccgagaagagatgtatccctgtatttcttgatgaagagattgttcatcagtattataatggctattgcaacaatatcttgtggcctctttttcattaccttggacttccgcaagaagaccgccttgccaccaccagaagtttccagtctcagtttgaagcatataagaaggcgaatcaaatgtttgcggatgtggtaaataaacactatgaagaaggggatgttgtctggtgccatgactaccatcttatgttcctaccagaatgcctgaaggaatacaacaacaaaatgaaagtggggtggtttctccatacaccttttccttcttctgaaattcacaggacactgccatctcggtcagagctgcttcgctctgttcttgctgcagatttagttggatttcacacttacgactatgcaagacattttgtaagtgcttgtactcgtattcttggacttgagggcacccctgaaggagttgaggaccaaggaaggctgactcgagtagctgcgtttcctattggaatagactcagctcggttcataagtgcacttgagcttcctcaggttaaggaacacatcagagaattaaaagagagatttgctggacgcaaggtgatgctaggtgttgatcggctcgacatgattaaaggaattcctcaaaagatactggcttttgagaaatttcttgaggaaaatcttacctggcgtgataaggtggttttgttgcaaattgcagtgcctacaaggactgatgttcctgagtatcaaaaacttacaagccaagtccatgaaattgttgggcgcattaatggcagatttggaacattgactgctgttccaatacatcacctggatcgctccctcgatttccatgcattgtgtgcactctatgctgttactgatgtagcacttgttacttctttgcgggatggaatgaatcttgtaagttatgagtttgtggcgtgccaagactcgaagaaaggggttctcattcttagcgagtttgccggcgcagcacagtctctgggtgctggagcaattctggtgaacccttggaatattacagaggtcgctgcttcaattggtctggctctgaatatgtcggccgaggaaagagagaagcgacatcggcataattttgatcatgtgaaaagccatactgctcaagaatgggctgagacatttgttagtgaacttaatgatactgtcgtggaggccgaactaaggacaagccaagtcccacctggtcttccagagaacaaggcaattgaacaatacttccagtcctgtaaccgactgctcatactggggtttaatgcaacattgactgaaccagttgacacttctgggagaagaggtgatcaaattaaagaaatggaattgaaattgcatccagaggtgaaaggatccttgactgcactttgtagtgatgcaaagacaaccgtggttgttctcagtgggagtcatagtagtgtcatggatgaaaatttcggagagtttgacatgtggttggcagccgaacatgggatgtttttacgtcataccaagggagaatggatgacaacaatgccagaacacttaaatatggaatgggttgagagcgtgcagcatgtctttgagtacttcacggaacgaacacctcgatcacattttgaacaacgtgaaacatcacttttatggaattacaaatatgcagatgttgaatttggaagacttcaagcaagggatatgttacagcatctgtggacaggtccaatatctaatgcatctcttgatgtggtccagggtagccgatcagttgaggttcgagcagtaggtgttacaaagggtgctgcaattgatcggatattgggagagattgttcacagtaaatccatgacaacaccaattgattatgtcctgtgtattgggcacttcttgggaaaggatgaagatgtgtacaccttcttcgagcctgagctcccttctgaccctagttgtgttggaagagcaaagccaactgatggactgaaatcgccaagtgaaagaagagctctgaagattccacccaatagaagtgggacgaaatcatctcaaggtaggatgcaacgaccttctccgaacactgagaagaaatatacaaatcacagcacaggaactgcacgacgggcatcaccagaaaagatgtcatggaatgtccttgatctcaagggaaaaaactacttttcctgttctgttgggcgcaatcgcacaaaggctcggtatcttcttggatcatcagatgtcgtcccttttcttaagaaactagccggtgcatcatcatcaagcgtttcgcttgcaccaaacagttgaaagttttatcatctggcacattgtggttcatgttccggttcaggaattcgcattgctagctccggattttcagaggcattgtgaggtaacaagaatggcttttgccataacattcctcctttcttctcctttaacctgtttagcaattatgcagatctatctagatgagtctggaatttttataagatcagaaataaagatcttggactattc

SEQ ID NO: 3479 - DNA, 3595 bp, Citrus clementina
agttcattagttgctgtcttgccgatactgcgtggcaaacatatcctaggtatcattccggcttttccaagccctcagggattgaagactactttttcttttgggtggaaaaattaattgatttccatttatcttttcaacaccaatcttttggtttatttgcatggctgtaaggctttatgtaccctctaaagcttacacgagggtctcgttgttccctctctttttttcatcttttcctctcactgtgataattttctgccacccggaatctggtggtttctctgtaccattcactcctccctttcttcttctcttctcactctaactcggtggctcaatgtcaaaaacccattagccatcttatgaactaacctacatgtaatcttttgttttgcttgaagggtcttgtgctcttctcttgagtgcttcttggaggacacagaattgttttgagaactcataaatttggtattggaggttggttctagagtgagcatatgcctggaaacagctacaacagtaattcgtccaatattccacctgaccgtgtcacacggctcgtaagagagaagatagaaagagatttaaggaaaagcagcagggcttcccaccctaatgatgtgactgataatggggggcgggaggtatttgaggatgaacagcgcttaagagatggtgacaacttggggccttccattgttgatgaagacttggaagggcctgcaagtacaccaaatgagggatgtgaaaggctagatggaaggactttcagcagacaacgactgctggtggtggccaataggctccctgtgtctgctataaggagaggtgaggactcatggtctcttgagattagtgctggcggtttggtcagtgcccttcttggtgtgaaggaatttgaggcgagatggattgggtgggctggtgtaaatgtcccagatgagattggacaaaaagcacttactaaagctttggctgaaaagaggtgtattcctgtattccttgatgaagacatcgttcatcaatactataatgggtattgcaacaacatcttgtggcctctttttcattaccttggacttccgcaagaagaccgcctggccaccaccagaagtttccagtctcagtttgctgcatatattaaggctaatcaaatgtttgctgatgtggtaaacaaacactataaggatggagatgttgtgtggtgtcatgactaccatctcatgttccttccaaaatgcctaaaggagtacaacagtgacatgaaagttggttggtttctccacacacctttcccttcttctgaaatccataggacgctgccatctcgatctgatctacttcgtgcagttctagctgctgatttggttggttttcatacctatgactatgcaaggcattttgttagtgcttgtactcgtattcttggatttgagggcacacccgaaggagttgaggaccaagggagactaactcgagttgctgcgtttcctattggaatagactcagaacggttcattcgggcactagagattcatccagtccaggttcacatcaaagaattacaagaaacatttgctggtcggaaggtaatgttaggtgttgatcgccttgatatgattaaaggaattccacaaaagttactggcttttgaaaagttcctcgaggaaaattctgattggcgtggcaaagttgttttgcttcagattgcagtgccaacaagaacggatgttcctgaatatcaaagacttacgagccaggttcatgaaattgttggacgcattaatggccgatttggaacactgactgctgttccaatacatcacctggatcgttctcttgatttccctgcattgtgtgcattatatgctgttactgatgtagcacttgtaacatctttaagggatggaatgaatcttgtcagctatgagtttgtggcatgccaagaccttaagaaaggggttctcattctcagtgaattcgctggtgctgcacaatctctgggtgctggagcaatccttgtgaacccttggaatataacagaggtggcaaatgcaattgcccgggcactaaatatgtcacctgaagagagagaaaagcgacatcggcataattttacacatgtaacgactcatactgctcaagaatgggctgaaacctttgtgagtgaactgaatgacacagttgttgaggcgcaactaaggataaaacaagtcccacctagccttcgagaagcagactccattgaacgttatttgcgttccaataatcgtttgctcatactgggtttcaatgcaacattaactgaacctgtggacactcctgggagaagaggggatcaaattagagaaatggaactaaaactgcatccagatctaaaacaaccactaaatgcactttgccatgatccaaagacaacaattgttgtccttagtgggagtgacagaaatgtcctggataaaaactttcgagagtacaatctttggttggcagcagaaaatgggatgtttttacgctgtaccacaggaaaatggatgaccacaatgccagagcatttaaatatggaatgggtcgacagtcttaagcatgtttttgagtatttcactgaacgaacaccgagatcacattttgaacagcgtgaaacatccctagtttggaattacaaatatgcagatgttgaatttggaagaattcaggcaagagatatgttgcagcatctctggacaggcccaatctctaatgcatctgttgaagttgttcaaggaagcaagtctgtagaggtgcgagcagttggtgttacgaagggtgcagcaattgatcgtattttggcagagatagttcatagtaagaagatgaaaacagcaatcgactatgtgctgtgtattggacattttctggggaaggatgaagatgtgtatgcgttttttgagccagaactacctgatgatggcccgggcattccaagaaccagaccaacagatgcaataaaggtaccaggggagcgaagacaagcattgaaggtagcaagtagaggcagctcaaagatatctcaaggtaagacgcagcgacctgcccaagctcccgagaaaaaaaccccgaatcacaactgtactaatgtacggcagccatcatcggataagacgtcctacaatgtgcttgatctcaataaagagaactacttctcctgtgctgtggggcgacctcgtacaaatgcccggtttctacttcagtcatcggatgaggtcgtctcatttctaaagaagctagctgacgcatcgtcgtcacatgaagcacacaatggtccaacttaagaaacgttttcagcttgcatgcttgcgacgttgcatctgattcgtaggcgcaagaaccaagcccaaattgaaggtacagagagagatgacagatgcgtcccctgcttactgggacatgaatctacacatgtttcatagagataggatattaaatgactcgaaatggttgtgtgatacaaagcttagttcttgtatgacacaggttaatagaaagaatctggaccacagggatgttcttcattgaaagatccattaagaaaaaaaaaaaaattgttagcacc

SEQ ID NO: 3480 - DNA, 3596 bp, Citrus sinensis
agttcattagttgctgtcttgccgatactgcgtggcaaacatatcctaggtatcattccggcttttccaagccctcagggattgaagactactttttcttttgggtggaaaaattaattgatttccatttatcttttcaacaccaatcttttggtttatttgcatggctgtaaggctttatgtaccctctaaagcttacacgagggtctcgttgttccctctctttttttcatcttttcctctcactgtgataattttctgccacccggaatctggtggtttctctgtaccattcactcctccctttcttcttctcttctcactctaactcggtggctcaatgtcaaaaacccattagccatcttatgaactaacctacatgtaatcttttgttttgcttgaagggtcttgtgctcttctcttgagtgcttcttggaggacacagaattgttttgagaactcataaatttggtattggaggttggttctagagtgagcatatgcctggaaacagctacaacagtaattcgtccaatattccacctgaccgtgtcacacggctcgtaagagagaagatagaaagagatttaaggaaaagcagcagggcttcccaccctaatgatgtgactgataacggggggcgggaggtatttgaggatgaacagcgcttaagagatggtgacaacttggggccttccattgtcgatgaagacttggaagggcctgcaagtacaccaaatgagggatgtgaaaggctagatggaaggactttcagcagacaacgactgctggtggtggccaataggctccctgtgtctgctataaggagaggtgaggactcatggtctcttgagattagtgctggcggtttggtcagtgcccttcttggtgtgaaggaatttgaggcgagatggattgggtgggctggtgtaaatgtcccagatgagattggacaaaaagcacttactaaagctttggctgaaaagaggtgtattcctgtattccttgatgaagacatcgttcatcaatactataatgggtattgcaacaacatcttgtggcctctttttcattaccttggacttccgcaagaagaccgcctggccaccaccagaagtttccagtctcagtttgctgcatatattaaggctaatcaaatgtttgctgatgtggtaaacaaacactataaggatggagatgttgtgtggtgtcatgactaccatctcatgttccttccaaaatgcctaaaggagtacaacagtgacatgaaagttggttggtttctccacacacctttcccttcttctgaaatccataggacgctgccatctcgatctgatctacttcgtgcagttctagctgctgatttggttggttttcatacctatgactatgcaaggcattttgttagtgcttgtactcgtattcttggatttgagggcacacctgaaggagttgaggaccaagggagactaactcgagttgctgcgtttcctattggaatagactcagaacggttcattcgggcactagagattaatccagtccaggttcacatcaaagaattacaagaaacatttgctggtcggaaggtaatgttaggtgttgatcgccttgatatgattaaaggaattccacaaaagttactggcttttgaaaagttcctcgaggaaaattctgattggcgtggcaaagttgttttgcttcagattgcagtgccaacaagaacggatgttcctgaatatcaaagacttacgagccaggttcatgaaattgttggacgcattaatggccgatttggaacactgactgctgttccaatacatcacctggatcgttctcttgatttccctgcattgtgtgcattatatgctgttactgatgtagcacttgtaacatctttaagggatggaatgaatcttgtcagctatgagtttgtggcatgccaagaccttaagaaaggggttctcattctcagtgaattcgctggtgctgcacaatctctgggtgctggagcaatccttgtgaacccttggaatataacagaggtggcaaatgcaattgcccgggcactaaatatgtcacctgaagagagagaaaagcgacattggcataattttacacatgtaacgactcatactgctcaagaatgggctgaaacctttgtgagtgaactgaatgacacagttgttgaggcgcaactaaggataaaacaagtcccacctagccttcgagaagcagactccattgaacgttatttgcgttccaataatcgtttgctcatactgggtttcaatgcaacattaaccgaacctgtggacactcctgggagaagaggggatcaaattagagaaatggaactaaaactgcatccagatctaaaacaacctctaaatgcactttgccacgatccaaagacaacaattgttgtccttagtgggagtgacagaaatgtcctggataaaaactttcaagagtacaatctttggttggcagcagaaaatgggatgtttttacgctgtaccacaggaaaatggatgaccacaatgccagagcatttaaatatggaatgggtcgacagtcttaagcatgtttttgagtatttcactgaacgaacaccgagatcacattttgaacagcgtgaaacatccctagtttggaattacaaatatgcagatgttgaatttggaagaattcaggcaagagatatgttgcagcatctctggacaggcccaatctctaatgcatctgttgaagttgttcaaggaagcaagtctgtagaggtgcgagcagttggtgttacgaagggtgcagcaattgatcgtattttggcagagatagttcatagtaagaagatgaaaacagcaatcgactatgtgctgtgtattggacattttctggggaaggatgaagatgtgtatgcgttttttgagccagaactacctgatgatggcccgggcattccaagaaccagaccaacagatgcaataaaggtaccaggggagcgaagacaagcattgaaggtagcaagtagaggcagctcaaagatatctcaaggtaagacgcagcgacctgcccaagctcccgagaaaaaaaccccgaatcacaactgtactaatgtacggcagccatcatcggataagacgtcctacaatgtgcttgatctcaataaagagaactacttctcctgtgctgtggggcgacctcgtacaaatgcccggtttctacttcagtcatcggatgaggtcgtctcatttctaaagaagctagctgacgcatcgtcgtcacatgaagcacacaatggtccaacttaagaaacgttttcagcttgcatgcttgcgacgttgcatctgattcgtaggcgcaagaaccaagcccaagaattgaaggtacagagagagatgacagatgcgtcccctgcttactgggacatgaatctacacatgtttcatagagataggatattaaatgactcgaaatggttgtgtgatacaaagcttagttcttgtatgacacaggttaatagaaagaatctggaccacagggatgttcttcattgaaagatccattaagaaaaaaaaaaaattgttagcacc

SEQ ID NO: 3481 - DNA, 3025 bp, Malus domestica
cacatgcctgggaacaagtacaacggtaattcagcccacatcccaccaactcgaattgaacggctcttgagagaaagggagctaaggaaaaatatcaaggccttgaacttgaatgaaacatttgaacctgagttgcagttaagagaagatgaaaactcaaaagctgcccttgttgaacgattcttggaaggggctgcagctgcaagggcgcttaatgagggatgcgaaaagcaagacgggaggcctagcagacaacgactgttggttgtggcgaacaggttacctgtctctgcaattaggagaggtgaagattcatggtctctggagatgagtgcagggggtctggtcagtgcacttttgggtgtaaaggagtttgaggcaaggtggattggttgggccggggtaaatgtgccggatgaaattggacagaaggcgcttactagagctcttgctgagaagagatgtattccagttttccttgacgaggagattgttcatcaatattacaatggctattgcaacaatattttgtggccccttttccattaccttggacttccacaagaagatcgacttgccaccacccggagtttccagtcacagtttgctgcatataagaaggcaaatcaaatgtttgctgatgtagttaatgagcactatgaagagggtgacgtagtttggtgccatgattaccatcttatgtttcttccaaaatgcttgaaggattacgatagtaaaatgaaagttggttggtttctccacaccccttttccttcttctgaaatccataggacattgccatcacgatcagaactgctacgtgcagttcttgcagctgatttagttggttttcacacttatgactatgcacggcactttgttagtgcttgcactcgcattcttggacttgagggtacacctgaaggagttgaggatcaagggaggcttactcgagtggctgcgtttcctattggaatagattcagaccgcttcatacgtggacttgaggttcctcaagtccaagaacacattaagaaaatgaaggaacggttggctgggagaaaggtaatgctaggtgttgatcgccttgatatgattaaaggaattcctcaaaagttactggcgtttgaaaagtttcttgaggaaaacccaacttggcgtgacaaagtggttttgctgcaaattgcagtgccaacaagaacagatgttccagagtatcaaaaacttacaagccaggttcatgaaattgttgggagaattaatggcagatttggaactttgaccgctgtcccaatacatcacctggattgttctctcgactttcatgaattgtgtgcactatatgctgtaactgatgtagcacttgtcacatccctgagggacggaatgaatcttgtcagttatgagtttgtggcatgccaggatgcaaagagaggggtccttattctgagtgagtttgctggtgccgcacagtctttaggtgctggagcaattctagtgaacccgtggaacatcacagaagttgctaattcaattgctcaagcattgaatatggactccgaacaaagagagaagcgacataagcataattttttacacgtgacagcccacactgcacaggaatgggccgaaacttttgtaagtgaactgaacgatactgttgtagcggcgcaattacggaccagacaggtgccaccaccacttccaaacaaggatgcaattcaaagttatttgcaagcaaataatcgattgatcatactgggattcaatgcaacattaactgaatcagtggacacacctgagaggcgaggtgatcaaataaaagaaatggaacttaaactgcaccccaaattgaaagaaaccttgtcagcactctgcaatgatccaacaacaactattgtcgtcctcagtgggagtgagagacatgtcttagatgataactttggggagcttgacatgtggttggcagctgaaaacgggatgtttttacgccttacaaagggagaatggatgacaacaatgcctgaacatgtgaatatggaatgggtcaacagtgtggagcatgtttttgagtatttcaaagagagaacaccgcgatcacattatgaacgtcgtcaaacttcccttgtgtggaattataaatatgcagatattgattttgggagacttcaagccagagatatgctgcagcatctctggactggcccaatttctaatgcctctgttgatgttgttcaaggtagccggtctgttgaggttcgagcagttggtgtgacaaagggtgcagcaattgaccgtatattgggagagatagttcatagtaaatccatgacatcccccattgattatgtgctgtgtattggacattttcttgggaaggatgaagatgtgtacacctttttcgagccagatcttccgcctgatccgagtagtcttccaagaaccaagatacctgatggactaaagcctaacgagaggcgatcttctttgaaggctccggccatcaaaagcggctcaaaatcgtctcagagcaaagcgcaacgggcgcctttaccaaaccacgagaagaaaaatgcaaatcacaacaccacgaatccacgatggccatctccagaaaaggtttcgtggaacgtacttgatctaaagaaggagaactactactcttgcgctgtcgggcggactcgcacaaatgctcggtatctacttcagtcctcggatgatgttgtctcgtttctgaaggaattggcgggtgcctcttctgcaagcgtttcatcttccggttcagagatataatgctctcgaatttctcgaaagtgtagcttcacttggtagctgtttggactgtagatatttctaatgcttcagctgaagtattagattattgttagtttaggtactgaaaccatctaaaccacactgatgattaaagacttagggctatatccctgttcgacaagaggccatatcctagtaagcaagcaaggctggcgacttgtagctctcgagtgggcagccctccgacaaa

SEQ ID NO: 3482 - DNA, 3023 bp, Arabidopsis lyrata
aaacttgtgttttggttctgttttggtgtgagcgtatgcctggaaataagtacaactgtagttcttctcatatcccactctctcgaacggaacgcctcttgagagatagagagctcagagagaagaggaagagcaaccgagctcgtaatcctaatgacattgctggcagttccgacaactctgagaacgacctacgtttagaaggagacagttcgaggcaatatgttgaacagtacttggaaggtgctgctgctgcaatggcccacgatgatgcgtgtgagaggcaagaagctaggccttataacaggcaacggcttcttgtagtggctaacaggctcccagtttctgccgtgcgaagaggtgaagattcatggtctctcgagatcagtgctggtggtctagttagtgctctcttaggtgttaaggaatttgaggctagatggattggatgggctggagtaaatgtgcctgatgaggttggacagaaggcacttagcaaagctttggctgagaagcggtgtatacctgtgttccttgatgaagagattgttcatcagtactacaatggctattgcaacaatattctgtggcctctgtttcactaccttggacttccacaagaagatcggcttgctacaaccagaagctttcagtcccaatttgctgcatacaagaaggcaaatcaaatgttcgctgatgttgtaaatgaacactatgaagagggagatgtcgtctggtgtcatgactatcatcttatgttccttcctaaatgccttaaggaatacaatagtaagatgaaagttggatggtttctccatacaccattcccttcgtctgagatacacaggacgcttccgtcacgatcagagctccttcgctcagttcttgctgctgatttagttggcttccatacatatgactatgcaaggcactttgtgagtgcgtgcactcgtattcttggacttgaaggaacacctgagggagttgaggatcaaggcaggctcacacgcgtagctgcttttccaattggcatagattctgagcggtttatacgagcacttgaggtccctgacgtcatacaacacatgaaggaattgaaagaaagatttgctggcagaaaggtgatgttaggtgttgatcgacttgatatgatcaaagggattccacaaaaaattctggcatttgaaaaatttctcgaggaaaatgcaagctggcgtgataaagtggtgttattgcaaattgcggtgccaacaagaacagacgttcctgagtgtagatcaaaaactcacaagctcacaagccaagttcatgaaattgttggacgcattaatggtcgctttgggacactgactgctgttccaatacatcacctggatcgttctctggacttttatgctttatgtgccctttatgccgtcacagatgttgcacttgtcacatctttgagagatgggatgaatcttgtcagttatgagtttgttgcttgccaagaggccaaaaagggggtcctcattctcagtgaatttgcaggtgctgcacagtctctgggtgctggagctattcttgtgaatccttggaacattacagaagttgctgcctccattggacaggccctaaacatgacagctgaagaaagagagaaaagacatcggcataattttcatcatgtcaaaactcacactgctcaagaatgggctgaaacttttgtcagtgaactaaatgacactgtaattgaggcacaactacgaattagtaaagtcccacctgagcttccacagcatgatgcaattcaacggtattcaaagtccaacaacaggctactgatcctgggtttcaatgcaacattgactgaaccagtagataatcaagggagaagaggtgatcaaataaaggagatggatcttaatctacaccctgagctaaaaggcccgttaaaggcattatgcagtgatccaagtacaaccatagttgtcctcagcggaagcagcagaagcgttttggacaaaaactttggagagtatgatatgtggttagctgccgaaaatgggatgttcctaaggctgacaaatggagagtggatgactacaatgccagaacacttgaacatggaatgggttgatagtgtaaagcatgttttcaagtacttcactgagagaactcccaggtcacactttgaaacacgcgatacttcacttatttggaactacaaatatgcagatatcgaattcgggagaattcaagcaagagatttgttacaacacttatggacaggtccaatctctaatgcatcagttgatgttgtccaaggaagccgctctgtggaagtccgtgcagttggtgtcacaaagggagcggcaatcgatcgcattctaggcgagatagtgcatagcaagttgatgaccacaccgatagattacgtcttgtgcattggtcatttcttggggaaggacgaagatgtttacactttcttcgaaccagaacttccatccgacatcccagccattgcacgagccagaccatcatctgatagtggaaccaagtcatcatcaggagaccgaagaccaccttcaaagttgacacataacaacaacaaaagtggatcaaaatcttcatcatcctctaactctaacaacaacaacaagtcctcacagagatctctccagtcagagagaaaaagtggatccaaccatagcttaggaacctcaagacgtccttcaccagagaagatctcatggaatgtacttgaccttaaaggagagaactacttctcttgcgccgtgggccgtactcgcaccaatgctagatatctccttggctcacctgacgacgttgtttgcttccttgagaagctcgctgacacgacgacgtctgcaccttaatatcccgagacggtgtcaagtgagttcatgtaacccaataaaacctattgttttgtaacaaaaagcagccattaccagactcttttagtggtttgattcttataaaataagagtagagcaacttatgacaaaattgtgaacaag

SEQ ID NO: 3483 - DNA, 2715 bp, Amsonia hubrichtii
tggttctgggtcatcagcccagttcttggggtttgctgcaatttaggtcagttgtttccggggacactggaactctgttaaatttggtcttagaggtctagctccagactgcccatatgcctggaaacaagtacaacggcagttctaacttccccaatagaatacagaggctcttgagagaaagagagttgaggaaaagtagtaaagcttctcattcaaatgattctgctgatggtggcagagggactccgctctctgagcatgatttgcgtcagagagatggtgatagctcgggagcttccatggaacaatatctgcgagattccttggctgcacaaagtcaaaaaactaatgaaggatgggaatggcctgatggaaggcctgtcagacaacgacttttggtggtggcgaatcggctaccagtctctgcagttaggagaggtgaggagtcctggtcactggagataagtgccggtggtctggtgagtgcattactaggtgtgaaggaatttgaagcaagatggattggttgggctggtgttaatgtgccagatgaagcagggcaaaaggcccttacaagagcattagctgagaagaggtgtatccctgtgtttctggatgaagagattgttcaccagtactataatgggtattgcaacaacatattgtggcctcttttccattatctcggacttccacaggaagaccgtttggcaactacccgaagttttcaatcccagtttgctgcatacaagaaagcaaatcaaatgtttgcagatgttgtaaatgagcattatgaagagggtgatgttgtttggtgtcatgattatcatctcatgttccttccaaaatgtctgaaggaatacaatagcaaaatgaaagttggttggtttctgcatacaccttttccatcttctgagatccataggaccttgccatctcgtttggagctcctacatgctgttcttgctgctgatctggttggcttccatacctatgattatgcaaggcattttgttagtgcttgtactcgtatacttggacttgaaggaacccctgaaggagtggaggatcaggggaggcttactcgtgtagctgcgtttcctattgggatagattcagagcggttcattagagcacttgaacttcctaaagtccaggaacacatcaaagaattaaagaaagtttgctggagaaaggttatgctaggggttgatcggctcgatatgattaaaggaattcctcaaagatcctagcatttgaaaaattccttgaagaaaatgcatattggcgcgataaagtggttttgctccaaattgctgtgccaacaagaacagatgtacctgaatatcaaaagcttacaagccaagttcatgaaattgttggacgcatcaatggaagatttggaagtctaactgctgtaccaattcaccatctggatcgttctctggactttcataagctctgtgcactatatgctgttactgatgtagcacttgtcacgtccttgcgggatggaatgaatcttgtcagctatgagtttgttgcatgccaagattcaaaaaagggggtactcattctcagcgaatttgccggtgctgcgcagtctttgggtgctggagcactcctggtgaatccttggaatattactgaagttactgctgcaatagatcaagctctgaatatgtctgctgaagaaagagagaaacgtcaccgacataacttttcacatgtgacgactcatactgctcaagaatgggctgaaactttcgttagtgaactaaatgacaccgtaattgaagctcagcaaaggataagaaaagttccaccaccgctaaacactgacgaggcggtcaagcgctacttgcactctaataaccgattactcatcctgggtttcaattctgcactaactgagccagtggatactcccggaagacgaggtggagatcaaataaaagaaatggaactcaaattgcatcctgatctgaaaggaccgctgacggtgctttgtagcgatctaaagaccacaatcgtcgtcctcagtggaagtgatagaagcgtcttggatgataactttggtgagtacaacatgtggttagcagctgagaatgggatgtttctacgatctacaaagggagaatggatgacaacaatgcctgaacatttaaatatggattgggttgatagtgtgaagcatgtttttgagtatttcactgaaaggacgccccgctctcactttgaacttcgtgaaacttcactagtgtggaactataagtatgcagatgttgaatttggaagattgcaagcaagagatatgcttcagcatctctggactggcccaatctcaaatgcatctgttgatgttgtccagggaagtaggtctgttgaggtacgagcggttggggttactaagggagctgcaatcgatcgtattctgggggagatagtacatagtaaagccattactacaccaattgattatgtgttatgtataggtcattttctacaaaaggatgaagatgtctactcatttttcgaacccgaacttccatctgactcaatgagcattccgaaaatcaagccaagtgatgggggaaaacttcatgaagaacggcgggcaactacaaaactttcaaacagcaggagcaactcaaaatcatctcacagcaagtctcaacgagctatcccaaactctgggggtgggcggcggtc

SEQ ID NO: 3484 - DNA, 5420 bp, Eutrema parvulum
gttaccatcggtttctggattgcgcataacttgaagctgagcttttggttctgttttggtgtgagcgtatgcctggaaataagtacaactccagctcgtctcatatcccgctctctcgaacagaacggctcttgagagagagagagcttagagagaagtggagaagcaaccgggctcgtaatcctaatgaagttgttggcaattctgacaactctgagaacgaccagcgtttagaaggggacagttcgaggcaatatgttgagcagtacttggaaggtgctgctgctgctagggcgcacgatgatgtgtgtgagaggcaagaagcaaggccttataacaggcaacggctgcttgtagtggctaacaggctcccggtttctgcggtgagaagaggtgaagattcatggtctctcgagatcagtgctggtggtctagttagtgctctcttaggtgtaaaggagtttgaggccagatggattggatgggctggagttaatgtgcctgatgaggttgggcagaaggcacttaccaaagctttggctgagaagaggtgcatccctgtgttccttgatgaagagattgttcatcagtactataatggttactgcaacaacattctgtggcctctgttccactaccttggacttccacaagaagatcggcttgccacaaccagaagcttccagtcccagtttgctgcatacaagaaagcaaatcaaatgtttgctgatgttgtcaatgagcattacgaagagggagatgtcgtctggtgccatgattatcatcttatgttccttcctaaatgcctcaaggaatacaacagcaagatgaaagttggatggtttctccatacaccattcccttcgtctgagatacacaggacacttccatcacgatcagagctgcttcgctccgttcttgctgctgatttagtgggtttccatacctatgactatgcaaggcactttgtgagtgcgtgcactcgtattcttggacttgaaggaacacctgagggagttgaggatcaaggcaagctcactcgagtagctgcttttccaattggcatagattctgagcgatttatacgagcacttgaagtacctgacgtcatacaacacatgaaggaattgaaagaaagatttgccggcagaaaggtgatgttaggtgttgatcgtcttgatatgatcaaagggattccacaaaagattcttgcatttgaaaagtttcttgaggaaaacgcaagctggcgtgataaagtggtgttattgcaaattgcagtgccaacaagaacagacgtccctgaatatcaaaaactcacaagccaagttcatgaaattgttggacgcattaatggtcgttttgggacgctgactgcagttccaattcatcacctggatcgttctctggacttttatgctttatgtgcgctttatgccgtcacagatgttgcacttgtcacatctttgagagatgggatgaaccttgtcagttacgaatttgttgcctgccaagaggccaaaaaaaggcgtccttattctcagtgaatttgcaggtgctgcacagtctctgggtgctggagccattcttgtgaacccttggaacattacagaagttgctgcctccattggacaggccctaaatatgtcagctgaagaaagagagaaaagacatcggcataattttcatcatgtgaaaactcacaccgctcaagaatgggctgaaacttttgtgagtgaactaaatgatactgtaattgaggcacaactacgaattagcaaagtcccacctgagcttccacaggacgatgcaattcagcggtattcaaagtcaaccaacaggctactgatcctgggtttcaatgcaacattgactgaaacagtggataatcaagggagaagaggcgaccaaataaaggagatggatcttaatctacatccagagctaaaaggaccgttgaaggcattatgcagcgatccaagtacaacgatcattgtcctgagtggaagcagcagaagcgttttagacaaaaacttcggagagtatgatatgtggttggccgcagagaatggaatgttcctaaggcttacgaatggagagtggatgactacaatgccagagcacttgaacatggaatgggttgatagcgtaaagcatgttttcaagtacttcactgagagaacccccaggtcacactttgaaacacgcgatacttcgcttatatggaattacaaatatgcagatattgaattcgggaggcttcaagcaagagacctgttacaacacttatggacaggtccaatctctaatgcatcagttgatgttgtccaaggaagccgctctgtggaagtccgtgcagttggtgtgacaaagggagctgcaatcgatcgcattctaggagagatagtgcatagcaagtcgatgaccacaccgatcgattacgtcttgtgcattggtcatttcttggggaaggacgaagatgtttacaccttctttgaaccagaactcccatccgacatcccagccattgcacggtccagaccatcatctgatggtggtaccaagtcatcatcaggagaccgaagaccgccttcaaagtcgacacaccacaacaaaagcggttcaaaatcttcatcctcctctaactctaacaacaacaacaacaataacaaggcctcacagagatctctgcagacaacggagagaaaaagcggatccaaccatagcttagggaactcaagacgtccttcgccagagaagatctcatggaacgtgcttgacctcaaaggagagaattacttctcttgtgcagtgggtcgtactcgcaccaatgctagatatctccttggctcacctgacaatgtcgtttgcttcctcgagaagctcgccgacacatcagcgcctaactcatcgtcctcatcttagactctgagacggtgtaaagtgagagttcgtgtaacccaataaataattgttttgtaacaagaagtaaccattaccagactcttttagttgtttgattctaatataataagagtagagcaagtgatgaattaattctctattacatagaataatcaaactacaatacacccctaagcaatctagtgaaagcaggggtaattaaacaatataacaagaacaaaaaaagaaacagatagatattagtgatcaatctaatgacgaatcacgacctttctctcttcagggtttcttgtttggctcgaatgcatacttgatcaaagactccttgatggagagtagttcagggaactctttcttgagcttagaagcatccatctcgttattgcttcgtggagccacaatgactttagcttgctcctctaacgtgaagtttgcccatttgaagtcagggttgatgtagtctctgtacatctctagaatttcattgtgactcaccacacccgggtttgtgaagttccagatccctttcaagtttctcttcgccatctcgatggaaattggcaaaagctcgtccaacacagtcatgctgtttggaatgttcactactttgttgtaccttgagatcttggtgatgaagttccgtgggttgtttagatccgaagaaataggcatccttaccctcaatgtgcatacgttgtcaaactcctttagcagctcctcgacctttaccatggccttggtttttgagtagaaagagccagtgaagttgggagtgtcttcctctttgaagccaattcctgaaccttccggatgcttgtcatcgtattcgaatatacaaccagtagcgaaattcatcatcaggaggccgtgctctctgcagacatcagctagagtcaacgttccagctacgttggcacggatagtctcggtcttgtgagactcacaccagtcaacgttgggtctcccagtcacaccagcggaattgaaaacatgggttggcttaacactcagaatatcctgtaaaagagaagatcgatcctccaaccgtccttttccgtactcgtacgcaatttcttgcttctcacataactttccaagcagaccaccaatccatcccgtctttccatatatcaagaacttgagagaaggcttctgtggtgtgctggtgctccttgggctcggaaccaccatgtggttctgactcggtttgctggataaagaagctgccaaagaattctcctcggatccatcaaagtgtcgcccaccaggcatcatcagcatccttggatgaggaagcaatgcaccagaaacatcaccccaccactcggggttctgtgtgtaccattccatagttttcttcaacccttcttcccacgtggtcctctctgaccatcccaacttcttgagcttctcatcatcaaggaagtacctttgatcgttgaaaggcctgttctcgacaaacttgatgttcgcctcagggtccatgttgaagagtttgcagacgtctctggcaacatcattcactctcctctccttcttggtcccaatattgtaaacatggccaacttctcccttgtgaagaataacttcaaacgcctcagcaacgtcttcgcagtataggtagctccggacatttgaaccatctccatgaatgggaagaactttccccctcattgccagcaagatgaacttaggaatcaacttctccggaaactgattgggtccgtagacgttattcccacgcgtggtaataacaggcaagccgtatgatctaccataggccatcacaagcatctcagcaccagctttcgttgcagagtaaggattcgtcgggaggagctgagaggcctcatggttaccaacaagagcatcctcatcggtctcaccatagacttcatcagtactcacatggataaacctcctgatctgaccagtgactttacaagcctcaagaagaacatgagttccatagatgttgttcttggtgaactcgaaactattaccaaaggagttgtcgacgtgtgtctgagcagcaaagtgcatgatggtgtcgataccttccgtgatgaggagatgattcacaagatcagcacttgcgatgtcacctttaacaaacttgaaatttggagactgtttagagggattgagattcttgagattggaacagtaatcgagtttgtcaagcacgactatcttgtaatcaggatagctccgtatgagtctgttggccacatgtgatgcaatgaaaccagcagcgccggtgatgagaatgttctttggagtatacgaagccattgagagagaagacacgattatttcctctgaattttcagatcttcacgatcaacaatcgtagatcgggcaagagaaatggagaagacgatagaaatatcggagaaaaaatgtgaagaaattcgacggtgagaagctgaggagaagcgaaagtaacggagaagaacaaattcaaaaaagagtcttctcgagagagcaaaaataga

SEQ ID NO: 3485 - DNA, 2283 bp, Secale cereale
gcggcaacaaaaaatctatcgctcgctcgctcgcccgcccgcactgacactcctcgccccgcatctccgaccggtccctgctccggcgatgtcggcggccgtgggcggcgccgagttccacggcttcggcggggcggcgcagctcccgcggtcccggatgctcggcaggcccgtcagggtggcgccgtctggggcgacgccggctggcggcggcggcccctcggcggccagcattcgcgccgtgtccacgcctctgaagaaggatgcaaaggaagttaagcgaagcaaggtggagataatcaaggagaagagcaatttccttcggtacccgctcaacgaggagctggtctcagaggctcccaatgtcaacgagactgctgtccagctcatcaagttccacggaagctaccagcaaagcgaccgagaagttcgtgggcaaaagaactactccttcatgctccggacaaagaatccttccggaaaagttccgaaccagacttacttggccatggatacactggctgatgagttcgggattggaacgctccgtctgacaaccaggcagacatttcagctgcacggcgttcttaagaagaacttgaagcatgtcatcagcactgtgatcaagaatatgggatcaaccttaggtgcctgtggagacctcaacaggaatgtgcttgcgcctgcagcgccatatgtgagaaaggatattctgtttgctcaagaaacagctgacaatattgctgcacttcttgcgccacagtcgggggcttattatgacctgtgggtggatggagagaagataatgtcagcggaagagcctcctgaggtcaccaaagcccggaatgacaactcacatggaacaaacttccctgattcccctgaaccaatctacgggacccaatatctgcccagaaagttcaagattgcggtcacggttgctggtgataactctgttgatattctgaccaatgacatcggtgttgttgttgtttcagatagtgcaggggagcctgttggctttaacctctacgttggaggtggcatgggaaggacacacagaatagaaaccacattccctcgtctggctgatccacttggttatgttcctaaggaggatatattatatgctataaaggcaatcgttgtcactcagagggagaatggaagaagggatgaccgcaggtatagcagaatgaagtatctgattgacagctggggtattgacaagttccgggctgaggttgaaaaatactatggaaagaagtttgaagatttccgtccattgccagaatggcagttcaacagctaccttggctggcaggagcagggcgatggtaaattattctatggagtgcatgttgataatggtcgtcttggggggcaagcaaagaaaactctgcgagagataattgagaagtataacttggatgttagcattactccaaaccaaaatcttatcttatgtggggttgatcaggcatggagagaacccataactgcagcacttgctcaagctggtctgttggaaccaaaggatgttgatctcttgaacataacctccatggcatgtcctgccttacctctgtgccctctagcacaaacagaagctgagcgagggatcctaccaattcttaaacgaatcagagcagtttttgacaaggttggcatcaaggatgaggagtctgtggtggtgaggataactggctgccccaatggatgtgccagaccatatatggccgaggttggcttcgttggtgatggcccaaacagttaccagatttggcttggaggaacaccaaaccagacaaccttggcagaaacgtttatgaataaagtgaagcttcaagatatagagaaggttttggaaccactgttttcttattggaatagcacacggcaggaaggcgaatcttttgggagcttcacaaacagaatgggatttgagcaactgaaagaggtggtgaacaagtgggaggggtcagcgtcagccgcatgagagccgtctttgctggacaaatcccagcaccatttttgctggggtgagaatctggtggcagccagggactcttctatcggatatatataaaaacaaggagaggaggaggaaacctgtcaattccgttgacaggcggaggacgaaggaagagccgggtctgaagatgttgctcctttgtgtttgttgaggttttttttttcgtgtgtacctgtatggataactccgttggcccctttgtttagcctgagaataaattccttgcaaaaaagaaatactacttgtga

SEQ ID NO: 3486 - DNA, 2299 bp, Secale cereale
cccccgcggcaacaaaaaatctatcgctcgctcgctcgcccgcccgcactgacactcctcgccccgcatctccgaccggtccctgctccggcgatgtcggcggccgtgggcggcgccgagttccacggcttcggcggggcggcgcagctcccgcggtcccggatgctcggcaggcccgtcagggtggcgccgcctggggcgacgccggctggcggcggcggcccctcggcggccagcattcgcgccgtgtccacgcctctgaagaaggatgcaaaagaagttaagcgaagcaaggtggagataatcaaggagaagagcaatttccttcggtacccgctcaacgaggagctggtctcagaggctccgaatgtcaacgagactgccgtccagctgatcaagttccacggaagctaccagcagagcgaccgagaagttcgtgggcaaaagaactactccttcatgctccggacaaagaatccttccggaaaagttccaaaccagacttacttggccatggatacactggctgacgagttcgggattggaacgctccgtctgacaaccaggcagacatttcagctacacggcgttcttaagaagaacttgaagcatgtcatcagcactgtgatcaagaatatgggatcaaccttaggtgcctgtggagacctcaacaggaatgtgcttgcgcctgcagcgccatatgtgagaaaggatattctgtttgctcaagaaacagctgacaatattgcggcacttcttgcgccacagtcgggggcttattatgacctgtgggtggatggagagaagataatgtcagcggaagagcctcctgaggtcaccaaagcccggaatgacaactcgcatggaactaacttccctgattcccctgaaccaatctatgggacccaatatctgcccagaaagttcaagattgcggtcacagttgctggtgataactctgttgatattctgaccaatgacattggtgttgttgttgtttcagatagtgcaggggagcctgttggatttaacctctatgttggaggtggcatgggaaggacacacagaatagaaaccacattccctcgtctggctgatccacttggttatgttcctaaggaggatatattatatgctataaaggcaatcgttgtcactcagagggagaatggaagaagggatgaccgcaggtatagcagaatgaagtatctgattgacagctggggtattgacaagttccgggctgaggttgaaaaatactatggaaagaagtttgaagatttccgtccattgccagaatggcagttcaacagctaccttggctggcaggagcagggcgatggtaaattattctatggagtgcatgttgataatggtcgtcttggggggcaagcaaagaaaactctgcgagagataattgagaagtataacttggatgttagcattactccaaaccaaaatcttatcttatgtggggttgatcaggcatggagagaacccataactgcggcacttgctcaagctggtctgttggaaccaaaggatgttgatctcttgaacataacctccatggcatgtcctgccttacctctgtgccctctagcacaaacagaagctgagcgagggatcctaccaattcttaaacgaatcagagcagtttttgacaaggttggcatcaaggaggaggagtctgtggtggtgaggataactggctgccccaatggatgtgccagaccatatatggccgaggttggcttcgttggtgatggcccaaacagttaccagatttggcttggaggaacaccaaaccagacaaccttggcagaaacgtttatgaataaagtgaagcttcaagatatagagaaggttttggaaccactgttttcttattggaatagcacacggcaggaaggcgaatcttttgggagcttcacaaacagaatgggatttgagcaactgaaagaggtggtgaacaagtgggaggggtcagcgtcagccgcatgagagctgtctttgctggacaaatccctgcgccatttttgctggggtgagaatctggtggctgccagggactcttctatcggatatatataaaaacaaggagaggaggaggaaacctgtcaattccgttgacaggcggaggacgaaggaagagccgggcctgaagaagttgctcgtttgtgtttgttgaggttttctttttcgtgtgtacttgtatggataactcccgttggcccctttgtttagcctgagaataaattccttgcaaaaatgaaatactacttgtgataataaattt

SEQ ID NO: 3487 - DNA, 2302 bp, Secale cereale
ccccgcggcaacaaaaaatctatcgctcgctcgctcgcccgcccgcactgacactcctcgccccgcatctccgaccggtccctgctccggcgatgtcggcggccgtgggcggcgccgagttccacggcttcggcggggcggcgcagctcccgcggtcccggatgctcggcaggcccgtcagggtggcgccgcccggggcgacgccggctggcggcggcggcccctcggcggccagcattcgcgccgtgtccacgcctctgaagaaggatgcaaaagaagttaagcgaagcaaggtggagataatcaaggagaagagcaatttccttcggtacccgctgaacgaggagctggtctcagaggctccgaatgtcaacgagactgctgtccagctcatcaagttccacggaagctaccagcagagcgaccgagaagttcgtgggcaaaagaactactccttcatgctccggacaaagaatccttccggaaaagttccgaaccagacttacttggccatggatacactggctgatgagttcgggattggaacgctccgtctgacaaccaggcagacatttcagctgcacggcgttcttaagaagaacttgaagcatgtcatcagcactgtgatcaagaatatgggatcaaccttaggtgcctgtggagacctcaacaggaatgtgcttgcgcctgcagcgccatatgtgagaaaggatattctgtttgctcaagaaacagctgacaatattgcggcacttcttgcgccacagtcgggggcttattatgacctgtgggtggatggagagaagataatgtcagcggaagagcctcctgaggtcaccaaagcccggaatgacaactcacatggaacaaacttccctgattcccctgaaccaatctacgggacccaatatctgcccagaaagttcaagattgcggtcacggttgctggtgataactctgttgatattctgaccaatgacatcggtgttgttgttgtttcagatagtgcaggggagcctgttggctttaacctctacgttggaggtggcatgggaaggacacacagaatagaaaccacattccctcgtctggctgatccacttggttatgttcctaaggaggatatattatatgctataaaggcaatcgttgtcactcagagggagaatggaagaagggatgaccgcaggtatagcagaatgaagtatctgattgacagctggggtattgacaagttccgggctgaggttgaaaaatactatggaaagaagtttgaagatttccgtccattgccagaatggcagttcaacggctaccttggctggcaggagcagggcgatggtaaattattctatggagtgcatgttgataatggtcgtcttggggggcaagcaaagaaaactctgcgagagataattgagaagtataacttggatgttagcattactccaaaccaaaatcttatcttatgtggggttgatcaggcatggagagaacccataactgcagcacttgctcaagctggtctgttggaaccaaaggatgttgatctcttgaacataacctccatggcatgtcctgccttacctctgtgccctctagcacaaacagaagctgagcgagggatcctaccaattcttaaacgaatcagagcagtttttgacaaggttggcatcaaggaggaggagtctgtggtggtgaggataactggctgccccaatggatgtgccagaccatatatggccgaggttggcttcgttggtgatggcccaaacagttaccagatttggcttggaggaacaccaaaccagacaaccttggcagaaacgtttatgaataaagtgaagcttcaagatatagagaaggttttggaaccactgttttcttattggaatagcacacggcaggaaggcgaatcttttgggagcttcacaaacagaatgggatttgagcaactgaaagaggtggtgaacaagtgggaggggtcagcgtcagccgcatgagagctgtctttgctggacaaaatccctgcgccatttttgctggggtgagaatctggtggctgccagggactcttctatcggatatatataaaaacaaggagaggaggaggaaacctgtcaattccgttgacaggcggaggacgaaggaagagccgggcctgaagaagttgctcgtttgtgtttgttgaggttttctttttcgtgtgtacttgtatggataactcccgttggcccctttgtttagcctgagaataaattccttgcaaaaatgaaatactacttgtgataataaatttgtc

SEQ ID NO: 3488 - DNA, 2418 bp, Brachypodium distachyon
cgctcaagtctcaaccgtgctcagcgcagatatctcgctcgctctcactcctcaactcaatctccctccataggctccggccagtttcctgctccggcgatgtcggcggtgggcggagccgggttccacggcgcggcgcagctcccgaggtcgcggatgctcggccggcccgtcagggtggcgccgccgcccgcggcgacaccggctggcggcggcgggccatcagcgtccagcattcgcgccgtgtccgcgcctctgaagaaggatgcaaccgaggttaagcggagcaaggttgagataatcaaagaaaagagcaattttcttcggtaccctttgaatgaggagctggtctcagaggctccaaatatcaacgacaatgctgttcagctgattaagttccatggaagctatcagcagacagaccgagctgttcgtggacaaaagaattactcgttcatgctccggacaaagaatccttctggaaaagttccaaacaagctttacttggctatggatacactagccgatgagttcggaattggaacactccgtttgacaaccagacaaacatttcagctgcatggtgttcttaagaagaacttgaagcatgtcatcagcactgtgataaagaatatgggttcaaccttaggtgcttgtggagatctcaataggaatgtgcttgcacctgcagcgccatatgtcagaaaagatattctgtttgcgcaagaaacagcagaaaatattgcagcacttcttgcaccacagtcgggggcttattatgacctttgggtagatggggagaagataatgtcagcagaagaaccccctgaggtcacgaaagctcgcaatgacaactcacatggaacaaactttcctgattcccctgaaccaatatacgggacccagtatctgcccaggaagttcaagattgcagtcactgttggcggtgataactctgttgatattctgaccaatgacatcggtgttgttgttgtttcagacagcgcgggagagcctgttggcttcaacctttatgtcggaggtggcatgggaagaacacaccgagtggaaaccacattccctcgactggctgatccacttggttatgttcctaaggaggatatattatatgctataaaggcaatagttgttacacagagagaaaatggaagaagagacgaccgcaggtatagcagaatgaagtatctgcttgaccgctggggaattgacaagtttcgggctgaagttgaaaaatattatggaaagaagtttgaaaatttccgtccattgccagaatgggaattcaagagttaccttggctggcaggaacagggtgatggtaaattattctatggggtgcatgttgataatggtcgtctgggggggcaagcaaagaaaactctacgagagataattgagaagtataacttggatgttagtattactccaaaccaaaatcttatcttatgtggggttgatcaggcatggagggctcccatcactgcagctcttactcaagctggcctgttggaaccgaaggatgttgatctcctgaatataacttccatggcatgtcctgccttacctctgtgccctctagcacaaactgaagctgaacgtgggatcctaccaattcttaaacgaattagagcagtctttgacaaggttggtatcaaggatcaggagtctgtagtggtgaggataactggctgccctaatggatgtgccagaccatatatggcagaggttggtttcgttggtgatggtccaaacagttaccagatttggcttggaggaacaccaaaccagacaacactggcagaaacgtttatgaataaagtgaagcttcaagatattgagaaggttttggaaccactgttttcttattggaatagcacacgccaggatggtgaatcatttgggagcttcacaaaccgaatgggatttgaacaattgaaagaggtagtgaacaagtgggaagagtcagcatcagccgcatgaaggatttgtttttgcttgacaagtccctggtcagttttggctgagggacagacaacctgagggcgtggtcaaaggggcgctccatatgtaaacaagaagagcaggtggaaatttgtcaattccgttgacaactttgacaagcagaactgcagaagacgaggactcgtgccaggacctgttccttaggtttagtcaagatgagtaaccaaatttcctgtgcgtcgaagagaatctttcttttgctgtttaacttgagaataaagtccttgcagatagtgatacttttttgagaataaatttgttccattgtgggagtgttatccttctgaagttgttctggcttctggaattggcaaattgtcctgccgtagttgggcagctgggccttccatgtttctggatttgttggtgggctgg

SEQ ID NO: 3489 - DNA, 2588 bp, Brachypodium distachyon
acccggtcgtggccgctcccaataaagcccccggtgactcgtcgtctcggccgctcaagtctcaaccgtgctcagcgcagatatctcgctcgctctcactcctcaactcaatctccctccataggctccggccagtttcctgctccggcgatgtcggcggtgggcggagccgggttccacggcgcggcgcagctcccgaggtcgcggatgctcggccggcccgtcagggtggcgccgccgcccgcggcgacaccggctggcggcggcgggccatcagcgtccagcattcgcgccgtgtccgcgcctctgaagaaggatgcaaccgaggttaagcggagcaaggttgagataatcaaagaaaagagcaattttcttcggtaccctttgaatgaggagctggtctcagaggctccaaatatcaacgacaatgctgttcagctgattaagttccatggaagctatcagcagacagaccgagctgttcgtggacaaaagaattactcgttcatgctccggacaaagaatccttctggaaaagttccaaacaagctttacttggctatggatacactagccgatgagttcggaattggaacactccgtttgacaaccagacaaacatttcagctgcatggtgttcttaagaagaacttgaagcatgtcatcagcactgtgataaagaatatgggttcaaccttaggtgcttgtggagatctcaataggaatgtgcttgcacctgcagcgccatatgtcagaaaagatattctgtttgcgcaagaaacagcagaaaatattgcagcacttcttgcaccacagtcgggggcttattatgacctttgggtagatggggagaagataatgtcagcagaagaaccccctgaggtcacgaaagctcgcaatgacaactcacatggaacaaactttcctgattcccctgaaccaatatacgggacccagtatctgcccaggaagttcaagattgcagtcactgttggcggtgataactctgttgatattctgaccaatgacatcggtgttgttgttgtttcagacagcgcgggagagcctgttggcttcaacctttatgtcggaggtggcatgggaagaacacaccgagtggaaaccacattccctcgactggctgatccacttggttatgttcctaaggaggatatattatatgctataaaggcaatagttgttacacagagagaaaatggaagaagagacgaccgcaggtatagcagaatgaagtatctgcttgaccgctggggaattgacaagtttcgggctgaagttgaaaaatattatggaaagaagtttgaaaatttccgtccattgccagaatgggaattcaagagttaccttggctggcaggaacagggtgatggtaaattattctatggggtgcatgttgataatggtcgtctgggggggcaagcaaagaaaactctacgagagataattgagaagtataacttggatgttagtattactccaaaccaaaatcttatcttatgtggggttgatcaggcatggagggctcccatcactgcagctcttactcaagctggcctgttggaaccgaaggatgttgatctcctgaatataacttccatggcatgtcctgccttacctctgtgccctctagcacaaactgaagctgaacgtgggatcctaccaattcttaaacgaattagagcagtctttgacaaggttggtatcaaggatcaggagtctgtagtggtgaggataactggctgccctaatggatgtgccagaccatatatggcagaggttggtttcgttggtgatggtccaaacagttaccagatttggcttggaggaacaccaaaccagacaacactggcagaaacgtttatgaataaagtgaagcttcaagatattgagaaggttttggaaccactgttttcttattggaatagcacacgccaggatggtgaatcatttgggagcttcacaaaccgaatgggatttgaacaattgaaagaggtagtgaacaagtgggaagagtcagcatcagccgcatgaaggatttgtttttgcttgacaagtccctggtcagttttggctgagggacagacaacctgagggcgtggtcaaaggggcgctccatatgtaaacaagaagagcaggtggaaatttgtcaattccgttgacaactttgacaagcagaactgcagaagacgaggactcgtgccaggacctgttccttaggtttagtcaagatgagtaaccaaatttcctgtgcgtcgaagagaatctttcttttgctgtttaacttgagaataaagtccttgcagatagtgatacttttttgagaataaatttgttccattgtgggagtgttatccttctgaagttgttctggcttctggaattggcaaattgtcctgccgtagttgggcagctgggccttccatgtttctggatttgttggtgggctgggtttgcatgagtctccatgcctgctcggctcattcgttgcgtcagaggctcagagcccattgggtagagactccttgacacaaccggccggagatctgaagtgaagtgtaaaacatgat

SEQ ID NO: 3490 - DNA, 2318 bp, Avena sativa
ctccctcgtgtcgtgtctcagagcgccgccgacacgaccaaacaacaaaaaaaatccatcgctcgcactcactcctcgccatcgcatctccatcgctcgcactcgctccggcgatgtcggcggcggtgggcggcgccgacttccacggcttcgccggcgcggcgcagctgccgaggtcgcggatgctcgggaggcccgtcagggtggcgccgcccggggcgtcaccggctggcggcggctcatcggcggccagcattcgcgccgtctccgcgcctctgaagaaggatgcatcaacagtgaagcgaagcaaggtcgagataataaaggagaagagcaacttcctccggtaccctttgaacgaggagctagaatcggaggctccaaacgtcaacgacagtgcggtccagctgattaagttccacggaagctatcagcagagcgaccgcgaagtccgtggacagaagaactactccttcatgctccggacaaagaatccttctggaaaagttcctaaccagacttacctggctatggatacgctggctgatgagttcgggatcggaacgctccgtctgacgaccaggcaaacgtttcagctgcacggcgttctcaagaagaacctcaagactgtcatcagcactgtgatcaagaatatggggtcaaccttaggtgcctgtggagatctcaacaggaatgtgcttgcgcctgctgcgccatatgtgagaaaagatattcagtttgctcaggaaacagcagacaatattgcggcgcttcttgcgccacaatcgggggcttattatgacctgtgggtggatggagagaagataatgtcagcagaagaacctcctgaggtcactgcagcccggaatgataactcacatggaacaaacttccctgattcccctgaaccgatctacgggacccagtatctgcctaggaagttcaagattgcggtcacagttggtggtgataactctgttgatattctgaccaatgacatcggcgtggttgttgtttcagatgatgcaggagaacctgtgggctttaacatttatgttggaggtggcatgggaaggacacacagagtggaaaccacattccctcggctggctgatccacttggttatgttccgaaggaggatatattatatgctataaaggcaatagttgtcacgcagagggaaaatggaagaagagatgaccgcaggtatagcagaatgaagtatctgcttgaccgctggggaattgacaagtttcgggctgaaactgaaaaatattatggaaagaagtttgaagagttccgtccacagccagaatggcaattcaacagctaccttggctggcaggaacagggtgatggtaagttattctatggggtgcatgttgacaatggtcgtcttggcgggcaagtaaagaaaactctgcgagagataattgagaagtacaacttggatgttagcattactccaaaccaaaatcttatcttatgtggggtcgaacaggcatggagagaacccatcactgcagctcttgctcaagctggtctgttggaaccgaaggatgttgatctcctgaacataacatccatggcatgccctgccttacctctgtgccctctagcacaaacagaagctgaacgagggatcctacctatccttaaacgaatcagagcagttttcgacaaggttggcatcaaggatgaggagtccgtagtggtgagaataactggctgccctaatggatgcgccagaccatatatggcagaggttggtttcgttggtgatggcccaaacagttaccagatttggctcggagggacaccaaaccagaccaccttggcagaaaccttcatgaataaggtgaagcttcaagatattgagaaggttttggaaccgctgttctcctattggcacaacacacgtcaggaaggtgaatctttcgggaccttcacaaaccgaatgggatttgaccagctgaaagaggtggtgaacaagtgggcagagtcagcagcagccgcgtgagagccgttttcgctggacaagtcccagcacagttttggctggggggggaaatctggccatggccaatgaatcttcagatgtaaacaagggaagaagagtaaacccgtcaattccgttgacaggcagaggatgaagtcgtctcggggacttgactcgagatgaatggtcttttttttttccgtgtgtgtgtgtgtgcttgtatggataacttggttggctgtctttgtttaacttgagaataagttccttgcaacaagaaattcgtacctgagaataaatttgttcaagcttagccgc

SEQ ID NO: 3491 - DNA, 2279 bp, Avena sativa
accaacaaaaaaaatccatcgctcgcactcactcctcgccgtcgcatctccctacagcctccgaccaatccctgctccggcgatgtcggcggcggtgggcggcgccgacttccacggcttcggcggcgcggcgcggctgccgaggtcgcggatgctcgggaggcccgtcagggtggcgccgcccggggcctcaccggctggcggctcatcggcggccagcattcgcgccgtctccgcgcctctgaagaaggatgcatcaacagttaagcgaagcaaggtcgagataatcaaggagaagagcaacttcctccggtaccctttgaacgaggagctggaatcggaggctcccaacgtcaacgacagtgcggtccagctgattaagttccacggaagctatcagcagagcgaccgcgaagtccgtggacagaagaattactcgttcatgctccggacaaagaatccttctggaaaagttcctaaccagacttacctggctatggatacgctggccgatgagttcggaatcgggacgctccgcctgacgaccaggcagacgtttcagctgcacggcgttctcaagaagaacctcaagaccgtcatcagcactgtgataaagaacatggggtcaaccttaggtgcctgtggagatctcaacaggaatgtgcttgcgcctgctgcgccatatgtgagaaaagatattcagtttgctcaggaaacagcagacaatattgcggcgcttcttgcgccacagtcgggggcttattatgacctgtgggtggatggagagaagataatgtcagcggaagaacctcctgaggtcactgcagcccggaatgataactcacatggaacaaacttccctgattcccctgaaccgatatacgggacacagtatctgcccaggaagttcaagattgcggttacagttggtggtgataactctgttgatattctgaccaatgacatcggcgtggttgttgtttcagatgatgcaggagaacctgtgggctttaacatttatgttggaggtggcatgggaaggacacaccgagtggaaaccacattccctcgactggctgatccacttggttatgttcctaaggaggatatattatatgctataaaggcaatagttgtcacgcagagggaaaatggaagaagagatgaccgcaggtacagcagaatgaagtatctgcttgaccgctggggaattgacaagtttcgggctgaaactgaaaaatattatggaaagaagtttgaagagttccgtccacagccagaatggcaattcaacagctaccttggctggcaggaacagggtgatggtaaattattctatggggtgcatgttgacaatggtcgtctcggcgggcaagtaaagaaaactctgcgagagataattgagaagtacaacttggatgttagcattactccaaaccaaaatcttatcttatgtggggtcgaacaagcatggagagaacccatcactgcagctcttgctcaagctggtctgttggaaccgaaggatgttgatctcctgaacataacatccatggcatgccctgccttacctctgtgccctctagcacaaacagaagctgaacgagggatcctaccaattcttaaacggattagagcagtcttcaacaaggttggcatcaaggatgaggagtctgtagtggtgagaataactggctgccctaatggatgcgccagaccgtacatggcagaggttggtttcgttggtgatggcccaaacagttaccagatctggcttggaggaacaccgaaccagaccaccttggcggaaacgtttatgaataaagtgaagcttcaagatattgagaaggttttggaaccgctgttttcctattggcacagcacacgtcaggaaggtgaatctttcgggaccttcacaaaccgaatgggatttgaccagctgaaagaggtggtgaacaagtgggaagaatcagcagcagccgcctgagagctgtgttttgctggacaagtcccagcagagttttggctgggggaggggaatctggccgtggccaatgaatcttcagatgtaaacaagggaagaagagtaaaatctgtcaatcccgttgacaggcagaggatgaagtcgtctcgggaagttgactcgagatgaatggtcttcttttttcccgtgtctgtgtgtgcttgtatggataacttggttggctgtctttgtttaacttgagaataagttccttgcaacaagaaatacttgagaataaatttgctcaagctttggc

SEQ ID NO: 3492 - DNA, 2632 bp, Oryza sativa
cgcccgcggctctatcctgtgtcactgacagtgggacccaccaccggtctcgttgagtggtctaccgtggacggcgcgcacggtggggccaggggcgcactccccggcccgtaggagtagacccgtacgccattaaagcccctcgaccccgaccgagcgaagcgccccgcacgcacgaaatatcccactcgcttcgacactctcttccccttcttctcccggagaaaacctcgagccaaggccccgactccgactccggtgatgtcggcggcggtggggggagccgagttccacgggttccgtgggggtggcggcggcgcggcgcagctgcagaggtcgcggatgctcggaaggccgctccgtgtggcgacccctcacgcggcggcccccgctggcggcggcgggtcgtcgtcggccagcatacgcgccgtctccgcgccactcaagaaggatgcatctgaagttaagaggagcaaggttgagatcatcaaggagaagagcaattttcttcggtaccctttgaatgaggaactggtctcagaggctcccaatattaatgacagcgctgtccagcttattaaatttcatggaagctatcaacagacggaccgtgatgttcgtgggcagaagaattactcgtttatgctccgaacaaagaatccttgtggaaaagttccaaaccagctttacttggctatggatacgctagctgatgaatttggtattggaacactccgattgacgaccagacaaacatttcagctgcatggcgttcttaagaagaacctgaagactgtcatcagcactgttataaagaatatgggttcatcattaggtgcctgtggagatctcaacagaaatgtacttgcacctgcagcaccttatgtcaggaaggatattctttttgctcaagaaacagcagagaatatcgcagctcttcttacaccacaatctggggcttattatgacctgtgggtggatggagaaaagataatgtcagccgaagaacctcctgaggtcacgaaagctcgcaatgacaacacatatggaacaaatttccccgattcccctgaaccaatatatggcacacagtatctgccaagaaagttcaagattgctgtcactgtcgctggagataactctgttgatattctgaccaatgacatcggtgttgttgttgtttcagatagtgcaggagagcctgttggcttcaacatttatgttggtggtggcatgggtaggacacaccgagtggagaccacattccctcgattggctgatccactgggttatgttcctaaggaagatatattgtatgctataaaagcaatagtcgtcacacagagggaaaatgggagaagggatgaccgccgatatagcaggatgaagtatctgattgataactggggaattgagaagtttcgggctgaagtcgaaaaatactatggaaagaagtttgaagattctcgtcctttgcccgaatggcagttcaacagctacctaggatggcaggaacagggtgatggaaaattattctacggagtgcatgttgataatggtcgtgtcgcagggcaagcaaagaaaactctacgagagattattgagaagtacaatttggaagttagcattactccaaaccagaatcttatcttatgtgggattgatcaagcatggaaagatcccatcacagcagctcttgctcaatctggcctgctggaaccaaaggatgttgatcccctgaatattacttccatggcatgtcctgccttaccactgtgccctctagcacaaacagaagctgaacgagggattctgccgattcttaaacgaattagagcagtttttgataaggttggcatcaaggaccatgagtcggtagtggtgaggataacaggctgccctaatggatgcgctagaccatatatggcagaggttggctttgttggtgatggcccaaacagttaccagatatggcttggaggaacaccaaaccagagtaccctagctgaaacctttatgaataaagtgaagcttcaagatattgagaaggttttggaaccattgttttcctattggaacagcacacgtcaggaaggtgaatcttttggtagcttcacacgccggacgggatttgacaaattgaaagaggtagtgaacaagtgggcagagtcagcatcagctgcatgatggactgctttcgctgaacaagttgataacaattctgaccacgggtccaatgcgggcatcgtcaagggctctcaacataactatgtgagcattgcaggagaaaattttgtcaatttcgttgacaagattgaggactcgccgactcgggtttggaatcgttcgttcagataattaatcaaaatttttcgtgtactctggtttgagaaaaaaaaatgtgcttatgagaaaacaaaaggaaccctggctgtttactttggaataaattgcttggaaagtgtactgaataaatttttccattgtggtgtttgtttttttttcctcattctgcctatgctctgtaaattgaactaaatcttgggaacgtttagcggtttgggtgattgggcccttcgtttattgagttgtttggtgggcttttcctacagagaggaaaacatccccaggc

SEQ ID NO: 3493 - DNA, 2526 bp, Oryza sativa
gcgaagcgccccgcacgcacgaaatatcccactcgcttcgacactctcttccccttcttctcccggagaaaacctcgagccaaggccccgactccgactccggtgatgtcggcggcggtggggggagccgagttccacgggttccgtgggggtggcggcggcgcggcgcagctgcagaggtcgcggatgctcggaaggccgctccgtgtggcgacccctcacgcggcggcccccgctggcggcggcgggtcgtcgtcggccagcatacgcgccgtctccgcgccactcaagaaggatgcatctgaagttaagaggagcaaggttgagatcatcaaggagaagagcaattttcttcggtaccctttgaatgaggaactggtctcagaggctcccaatattaatgacagcgctgtccagcttattaaatttcatggaagctatcaacagacggaccgtgatgttcgtgggcagaagaattactcgtttatgctccgaacaaagaatccttgtggaaaagttccaaaccagctttacttggctatggatacgctagctgatgaatttggtattggaacactccgattgacgaccagacaaacatttcagctgcatggcgttcttaagaagaacctgaagactgtcatcagcactgttataaagaatatgggttcatcattaggtgcctgtggagatctcaacagaaatgtacttgcacctgcagcaccttatgtcaggaaggatattctttttgctcaagaaacagcagagaatatcgcagctcttcttacaccacaatctggggcttattatgacctgtgggtggatggagaaaagataatgtcagccgaagaacctcctgaggtcacgaaagctcgcaatgacaacacatatggaacaaatttccccgattcccctgaaccaatatatggcacacagtatctgccaagaaagttcaagattgctgtcactgtcgctggagataactctgttgatattctgaccaatgacatcggtgttgttgttgtttcagatagtgcaggagagcctgttggcttcaacatttatgttggtggtggcatgggtaggacacaccgagtggagaccacattccctcgattggctgatccactgggttatgttcctaaggaagatatattgtatgctataaaagcaatagtcgtcacacagagggaaaatgggagaagggatgaccgccgatatagcaggatgaagtatctgattgataactggggaattgagaagtttcgggctgaagtcgaaaaatactatggaaagaagtttgaagattctcgtcctttgcccgaatggcagttcaacagctacctaggatggcaggaacagggtgatggaaaattattctacggagtgcatgttgataatggtcgtgtcgcagggcaagcaaagaaaactctacgagagattattgagaagtacaatttggaagttagcattactccaaaccagaatcttatcttatgtgggattgatcaagcatggaaagatcccatcacagcagctcttgctcaatctggcctgctggaaccaaaggatgttgatcccctgaatattacttccatggcatgtcctgccttaccactgtgccctctagcacaaacagaagctgaacgagggattctgccgattcttaaacgaattagagcagtttttgataaggttggcatcaaggaccatgagtcggtagtggtgaggataacaggctgccctaatggatgcgctagaccatatatggcagaggttggctttgttggtgatggcccaaacagttaccagatatggcttggaggaacaccaaaccagagtaccctagctgaaacctttatgaataaagtgaagcttcaagatattgagaaggttttggaaccattgttttcctattggaacagcacacgtcaggaaggtgaatcttttggtagcttcacacgccggacgggatttgacaaattgaaagaggtagtgaacaagtgggcagagtcagcatcagctgcatgatggactgctttcgctgaacaagttgataacaattctgaccacgggtccaatgcgggcatcgtcatgggctctcaacataactatgtgagcattgcaggagaaaattttgtcaatttcgttgacaagattgaggactcgccgactcgggtttggaatcgttcgttcagataattaatcaaaatttttcgtgtactctggtttgagaaaaaaaaatgtgcttatgagaaaacaaaaggaaccctggctgtttactttggaataaattgcttggaaagtgtactgaataaatttttccattgtggtgtttgtttttttttcctcattctgcctatgctctgtaaattgaactaaatcttgggaacgtttagcggtttgggtgattgggcccttcgtttattgagttgtttggtgggcttttcctacagagaggaaaacatccccaggcccttgctcgcacgagaagttgcgtgggagatcattgcgtgaaaaggccca

SEQ ID NO: 3494 - DNA, 3380 bp, Setaria italica
tgcggacatggagcttcgagccacagagaatcggcacggcgcatgtatgcacgtacgtacgcattcagccgcgaccgaccgtgatattctgccaataagccgccacaccaaagttttctcaaaacgagctgcaagttattcgatgccgcggctttatccaagtccaagggaccgaacaagcagggggaatcaacaaagcaacgaggccaggaggcggcctctcactgtcagcgctgtcactgcatcgcggcatcacaccggaaacagaaggcaagctgccacacgagatccaggtccacgggccaccaatgagagatttgcctctgatctcatttctgacctcaccccgcctccgttcatgcgggcggtgcggctgcggcggctgcgcgcggacagggataggggaagtcaagtgaggaggggaatccagcttttggcaacgaaaaagacgtccacgttcaatgaacccacacaaatcccgggccaaatccagagccatccccggtcacgcctgcaagccgcatcttggccgcctcgcagtggatgcgcgcacataaaaaattcgtcgaaatcccaaacgctacgagacaactggcgggctcccaacgtgtcactgacatgtggggctagagtggccaggcccacttgtcaatctattgcatacgacgcgtggtcggcacaggcgtcaggtgtggaccgcgggggatgcttcaccactgccgttcccgtcttccccactggaatccaccaccctcacacgcccgcaccgcgcgcatccaccgcgaccatttcgtttcaactgacatgtggccccgtacccgtcgtcccttccggcacgacccctcatatcccacgctcgctcgccactccgcccgccgccgcacctccgccgatcgcttttctccttcctccgtctccggcgatgtcggcggcggtcgggggcgccgagttccacgggttccggggcgccgcggcgcagctccccaggtcgcggatgctcgggaggccgctccgggtggcgccacccgccgcggccccggccggcgggggcgcgtcctcgggcagcatacgcgctgtctccgcgcctctgaagaagggtgcagctgaagtgaagcgaagcaaggttgagatcatcaaggaaaagagcaatttcctccggtaccccttgaacgaggagttggtctcagaggccccaaatatcaatgatagtgctgtccagttgatcaagtttcatggaagctaccaacagactgatcgagatgtccgcgggcagaagaattactctttcatgctccggacaaagaatccttgtgggaaagttccgaaccagctttacttggctatggatacacttgctgatgagtttggcattgggacactccgtttgaccaccaggcagacattccagctgcatggtgttcttaagaagaacctgaagactgttctcagcactgtcataaagaatatgggctcaacattgggtgcttgtggagatctgaataggaatgtgcttgcacctgcagcgccttatgtcaggaaagatatcctttttgctcaacaaacagcagagaacattgcagcactccttacaccacaatctggagcttattatgacctgtgggtggatggagagaagataatgtcagctgaagagcctcctgaggtcacaaaagcccgcaatgacaactcacatggaacaaatttccctgactctccggaaccaatctacggcacccagtatctgccgaggaagttcaagattgcagttactgtggctggtgataactctgttgatattctgaccaatgacattggtgttgttgttgtttcagatgatgcaggagagcctgttggctttaacatctatgttggtggtggcatgggaaggacacaccgagtggaaactacattccctcggctggctgatccattgggttatgttccaaaagaagatatattatatgctataaaggccatcgtcgtcacacagagggaaaatggaagaagggatgaccgcaagtatagtaggatgaagtatttgattgaccgttggggaattgacaagttccgggctgaagttgaaaaatattacgggaagaagtttgaaagtttccggccattgcctgagtggcagtttaacagctaccttggctggcaagaacagggtgatgggaaattattctatggagtgcatgttgataatggtcgtgttggtgggcaagcaaagaaaactctacgggagataattgagaagtataatttggatgttagtattaccccaaaccaaaatcttattttatgtgggatcgatcaggcatggagagaacccatcactacagctcttgcacaagctggcctgctggaaccaaaggatgtggaccccctgaatttaactgccatggcatgccctgccttgccactgtgccctttggcacaaacagaagctgaacgtgggatcctacctattcttaaaagaattagagcagttttcgataaggttggtatcaaggattcggagtctgtggttgtgaggataactggctgccctaatggatgtgctagaccatatatggcagagcttggttttgttggtgatggcccgaaaagttaccagatctggctgggtggaacaccaaaccagagtaccctagcagaatcattcatgaacaaagtgaagcttgatgacattgagaaggttttggaacctctattttcctactggaacagcacgcgcctggaaggtgaatcttttggaagcttcacaaaccgaacaggattcaacaaattgaaagaggtggtggacaagtgggtagagtcaccatcagccgcataaaaggatcgcttttgtcggataaaatcccgggctcgcagcacaattttgtctccgacattcacggtgtgcgacgaaaggctctccagataaacgagataaagagggtgtcaaccccgttgacaatagaaaacgaaggctcggtttggagtcgttatgtttgttgggttgagtgatcaaattttttttgcgtgtgctttgaaggaaacctatgtcgacttgaataaattcctcgcaaagttgtgcctcagaataaattcgaccgaggcattgagttctgccatcgtcctgaccacagactggaactgcccacgtttgtatttctgtggttctgggaagcgcatttgaattccgcggttgttaacgggcctggcccgcatgaaatgcggacctggtttgggctggggccgtgcaacaacattcgtatttttgctgcgtgcagtgcactgccagtgcagcagcagtcactggcatcaccatcgcaccacaggcagtggagtcgcagtatcccaggatcgaaaagggtgacctgctgcactggaaaagctgg

SEQ ID NO: 3495 - DNA, 3197 bp, Setaria italica
atggagcttcgagccacagagaatcggcacggcgcatgtatgcacgtacgtacgcattcagccgcgaccgaccgtgatattctgccaataagccgccacaccaaagttttctcaaaacgagctgcaagttattcgatgccgcggctttatccaagtccaagggaccgaacaagcagggggaatcaacaaagcaacgaggccaggaggcggcctctcactgtcagcgctgtcactgcatcgcggcatcacaccggaaacagaaggcaagctgccacacgagatccaggtccacgggccaccaatgagagatttgcctctgatctcatttctgacctcaccccgcctccgttcatgcgggcggtgcggctgcggcggctgcgcgcggacagggataggggaagtcaagtgaggaggggaatccagcttttggcaacgaaaaagacgtccacgttcaatgaacccacacaaatcccgggccaaatccagagccatccccggtcacgcctgcaagccgcatcttggccgcctcgcagtggatgcgcgcacataaaaaattcgtcgaaatcccaaacgctacgagacaactggcgggctcccaacgtgtcactgacatgtggggctagagtggccaggcccacttgtcaatctattgcatacgacgcgtggtcggcacaggcgtcaggtgtggaccgcgggggatgcttcaccactgccgttcccgtcttccccactggaatccaccaccctcacacgcccgcaccgcgcgcatccaccgcgaccatttcgtttcaactgacatgtggccccgtacccgtcgtcccttccggcacgacccctcatatcccacgctcgctcgccactccgcccgccgccgcacctccgccgatcgcttttctccttcctccgtctccggcgatgtcggcggcggtcgggggcgccgagttccacgggttccggggcgccgcggcgcagctccccaggtcgcggatgctcgggaggccgctccgggtggcgccacccgccgcggccccggccggcgggggcgcgtcctcgggcagcatacgcgctgtctccgcgcctctgaagaagggtgcagctgaagtgaagcgaagcaaggttgagatcatcaaggaaaagagcaatttcctccggtaccccttgaacgaggagttggtctcagaggccccaaatatcaatgatagtgctgtccagttgatcaagtttcatggaagctaccaacagactgatcgagatgtccgcgggcagaagaattactctttcatgctccggacaaagaatccttgtgggaaagttccgaaccagctttacttggctatggatacacttgctgatgagtttggcattgggacactccgtttgaccaccaggcagacattccagctgcatggtgttcttaagaagaacctgaagactgttctcagcactgtcataaagaatatgggctcaacattgggtgcttgtggagatctgaataggaatgtgcttgcacctgcagcgccttatgtcaggaaagatatcctttttgctcaacaaacagcagagaacattgcagcactccttacaccacaatctggagcttattatgacctgtgggtggatggagagaagataatgtcagctgaagagcctcctgaggtcacaaaagcccgcaatgacaactcacatggaacaaatttccctgactctccggaaccaatctacggcacccagtatctgccgaggaagttcaagattgcagttactgtggctggtgataactctgttgatattctgaccaatgacattggtgttgttgttgtttcagatgatgcaggagagcctgttggctttaacatctatgttggtggtggcatgggaaggacacaccgagtggaaactacattccctcggctggctgatccattgggttatgttccaaaagaagatatattatatgctataaaggccatcgtcgtcacacagagggaaaatggaagaagggatgaccgcaagtatagtaggatgaagtatttgattgaccgttggggaattgacaagttccgggctgaagttgaaaaatattacgggaagaagtttgaaagtttccggccattgcctgagtggcagtttaacagctaccttggctggcaagaacagggtgatgggaaattattctatggagtgcatgttgataatggtcgtgttggtgggcaagcaaagaaaactctacgggagataattgagaagtataatttggatgttagtattaccccaaaccaaaatcttattttatgtgggatcgatcaggcatggagagaacccatcactacagctcttgcacaagctggcctgctggaaccaaaggatgtggaccccctgaatttaactgccatggcatgccctgccttgccactgtgccctttggcacaaacagaagctgaacgtgggatcctacctattcttaaaagaattagagcagttttcgataaggttggtatcaaggattcggagtctgtggttgtgaggataactggctgccctaatggatgtgctagaccatatatggcagagcttggttttgttggtgatggcccgaaaagttaccagatctggctgggtggaacaccaaaccagagtaccctagcagaatcattcatgaacaaagtgaagcttgatgacattgagaaggttttggaacctctattttcctactggaacagcacgcgcctggaaggtgaatcttttggaagcttcacaaaccgaacaggattcaacaaattgaaagaggtggtggacaagtgggtagagtcaccatcagccgcataaaaggatcgcttttgtcggataaaatcccgggctcgcagcacaattttgtctccgacattcacggtgtgcgacgaaaggctctccagataaacgagataaagagggtgtcaaccccgttgacaatagaaaacgaaggctcggtttggagtcgttatgtttgttgggttgagtgatcaaattttttttgcgtgtgctttgaaggaaacctatgtcgacttgaataaattcctcgcaaagttgtgcctcagaataaattcgaccgaggcattgagttctgccatcgtcctgaccacagactggaactgcccacgtttgtatttctgtggttctgggaagcgcatttgaattccgcggttgttaacgggcctggc

SEQ ID NO: 3496 - DNA, 1902 bp, Leymus cinereus x Leymus triticoides
agactgctgtccagctgatcaagttccatggaagctaccagcagagcgaccgaggtgtccgtggacagaagaattactcgtttatgctccggacaaagaatccttctggaaaagttccgaaccagctttacttggccatggatacactggccgatgagttcggaattggaacgctccgtctgacaaccaggcaaacatttcagctgcatggcgttcttaagaagaacttgaagcatgtcatcagcactgtgataaagaatatgggatcaaccttaggtgcttgtggagacctcaataggaatgtgctggcgcccgcggcgccatatgtgagaaaagatattctgtttgctcaagaaacagcagagaatattgcggcacttctcgcaccacagtcgggggcttattatgacctgtgggtggatggagagaagataatgtcagcggaagaacctcccgaggtcacgaaagcccggaatgacaactcacatggaacaaacttccccgattcccctgaaccaatctacgggacccagtatctgcccaggaagttcaagattgcggtcacagttgctggtgataactctgttgatattctgaccaatgacatcggtgttgttgtagtttcagatagtgcaggggagcctgttggctttaacctctatgttggaggtggcatgggaaggacacaccgaatagaaaccacattccctcgtctggctgatccacttggttatgttcctaaggaggatatattatatgctataaaggcaatcgttgtcactcagagggagaatggaagaagagacgaccgcaggtatagcagaatgaagtatctgattgacagctggggtattgacaagttccgcgctgaggttgaaaaatactatggaaagaagtttgaagattttcatccattgccagaatggcaattcaacagctatcttggctggcaggaacagggcgatggtaaattattctatggggtgcatgttgataatggtcgtctcggggggcaagcaaagaaaactctgcgagagataattgagaagtatagcttggatgttagtattactccaaaccaaaatcttatcttatgtggggttgatcaggcatggagagaacccataactgcagctcttgctcaagctggcctgttggaaccaaaggatgttgatctcctgaacataacctccatggcatgccctgccttacctctgtgccctctagcacaaacagaagctgagcgagggatcctaccgatacttaaacgaattagagcagttttcgacaaggttggcatcaaggatgaggagtctgtagtggtgaggataactggcagccccaatggatgcgccagaccatatatggcagaggttggctttgttggtgatggcccaaacagttaccagatttggcttggaggaacaccaaaccagaccaccttggcagaaacgtttatgaacaaagtgaagcttcaagatatcgagaaggttttggaaccactgttttcctactggaatagcacacgccaggaaggcgaatcttttgggagtttcacaaaccgaatgggatttgagcaactgaaagaggtggtgaacaagtgggaggggtcagcgtcagccgcatgagagatgtctttgctggacaagtcccagcaccatttttgctggggtgagaatctggtggcgaccaagtactcttcggatatataaaaacaaggagaggaggaggaaagctgtcaattccgttgacaggcggaggatggaggaagagccggggtctgaacttgctcctttgcgtttgttgagggtttttttttcgtgtgtacttgtatggataactccgttggcccctttgtttagcctgagaataaatccttgcaaaaaaaaaaacttgataata

SEQ ID NO: 3497 - DNA, 2011 bp, Panicum virgatum
acgaggagttggtctcagaggccccaaatatcaacgagagtgctgtccagttgatcaagtttcatggaagctatcagcagactgatcgagatgtccgcgggcagaagaattactcttttatgctccggacaaagaatccttgtgggaaagttccgaaccagctttacttggctatggatacacttgctgatgagtttggcattgggacactccgattgaccaccaggcagacattccagctgcacggcgttcttaagaaaaacctgaagactgttctcagcactgtcataaagaatatgggctcaacattgggtgcttgtggagatctcaataggaatgtgcttgcacctgcagcgccttatgtcagaaaagatatcctttttgctcaacagacagcagagaacattgcagcacttcttacaccacaatctggagcttattatgacctgtgggtggatggagaaaagataatgtcagctgaagagcctcctgaggtcacaaaagcccggaatgacaactcacatggaacaaacttccctgactctcctgaaccaatctacggcacccagtatctgccgaggaagttcaagattgcagttactacggctggtgataactctgttgatattctgaccaatgacatcggtgttgttgttgtttcagatgatgcaggagagcctgttggctttaacatctatgttggtggtggcatgggaagaacacaccgagtggaaactacattccctcggctggctgatccattgggttatgttccaaaagaagatatattatatgctataaaggccattgtcgtcacacagagagaaaatggaagaagggatgaccgcaagtatagtaggatgaagtatttgattgaccgttggggaattgacaagttccgagctgaagttgagaaatactatgggaagaagtttgaaagtttccggccattgcctgagtggcagtttaacagctaccttggttggcaagaacagggtgatgggaaattattctatggagtgcatgttgataatggtcgtgttggtgggcaagcaaagaaaactctacgagagataattgagaagtataatttggatggtagtattaccccaaaccaaaatcttattttatgtgggatcgatcaggcatggagagaacccatcactaaagctcttgctgaagctggcctgctggagccaaaggatgtggaccccctgaatttaactgctatggcatgccctgccttgccgctgtgccctttggcacaaacagaagctgaacgtgggatcttactaattcttaatcgaattagagcagttttcgataaggttggtatcaaggattcggagtctgtggttgtgaggataactggttgccctaatggatgtgctaggccatatatggcagagcttggttttgttggtgatggtccgaaaagttaccagatctggctggggggaacaccaaaccagagtaccctagcagaatcatttatggataaagtgaagctcgatgacatcgagaaagttttagaacctctgttctcctattggaatagcacacgccaggaaggtgaatcgtttggaagcttcacaaaccgaacaggattcaacaaattgaaagaggtagtggacaagtgggcagagtcaccatcagccgcataaaaggatcgctaatgtcagataaaatcccaggctcgtgcacaattttggctccgggattacagcttgccgaaaggctctccagataaacgtgacaagaggttgtcaaccccgttgacaatggaaaacaaggctcgttttggatttgttataagcttgttgggttgagtgatcaaaagaattttgcgtgtactttgaagaaaacctatgctgacttgaataaattcctcacaaagttgtactccctccgtccctaaataactgtcgctttcgcttcccgagaaaaaactttgattaattttatataaaaatatattaacatttatgatacataattaatatcattagat

SEQ ID NO: 3498 - DNA, 6263 bp, Phaseolus vulgaris
ctccaatccaaaccctctttttttatgcacacttccctctcaactctgaaccctctttctctgcataataccctatttgttttcagtttgtactttaatgtttctaccatctacttcatactttgagttatttataaacatgaaccccacaatgcattaagggtctctctctctttccctcttatccaatcctacaataaaaacatctcttttgctttgaatttatattgttttcgatttcaaagaactgcaaaatggcaccaagaaacagtcgcggaaaggccaagggtgagaagaaaaagaaggaagaaaaggttcttccagttgtcatagacatcacagtgaagcttcttgatgaaactcatgttctcaagggaatttcaacagacagaataatagacgttcgtcggcttttatcagtgaatacggacacgtgttatgtcacaaatttttccctgtctcatgaggtaagagggtcacgtctgaaggacacggtggacgtgtccgcactgaagccctgcctcctcactttagttgaagaggaatacaatgaagaacgagcagtggagcacgtgcgaagactccttgacatcgtcgcctgcaccacgagcttcggtccgtcgccgcctccgccaccgaaggtcgccgccggcacagttacgaagtccggcaagtccgaggtcccgccagcgaaagatgcggcggtgacggttgcggacgtggacggcgagataagccactcgtgccctaagctggagaacttctacgagtttttctctctctcgcacctcaccgcacctatacaatatgtgaagaaaggttcgagacggcgcgtggaggagatatcggaggcggattatctgttctcgctggatgttaaggtgtgcaacgggaaagtggtgcacgttgaggcttgcaggaagggattctacagcgttgggaagcagcggattctgtgccataatctggttgatttgttgagacagattagcagagcttttgataatgctttcgatgacctcttgaaggcattttcagagcgtaacaagtttgggaatctcccatatggcttcagagccaacacgtggcttgttcctcctgttgctgcacagtcaccctcatcttttcctcctcttcctgtggaggatgaaacatggggaggaaatggtggtagtctcggaaaagacggaacgtatgatttgattccttgggccaaagagttttcattaattgcatctatgccttgcaagacagcagaagaaagacaagttcgtgatagaaaagcatttcttctgcacagcctgtttgttgatgtttctattttcagagcaataggggctgttaaacatgttatggaagaacccaatgttagttgctccgttgtagaaaataatgttgtttacactgagagagtaggtgacttgagtatcaaggtcttgaaaaatggttctattgcaagctgtaagattgatactaaaattgatggagttgaagctactggagtaaatcaaaaggatctaatagagcgaaatctactgaaaggcatcactgctgatgaaaatactgctgcccatgatattaccactttaggtgtcattaatgtaagatactgtggttatgtggtcgttgtgaaagttgagggtggagtcagggaaaatgttgtctctccatcgcaacaaattattgaattgtttgatcagccagagggtggtgccaacgcactcaatattaacagtctgagattacttcttcacaacacagctccaccagaaaacaataaaccaatgattcagatacagacgtttgagagtgaagagactggtgcttcccattcttttgtggagaagctgattaatgaaagtcttgctaagcttgaggaggaagaacttggtatggactattttgtaagatgggaacttggagcttgctggatgcaacatttgcaagaccaaagtaataatacagaaaaagataagaaaccatccttggagaaggctaagaatgagatgaaggtcgagggtcttgggaaaccccttaaatcccttaagaattttaaaaagaaatctgattcaagcaatactacttctgcatctgaatattcaaaatttagtcgggagtcccaaagcccttcattgccctcaattgaatcgcaacatgaaactacagaagctgagaatgagcttgttctgaaaaggatgttatctgaggaagcttttactcgatttaaagaatcaggaacaggacttcactgcaagtctatgcatgatttgattgacttatctcaaaaatattacacagacgttgcactcccaaaattggtagcagattttggctcattagaactctcgccagttgatggacgcactctaactgattttatgcatactaggggtctaagaatgcgttctcttggacatgttgtcaagctttcagaaaagctttcacatgtgcagtcactttgtattcatgagatgatagttcgagcttttaagcacatcctgcgggcagtaatttcttctgttaacaaggagaaaatggcttcatcaattgctggtgctttgaatttgctgctcggtgttcctggaaatagagattcagataaatcacatgaagttcatcccttggtgtggaaatggctagagatgtttttgaaaaagcgatttgattgggatcttcacaggttgaattacaaagatgtgaggaaatttgcaattctccgtggcttgtgtcacaaggtgggaattgagcttgttccaagggattttgatatggattctcctattcccttccacaaatctgatattgtcagcttggtccctgttcacaagcaagctgcatgctcatctgcagatggaaggcagctcttggagtcatccaaaactgctttggacaagggaaagcttgaggacgctgttacctatggcacaaaggctcttgctaagctagtagcagtttgcggtccctaccatcgaatgacagcaggagcatacagcctgcttgctgtagttttatatcatactggagacttcaatcaggctacaatatatcaacaaaaagctttggatatcaacgagagagagttaggtctggatcatcctgataccatgaagagctatggggatcttgctgttttctattacagactacaacacacagagctggctctgaagtatgtgaagcgtgctttatatcttctgcatctaacatgtggcccatctcatccaaacactgctgctacttacattaatgtggctatgatggaagaaggtctgggaaatgtgcatgttgctctcagatatcttcacaaagctttaaagtgcaaccaaagattacttggcgcagatcatattcagacagctgcaagttatcatgcaatagcaatagcactctcattgatggaagcatatccattgagcgtgcagcatgagcaaacaactttgcaaattctgaggtcaaaacttggtcctgatgacttgcgaacacaggatgctgcggcttggctggagtattttgagtccaaggcttttgaacagcaagaagctgctcgaaatggtactcgaaaacctgatgcatcaatagctagcaaaggccatttgagtgtgtcagatttgcttgactatattaatcctaatcatgatactaaagggagagatgcagcaacaaagagaagaagccagataacaaaggtgagagcgacatcctaccttaaccttggcatgtcaagttctgatgagtcttcaaaagaaattcccaaagaggcttcagatgaagaggtacaaatacctgtagctgaaggtagtgcagattctgagcaggaaagcaactctggacctgactcagaacatactattttaaaacaaataccagatgaaaagccgcaaatttatgatgaaatattgtctgaagcacatgctgaaggagaagatggatggcaaccagttcaaagaccaagatcaactggttcatatggccggagactgaagcagagacgggcaacacttggcaaagtttatagttatcaaaagaatgtggaagttggcacagaatctccttttgtaaggaatgctagtccaaatagtaggtattatttcttgaagaagcggccaatttcccatgggggttatactggtgatcatacagtaaacatcacccaaggccctaaatttggaaggaaagtagttaaagctcttacatacagggtcaaatccataccctcaacttccaaggctagtgcaaatgagacgttagaaacaggtgacaagctgtttagttctgtttcagaacctgatccaattgatgttaatccagttaagaattctatagttagtcttggaaagtctccttcatacaaggaagtggccttagcacctccagggacaatctccaagtttcaggtctataatcctccaagtgagatttctgttagctgtgaacatgatggtggcaaacctgaagaggaagatattgaagctaataggaatgttaatccaaccccggcagaggcaaatgatatggataaaggcaagagtaataattctgtttctagttctgttgatggttcacaggatgatactggagttactactgaggggaaagaggaaactcagttgattgttgctgtgcaagataaatgtatgaatgctgaggggaaattaggagatgttgaagctcaaggagcaatcgataatagcagttcgattcaggaagtagatgatcatgtggattcttccaaaaaagaactcgatgcaagtaatttagctggcagtttggaacctagtgataatacaaatcccatttcccaaggtggcaaggatttaagggtcgatgtgtcatcatcaaatcagagtcacactgggggcatcccgtataagaaattgtctgcatctgcagctccattcaacccatcgcctaccattgcacgtgctccatcaattgccatgaatatgactcttccttctggtcccagtgtagtgcctggaattggcccctggccagtaaacatgaatgttcatcctggacctaccactgtgctacctgcagttacccccatgtgctcctctcctcaccatgcatatccatcgcctccaactacaccaaacatgatgcaaccactgccatatatgtatcctccttatactcaacctcaatcaatgccacctggcagctttccggtcactagcagtgcctttcatgcgaatcattttacatggcaatgtaatttgaaccccacagtatctaagtttggtcccggtgctgtttggcctggttgtcatcctgtggaatttcctcttccgttacctattgttgaaccaatccctgatcccatttcagagtcacaagttccgtgtaatggttctgaaagtccaagttcagcttcagttcttcctgaggacattgataatattggtgattctaatcaattggtgaaaactttagtatcagacactagtgaagatgaagcagtgagagctggttcagaaagtgtaaaagaaaatggtgatatgaatttacatgggactgaaaattctgggaacgagcaaaatcaaaacattggttctaatggaaactctagcagtggtgaaacaaacatggatggtgagaaaaccttcagcattttgattcgggggagaagaaatcgaaagcagactctaagaatgccaataagtttgcttactcgacctaatggctcacagtcatttaaggttatttataaccgcgtagttagaggaagtcatgcttccaagtctatcaatctctcgtctagtaaagattgtactgctactgcttgatgcacagttctatgttgttactgatgaaatttatcagaactatcatggataaagaagacctcataattttgcgtaagaggtgtttgctatttctatgatttctggaattcagttacaaaatgccctgcagtatcagcttcaaatttatagctgcactatcatttgcaaggtttctggatacctgtctctctttaggatggaggttgaaggcatttcttcatcaataaacgttacccgtggagcaccattcatgctaataatgttgctcaggttcgtcggagtcagtttcagggtgaggcaccttcaaggtgaaaattttggtattttgtacttagacaattttgatataatgaattacgggatggtggaacgttctaattactacttttttgttagaacattacctttggttttgataattaattttgttcaattgtatattctttcttaatttcttaatatcttgttaggtaa

SEQ ID NO: 3499 - DNA, 6363 bp, Phaseolus vulgaris
ctctcatctatatctctgcttccctctgccatttctcttcctctaacaattttcttccttctactggatgagacctccaatccaaaccctctttttttatgcacacttccctctcaactctgaaccctctttctctgcataataccctatttgttttcagtttgtactttaatgtttctaccatctacttcatactttgagttatttataaacatgaaccccacaatgcattaagggtctctctctctttccctcttatccaatcctacaataaaaacatctcttttgctttgaatttatattgttttcgatttcaaagaactgcaaaatggcaccaagaaacagtcgcggaaaggccaagggtgagaagaaaaagaaggaagaaaaggttcttccagttgtcatagacatcacagtgaagcttcttgatgaaactcatgttctcaagggaatttcaacagacagaataatagacgttcgtcggcttttatcagtgaatacggacacgtgttatgtcacaaatttttccctgtctcatgaggtaagagggtcacgtctgaaggacacggtggacgtgtccgcactgaagccctgcctcctcactttagttgaagaggaatacaatgaagaacgagcagtggagcacgtgcgaagactccttgacatcgtcgcctgcaccacgagcttcggtccgtcgccgcctccgccaccgaaggtcgccgccggcacagttacgaagtccggcaagtccgaggtcccgccagcgaaagatgcggcggtgacggttgcggacgtggacggcgagataagccactcgtgccctaagctggagaacttctacgagtttttctctctctcgcacctcaccgcacctatacaatatgtgaagaaaggttcgagacggcgcgtggaggagatatcggaggcggattatctgttctcgctggatgttaaggtgtgcaacgggaaagtggtgcacgttgaggcttgcaggaagggattctacagcgttgggaagcagcggattctgtgccataatctggttgatttgttgagacagattagcagagcttttgataatgctttcgatgacctcttgaaggcattttcagagcgtaacaagtttgggaatctcccatatggcttcagagccaacacgtggcttgttcctcctgttgctgcacagtcaccctcatcttttcctcctcttcctgtggaggatgaaacatggggaggaaatggtggtagtctcggaaaagacggaacgtatgatttgattccttgggccaaagagttttcattaattgcatctatgccttgcaagacagcagaagaaagacaagttcgtgatagaaaagcatttcttctgcacagcctgtttgttgatgtttctattttcagagcaataggggctgttaaacatgttatggaagaacccaatgttagttgctccgttgtagaaaataatgttgtttacactgagagagtaggtgacttgagtatcaaggtcttgaaaaatggttctattgcaagctgtaagattgatactaaaattgatggagttgaagctactggagtaaatcaaaaggatctaatagagcgaaatctactgaaaggcatcactgctgatgaaaatactgctgcccatgatattaccactttaggtgtcattaatgtaagatactgtggttatgtggtcgttgtgaaagttgagggtggagtcagggaaaatgttgtctctccatcgcaacaaattattgaattgtttgatcagccagagggtggtgccaacgcactcaatattaacagtctgagattacttcttcacaacacagctccaccagaaaacaataaaccaatgattcagatacagacgtttgagagtgaagagactggtgcttcccattcttttgtggagaagctgattaatgaaagtcttgctaagcttgaggaggaagaacttggtatggactattttgtaagatgggaacttggagcttgctggatgcaacatttgcaagaccaaagtaataatacagaaaaagataagaaaccatccttggagaaggctaagaatgagatgaaggtcgagggtcttgggaaaccccttaaatcccttaagaattttaaaaagaaatctgattcaagcaatactacttctgcatctgaatattcaaaatttagtcgggagtcccaaagcccttcattgccctcaattgaatcgcaacatgaaactacagaagctgagaatgagcttgttctgaaaaggatgttatctgaggaagcttttactcgatttaaagaatcaggaacaggacttcactgcaagtctatgcatgatttgattgacttatctcaaaaatattacacagacgttgcactcccaaaattggtagcagattttggctcattagaactctcgccagttgatggacgcactctaactgattttatgcatactaggggtctaagaatgcgttctcttggacatgttgtcaagctttcagaaaagctttcacatgtgcagtcactttgtattcatgagatgatagttcgagcttttaagcacatcctgcgggcagtaatttcttctgttaacaaggagaaaatggcttcatcaattgctggtgctttgaatttgctgctcggtgttcctggaaatagagattcagataaatcacatgaagttcatcccttggtgtggaaatggctagagatgtttttgaaaaagcgatttgattgggatcttcacaggttgaattacaaagatgtgaggaaatttgcaattctccgtggcttgtgtcacaaggtgggaattgagcttgttccaagggattttgatatggattctcctattcccttccacaaatctgatattgtcagcttggtccctgttcacaagcaagctgcatgctcatctgcagatggaaggcagctcttggagtcatccaaaactgctttggacaagggaaagcttgaggacgctgttacctatggcacaaaggctcttgctaagctagtagcagtttgcggtccctaccatcgaatgacagcaggagcatacagcctgcttgctgtagttttatatcatactggagacttcaatcaggctacaatatatcaacaaaaagctttggatatcaacgagagagagttaggtctggatcatcctgataccatgaagagctatggggatcttgctgttttctattacagactacaacacacagagctggctctgaagtatgtgaagcgtgctttatatcttctgcatctaacatgtggcccatctcatccaaacactgctgctacttacattaatgtggctatgatggaagaaggtctgggaaatgtgcatgttgctctcagatatcttcacaaagctttaaagtgcaaccaaagattacttggcgcagatcatattcagacagctgcaagttatcatgcaatagcaatagcactctcattgatggaagcatatccattgagcgtgcagcatgagcaaacaactttgcaaattctgaggtcaaaacttggtcctgatgacttgcgaacacaggatgctgcggcttggctggagtattttgagtccaaggcttttgaacagcaagaagctgctcgaaatggtactcgaaaacctgatgcatcaatagctagcaaaggccatttgagtgtgtcagatttgcttgactatattaatcctaatcatgatactaaagggagagatgcagcaacaaagagaagaagccagataacaaaggtgagagcgacatcctaccttaaccttggcatgtcaagttctgatgagtcttcaaaagaaattcccaaagaggcttcagatgaagaggtacaaatacctgtagctgaaggtagtgcagattctgagcaggaaagcaactctggacctgactcagaacatactattttaaaacaaataccagatgaaaagccgcaaatttatgatgaaatattgtctgaagcacatgctgaaggagaagatggatggcaaccagttcaaagaccaagatcaactggttcatatggccggagactgaagcagagacgggcaacacttggcaaagtttatagttatcaaaagaatgtggaagttggcacagaatctccttttgtaaggaatgctagtccaaatagtaggtattatttcttgaagaagcggccaatttcccatgggggttatactggtgatcatacagtaaacatcacccaaggccctaaatttggaaggaaagtagttaaagctcttacatacagggtcaaatccataccctcaacttccaaggctagtgcaaatgagacgttagaaacaggtgacaagctgtttagttctgtttcagaacctgatccaattgatgttaatccagttaagaattctatagttagtcttggaaagtctccttcatacaaggaagtggccttagcacctccagggacaatctccaagtttcaggtctataatcctccaagtgagatttctgttagctgtgaacatgatggtggcaaacctgaagaggaagatattgaagctaataggaatgttaatccaaccccggcagaggcaaatgatatggataaaggcaagagtaataattctgtttctagttctgttgatggttcacaggatgatactggagttactactgaggggaaagaggaaactcagttgattgttgctgtgcaagataaatgtatgaatgctgaggggaaattaggagatgttgaagctcaaggagcaatcgataatagcagttcgattcaggaagtagatgatcatgtggattcttccaaaaaagaactcgatgcaagtaatttagctggcagtttggaacctagtgataatacaaatcccatttcccaaggtggcaaggatttaagggtcgatgtgtcatcatcaaatcagagtcacactgggggcatcccgtataagaaattgtctgcatctgcagctccattcaacccatcgcctaccattgcacgtgctccatcaattgccatgaatatgactcttccttctggtcccagtgtagtgcctggaattggcccctggccagtaaacatgaatgttcatcctggacctaccactgtgctacctgcagttacccccatgtgctcctctcctcaccatgcatatccatcgcctccaactacaccaaacatgatgcaaccactgccatatatgtatcctccttatactcaacctcaatcaatgccacctggcagctttccggtcactagcagtgcctttcatgcgaatcattttacatggcaatgtaatttgaaccccacagtatctaagtttggtcccggtgctgtttggcctggttgtcatcctgtggaatttcctcttccgttacctattgttgaaccaatccctgatcccatttcagagtcacaagttccgtgtaatggttctgaaagtccaagttcagcttcagttcttcctgaggacattgataatattggtgattctaatcaattggtgaaaactttagtatcagacactagtgaagatgaagcagtgagagctggttcagaaagtgtaaaagaaaatggtgatatgaatttacatgggactgaaaattctgggaacgagcaaaatcaaaacattggttctaatggaaactctagcagtggtgaaacaaacatggatggtgagaaaaccttcagcattttgattcgggggagaagaaatcgaaagcagactctaagaatgccaataagtttgcttactcgacctaatggctcacagtcatttaaggttatttataaccgcgtagttagaggaagtcatgcttccaagtctatcaatctctcgtctagtaaagattgtactgctactgcttgatgcacagttctatgttgttactgatgaaatttatcagaactatcatggataaagaagacctcataattttgcgtaagaggtgtttgctatttctatgatttctggaattcagttacaaaatgccctgcagtatcagcttcaaatttatagctgcactatcatttgcaaggtttctggatacctgtctctctttaggatggaggttgaaggtctctctttaggatggaggttgaaggcatttcttcatcaataaacgttacccgtggagcaccattcatgctaataatgttgctcaggttcgtcggagtcagtttcagggtgaggcaccttcaaggtgaaaattttggtattttgtacttagacaattttgatataatgaattacgggatggtggaacgttctaattactacttttttgttagaacattacctttggttttgataattaattttgttcaattgtatattctttcttaatttcttaatatcttgttaggtaa

SEQ ID NO: 3500 - DNA, 6473 bp, Cicer arietinum
gttctaaaaaatagagcgtgtttgctaccttatatataaaaaaagtgttattaggataattgatgtatatatataccctgcaaattgataattaacctgtataagcaagcagccataaaatgccaatctatgattctgaccattgaatctcagcccttccttccttatcataccacactccactctatatctttctccttccttctcttatttttcttcctcattctttatcctttctcaaatgttcttgcacacttcattatcctcattctgaactaccccatttctctcaaaacataatcactctttttcactttatttgtactttattatacactcatcaataacacattaaagacccttctatctctttctctattatcttcaataagcacctgctttttattctttggaattgaaaatggcaccaagaaacagccgcggaaaggccaagggagagaagaagaagaaggaagaaaaggttcttcctgttgtcatggatatcacagtgaaccttcctgatgaaactaatgttgttctcaaggggatatcgacggataggataatcgacgttcgtcggctattatcggtgaatacagagacgtgttatctcaccaatttttccttatcacatgagataagagggatacgtttgaaggatacggtggacgtgtccgcactcaaaccatgcctcctcactttagttgaagaggattacgaagaggatggagcggtggatcacgtgcgaagactcctggacatcgtggcctgcaccaccagcttcggtccgtcgtctcctccgaagaacgcggcgaagtcgagcaaatctcaaccgcctccggcgaagcaatcaccgaaagacgctgcagcggcggacggagacggagagataagtcactcgtgccctaagctggagagcttctacgagtttttctcactgtcacacctcactgcgcctctccaatatgtgaagaaagcttcgaagcgaaatgtggaggagatatcggaggcggatcatctcttctcgctcgatgtgaaggtgtgtaatgggaaagtggtgcacgttgaggcttgcagaaaggggttttatagcgttgggaagcagaggattctgtgtcataatctcgttgatttgttgagacagattagcagagcttttgacaatgcttatgacgatctcttgaaggcattttcagaacgtaacaagtttggaaatctcccttatggcttcagagccaacacatggcttgttcctcctattgcagcacaatcaccatcattttttcctcctcttcccgtggaggatgaaaattggggaggaaatggtggtggtctcggaagaaacggagagtatgatttgattccttgggccaataagttttcttttattgcatctatgccctgcaaaacagcagaagaaaggcaagttcgtgatagaaaagcatttcttctgcacagcttgtttgttgatgttgccattttcagagcaattagggctgttaaacatgttttggaagagcccaattttagctgttcagtagcagaaaatgaaatttacagtgagagagtaggtgacttgagtgttagagtcttgaaagatggctctgttgcaaactttaagattgattctaaaattgatggagttgaagctacaggagtaaatcaaaaggatctagtcgaacggaatttattgaaagggatcactgcagatgaaaatactgccgcccatgatattaccactttaggtgttgtttacgtaagatattgtggttatgtggttgttgtgaaagttgaaggtgtaggtgatgaaaaagtcaattcttcatctcatcaaaatagtgaattgtttgatcagccagagggtggtgccaatgcactaaatattaacagtttaagatttcttcttcacagcacagccctgccggagaacaataaacagatgactgagatacaaatgtttgagggtgaagagcttggtggtaccgatacttttgtggaaaagctgattaaaaatagtcttgctaatcttgaggaagaggaactgagttcggactattttgtaagatgggaacttggtgcttgctgggtacaacatttgcaagatcaaaacagtacagaaaaagataagaaaccatcttcggagaagactagcaatgaaatgaaggtcgagggtcttgggaaacctctcaaagccctcaagaataataataaaaagaaatctgattcaagcaatcctaattttgcatctgaatcttcaaaatctaatctcgaggctgaaaaggctgcattgtcctcaagtgaaacccagcatgaaactacagctgctgagaatgagcttgtgctaaaaaggatgttatctgaggcagcttttacccggttgaaagaatcaggaactggacttcactgcaagtctatacaagatttgattgacttatctcagaaatattacatggatgttgctatcccaaaactggtagcagattttggctcattggagctctctccagttgatggacgcacgctaactgattttatgcataccaggggtttacgcatgcgatctcttggacatgttgtcaagctttctgaaaaactttcacatgtgcaatcactgtgcattcatgagatgatagttcgagctttcaagcacatcctgagggcagtgatttctgctgtggttgacaaggagaaaatggctttatcaatagctggtgcattgaatttgctgcttggtgttcctgaaaataaagaatcagataaatcatgctatgtccaccctcttgtatggaaatggttagagttgttcttgaagaaacggtttgactgggatcttaacaggttgaactataaagatgtgaggaaatttgcaattttacgcggcttgtgtcacaaggtgggaattgagctcgtaccaagggattttgacatggattctccatttcccttccaaaaatctgatattgtcagcttggttgcagttcacaagcaagcagcatgttcatctgcagatggaaggcagctcctggagtcatccaaaacagctttagacaagggaaagcttgaagatgctgttacctatgggacaaaggctcttgcgaagcttgtagcagtttgcggtccctaccatcggatgacagcaggagcatacagcctccttgctgtagttttatatcatactggagacttcaatcaggctacaatttatcaacaaaaagctttggatatcaacgagagagaattaggtttggatcatcctgataccatgaagagctatggggatcttgcagttttctattacagacttcaacacacagagctggctcttaaatatgtgaagcgtgctttatatcttttgcatctgacatgtgggccatctcatccaaatactgccgcaacttacattaatgtggctatgatggaggaaggtctgggaaatgtacacattgctctcagatatcttcacaaagcattaaagtgcaaccaaaaactacttggtgcagatcatattcagacagctgcaagttaccacgcaatagcaatagcactctcgttgatggaagcatatccattgagtgtgcagcatgaacaaacaactttgcaaattctgagggcaaaacttggccctgatgacttgcgaacacaggatgctgcagcttggcttgagtattttgagtccaaggcttttgaacagcaagaagctgctcgaaatggtacaagaaaacctgatgcatcaatagctagcaaaggccatctaagcgtgtcggatcttcttgactacattaatcctaatcatgataccaaaggaagagatgcagcagcaaagagaagaaaccaggtgagagcaatatcctatcagaacaatgtttcagcaagttctgacgagtcttcaaaagaaattcaaaaagaagcttcagatgaagagttacctatacctgaaccaggaggtggtgcagattctgagaatgagagcaactcggcacctgattcagaacagccaattctagaaaagatctcggatgaaaagccacaaacttctaatgacttattgtccgaagcacttcctgacggagaggatggatggcaatcagttcaaagaccaaggtcggctggctcatatggtcgaagactcaaacaaagacgagcaacacttggcaaagtttatagtcaccaaaagaatgtggaagttgggactgaacatcctttggtaaagagtgctaataaggaaaatagtaggtattatttcttgaagaagcggacaatgtaccatgggggttatgcagataatcgtgctgtaaacatcagccaaggcactaaatttggaaggaaagcagtcaaggctgttgcatacagggtcaagtctacgccctctgcttctaaagctattgaaaatgagacattagaagttggtgacaaagaacctgattcaatcgatgttaatccagttaagacatctatagttagtcttggaaaaagtccttcatacaaggaagtagccttggctcctcccgggacaatctctaagttgcaggtctataatcctcaaagtgagatttctgttagtcgtgaacatgatgaaaaacatgaagaggaagatattgaagctcaccgaaatattaatccaaccccaaaagaggcgaataatgcggttaaagagaagtatgatgattctttgtcagattctatagaagattcacaagatgatactttagttgctactgagaagaaagaagaaactcagttgaataaagttgtggaggataattgtgtggctactgaggggcttgaatctggggacattgaagcacaaggagctgttgttaacagcatagtgattaatgccgtagaggatcctgcagactcttacaaacaagaatttgttgcaagtaattcgccttgcagttttgaaccttgtaataatacaaattctggttcaaatggtggtgaggatttaggagtcaatatatcatcatctggtcagagtcatgctgggggcatctcatataagaaattgtctgcgtcagcagctccattcaacccatcaccagctattgcacgtccagcacctattgccatgaacatgactcatccttctggtcccggtactggtccagctattggacactggccagtaaacatgaatgttcaccctggacccgttgttaacccaatgtgttcctctccacaccatgcttatccatcacctccaacaacaccaaacatgatacaaccattgccattcatgtatcctccttatacccaacctcaatcagtacaaaccagcaactttccggtcactagcaatgccttccatgctaatcattttacatggcagtgtaatttgaaccctgtcatagctaagtttggtcctggtgctgtttggcctggttgtcatcctgtggaatttcctcgtccagtacctattgttgaatcaatccctgatatcatttcagaagcacaagtgcagtgttctacagttgagagtccaacttcagcttcagttctgcttgaagacattaataaggttgtggattctagtaaagaggtaaaaacttcagcatcagagatgagtgatgatgatacagtgagagttggttcagaaagtataaaagataacggcaatccaaattttcccgggaccgaaaatgctgggaatgagccaaatcaaaacactggcttgaatggcagcactagcaatagtgaaatgaacatggatggtgagaaaacattcagcattttgattcggggaagaagaaaccgaaagcagactctcagaatgccaataagtttgcttacccggccccatggctctcagtcatttaaggttaactataaccgtgtagttagaggaagtgattctcccaggtctatcaatttctcttctagtgaacattgtacagctactgcttaagccacagtactttgttgttgctaatgaaatgtagcagttattatggaaatagaagacctctacctcaaaagttctcatgaaggatcgcggtatatcatcatttgtggattcaattacaaattgctctgccttatgagctccattttatagtttcaccatgccactatcttttgtgagcttttcgatatatctatttaagatggaggtttagatgcttttcttgaaattaagcattcacgcttatcatcttgctcattctacgggttcattgcagttagttttggggtttcagaggcaccttcaaggtgaatttttgttttttttatgtagttagacaattttgataatgaattacgggaccgagagatcattagtaattattattattttgttaaaccattttcaatggttttgataactaatttggttcatttgtatatacattcacattattttgttaggtgataatggttctactttgttggttgacttgttattgaattattacaactgaaataatgtgaaggaacatattcacgaagatcattgattgttacttttgtag

SEQ ID NO: 3501 - DNA, 6031 bp, Lotus japonicus
ttgaaaatggcaccaagaaacactcgcggaaaggctaagggtgagaagaagaagaaggaagaaaaggttcttccagttgtgatagatgtcactgtgaaccttgtcgatgaaactcaagttgttctcaagggcatatcaactgatagaacaatagatgttcgtcgacttttaacagttaatacagagacatgtcatatcactaatttctccctatcacatgaggttagagggcctcgtttgaaggattcggtggatgtttccgcactgaagccctgcttcctcactctagtggaagaggattacgatgaagaacgagcggtggctcacgtccgaagactcctcgacatcgtcgcctgcaccaccaccttcggtccgtcgtcgacgccgaagaatgccgccaccaccgcgccgaagtccaaacctccgccggccaatccgtcaccgaaagatgccaccgcggcggcggcggcagccgcagcagacggagacggcgagataagccactcttgccctaagctggacagtttctacgagtttttctcgctttcgaatctcactgcaccgatccaatatgtgaagaaagcttcgaagcgccacgtggaggagatagcagaggctgatcatctgctttcgctcgatgtgaagctgtgtaatgggaaagtggtgcatgttgaagcttgcagaaaggggttttatagcattgggaagcagcggattctgtgtcacaatcttgttgatttgttgagacagcttagcagagcttttgaccatgcgtacgatgatctcttgaaggcatttctagaacgcaacaagtttgggaatctcccctatggcttcagagccaacacatggcttgttcctcctattgcagctcattcacaatcagtttttccttctctccctgtggaggatgaaacttggggtggaaatggtggtggtcttggaagagacgggaaatttgatttgattccttgggccaataaattttcatatattgcatctatgtcttgcaagacagcagaagaaaggcaaattcgtgatagaaaagcatttctactgcacagcctgtttgttgatgttgccattttcagagcaattagagctgttaaacatgttatggaagagcacaattttagctgctcggctgcagaaaatggaattatttacactgagaaagtaggtgacttgagtatcagaatcttgaaagatggttctgtggcgagctgtaagattgataccaagattgatggagttgaagctactggagtaaatcaaaaggatttattagaacgaaatctactgaaaggaatcacagctgatgaaaatacagcagctcatgatattaccactttaggtgttgtcaatgtaagatattgtggttatgtggttgttgtgaaagttgaagatggaggctctgaaaataacaattctccatctgatcaaaatgatgaattgtttgatcagccagagggtggtgccaacgcactaaacattaacagtttaagattacttcttcacagcacaacccaaccagagaacaataagcagatgactcagacacaaatgtttgaagagcttagtggttccaatgcttttgtggagaaactgattaaagaaagcctttctaagcttgaggaagaggaactgggtttggactatttcgtaagatgggagcttggagcttgctggatacaacatttgcaagaccaaaacagtgcagacaaagacaagaaaccatctttggagaaagctaagaatgaaatgaaggtcgagggtcttgggaaaccgctcaaggccctcaagaataataaaaagaaatctgattcaagcaatactatgcttgcatctgaatattcaaagcctaatcaggaggttgaaaatgctccattgccctcaattgaatcccagcctgataccactgcagctgataatgaacttttgctaaaagggatattatctgcagcagcttttatccgattgaaagaatcaggagctggacttcactgcaaggcaagtcttctagatttgatcaacttatctcggaaatattacctggatgttgctatccctaaactggtagcagattttggctcattggaactctctccagttgatggccgcaccctaactgattttatgcatactcgtggtctacgcatgcaatctcttggacatgttgtcaagctttcggaaaagctttcacatgtgcagtcactttgtattcatgagatgatagttcgagctttcaagcacatccttagggcagtgatttctgctgttgttgacaaggagaaaatggctacatcaatagctggtgcattgaatttgctacttggtgttcctgaaaatagagaatcagataaatcatgcgaacttcaccccattgtatggagatggctagtattgtttttgaagaaacggtttgactgggatcttagcaggttaaattacaaagatgtgaggaaatttgcaattttacgaggcttgtgtcacaaggtgggaattgagcttgctccaagggattttgatatggattctccatttcccttccaaaaatctgacattgtcagcttggtcccagttcacaagcaagcagcatgctcatctgcagatggaaggcagctcctagagtcatccaagacagctttagataagggaaagcttgaagatgctgttacctatgggacaaaggctcttgcaaagctggtagcagtttgtggtccctaccatcggatgacagcgggagcatacagcctccttgctgtagttttatatcatactggagacttcaatcaggcgacaatttatcaacaaaaagctttggatatcaatgagagagagttaggtctggatcatcctgataccatgaagagctatggggatcttgcagttttctattacagacttcaacacacagagctggctctgaagtatgtgaagcgtgctttatatctgttgcatctgacttgtggtccatctcatccaaatactgctgcaacatacattaatgttgctatgatggaggagggtttaggaaatgtacatgttgctctcagatatcttcacaaagcattaaagtgcaaccaaagattacttggtgcagatcatattcagacagctgcaagttatcatgcaatagcaatagcactctcattgatggaagcatacccattgagtgtgcagcatgagcaaacaactttgcaaattctccgaacaaaacttggccctgacgacttgcgtacacaggatgctgcagcttggcttgagtattttgagtccaaggcttttgaacaacaagaagctgctcgtaatggtactcgaaaacctgatgcatcaatagctagcaagggtcatctaagtgtgtcagatcttcttgactacattaatcctaatcacgattccaaagggagggatgcagcagccaagagaagaagccaggtaacaaaggttaaggcttcaacctaccagaacattggctcagcaagttctgatgagtcttcaaaagaaattcaaaaagaggtttcagatgaagatgtacctatacctgacccaggaggtagtgcagattctgagcctgagaacaactctgcacctgactcagaagagcatatttgtgaaaagatatctgatgaaaagccacaaatgtctggtcaaatactgtctgaagctcctgctgatggagatgatggatggcaacctgttcaaagaccaagatcagctggctcatatggtcggcgactgaagcagaaacggcttggaaaagttcataattatcagaagaatgttgaaactagtgcagaataccctttgggaaggagtgataatcagaatagtaggtattatttcttgaagaagcggtcaatgtaccatgggggctctgcagataatcatgctttcaacatcacccaaggctctaaatttggaaggaaagtagtcaaagctgttacatacagggttaagtctatgccctcagctcccaagactgcttcagatgagacattagaaattggtgacaagcaactaagttctcattcagaacttgattctaatgatgaccatccaattaagacttcagtagttagtcttggaaaatctccttcgtacaaggaagtagcattggctcctccggggacaatctccaagttccaggtctataatcctcaaagtgagattcctgaatgccgtgaacatgatgttggaaaacataaagaggaagatgttgaagctcataaaagtattaatccaaccccgaaggaggtaaatgatatgtctcaagagaagtgtgatgatcctttatcagattctgtagatgatacacaagatgatattgtggttgctcctgaaaagaaagcggaaagtcagttgattgaagttgtacaagaaaattctgggagtgctgaggtccttgaatctgtggatgttgatgctcaaggaacagatgataatagcatagtgattgatgctgtacagaatcatttggagtcttacaaacaagaacctaatgcaactaattcatctggcagttttgaacctagtgatgatacaaagtccaattcaccaggtggtgatgattcatcatcaagtccgagtcatgccggggtcatcgcctataagaaattgtctgcatctgctgctccattcaacccgtcacctgccattgcacgtgctgctccaattgccatgaatataactcatctttctggtcctggtcctgttcctgctattggcccctgggcactaaacatgccgggacctgctactttgctacctgcaggtaccccaatgtgttcctctccacaccacgcatatccatcacctcccacaacaccaaatatgattcaaccattgcctttcatgtatcctccttttacccaacctcagtcaataccaaccaacaactttccggtcagtaatgcctttcatgccaatcattttacatggcaatgtaatttgaaccccgccatatctaagtttggtcccagtgcagtttggcctggttgtcatcctatggaattttctcatccggtacctattgttgaaccaatccctgatatcatttcagagccacaagtgcagtatcatgcagttgaaagtccccgttcagcttcagttctgcctgaggatattgataacataggggattccaataaagagataaaagctttaacatccgaggcaagtgaagatgaagtggtgagagctggttcggaaagtataaaagaaaatggtaatccaaattttcctgggacagaaaatgctgagaacaagccaaatctaaacattggctcgaatggcagcagtagcagcagtgaaacaaacatggatggtgagaaaacattcagcattttgattcgaggaaagagaaaccgaaagcagactctcagaatgccaataagtttgcttacacggcctcatggctctcagtcgtttaaggtcatatataaccgtgtagttagaggaagtgatgctcccaagtccatcaatttctcttcaagtaaacattgtacagctactgcttaactcacagttcttcattgttactaatgaaatatagctgagttattgtgtgcaaagaagaaccagtcgacataatttctcatgaaaggaacgtggtatatcagtcattcgtggattcaatcacaaatcaccctgccttcgcatcttagtttttttgctgcactgtcttctgagagatgtttccatttaatattagaggattggagacttttcttcaatttaagtctgcaggttactgctgtctgttttggggtttcggaggcaccttcaaggtgaaaattttggttcttcatggagttagacagtttttgatataatgaattacgagaccgagactttctaatcattattattctttcttgctacaccatagtcgatggttttgaattttgataattaattcggttcaattgtatatacattcttaatatttggttgacttgttattgaattgttccaactggaataatgtgaaggaacatatcaatgaaaatcactaattgttggtttaggt

SEQ ID NO: 3502 - DNA, 1692 bp, Zea mays
cgggggagcaggagagggggagaggccaagaacccagccgcgaagccaagcccatctgatccggcccctgctgccctgccccagctcgtctctcaggtcgccttgccgttgccggttccgcgcccggctcagagtcgcgagctcgtctcgcagatccggcttcgcttgcttgaattctgttctttgggagcaaagaggtgctggccggtggcgtggcttggtgctctggggccggcgagttttttttgcgtccgctcgctctgcctgtagtcttcttgctgcggcggcggggtggagatgggggtggcgggggagaagttccagctggggacggtgggggcactcagcctctcggtggtgtcctccgtctccatcgtcatctgcaacaaggctctcatgagctcccttggcttcaacttcgccactactttgacaagctggcatctcctggttacattctgttctctccatgtggcattatgtatgaagctgtttgagcacaaacctttcgatgcaaggactgtcatgggattcggagtgctcaatggcatatctattggacttcttaacttgagtctgggtttcaattctgttggtttctatcagatgacaaagctggccataattccctgtactgttatactggagacccttttcttccggaagaaatttagccggaatatcaagctttcccttagtgtgctccttcttggtgttggtgttgcaactgtaactgatctgcaactcaacgttatgggatctgtactgtccctactggcaatcatcacaacctgcatcgctcagatcatgacaaatacaatacagaagaagttcaaggtatcttcaacacagctcctgtaccagtcatgcccataccaggcattgacgttgttccttgtcggtccattcctcgatggatttttgaccaaccaaaatgtctttgctttcgactacacaactcaagttctgtttttcatcgtgctgtcgtgcctgatttcagtctcggtgaacttcagcacttttctcgtgatcgggaagacgtctcctgtaacctaccaagtccttggccatctgaaaacatgcttggtcctcacctttggctatgtcctgcttcacgacccgtttagctggagaaacatacttgggatcctaatcgcggtaatcgggatggttctgtactcgtacttctgcactagagagactcagcaaaaaccagcagaagcctccccgcaagccgttcaggcaaaggagggtgaatcgaacccgctgatctcggactccctgagcgctgccgaaaatggaggcagtgccaccgacgatgaacctctgaaggtaccaatgtggagctcgaagtactcgaaggcgtgaagtggctgttctggtattagtgcacacggtgctatacagaattcagcgtggtaggcagatactagggttggaaggcaaccctgttcctgttccatttttggccttctattttttcttcttcctggcacaaatactataaatatgtgctgtcagtaaatggatctcactcttgagaggaatacctcagctcgagaccgagtgttctgttctgcctgaaagctagtatttgtttgtgctccactccacgtgtaaagtggtagatggacatgatctcaacagtagtagtttgcattcttttgtactagtgatatacaatatttatgt

SEQ ID NO: 3503 - DNA, 1680 bp, Zea mays
tctcgtctccctcctccccgttccttattcgccagaccggagggaggggtacgagcttcaccgctttcatcccgcccgcgctcctccccagatctcgtctccattaaagccgaccttgcccagattcgcgccctcctcgctcatatctgaaagcggctctgattttccaagccgaccgcaggagcggtgcaccgggccgcgtgattccggcggcttgatttggaatttgtgatctttcggggcattcgtcggtttgtctgtcggtgacggtggtgctgcgtttcgagggcagcgaagatgggtgtcggcggagagaagttccagctggggacggtgggggcgctgagcctatccgtggtctcctccgtctccattgtcatctgcaacaaggccctcatgagctccctcggctttaacttcgccactaccttgacaagctggcatctgctggttacattctgctcccttcatgtggcattatggatgaaattctttgagcataagccttttgattcaagaactgtcatgggatttggagtacttaatggaatctccattgggctcctcaacttgagtcttggcttcaactctgttgggttttaccagatgactaagctggcgatcatcccgtgcactgtcatcttagagacacttttcttcaggaagaagttcagtcggagtatccagatgtccctttctgtgctccttcttggtgttggtgttgcaactgtcactgatctgcaactcaatgctgtgggatccatactctccttgctggcaattatcacgacttgcattgctcaaattatgacaaacactatccagaagaagttcaaggtctcatcgacccaactgctctaccagtcttgcccttatcaatcactgaccctgtttctcattggccccttccttgatggctttttgactaaccaaaacgtctttgcttttaattatacatcacaagttgtgtttttcattgtgttgtcatgcctgatatcggtctcagtgaacttcagcacttttcttgtgattggaaagacgtctcctgttacttaccaagtcctgggccatcttaaaacatgccttgttcttacctttggttatgttttgcttcatgacccatttagctggagaaacatacttgggatcctaattgcagtagttggaatggtcttatattcatacttctgcacagtggagacccagcataagaacactgaagtctccccacagcaggtgaaagaaagtgaggcagcccctttgatctcagactctttgagcaaagttgaaaatgggggcggtgttgttgatgacgagcctttgaaggtacccatgtggagctcaaagtattcgcgggagtgaaattttctcccgctagacggtggcatcatacaggattcagtttagtaggcagatagtagggttggaagccaacccagagtgtaatgaacatttgagttacattttttggccttttttagcgtcacgatctactactggtaaaagggtctgtttcttgggaggatcttaccttcaagattgccagatatacattgaaactagacggcagatattgtatgattgtatctggacatgttccacatcgtctaactgtaacttccaactggtacatggcatgcctatatccaaagatagatttctttttttttgtatcagaaa

SEQ ID NO: 3504 - DNA, 843 bp, Arabidopsis lyrata
cctccacgtcgtttccaaattccaaaaccaaatgtcgactgtgagaaaaatcactctaaaaagctccgatggcgaaaacttcgaaattgacgaagcggtggcactagaatcacaaaccatcaagcatatgattgaagacgactgtgccgataatggtatccctctccctaatgtcaccagcaagatcctttcgaaggtgattgagtactgtaagaaacatgtcgaagctgctgcgaaatccgaaaccaccaccgaagctgctgctactactaccaccgtcgcgtcgggttctagtgacgaagatcttaagacttgggattctgagtttatcaaagttgatcagggcactctcttcgatcttatcctggctgctaactacctgaatatcaagggactgttggacttgacctgccaaacagtggccgatatgattaaaggtaaaaccccagaagaaatccgcaagactttcaatatcaagaacgacttcacgccagaagaggaagaagaggttcgccgtgagaatcagtgggcatttgaatgaataaaaatgaaaacctggttgctgtcttgtcctcgacccctttgtgtctctctgtcttgtcttttttctttgactatatatccattctgttctctgtgttggtccagctaagttattgggtcggatgttatgttatgaatgttaaaattcaatacttaactaccaaacatattgaagttgttgctcaaaagagagtgttggtctggtcttctattaattcttcaatcatttagataggttgtgagcacaagtgataagatttgtctgccttgtctcaaaaaagaaaatattttattacttgt

SEQ ID NO: 3505 - DNA, 851 bp, Arabidopsis lyrata
ctcactggttcaatgtgtgaaccggctttaaaaacattgattaaacttggtttttcacatatatatctctcgtttccacaaatctcctccacgtcgtttccaaattccaaaaccaaatgtcgactgtgagaaaaatcactctaaaaagctccgatggcgaaaacttcgaaattgacgaagcggtggcactagaatcacaaaccatcaagcatatgattgaagacgactgtgccgataatggtatccctctccctaatgtcaccagcaagatcctttcgaaggtgattgagtactgtaagaaacatgtcgaagctgctgcgaaatccgaaaccaccaccgaagctgctgctactactaccaccgtcgcgtcgggttctagtgacgaagatcttaagacttgggattctgagtttatcaaagttgatcagggcactctcttcgatcttatcctggctgctaactacctgaatatcaagggactgttggacttgacctgccaaacagtggccgatatgattaaaggtaaaaccccagaagaaatccgcaagactttcaatatcaagaacgacttcacgccagaagaggaagaagaggttcgccgtgagaatcagtgggcatttgaatgaataaaaatgaaaacctggttgctgtcttgtcctcgacccctttgtgtctctctgtcttgtcttttttctttgactatatatccattctgttctctgtgttggtccagctaagttattgggtcggatgttatgttatgaatgttaaaattcaatacttaactaccaaacatattgaagttgttgctcaaaagagagtgttggtctggtcttctattaattcttcaa

SEQ ID NO: 3506 - DNA, 864 bp, Linum usitatissimum
aaactaaaggtccataacctagccctcttccttcaatcgcgaagatcttcgccggagaatcaagctagtagaaacccagagatgtcgactgccaggaaaataactctcaagagctccgatggggagacgttcgaggtagacgaggcggtagctttggaatcgcaaaccatcaagcacatgatcgaagacgactgcgccgataacggcatccctctcccgaacgtcaccagcaaaatcctctctaaggtcatcgagtactgcaagaggcatgtcgaggttgctgccaccaagaccgaggatcgccctaccactgcggacgacgatctcaagaattgggacgccgaattcgtcaaggtcgatcaggccactctcttcgatctgattctggctgcgaactatctgaacatcaagagcttgctagacctaacttgtcagacggtggctgacatgataaaagggaaaactccagaggaaatccgcaagactttcaacatcaagaatgacttcacccctgaggaagaagaggaagttcgtcgagagaaccaatgggcatttgagtgattaatctctccacaggaggccattgtcttactccaccgcttcccctctttcttattcttagtttccctcctacgaattgtacttccagctttgtgttttcctcgatgaacaatcatccttctaccagacagacagcttcaatcgttgtgatatatgtataactttgatgtttccctaatcggggtttgctgtgaatatgctttatctctgatcttttctcagtcatcttttaccttgtctgtatagctactaagtgtgttttctggtgatggtttcatatgatgggtgggctctttgtttctg

SEQ ID NO: 3507 - DNA, 872 bp, Cleome gynandra
gggggaaaataattgctatattaaacctacgtttcaaagcaaaaattacgtattatacctatttcccgtttctctctctctctctctcgatcgaatcctcatcttctgcgctcgaacctgtttatcagaaactatgtcggggagaaaaatcacgctgaagagctccgatggtgagacttttgaagtcgacgaagccgtcgctttggagtcgcaaaccataaagcacatgatcgaagacgactgcgccgacaatggaatccctctccccaacgtcactagcaagatcctctcgaaggtgattgagtactgtaaaaagcacgtcgacgctaccgctaagtccgaaaacgctgctgcctccaccgacgacgatctcaagaactgggacgccgagttcgtcaaagtggaccaggccactctgttcgatctcatcctggctgctaactatctgaacatcaagggtctattggacttgacctgtcagactgtggccgacatgatcaaaggtaaaactccggaggagatccgcaaaacattcaacatcaagaacgacttcaccccggaggaagaagaggaggtgcgccgtgagaaccaatgggcatttgagtaaagcaaaaaacggtaatcagaaccgtcatgtcctgtcttgctgtcactgttcgtctatctccaatattttagtattaagacttccccttagtatatctccctgtgttccttatctcacatatcttctctttatgtctggcatctctgtcttctggtctctgtcttctgtcgttgcgtcttctgttgtggagcttctttggatctaaagctatattgttaatatgactgttatttccgttttaataatcatcggctgctgtagtgtt

SEQ ID NO: 3508 - DNA, 893 bp, Cleome spinosa
tcggggtatatacatctaagtaaaatacggtattcacatcaccggtttctctctccctctctcgatctcgatctcgatcgattcctctcctcttcgtaatctctgtggatcaaaagaccatgtcgggaagaaaaatcacgctgaagagctccgatggcgagacctttgaggtcgatgaagccgtcgctttggagtcgcaaaccatcaagcacatgatcgaagacgactgcgccgacaatggaatccctctccctaacgtcaccagcaagatcctctcgaaggtcatcgaatactgcaagaagcacgtcgacgccgccgctaagtccgaagccgccgccgccgccgaagaagacgttatgaagaactgggacgccgagttcgtcaaagtggaccaggctaccctcttcgatctcatcttggctgccaactatctgaacatcaagggccttctggacttgacctgccagaccgtagccgatatgatcaagggtaaaactccagaggagatccgcaaaaccttcaacatcaagaacgacttcaccccggaggaagaggaggaggtgcgccgtgagaaccaatgggcctttgagtaaaggtgaaagaccaaccgagaaaaccgaaagaaaaaaacggggtgtgcccgattgtctatctccgccatattagtaatctacaagacttcaccctcagtagtacaatctctgtgtttgttcgtcgcacattgtttctgtttacgtctgttgtgttgattctctctccctctccttctccctctccctcactcgcaacctgtcacgggttgtgagatgctgcgtcggatgttatgctatgaatgttgaatgacttgttttccatttcgataaccatctttcgtaataaccattatgaatgta

SEQ ID NO: 3509 - DNA, 708 bp, Cleome spinosa
tcggggtacgggttattctttcttctctcgattcttcctcctcttcgccttcctgtgtccgtgaatcagaaaccatgtcgggaagaaaaatcgcgttgaaaagctccgacggggagacgtttgaggtcgatgaagccgtggctttggagtcgcaaaccatcaagcatatgatcgaagacgactgcgccgacaatggaatccccctcccaaacgtcaccagcaagatcctctcgaaggtgatcgagtactgcaagaagcacgtcgacgcttccgttaagaccgaaaccgcaactacctattccaccgatgacgatctcaagaactgggacgccgagttcgtcaaagtggaccaggccaccctcttcgatctcatcctggccgctaactatctgaacatcaaggggctattggacttgacgtgtcagactgttgcggacatgatcaaaggtaaaactccggaagagattcgaaaaacattcaacatcaagaatgacttcaccccagaggaagaggaggaggtgcgccgcgagaaccaatgggcctttgagtaaagaagaaaaaaccaaccaattctctctatctctacaagactttctccttggcagtaacctatctatgtttgtcatctcacatttcttccctttacgtctgtgttgtttgcatcttctgtaccatctctccatcacggcttgcgagatgctgcttcgg

SEQ ID NO: 3510 - DNA, 862 bp, Linum usitatissimum
gatcctcgccaccgttctctctccaatatcaccaaggtaaacgaaaggtcggtttcctctacctagccctcttccttcaatagctaaaatctttgccggagaatcaagctagtcgagagccagagatgtcgactaccaggaaaatcactctcaagagctccgacggggagacgttcgaggtggacgaggcggtagctctggaatcgcaaaccatcaagcacatgatcgaagacgactgcgccgataacggtatccctctcccgaacgtcaccagcaagatcctctccaaggtcatcgagtactgcaagaggcacgtcgaggttgctgccaccaagaccgaggatcgtcctacctctgcggacgacgatctcaagaactgggacgccgaattcgttaaggtcgatcaggctactctcttcgatctgattctggctgcgaactatctgaacatcaagagcttgctagacctaacttgtcagacagtggcggacatgataaaagggaaaactccagaggaaatccgcaagactttcaacatcaagaatgacttcacccctgaggaagaagaggaagttcgtagagagaaccaatgggcatttgagtgattaatcatctctctgcaggaggtcattgtcttactacaccgcttcccctctcatttattcttagtttccctcctatgaattgtacttccagctttgcagactctcgactctgttttccttgttgaacaatcattctcctaccaaacagacagcttcaatcgttgtgatatataaatcttatgtttccctaatcgggtttgctgtggatatgctttatctgagcttttctcgataatctctaccttttctgcatagcc

SEQ ID NO: 3511 - DNA, 843 bp, Linum usitatissimum
tttgccggagattcaagctagtcgagagccagagatgtcgactaccaggaaaatcactctcaagagctccgacggggaggcgttcgaggtggacgaggcggtagctctggaatcgcaaaccatcaagcacatgatcgaagacgactgcgccgataacggcatccctctcccgaacgtcaccagcaagatcctctctaaggtcatcgagtactgcaagaggcacgtcgaggttgcttccaccaagaccgaggatcgccctacctctgcggacgacgatctcaagaattgggacgccgagttcgttaaggttgaccaggctactctcttcgatctgattctggctgcgaactatctgaacattaagagcttgctagacctaacttgtcagacagtggcggacatgataaaagggaaaactccagaggaaatccgcaagactttcaacatcaagaatgacttcacccctgaggaagaagaggaagttcgtagagagaaccaatgggcatttgagtgattaatctctctgcaggaggtcactgtgttacttcaccgctgcccctctcatttattcttagtttccctcctacgaattgtgcttgcagctttgcagactctcgactctgttttccttgttgaacaatcatcctcctaccaaacagacagcttcaatcgttgtgatatataaatcttatgtttccctaattgggtttgctgtgaatagctttatctgaacttttttcaataatctctacctttgtctgcatagctaccaagtgtgtttcctggtgatggttttatgactggcagggtctttgtttctggtgggaaacaagttgtttgaac

SEQ ID NO: 3512 - DNA, 789 bp, Carpinus betulus
ctctctctctctctcgtcaaagtccaattctagggtttgtgttttgaatacctcatcaaaacgatgtcgtcagggaggaagataactctgaagagctcggacggagagaccttcgaggtggaagaggcggtggctctggagtcacaaacgataaagcacatgatcgaggacgactgcgccgacaatggcatcccgctcccgaacgtgacgagcaagatcctctccaaggtcatcgagtactgcaagaagcacgtcgaggctcctaaagcagctgccgcgtccgaagaccgctccacctcctccgacgatgacctcaaggcctgggacgccgagttcgtcaaggtcgaccaggccaccctcttcgatctcatcctggctgcaaactatctgaacatcaagagcttgctggatctgacttgccagaccgtggctgacatgatcaagggcaaaactcctgaggaaatccgcaagacattcaacattaagaatgacttcacaccagaggaagaggaggaggttcgcagggagaatcaatgggcctttgagtgaagatccaaaataagcacatctgttttttgtggcttatgtttctcttttgtgctgggggaaggggatgctgtttctacctatctaagacttcttaagatattaacttactattctggctgtcactgttgtagacaatggttgttctgcttaaaccttatccccaattacctctccatttaattttccccgtatgatgttcaatggatcttttttctatgttaatatggtatatgctgtttt

SEQ ID NO: 3513 - DNA, 740 bp, Gossypium raimondii
aaatttggtatggtatcgccaatcctctactttcccgcattttctttttccctctttagattaggattctgaaaccctccaatttggatacatcgtcatggcttctacgggtcggaaaatcatactaaagagctcagacggcgagaacttcgaggtggacgaggcggtggctctcgaatcacaaacgattaagcacatgatcgaggacgattgcgccgataacggcatccctctacccaacgtcaccagcaagatcctctctaaggtaatcgagtattgcaagaaacacgtcgaagcatcgaaatctgaggatcgttcagcctccctcgatgatgaccttaaagcttgggatgctgatttcgtcaaggtcgatcaagccacccttttcgatctcatactggctgctaattacttgaacatcaagggcttgttggacctaacgtgtcaaactgtggcagacatgataaagggaaaaacgcctgaggaaatccgcaagacatttaacattaagaatgattttactccggaggaagaggaagaggttcgtcgcgagaatcaatgggcgtttgagtgatggctcttaattgaactgaacatagtttaatatttgtgtttttgttttcattttacttttgaatgtccttgagaacttgggattgttatttccgtccttttttttacttgttttaactgttatttcacctcggatgtgttaataaatgttgtttatttggttaaaa

SEQ ID NO: 3514 - DNA, 785 bp, Gossypium hirsutum
accagtaaaaaatgtaaaagtagaacaacttttaaacgaataaaagaaagcgaagagactaaatccaaatttggtatggtatcgccaatcctctactttcccgcattttctttttccctctttagattaggattctgaaaccctccaatttggatacatcgtcatggcttctacgggtcggaaaatcatactgaagagctcagacggcgagaacttcgaggtggacgaggcggtggctctcgaatcacaaacgattaagcacatgatcgaggacgattgcgccgataacggcatccctctacccaacgtcaccagcaagatcctctctaaggtaatcgagtattgcaagaaacacgtcgaagcatcgaaatccgaggatcgttcagcctccctcgatgatgaccttaaaggttgggatgctgatttcgtcaaggtcgatcaagccacccttttcgatctcatactggctgctaattacttgaacatcaagggcttgttggacctaacgtgtcaaactgtggcagacatgataaagggaaaaacgcctgaggaaatccgcaagacttttaacattaagaatgattttactccggaggaagaggaagaggttcgtcgcgagaatcaatgggcgtttgagtgatggctcttaattgaactgaacatagtttaatatttgtgtttttgttttcattttacttttgaatgtccttgagaacttgggattgttatttccgtcctttattttacttgttttaactgttatttcacctcggatgtgttaataa

SEQ ID NO: 3515 - DNA, 752 bp, Gossypium hirsutum
gcgaagagactaaatccaaaatttggtatggtatcgccaatcctctactttcccgtcatttctttttccctctttagattaaaattctgaaaccctccaatttggatacatcgtcatggcttctacgggtcggaaaatcatactaaagagctcagacggcgagaacttcgaggtggacgaggcggtggctctcgaatcacaaacgattaagcacatgatcgaggacgattgcgccgataacggcatccctctacccaacgtcaccagcaagatcctctctaaggtaatcgagtattgcaagaaacacgtcgaagcatcgaaatctgaggatcgttcagcctccctcgatgatgaccttaaagcttgggatgctgatttcgtcaaggtcgatcaagccacccttttcgatctcatactggctgctaattacttgaacatcaagggcttgttggacctaacgtgtcaaactgtggcagacatgataaagggaaaaacgcctgaggaaatccgcaagacatttaacattaagaatgattttactccggaggaagaggaagaggttcgtcgcgagaatcaatgggcgtttgagtgaaagctcttaattgaactgaacatggtttaatatttgtgtttttgttttcattttacttttgaatgtccttgagaacttgggattgttatttccgtcctcttttttacttgttttaactgttatttctcctcggatgtgttaataaatgttgtttatttgg

SEQ ID NO: 3516 - DNA, 813 bp, Gossypium raimondii
ccgaaaatctgccagtaaaaaatgtaaagtgacaacttttaaacgaataaaagaaagcgaagagactaaatccaaatttggtatggtatcgccaatcctctactttcccgcattttctttttccctctttagattaggattctgaaaccctccaatttggatacatcgtcatggcttctacgggtcggaaaatcatactgaagagctcagacggcgagaacttcgaggtggacgaggcggtggctctcgaatcacaaacgattaagcacatgatcgaggacgattgcgccgataacggcatccctctacccaacgtcaccagcaagatcctctctaaggtaatcgagtattgcaagaaacacgtcgaagcatcgaaatccgaggatcgttcagcctccctcgatgatgaccttaaaggttgggatgctgatttcgtcaaggtcgatcaagccacccttttcgatctcatactggctgctaattacttgaacatcaagggcttgttggacctaacgtgtcaaactgtggcagacatgataaagggaaaaacgcctgaggaaatccgcaagacatttaacattaagaatgattttactccggaggaagaggaagaggttcgtcgcgagaatcaatgggcgtttgagtgatggctcttaattgaactgaacatagtttaatatttgtgtttttgttttcattttacttttgaatgtccttgagaacttgggattgttatttccgtcctttattttacttgttttaactgttatttcacctcggatgtgttaataaatgttgtttatttggttaaaa

SEQ ID NO: 3517 - DNA, 641 bp, Euphorbia peplus
ttgctttctcaacgaagtggaaaccagccgcttaatcggaaatcggtgataacaacttaagtaaccatgtcgacggggaggaaaatcacgttgaaaagctccgacggtgagacctttgaggtagacgaggcggtggctctcgaatctcagacgataaagcatatgattgaagacgattgcgccgataacggcatccctcttcctaatgtcaccagcaagatcctttctaaggtaatcgagtactgcaagaagcacgtcgagactcctaagtccgacgatcgcccttccgccgacgaagagcttaagacctgggacgctgagttcgtcaaagttgatcaggctaccctctttgatctcatattggctgccaattatctaaacatcaagaccttgctggatctcacttgtcagacagtagcagacatgatcaagggaaaaactccagaagaaattcgtaagacttttaacatcaagaacgactttacacctgaggaagaggaggaagttcgcagagagaaccagtgggcttttgagtgaaaagttggaaagtgttgtagttatccctgtttcctttttgtgttagatgtggtgtctggaacactgtttgcaagcaattgttaatttacttgctacattgccga

SEQ ID NO: 3518 - DNA, 1269 bp, Citrus clementina
agcagcattttgttagttgtccgttccgagaacagacaccttttcgaagggcttttcttctcttctcttcatctttatcctccttttatatataaatataataaatatcaagaaagttagggtttcaagagtgtgttggatcgatcgatcagaatgtcaacgagtaagaaaatcacgctgaagagctcggatggagaggcgttcgaggtcgatgaagcagtggcgttggaatcgcagacgatcaagcatatgattgaggacgattgcgccgacaacggaatccctttgcctaacgttaccagtaagatcctctctaaggtcatcgagtactgcaagaagcacgtcgaggcatctaagtccgacgatcgggccactagcggcgtcgatgatgatctcaaggcttgggataccgatttcgtcaaagtcgatcaggccactctctttgatcttattcttgcggcaaactacctgaacatcaagagcttgctggacttaacttgccagactgttgcagacatgattaagggaaagactccagaggagatccgcaagacattcaatatcaagaacgactttaccccagaagaggaggaagaggttcgtcgggagaatcagtgggcttttgagtgaaaggatctcaaatgaccaatttgtaattgtgtcttttcttttttgttttgccttctttttgttgttgctgctgactcaaatgtctttagctggtaaaagcatcaaaccattattgttttaatgtcatatcatcccaaccttctctgtatcattaattgtgaagtccttttggatcttgttagtgatgttaatatggtatatgttcttccgtacccattagtttgttttctcatgttaaatgattgttatctagcttgttggctgcataatttagatatgttgcttcaatgctcttgttgacttagagggatcagataatgtgttcatgttgttccttctaaaggtgaagattttgtagccatgttgtgctaaaagcccagcatataatatgtagtcattggagtgtcacgagggctgatgatttgcacagaggccatacgagtgatgctggtgtacttaaccaactagtgactttggccagagttcatcagtttgtgtgtcagttttgtggtcttatctttaagtggtgtctggcgtgaattgagaggtgcacttggaaatttggtttggaattacattgactggtgtatctgacaagttttttttggttatctggatctttccattgaaacatgtaga

SEQ ID NO: 3519 - DNA, 975 bp, Carica papaya
accattaggtattaggaattggattttcttgtcctaatcaaatctctcatctatatatacccattcccccaagcgtaattctccttctacacccattattcacttacctttcctctccattcatttgtcctagggtttctggaatcttcttcgtagccatcaaaccatgtcgacgaggaaaatcaccttgaagagctccgatggggagaccttcgaggtggacgagtcggtggcgctcgaatctcagaccataaaacacatgatagaagatgattgcgccgataatggcatccctcttccgaacgttaccagcaagatcctctctaaggtaattgagtactgcaagaagcacgtcgagtctccaaaatcagatgatcggaccaccagcactgttgacgatgagctcaaggcatgggacgctgaattcgtcaaagttgatcaggctaccctcttcgatctcattttggctgctaactatctgaacataaagagcttgctggaccttacttgccagaccgtggcagacatgatcaagggcaaaactccggaagagattcgcaagaccttcaatatcaagaatgacttcacaccagaagaagaagaggaggttcggcgcgagaaccagtgggcctttgagtgaaggatacggtgatgaacaaaactgtttttctttccttgggctgcttttgtctaatagtttgacttttgaaatcttgtccgtaaagtagtagtaatccttgtctcagctgttgccgtttcccgtccatctatcctctcctgttacaaactatgatgtccttaagtaatctttaatgatgtcaatatattttacatggtccttatctgtctgttttacttcacattatattgccaattgcattatctgtctccatgttcaagacagctttgttgttgtcatcttcatgattgtgcatcccaaattactattgaatgaaaatttaaactttctgcccc

SEQ ID NO: 3520 - DNA, 831 bp, Manihot esculenta
agagctgcccaatagaaagctcatacgtgtgtagctagggctatcttatgctcggcgtctctctcaaaacataaaatcagtaccttatcgctctacggcatcagggttttttcccaaatcagaaaattttcgcaggcagaagaaggagcatcgccggcaaaattagctatgtcaaccggcaggaagatcacgttgaaaagctctgacggagagacctttgagatggacgaggcggtggctctcgaatctcagacgataaagcacatgatagaggacgactgcgccgataacggtatccctcttcctaatgtcaccagcaagatcctctctaaggtaatcgagtattgcaagaagcacgtcgagactcccaagtccgaagatcgtccctcttctgtcgacgacgagttgaaggcgtgggacgctgagtttgtcaaagttgatcaggctactctcttcgatctcattctggctgccaactatctaaacatcaaaagcttgctggatctcacttgtcagactgtagcggacatgatcaagggcaaaactccagaagaaattcgcaagactttcaacatcaagaatgactttacaccagaggaagaggaggaagttcgcagagagaaccaatgggcctttgaataaaagtccaggaaacagtgtctgtatttctagttccctttctatgttggacatgggtgttcaggatcactgctttgcagacaattattagtttacttgccttgttccctacctaaaactatcagaaactctgatgtctggctgtaaccttttcattacatgttaatatggtatctgctgttcttttatggt

SEQ ID NO: 3521 - DNA, 1118 bp, Ricinus communis
acgtgcgtctactgttctctccactcgacagtagggatctggcggtctcactctcatccgaacgaagaagaagaagacagcttaaacctaatcagaaaagcgttgaccaatgtcaactagcaggaaaatcactttgaagagttctgacggtgagacttttgaggtggacgaagcggtggcgcttgaatcgcaaacaattaagcatatgatcgaagatgactgcgccgataacggcatacctcttcctaatgtcaccagcaaaatactctctaaggtgattgagtattgtaagaagcacgttgaaacttctaagtctgacgatcggccttcttctgttgacgatgagcttaagacttgggatgctgagtttgttaaagttgatcaagctactttatttgatcttatattggctgccaattatctgaacatcaagagtttgctggatctgacttgtcagactgtggccgatatgatcaagggaaaaacaccagaggagatacggaagactttcaacatcaagaatgactttacaccagaagaagaagaggaagttcggagagaaaatcagtgggcctttgagtgaagggctttgtgaaataatatatctgtatttgtagttcttttctttttgtgcttgactttggcgtttagggattatggctttgcaaacagctgctatcagtatattgtttgttgcctttatcgatgtagaagccatatcgatgcagtgttttatgctttggtcataaataagcatgatgaagtgcaggaatataaactggaatgcgttctcagcagagttttgctcatgtcaaaatggcaaagggtatagtaaaagtgagcctatattcagaaatatcggtgactggttttctgctatggccaaaaccattggatcaacgctgagaagattggtacaccaatgaccccttagcaataccgtgcattcatatagaacttttggtcaaaactcatagaaaagaaagattagtcggaataaagttcatttggccactgttcttgtggcttgtgttcaattttttaggttttttttttaaattatttttttttgaatttatgaaatgttacttggttcaaagtggtctcactatcatgta

SEQ ID NO: 3522 - DNA, 841 bp, Cucurbita pepo
atcggtggaatttgcacttgaaaacccattttgtggtcaccgtttggttttcgtcctctttagcaaatcgcgactctctctttttctctctctttctctctctctctctctttgggtttcagacctcaccgaatcttcgagaaaggagatacggcaccatgtcttcagggaggaagatcacgttgaagagctccgatggcgagatctttgaggttgacgaagccgtcgccttggagtcacagacgatcaagcacatgattgaagacgattgcgccgatagtggaatccccctccctaacgtcaacagcaagatcttgtccaaggttatcgagtactgcaagaagcacgtcgagtctcccaagccggaggatcgtgctggctccgtcgaggacgacctcaagacttgggacagcgaattcgtcaaagtcgaccaggcgaccttgttcgatctcattctggctgcaaactatctcaatatcaagagcttgctagatttgacttgtcagacggtggctgacatgatcaaggggaagactcctgaggagatccgcaagacatttaacatcaagaatgacttcacacccgaggaagaggaggaagttcgtagggagaatcaatgggcgttcgagtaaaaaaaaaaaaggagtaaacgcttatattctactttctcttgtcgcattgtaacatttgatacttgttctttctgttaaactaaactatgtgatgttcgttgggtgttatcttcattcctcaatctctggttttcatcgaactttacccgacttgcatttcttcataatataagacagaactcgtgaagcactcgtgtcgcgataatgta

SEQ ID NO: 3523 - DNA, 799 bp, Momordica charantia
gattcaaacccattctgtggtgagtttccgttttgttccacaacttctctggttttggagacctcgccgaatcctccacaatcgaaatacgcgcaccatcatcatgtcttcagcaaggaagatcaccttgaagagctccgatggcgagatcttcgaggtcgacgaagcggtggccttggagtcgcagaccatcaagcacatgatcgaagacgattgcgccgacagtggaatacccctccctaacgtaaacagcaagatcctctccaaggtcatcgagtactgcaagaagcacgtcgagtcccccaagcccgaggaccgcgccgcctctgtcgacgacgacctcaagacttgggacaccgaattcgtcaaagtcgaccaggccacccttttcgatctcatcttggctgcaaactatctcaatatcaaaagcttgctagatttgacttgtcagacagtggcagacatgatcaaggggaagactcctgaggagatccgcaagacatttaacatcaagaatgactttacacccgaggaagaggaggaggttcgtagggagaatcagtgggcctttgagtaaaacaaaaaaaataaacgagcgaaacgcttgtatgttactttctcttgttgcatggtaacgtttgatctttgttctacctgtgttatgctaaaccttgtgatgtcggttgggtgtttacttcattctacaatctgttatattatttcatccaacttaactgacttcggcatttttttaatacaagatgaactcgtggagcacccttgtcttcacaattgttct

SEQ ID NO: 3524 - DNA, 967 bp, Humulus lupulus
ttctctattataaaaatcaagtttcgtgttcatccactctctctctctctcactgtaatcccaatccatatccctattcttctctctttctccgaatcgatcagagagcgtcacagcccgagatcgcttcagcgatgtcgaccggcagaaagattacgttgaagagctctgacggtgagaccttcgaggtcgatgaggcggtggccttggaatcgcagacgatcaagcacatgatcgaggacgattgcgctgacaatggtattccccttcccaacgtcaccagcaagatcttgtctaaggtcatcgagtactgcaagaaacacgttgaggctcctaaggccgaggaccgcgcctcctccgtcgacgatgaactcaaggcttgggacgcagatttcgtcaaggttgaccaggccactcttttcgatctcatcttggctgcaaactatttgaacatcaagagcttgctggacctgacttgccagacggtggcggacatgatcaagggcaaaactcccgaggagattcgcaagacattcaacatcaagaatgactttacaccagaagaagaggaggaagttcgcagggaaaaccaatgggcatttgagtaaatctcgtttacatcaaatgagctactctgtttttgtgttcaagtgtttttttttcctctctatctctctctctttttactgtttttcaattggatgtcgaggttactgaatgctatttcaatccattatgggaaaagcctcttagtccttaaaactgtggaatttcatgttcctataaatcttcttcctccccctctctaaatttagatactgggatgatcatcatgatgttatcttgatctcttcaagtatatgaatgtgataaatgatgttctttattcacatttcttttctttacttattcatattttgctatgttcatgattgaagcttggattgtcttatatccaagacagctt

SEQ ID NO: 3525 - DNA, 787 bp, Humulus lupulus
gaaactctctctctctcactgtaatcccaatccatatcccttttcttctctctttctccgaatcgatcagagagcgtcacagcccgagatcgcttcagcgatgtcgaccggcagaaagattacgttgaagagctctgacggcgagaccttcgaggtcgatgaggcggtggccttggaatcgcagacgatcaagcacatgatcgaggacgattgcgctgacaatggtattccccttcccaacgtcaccagcaagatcttgtctaaggtcatcgagtactgcaagaaacacgtcgaggctcctaaggccgaggaccgcgcctcctccgtcgacgatgaactcaaggcttgggacgcagatttcgtcaaggttgaccaggccactcttttcgatctcatcttggctgcaaactatttgaacatcaagagcttgctggacctgacttgccagacggtggcggacatgatcaagggcaaaactcccgaggagattcgcaagacattcaacatcaagaatgactttacaccagaagaagaggaggaagttcgcagggaaaaccaatgggcatttgagtaaatctcgtttacatcaaatgagctactctgtttttgtgttcaagtgtttttttttcctctactatctctctcttcttttactttttttttaattggatgtcgaggtttctgaatgctatttcaatccattatgggaaaagcctcttagtccttcaaactgtggaatttcatgttcctataaatcttcttcctccccctctctacatttagatac

SEQ ID NO: 3526 - DNA, 1057 bp, Humulus lupulus
accgtaaatttttttggttattctctattataaaaatacaggtttcgtgttcatccactctctctcgtctctctctcactgtaatcccaatccatatcccttttcttctctctttctccgaatcgatcagagagcgtcacagcccgagatcgcttcagcgatgtcgaccggcagaaagattacgttgaagagctctgacggcgagaccttcgaggtcgatgaggcggtggccttggaatcgcagacgatcaagcacatgatcgaggacgattgcgctgacaatggtattccccttcccaacgtcaccagcaagatcttgtctaaggtcatcgagtactgcaagaaacacgtcgaggctcctaaggccgaggaccgcgcctcctccgtcgacgatgaactcaaggcttgggacgcagatttcgtcaaggttgaccaggccactcttttcgatctcatcttggctgcaaactatttgaacatcaagagcttgctggacctgacttgccagacggtggcggacatgatcaagggcaaaactcccgaggagattcgcaagacattcaacatcaagaatgactttacaccagaagaagaggaggaagttcgcagggaaaaccaatgggcatttgagtaaatctcgtttacatcaaatgagctactctgtttttgtgttcaagtgttttttttcctctctatctctctctcttttactttttttctaattggtatgtcgaggttactgaatgctatttctaatccattatgggaaaagacctcttagtccttaaaactagtggaatttctatgttcctataaatcttcttcctccccctcctctaaatttagatactgggatgatcatcatgatgttatcttgatctcttcaagtatatgaatgtgataaatgatgttctttattcacatttcttttctttacttattcatattttgctatgttcatgattgaagcttggattgtcttatatccaagacagcttccatctacttctttatacataattgtcaaggctaatctgatggaatcatggaccataga

SEQ ID NO: 3527 - DNA, 529 bp, Bruguiera gymnorhiza
agagaaagaaagaagaatcagataagagagagaaaggagaggaaaaataatcatgtcagcgggccggaaaataacgctgaggagctcggacggagagactttcgaggtggacgaggcggtggccctggagtcgcagaccataaagcatatgatagaggacgattgcgccgacaacggcatccctctacccaatgtcaccagcaagatcctctccaaggtcatcgagtactgcaagaagcacgtcgaggcgccaaagtccgacgatcgaagcaccccctccgccgacgaggagctcaagtcgtgggacgccgagttcgtcaaagtcgatcaggctactctcttcgatctcatcctggctgccaattatctgaacatcaagagtttgctggatctcacatgccagactgttgcagacatgatcaaagggaaaacaccggaggagattcgcaagacatttaacatcaagaatgactttacacctgaagaagaggaagaggttcgcagagagaatcagtgggcctttgagtga

SEQ ID NO: 3528 - DNA, 794 bp, Jatropha curcas
attcgtcataatattatatttctctctcatacgataaaattcacccccctcttctgttcggggtcagaggttatctcgacgaacaacagccagtcgctcactcagaagtattcaattaagaagcatcaatgtctacgggcaggaaaatcactttgaaaagcgccgacggggagaccttcgaggtagacgaggctgtggctcttgaatcgcagacgattaaacacatgatagaggacgactgcgccgataatggaatccctctgcccaatgtcaccagcaagatcctatctaaggtaattgagtactgtaagaagcatgtggagacccctaagtccgacgatcgcccctcttctgccgacgaagaacttaagacctgggacgcggactttgtcaaagttgatcaggctaccctctttgatctaatcttggctgccaattatctgaacatcaagagtttactggatctcacttgtcagacagtggctgacatgatcaagggcaaaactccagaggagatacgcaaaacgttcaacatcaagaatgatttcacaccagaggaagaagaggaagttcggagagagaaccagtgggccttcgagtgaaaagaccatgaaaaattgtatctttattcctagttaccttcttgtgttagacctgggtgtttagggattacttgttttgcaagcacttgtcttcttatttgctccattccgtacctgaacctatcgggaaactctaatatttgttccaaaccctttgttatgtcaatatggttattgctgttctttcaatat

SEQ ID NO: 3529 - DNA, 778 bp, Cucumis melo
gtttcatacatatttggtttctctctttctcaaatcgcaaaacgcttctctctctctctctctgtattcaaacctcaccgaatcccaaacaccccaccatgtcttctggccggaaaatcaccttgaagagctccgacggcgagatcttcgaggtcgatgaagcggtcgccttggagtcacaaacgatcaagcacatgatcgaagacgactgcgccgatagtggaatcccccttcctaatgttaccagcaagatcttgtccaaggttatcgagtactgcaagaagcatgtggagtcccctaagcctgaggatcgtactggctccgtcgacgatgacctcaagacttgggacagcgaattcgtcaaagtcgaccaggccaccttattcgatctcattctggctgcaaactatctcaacatcaaaagcttgcttgatttgacttgtcagacggtggctgacatgatcaaaggaaagactccagaggagatcaggaagacatttaacatcaagaatgactttacacccgaggaagaggaagaggttcgtagggagaaccaatgggcatttgaataaaaaaagagtaaaagggatggaatcacttatatgttgttaacttttctcttgcgcatggtgatatttgatgattgtgttatctgttgtgttaaactcttgtgatgttcgttgggtgttaactatatattctacaatgttatctttcatccaacttacctgatttcggcttcaacatttttattaatatcgtagcttgcctgctatta

SEQ ID NO: 3530 - DNA, 941 bp, Camellia sinensis
tcgagaggtatatcttattataaaaagttaaagttagggttagggtttgctttcaatctgttgcaaacaacagagcagagccatgtcgtcaacgaggaagatcatcctgaagagctcggacggtgagaccttcgaggtcgacgaggtggtggctctggagtcgcagacgattaagcacatgatcgaggacgattgcgccgataacggaattccattgccgaacgtgacgagcaagatcttatcgaaggtgatcgagtactgcaagaagcacgtcgagactccaaaatccgaagatcgcgccaccggcgtcgaggacgaactcaagactttcgatatcgaattcgtcaaagtcgatcagggcactctgtttgatctcattctggcagcaaactatctgaatatcaagagcttgttggatctgacctgccagactgttgcagacatgatcaagggaaaaactccagaagaaatccgcaaaacatttaacattcagaatgacttcaccccagaggaggaggaggaggtccgcagggagaaccaatgggccttcgaatgaacgatctgaaatgaccagtcttgttttttggtattttggcttttaggctggagtgtatggggatggttgtttcttgtcacagttcattttgcaaaaccctgtagttattaaggtagagtgtctgagggcacttggaacaaatttacctcaccggtggtaatatggtatattttggattaatcacgttaatatgttatattttgtttctccaaccatggattgtgtttcttctcttgttgaatcttgtttgcttatgagttgatgttttttggtcttattgcatgtcaagtaagcttttgggctatcttaattgcttttgccatctcattagttagatggcatgttatacggattcctcgaaataaatcaaatatgttggataccg

SEQ ID NO: 3531 - DNA, 1032 bp, Fagus grandifolia
ttgcctttcactatttataagagagggcacgacatatcaaaaccacatcacaccgtaagggtaaaaaagcctttattgtttttgttcgagagtccgactctctaatctaatccgatccctttcaagcctcttctcaaggctagggtttgtgtcaccggaaaacaaaaacgatgtcgtcgaggaagataacgctgaagagctccgacggcgagaccttcgaggttgaagaggtggtggcgttggaatcgcaaacgataaagcatatgatagaagacgattgcgccgataatggaatccctcttccgaacgtgacgagcaagatcctttccaaggtcatcgagtactgtaagaaacacgtcgaatctcccaaggccgaggaccgtgtcgcctccgtcgatgaggagctcaagacctgggacgccgagttcgtcaaggtggaccaggccaccctcttcgatctaatactggctgcaaattatctgaacatcaagaacttgctggatctgacttgccagacggtggcagatatgatcaagggaaaaactcctgaggaaatccgcaagacattcaatatcaagaatgacttcacaccagaggaagaggaggaggttcgcagggagaaccaatgggcttttgagtgaatgttacaaaatgatcagatctgtttttttgtggcttatgttttcttttgtgtcgaggaaaggggttgctgtttccacctatctaagactttgtagttatttaagtactactccagggtgttgctgctgtaaaacaatgcttgtcttgcttaaaccttacccaacttccctgttcatttagttgcaaagtatgatgtttaatggatctcttttattatgttaatatggtagtatgttgcttttaattcagtcggtttgtgtttttgttgatgctttatctacagtcctcgtcatattcaggtgatccaccatttgactttggtggaggtgatcccagtgagtattgtttcggagggtgtaagacggaggttatatcattattctatgtata

SEQ ID NO: 3532 - DNA, 823 bp, Manihot esculenta
tttcacaagatctataaattgaaaggggtcgcggcttttcggttcacccaatcttctattgttcgtttgcgctcgcaacaatgtcgtccaagaagatcatcttgaagagcagcgacggtgagtccttcgaggtggacgaggcggtggcgcttgagtctcagactatcaaacatatgatcgaggacgattgcgccgataacggtatcccgctgccgaatgtgacgagcaagatcctggctaaggtgatcgagtactgcaaaaggcacgtggagactcccaagtctgatgatcgcaacaacagtgtagatgacgatctcaagacctgggatgctgaattcgtgaaagtcgatcaggccacactcttcgatctcattctggctgccaactatttgaacattaagggcctgctggacttgacatgccagactgttgcagacatgatcaagggaaagactcctgaggagatccggaagacattcaacatcaagaatgacttcacccctgaggaagaggaagaggttcgtagggagaaccagtgggcgtttgaatgaaagtacatgctggttggtatagagtagcaaatgtgtaatattttgatggaatgtgtggcttaatagtaaaagtgaacttttttggactaagtcttctttggtttcaattactgctttgaacttgtgggcgcatttaaatgtaaataattcttggattctctggggagttgtagtagtggatgggctttcctttcaatcaattgtctactatctacatgatctgtttttaacagtctctgcattttaaatctgatgttctcccttcccttctc

SEQ ID NO: 3533 - DNA, 909 bp, Castanea mollissima
aaattttatttctccagagagagtctctcaaactctatccaatttctagggtttgcgtgagcggaaaagaggtaaagagaagagaagagagagcgaaaaacgatgtcgtcgaggaagataacgctgaagagctcagacggagagacgttcgaggtggaggaagcggtggcgttggagtctcagacgataaagcacatgattgaagacgattgcgccgacaatggaatccctctgccgaacgtgaccagcaagatcttgtcgaaggtcatcgagtactgcaaaaagcacgtcgagaccccgaaagccgaggaccgtgtcgcctctgccgatgaggagctcaagaactgggacctcgagttcgtcaaagtcgaccaggccaccctcttcgatctcatcttggctgcaaattatctgaacatcaagagcttgctggatctgacttgccagacagtggcagacatgatcaagggcaaaacaccagaggaaatccgcaagacgttcaacatcaagaatgacttcacacccgaggaagaggaggaggttcgcagggagaaccaatgggcctttgagtgaaaaaagttataaaaatgagcagatctgtttttacttttttgtggcttatgatttactcctgtgctgaggaaaggggtggttgtttccacctatctaagaccttctagttattcaagtactgttctaggtgtctctgctgtaaaacaatgtttgttttgcttatacccacttcccttccctccacatttaggcgcaaagtatgatgtttaatggatctcttttattatgttaatatgataatatgttgctttttctccagttgtttgtgttcttgacgctttgtctacagtacttgtcatatcaaggtgatccaccattgacttttggtggggggga

SEQ ID NO: 3534 - DNA, 771 bp, Euonymus alatus
ccggtccaataattatcggacccgttctctctatctcttctctgtttctctgctagggttagggttctcactaagcagtacctcttatcaatcatgtcgactagcaggaaaatcactctgaagagttccgacggagagaattttgaggtagacgaggcggtggccttggaatctcagactattaagcacatgatagaggacgactgtgcggataacgggatcccgcttcccaacgtcaccagcaagatcctctcgaaggttatcgagtactgcaagaagcacgtcgacgctgcaaaggttgaggagcgccccgcgactgctgacgatgaactcaaggcttgggacgccgagttcgttaaggtcgaccaggccaccctcttcgatctcatcttggctgccaactatctcaatatcaagagcttgctggaccttaattgtcagacagttgcagatatgatcaagggaaaaacaccggaggagatacggaagactttcaacatcaagaatgattttacaccggaggaagaggaggaggttcgtcgggagaaccagtgggcttttgagtgaagacacaagttcaaaaaaaaagctatttacatggtttcttccctttattttgtgttggacatggatggctgtatccttaaatgttgacccgtctaaaattatctggtactgtttaaattcttgttctgggggtcttctgaaaaaacagctgctaatctgatgtttcttggatctctttaattatgttaatatgatggtatatgt

SEQ ID NO: 3535 - DNA, 777 bp, Euonymus alatus
gtcccataattatcggacccgttctctctatctcttctctgtttctctgctagggttagggttctcactaagcagtgcctcttatcaatcatgtcgactagcaggaaaatcactctgaagagttccgacggagagaattttgaggtagacgaggcggtggccttggaatctcagactattaagcacatgatcgaggacgactgtgcggataacgggatcccgcttcccaacgtcaccagcaagatcctctcgaaggttatcgagtacagcaagaagcacgtcgacgctgcaaaggttgaggagcgccccgcgactgctgacgatgatcttaaggcttgggacgccgagttcgttaaggtcgaccaggccaccctcttcgatctcatcttggctgccaactatctcaatatcaagagcttgctggaccttacttgtcagacagttgcagagatgattaagggaaaaacaccagaggaaatacggaagactttcaacatcaagaatgattttacaccggaggaagaggaggaggttcgtcgggagaaccagtgggcttttgagtgaaaacacaagttaaaaaaaaacaaaagctatttacattgtttcttccctttattttgtgttggacatggatggctgtatccttaagtgttgactcgtctaaaactctctagtactgtttaaattcttgttctgggggtcttctgaaaaaacagctgctattctgatgtttcttggatctctttaatcatgttaatatggtggtatatgttgtct

SEQ ID NO: 3536 - DNA, 687 bp, Linum usitatissimum
gccggagaatcaagctagtcgagagccagagatgtcggctaccaggaaaattattctcaagagctccgacggtgagacgttcgaggtagacgaggcggtagctctggaatcgcaaaccatcaagcacatgatcgaagacgactgcgccgataatggcatccctctcccgaacgtcaccagcaagatcctctccaaggttatcgagtactgcaagaggcacgtcgaggttgctgtcaccaagaccgaggatcgccctaactctgcggacgacgatctcaagaattgggacgctgaattcgttaaggtcgatcaggccactctcttcgatctgattctggctgcgaactatctaaacatcaagagcttgctagacctaacttgtcagacagtggcggacatgataaaagggaaaactccagaggaaatccgcaagactttcaacatcaagaatgacttcacccctgaggaagaagaggaagttcgtagagagaaccaatgggcatttgagtgattaatcatctctctgcaggaggtcattgtctaaatacaccgcttcccctctcatttattcttagtttccctcctatgaattgtacttccgctttgtgttttcgtcgatgaacaatcatcccctatcagacagacagcttcaatcgttgtgatatatatataactttgatgtttccc

SEQ ID NO: 3537 - DNA, 837 bp, Quercus alba
acgtacctcaaaattatttcattactaaaaaaatttatttctcaatagagagtctcccaaactctatccgatttctagggtttgtgtaaccggaaaagaggtaaagagaagagagagagagagagcgagaaaacgatgtcgtcgaggaagataacgctgaagagctcggacggagagacgttcgaggtggaggaagcggtggcgttggaatctcagacgataaagcacatgattgaagacgattgcgccgacaatggaatccctctgccgaacgtgaccagcaagatcttgtcgaaggtcatcgagtactgcaaaaagcacgtcgagaccccgaaagccgaggaccgtgtcgcctctgccgatgaggagctcaagaactgggacctcgagtttgtcaaagtcgaccaggccaccctcttcgatctcatcttggctgcaaattatctgaacatcaagagcttgctggatctgacttgccaaacagtggcagacatgatcaagggcaaaacacctgaggaaatccgcaagacgttcaacatcaagaatgacttcacacccgaggaagaggaggaggttcgcagggagaaccaatgggcctttgagtgaaaaaagttataaaaatgagcagattgtttttactttttgtggcttatgttttactcttgtgctgaggaaaggggtggttgtttccacctttctaagaccttctagttattcaagtactgttctaggtgtctctgctgtaaaacaatgtttgttttgcttaaaccttacccacttccctttcctccacatttagttgcgaaatatgatgtttaatggatctcttttattatg

SEQ ID NO: 3538 - DNA, 787 bp, Fragaria vesca
aaaactctctttcaattccatctctctcaatcatttcagttctctccacacagcaaatcgatcgaaacgatgtcgtccggaaggaagataaccctgaagagctccgacggcgagtctttcgaggtggacgaggcggtggctttggagtcgcagacgatcaagcacatgatcgaggacgattgcgccgacaatgggatcccactccccaacgttaccagcaagatcctcgcgaaggtcatcgagtactgcaagaagcacgtggacgctgcccctaagtccgacgaccgctcctcctcctccggcgacgaagagctcaagaactgggacgccgacttcgtcaaggtcgaccaggccaccctcttcgatctcatcctggctgcgaattatttgaacatcaagaacctgctcgaccttacttgccaaacggtggcggacatgatcaaggggaaaacgcctgaggagattcgcaagacattcaacatcaagaatgactttacaccagaggaagaggaggaagtccgcagggagaaccaatgggcttttgagtgaaggtcataaatattgaagaaacttgtttttcttgtttgttgctgtttatgaatgctgcggtctgtattactgaactgctttttctttgcttagtggactgcttttcgttggatatgcttcttcttaggcaataattgccttgcttcatgttacccctttgcccttgtgatatacaaattctgttgctattcagttctcttttgctatattaaatgtgattctgtttattgttctgttc

SEQ ID NO: 3539 - DNA, 739 bp, Tripterygium wilfordii
gctagcgttagggttcttaataaacggttcctttaatcaatcatgtcgactagcaggaaaatcactctgaagagctctgatggagagactttcgaggtcgacgaggccgtggctttggaatcgcagactattaagcacatgatcgaggacgattgtgccgataacgggatcccgcttcccaacgtcaccagcaagatcctctcgaaggttatcgagtacagcaagaagcacgtcgacgctgcaaaggctgaagagcgccccgcgacagctgacgatgaactcaaggcttgggacgccgagttcgtcaaggtcgaccaggccaccctcttcgatctcatcctggctgccaactatctcaatatcaagggcttgctggaccttacctgtcagacagtggcagatatgattaaggggaaaacaccagaggagatccggaagactttcaacatcaagaatgattttacaccggaggaagaggaggaggttcgtcgggagaaccagtgggcttttgagtaagggacatgaagtgaaaaaaaaaaaaaactatttatattgtttcttcccttcattttgtgttggcatggattgctgtttccttaatcttgtatcgtgtaaaactctgtaatactggtttaaattcttgttctaggggtctcttatgaaaaacaacttccattctgctttgcgtgtttctcacccaattgctattatgctaatctagccatagcgatatcatggc

SEQ ID NO: 3540 - DNA, 866 bp, Panax ginseng
ggcctgatccggcgctcctcaaacttcaacacccagcgcatcaaccacatctacatcgacccccacaacgcccacaaggctcacatgaagctccacttcggaagcagtggtatcaacgcagagtacatggggatcgttcgttattcggtttatttgccaacctttctctctcttcagtttagggctagggcttgaaatctcatcatgtcttcgacgaagaagatcacattgaagagttctgacggcgaggtgtttgaggttgaccaggccgtagctctggaatcacagacgataaagcacatgatcgaagacgattgcgctgataacgggattcccctgccgaatgtcaccagcaagatcttgtccaaggtcatcgaatactgcaagaagcacgtagaggctcctacaacggaggatcgtgttcctgactcagatgatgacctcaaggctttcgacaccgagttcgtcaaagttgaccagggcaccctcttcgatctcattttggctgcaaactatctgaacatcaagagtcttctggatctgacctgccagactgttgcggacatgataaagggaaaaactccagaggagattcgcaagacattcaacatcaagaatgacttcacgccggaggaggaagaagaggtccgcagagagaaccaatgggcatttgaatgaaagaactaatagaatgttcagtttatctgctggcttttaatgtttttgatcatttaacagaactttgtagttggtaaaaaaaaaataacctagtggggtgtaattgtttcttcaaacctggctactgcctcgtcttgttagtgatgactctttggatcagtttatattaatatggtatatgcctttca

SEQ ID NO: 3541 - DNA, 811 bp, Panax ginseng
tcgttattcagtttatttgccgacctttctctctcttcagtttagggctagggcttgaaatctcatcatgtcttcgacgaagaagatcacattgaagagctctgacggcgaggtgtttgaggttgaccaggccgtagctctggaatcacagacgataaagcacatgatcgaagacgattgcgccgataacgggattcccctgccgaatgtcaccagcaagatcttgtccaaggtcatcgagtactgcaagaagcacgtagaggctcctacaacggaggatcgtgttcctgactcagacgatgacctcaaggctttcgacaccgagttcgtcaaagttgaccagggcaccctcttcgatctcattttggctgcaaactatctgaacatcaagagtcttctggatctgacctgccagactgttgcggacatgataaagggaaaaactccagaggagattcgcaagacattcaacatcaagaatgacttcacgccggaggaggaagaagaggtccgcagagagaaccaatgggcatttgaatgaaagaactaatagaatgttcagtttatctgctagcttttaatgtttttgatcatttaacagaactttgtagttggtaaaaaaaaaaaaaccaagtggggtgtaatggtttcttcaaaccaattggcaggctactgccttgtcttgttagtgatgactctttggatcagtttatattaatatggtatatgccttttcagttacaaaaaaaaaaaaaaaaaaaaaaaaacaaaaaaaaaaaaaaaaaaaaaaaaaaaaacaaaaaaacaaaaa

SEQ ID NO: 3542 - DNA, 996 bp, Chelidonium majus
caaaagaggaactagggttagggttttcgctttctcttttcatcgcagcagatctgttctactttcttgttcatctttgaaatcatgtcgactaagaaggtgactttgaagagttccgatggtgagacctttgacgttgatgaggctgttgccctcgaatctcagacaatcaagcacatgatcgaggacgattgtgctgataacggcatccctttgcctaacgttaccagcaagatcttggctaaggtcatcgagtactgtaagaagcatgttgagagtcctaagggtgatgatcgctccgctgatgaagatctaaagacctgggatagcgagttcgtgaaggtcgaccaggctaccctgtttgatcttatcttggctgcaaattaccttaacattaagagcttgctggacctgacctgtcagacagtggcggacatgatcaaggggaagacaccagaggagatccgcaagactttcaacatcaagaatgacttcaccccagaagaagaggaggaggtcaggagggaaaaccagtgggccttcgagtgaccgaaggaaagagtagactgaaagtgaagctgcagctggagaaccttgaaggaagatgtgttggtagttagttttttattatgatttatggggataacaagtgacaatgttctttactgggtatatatactgctatatatattattagcaagtaatggtagtagtggtagctgaagtcgtagtttattttggaagtgtatataaggggttagttggttaaaagacatctgattgcgggaatggtgtgtggtggtgctggtttaccctactacttaccttccctctttctaattaccagctaacctcattttgatataccaacactatgcatggttgatgcttctccattgttgtctttacttgaaaactgatgtttgttggatatatcatgttttcttttgtgttgagttatctatgttcataatttatcctgtcaaaaaaaaaaaa

SEQ ID NO: 3543 - DNA, 811 bp, Cucumis sativus
ggtggagtttgatcttaaaagccatatttttgtggtcagtttcatacatatttggtttctctctttctcaaatcgcaaaacgcttctctctgtgttttcgaacctcaccgaatcccaaacacgccaccatgtcttctggccggaaaatcaccttgaagagctccgacggcgagatcttcgaggtcgacgaagcggtcgccttggagtcacaaacgatcaagcacatgatcgaagacgactgcgccgatagtggaatcccccttcctaatgtcaacagcaagatcttgtccaaggttatcgagtactgcaaaaagcacgtcgagtcccctaagcccgaggatcgtactggctccgtcgacgacgacctcaagacttgggacagcgaattcgtcaaagtcgaccaggccaccttattcgatctcattctggctgcaaactatctcaacatcaaaagcttgcttgatttgacttgtcagacggtggctgacatgatcaaagggaagactccagaggagatcaggaagacatttaacatcaagaatgactttacacccgaggaagaggaagaggtccgtagggagaaccaatgggcatttgaatgaaaaaagaataaaagagatggaatcacttatatgttattaactttttctcttgttgcatggtgatgtttgatgcttgtgttatctgttgtgttgaactctcgtgatgttcgttgggtgttaactatcctacaatgttatctttcatccaacgtacctgacttcgacttcaacattttttattaatatcgtagattgcctgctattatgaa

SEQ ID NO: 3544 - DNA, 768 bp, Cucurbita pepo
tcttaagagacgtgtttgtggtcagattactctcttcgtttcgcaacgcagcgcctcggtctgggtttgagacctcatcgaatcttccagaaagcgaaatacggcaccatgtcttcaggcaggaagatcacgttgaagagttccgatggcgagatctttgaggtcgacgaagctgtggccttggagtcacagacgatcaagcacatgattgaagacgattgcgccgatagtggaatccctctccctaacgtcaacagcaagatcttgtctaaggttatcgagtactgcaagaagcatgtcgagtcccccaagccggaggatcgtactggctccgtcgacgatgaccttaagacttgggacagcgaattcgtcaaagtcgaccaagccaccttgttcgatctcattctggctgcaaactatctcaacatcaaaagcttgctagatttgacatgtcagacagtggctgacatgatcaaggggaagactcctgaggagatccgcaagacatttaacatcaagaacgactttacgcccgaggaagaggaggaggttcgtagggagaaccagtgggcctttgaatagaaaagaaataaaggagtgaaactctgatatgatggtacttttctcttgtcgcatggtaatgtatgatgcttgttctgtgtgttatgttaaactctgtgatgttcgttgggtgttgagactatattctacaatcgtgttatcttatctttcatccaacttacctgacttcagcatcttttctttaac

SEQ ID NO: 3545 - DNA, 887 bp, Citrullus lanatus
aaggcaatgggttatcggtggaatttgatcctaaaagccattttgtggtcagattctaacattttctttctctctttcgcaaatcgcaaagcttctctctgggttttcagacctcaccgaatcctctagaaaccgaaacacgccgccatgtcttctggccggaaaatcaccttgaagagctccgacggcgagatcttcgaggtcgacgaagcggtggccttggagtcacagacgatcaagcacatgatcgaagacgattgcgccgatagtggaattccccttcctaacgtcaacagcaagatcttgtccaaggttatcgagtactgcaagaagcatgtcgagtcccctaagccggaggatcgtactggctccgttgacgacgacctcaagacttgggacagcgaattcgtcaaagtcgaccaggctaccttattcgatctcattctggctgcaaactacctcaacatcaaaagcttgcttgatttgacttgtcagacggtggctgacatgatcaaggggaagactcctgaggagatccgcaagacatttaacatcaagaacgactttacacccgaggaagaggaggaggttcgtagggagaaccaatgggcctttgaataaaaaagaattaaaggaatgaatcacttatatgttacttttctattgtcgcatggtaatgtttgatgcttgtgttgtctgttatgttaaactctgtgatgttcgttgggtgttaactttattctacaatgttatctttcatccaacttacctgacttcgccattttttattaatatcggagattgcctgcttctatgaatggtttcatttctcattgttgtcagctcctaaattccataaactcttgagacctacattgtaagatctt

SEQ ID NO: 3546 - DNA, 916 bp, Euonymus alatus
cggccggggggccaacgagtcgtttttacccctcacgaatcacaggttacttttgtcttataaaagtatgcgtcccccataaaccgattattatcatctagtctccatcccgtccaatcattatcggacccgctctctccctctcttctctgtttatctggcagggttagggttcttaatagacagtttctctaatcaatcatgtcgacgagccggaaaatcactctgaagagctctgatggagagactttcgaggtcgacgaggccgtggccttggaatcgcagactattaagcacatgatagaggacgattgtgccgataacgggatcccgcttcctaacgtcaccagcaagattctctcgaaggttattgagtactgcaaaaagcacgtcgacgctgcaaaggttgaagagcgccccgcgaatgctgacgatgaactcaaggcttgggacgccgaatttgtcaaagtagaccaggccaccctcttcgatctcattctggctgccaactatctcaatatcaagagcttgctggaccttacttgccagacagtggcagatatgattaagggaaaaacacctgaggagatccgcaagactttcaacatcaagaatgactttactccagatgaagaggaggaggttcgtcgggagaaccagtgggcttttgagtgaaggacataaagtggaaaaaaagactttatatattgtttcttccattcatttggtgttggacatggatggctatttttgtaatgttgacttttttaaagttctgtggtactgtaggggtctcttttgaaaaacaactgctattctgctccaggggtctcttttgctcttgctcaccccaatattgtcgactctgatgtttcttggatctctttaattttgttaatattgcggtatatgttat

SEQ ID NO: 3547 - DNA, 889 bp, Carpinus betulus
ttaatcacgatttttgcttcgcacaagaaagaagtccagaaaggcgagcgctcggattctagggttattttttccccttttgcgcttctgtttgttccttcttttgcaggaacgctcccaaacgccgtcgtcttttctagatcaccatgtcgtcgtcgaagaagatcaccctgaagagctccgacggcgaggccttcgaggttgacgaggccgttgcgctcgagtcgcagacaatcaagcacatgatcgaggacgattgcgctgacaacggaattcctctcccgaacgtgacgagcaagatcttggccaaggtcatcgagtactgcaagaagcacgtcgaggcggcgaaccccgaggaacgcacatcagacgacgatctcaaggcctgggatgcggagtttgtcaaggttgaccaggcaactctattcgatctcattctggctgcaaactatttgaacatcaagagccttctggatctgacatgccagactgtagcagacatgataaaggggaagacgccggaggagatccgcaagacctttaacattaagaatgacttcacccctgaagaagaggaagaggttcgtcgggagaaccagtgggcctttgaatgatgtattgggcgataatgtgaacgagaatgtggttttatgtagtatattttgtgggtttatattaggcaatagttattctaatgttatcattctctgtttgaagcattctctttctcaaacagtttgagctcttttgaaatgtaaataatatttggattctaatggggcactggtgttgctcctgctatcaatttctcttatacaaaaaaaaccaaaaaaaacaaaaaaacaaaaaaacaaaaacaaaaacaaaacaactatacagtagtacacac

SEQ ID NO: 3548 - DNA, 817 bp, Quercus alba
ttatttcattactaaaaaatttatttctcaatagagagtctcccaaactctatccgatttctagggtttgtgtaaccggaaaagaggtaaagagaagagagagagagagcgagaaaacgatgtcgtcgaggaagataacgctgaagagctcggacggagagacgttcgaggtggaggaagtggtggcgttggaatctcagacgataaagcacatgattgaagacgattgcgccgacaatggaatccctctgccgaacgtgaccagcaagatcttgtcgaaggtcatcgagtactgcaaaaagcacgtcgagaccccgaaagccgaggaccgtgtcgcctctgccgatgaggagctcaagaactgggacctcgagtttgtcaaagtcgaccaggccaccctcttcgatctcatcttggctgcaaattatctgaacatcaagagcttgctggatctgacttgccaaacagtggcagacatgatcaagggcaaaacacctgaggaaatccgcaagacgttcaacatcaagaatgacttcacacccgaggaagaggaggaggttcgcagggagaaccaatgggcctttgagtgaaaaaagttataaaaatgagcagattgtttttacttttttgtggcttatgttttactcttgtgctgaggaaaggggtggttgtttccacctttctaagaccttctagttcttcaagtactgttctaggtgtctctgctgtaaaacaatgtttgttttgcttaaaccttacccacttccctttcctccacatttagttgcgaaatatgatgtttaatggatctctttta

SEQ ID NO: 3549 - DNA, 786 bp, Rosa hybrid cultivar
tgctttttccatattataaactcatttctttcccttccacctcctccatctctctcaatcatttcatctctctctgtgtagaggtttgtagggtaaccacagcagcgatcgaaacgatgtcgtccggaaggaagataacgctgaagagctccgacggcgagtcgttcgaggtggacgaggcggtggctttggaatcgcagaccatcaagcacatgatcgaggacgattgcgccgacaatgggatccctctccccaacgtcaccagcaagatcttggccaaggtcatcgagtactgcaagaagcacgtcgacgctgcgcctaagtccgacgaccgctcctcctcctccggcgacgatgagctcaagaactgggacgccgacttcgtcaaggtcgaccaggccaccctcttcgatctcatcctggctgcaaactatctcaacatcaagaacttgctcgaccttacttgccaaacggtggcggacatgatcaaggggaaaacacctgaggagattcgcaagacattcaacatcaagaatgactttacaccagaggaagaggaggaggtccgcagggagaaccaatgggcttttgagtgaaggtcataaatatgaagaaacctgtttttgttgtttgttgctctttatgtgctatggtctgtctgtttctgaactgctttttctttgcttagtgaactatgtttcgttggatatgcttctccacagacaataattactttcctccatgttaccccttgcccttctaatttacaagttctattgttctcca

SEQ ID NO: 3550 - DNA, 803 bp, Tripterygium wilfordii
ttattggacgagctccctttttcttctctgtttctcttctagggttagggttcttactgtataaacatttcctctaatcaatcatgtcgactagcaggaaaatcactctgaagagctccgatggagaaacttttgaggtcgacgaggctgtggccttggaatcgcagactattaagcacatgatcgaggacgattgtgccgataacgggatcccgcttcccaacgtcaccagcaagatcctctctaaggttattgagtacagcaaaaagcacgtcgacgctgcaaaggctgaggagcgccccgccaatgctgacgatgagctcaaggcttgggacgccgaattcgtcaaggtcgaccaggccaccctctttgatctcatcctggctgccaactatctcaatatcaagagcttgctggaccttacttgccagacggtggcagatatgatcaaaggaaaaacaccagaggagatccgcaagactttcaacatcaagaatgactttacaccagaggaagaggaggaggttcgtcgggagaaccaatgggcttttgagtgaaggacatgaagtgaagaaaaatgtatttgtactgtttgttccattcatttggtgttggaaatggatggctgtttccataatgttgacttgtgtaaaactccttagtactggttaaattcctgcgctagggctctcttttgaaaaacaactgctattctcctccgtggtgctcgtgctcaccccaaaaactggtcgattctgatgttccttggatctctttaattatgttaatatggtggtatatgt

SEQ ID NO: 3551 - DNA, 1354 bp, Cicer arietinum
catttttctacattggacaatggcttatgcttttagtaagagtcattttttcacctttcttgtgatactcacctttctttctttttccctcatcaaagaatctgaagcacaagccaaacctcctcctatagtaaagggactatcatggaacttctacgattcaagttgtcctaagcttgaatctatcatcagaaatgagctcaagaaaatctttgatgatgatattggtcaagctgctggcttgcttcgtcttcacttccatgattgctttgttcagggttgcgatgggtcagtattattggatggatcagcaagtgggcctagtgagaaagatgcaccaccgaacttaagtctaagggcttcggccttcaagataattgaaaaacttcgtggtcgtgtacagaagcagtgtggaagaatcgtctcatgtgctgacatcactgccattgccgcacgtgacgctgttttcctttcaggaggagcagattacaaagttcccttaggaagaagagatggactaacatttgcaacaaggaatgtgacattggataaccttccatcaccatcaagcaacacaacaacaattctaaactcacttgcaaccaaaaaccttaacccaacagatgttgttgctctctcaggtggccacacaattggcataagccactgttcttctttcactaacagactctaccctaaacaagaccctgtcatggacaaaacctatggaaataaccttaaactcacttgtcctactaacaacacagataacacaactgttcttgatattcgtagtccaaacaaatttgataataaatactatgttgatcttatgaaccgtcagggtttattcacctcggatcaagatttgtacactgataaaaggactaaggatattgttactaattttgctgttaatcaatctctgttctttgagaaatttgttgctgctatgattaaaatgggtcagcttaatgttttgactggaactcaaggtgagattcgtgctaattgctctgttaggaataaggctactaaatccttccttggttctgttgtggaagatgtggtcgaaggatttttggaaatttaatttaataaataaatcattacaaatcatagtttcttatttcaatagtaatggaaaaataaaagcttgtattgcttatctaattttctccatcagaaccataaatattacatgtaagatgtctgtgtgactctgtgtattgtgtaattaatgtgtaccctgactcatgtatttgtttaagccctcttttgttaattaattatggtttgatattttaatcttagaatttactcattatttgacggtgtaacaaaatgtttttgc

SEQ ID NO: 3552 - DNA, 1198 bp, Cicer arietinum
atttctatttctataagggaaaatgctagtcgcagctcgataatgtcatctcgttcaaaatttcatgttgcccaactaactcacaactcacaaacacaactgccaacctcggttaattaatagagttcaaaaactgaatttacctctttcctcctaccaatgattatatcacacccctttgcacctcttccttcttgctttacaattacatgttctaagcccttttcccataaaaatcactttatctcttcctcctctacatctccacacctagtcctgacctattcaacaacatcaacattgttatgtagtgctagaagtcgaagacgtacagacttcaatgtagacatcactgatgaagatcaggtggttgagaatgatgattatggtgggttttcagctcaaggaatggaatcaaaggacattgatatagaagacgatgacaaaagatattcaggtggaggactgtataaaggcgtggaagagaaggattttgacagaaatcctgaatttgctgaattaattggggattttcttgatgatcctgaaaaggcacaatctagaatggaagatagactaagaaagaaaaggaataaaatactgcacacaaagactggatcaggagtacaaatgaaagtgtcatttaataaatttgatttttcaaactcatatatatggtttgaatttcacaatgctccattggcaaaagacgtctccttactttgtgatactattcgggcgtggcacattctaggacggcttggaggatgcaatgccatgaatatgcaactgtcacagtcacagatggaaaaacgaccaaattatgattatattcaaggagcgaatgtgacaccaactacattttacaatattggggatcttgaggttcaagacaacttggctcgaatatgggtggatattggaactaatgaaccgctgattctagatgttttgataaacgcattgacacaaataagttcagactttgttgggatcaagcaagtagtattcggtggagaagaatttgagaattggaaagagaatctaacatcagaggattcaggttatggtgttcacaagatatagatacttttctaggcatagtcaaatgaagagtaaatcaatgatatgtatcttttagtaatctattgtatcaaagttgtaagcattttcctgaatttatattttgattgtttag

SEQ ID NO: 3553 - DNA, 1181 bp, Cicer arietinum
ttgaaacactaggaaatgaagcaaacataaaccccatttttcgcacagaaaagagaaatctttccaaaagcaaaaatgttgaagctatctcgcgcgcttcgttcatattccaggcatcaactattggaagtggtgtcgtctacgaaagttgaagttgcgggattctctactgcaacaaataactattctgctaaaggatataataataattataatagttcagatcgtatttttgctccttattctgtttacaagggaaaagctgcattctcactcagtccttgtcttccaactttcactaagttggattctggggctcttgtggttgagcgtcgcggttccataatgatgagtttcatgcatgctattggggagcacaaatatgactgggagaagagacaaagatttgctctatcagctactgaagttggttctttgatagccattggtccccaagattcatgtgaattctttcatgacccctcaatgaaatcaagtaatgctggccaagtaaggaagaacttatcaattaagcctcatagcaatggctactttgtctctctgaatgttgttaacatcgttttaaataccaaagacagtttcagtgttcctgttacaactgccgagtttgctgtgatgaagacagcttgcagttttgcattgccacacattatgggttgggatcgtctaactaatcagcaaatgcagtccaatgggacagttggctttcaatcgaagacaaacccacaaattttagacttggaatgggacaagtgaattactgttgggaaacattaaatgaatccttctttgtgctgcagttccattttggttattatcaatccaaatactaggattgctatgggaagataacttgtaaattgtaatatttaagcaagagatatgagaaggacgattgattaaatatcgatgctgttttgcaattagttgtgttattgatattttgttgatgtttcttgtcttctcttttgtttcttttgtttactttaggctgttagaagttagaacatagtcaatcccatgttcatggcaatgtatattctggaaggcagtttaatggttagttgtgttaatgattatttctgtccattctacttgagtagtgataattttctgtcacgctctgaataaatagtatgcagcatgtggatgagttaaat

SEQ ID NO: 3554 - DNA, 1921 bp, Oryza sativa
agtacacacactccacctaatcttcttctcctcacacattcacacacacacaccccgcagaccccggcaccttaccgagcggcggctcagcacgctgctgctacgcacatggacaagagccagggagtcctactgtccagcaacgtcggggccggctcccggccgtggccggagctgctcggctccgcccactgggacggcctcctcgacccgctcgacctcacgctgcgccgcctcatcctgctctgcggcgacctctgccaggtcacctacgactccttcaactccgactcccactccaagtactgcggcacctgccgcttctccaggtccacgctcctcgaccgcacgcagttcccggccgccggcgacctctccgtcgccgcctacctctacgccacctccgacgccacggcgttcccggggagcatggtgtactcgatgtcgcgcgaggcgtggagcaaggagtccaactggatcggctacgtcgccgtgtccaacgacgccgcagcggccgcctcgggccagcgcgtcatctacgtcgcgtggcgcggcaccatccggtcgctggagtgggtcgacgtgctcaagccggacctggtcgaccacgacgacatcctccccgaggggcacccggggcgcggccggtcgcgcgtcatgaaggggtggtacctcatctacagctccaccgacgagcgctcccctttctccaagtacagcgcccgcgaccagatgctcgccgccgtgcgcgagctggtggcgaggtacaggaacgagagcctcagcgtcgtctgcacggggcacagcctcggcgcgtcgctcgccacgctctgcgcgttcgatatcgtcgtcaacggcgtttccaaggtcggcgacggcgcgcacatcccggtgaccgccgtggtgttcgggagcccgcagatcgggaacccggagttcaagaagcagttcgaggagcagcccaacctgcgggcgctgcacgtcaggaacacgcccgacctcatcccgctctacccgagcggcctcctcggctacgccaacgtcggcaaaaccctccaggtcgactccaagaagtcgccctacgtgaagcgagacaccagcccaggcgactaccacaacctgcaggggatcctacacacggtggccggctggaacgggaaggacggcgagttcaagctccaggtgaagcgcagcgtcgcgctggtgaacaagtcgagcggcttcctcaaggacagcaaccttgtgccggagtcatggtgggtggagaggaacaaaggcatggtgctcggccagaacggggaatggcagctcgaggggcccgcagaggagaacctgcccgtgccaccggtggtgaccgggaagatcatcgacgacgacgtcgctgccgtggccacctccagcagtgccaaggaggataagaagacgggcaaagggtctaagcttctgtctggattgattgatcaactgctttgtgtgcctgatacatgtaaagccggagctgcgtgagttgttgaagaccacatcagaaaaagactcgagagcggtggcgtcgaactgatatgcttgtgaagtagctggagcttgggagttgggagcgagctagattacaacaatgtcatttatcggtttttctttggaataaaatgagttgttttgttaggagaaagtagtatttttcctttctgcttttagtgtctcttgagaaagaataaaatgagtcctggcatcataagtaggtgggttagtcgactaggttcgagcctcaccacatctcaataaatatcgatatgtgacccctcctttcatatccagtatcttttaagtgtgccttgtctcctagatataatttctgtttaaaacagccttctacctgaacatgtatgatagaagcataaactgagcacaccaatttttcccttcc

SEQ ID NO: 3555 - DNA, 1528 bp, Glycine max
ttatattatatcaatatatataataaactcatcagcattaaactcttgcacaattcccatattttgttcgcaaagttatataatctgaagtctgaactttaagcggtgaatttagcaagtggcacagaaagaaaacagatgtttagagaggaattcccgagaatacccccgcacgttcctcaaaatctcgtctcgaaagcgccaatagcgtcccccacacacactctctctccctctccttcctccctcgctttctctctccccgcgatggagaaagccgagagctccgcctccacatcagagccagactccgacgacaaccaccaccgccacccgacgaaccaccacctcaaccctccctccggcctcaccccgctcgagttcgcctccctcgtcccctccgtcgccgagcaccactcctacctcgtcggccccggccaatgctcctccctcctcgcccagcgcgtccacgcgcctccagacgccgtctggtccttcgtccgacgcttcgacaagccccaaacctacaagcacttcatcaagagctgcgccgtcaaagagcccttccacatggccgtcggcgtcactcgcgacgtcaatgtcatctccggcctccccgcagccacgagtaccgagcgcctcgacttcctcgacgacgtccgccgcgtcaccggcttcagcatcatcggtggcgaacaccgcctccgtaactaccgctccgtcaccaccgtccactccttcgacgacgacaacgcctccgccgacggcaagatctacaccgtcgtcctcgaatcctacgttgtcgacgtccccgacggcaacaccgaagaggacacgcgtctcttcgccgacaccgtcgtcaagctcaacctccagaagctcgcgtccgtcaccgaaggaaccaacggcgacggtgacggtaagccacactcgcggtgaggaagcaagcaagcctcaataaaaaaatatatatatattaaagcaaaaaaaagaaaagaaaaagggaattggaatttgaaacaaatctctccctccccaattcataaaaaaggagaaaagcaaaacaagtttttctctcttttctttttattttcctaaattcattttgttttcgttttattttatttttttcggctgagactctcgttttttttttttttctgtttttgatgattttgtttgcgcgctcgcaagcaatagcatgtcctccatggtcgtcgtcgtggatgcaccgttgaatttttgtcattacaatggaagagggcatttcagtcaatgcacgtgtacaggaaatgttgactttgtgatgcttgttcatcgtgtctttttaacccgttctgttctgtgaatatcatttactttttctgctcgattttattccatgtacaaatctttttcctttttctcccatgagtgcaagcctactaattaaagaagatgcttccttctgtagattgcagatgcttatgctataattgaattgaaagaatcaaataagtttactgttaaattttgttaattatgaagg

SEQ ID NO: 3556 - DNA, 1445 bp, Glycine max
tctgaagtctgaactttaagcggtgaatttagcaagtggcacagaaagaaaacagatgtttagagaggaattcccgagaatacccccgcacgttcctcaaaatctcgtctcgaaagcgccaatagcgtcccccacacacactctctctccctctccttcctccctcgctttctctctccccgcgatggagaaagccgagagctccgcctccacatcagagccagactccgacgacaaccaccaccgccacccgacgaaccaccacctcaaccctccctccggcctcaccccgctcgagttcgcctccctcgtcccctccgtcgccgagcaccactcctacctcgtcggccccggccaatgctcctccctcctcgcccagcgcgtccacgcgcctccagacgccgtctggtccttcgtccgacgcttcgacaagccccaaacctacaagcacttcatcaagagctgcgccgtcaaagagcccttccacatggccgtcggcgtcactcgcgacgtcaatgtcatctccggcctccccgcagccacgagtaccgagcgcctcgacttcctcgacgacgtccgccgcgtcaccggcttcagcatcatcggtggcgaacaccgcctccgtaactaccgctccgtcaccaccgtccactccttcgacgacgacaacgcctccgccgacggcaagatctacaccgtcgtcctcgaatcctacgttgtcgacgtccccgacggcaacaccgaagaggacacgcgtctcttcgccgacaccgtcgtcaagctcaacctccagaagctcgcgtccgtcaccgaaggaaccaacggcgacggtgacggtaagccacactcgcggtgaggaagcaagcaagcctcaataaaaaaatatatatatattaaagcaaaaaaaagaaaagaaaaagggaattggaatttgaaacaaatctctccctccccaattcataaaaaaggagaaaagcaaaacaagtttttctctcttttctttttattttcctaaattcattttgttttcgttttattttatttttttcggctgagactctcgttttttttttttttctgtttttgatgattttgtttgcgcgctcgcaagcaatagcatgtcctccatggtcgtcgtcgtggatgcaccgttgaatttttgtcattacaatggaagagggcatttcagtcaatgcacgtgtacaggaaatgttgactttgtgatgcttgttcatcgtgtctttttaacccgttctgttctgtgaatatcatttactttttctgctcgattttattccatgtacaaatctttttcctttttctcccatgagtgcaagcctactaattaaagaagatgcttccttctgtagattgcagatgcttatgctataattgaattgaaagaatcaaataagtttactgttaaattttgttaattatgaagg

SEQ ID NO: 3557 - DNA, 1338 bp, Phaseolus vulgaris
ggcagagaaagaaaacagagtttgagaggggaattcccaagagtacccctaaccgttcctcaaagtctcgttccgcaagtgccaaacagcgtcacttacacactctctccttctcacgctctctctctttctctctccccgccatggagaaaggtgagagctccgccaccacatcggagccagactccgatgacaaccaccgcatcccgaccaaccaccacctcaaccctcctttcggcctcaccccgcatgagttcggctccctcgtcccctccatcacggagcaccacatctacctcgtcggcccgggccaatgctcctccctcctcgcgcagcgcgtccaggctccgcccgaagttgtatggtccgtcgtccgccgcttcgacaagccccagacctacaagcacttcatcaagagctgcgccgtcaaagagccctttcacatggccgtgggcgtcacacgcgatgtcaatgtcatctccggcctcccgccgctactagtacagagcggctcgactacctagacgacgaccgccgcgttaccggtttcagcatcatcggcggcgaacaccgcctccgcaactaccgctccgtcactaccgtccacgccttcgactccgacgcagacgctaagatctacaccgtcgtcctcgaatcctacatcgtcgacgtccccgacggcaacactgaagaagacacgcgtctcttcgccgacaccgtcgtcaagctgaaccttcagaagctcgccaccgtcaccgaaggaacaaaccgcgacggtgactataagccacactcacggtgaagcaaaccaaacgaaaccaccactgcgcaaatctcaataaaaacaaaaaaaaattaaacaaaagaagggattggaatttgaaacaatcgctccctcgctcaccaattcataaaatgagaaaaacaagtttttctctcttttcttttctttatttttctctttggaaattcatttagttttccttaatttttttcgggtgagactctggttttgtgtttttgatgattttctttggcggtagctagcatgtcctctttggtggtccgttgaattttgttattacaatgggtgagggcattttggtgaatgcaggtgtacaggaaatgttgacttgtgatgtttgttcttcatggtgtctttcaaccgttctgtgaatatcatcatttacttttcctctggatttgattccgtgtacatatcttctcttttttctcccatgagtgcaagcctacttaaagaagatgctttcttctgtggattgaacatgcttatgctattattgcacgaatcaaataagtttactgtcaaattttgtt

SEQ ID NO: 3558 - DNA, 1235 bp, Phaseolus vulgaris
aaaatgctaaccgttaatattgggagtgaggcacagaaagagttgaagagatatagataacgtgaaacagaaaggaaaatggcactctccctgtgttccggtgttcgcgttccttattgctctccttcgtgttcttggaaaccaaatggtaaaaattgcgaagcgcctactaagatgtcatgtaccgcagttcacagtgataagaagaatccattggttggaatgggtattgggttggtaacggcttgggtgatgggtttaacggcgttagatgcggacgccacaagaatcgaatactacgctaccgttggagagcctttgtgtgagtacaagtatgtgaagtctggcctcggttactgtgatattgtcgagggcttcggtgtggaagctccaatcggtgagcttatcaatgttcactatactgcgagattcggtgatgggatagtgtttgatagcagctacaaacgtggtagatctctcaccatgcgcattggtgttggcaaggtaatcaagggactggatcaaggtattttagggggtgaaggagttcctccaatgcggataggtgggaaacgcaaactgtatgttcctccgcagttagcatatggccctgaacctgcggggtgcttctcaggtgactgcaacatacccgccaatgccactcttctgtatgatgttaattttgttgagctttattcggggaacagatcaaagtgaacgaagtcaaagctgataagatatatatatgcatatgaaccacacatggattgggtagaagcagacatgcggtaaataaatttaatatatcttcttatagtataacgtgaaaaatgctacttaaagctattaatgctaagagataatgatgtgatatactggtatgctttcttttcttctctggcctagtttatctaaaataggtacaattctaatttcttattgcttttagagcaatgaaatagtggagaatgtggatcaacttgtttggaagaatctccttcccaattccagctacctcaagttactgttcctggatagtggagtggtacatgattgacctggatatcccttttgtgagtaatgaccagtccttcctcggatatctattacataattcacgtgtatctctgcacaggacatgcgagcaacttgtgtatctttagtgtatatgtaattttctgaatgataaaaaattattaattcttgatatgataaatgtcacctcttatacatga

SEQ ID NO: 3559 - DNA, 1062 bp, Phaseolus vulgaris
aggaatgaaaatgctaaccgttaatattgggagtgaggcacagaaagagttgaagagatatagataacgtgaaacagaaaggaaaatggcactctccctgtgttccggtgttcgcgttccttattgctctccttcgtgttcttggaaaccaaatggtaaaaattgcgaagcgcctactaagatgtcatgtaccgcagttcacagtgataagaagaatccattggttggaatgggtattgggttggtaacggcttgggtgatgggtttaacggcgttagatgcggacgccacaagaatcgaatactacgctaccgttggagagcctttgtgtgagtacaagtatgtgaagtctggcctcggttactgtgatattgtcgagggcttcggtgtggaagctccaatcggtgagcttatcaatgttcactatactgcgagattcggtgatgggatagtgtttgatagcagctacaaacgtggtagatctctcaccatgcgcattggtgttggcaaggtaatcaagggactggatcaaggtattttagggggtgaaggagtacctccaatgcggataggtgggaaacgcaaactgtatgttcctccgcagttagcatatggccctgaacctgcggggtgcttctcaggtgactgcaacatacccgccaatgccactcttctgtatgatgttaattttgttgagctttattcggggaacagatcaaagtgaacgaagtcaaagctgataagatatatatatgcatatgaaccacacatggattggagcaatgaaatagtggagaatgtggatcaacttgtttggaagaatctccttcccaattccagctacctcaagttactgttcctggatagtggagtggtacatgattgacctggatatcccttttgtgagtaatgaccagtccttcctcggatatctattacataattcacgtgtatctctgcacaggacatgcgagcaacttgtgtatctttagtgtatatgtaattttctgaatgataaaaaattattaattcttgatatgataaatgtcacctcttatacat

SEQ ID NO: 3560 - DNA, 681 bp, Glycine max
catacgaagagttgaatagagatatagataacgtgaaactgaaagggaaatggcactctcactctcctccatcctcctctttctgtgtatgcattccttcatgtgcattgtgcagctcacaatgataataagaatccattggttggaatcggtattggggttgtaacggcttgtgtgatgggtttaactgcattggatgcggacgccacgagaatcgaatactacgcaacagtggcagagcctttctgtgagtacaactatgtaagtctggcctcggttagttactcacttcggtgacgaagctccacttgctgagcttatcaatgttcactatactgcgagattcgctgatgggatagtatttgatagcagctataaacgtctagacctctcaccatgcgcattggtgtgggcaaggtaatcaagggactggatcaagggattttagggggtgaaggggtacctccaatgcgaataagtgggaaatgcaaactgcagattcctctgcacttagcatatggccctgaacctgcagtgtgcttctcgggtgactgcaatatacccggcaatgccactcttctgtatgatattaattttattgaggtttattcggggaacagatcaaagtgaagtcagtcaaagctatatacatatgaaccacagatggatgggttgagtttc

SEQ ID NO: 3561 - DNA, 976 bp, Medicago truncatula
gaactatacacacacacactaagatagaaaatggcactctcattctcactctgttcaggcacaaccgttcataaccgttttccttcttgtatgaaattgaatggtaaaagttataaagtatccgataaagtgttatgttctgcacgtaacggtaacgaaaagaagccgttagtgggaattggtattggaattgtagcagcatgggtaatggggttaacagcgttggatgcagatgcaacgagaattgaatactatgctactgtgggagaaccaatgtgtgagcttaattatgttaaatctgggcttggttactgtgattatgttgagggttttggtgatgaagctcctttaggagagcttattgatattcactatacagctaggttcgccgatggaatagtatttgatagtagttataaacgtgctaggcctttaactatgcgtattggtgttggcaaggtaataaggggattggatcagggaattttagggggtgaaggagtacctccaatgcggataggtgggaaacgcaaactcacgattcctccattgttagcgtatggtcctgaacctgcaggctgtttctcaggtgactgcaatataccgggtaatgcaactcttctgtatgatattaaatttgttggtctttattcgggcaatcgaagtcaatgaagacaaaattgatcgaatacgtatacgtatatgaaccgcacgtggattagagtaatgaaatggactttttttgctggtgagtgtggatcgacttgttaggcagattctccttcctggttccagctctctcaaattactattcctgtttagtgcagtccgacatgattcacctgaatagaataccccttttaagagtaaagaggatccaaccctggtgcggtgatatatattagacatgtctggtaacatgatgcaactttttgtatctttattgtaaatgtaattttcaatagtacactctgaa

SEQ ID NO: 3562 - DNA, 1681 bp, Glycine max
gaaccaaccaaaaccaaagggtggttgaagcagagataagtgatatgcaaaacatgtctctaatagcttcactctcctccacaacttcacaactcacttcccttccttccctcccttcttccacctctccactttctcgcaaatttcccctcactttccgggaaaaaaacagaactccaatcacacctcacaagctccctttttcagcaaggcctaccactaccagagtggtgttggtgaagtctcaggccacagcacctgcttcttctgaggctgtggcagtgacacctgtgtcttctgagatgaaggcatgggtctatggggaatatgggggtgtggatgttctgaagctggactccaatgttactgtgcctgatgtgaaggaagatcaggttctaatcaaagttgttgctgctgctcttaaccctgttgatgccaagaggaggcagggaaagtttaaggccactgattctccccttccgactgttccgggctacgatgtagcgggtgtggtggtgaaggttggtagtcaagtgaaggactttaaagtgggtgatgaagtgtatggagatgtaaatgagaaagcactagaaggacctaagcaattcgggtctttggctgagtacacagctgttgaggagaaattgttggcatcaaaaccgaagaatttggactttgctcaagctgctgctcttcctctagcaattgagactgcttatgagggtttggagaggactggattttctcctggtaaatctattcttgttctaaatggttctggaggagttggtagcctagtgattcagctagctaagcaagtttttggagcttcaagagttgctgccacttcgagtactagaaatttggacctattgaaaagcttgggagctgatttggctattgactacacaaaagagaactttgaagatttgccagaaaaatttgatgtagtttatgatgccattgggcaatgtgacagggcagtgaaggctgtgaaagaaggcggcagtgtcgtggcactcacaggtgctgttacaccacctggcttcagatttgtagttacttccaatggagctgttctgaggaaactaaacccttacttagaaagtgggaaggtgaagccaattgtagaccccaaaggtccattctcctttgataagcttgctgaagccttctcttaccttgaaacaaaccgagccactggaaaggttgttatacatccaatcccttgaatcaaataaaagggataggcaatttttctgtgtgtctagtaaacttcacattctgtgcaaatcagagtttagataaaaactcaaaaaaatataatgaacttcatttttacattcttagtactttaaattttccattacatttcacctagtttgaaagcaaaacattcttcaaatttgatccgtaaaagagagctcttcttagatacggggatagagtgtgtcgtctactcattcagttaatttgaaaacagcaacatgctctctggttttgttggataattcagtctgggatccatacaatgtaagattatgttttgaaattgccagtacaacaaagttcagaacatagaagatatgttctccattattttaacttcaccaaaatattaaaagaaatatttcccttgtatcaagtcgtgcctttcatacacggttctcaaacaatttgg

SEQ ID NO: 3563 - DNA, 1923 bp, Glycine max
atattataaccgaaccaaccaaaaccaaagggtggttgaagcagagataagtgatatgcaaaacatgtctctaatagcttcactctcctccacaacttcacaactcacttcccttccttccctcccttcttcctcctctccactttctcgcaaatttcccctcactttccgggaaaaaaacagaactccaatcacacctcacaagctccctttttcagcaaggcctaccaccaccagagtggtgttggtgaagtctcaggccacagcacctgcttcttctgaggctgtggcagtgacacctgtgtcttctgagatgaaggcatgggtctatggggaatatgggggtgtggatgttctgaagctggactccaatgttactgtgcctgatgtgaaggaagatcaggttctaatcaaagttgttgctgctgctcttaaccctgttgatgccaagaggaggcagggaaagtttaaggccactgattctccccttccgactgttccgggctacgatgtagcgggtgtggtggtgaaggttggtagtcaagtgaaggactttaaagtgggtgatgaagtgtatggagatgtaaatgagaaagcactagaaggacctaagcaattcgggtctttggctgagtacacagctgttgaggagaaattgttggcatcaaaaccgaagaatttggactttgctcaagctgctgctcttcctctagcaattgagactgcttatgagggtttggagaggactggattttctcctggtaaatctattcttgttctaaatggttctggaggagttggtagcctagtgattcagctagctaagcaagtttttggagcttcaagagttgctgccacttcgagtactagaaatttggacctattgaaaagcttgggagctgatttggctattgactacacaaaagagaactttgaagatttgccagaaaaatttgatgtagtttatgatgccattgggcaatgtgacagggcagtgaaggctgtgaaagaaggcggcagtgtcgtggcactcacaggtgctgttacaccacctggcttcagatttgtagttacttccaatggagctgttctgaggaaactaaacccttacttagaaagtgggaaggtgaagccaattgtagaccccaaaggtccattctcctttgataagcttgctgaagccttctcttaccttgaaacaaaccgagccactggaaaggttgttatacatccaatcccttgaatcaaataaaagggataggcaatttttctgtgtgtctagtaaacttcacattctgtgcaaatcagagtttagataaaaactcaaaaaaatataatgaacttcatttttacattcttagtactttaaattttccattacatttcacctagtttgaaagcaaaacattcttcaaatttgatccgtaaaagagagctcttcttagatacggggatagagtgtgtcgtctactcattcagttaatttgaaaacagcaacatgctctctggttttgttggataattcagtctgggatccatacaatgtaagattatgttttgaaattgccagtacaacaaagttcagaacatagaagatatgttctccattattttaacttcaccaaaatattaaaagaaatatttcccttgtatcaagtcgtgcctttcatacacggttctcaaacaatttggtgagaagagtttgtgagaaatactttgttattgttgcatgcctaaatttctatttcatcggataattaattaatgttgttaacacctaaagttagtcgttggagcaacaactgctgattggatacgattggcataaggaaaccaattgagggtaaaaagctaaaatgactaggatggaacactttgagtggtctgaaggctgatttagagaacgtgtaagacagattgaca

SEQ ID NO: 3564 - DNA, 1334 bp, Phaseolus vulgaris
tataaccgaaccaaagggtggttggttgaggcatagataagtgtgaagtgatatgcaaaacatgtctctctgtgcttcaccctccaccacaacttcacacctcacttcccttccttcttcactcccttccacttcaccactttctctcagattttccttcactttccgggaaaacagaaccccagttagatcactcaaagctcccttttcagcaaggcctgcaagagtgttggtgaaggctcaggctactgcacctgcttcttctgaggctgtgaaactcacacctgtgccttctcagatgaaggcatgggtgtatggggaatatgggggtgtggatgttttgaagctggactccaatgttgctgtgcctgatgtgaaagaggatcaggtccttgtcaaagttgctgctgctgctcttaaccctgttgatggcaagagaaggcagggaaagtttaaggccactgattctcctcttccgactgttccgggctatgatgttgcgggtgtggtggtgaaggttggtagtgaagtgaaggactttaaagtgggtgatgaagtttatggagatctaagtgagaaagcattagaagggcctaagcaattcgggtctttggctgagtatacagctgttgaggagaaactattggcactaaaacctaagaatttggactttgctcaggctgctgctcttcctctagcaattgagactgctcatgagggtttggagaggactgcattttctcctggtaaatctattcttgttctaaatggttctggaggagttggaagcctagtcattcagctagctaagcaagtctttggagcttcaagagttgctgccacttcaagcactagaaatttggacctgttgaaaagtctgggagctgatttggctattgactacacaaaagaaaactttgaagatttgtcagaaaaatttgatgtagtctttgatgccattgggcaatgtgacagggcagtgaaggctgtgaaagaaggtggcagtgtggtggcactcacaggtgcggttaccccacctggtttcagatttgtagttacttccaatggagctgttcttaggaaactaaacccttacttagagagtggaaaggtgaaaccaattgtagaccccaaaggtccatttccctttgaccagcttgctgaagccttctcctaccttgaaaccaatcgagccactggaaaggttgttatacaccccatcccctgaatcagacaaaagggttagacaattttgctatgtctagtcaacttcatattctatataaatgtagcactcttcttgttgaatggtgaagctcatatttgatccatta

SEQ ID NO: 3565 - DNA, 1507 bp, Phaseolus vulgaris
ggaacaagtgtgtgtgaagctaatgtactaaacaaaacactaacgatataaccgaaccaaagggtggttggttgaggcatagataagtgtgaagtgatatgcaaaacatgtctctctgtgcttcaccctccaccacaacttcacacctcacttcccttccttcttcactcccttccacttcaccactttctctcagattttccttcactttccgggaaaacagaaccccagttagatcactcaaagctcccttttcagcaaggcctgcaagagtgttggtgaaggctcaggctactgcacctgcttcttctgaggctgtgaaactcacacctgtgccttctcagatgaaggcatgggtgtatggggaatatgggggtgtggatgttttgaagctggactccaatgttgctgtgcctgatgtgaaagaggatcaggtccttgtcaaagttgctgctgctgctcttaaccctgttgatggcaagagaaggcagggaaagtttaaggccactgattctcctcttccgactgttccgggctatgatgttgcgggtgtggtggtgaaggttggtagtgaagtgaaggactttaaagtgggtgatgaagtttatggagatctaagtgagaaagcattagaagggcctaagcaattcgggtctttggctgagtatacagctgttgaggagaaactattggcactaaaacctaagaatttggactttgctcaggctgctgctcttcctctagcaattgagactgctcatgagggtttggagaggactgcattttctcctggtaaatctattcttgttctaaatggttctggaggagttggaagcctagtcattcagctagctaagcaagtctttggagcttcaagagttgctgccacttcaagcactagaaatttggacctgttgaaaagtctgggagctgatttggctattgactacacaaaagaaaactttgaagatttgtcagaaaaatttgatgtagtctttgatgccattgggcaatgtgacagggcagtgaaggctgtgaaagaaggtggcagtgtggtggcactcacaggtgcggttaccccacctggtttcagatttgtagttacttccaatggagctgttcttaggaaactaaacccttacttagagagtggaaaggtgaaaccaattgtagaccccaaaggtccatttccctttgaccagcttgctgaagccttctcctaccttgaaaccaatcgagccactggaaaggttgttatacaccccatcccctgaatcagacaaaagggttagacaattttgctatgtctagtcaacttcatattctatataaatgtagcactcttcttgttgaatggtgaagctcatatttgatccattagcaccaattccaaatcaattggaagaacaaaaggaaaaagcaaatcatagtggaattaggtaggaaatctaaagaaatacactataatcctagattgatagatgaattaagtaacattcacttcaag

SEQ ID NO: 3566 - DNA, 1685 bp, Cicer arietinum
attttgccaaaaaacaaaaaaaatacaaacttcaaagggtggttgaagttgaagcagagacaacatacaactgataaggcaataacgaaaccatgtcactctcctccacaacttcccacctcactatccttccttcacttccttcaacttcaccactttctctccgattttccttcactttccgagaaaaaagaaaccaaaccacacctctcacaacaaccctgttagcttcaccaaggactgccactgctagattcttggtgaagtctcaggccacaactactcctgcttcttccgaggctgcgaaagtgacacaagtgccttctgaaatgaaggcttgggtgtatggagaatatggaggtgttgatgttttgaaatttgattccagtattgctgtccctgatgttaaggaagatcaggttcttgttagagtttttgctgctgctcttaaccctgttgatggtaagagaagacaagggaagtttaaagccactgactctcctcttccgactgttcctggctatgatgtagctggagttgtggtgaaagttggtagtgaagtaaaggatttcaaagtgggtgatgaagtgtatggtgatgtaaatgagaaagcacttgaagggccaaaacagtttgggtctctggctgagtacacagctgttgaggagaaattgttggcactaaaacctaagaatttagactttgctcaagctgcttctcttcctcttgcaattgagactgcttatgagggtttggagaggactggtttttctgctggtaaatctattcttgttcttaatggttctggtggagttggaagtttagtgattcagctagctaaacaagttttcggagcttcaagagttgctgccactgcaagcactagaaatttggagttgttgaaaagtcttggagctgatttggctattgactacacaaaggagaactttgaagacttgccagaaaaatttgatgtagtttatgatgctattgggcaatgtgatagggcagtgaaggctataaaagaaggtggcagtgtagttgcacttacaggtgctgttacaccacctggcttcagatttgtagtaacttccaatggagcagttctgaagaaactaaacccttatttagagagtggaaaagtgaagccaattgttgatcccaaaggcccattcccttttgatcaggtggttgaagctttctcttacgttgaaacaaacagagctactggaaaggttgttatataccccatcccatgaatcaaataaaaattttaggcaattttgttatgtatccagtgattttcattgttcacactttatcggtaaataagagttcacaccctatgtatctagtgatggtcacattttctccctttaattgtatgtttgtttcaagagaaagataggtgagagactttgctacgacagatttaaacgagaaatgacgataaaataccgaagagaagtaaaacattgtgggccctgtgcctttttcttttctttgttgatatgcgaagaaaaggggagagagaaacttttacttttcctactattacccatgcgttaatgcttcaagacataatccactgtaataataacaataaggtccaaaaattgctaataataaaaataaggtccaaaattgctacacttatcagtaatagtaagctcatatttgaatcg

SEQ ID NO: 3567 - DNA, 1203 bp, Arachis hypogaea
gagagcagagataagtgataagccgttagaaaacaatgtccgtctcagctgcactctcctccacaccttcccacctcacctctctcccttccactactccattttctctcagattttccctccctttccgggaaaataacagggaccggttattcttcggtcctcagagtcggagacacttaggagttgtggtggtgaggtctcaggctacaaccacacctgcttcttctgaggcagttaaagcgacggctgtgccttctgagatgaaggcatgggtgtacggtgagtatggcggtgttgacgtgttgaagtttgattccagtgttggtgtccctgatgtcaaggaggatcaggttcttgttaaggttgttgctgctgctcttaaccctgtcgatgccaagagaaggcagggaaagttcaaggccactgattctcctcttccgactgttccggggtacgatgttgccggagtggtggtgaaggttggtagcaaagtaaaggatttcaaagtgggtgatgaagtatatggtgatgttaatgagaaagcacttgaagggcctaagcaatttgggtctttagctgagtacactgctgttgaggagagattgttagcaccaaaaccaaagaacttgaactttgctgaggctgcttctctccctcttgcaattgagactgcttatgagggtttggagaggcttggattctcccctggtaaatccattcttgttctaaatggttctggtggtgttggaaccctagtcattcagctagctaagaaagtttttggggcttcaagagttgctgccacttcaagcaccagaaatttggagctgttgaaaagcttgggagctgatttggctattgactacacaaaggagaactttgaagacttgccagaaaaatttgatgttgtttatgatgccattgggcaatgtgagaaggcagtgaaggcagtgaaagaaggtgggagtgtggtggcactaacaggagcagttacaccacctgggttcagatttgtggttacttccaatggagctgttctcaggaaactgaacccttacttggagagtggacaagtaaagccagttgtggatcccaaaggtcccttctcctttgctcagcttgttgaagccttcacttaccttgaaacaaaccgtgctactggaaaggtcgtcataagtcccatcccataaagacagagaa

SEQ ID NO: 3568 - DNA, 1518 bp, Medicago truncatula
cagatgcgagcgtataggcatgcagtcaatatcaccaccataccatataatcatgcaacaaaacaaaacattaaacaaaacaccaacgttaaaacgtggttgaaactaaaacagaaacagaaacaactgcaactgataaggcaacatcagaaacaatgtcactctccaccacaacttctcacctcaccattcttccttcacttccttcaacttcaccactttctctcagattttccttcactttccaaccaaaaactaaccaaaaaacttgtctcaaaactctcttgtcttcttcaacaaggcatgctagattcttggtgaagtctcaatctactactgcttcatctgaggctgtgaaagtgacacaagttccttctgaaatgaaggcttgggtgtatggagaatatggaggtgttgatgttttgaaatttgactccaatgttgctgtacctgatgttaaggaagatcaggttcttgttaaagttgttgcagctgctcttaaccctgttgatggtaaaagaaggcagggaaagtttaaggctacagattctccgcttccgactgttcctggctatgatgttgctggggttgtagtgaaggttggcagtgaagtaaaggacttcaaagttggtgatgaagtgtatggtgatgtaaatgagaaagcattagaagggcctaaccaatttgggtctttggctgagtacacagcggtcgaggagaaattgttggcactaaaacctacaaatttggactttgctcaagctgcttctctacctcttgctattgagactgcttatgaaggtttggagaggactggattttcttctggtaaatctattcttgttctcaatggttctggtggagttggaagcctagtgattcagctagctaaacaagtttttggagcttcaagagttgctgctacttcaagcactagacatttggagctactgaaaagtcttggagctgatttggctattgactacacaaaggagaactttgaagacttgccagaaaaatttgatgtagtttatgatgccattgggcaatgtgacagagcagtgaaggcaataaaagaaggtggcagtgtagtagcactaacgggagctgttacaccacctggattcagatttgtagtgacttccaatggagctgttttgaagaaactaaacccttatttagagagtggaaaggtgaagccaattattgatcccaaaggtccattcccttttgatcaggttgctgaagctttctcttacattgaaacaaacaaagctactggaaaggttgttgtattccccatcccatgaatcaaatcaaaattataggcaattttgttatgtatgtatctagttatgttcacatccattgagtaaataagagttctgataacagcaaaaaaaattatactcagtactttattgtcattctttctcccttgaaactttatgacatttaatttttttggtgtacaaacgggtatccaagaagctcttcctaaaagttttaacactgttg

SEQ ID NO: 3569 - DNA, 1228 bp, Arachis hypogaea
gactagaatattttctgttacaaaaacatgtaacattcacatggttagttagaaagttagttgagagcagagataagtgataagccgttagaaaacaatgtccgtctcagctgcactctcctccacaccttcccacctcacctctctcccttccagttctccattttctctcagattttcccttcctttccgggaaaataacagggaccggttattcttcagtcctcagagtcggagacactcaggagttgtggtggtgaggtctcaggctacaaccacacctgcttcttctgaggcagttaaagccacggctgtgccgtctgagatgaaggcatgggtgtacggtgagtatggcggagttgacgtgttgaagtttgattccagtgttggtgtccctgatgtgaaggaggatcaggttcttgttaaggttgttgctgctgctcttaaccctgttgatgccaagagaaggcagggaaagttcaaggccactgattctcctcttccgactgttccggggtacgatgttgccggagtggtggtgaaggttggtagcaaagtaaaggatttcaaggtgggtgatgaagtatatggtgatgttaatgagaaagcacttgaagggcctaagcagtttgggtctttagctgagtacactgctgttgaggagagattgttagcaccaaaaccaagaacttgaactttgctgaggctgcttctctccctcttgcaattgagactgcttatgagggtttggagaggcttggattctcccctggtaaatccattcttgttctaaatggttctggtggtgttggaaccctagtcattcagctagctaagaaagtttttggggcttcaagagttgctgccacttcaagcaccagaaatttggagctgttgaaaagcttgggagctgatttggctattgactacacaaaggagaactttgaagacttgccagaaaaatttgatgtcgtttatgatgccattgggcaatgtgagagggcagtgaaggcagtgaaagaaggtgggagtgtggtggcactaacaggagcagttacaccacctgggttcagatttgtggttacttccaatggagctgttctcaggaaactgaacccttacttggagagtggacaagtaaagccagttgtggatcccaaaggtcccttctcctttgctcagcttgctgaagccttcacttaccttgaaacaaaccgtgctactggaa

SEQ ID NO: 3570 - DNA, 2016 bp, Glycine max
aaagaaaaatctaatagtatactagcatagttatttccttccacaccaacagttttgtgagtgaagcctttccagtgtgcagctgcatctgcagccggttcaatcattcaaaattgttaagttgtttggtttggagcaatcatcattgtccaaattgcaattttttcagaaggatagcaagaatttgggaagttgctgaagcaatagggagtagtggatacggtttaggatcattgttataataggcaaaattgatggtaatcgtacatagtggctaggaagggatataatggctactgctgcagttattggactcagtggaggaaagaggctcttgagttcatcataccattactctgatattatagaaaagctttcttatggcagtgattttggatccacacactaccaaattgttcctacaaaatctttaatagttgccaagaagtcatccaactatactccaacttttccagcatcgaaccagcagaatcagtccattaaggctcttaaggagcatgttgatgatgcccctaccattgcggatccatggtttcagagttacaactctaatgacttagaggtggaaagctctgaaatgggttattctgtggaggctcttcttttgctgcagaagtcaatgctggaaaagcaatggaacctttcctttgaaagagaagtgcttactgaaaattcgagtaagggaaaaaaatgtaggaaagtggcggtgacttgttctggggtgtctgcaaggcaaagaagaatgaataccaagaggaagaccgctattaaaacttgtggtgctatgcagctgaagtccaaaatcagtccagagctgcttcaacaccgtttgaagggctacgtaaaaggtctagtgagtgaggaattgctctctcatgcagaagttgtaaacctatcggagaaaataaaagttgggctttccttagaggaacataaatccagactgaaggaaaaactaggatgtgaaccctctgatgatcaaatggcaacttctttgaagatttctcgcactgaactacgagcaagaatgatagagtgctctctggcaagagaaaagttggctatgagcaatgtacgcttagttatgtctattgcccaaaagtatgataacctgggtgcagaaatgggtgaccttgttcagggtggcttgattggattactgcgtggtattgaaaagttcgattcttcaaaagggtttaagatttcaacttatgtttattggtggatacgtcagggtgtttcaagagctttagttgagaattcaagaacattaagattgcctgctcatttgcatgagagattatctctaatccgcaatgcaaagtttagactagaagagagaggcattactccaactattgataggattgcaaaataccttaacatgtctcaaaagaaagtcagaaatgctactgaggcaatcagcaaaattatctcgcttgatagagaagcattcccctctctgaatggtctacaaggagaaactcatcatagttatattgcagataatcgagtggagaacatcccatggaatggagtagacgagtgggcactaaaggatgaagtgaacagactcattaatgtgacccttgtggaacgagagagagaaattattcgactttattatggactggaaaaagaatgtcttacgtgggaagacataagcaaacggataggtttgtcaagagaaagagtaaggcaagttggacttgttgcattggagaaactaaaacatgctgcgaggaagagacaaatggaagccatgctattgaaacattaaatttggactcatcatagaaatatgttacaatgtatatatacagagaggaagtatgtacctagaaatttgacttcccgattcaaaaagaggacaatcatataagggaacattgaagatttgtaaatccctttaaatatggtgttagtaccaataaatatgggtaatttttgttttaatactccaaaagaaattgttgctttaagttctcatatatt

SEQ ID NO: 3571 - DNA, 2018 bp, Phaseolus vulgaris
ggataaaaacataaaaagaacgttgaatccatagcgaacgtggaactaagagaagagagaacataacgcatcatacaccacacaagtttaacttcctcctcacaccatcaagaacaaataaaaggagggaaaaagaaagagaaaaaaaatctaactgttctgtgagtgaagccttttcaattggtgcagctgattcaatgattcaaattccaaattaaggattgagagaatttgggaagcttctgaaggaagtagtggagacggtttaggatcattgttacagtaggaaaatatgaattgatggtaatcttagggatataatggctagtgctgcagttattggactcagtggagggaagagattgttgagttcatcttatcattactctgatattatagaaaagctttcttatggaagtgattttggatccacacactatcagattgtttcaacaaaatctgtgatagttgccaagaagtcatccaactacactccaacttttccagcaccgaaccggcagaatcagtccattaaggttcttaaggagattgttgatgatgctgctaccgttgcggatgcatggtttcagagtttgagttctaatgacttggaagtggaaagctctgaaatgggttattctgtggaggctcttcttttgctgcagaagtcaatgctggaaaagcaatggagcctttcctttgaaggggaaggggtaacagaacattctagtaaagaaaaaaactgcaggaaagtggcagcggtgacctgttctggggtgtctgcaaggcaaagaagaatgaatgccaagcggaagaccgcggttaaaaccggtggtgctgtgcagctgaagtccaagatcagtccagagctgcttcaaaaccgtttgaagggctatgtgaaaggagtagtgagtgaggaattgctctctcatgcacaagttgtaagcctatcagagaaaatcaaagttgggctttccttagaggagcataaatccaggatgaaggagagactaggatgtgaaccctctgacgatgaaattgcaacttcattgaagatttctagtactgaactacgagaaaaaatgctagagtgctctctggcaagagaaaagttggctatgagcaatgttcgcttagtgatgtctattgctcaaagatatgaaaacgctggtacagaaatgggtgaccttgttcagggtggcttgattggactacttcgtggtattgagaagtttgattcttcaaaagggtttaagatttcaacttacgtttactggtggatacgtcagggtgtttcaaaagccttaattgagaattcaagaacattaagattgcctgctcatttgcatgagagattatctttaatccgcaatgcaaagcttagactagaagagagaggcattactccaactattgataggattgcacagcaccttaacatgtctcaaaagaaagtcagaaatgctactgaggcaatcagcaaaactatctcgcttgatagagaagcattcccctctctgaatggtctacgaggagacactcatcatagttacattgcagataatcgcgttgagaacatcccctgggagggagtagatgagtgggcattaaaggatgaagtgaacagactcatcaatgtgacccttaaggaacgagagagagaaattattcgactttattatggactgggtaaagaatgtcttacatgggaagacattagtaaaaggatgggtttatcaagagaaagagtaaggcaagttgggcttgttgcattggagaaactaaaacatggtgcaaggaatagagaattggaggccatgctattgaaacattaaatttggactcatcacagaaatttgatacaatgtatatatacagagcggaagaatgtacctagaaatttcacttcctcattcaaaaagaggacaacgatataagggaacatgcaagatttgtaaatcccccttcaaatatggttttagtaccaatgaatatgggtaattttggttttaggcaaa

SEQ ID NO: 3572 - DNA, 2125 bp, Arachis hypogaea
accaacagttatgtgagtgaaatctcttcctgtgagcttgttccttttgattgtatgattctaaataagaactactaagctaatacctttttggagcaatcatcattctctgaattgcatttctctttctcagttcactcagctgacacaggttaagaattattgacttaatagggaagtttgatgttactcgcacatagttattaggggagtataacaatggctactgcagcagttattggactcagtggaggcaagaggattttgagttcatcataccattactctgatgttactgaaaagctttcatttggcactgattttggatccacacactatcagattgttccaacaaagtctgtaataattgctaagaagccatccaattacaccccgacctttgcagcatcgaatcgccaaaaccagtccatcaaggctcttcaggaacatgttgatgccgaggcagccggtacttcagatccatcgtggtttcaaggattcagttccagtgacttagagttggaaagctctgaaatgggttattctgtggaggctcttcttttgctgcagaagtcaatgctggaaaagcagtggaacctttcttttgagagggatgtgctaaacgagcattcgagaatggataaaagccgaaggaaagtggcagtaacttgttctggggtgtctgcaagacagagaagaatgaacaccaagaggaaggcctcgggtaaaaccagcgcaatgatcgaaccatgtactgctatgcagctgaggtctgccatcagtccagagctgcttcaatatcgtttgaagggctatgtgaaaggagtagtgagtgagcaattgctctctcatgctgaagttgtaaacctttcagagaaaataaaagctggactttccttagaggagcataaatccagaatgaaggacaaactaggatgtgagccctctgatgatcaaattgcagcatcattgaagatttctcgggctgcactacgagcaaaaatgatagagtgctctttggcaagagaaaagttggctatgagcaatgttcgcttagttttgtctattgctcaaagatatgataacatgggagccgaaatggatgaccttgttcagggtggtttgattggacttcttcgtgggatcgagaagtttgattcttcaaaggggtttaagatttcaacttatgtttattggtggatacgtcagggtgtttcaagagccttagttgaaaattcaagaacacttagattgcccactcatatacacgaaagattatctttaatccgcaatgcaaagtttagactggaagaaaaaggagttactccaactgtggaaaggatagcaaaatgtcttaatatgtctcaaaagaaagtcagaaatgccactgaggcaatgagtaaaattttctcgcttgatagggaggcgtttccatctttgaatggtcttccaggagaaactcatcatagttatatcgctgatactcgcgaagagaacatcccgtggaatagagtagatgaatgggcactaaaggacgaagtgaataaactccttaatgtgacccttgtggaaagagagagagaaatcattcgactctattacggattggatagagaatctcttacatgggaggatattagtaaacggatagggttgtcaagagaaagagtaagacaagttggacttgttgcattggagaaactaaaacatgctgcaaggaagggagggatggaagccatgcttttgaaacattagactttggactcatcatagattgagaaagagagagagacatgttaaaaaatgtatatatacagaagggaagtgtgtacctagaaaatttaacttcctgattgaaaatagatgaaagaggccatataagggaacactgaagatttgtaaaccccatcataagatcaattattgtctattgtaatagtttttgtttttatcaataggttgagggatacaatctatggatctcaactttctattccagaaatgatgaggtcacgtttattttttccttctatttgtaggggccatagtcccaaaaagccaacatagcaatagatcttaagtgtgagctatctaccacatgctaggttgcaatatatgcacacat

SEQ ID NO: 3573 - DNA, 2089 bp, Lupinus angustifolius
aaataaatgcagaaaataataaatacaaaatctaacactgctacaaccttaacgtgtgtccttccacaccaacagttttgtaagtgaagcctttcactctgcaactccacctcattcaatatttctaaattagttaaataataatactttcattctccaaattgcaatttttcttcagatggttagcaacatcttgtgaagtttgtgaatacagtggagaaggttaagaagtattgatataataggaaagtttgatgataattatacatagtggataagaagggatacaatggctactgctgcagttattggacttagtggaggaaagaggctcttgagttcatcttaccattattcagatattacagaaaagcttttctatggaagtgattttggatccacacactatcagattgcacctacaaaatatgttataatttccaagaagtcatcaaattatactccaacttttccaacatgcaataaggagaaggagattcagtccatcaaggctcttaaggaacatgttgatgctgcccccactattgcagatcaatggtttgagggatatgataattctgatgtcttagaggtggaaggttctgacatggataattctatggatgcacttcttttgctgcagaaatcaatgcttgaaaagcaatggaacctttcatttcaaaggggagtgttacgtaagaagtcgaaaagagaaaaaagccgtaggaaagatacggtgacttgctctggtgtatctgctaggcaaagaagaatgagcactaagaggaagactcctggtatgcagttgaggtccataatcagtccagaactgcttcaaaaccggttgaagggctatgtgaaaggagtactgagtgaggaattgctctctcatgcagaagttgtgaacctatcccaaaaaataaaagttgggctttccttagatgaacacaaatgcagactgaaggaaagactaggatgtgaaccctcggatgatcaaattgcaacttcactgaagatttcttgtgctgaactacgagcaagaatgatagagtgctctttggctagagaaaggttgactatgagcaatgttcgcttagtcatgtctattgctcaaagatatgataacctgggtgctgaaatggctgaccttgttcagggtggtttgattggactacttcgtgggattgagaaatttgattcttctaaagggttcaagatttcaacttatgtttattggtggatacgtcagggtgtttcaagagctttagttgagaattcaagaacattaagattgcctactcatttgcatgagaggttatctttgatccgcaatgcaaagttaagactagaagagaaaggcattactccaactattgagaggattgcgaaaagccttaatatgtctcaaaagaaagttaaaaatgctaccgaggcaatcaataaagttatctcacttgatagggaagcattcccctctctgaatggtcttccgggagaaactcatcatagttacattgcagatagccgccatgagaatatcccgtggaatggagtagatgagtgggcactaaaggatgaagtgaacaaactcattaatgtgacccttgtggaacgagaacgggaaatcattcgattttattacggattggataaagaatgtcttacatgggaggacataagtaaacggattgggttgtcaagagaaagagtaagacaagttggacttgttgcattggagaaactaaaacatgctgccaggaagagagaaatggaagctatgctattgaattgaaacatgaaacatgaaacatgaagcttgagtaatcaaaagagacatgttcaaatgtgtatatatacagaaaggaagtatgtacctacaaatttgacttccttatgcaaaatagactaaagaggaggatataagttataactaagggaacatttcatatttttaaacctcatacaaatattctatgtttatggataaaaccgttgggtctcaacttcctattccatcaatatgtgccggtattaaagaggttcattacatttctctttcaaaataatatattgaaaatttaaatatcaa

SEQ ID NO: 3574 - DNA, 1971 bp, Lupinus angustifolius
aaccaagtaaaatagtgcattttctctctccactctatatgaatattcataataaataaaaagcataaaaactacttaaaaaaataatcgaacattgcaacaaccttaacttatgtgcttctacaccaacagttttatgtttagcaacaacaacttgggaagtttctgaaaagtggacaaggttttaagacttaagaagcattggtgtaataagagatttttatgattaattatacatagtggataggaagggatattacaatggctactgctgctgtgattggacttagtggaggaaagaggctcttgagttcatcttaccattactctgatattacagaaaagcttttctatggaagtgattttggatcagtacactatcaaactgctcaaacaaaatctgttataattgctaagaagacatcaaattacacgccgagttttccaacatgcaacaatgagaagcagattcagtccatcaaggctcttaaggagcatgttgttgatgccccaattattgcagatcaatggtttgagggatataataattgtaatgacttagaggtggaaagttctgacataggttattctgtggatgcacttcttttgctgcagaagtcaatgctggaaaagcaatggaacctttcatttgagaagggagtgttaagtgagaaatcgagaagagaaaaaagccgtaggaaagtgactgtgacttgttccggtgtgtctgcaaggcaaagaagaatgagtactaagaggaagactctcggtaaaaccggctcagcaatgatacaaccttgtatgcagttgaggtccataatcagtcctgagctgcttcaaaaccggttgaagggttatgtgaaaggagtagtaagtgaggaattgctctctcatgcagaagttgtgaacctatcagaaaaaataaaagttgggctttccttagatgagcacaaatgcagactgaaggaaaggctaggatgtgaactctcagatgatcaaattgcaacttcactgaagatttcatgtgctgaactacgagcaaaaatgatagagtgctcgtttgctagagaaaggttgactatgagcaatgttcgcttagtcatgtctattgctcaaagatatgttaacctgggtgctgaaatggctgaccttgttcagggtggcttgattggactacttcgtgggatcgagaagtttgattcgtctaaagggttcaagatttcaacttatgtttattggtggatacgtcagggtgtttcaagagctttagttgagaattcaagaacattaagattgcctacttatttgcatgagaggatatctttgatccgcaacgcaaagtttagactagaagagaaaggcattactccaaccattgataggattgcgaaaagccttaatatgtctcaaaagaaagttaaaaatgctactcaggcaatcaataaagttatctcacttgacagggaagcattcccctctttgaatggtcttcccggagaaactcatcatagttatattgcagatagccacgttgagaatatcccgtggaatggagtagatgaatgggcgctaaaggatgaagtgaacaaactcattaatgtgacccttgtggaacgagaaagagaaattatccgtctttattatggattggaaaaagaatgtcttacgtgggaggacattagtaaacggatagggttgtcaagagaaagagtaagacaagttggacttgttgcattggagaaactaaaacatgctgcaaggaagaaagacatggaggccatgctattgaattgaaagattagacttgagttatcataagagacatgttaaaatgtatatatacacagaaaaaggaaatatgtaaactcatgcaaatattgtcttgtggaataaatctgttttatcaatatgtttatgtataaatctttggatctcaatttggtctttaactagatattgattttacctctt

SEQ ID NO: 3575 - DNA, 2019 bp, Medicago truncatula
cttccactctatattaataataaataataaaaagcagaaaaaaaataaaaaaaataaaatctagtaatagctagcagcaagaaggttttttccagtgtgcagctggatagcttattcagtggttctaaaagttctaaactatacatttttgcatagttgcaattttttaagaacttgggaagtttctgaaagaaataggttcagttgatttatagtataataggaaaaattgatggtataataatggctactgcagcagttattggattaagtggaggaaagaggctattgagttcatcttatcattattcagatattatagaaaagttttctcatgcatgtgactttggttccacacagtatcaacttcctccttcaaaatctgtaatagttgcaaagaaatcatcaaaatacactccaacttttccaccagaaaggaagaatcagtctatcaaggcacttaaggaacacgttgtcgatagcgcgcaagctgattcggaacaatggtttcagggatacaattctaatgactttgaggttgaaagctctgacatggattattcattggattcacttcttttgctgcagaagtcaatgttggaaaagcaatggagtctttcgtttgaaaggaaagtgttgagtgagaattcgaggagagaaaagatccggaggaaggtatcggtgacttgttctggagtgtctgcaaggcaaagaagaatgacaaccaagaggaaggttgctgctaaaagtggttctgcagtgatgcagctgaggtctacaatcagtcccgaacttattcaaaaccgtttgaagggatatgtgaaaggtgtcgtgtgtgacgaattgctctctcatgctgaagttgtaaagctatcggagaaaattaaagctggcctttctttagatgagcataaatccagactgaaggaaagattaggaagtgaaccttccgatgatcaagttgcaacttcgttgaagatttctcgagctgatctacgagctaaaataatagagtgctctttagcaagagaaaagttaactatgagcaatgttcgcttagttttgtcgattgctcaaagatatgataatatgggtgctgaaatgggtgaccttgttcagggtggcttgattggactacttcgtgggattgagaagtttgattcttcaaaagggttcaagatttcaacttatgtttattggtggatacgacagggtgtttcaagagctctagttgagaattcaagaacattaagattgcccgctcatttgcatgagaggttatctctgatccgcaatgcagagtataaactcgaagagagaggcatcactccaactattgatagaattgcaaaaagccttaatatgtctcaaaggaaagtcagaaatgctactgaggctacaagcaaagttttctccttagatagggaagcattcccctctctgaatggtcttccaggagacactcatcatagctttattgcagataaacaaaatgagaacatcccatggaatgtagtagatgagtgggctctaaaggaagaagtgaacagactcattaatctgacccttgtggaacgagagagagaaattattcgtctttattatggattggataaagaatgtcttacatgggaagacattagtaaacggataggtttgtcgagagaaagagtaaggcaagttggacttgttgcattggagaaactaaaacatgccgcaaggaagagggagatggaagccatgcttttgaaatattgatatgatggactcatcatagagacatgtatatatacagaacagaaaggaagtatgtacctagaaatttgacttcctgatgaaaatagacgagagaagactatataagggaagattgaagttcataaaccccctgaaaatattgtcttttggagtaattatgttttatcaaaaatgttgaaggattaattttatagatctcaactttctattccaaaattatgaggcgtctgtttcctaggaagacttgtatcaagaggagtt

SEQ ID NO: 3576 - DNA, 1823 bp, Glycine max
aaaaaaaagttataggaataataatcttattctgctcaaataaaattatctttcataaaaaatatatcatttcaagaagaaaaaaaacagaaacacacatacataggtatatgcagtagaaacacatgagaaaattcctagaagaaccacattaacttggtcgcttgacatcataccaaacgcgttaagtttattcaccaaataaataaataaaaatatatcgaacgcgttgactcaattactatgttccatttatatgcactttagccttttctcttgctttgtcgaatccaattctctctctctctcttttcttgattcattttgttgtctcaattaaacctttgttttggtctgaattgaaaagggttgtgaattaatagtgatgtttatctctagatcaattctctttgtgtttgtgttctcagcttgcttgcttctatttccagccaatggaattcgatcatttgccacaacaaatggttatgaaactgaggttgaagaagttgatccttttgtgcaattcagagaggccccagaatacagaaaccagcaaaagtgcactctaattgacacaaccaatgttcaattagtatgtgatccttcacttgttcatgttgccatgaccattgattggcactacttaagagggtccattgctgcagtgcattctgttgtgaaacacacttcctgccctcagaacctgttctttcatttcattgcatcagatgcaagattggagagcaaggatgtgtttgaaaggattgttcacacttccttcccttcattgggattcaaagtttatgtgttcagggaaagtcttgttggcaatctcatatctccttcaattagggaggcacttgacaaccctcttaactatgcaagaagttaccttgctgatttgcttgatcaatgcattgaaagggtcatatacttggactcggatgttgtagtagttgatgatgtccaagagctttggaaggtttctttgacagggtcaagggtcattggtgctcctgaatattgtcatacaaacttcaccagatacttctcctatgagttttggtcaagtgctgagttttctgaggtctttcaagggaaaaggccttgttatttcaacactggggtgatggtgatggacttggtgaggtggagagagggtggctacacaaggaagattgagaagtggatggagattcaaaaggagagaaggatctataagttaggttcactccctccctttttgttggcttttggcggtgatgttgaagccattgaacatagatggaaccaacatggtcttggaggagataatgtgagaaatagttgtaggactttgcatcctggtccagttagtttgttacattggagtggtaaagggaaaccatggactaggcttgatgccaagatgccttgctcagtggactttctttgggcaccttatgatctctatataccccatcaccatacacatcatcaacaccaccaccatcagagaattgctattggctcaacacattcatcattttaggacatagttttatattggttgattttgattcatttgttctgaatattttattttttttggtatagacagaacaatcaaaagattttgtaatgtttgttgatacatcttaatagtatagtaacagagaatatcatgcggaacatgctgatgcacaattattggataaagtatgagtttaattttcatgtttaaagatatttacactcaaaaccagtcagaaataacccataagacagatgttcctgagttgttgcttgtgtcattctccaatcataattttaccttgataaac

SEQ ID NO: 3577 - DNA, 1408 bp, Phaseolus vulgaris
atatacccttttgccttttctcttgctttgtcaaatccaattctctcagtttttcttttctcgattcattttgttctctcaattgaaaagggtagtggtgaatagtgatgtttctctctagatcatttgtgcttgtgttctcagcttgctttcttctctgtcaagccaagggaattagatcttttgccagagaaaatggttatgaaactgaggttgaagttgcttcctttgtgcaattcagagaggccccagaatacagaaaccagaaaaagtgttctctgcttgatacaagcaatgtggcaatggcatcatgtgacccttcacttgtgcatattgcaatgaccattgattggcactacttgagagggtctattgctgccctgcactctgttgtgaaacacacttcctgccctcagaatctgttctttcacttcattgcatcagatgcaagattggagagcagggatgagtttgaaaggattgttcacacctcctttccttccttgagatttgaagttcatgtgtttgaggaaagtctagttggcaatctcatatctccttctattaggcaagcacttgacaaccctcttaactatgcaagaagttacctggctgatttgcttgatccctgcattgagagggttatatacttggactctgatgttatagttgttgatgatgttcaagagctttggaaggttccattgtcagggtcaagggtcattggtgctcctgaatattgccatgcaaacttcaccagatacttctcctatgagttttggtccagtgctgagttttctgaggtgtttcaagggaaaaggccttgctacttcaacactggggtgatggtggtggacttgttgaggtggagagagggtgactacacaaggaagattgagaagtggatggagattcaaaaggagagaaggatctatatgttagggtcactccctccctttttgttagtttttggtggtgatgttgaggctattgagcatagatggaaccaacatggcctaggaggggacaatcttagaaacagttgtaggactttgcatcctggttctgtgagtttgctacattggagtggtaaagggaaaccatggacaaggcttgatgctaagaagccttgctcagtggacttcctttgggcaccttatgatctctatataccccctcaacagaagagaattgctgctactggcacaataaattcatccttttagcacataattttatattggttcatctcattcatttgttctggtttttttatagacagaacaaaaagattttgtaatgtttgttcatacttttctatagtatagtcacagagaatgcaattggataaactgagttttgttttcaggagttatgctactaatgctctgaaccaataaatatagca

SEQ ID NO: 3578 - DNA, 1413 bp, Nicotiana benthamiana
ttttgaaattttaaaacgtgataatcttacatatataattatcagtattctgtttccattattgttattggaatatcaataaattgaaaattctaaaaagggtcagcgacttaaatgcataccctacatgttcacatgcaaagggtgataggttgttagctttgattgctaagttcatagaaagaagcaacttaatttatcttttttccttttttttgggggtgggttttatacgcctgacaggcgaagcatcagatgtcgtagttgaaagcaaatttcactctgaatttgtagttgattctcagtagtgttacggtgatgtcagtggaagaaaggccatcatcttcatcttcaacgtcgtcaacgacgtcgtcgtgtatggtggtggatccgttgttgaaggatctgagtgagaaaaaacagaatttccggcggaatgtggtgtcgcttgcggcagagctcaaagaggttcgcaaccgtctcgcttctcaagaacagtcttttgttcgtgaaaccctaacaagacaggtagcagagagtaaagctaaaaaaatggaagaagagataagcaagttgcaaaagaatttggagcagaaagacgggcagcttcaagtttcttctttaaacaccgagaagtatctcaagcagttggatgatcttagatcacagctttctgctactcaagcaactgcagatgcaagtgctgcatcagctcaatctgcacagcttcagtgtttggcacttttgaaagagttggatgacaaaaacagttcattgaaggaacatgaagttcgtgtaaataaacttggtgagcaattagatcttttgcagaaggatctccaagccagggaatcatcccaaatgcaattgaaagacgaagtcctaagaattgagcatgatatcatgcaagcattagcgaaatctggagcaaacaaagattgtgaattgatgaagattttagatgaggtctcaccaaagaatattgaaaagatgaacaagctgttgacgagtaaagatgaagaaattgccaaactcagggatgaaatcaggatcatgtctgcccattggaagctaaaaaccaaggagttggagtctcagttagaaaagcatcgtagagctgatcaagagttaaaaaagaggattatgaagttggaattctgtctccaagaggcgcgaactcaaactcgcaagctccaaaggatgggagaacgccgcgacaaagctattaaggaactcagagaccaattagcagctaagcaagtcggaacttccattaatgataaacagaacttctgggaatcctcagggttcaagattgttgtttcaatgtccatgttggtgttagtcctcttttcgaagcggtgataataatatatgtatttaacgttgtataaaggagatatctagctagct

SEQ ID NO: 3579 - DNA, 1149 bp, Nicotiana benthamiana
ggcgaagcatcggttgtcgtagttgaaagcaaagttcactctggatttgtagttgattctcagtagtgttacggtgatgtcagtggaagaaaggccgtcatcttcatcttcaacgtcgtcaacgacgtcgtcgtgtatggtggtggatccgttgttgaaggatctgagtgagaagaaacataatttccggcgaaatgtagtgtcccttgcggcggagctcaaggatgttcgcaaccgtctcgcttctcaagaacagtcttttgttcgtgaaaccctaacaagacaggttgcagagagtaaagctaagaaaatggaagaagagataagcaaattgcataagaatttggagcagaaagacgggcagcttcaagtttcttctttaaacactgagaagtatctcaagcagttggatgatcttagatcacagctttctgctactcaagcaactgcagatgcaagtgctgcatcagctcaatctgcacagcttcagtgtttggcacttttgaaagagttggacgagaaaaatagttcactgaaggaacatgaagctcgtgtaaataaacttggtgagcaattagatcttttgcagaaggatctgcaagcaagggaatcatcccaaatgcaattgaaagatgaagtcctgagaattgagcatgatatcatgcaagcattagcgaaatctggagcaaacaaagattgtgaattgaggaagattttagatgaggtctcaccaaagaatattgagaagatgaacaagctattgacgagtaaagatgaagaaattgccaaactcagggatgaaatcaggatcatgtctgcccattggaagctaaaaaccaaggagttagagtctcagttggaaaagcatcgtagagctgatcaagagttgaaaaagaggattatgaagttggaattctgtctccaagaggcgcgaactcaaactcgcaagctccaaaggatgggagaacgacgtgacaaagctatcaaggaactcagagaccaattagcaactaagcaagtcggaacttccagtaatgataaacagaacttgtgggaatcttcagggttcaagattgttgtttcaatgtccatgttggtgttagtcctcttttcgaagcggtgatattattatgtgtatttataactttg

SEQ ID NO: 3580 - DNA, 1947 bp, Nicotiana benthamiana
aacatggacgggtaggccaacctctcgttggcagtttcagccactaccctttcactccctcgacgagtccgtcactctcccccatacctaatatccatcccaccaaacactcattttcactatatattcatcttcttccttttcttatcaaaaaacctcccttctctcttttttcttttctacttaaattttcttattcattctgccatggaaggagctgctactgctcaagctatatctcgtattgggttagctggcctagctgttatgggtcaaaatcttgccctaaacatagccgagaaagggttcccgatctccgtttacaatagaaccacttctaaagttgacgaaaccctagatcgcgctcaacgcgaaggtcaactacctttaaccggtcagtacaatccgcgtgatttcgtgctgtcgattcaacggcccagatctgttatcatcctcgttaaagctggggcccccgttgatcagacgattgctgctttagctgaacacatggagcctggcgatacgattattgacggaggtaacgagtggtacgagaacactgaacgccgtattggtgaagcttcgagtaaagggcttttgtatttgggtatgggtgtttctggcggtgaagatggggctagaaatgggccctcgcttatgcccggtgggtcccatggggcgtacattaacatcaaagacattctcgagaaagttgcggctcaagttgaggacgggccgtgtgttacttacattggcgaaggcgggtccggtaatttcgtgaaaatggtgcataacgggattgagtatggtgatatgcagttgatttcggaggcgtatgatgtgttaaagaatgcgggcgggttgagtaactctgaattggcggatattttcgctgagtggaaccgtggtgagctggagagttttctggttgaaattacagcggatatatttaatgtgaaggatgagaaaacggggagtggtgagctagtggataaaattttggataagacaggaatgaagggaacggggaaatggactgtgcagcaggctgctgagctgtcaattgcagctcccacaattgctgcttcgttggatagtaggtatatgagtggattgaaggaagagcgggaagacgctgcagggatttttaagaaggaagggttaaaggaggagataaattttgacgtgaatgggagtagtgttgataagaagagattgattgatgatgtgaggcaggcattgtatgcctcaaaaatttgtagttatgctcagggaatgaatttgctaagggcgaagagtgctgagaaggggtggaatttgaatttgggagagatggcgaggatttggaaaggcgggtgtattatcagggcagtgttcttggatcggattaagaaggcgtatcagaggaatcccgggttggctaacttgatggttgacccggaatttgccagggagatggtgcagaggcaagctgcatggagaagagtggtgggtcaggctatccagaggggaattagtgttcctggaatgtctgcaagtcttcaatatttcgatacttatagacgttctaggcttcccgcaaacctcgtgcaggctcaaagggactattttggggcacatacttatgagagaattgatatgccaggagcataccatactgagtggtctaagcttgctagaaaggccagagtgtaatgctgccgcagctgttgcagattatgataaaaatctggtattagttgagctttgtcaactattgattctaaattgtgctattcaggcatttaaaatttagaatgtgacttgttgagaatttttacttgttgctagttttgcagttaataatgttgtatgcttttgaacattatagggccttggcaattgaatgacttctttattgaagttaaagaaggcgcatttcctacattatgcataaatattccctgc

SEQ ID NO: 3581 - DNA, 1913 bp, Nicotiana benthamiana
taggaaacatcgacgagtacgccaccctctcgttggcagtttcagccactaccctttcagtccctcgacgagtccgtcactctcctcccatacctaatatcccaccaaacactcattttttcactatatattcatcttcttccctcttctcaaaaaatctccctttctctctctctctctctctctctctcttttccatttatactttcctcctaaaattttctcattcattccgccatggaaggagctgcaactgctcaagctttatctcgtattgggctggctggtctagctgttatgggccaaaatctagccctaaacatagccgagaaagggttcccgatttccgtttacaacagaaccacttctaaagttaacgaaaccctagatcgcgctcaacgtgagggtcaactacctttaaccggccagtacaatccgcgtgatttcgtgctgtcgatacaacggcccagatctattatcatcctcgttaaagctggggccccggttgatcagacgattgctgctttagctgaacacatggagtccggtgacacgattattgatggaggtaacgagtggtacgagaacactgaacggcgtattggtgaagcttcgagtaaagggcttttgtatttgggtatgggtgtttctggtggtgaagatggggcccgtaatggcccctcgcttatgcctggtgggtcccacggggcttacatgaacatcaaagacattctcgagagagttgcggcccaagttgaggacgggccgtgtgttacttacattggtgaaggcgggtcgggcaatttcgtgaaaatggtgcataacgggattgagtatggtgatatgcagttgatttcggaggcgtatgatgtgttgaagaatgcgggcgggttgagtaaccccgaattggcagacattttcgctgagtggaaccgtggtgaactggagagttttctggttgaaattacagcggatatattcaatgtgaaggacgagaaaacagggagcggtgagctagtggataagattttggataagacaggaatgaagggaacagggaaatggactgtgcagcaggctgctgagctgtcaattgcagctcccacaattgctgcctcgttggatggtaggtatatgagcggattgaaggaagagagggaagatgctgcaaggatttttaagaaggaaggattaaaggaggaaatgaattttgatgtaaatggtgctagtgttgataagaagagattgattgatgatgtgaggcaggcattgtacgcgtcaaaaatttgtagttatgctcagggaatgaatttgctgagggcaaagagtgctgagaaagggtggaatttgaatttgggagagatggcgaggatttggaaaggcgggtgtattatcagggcagtgttcttggatcggattaagaaggcgtatcagaggaatcccgggttggctaacttgatggtggacccggagtttgcaagggagatggtgcagaggcaagccgcatggaggagagtcgtgggactggctatccagagaggaattagtgttcctggaatgtctgcgagtcttcagtatttcgatacctataggcgttctaggcttccagcaaacctcgtgcaggctcaaagggactattttggggcacatacttatgagagggttgatatgccaggagcataccataccgagtggtcgaagcttgctaggaaggccagagtgtaatgcggctgcagctgttgcagattatgataaaaatctggtattagttgagctttgtcaacttttgattctaaattgtgctattcacttgtgattaatttcagtaactataattttgcccgactggggggcaaaaccatttgaaatcctttaaaatattctggtagtatgactaataagaattgggtttg

SEQ ID NO: 3582 - DNA, 1633 bp, Nicotiana benthamiana
tctctctctctctctcttttccatttatactttcctcctaaaattttctcattcattccgccatggaaggagctgcaactgctcaagctttatctcgtattgggctggctggtctagctgttatgggccaaaatctagccctaaacatagccgagaaagggttcccgatttccgtttacaacagaaccacttctaaagttaacgaaaccctagatcgcgctcaacgtgagggtcaactacctttaaccggccagtacaatccgcgtgatttcgtgctgtcgatacaacggcccagatctattatcatcctcgttaaagctggggccccggttgatcagacgattgctgctttagctgaacacatggagtccggtgacacgattattgatggaggtaacgagtggtacgagaacactgaacggcgtattggtgaagcttcgagtaaagggcttttgtatttgggtatgggtgtttctggtggtgaagatggggcccgtaatggcccctcgcttatgcctggtgggtcccacggggcttacatgaacatcaaagacattctcgagagagttgcggcccaagttgaggacgggccgtgtgttacttacattggtgaaggcgggtcgggcaatttcgtgaaaatggtgcataacgggattgagtatggtgatatgcagttgatttcggaggcgtatgatgtgttgaagaatgcgggcgggttgagtaaccccgaattggcagacattttcgctgagtggaaccgtggtgaactggagagttttctggttgaaattacagcggatatattcaatgtgaaggacgagaaaacagggagcggtgagctagtggataagattttggataagacaggaatgaagggaacagggaaatggactgtgcagcaggctgctgagctgtcaattgcagctcccacaattgctgcctcgttggatggtaggtatatgagcggattgaaggaagagagggaagatgctgcaaggatttttaagaaggaaggattaaaggaggaaatgaattttgatgtaaatggtgctagtgttgataagaagagattgattgatgatgtgaggcaggcattgtacgcgtcaaaaatttgtagttatgctcagggaatgaatttgctgagggcaaagagtgctgagaaagggtggaatttgaatttgggagagatggcgaggatttggaaaggcgggtgtattatcagggcagtgttcttggatcggattaagaaggcgtatcagaggaatcccgggttggctaacttgatggtggacccggagtttgcaagggagatggtgcagaggcaagccgcatggaggagagtcgtgggactggctatccagagaggaattagtgttcctggaatgtctgcgagtcttcagtatttcgatacctataggcgttctaggcttccagcaaacctcgtgcaggctcaaagggactattttggggcacatacttatgagagggttgatatgccaggagcataccataccgagtggtcgaagcttgctaggaaggccagagtgtaatgcggctgcagctgttgcagattatgataaaaatctggtattagttgagctttgtcaacttttgattctaaattgtgctattc

SEQ ID NO: 3583 - DNA, 1933 bp, Mimulus guttatus
cccctgaaacccttacactctgcaaaattcaagatcggatttttaaggtagcacagcgcagcaggaaaaatcaacaatggagtccgccgcgctatctcaaatcggcctcgccgggctcgccgtgatgggccaaaacctcgccctcaacatcgccgagaaagggttcccaatctccgtctacaaccgcacaatctccaaagtcgacgaaaccctagatcgggcccaccgcgaagggcagctcccactcaccggccactacaaccccaaagacttcgtcctctcgatcaagaagccccgctcaatcatcatcctcgtcaaggccggcgcccccgtcgaccagaccatcgccgccctctccgcccacatggagcccggcgacaccatcatcgacggcggcaacgagtggtacgagaacaccgagcgccgcatcgtcgacgcctccgccaacggcctcctctacctcgggatgggcgtctccggcggcgaggacggcgcccgtaacggaccctccctcatgcccggcggctcccaccgcgcctacctcaacatccacggcatcctcgacaaggtcgccgcccaggtggacgacggcccctgcgtcacctacatcggcgaaggagggtccggcaatttcgtcaaaatggtgcacaacggaatcgagtacggcgatatgcagctgatttcggaagcctacgatgtgttgaaaaacgttgggggcttgagcaacgatgagctggcagagattttcgaggagtggaaccgcggcgaactcgagagtttcttgatcgagatcacgaccgatattttcaaggtgaaagatctcgaaacgggcaacgggcatttagtggacaaaatcctggacaaaaccgggatgaagggtaccggaaaatggaccgtgcagcaagcggccgagctctcaatcgccgcccccacgatcgccgcctcactggacagtcggtacatgagcggcttgaaggaggagagagaagctgcatcagagattttcaagaacgaagggttgaaagaggagatcgaaaatgtgggcgacgtggacaagaaaagattgatcgacgatgttaggcaagcgctctacgcgtcgaaaatttgcagctacgcacaagggatgaacttgttgagggcaaagagtatggagaagggttggggtttgaatttgggggagttggctaggatttggaaaggaggttgtattatccgggcggttttcttggataggattaagcaggcttatcagaggaatccgggattggctaacttgttggtcgaccccgaattcgctcgggaaatggtgcagaggcaatcggcatggaggagagttgtcggggtggctatacagaagggggttagcgtacccggaatgtctgcgagtttgcagtatttcgatacgtacaggcgcgggagactccctgcgaatcttgtgcaggcgcagagggactatttcggtgcgcatacctacgagagaattgatctgccgggggcgtaccatacagagtggtccaagcttgctagaaatgccaaactgtaggtggggagtgctatttatgtatcgagatggtatgatttggttatttcttattgttttgagtttcggttattttcttgaagggtttttaatttgaaatttgagttgatgaggatttcgttgttcgaaaaaagaaattacttttgtaggggttctgcattgtttgtgtatgcagttaaataagatgggaatgccttttcgaacgatattattctatacgggctgtcctttgtgatctgtttggcattctatgatgtttatgttttagccttttattgtcatgttgattgatgctcatgtctatactggtttcgaattacggtttcgaattacgagtgttgtatcatttatatacttaggacagtacgaaaaatatactttcattcggtccca

SEQ ID NO: 3584 - DNA, 1796 bp, Echinacea purpurea
cggccggggggatgccgtaaacccaaaaccccatcacaaattttcgaaagaagcaggtaacgacacaacttttcgtgcgttgtgcagccaataaacgtttcactccttcgacgagtccgtcaccattcaccaaaccccatcaatcccattttataaccatccttcatttcaatcttcatctcccaaaaccctcaaaaagatctctcgaaaacccttcaaccatctattgcaatggaggctgcaactctttcccgcatcggtctcgctggtcttgcagtcatgggccagaacctagccctcaacatcgccgaaaaagggttcccgatctccgtctacaaccgcacaacttctaaagtggatgaaacactagatcgagctcatactgaaggccagcttccgttaacggggtactacacacctcgggattttgttctttcgattcagaagccccgatctgttataatccttgtgaaagctggggcgccggtggaccagacgattgcggctttggcggcgcatatggagcccggtgacactattattgatggtggaaacgagtggtatgagaacacggagagacggattgttgaagcttcagataaagggttgctttatctcggaatgggagtctctggaggtgaagaaggtgcacgaaatgggccgtcattgatgccaggtggctcttatgaagcttataataacattaaagatattgttgcaaaagtggctgcacaggttgaagatggaccttgtgtgacatacataggtgaaggtgggtctggtaactttgttaaaatggttcataatgggatagagtatggtgacatgcaattgatttctgaagcttatgatgttttgaaaaatgttggtgggttgagcaacagtgagttagctgagatttttcaagagtggaacacaggggaattagagagtttcttgattgagatcactgctgacatctttaaagtgaaagatgagcatggtgaaggagaactagtcgacaagattcttgataagacaggaatgaaggggacgggtaaatggacggtccagcaggctgctgagctgtccgtggcggcccccaccattgccgccagtctggactgtcggtatttgagtggtttaaaggacgaaagggaagctgccgctaaggttttgtcggatgcagggttgaaagatgaggtgggaagcgtgagaagtgggattgataagaaaagattaattgatgatgtgaggcaggctttatatgcttccaagatttgtagttatgcacaagggatgaacttgttgagggccaagagtgtcgagaaaaattggaacttgaactttggtgaattagctaggatttggaaaggagggtgtattatcagggcggtcttcttggaccggatcaagaaagcataccagcggaaccctaatcttgcaagtctggtggtggatcccgagtttgccaaggagatggtgcaaagacaggcggcgtggaggagagtggtggggctggccatctcagctgggattagtacaccaggaatgtgtgctagtcttgcttattttgacacatatagacgggctcgactgcctgccaaccttgttcaagctcaaagggacttgttcggggctcatacttacgagcgggttgatcgcacaggtgcttttcataccgaatggacaaaactcgcaaggaagaaggcgtgaaaaagatctaaaagaattggtgagtcttttcacattggtgatgaacttatttggtgatttttactgtttttggttgaattatgggttgtgattgatgatga

SEQ ID NO: 3585 - DNA, 1646 bp, Triphysaria pusilla
tccgccattgccaaaatcttcttcagcttcaacagcaaaaccaaaaatggagtcagccgcgctatcccaaatcggcttagcaggcctagctgtaatgggccaaaacctagctctcaacatcgctgagaaaggattcccaatttcagtctataatcgcaccatctccaaagtcgacgaaaccctcgatcgagcccaccgcgagggccaactcccactctccggccactacaaccctaaggatttcgtcctctccatcaaaaaaccccgctcgattatcatcctggtcaaagccggggctcccgttgaccagaccatcgccgccctctccgctcacatggatcccggcgacaccatcatcgacggaggtaatgagtggtacgagaacaccgagcgccgcatggtcgaagcctccgctagcggcctcctctacctcgggatgggggtttcgggcggagaggatggggcccggtacgggccttcactcatgcccggagggtcccaccgggcctacctcaacatccacggcatacttgagaaggtcgcggcccaggtcgacgacgggccttgcgtcgcctacatcggcgagggcggtgctggtaatttcgtcaagatgatccacaacgggattgagtatggcgatatgcagctgatttcagaagcctatgacgtgctcaagaacgcaggagggttaggcaatgatgagctggcggatattttcgaagaatggaatcgaggcgagctagagagtttcttaattgagattacatccgatattttcagagttagggatgaagaaaccggcgatgggcatttagtggataagattctggataagaccgggatgaaagggaccggtaaatggaccgtgcagcaggcggctgagctctcgattgcggcccccacaattgcagcctcattggacagtcggtacatgagcggtctaaaggatgaacgagaggctgcggctgagattttcaagaatgaggggctaaaagaggaaatcaacaatgtgggcccagtcgataagaagagactaatcgaagacgttaggcaggctctgtacgcgtccaagatttgcagctacgcgcaggggatgaatttgctgagggctaagagtatggagaaaggttggggtttgaatttgggtgagctagctaggatatggaaaggtgggtgtattatccgagccgttttcttggacaggatcaagcaggcgtaccagaggaacccgggtttggcaaatctgttggttgaccctgagtttgcaagggagatggtgcagaggcagggggcttggagacgggtcgtgggtttggcagttcaaaagggtattagcgtcccaggaatgtcggcaagtttacaatattttgatacgtatagacgtgggaggttgcctgctaatcttgtgcaggcacgagggattacttcggtgcccacacctatgagagggttgatcgttcaggagcgtatcatacggagtggtccaaacttgctcaaaaggctagactgtagtggattgaggtttggtttggtatggtttaattggtatttgttttcttgaactttaagtttcttttgattaagatgtattccttgataaaaaaatctttatgggtaataataataggaacatgcattttaatcta

SEQ ID NO: 3586 - DNA, 1933 bp, Arabidopsis lyrata
gtctcttggctccatcgacgagtccgtcactttcaccgtataaatatctccgccactctctctcccatcaccaccaacctccgtcaaaacgctaacctctctctctctctctctctctctctatctctcaaaaatggagtccgccgctctatctcgcatcggtctcgccggtcttgcagtcatgggacaaaacctcgctttaaacatcgccgagaaaggattcccaatctccgtctacaatcgaaccacttccaaagtcgacgaaaccctagatcgtgcctccgacgaaggaaatctcccagtcgctggtcaatactctcctcgcgatttcgttctctccatccaacggcctagatccgttatcatccttgtcaaagccggtgctcccgttgaccaaacaatctcagcactctccgaatacatggagcctggtgattgtatcatcgacggtggaaatgagtggtatcagaacacagaacgacgaatcgttgaagctgagaagaaaggattgctttatttaggtatgggagtctccggtggtgaagaaggtgctcgtaatggtccttcgcttatgcctggtggatctttcactgcgtataataatgttaaagatattcttgagaaagttgctgctcaagttgaagatggtccttgtgttacttacattggagaaggtggatctgggaattttgtgaaaatggttcataatgggattgaatatggtgatatgcagctgatttccgaggcgtatgatgtgttgaagaatgttggtggattgagtaatgatgaattggctgagatcttcacggagtggaatcgaggtgagcttgagagtttcctggttgagattacttcggatatttttagggttaaggatgattatggtgatggagagttagtggataagattttggataagactggtatgaaaggtactgggaaatggacggttcagcaggcggctgagctttctgttgcggcgcctactattgctgcgtcgttggattgtagatacttgagtggattgaaggatgagagggagaatgctgctagagtgttggaagatgctggattgaaggaggatattggttctgcgtctcgtggtgttgataagaagaggttgattgatgatgtgaggcaagctttgtatgcttctaagatctgtagttatgctcaaggtatgaatttgcttagggctaagagtttagagaaagggtgggatttgaatttgggtgaaatggctaggatttggaaaggcgggtgtattatcagggcggtattcttggacaggatcaagaaagcttatcagagaaacccgaatttggcaagcttagtggttgatcctgattttgctaaagagatggttcagaggcaagctgcgtggaggagagtggtgggacttgctatctctgctgggataagtacaccaggaatgtgcgcaagtttagcgtatttcgacacttacaggcgtgcgagattacctgcgaatctggttcaggcgcagagagatctctttggagctcatacatatgagagaaccgatcgtcctggtgcgtaccacactgaatggactaagcttgcaaggaagagtcagtaaagcgtagactcagtcccttgattgaggttattctctctctctctctctcttgtgcctattctgaattcagtgcttccatgttgttgtgtagggctttgtttcatcatagaacacgaaaacaaattgtttcagcgtatttttgttgagttataataagaaatgcaatgcccttgacgctctgtatctgtctgttgttgatatctggagagtttcctttaattctctgttctgctttggttcatattttgaatttgaatttgatatctttgttgatattttgaaagctcaaagtcttgataattcttcggcagtctttgcttgacgaattatgtccgg

SEQ ID NO: 3587 - DNA, 1774 bp, Arabidopsis lyrata
ggctccatcgacgagtccgtcattttcacagtataaatatctccgcccactctctctcatcagtcccactacctcattttctctctctaccaaaaatcctaagctctctctatctccaatggagtccgccgcactatcccgaattggtctcgccggactcgccgtaatgggccagaacctcgccttaaacatcgccgagaaaggtttcccaatctcagtctacaatcgtaccacttccaaagtcgacgaaaccctagatcgagccgccgtcgaaggaaacctcccagtctccggccaatactcgcctcgcgatttcgtcctctcgatccaacggcctagatctctcatcatcctcgtcaaagctggagctcccgttgaccaaacaatcgacgcgttctccgagtacatggagcccggagattgcatcatcgacggtggaaacgaatggtatcagaacacagagcgacggatctccgaagcagagcaaaaaggattgctctatttaggtatgggagtctccggcggcgaagaaggtgctcgtaacggtccttcgttaatgcctggtggatcatttcaagcttatgataacatcaaagacatcttggggaaagtcgcagctcaagttgaagatggaccttgtgttacttacatcggagaaggtggatctggaaatttcgtgaagatggttcataacgggattgagtatggagatatgcaattgatctctgaagcgtatgatgtgttgaagaacgttggtggtttcagcaatgaagagcttgcggagattttcacggagtggaatcgaggtgagcttgagagtttcttggttgagattacttctgatatatttagggttaaggatgagtttggtgatggagagttagttgataagattttggataagactggtatgaaaggtaccgggaaatggacggtgcagcaagcggcggagctgtctgtggcggctccgacgattgctgcttcgttggattgtaggtatttgagtgggttgaaagatgagagggagaatgctgcgaaagtgttgagggaagctggtttgaaggaagagattggttctgcgtctagcggaatcgataagaagagattggttgatgatgttaggcaagctttgtatgcttcgaagatttgtagttatgctcaagggatgaatttgcttagagctaagagtttagagaaaggttggaacttgaatttcggtgaattggctaggatttggaaaggtgggtgtattataagagcggttttcttggataggatcaagaaagcttaccagaggaacccggatttggccagtcttgtggttgatcctgagtttgctaaagagatggttcagagacaagctgcgtggagaagagtggtgggcttggctgtttccgcagggattagcacacctggaatgtgcgcaagtcttgcgtatttcgatacttatagacgtgctagattgcccgcaaatctggttcaggcgcagagagatctctttggagctcatacttacgagaggaccgatcgtcccggtgcgtaccacaccgaatggactaagcttgctaggaagaacaattgaacactccattaacgtttttttatgttttttcctagaacccttttgtctttgctttttataagcatgggaactgggattcaaagtttcaaaccacagattgtttcacgagtcttttgttcagatttcagaataagaaatgcagcagcaccttgatttttgttttagtttctgaccatggcgtcttttgctgtt

SEQ ID NO: 3588 - DNA, 1846 bp, Arabidopsis thaliana
ggctccatcgacgagtccgtcattttcacagtataaatatctccacccactctctctcatcactcccactacctcatttttctctctctacctaaccaatcctaagctcatctctctatctccaatggagtccgccgcactatcccgaatcggtctcgccggactcgccgtgatgggccaaaacctcgccttaaacatcgccgagaaaggtttcccaatctcagtctacaatcgaaccacttccaaagtcgacgaaaccctagatcgagccgccgtcgaaggaaacctcccagtctccggccaatactctccccgcgatttcgtcctctcgatccaacggcctagatctctcatcatcctcgtcaaagctggagctcccgttgaccaaacaatcgacgccttctccgaatacatggagccaggagattgcatcatcgacggtggaaacgaatggtatcagaacacagagcgacggatctccgaagctgagcaaaaaggattgctctatttaggtatgggagtctccggcggcgaagaaggagctcgtaacggtccttcgttaatgcctggtggatcatttcaagcttatgataacatcaaagatattttggagaaagtcgcagctcaagttgaagatggaccttgtgttacttacatcggagaaggtggatctggaaatttcgtgaagatggttcataatgggattgagtatggagatatgcaattgatctctgaagcttatgatgtgttgaagaacgttggtggattaagcaacgaggagcttgctgagattttcactgagtggaattcaggtgagcttgagagtttcttggttgagataacttctgatatatttagggttaaggatgagtttggtgatggagagttagttgataagattttggataagactggtatgaaaggtactgggaaatggacggtgcagcaagcggcggagctgtctgttgcagctccgacgattgctgcttcgttggattgtaggtatttgagtgggttgaaagatgagagggagaatgcagcgaaagtgttgagggaagctggattgaaagaagagattggttctgcgtcgagtggaatcgataagaagagattggttgatgatgttaggcaagctttgtatgcttccaagatttgtagttatgctcaagggatgaatttgcttagagctaagagtttagagaagagttggaacttgaattttggtgaattggctaggatttggaaaggtggttgtattataagagcggttttcttggataggatcaagaaagcttaccagaggaacccggatttggctagtcttgtggttgatcctgagtttgctaaagagatggttcagagacaagctgcttggagaagagttgttggtttggctgtttctgctgggattagcacgcctggaatgtgtgctagtcttgcgtatttcgatacttatagacgtgctagattgccggcgaatctggttcaggcgcagagagatctctttggagctcacacttatgagagaaccgatcgtcctggtgcgtaccatactgaatggactaagcttgccaggaagaaccattgaaaaatccctttctgtttttgtaaaagccctatttgtcttgcttatttttgagcaattggaaatgggatttcaaaccacattgtttaacacgagtattttgttcagatttcagaataagaaatgcagcagcaccttgatttttgtttttgtttctgaacatctttgcttttaaatttgtaaaacatatctcccctgtctttaatagatcgaatgtctagacgattagttgaacaatcaattaacgacttttctgcgccg

SEQ ID NO: 3589 - DNA, 1770 bp, Eutrema halophilum
attgagatcatcgtctaccaaatttataagtttgcagtttgtcccttggctccatcgacgagtccgtcactttcactgtataaaatatctctctctctcactcatcattcacagcccatttctctccctctctatctcctccaaaatcctacgctctctgcaatggagtctgccgctctatcccgaatcgggctcgccggtctcgccgtaatgggccagaaccttgccttgaacatcgccgagaaaggtttcccaatctcagtctacaatcgaaccacatcgaaggtcgacgaaaccctagatcgagcctccgtcgaaggaaacctaccagtttccggccaatactctccgcgcgatttcgtcctctcgatccaacgaccgagatcccttatcatcctcgtcaaagccggagctcccgttgaccatacaatcgccgccttctccgagtacatggagcccggagattgcatcatcgacggtggaaacgaatggtatctgaacacagagcgacggatctctgaggcggagcagaaaggactgctctatataggcatgggagtctccggcggcgaagaaggagctcgtaacggtccgtcgcttatgcccggcggatcgtttcaggcgtatgacaacatcaaagatatcttggagaaagtcgcggctcaggtagaagatggaccttgcgtaacttacatcggagaaggcggatctggaaattttgtgaagatggttcataatgggattgagtatggagatatgcaattgatctctgaagcttacgatgtgttgaagaacgttggtggattgagcaacgaggagcttgcggagatcttcacggagtggaatcgaggtgagcttgagagtttcttggttgagattacttcggatatatttagggtcaaggatgagtttggtgatggagagctagtggataagattttggataaaaccggcatgaaaggtaccggaaaatggactgttcagcaggcggcggagctctctgtggctgctccgacgattgctgcctcgttggattgtcggtacttgagcggattgaaagatgagagggagaatgctgcgaaagtgttgagagaagctggattgaaggaagagattggttctgcatcgagcggtatcgataagaagagattggttgatgatgttaggcaagctctctacgcttcgaaaatctgtagttatgctcaagggatgaatctgcttagagctaagagctcagagaaaggctggaacttgaacttcggtgagctggctcggatttggaaaggaggctgcatcataagagcggttttcttggataggatcaagaaagcataccagagaaacccggatttggcaagtcttgtggttgatcctgactttgctaaagagatggttcagagacaagctgcttggagaagagtggtgggtttggctgtctctgcagggataagcacgcctggaatgtgcgcgagtcttgcatatttcgatacttacaggcgcgctagattgccggcgaatctggttcaggcgcagagagatctctttggagctcatacttatgagaggatcgatcgtcctggtgcgtatcacactgaatggtctaagcttgccaagaagagcacttgaggtttttgctttcctaaaaatcctctctttgtctttgctatttttagcaatagggaattggatttgaaccacattgtttcaagagtctttcagatttcaaaataagaaaatgcagtaccttgaattttgctttagttttctgac

SEQ ID NO: 3590 - DNA, 1721 bp, Arachis hypogaea
cccctccttctctgtaactgatggaagcatcggcagcgttgtcgcgcatcgggcttgcgggcctggcggtgatgggccaaaacctggctctgaacatagcggagaaaggcttcccaatctccgtgtacaaccgcacaacctccaaggtcgacgagaccgtagatcgggcccgccaagagggctctctccctctcaccggtcaatacaacccccgcgacttcgtcctctcactccaacggcccagatccgtcatcatcctcgtcaaggccggcgcccccgttgaccagaccatcgccgctctctccgaccacatggagcctggcgataccatcatcgacggcggcaacgagtggtacgagaacaccgagcgccgcatccaccaggcctccgagaagggactcctctaccttggcatgggagtctcgggcggcgaggagggcgcccgtaacggtccttccctcatgcccggcggctctctccaggcctacaacaacatccaggatattctctccaaggtggccgctcaggtcgaggacggcccctgcgtcacctacatcggcgagggaggttctggaaacttcgtgaagatggtccacaacggaattgaatacggagacatgcagttaatctctgaagcctacgatgttctcaagcatgttggtggtttgaacaattctgagctcgctgatattttcgcggagtggaaccgtggggagcttgagagtttcctcattgagatcaccgctgatatcttcaaggtgaaggatgaggaaggtggtgatggtttcttggtggataagattcttgataagaccggcatgaagggcactggcaagtggacggttcagcaggctgccgagctttctattgcggcgccaaccattgctgcgtccttggattccaggtacttgagcgggttgaaggaggagagggagaatgctgccagtgttttgaaggaggctgggatgagtgatgatatcgcatctgccgcgagggttggcgtcgacaagaagcgattgattgatgatgtgaggcaggcattgtatgcttccaagatttgcagctatgctcaggggatgaacttgttgagggccaagagtaatgagaaaggttggaacttgaatttgggagagttggctaggatttggaagggtggatgtatcataagagctgtgttcttggataggatcaagaaggcctatcagaggaatcccaacttggcgagcttgattgtggacccagagtttgcgagggagatggtgcagaggcaggctgcttggaggagggtcgtggggttggccatttcggccggaatcagcactcctgggatgtgtgctagccttgcttactttgacacgtaccggagggcacggctgccagctaaccttgttcaggctcagagagacttgttcggagctcatacttatgagagggttgatcgccccggagctttccatactgagtggacaaaactcgctcgcaagagtggatctggggttggtgctctcaattgatactgtgttttggttgggttggttagttgtatttgtgctttattgttcatgcagaatttgagttgaaaaattgacactgtatgtgcttcttttgaggatccttgtttaggcagaggaaaaaccactattgtttacttcttatatctgtttttgctcttaatttaataaaagcaaggttttttacaaaaaaaaaaaaaaaaaaaaaaa

SEQ ID NO: 3591 - DNA, 1929 bp, Arabidopsis thaliana
cctaacaaaaactcttcaccagtttgttaagtcagccttttgattgtctcttggctccatcgacgagtccgtcactttcaccgtataaatatctccgccactctctctcccccatcaccaccaacctccgtcaaaaccctaaaccactatctctctctctctcttcatatcgcaacaatggagtccgtcgctctatctcgcataggtctcgccggtctcgcagtcatgggacaaaacctcgccttaaacatcgccgataaaggattcccaatctccgtctacaatcgaaccacttccaaagtcgacgaaaccttagatcgtgcctccaacgaaggaaaactcccagtcgctggtcaatactcgcctcgcgatttcgttctctcgatccaacggcctagatccgttatcatccttgtcaaagccggtgctcccgttgaccaaaccatctctgctctctctgaatacatggagcctggtgattgtatcatcgacggtggaaatgagtggtatcagaacacagagcgacgaatcgttgaagctgagaagaaaggattgctttatttaggtatgggagtctccggtggtgaagaaggagctcgtaatggtccttctcttatgcctggtggatctttcactgcgtataacaatgttaaagatattcttgagaaagttgctgctcaagtcgaagatggtccttgtgttacatacattggagaaggtggatctgggaattttgtgaaaatggttcataatgggattgaatatggtgatatgcagctgatttcggaggcgtatgacgtgttgaagaacgttggtggattgagtaatgatgaattggctgagatcttcacggagtggaatcgaggtgagcttgagagtttcttggttgagattacttcggatatatttagggttaaggatgattatggtgatggagagttagtggataagattttggataagactggtatgaaaggtacagggaaatggacggttcagcaggcggctgagctttctgttgcggcgcctacgattgctgcgtcgttggattgtagatacttgagtggattgaaggatgagagggagaatgctgctaaagttttggaagaagctggattgaaggaggatatcggttctgcgtctcgtggtgttgataagaagaggttgattgatgatgtgaggcaagctttgtatgcttctaagatctgtagttatgctcaagggatgaatttgcttagggctaagagtttagagaaaggttgggacttgaatttgggtgaaatggctaggatttggaaaggtgggtgtattatcagggcggttttcttggacaggatcaagaaagcttaccagagaaacccgaatttggcgagcttagtggttgatcctgattttgctaaagagatggttcagaggcaagctgcatggaggagagtggtgggtcttgctatatctgctgggattagcacaccaggaatgtgcgcaagtttagcgtatttcgacacttacaggcgtgctagattacctgcgaatctggttcaggcgcagagagatctctttggagctcatacatatgagagaaccgatcgtcctggtgcataccacactgaatggactaagcttgcaaggaagagtcagtaaagcatggacacagtcccttgatttgagggctttatttcatcatagaacacgaaaacaaattgtttcagcttatttttgttgagttataataagaaatgcaatgccccttgactctctgtatctgtctgttgatgatatctggagagtttcctttattttctcttatgtatggcttggttcatttttcgaatttgaatttgatatctatgttgaaattttggaagctgaagtcttcataattcttctgtagtcttcttgctcgttaaattgacgaatttttttccggtc

SEQ ID NO: 3592 - DNA, 2037 bp, Panax ginseng
caacagtccaatatgagcaactcactagagactagtcattggaagcatccaccttgaacctacgtcgtttactaaacctaagaatcatcgtcctctcgtaggttgttgggtcactccaccactgagtctaccctttcgctccctcgacgagtccgtcactctctctttctctctacatattcatctccttcactccattccccatttctaatctctcttttctctctctctctaaaacccccactcaattctcccatggaagcctcccaagtcctctcccgcataggcctagctggcctcgccgtcatgggccaaaatttagccctcaacattgccgataaaggcttccccatttccgtctacaaccgcaccacctccaaagtcgacgaaaccctcgatcgagctcacaacgaaggccaactccccttaaccggccactataccccacgcgatttcgtcctctctatccaaaaacccagatcggtcatcattttagtcaaagccggcgctcctgttgaccaaaccatagccgccctctctgcccacatggagcccggagacaccatcatcgacggtggcaacgagtggtacgagaacactgagcgtcgcatttccgaagcctccagcaacggcctgctctatttggggatgggtgtttctggcggcgaagagggtgcccggaacggcccgtctttgatgcctggtggttcttaccaagcttatgagaatattaaggatattgttgagaaagttgcagctcaagttgaagatgggccgtgtgttacttacattggggaaggtgggtcgggtaattttgtgaaaatggttcacaatgggattgagtacggtgatatgcaattgatttctgaagcgtatgatgtgttaaagaatgttgggggtttgtcgaatgctgaattggcggagatttttgatgagtggaatagaggggaattagagagtttcttgattgaaatcactgctgatatatttaaagttaaggatccacttggggaaggggagttagttgataaggttttggataagactgggatgaaaggaaccgggaaatggacggtccagcaggctgcggagttgtcagtgcctgtgcctaccattgctgcctctttggattgtaggttcttgagtgggttgaaggatgagagagaggcagcttccgaggtttataaggaagttggtgtggtaagaagtggggttgataagaagaggttgattgatgatgtgaggcaggcattgtatgcttccaagatttgtagttatgctcaggggatgaatttgttgagggcgaagagtgttgaaaaggggtggaatttgaattttggggaattggcgaggatttggaaaggtgggtgtatcattagagctgtgtttttggacaggattaagaaggcttatcagtggaatccgaatttggcgagcttgttggttgacccagaatttgctagggagatggtgcagagggagaaggcatagaggagggtggtgggattggccatttctgctggggttagtattccggggatgtgtgctagtctttcttattttgatacctataggcgtgccagacttcctgctaaccttgttcaggctcagagggatttgtttggggcacacacatatgagagggttgattgccccggagcatttcatacagagtggacaaagcttgcccagaagagtgctaatggtgttgctgctctgaaatgaggcactatattatctgtcagttacttgcttttgccaagtgttttcgtgtttctatctggatttgaattgtatccctgactgaggattcttggataggaatgacaattgttgtttagcctcacattgttatgttatgtttttaataagtggtgcctgtcttttgagtattacagccttcaatatatgcaaatgattagctccgattgcaatttatttcatggtcttcatatcccttgcataaaacaacttccaccgattccattataacatgtttgattaagattattcagaagcatattaggtagaatttgg

SEQ ID NO: 3593 - DNA, 2955 bp, Theobroma cacao
gtccgtcactctcacaaaaatccttcctttcttcaaaaggccaaactccccgctttctcctacctttaaaaataaaaggaaaatatctttcaccaaaccccccatttccttcctctctccatctaacccccatttcctttccttgctgtcgtcttttccgcccaaaaatggaagcctccccagctctctctcgcataggcctggcaggcctagcggtcatgggccaaaatctggccctaaacgtcgccgaaaaaggcttcccaatctccgtctacaaccgcaccacctccaaagtcgacgaaactgtccagcgagcccaggaggaagggcagcttccactcttcggccagtactcccctcgcgaattcgtcctctcaatccaaaggcccagatctgtcgtcatcttagtcaaagccggttcacccgtcgatcaaaccatcgccgctttatctgaccacatggaacctggcgactgcatcatcgacggtggtaacgagtggtatgaaaacactgagagaagaatccaagaagtttccaataagggtcttctttatctcggtatgggcgtttccggtggcgaagaaggggcacgtaatggcccatcgttgatgcccggtggatctcaccaagcgtattcgaatatcaaagacatacttgaaaaggtggcggcccaagtcgaagatggaccttgcgtcacttacattggcgaaggaggatcaggtaatttcgttaaaatggttcataatggaatcgaatacggtgatatgcagttaatttctgaagcttatgatgttcttaaacatgttggggggcttacgaatgatgaattggcggagattttttcggaatggaataggggagagcttgaaagtttcttaattgagataacatctgatatatttagagttaaggatgagttggaagatgggtatttggtggataagattttggataagactgggatgaaagggactgggaaatggactgtgcagcaagctgctgagttatctgttgctgctcctactattgctgcttcattggattgtaggtatttgagtggattgaaggaggagagggagaatgcagctggggttttgaaagaagctgggttgaaagaggaagttggaagtttagcacaggggattgataagaaaagattgattgatgatgttaggcaagccttgtacgcttcaaagatatgcagttatgcccaagggatgaatttgttaagagctaagagtgtggaaaaagggtggaatttgaatttgggagagttggctaggatttggaaaggtgggtgtattataagggctgtgtttttggataggatcaagaaggcttaccagaggaatcccaatttggctagcttggttgtggaccctgagtttgctagggagatggttcagaggcaggcggcttggcggagagttgtggggttggctatctctgctgggattagcactccaggaatgtgcgcaagtcttgcctattttgatacctataggcgtgcaaggctcccagccaaccttgtgcaggcacagagggacttgtttggggcgcatacctatgagaggactgatcgtccaggggcatttcatacggagtggacaaagcttgctcgtaagagtactgctggtgttggtgcactcaattgagcttttctagtttagattgttatactctggtttacttgtttgtttcaattgagcattggttatatttctatgttgaaataggattctacctcggcatagcataattgttcagtcttgcagttcttttttttttttggttaataaaatgcatgccctttgagttgtagaaattgagcggttattcaatggatttatgttgcaacttgcggcagattagatggagctgtcttctggttctcaatatattttcctgttataaatttaaataagataggatgatatgatatacaagagttggacttaaacattttggtaaatatgattggaaaagttaggtagcttcttcaatgtaaaggtaaaaagattgcagtttgcaactggaaaggggtcagtaacattgctaatgtcttctcaattattctggatgaagagatattgtagtttattgtagcacctctcacgaccactaacatatggcttttacatatatctgacattttaatgctcttttacttttgatgcttgaatggattatgattcattgctcaaatagatggggttagaaactatttttgttgcattctttgcttggaccgatattcctaatcctaatcatttaattatgaagaatttgtggtgttcacaggaccacagctaatagtagttttaaatgctacttttctcttttctggttcaaaatgttaactattgttttttgcatctttcctgtgaattagatgggataaactgctatcggagttgtgaatctcttttgcctgaatatggccactatggagttctcataaggttttgcgagaagctttatctggtagatcttctgcaatgaaaaaggaacaaggaaaacttcattgaaaatgcatatgtttgacaaaggtctctcaacttctttttcaatcggtcaaaatgaacgatgaaacacttacaagcttttaccttctcatgtttctggtttgatgataactttgttttcatgttaagtgccccgtagcgttcacattcttggaaactgccctctgcttcgaagagaggaattgcccttgttataatttgctgtcttatgtgtatgtactgacaagtcatatgttatagccaaagcaccaaggtgcacctctttttagtgatactcatagaggtggtaaaatgtgaaatcacattgtaaatttttttctttttttcaccattttctcttggttataagcactggactttgccagcggcaccatcccccacatggtcagaatttactgttgggatctatcggacactttcctcatatatg

SEQ ID NO: 3594 - DNA, 1769 bp, Panax ginseng
aagcagtggtatcaacgcagagtacatggggacaactccttccccatttctaaaacctccccctttctccctctaccagcaatggaagcctccacagctctttcccgcatcggcctagcgggcctagctgtgatgggccaaaacctggccctcaacattgccgagaaaggcttcccaatctccgtctacaatcgcaccatttccaaagtcgacgaaaccctagatcgagcccaaaacgaaggccagctccccttaaccggccaccacaccccacgcgatttcgttctctctctccgaaaacccagatccgtcatcatcttggtcaaagccggcgcccccgttgacgaaaccatcgccgccctgtccgcccacatggaacccggtgacacaatcattgacggcggcaacgagtggtacgagaacaccgagcgccgcatttcagaagcttccagcaacggcctgctctatttggggatgggcgtttcgggcggtgaagagggtgcccgaaatggcccgtctttgatgcccggagggtcttaccaagcttataacaatattaaggatattgttgagaaagttgcagctcaagttgaagatgggccgtgtgttacttacattggggaaggtgggtcgggtaattttgtgaaaatggtgcataatgggattgagtatggcgatatgcaattgatttctgaggcatatgatgtgttaaagaatgttgggggtttgtccaatgctgaattggcggagatttttgatgagtggaatagaggggaattagagagtttcttgattgaaatcactgctgatatatttaaagttaaggattcacttggggaaggggagttggttgataaggttttggataagactgggatgaaaggaactgggaaatggacggtccagcaggctgcggagttgtcagtgcccgtgcccaccattgcggcctctttggattgtaggttcttgagtggattgaaggatgagagagaggcagcttctgaggtttatgagaaagttggtgtggtaaaaagtggggttgataagaagaggttgattgatgatgtgagacaggcattgtatgcgtccaagatttgtagttatgcacaggggatgaatttgttgagggcgaagagtgttgaaaaggggtggaatttgaattttggggaattggcgaggatttggaaaggtgggtgtatcattagagctgtgtttttggacaggattaagaaggcatatcagcggaatccagatttggcgagcttgttggtggacaccgagtttgctagggagatggtgcagagggagaaggcgtggaggagagtggtgggattggccatttctgctggagttagtattccggggatgtgtgctagtctctcctatttcgatacgtataggcgtgccagacttcctgctaaccttgttcaagctcagagggatttgtttggtgcacatacctatgagagggttgatcgtcccggatcttttcatgcggagtggacaaagcttgcgcggaagagtaacacccgtgtcgcagctctcaattgagctactctattatgtgtcagttacttgcttttgcatagtgttttagatgtttctattaaatctagattgtacctctggctgaggatttcctacatttgaatagcaattgttgtttagccttgctagctattttctgttttaaataagtggtgcatgtattttttgaataacattggcttcgatatatgcaaatgaatagcttggattgctatttaatt

SEQ ID NO: 3595 - DNA, 1754 bp, Panax ginseng
ctctaaaacccccacccagttccaccatggaagcctcccaagccctctcccgcataggcctagctggcctcgccgtcatgggccaaaatttagccctcaacattgccgataaaggcttccccatttccgtctacaaccgcaccacctccaaagtcgacgaaaccctcgatcgagctcacaacgaaggccaactccccttaaccggccattataccccacgcgatttcgtcctctctatccaaaaacccagatcggtcatcattttagtcaaagccggcgctcctgttgaccaaactatcgccgccctctctgcccacatggagcccggagacaccatcatcgacggtggcaacgagtggtacgagaacactgagcgtcgcatttccgaagcctccagcaacggcctgctctatttggggatgggtgtttccggcggcgaagagggtgcccggaacggcccgtctttgatgcccggtggttcttaccaagcttatgagaatattaaggatattgttgagaaagttgcagctcaagttgaagatgggccatgtgttacttacattggggaaggtgggtcgggtaattttgtgaaaatggttcacaatgggattgagtacggtgatatgcaattgatttctgaagcgtatgatgtgttaaagaatgttgggggtttgtcgaatgccgaattggcggagatttttgatgagtggaatagaggggaattagaaagtttcttgattgaaatcactgctgatatatttaaagttaaggatccacttggggaaggggagttagttgataaggttttggataagactgggatgaaaggaaccgggaaatggacggtccagcaggctgcggagttgtcagtgcctgtgcctaccattgctgcctctttggattgtaggttcttgagtgggttgaaggatgaaagagaggcagcttccgaggtttataaggaagttggtgtggtaagaagtggggttgataagaagaggttgattgatgatgtgaggcaggcattgtatgcttccaagatttgtagttatgctcaggggatgaatttgttgagggcgaagagtgttgaaaaggggtggaatttgaattttggggaattggcgaggatttggaaaggtgggtgtatcattagagctgtgtttttggacaggattaagaaggcttatcagcggaatcagaatttggcgagcttgttggttgacccagaatttgctagggagatggtgcagagggagaaggcatggaggagggtggtgggattggccatttctgctggggttagtattccggggatgtgtgctagtctttcttattttgatacctataggcgtgccagacttcctgctaaccttgttcaggctcagagggatttgtttggggcacacacatatgagagggttgatcgccccggagcatttcatacagagtggacaaagctttcccggaagagtgctaatggcgttgctgctctgaaatgaggcactatattatctgtcagttacttgcttttgccaagtgttttcgtgtttctatctggatttgaattgtatccctgactgaggattcttggataggaatggcaattgttgtttagcctcacattgttatgttatgtttttaataagtggtgcctgtcttttgagtattacagccttcaatatatgcaaatgattagctccgattaaaaaaaaaaaaaaaaaaaaaaaaaaaaaaaaaaaaaaaaaaaaaaaaaaaaa

SEQ ID NO: 3596 - DNA, 3987 bp, Glycine max
ctgaaagaaccttctgtcttattgagatgtcggaaagatgacctgcacttggtagagcatgtgctggattcagctgcacaggagtatgctgagaaagtaaatgttgatcccccagagatcattgttgacaaccaagtctatcttccacctggaccccatcatcacaactctcatgatctctactgctctggtggggtggtgttggcttctcgtgatggaaagattgtgtgtgaaaatactcttgatgcacgacttgatgtagtgttccgtaaaaagcttccagaggtaaatattttgtgcataacaactgttttattgtgtggctctatcctttttgttagatatttgccgctgtattgctactgactttcatattgtttccaagtagaaagttgttattttcaaggtattgaaactttgacattgaaataaaataagatattgaaactttcacactgatggacaactagaacaattaactggaacgaatttatgtttgaaacgagggctgggttccttaattctgggactttaggcaacatttatttgaggactcatataatataacctatcaattctcattttattattcaaaataccttttttttctgtaaggaattcttcaaaattcctaagctgtataattatttatcaaaattttataatcaagtaattctaacattttgtaatatataatatgtaattcatttaacacaacttataatttataaagtgatgaactggttaactttctagattctgatgaagtttcttgatcctaattgtagatccgaaatcagctctttggacaagttgttgcttgaagattttgattgtattgtttggttacccctgtaatatttatattccgaagcataagcttgtctttggacctaaatagctatcttgccattgattctgtcaacttataatggtcttttagataacaccatatttcggtagttcagttgttcccatattgggtacgatgggggcatgcgttattcaacattttctttagcgatggttgttatttgcagctttgagcttcttggcaataaagtaccagatgtaatatattgaacattactctcaacattatgacggaaatataacgttcgatattgtcgtaagttcgtaactgaagcaagtcaaatatttattatatatttcaaaaaatattttaagcgatttttttcttctaaaagtaacactaacaaagtggggtaaatttattttggtcttgaatctcacgtgaagtcaatgatgaactttgaaagtgaaaataatgtttcgtagatcaagcttgagatttagcataaagccgacatgttacccaatgcaaagtcttttactatgaattcaattaatagtaatattggtagaatttgattcttatttccattgttaagaatgccatttctttgggatgctaatcttatgatatgacacattctccatattctatctatttttatttgatttctttaaataagaataactaacttctacattataaatcaatattacagttattgcatttacagaccaaaaataaataaataacgcttaattttcacgtacgcaactaactttcgactactttttcaattaattctacgaacataattcatatcaattttttatatataaatataaatcagtgtagtactagcacatacataaatatcaactcaaacacgtcaacatattagtagtttttttttataaaaaaaaaaagtagccactaaaagagggctgactatgaaatataaatatctgggttgactgatttggatgcaatcgaaacgcagtcgtttgattgtgaagtgagttcccattgagcagatgttggaggcaacaacgtctacggcagctcctcgaggagtccgccaacctcaccaaaccccccaaaaagcccttgtcagtttttcccctaatactaataattaatgattaacgattaacgatttataacaacaacaacgacgacgacactttgacacacctaaccctccaaattcctatctctcttcgaatggaatccgcagctctgtcgcgcataggcctggcgggcctggccgtgatgggccaaaacctagccctgaacatcgcggaaaaggggtttcctatctccgtctacaaccgcacagcctcgaaagtggacgagaccgtagatcgggcccgcaacgagggctccctccctctcacgggccaatacacccctcgcgacttcgttctctccctccagcgccctagatccgtcatcatcctcgtcaaggccggcgcccccgtcgaccaaaccatcgccgccctctccgaccacctcgaccccggcgactgcatcatcgacggcggcaacgagtggtacgagaacaccgagcgccgcatgagcctcgtcgccgacaaaggcctcctctacctcggcatgggcgtctccggcggcgaagacggcgcacgccacggcccctccctcatgcccggtgggtcccaccaggcctactccaacgtccaggacatcctccacaaaatcgccgcccaggtcgaggacggcccctgcgtcacttacatcggcgagggaggctccggaaacttcgtcaaaatggtccacaacggaatcgaatacggcgacatgcaactcatctctgaagcctacgatgttttgaagcacgtcggtggcttgtcgaattccgagcttgcagatattttcgccgagtggaacagaggggaacttgagagtttcttaattgaaattaccgcagatatttttaaagtgaaggatgaagatggtgaagggtttttggtggataagattttggataagaccgggatgaaggggaccgggaaatggacggtgcagcaggcggcggagctttcgatagcggcgcccacgattgcggcttcgttggattgccggtacttgagtgggttgaaggaggagagggagagtgccgcagcggtgttgaaggaggcggggttgagtgatgaattggggagggttagtgtgagtggggtggataagaagaggttgattgatgatgtgaggcaggctttgtatgcttccaagatttgtagctatgctcaggggatgaatttgttgagggctaagagcaatgagaaagggtggaacttgaatttgggggaattggctaggatttggaagggagggtgcatcataagggcggtgttcttggacagaatcaagaaggcctatcagaggaaccctaatttggctagcttgatagtggacccggagttcgccagggaaatggtgcagaggcaggctgcgtggaggagggttgtggggttggcagtttcagctgggattagtactcccggaatgtgtgccagtcttgcttactttgacacctatcggagggcaaggctgccggcaaaccttgttcaggctcagagggacttgtttggggcgcatacttatgagagggttgatcgccccggggcttttcataccgagtggacgaagctcgcccgcaagagtgggactggagttggtgcactcaattgattgatgatgggttttggttgtttgcttgattgtcgtgcagtgcagcatttgagttgtaattgtttgtttcttttgaggatctttggtaggcagagagcagctattgttttcttgctataactgtttttaatcttaataaaacaaaggcgtgtcatttggcttccactggcttttgcttaagtagagtacaagttgttgattttcttgtctcttgtatgtttgtttccgattagagtggtaattgcatttttggatttgattcctctaaagtgaggaaggttaaaataagtaacctagttgttgatatttcaaaacattcatgatttattatccagatgcctgtgatgctggctgcaaattttctcatcaatgactgaggttgttgcttgctttattctctaaagtatcactttagaagagacagatccttgcattttattttatataaaacactttcatga

SEQ ID NO: 3597 - DNA, 2145 bp, Vitis vinifera
gggtagttggtcattgggcctccaaaacggcgccgtttggcagttctttcttgacattggaggcatcgacgttcacgacaccctctcgttggtggttcggtcgctgccctttcactccctcgacgagtccgtcacttcactttctcagaatcagaacacccctcttatacacatactagagtacatctccatcgacgctcggtcttttgctctgaatctttctcagctgccaaacgtccctctcagctctccctaaatggaagcctccactctctcacgaatcggcctcgccggcctggccgtcatgggccaaaacctagctctcaacatcgccgaaaaagggtttccgatctccgtttataatcggacgacctccaaggtggatgaaacgctagatcgggcgcaccgcgaaggccatctacctctcagtggccactactcgcctcgtgacttcgtgctctccatccaacggcctagatccattgttatcctcgtcaaggccggcgctcccgtcgaccaaaccattgctgctttgtctgagcacatggaggccggggattgtattattgacggtggaaacgagtggtacgagaacaccgagcgccggattgtggaagcttctggcaagggcattctgtatctgggcatgggcgtctccggtggcgaagagggtgcgcgccacggcccgtcgttgatgcccggtggatcttatcaggcgtatcagaacatcgaggatattgtgaagaaagtggctgctcaggtcgatgatggtccctgcgttacctatattggcgaagggggttcggggaatttcgtgaaaatggtgcacaatgggattgaatacggcgatatgcagttgatttcggaagcctacgatgtgttgaagaacgttggagggttgtcgaactccgaattgtctgacattttcggtgaatggaacaggggagagcttgagagcttcctgattgagattacagctgatattttcaaggtgaaggacgagcatggagatggggaattggtggataagattttggataagacggggatgaaagggaccggaaaatggacagtgcagcaggccgcggagctgtccgttgcagcaccaactattgcagcctctttggattgtaggtacttgagcggcttgaaggaggaacgagaggctgcagctggggttttgagcgaggcggggttgaaggatgaggtggggtttgccaggagtggggtcgataagaagaggttgattgatgatgtgaggcaggcattgtatgcctcaaagatttgtagttatgctcagggaatgaatctgttgagggcgaagagtgttgagaagggttggaatttgaatttcggggagttggcaaggatttggaaaggtgggtgtatcataagggcagtgtttttggaccgaatcaagaaggcatatcagaggaatccaaatttagcaagtttgattgtggaccctgagtttgcaagggagatggtgcagaggcaggcagcatggaggagagtcgtgggcttggcgatttctgcagggattagtactcctggaatgtgtgctagtcttgcttattttgatacatataggcgtgcaaggcttcctgcaaatcttgtgcaggctcagagggacttattcggggcacatacttatgagaggattgatcgcccaggctcatttcataccgaatggacaaaacttgctcgaaagagtgatgctggttttgctaccctgaaatgagaatttctgttgctgtcacccatgtttgttccaattggatgttatttaactttctattcgaatccgggttgtatttcttgctgagtagtcctttgattaggcagtgcaattggtgttagaccttgcagttcttcagctgctaataagtagtgcatgccttttgagttatgctggccaaatgaatgccaaatgttttctttcccttccagtagagaagataaagagtttcctgtcttcttcttagtattttacctttaacatgtctttgatttgcatattgatagaagtgttcatgtctaatattaagttggtggttgttgcatattttcaatatcctacaaaatgcagaatcatggttctgttgaatctgtaaagatatcaaataatttgggcttgtattggaa

SEQ ID NO: 3598 - DNA, 2567 bp, Glycine max
cgagtatgaaatataaatatctgggttgactgatttggtaggaaccgaagcgcagtcgtttgattgtgaagtgagttccgattgagcacgtcttggaggcaacgacgtctacggcagctcctcgttggtggttaagtcgcttgtcctttcagtccctcgatgagtccgccaacccctaaaaagcacttcttagttctccctctcccactaaaaaccatagtaatctagataataattaacatcagccctcactccttcgcacaccaaacccttccttcctatctctcactaatctaatggaatccgcagcactgtcgcgcataggcctggcgggcctggcggtgatgggccaaaacctagccctaaacatcgcagaaaaggggttcccgatctccgtgtacaaccgcacggcctccaaagtggaccagaccgtagatcgtgcccgcaacgagggctccctccctctcacgggccaatacacccctcgcgacttcgttctctccctccagcgccccagatccgtcatcatcctcgtcaaggcaggctccccagtcgaccacaccatcgccgccctctccgaccacctcgaccccggcgactgcatcatcgacggcggcaacgagtggtacgagaacaccgagcgccgcatgaacctcgtcgccgacaaaggcctcctctacctcggcatgggcgtctccggcggcgaagacggcgcacgccacggcccctccctcatgcccggtgggtcccaccatgcctactccaacgtccaggacatcctccacaaaatcgccgcccaggtcgaggacggcccctgcgttacctacatcggcgagggaggctctggaaacttcgtcaaaatggtccacaacggaatcgaatacggcgacatgcaactcatctctgaagcctacgatgttttgaagcacgtcggtggcttgtcgaattccgagcttgcggagattttcgtggagtggaacagaggggaacttgagagtttcttgattgaaattaccgccgatatttttaaagtgaaagatgaagatggtgaagggtttttggtggataagattttggataagactgggatgaaggggaccgggaaatggacggtgcagcaggcggcagagctttcgatagccgcgcccacgattgcggcgtcgttggattgccggtacttgagtgggttgaaggaggagagggagagtgccgcggcggtgctgaaggaagcggggttgagtgatgaattggggagggtaaatgtgagtggggtggataagaagaggttgattgatgatgtgaggcaggctctgtatgcttccaagatttgtagttatgctcaggggatgaatttgttgagggctaagagtaatgagaaaggatggaacttgaatttgggggagttagctaggatttggaagggagggtgcatcataagggccgtgttcttggaccggatcaagaaggcttatcagaggaaccctaatttggcgagtttgattgtggacccggagtttgcaagggaaatggtgcagagacaggctgcgtggaggagggttgtggggttggcggtttcggctgggattagtactcccggaatgtgtgccagtcttgcttactttgatacctatcggagggcaagacttccggcaaaccttgtccaggctcagagggacttgtttggggcgcatacttacgagagggttgatcgccctggggcttttcataccgagtggacgaaactcgctcgcaatagtggggctggagttggtgcactcaattgattgattttgggttttggttgtttgtttaatggtcgtgcattgcagtgcagcatttgagttgtaattgtttgtttctttgaggatctttggtagggagagagcaactattgttttcttgctataactgtttttaatcttaataaaacaaaggcatgtcatttggcttccactggcttttgcttaagtagagtacaggttgttgatgctctcatctcgtctgtatttgtttccaattagagttataattgcatttttggatttgattcctctaaagtgaggaaggttaaaataagtaatctagttgttgatgttgatatttcaaaacattcatgatttattatctacatgcatgtgatgctggctgtaaattttcttatcaatgactgagattgttgcttactttattctccaaagtatctctttagaagagactgatccttgcattttatactttattttatataaaaagcattaatgactttcttgacaaaatgtgatgagaagaattgtgttgactcctctaacatgaggaatatttaagtattaagaaaatcaattgttgatattttaacgcattcatgacttgttatggatgtgatattggttgttgatagtttcatcaatgactgaaattgctactttactctctaaaagagctgctcgtgctagaggaacctgatcttgtattttgtataaaacacattcatgaatttcttgacaaaatatgatgagaattgtgttaatgatttttgtatcaagtcaactgtggtcggaacatcctat

SEQ ID NO: 3599 - DNA, 2427 bp, Glycine max
ctggtgcataccaaaatatcaactgacacacgtcaacatattagtagttatttaattttattttcttgaaaagaaaagtaaggtggccactaaaagagggccgagtatgaaatataaatatctgggttgactgatttggtaggaaccgaagcgcagtcgtttgattgtgaagtgagttccgattgagcacgtcttggaggcaacgacgtctacggcagctcctcgttggtggttaagtcgcttgtcctttcagtccctcgatgagtccgccaacccctaaaaagcacttcttagttctccctctcccactaaaaaccatagtaatctagataataattaacatcagccctcactccttcgcacaccaaacccttccttcctatctctcactaatctaatggaatccgcagcactgtcgcgcataggcctggcgggcctggcggtgatgggccaaaacctagccctaaacatcgcagaaaaggggttcccgatctccgtgtacaaccgcacggcctccaaagtggaccagaccgtagatcgtgcccgcaacgagggctccctccctctcacgggccaatacacccctcgcgacttcgttctctccctccagcgccccagatccgtcatcatcctcgtcaaggccggctccccagtcgaccacaccatcgccgccctctccgaccacctcgaccccggcgactgcatcatcgacggcggcaacgagtggtacgagaacaccgagcgccgcatgaacctcgtcgccgacaaaggcctcctctacctcggcatgggcgtctccggcggcgaagacggcgcacgccacggcccctccctcatgcccggtgggtcccaccatgcctactccaacgtccaggacatcctccacaaaatcgccgcccaggtcgaggacggcccctgcgtcacctacatcggcgagggaggctctggaaacttcgtcaaaatggtccacaacggaatcgaatacggcgacatgcaactcatctctgaagcctacgatgttttgaagcacgtcggtggcttgtcgaattccgagcttgcggagattttcgtggagtggaacagaggggaacttgagagtttcttgattgaaattaccgccgatatttttaaagtgaaagatgaagatggtgaagggtttttggtggataagattttggataagactgggatgaaggggaccgggaaatggacggtgcagcaggcggcagagctttcgatagccgcgcccacgattgcggcgtcgttggattgccggtacttgagtgggttgaaggaggagagggagagtgccgcggcggtgctgaaggaagcggggttgagtgatgaattggggagggtaaatgtgagtggggtggataagaagaggttgattgatgatgtgaggcaggctctgtatgcttccaagatttgtagttatgctcaggggatgaatttgttgagggctaagagtaatgagaaaggatggaacttgaatttgggggagttagctaggatttggaagggagggtgcatcataagggccgtgttcttggaccggatcaagaaggcttatcagaggaaccctaatttggcgagtttgattgtggacccggagtttgcaagggaaatggtgcagagacaggctgcgtggaggagggttgtggggttggcggtttcggctgggattagtactcccggaatgtgtgccagtcttgcttactttgatacctatcggagggcaagacttccggcaaaccttgtccaggctcagagggacttgtttggggcgcatacttacgagagggttgatcgccctggggcttttcataccgagtggacgaaactcgctcgcaatagtggggctggagttggtgcactcaattgattgattttgggttttggttgtttgtttaatggtcgtgcattgcagtgcagcatttgagttgtaattgtttgtttctttgaggatctttggtagggagagagcagctattgttttcttgctataactgtttttaatcttaataaaacaaaggcatgtcatttggcttccactggcttttgcttaagtagagtacaggttgttgatgctctcatctcgtctgtatttgtttccaattagagttataattgcatttttggatttgattcctctaaagtgaggaaggttaaaataagtaatctagttgttgatgttgatatttcaaaacattcatgatttattatctacatgcatgtgatgctggctgtaaattttcttatcaatgactgagattgttgcttactttattctccaaagtatctctttagaagagactgatccttgcattttatactttattttatataaaaagcattaatgactttcttgacaaaatgtgatgagaagaattgtgttgactcctctaacatgaggaatatttaagt

SEQ ID NO: 3600 - DNA, 9932 bp, Glycine max
atgtgagtttcgtataaattggttcacaaagtagatcgtgggatgtggtagtggggtaacgatacgtaataagttctatcattgaggaagtttcctgtgcatcgtctccgaaaatgaacgacgcagatgtctcaaagcaaatccagcagatggtgcagttcatccgccaggaagctgaggaaaaggccaacgagatctctgtctccgccgaagaggaattcaatatcgagaagctgcagttggtcgaagccgacaagaagaagatcaggcaagaatacgaacgcaaagagcgccaagttgaaattcgcaagaagattgagtactcgatgcagctaaatgcttctcggattaaagttcttcaagctcaagatgacgtgatcagttccatgaaagaagctgcatccaaggaactgttgaatgtgagtcatcatcatcatttgaatctactgagtcatcatcatcatgagtacagaaaccttctgaaagatctcattgttcagtgtttgcttagactgaaagaaccttcagtcctattgagatgtcggaaagatgacctgcacttggtagagcatgtgctggattcatctgcacaggagtatgctgagaaagcaaatgttgatcccccagagatcattgttgacaaccaagtttatcttccacctggacccagtcatcacaattctcatgatctctactgctctggtggggtggtgttggcttctcgtgatggaaagattgtgtgcgaaaatactcttgatgcacgacttgatgtagtgttccgtaaaaagcttccagaggggaaggagagagccaggaagggaatgttggattaagggttgccaaacttcttcaattaaaactctgtgaacttggatgtattgctgtcactcaaataagatccgaaagcagctctttggacaagttgttgtttgaagattttgattgtatggtttggttacccctgaaatgtttatatcccgaagcatcattagcttgtctttgacctgaaaagctgtcctgccattgcttctgtgtacttataattattgtcttttaaataacaccatatttcggtagtccatttgttcccatgtcgtgtatgatgggggatgcatcgttctaagttttctttcgtgatgacttttatctcattgacaataagtgtttgctccggctcattgctgctttgattttaaaaaaataaaataaaacagggattatttattcatttatttattttcgctcattccttatacacattttttatcttacaatttattttaaccattgaagtatttataatatttattttatagatcaatataaatattataaatagtacaatattatttcaacactatacttcatgaaattgataaaaataaatattatattcattttattattttttaaataattttattattagattattttaaaaaattaaaattctaataccccaaaatatataaatttattcataaaatgaaattaaaatgtatataaaaccttatataaatatgttcatttcttttcttttacatctttcaactatttcaataaataattttatcaaaaaattatgatttaataagataatttaaacacttttgactgagtagtttttttaatcagtttttattaacataacctttataaaaaaaaaagtacaatagatatttatattattattcaataaaaaatcatcatatcgcatatattgaatttatttttgtatagctattttaaaaatcataaataataatatcataaaaattaaattggtatttttaatgcacacataaaaaaaatgttaggaaagaaattaaatataaacgaattttccacgcgagaaccaagatgtgcagcataaattgtcaccttgttgaacatgcataaaaaagaggtgagctggcctgggctgtgatattggggcagcgcagcaatacgtaacaagttctatcattgaggaagtttccggtctccgaaaatgaacgacgcagatgtctcgaagcaaatccagcagatggtgcggttcatccgccaggaagctgaggaaaaggccaacgagatctctgtctccgccgaagaggaattcaatatcgagaagctgcagttggtcgaagccgacaagaagaagatcaggcaagaatacgaacgcaaagagcgccaagtcgaaattcgcaagaagattgagtactcgatgcagctgaatgcttctcggatcaaagttcttcaagctcaagatgacgtgatcagttccatgaaagaagctgcatccaaggaactgttgaatgtgagtcatcatcatcatttgaatctactgagtcatcatcatcatgagtacagaaaccttctgaaagatctcattgttcagtgtttgcttagactgaaagaaccttctgtcttattgagatgtcggaaagatgacctgcatttggtagagcatgagctggattcagctgcccaggagtatgctgagaaagcaaatgttgatcccccagagatcattgttgacaaccaagtctatcttccacctggacccactcatcacaattctcatgatctctactgctctggtggggtggtgttggcttctcgtgatggaaagattgtgtgtgaaaatactcttgatgcacgacttgatgtagtgttccgtaaaaagcttccagagatccgaaggcagctctttggataagttgttgcttgaatattttgattgtattgtttcgttacccctgtaatgtttatatcccgaagcataagcttgtctttggagcttaatagctatcgtggcattgcttctgtcaacttataattgtcttttagataacaccatatttcggtagtccagttgttcccatattgtgtatgatgggggggcatgcgttgttctagattttagcgtatgtaatatattgaacattactgtcaacattatgacggaaatataacgttctatattgtcgtatctgatgcaagtaaaagcccatatagaatatgggttggtttgatccaatccgattttcaagcctggtttgacggatcagatggatcaatctgtgtattttgtcgagctctatgtgagattccaaccataatcaattatcatataagtataaggttaatttgttttaatttatatattcaaataaatattttcatatttttttgtgtatttgttcaaattgtttttgttttaaaaaaatagttttctgctaagaaaaaaattctttgcttcttgaaaaatacttatatgaaaaaatctattttaaaattattttttataagtttaaataaattcatctataattgactgagtaaagtgctctgtggctcgtgatatacgcgattatgacaaatgatattaattacttttaggcatttaaaaaaatgaggcaccaaacttatatatatcaacattttttttatttgaggtaagctgtatcaacttctttatatgtaaatattcatgaattatataaataaattttaatatatatagcaacttgttcaatgtatgtcaactatatcaacttctgtttattttatatatatgtatataaatataaatcattgtagtactggtgcataccaaaatatcaactgacacacgtcaacatattagtagttatttaattttattttcttgaaaagaaaagtaaggtggccactaaaagagggccgagtatgaaatataaatatctgggttgactgatttggtaggaaccgaagcgcagtcgtttgattgtgaagtgagttccgattgagcacgtcttggaggcaacgacgtctacggcagctcctcgttggtggttaagtcgcttgtcctttcagtccctcgatgagtccgccaacccctaaaaagcacttcttagttctccctctcccactaaaaaccatagtaatctagataataattaacatcaaccctcactccttcgcacaccaaacccttccttcctatctctcactaatctaatggaatccgcagcactgtcgcgcataggcctggcgggcctggcggtgatgggccaaaacctagccctaaacatcgcagaaaaggggttcccgatctccgtgtacaaccgcacggcctccaaagtggaccagaccgtagatcgtgcccgcaacgagggctccctccctctcacgggccaatacacccctcgcgacttcgttctctccctccagcgccccagatccgtcatcatcctcgtcaaggcaggctccccagtcgaccacaccatcgccgccctctccgaccacctcgaccccggcgactgcatcatcgacggcggcaacgagtggtacgagaacaccgagcgccgcatgaacctcgtcgccgacaaaggcctcctctacctcggcatgggcgtctccggcggcgaagacggcgcacgccacggcccctccctcatgcccggtgggtcccaccatgcctactccaacgtccaggacatcctccacaaaatcgccgcccaggtcgaggacggcccctgcgtcacctacatcggcgagggaggctctggaaacttcgtcaaaatggtccacaacggaatcgaatacggcgacatgcaactcatctctgaagcctacgatgttttgaagcacgtcggtggcttgtcgaattccgagcttgcggagattttcgtggagtggaacagaggggaacttgagagtttcttgattgaaattaccgccgatatttttaaagtgaaagatgaagatggtgaagggtttttggtggataagattttggataagactgggatgaaggggaccgggaaatggacggtgcagcaggcggcagagctttcgatagccgcgcccacgattgcggcgtcgttggattgccggtacttgagtgggttgaaggaggagagggagagtgccgcggcggtgctgaaggaagcggggttgagtgatgaattggggagggtaaatgtgagtggggtggataagaagaggttgattgatgatgtgaggcaggctctgtatgcttccaagatttgtagttatgctcaggggatgaatttgttgagggctaagagtaatgagaaaggatggaacttgaatttgggggagttagctaggatttggaagggagggtgcatcataagggccgtgttcttggaccggatcaagaaggcttatcagaggaaccctaatttggcgagtttgattgtggacccggagtttgcaagggaaatggtgcagagacaggctgcgtggaggagggttgtggggttggcggtttcggctgggattagtactcccggaatgtgtgccagtcttgcttactttgatacctatcggagggcaaggctgccggcaaaccttgtccaggctcagagggacttgtttggggcgcatacttacgagagggttgatcgccctggggcttttcataccgagtggacgaaactcgctcgcaatagtggggctggagttggtgcactcaattgattgattttgggttttggttgtttgtttaatggtcgtgcattgcagtgcagcatttgagttgtaattgtttgtttctttgaggatctttggtagggagagagcaactattgttttcttgctataactgtttttaatcttaataaaacaaaggcatgtcatttggcttccactggcttttgcttaagtagagtacaggttgttgatgctctcatctcgtctgtatttgtttccaattagagttataattgcatttttggatttgattcctctaaagtgaggaaggttaaaataagtaatctagttgttgatgttgatatttcaaaacattcatgatttattatctacatgcatgtgatgctggctgtaaattttcttatcaatgactgagattgttgcttactttattctccaaagtatctctttagaagagactgatccttgcattttatactttattttatataaaaagcattaatgactttcttgacaaaatgtgatgagaagaattgtgttgactcctctaacatgaggaatatttaagtattaagaaaatcaattgttgatattttaacgcattcatgacttgttatggatgtgatattggttgttgatagtttcatcaatgactgaaattgctactttactctctaaaagagctgctcgtgctagaggaacctgatcttgtattttgtataaaacacattcatgaatttcttgacaaaatatgatgagaattgtgttaatgatttttgtatcaagtcaactgtggtcggaacatcctatattaatgcatgctaatttcttgtgcattacgatataggttatcctggtgtacgtggtgaaggattttctctttttcttcctttgttactttacatgcaggtgcacttgtaagattttgtgcttcttgttggtgccttgatggccaagtttttatttttaccttttggtaaatgatagcgtgctttataggctgttatttagctggttttcctttgggcaaccttctggatgtaggactcagtaatgcttttgtgatatagtttcttttggagtttacgctgctttttttgcttcagtttattaaattgaatgccacatttacagttgtaacttggaagagactaattaacaaatgcaaattgcttcatgccattgagaaaaggttgattatgtgtaaatcgtgacaattcttttccctggcagaatatattcgatagtacaaagaaagttaaaagactaataataattttcattcttgaaatatctacaaaactattccttcatctgtagtcagatacacttcctttgttcgttgcacagaatggacgaaccttgtttgttttgttatacatgcacagacaaaacagtattagcaaagtaaccagagtaattggacaaaagattatatggggaagatgcagtggactaaagaacaccgctctcaagaactggctgagttcttgtcactgctgcggagggcattttactgttgccaacccatctactttctagaacctgatcttcaccagcttgtttttccatggcttgaatcctcttggtcttgagaagtctcatagaagaaaaaaccgcatagcccgctatgatcaacccaaaaaatccaacaacaaagccaatcacccacagataccatgttccccgcttcttctccaatgggagtacaactgaaaagtggccctggtctctggagttacacactccaggggaactcatctcagtaagttgaaatgttccattggcattgaaagctacacatctcacccttgtgttgatgctacccctacccataaatgtaacgttgggaaattgaacagatatgggctgccccattgtgttgagagtgatgtttctctcactcgtgtctgttacatttgaggcatcaaaaaccatgaagccgacaacagaagagatgagtgagtaacctggcaaattgaagtagtgggaagaccagttgcccaagttttggtagacaatagccaacctcctcacatggggaatggacatggttcttggtgggatctgaaagtaactaaagttggcacctttgttccagagccttctgcttctgagacgtactactgaaacatccataccggacaggttccttggaagaagagcatcatatagagcaccagtttgaggcctgtgtttgaccagtgacctgaaagcaaaatcttgaaccaaggaattcaatgattcacatgcagcagcagtgttgtccaagctgtgcaccaaggagccgcagcaacacaaggtgagaagcaacacccagatgaaatcccagtcaatgttggatcccattaacacattcggcaaaagaacaagcttagacaagttttaaggaatggaaggaacaatacggcgatctgttttaggtattgctgctttcatttgtttcatataagagctgattgtagatgtaaatataggaagcaccaagtccaatgattgttactttccacaaagaagaagcatgctcaggtttgggtcccaactactgactccagagggaagaaaggctcaaaaagtagcaattgactaggggcactctgattccatctcattctcatgacttgtgtgattgtgtctgagaatctttgtcactacaatgcgagaaccaactttagcatgcgttgattgctcattttctccggagtgctgctaggtgcacccagcattattgtcggtgcacccagcactaaccacgaaaagacaaaaatagcccttatggatcaagttgatccgtaaattaatttttaagacttatggatcaacttgatccgtaagtcttttacggatcaacttgatccgtaagtcttttacggatcaacttgatccataagtttttcatggatcaagttgatccgtaagttgatttttaagacttacggatcaagttgatccgtaagtcttttacggatcaagttgatccgtaaatcttaaaaattaatttatagatcaacttgatccataaggagagaaattaacaagggtaattttgccatttttaaaaaatgctgggtgcaccaacaataatgctgggtgcacctagcaacactcttttctcctgggaggcaaatgatgaacaattccacaagcccaaatttcggcccgtcaagcctgcaggggctcatctagcatttaggcccaaacgtatatgcccagcccaaatttccactatatagcatttagtttactttttttttataatagttatttttttaaaacaaaaaacaaacatacttatcatagtttatcatatttttgattaattgttgttgttaaaaaaagagaagttgacgttcacaatgtatggaaattaagattaaactccaaacaaaatctctcaaatgtttactcgaaaagtatttttggagtaaataaagtatatattgcgtaaaggtatttagattttcatccaattacaaaatcgttaaatatgatatatttatttatttttatcattactatcttaaaattttctgcttcacacaaaagtacatcaaaattaacttaatataatgaacataattttttttttcaatatcaaagaaattagaaataaataaaatttccacgcgtaagccaaaatatatttattttaaattttgttagtagcttgaagatgcataaaagagaggtgaggtgaactcgtgtggggtgtggtagtgtggcagcgacacgtatcaacttcaataatcgcatcgcagaagcagtttccggtgcatctcatcgtctccgaaaatgaacgacgcagatgtctcgaagcaaatccagcagatggtgcggttcatccgccaggaagctgaggaaaaggccaacgagatctctgtctccgccgaagaggaattcaatatcgagaagctgcagttggtcgaagccgacaagaagaagatcaggcaagaatacgaacgcaaagagcgccaagttgaaattcgcaagaagattgagtactcaatgcagctgaatgcttctcggattaaagttcttcaagctcaagatgacgtgatcagttccatgaaagaagctgcatccaaggaacttttgactgtgagtcatcatcatgatgatcatgtgtacagaaaccttctgaaagatctcattgttcagtgtttgctaagactgaaagaaccttctgtcttattgagatgtcggaaagatgacctgcacttggtagagaacgtgctggattcagctgctcaggagtatgctgagaaagcaaatgtcgatcccccagagatcattgttgacaaccaagtctatcttccacctggacccagtcgtcacaattctcacgatctctactgctccggtggggtggtgttggcttctcgtgatggaaagattgtgtgtgaaaatactcttgatgcacgtcttgatgtagttttccgtaaaaagcttccagaggtaaaaaaaaaattgcatagcagttcttattcagt

SEQ ID NO: 3601 - DNA, 2316 bp, Medicago truncatula
attaatcaatttaaattttatacgagttgactggatactctaaaacgcagtcgtttatgtaacaattttgacacatcttggaggtaacggtagctcctcgttggtggttaagtcactgtcctttcacaccctcgacgagtccgccacttctcaacaacaacaactcatcatacaaaaacacttcacactccttcccctctctctctatctcaccaactccttctttcatttcatttcatttcttcaattcaactatggacgcttccactctctctcgcataggcctcgctggcctagccgtaatgggccaaaacctagccctaaacatcgccgagaaaggcttcccaatctccgtctacaatcgtactacttccaaagtcgatgaaaccgtagatcgtgcccaccgtgaaggctccctccctttaaccggtcaatactcccctcgcgaattcgttctctctctccaacgtcctagatcagttatcatccttgtcaaagctggtgctcccgtcgatcaaacaatctccgccctctcagatcacatggagcccggcgattgtattatcgacggtggtaacgaatggtatgaaaataccgaacgaagaatccaacaaatctctgaaaagggaatactctatctcggtatgggtgtttctggtggtgaagaaggtgctagaaatggaccttctcttatgcctggtggctcctaccaggcttatagtaatattcaagatattcttaccaaggttgctgctcaggttgaagatggtccttgtgttacttacattggtgaaggtggttctggtaattttgttaagatggttcataatggtattgaatatggtgacatgcagcttatttctgaagcttatgatgttttgaagcatgttggtggattgtccaattctgaacttgctgatatttttgctgagtggaatagtggtgagcttgagagttttcttattgagattactgctgatatttttaaggtgaaggatgaaggtggggatgggtatttggtggataagattttggataagactggtatgaaggggaccggtaaatggactgttcaacaagctgcggagttgtcagttgctgctccgactattgctgcttcgttggactgtaggtatttgagtgggttgaaggaggagagggagaatgccgcggcagttttgaaggaagcggggttgggcgaggaagtgggagggtttgtgagaagtggggttgataagaaaaggttgattgatgatgtgagacaagctttgtatgcttctaagatttgtagttatgcacaaggaatgaatttgttgagggcaaagagtgatgagaaaggttggaatttgaattttggggagttagctaggatttggaaaggtgggtgtattataagagctgtgtttttggataggattaagaaggcttatcagaggaaccctaatttggctagtttgatagtggatcctgaatttgctaaggaaatggtgcaaaggcaaggtgcatggagaagggttgttggattggctatttcagctgggattagtactcctggaatgtgtgctagtcttgcttactttgatacatataggagagcaaggcttcctgctaaccttgttcaggctcagagggatttgtttggagctcatacctatgagcgtctcgatcgtcccggcgctttccataccgagtggacaaaacttgctcgtcagagtggtactggtgctgctgctcttaattgatgatatgtctcttagtgtggttagttgtttgtttgttgtttaatgcagcatttgtgttgcaactgtatgtttcgttgagattgaggttcttcggttaggcagagcaattattgtttccttattgttgtagctgtttttccttttaatttaacaaataaaagaaaagctttgtcatttgttcacctgctttttttgtttcaagtttgagtcctgaattacactttaaattgttgatgcttttgtctcatagatacctttaaagctgtgtttaaagactgtgtattaacaatgacagaaacatcctctcaggtttcaatatattttggactttgtttccttagctttactttatagctgaacttggtgtattccctttgttattccttttgtaacttcaatgtgtgaccagtgttgttttgcacgcatctacatgctcatgcactatgtatggtttttaaagttgcttttgttgccttgctagctaagtgttttttaatatacattttgttgtatgctttgtagattgattcaggactagggaacgttccttatattgcttcttgtgggttttagt

SEQ ID NO: 3602 - DNA, 1629 bp, Eutrema halophilum
ttgggccagaaccttgccttgaacatcgccgagaaaggtttcccaatctcagtctacaatcgaaccacatcgaaggtcgacgaaaccctagatcgagcctccgtcgaaggaaacctaccagtttccggccaatactctccgcgcgatttcgtcctctccatccaacgaccgagatccctaatcatcctcgtcaaagccggagctcccgttgaccagacaatcgccgccttctccgagtacatggagcccggagattgcatcatcgacggtggaaacgaatggtatctgaacacagagcgacggatctctgaggcggagcagaaaggactgctctatttaggcatgggagtctccggcggcgaagaaggagctcgtaacggtccgtcgcttatgcccggcggatcgtttcaggcgtatgacaacatcaaagatatcttggagaaagtcgcggctcaggtagaagatggaccttgcgttacttacatcggagaaggaggatctggaaatttcgtgaagatggttcataatgggattgagtatggagatatgcaattgatctctgaagcttacgatgtgctgaagaacgttggtggattgagcaacgaggagcttgcggagatcttcacggagtggaatcaaggtgagcttgagagcttcttggttgagattacttcggatatatttagggtcaaggatgagttcggtgatggagagctggtggataagatattggataaaaccggcatgaaaggtaccggaaaatggactgttcagcaggcggcggagctctctgtggcggctccgacgattgctgcctcgttggattgtcggtacttgagcggattgaaagatgagagggagaatgctgcgaaagtgttgagagaagctggattgaaggaagagattggttctgcatcgagcgggatcgataagaagagattggttgatgatgttaggcaagctctctacgcttcgaaaatctgtagttatgctcaagggatgaatctgcttagagctaagagctcagagaaaggctggaacttgaacttcggtgaactggctcggatttggaaaggaggctgcatcataagagcggttttcttggataggatcaagaaagcataccagagaaacccggatttggcaagtcttgtggttgatcctgactttgctaaagagatggttcagaggcaagctgcttggagaagagtggtgggtttggctgttgctgcagggataagcacgcctggaatgtgcgcgagtcttgcatatttcgatacttacaggcgcgctagattgccggcgaatctagttcaggcgcagagagatctctttggagctcatacttatgagaggatcgatcgtcctggtgcgtatcacactgaatggtctaagcttgccaagaagagcacttgaggtttttgctttcctaaaaatcctctctttgtctttgctatttttagcaatagggaattggatttgaaccacattgtttcaagagtgttttgttcagatttcaaaataagaaaatgcagtaccttgatttttgctttagttttctgacattgtgccttttacctttaaattggcagacatcttccctatcttctaaaaatcaaacgtctagac

SEQ ID NO: 3603 - DNA, 2178 bp, Prunus mume
tcttcgtatatttcccctctttttaactaccttataaccgccaaaaaaaaaaaaaatcagcaaaaactaatagacggattatgttgtttgagaggacaaaacgtggcgttttggttaaacctcaaagtcatcgacgtccacggcaccctctcgttgttggttaggtcactgtcccttcgctacctcgacgagtccgtcagttccctccccaacccaactcaccaacccacttgccaaaaccgaaatacaaaaaaattatccttccatatatctctccgctccatcgaccaccctcctccaatctctctcttcaccaaacccccctctctcactctctctctttctctctgtacagcagtagccatggaagcttcacctgctctctcgcgcatcggcctcgcaggcctcgccgtcatgggccaaaacctcgccctcaacatcgccgagaaaggcttccccatctccgtctacaaccgcacaacctccaaggtcgacgagaccgtcgaccgggcccacaacgagggcaatcttcctctcttcggtcagtacaatcctcgcgacttcgtgctctccatccaacggcccagatccgtcatcatcctcgtcaaggctggtgctccggtcgatcaaactatcgccgctctctccgcccacatggagcccggcgacgccatcatcgacggcggcaacgagtggtacgagaatacggagcgtcgaattgctgaggccaccggcaggggacttctctacctcgggatgggagtctccggcggcgaggagggggcccgccacggccccagcctaatgcccggtgggtcccaccaggcctacaccaacgtccaggatattctccacaaggttgccgcccaggtcgaggatggtccctgcgtgacctacatcggagaagggggttctggtaatttcgtgaagatggtgcataatgggattgagtacggcgatatgcagctgatttcggaggcgtacgacgtgttgaagaacgtcggggggttgagcaatgaggaattgggtgagatttttgcagagtggaacaagggagagctggagagcttcttgattgagataacggctgatattttcaaggttagggatgatttggcagatgggtttttggtggatagtcttttggacaagactgggatgaaggggactgggaagtggactgtgcagcaggctgctgagctgtctgtagctgcgcccaccattgctgcttctttggactgcagatacttgagtgggttgaaggaggagagggagaaggctgaggaggctttgaagcaagctgggtttaaggaagagattgggagtgtgacgagtgggattgataagaagaggttgattgatgatgtgaggcaggctttgtatgcttctaagatttgcagttatgctcaagggatgaacttgttgagggccaagagtgtggagaagggttggggtttgaatttgggggagttggctaggatttggaaaggtgggtgtattatcagagcagtgttcttggatcggattaagaatgcttatcagaggaatcaaagcttgcccaacttgattgttgatcctgattttgctaaagaaatggtgcagaggcaagctgcgtggaggagagttgttgggttggctgtagcagccgggattagcactcccggaatgtgtgccagtttgtcgtatttcgatacctatcggaggggtaggcttccggccaatcttgttcaggcgcagagggacttgtttggagctcatacttatgagagggttgatcgccctggagcttttcataccgagtggaccaagcttgctcagaagagtggttctagtgttggtgctctcaattgagcgctggtttactagtttggttggttgttgatttggattggatgctggttgttttgatacttgaattggaattgtatgtctcttagaggcttctttgcttaggcatagcgagtagcgatcattgcttacttgataataagaaatgcatgccttttgagttcaatgagctaaattgttgtcttatgatttctttccattgttcacttttgcattttgaaatgactattcttttccttgcgttctttttcagtcatggctgccttgcattgtggttttggttcacaattttcttgttcagctgtcagctaacattgttgtgaggttgag

SEQ ID NO: 3604 - DNA, 2379 bp, Populus trichocarpa
tctctctccctctctctccccaaccccatttgttctctctctacaccatggacgcctctactctttcacgcataggcctagccggtctagccgtgatgggtcagaacttagccctaaacattgctgaaaaaggtttcccaatttcagtctacaacagaaccacctccaaagtcgacgaaacccttcaccgtgcccaatccgaaggcccatttcctttaactggtcagtactcccctcgtgattttgttctctcaatccaacgccccagatccatcattatcttggtcaaagctggaaaccctgttgaccaaacgatttctgctttgaccgagttcatggagcctggtgatactatcatcgatggcgggaatgagtggtatcagaatactgagaggaggattcaagaagtgggagataaagggattctttatttgggtatgggggtttcgggtggagaagaaggtgcacgacatgggccttcgttgatgcctggtgggtctttggaggcgtataataatattgagtctgttttgaagagtgttgccgctcaagttgatgatgggccttgtgttacgtatattggtgaagggggttctggcaattttgttaaaatggttcataatgggattgagtatggagatatgcagttgatttcggaagcctatgatgttttgaagaatgttggtgggctttctaatggcgaattagctgagattttcggggagtggaatagaggggagttggagagttttttgattgagattacgagtgatatttttaaggttaaggatgatttggctgacggggatctggttgataagatattggataaaactggaatgaaagggactgggaaatggactgtccagcaagctgctgagttgtctgttgctgcgcctacaattgctgcttcgttggattgtaggtatttgagtgggttgaaggaggagagggagagtgcggccgagattttggaaaaagctggcttgaaggaggaaatggggagtgttaagagtgagattgacaagaagaggttgattgatgatgtgaggcaagcattgtatgcgtcgaagatttgtagttacgctcaggggatgaatttgttgaggtctaagagtgttgagaaagggtgggatttgaatttgggtgagttagctaggatttggaaaggtggatgcattattagggctgtgtttttggataggattaaaaaggcttaccagaggaatcctagcttggctagtttaattgtggacccggaatttgcgagggagatggtgcagaggcaggcggcatggaggagagtcgtggggctggcgatttcagctggaattagcactccagggatgtgtgctagtcttgcatattttgatacttacaggcgtgctaggctgccagcaaaccttgtccaggctcagagggacttgtttggggctcatacttatgagaggactgatcgtccaggggcatttcatactgagtggacaaagcttgctcgtaagagcaatgctggttttggagctttcaattgagcatgttcatgagtcggttggctgtttgtttgtttgtttcaattggccgttggtaatgtttctctttgaactatggttgtatgtttccttgagaggattcgttgcagttattggttagcctcacagattttactgttaataagaaatgcatgcctcttgagttcagtaaattggtttttcatctgcagcaggcacgatagagttgagttctgccttttagattttgcttatttgctcctgaataatgtttcgaactcttgtgaggctatttgatttgaaactttgtaatttgcatactttacgtaagtatgtgtatgtccttctagaaataaacctgttcgaatgcatcttatgtgtttatgaaacaattctgatacaaatgtatcataggttacaaggttggttgcaatgtgaaaacgtggttgttgggcaggaatgttaacttcatcataagttcaagttagctgttgatttttttttttttttttgaagtcaatgaacacttgatgatttgttgagtttttggatattgattgctctgttcagagagaagggaaaacactctatacaaaccgttgagccctctattctttaaggtgattgtggcagtataccatgggttacttcttattgtgtgtttatgcaaaaccttttccatggaaatatttggttttcatgtatgatctgctatgaacctgacatgatgctcaacttctgcttgattcaccggaaggtttttctcttgcttttgcattaactggcagaatagtgggcatggagcttagtggttagggttgtcagatgtcattttgctaacacgttcaattgctgttaaatcttatttctt

SEQ ID NO: 3605 - DNA, 2190 bp, Cicer arietinum
taaaaaacgcggtcgtttttgtaagaattgaaagacatcttggaggtaacgacgtctacggtagctcctcgttggtggttaagtcactgtctcttcacaccctcgacgagtccgtcagttccaacaacaagagcaaaaacacttcactccttccactctcaccaaacaaatatttactattattattaattaattaatagataaatacagaaataaattttataacctcactcaacctgcactctgaaattgaattaagcattcaccaaacccctctctcacccctccctcaaaattcaacaacaatggattcttccactctctctcgcataggcttagcgggactagccgtcatgggccaaaacttagccctaaacatcgccgaaaaaggcttccctatttccgtctacaaccgcacaacctccaaagtcgacgaaaccgtagatcgggcccaccgtgaaggttctctcccgttaaccggccaatacagcccccgcgaatttgtcctctctctccaacgtcctagatcagtcatcatcctcgtcaaagctggcaatcccgtcgaccaaaccatcgccgctctctccgatcatatggagcccggtgactgcatcatcgacggcggtaacgaatggtacgaaaacaccgaacgaagaatccaacaaatctcgaataaaggtatcctttatctcggtatgggagtatccggcggcgaagaaggtgctcgtaacggtccttccctcatgcccggtgggtcttaccaagcctacagcaacatccaggatattctcatgaaggtcgccgctcaggttgaagacggtccttgtgtcacttacatcggcgaaggaggtgccggaaatttcgttaaaatggttcataacggtattgaatacggtgacatgcaacttatttcagaagcttatgatgttttgaagcacgttggtggtttatcgaattctgaactcgctgatatttttgccgaatggaacagtggtgaactcgagagtttccttgtagaaatcactgctgatattttcaaagtgaaagatgatattggtgatggttatttagttgataagattttggataaaaccggtatgaaaggtaccggtaaatggacagttcaacaagcagccgagctttctgttgcggcgcccacgattgccgcttcgttggattgtaggtatttgagtgggttgaaggaagagagggagaatgcatctgcggttttgaaggaagcagggttgaacgaggaagcagggtttgtgaaaagtgggattgataagaagaggttaattgatgatgtgagacaagctttgtatgcttcaaagatttgtagctatgctcaagggatgaatttgttgagggcaaagagtgacgagaaaggttggaatttgaatttaggggaattagctaggatttggaaaggtgggtgtattataagagcagtgtttttggataggattaagaaagcttatcaaaggaaccctaatttggctagtttgatagtggatcctgaatttgctaaggaaatggtgcaaagacaaggagcatggagaagggttgttggattggctatatcggccgggattagtacacctggaatgtgtgctagtcttgcttattttgatacttataggagagctaggcttcctgctaaccttgttcaggctcagagggatttgtttggagctcatacctatgagcggctcgatcgccccggcgcgtttcataccgagtggacgaaaattgctcgtcagagtggtactggtgttgctgctcttaattgatcattggtgatgtgtcacttttgtgtggttagttcagttgtttctttgttggctggttaatgcagcatttgtgttgcgattgtatgtttctgaggatctttggttatggttaggcagagcaactattgtttccttaatattattgtttttgcttttaagttaacaaataaaagaaaggccttgtcatttgaattaatcaggcttttgtgtttcaactttgcttccttaagtacactttgaattgttgatgctttgtctggtagatacatttcaagctgtgtttaaagattgtgtattagcaataatagaaacatcctctcaggcttcaatatatttttgactttgtttccttagccttactttgctggtgatcttggtgcgtatgtcctgaaagattccc

SEQ ID NO: 3606 - DNA, 1805 bp, Panax ginseng
ggaagcctccacagtctctttcccgcatcggcctagcgggcatagctgtgatgggccaaactggccctcaacattgccgagaaaggcttcccaatctccgtctacaatcgcaccattccaaagcgacgaaaccctagatcgagcccaaacgaaggccagctccccttaaccggccaccacaccccacacgatttcgttctctctctccgaaaacccagatccgtcatcatcttggtcaaagccggcgcccccgttgacgaaaccatcgccgccctgtccgcccacatggaacccggtgacacaatcattgacggcggcaacgagtggtacgagaacaccgagcgccgcatttcagaagcttccagcaacggcctgctctatttggggatgggcgtttcgggcggtgaagagggtgcccgaaatggcccgtctctgatgcccggagggtcttaccaagcttataacaatattaaggatattgttgagaaagttgcagctcaagttgaagatgggccgtgtgttacttacattggggaaggtgggtcgggtaattctgtgaaaatggtgcataatgggattgagtatggcgatatgcaattgatttctgaggcatatgatgtgttaaagaatgttgggggtttgtccaatgctgaattggcggagatttttgatgagtggaatagaggggaattagagagtttcttgattgaaatcactgctgatatatttaaagttaaggatcacttgggaagggagttagttgataaggttttggataagactgggatgaaaggaaccgggaaatggacggtccagcaggctgcggagttgtcagtgcctgtgctaccattgctgcctctttggattgtaggttcttgagtgggttgaaggatgagagagaggcagcttccgaggtttataaggaagttggtgtggtaagaagtggggttgataagaagaggttgattgatgatgtgaggcaggcattgtatgcttccaagatttgtagttatgctcaggggatgaatttgttgagggcgaagagtgttgaaaaggggtggaatttgaattttggggaattggcgaggatttggaaaggtgggtgtatcattagagctgtgtttttggacaggattaagaaggcttatcagcggaatcagaatttggcgagcttgttggttgacccagaatttgctagggagatggtgcagagggagaaggcatggaggagggtggtgggattggccatttctgctggggttagtattccggggatgtgtgctagtctttcttattttgatacctataggcgtgccagacttcctgctaaccttgttcaggcccagagggatttgtttggggcacacacatatgagagggttgatcgccccggagcatttcatacagagtggacaaagcttgcccagaagagtgctaatggtgttgctgctctgaaatgaggcactatattatctgtcagttacttgcttttgccaagtgttttcgtgtttctatctggatttgaattgtatccctgaccgaggattcttggataggaatggcaattgttgtttagcctcacattgttatgttatgtttttaataagtggtgcctgtcttttgagtattacagccttcaatatatgcaaatgattagctccgattgcaaattttaaaaaaaaaaagaaaaaaacaaaaaaagaaaaaaataaagaagagaagagagagagaggagagagagagagagagagagagagaggataggagaaggaagggagagcagagagagacatagagacggagag

SEQ ID NO: 3607 - DNA, 2298 bp, Lupinus angustifolius
tgagttgagcataaagttggaagcaccgtccctcttgttggtggtcaagtaactgtcccttcagtccctcgacgagtccgccattaccaccaacccaacaaacaatacaaattaataagacaacaaaacccagaaactgaaaacaccaaccattcattatcacaaaccctaaaatggagtctgctgcagctttatcccgcataggcctagctggcctagccgtcatgggccaaaaccttgccctcaacatcgccgacaagggcttccctatctccgtctacaaccgcaccacctccaaggtcgacgagaccgtagatcgtgcccatcgcgagggcaccctgcccttaactggccactataacccccgcgacttcgtcctctccctcacccgcccccgttccgtcatcatccttgtcaaggccggcgcccccgtcgaccagaccatcgccgccctctccgattatatggaacccggcgacgccatcattgacggcggtaatgagtggtatgagaacactgaacgccggatccagcaggttaacgagaaaggtattctttatttggggatgggtgtctctgggggtgaagatggggcaagaaatggtccctctcttatgcctggtgggtcctaccaggcctatagtaatgttcaggatattttgcataaaatcgctgctcaggtcaacgatggtccatgtgttacttacataggtgagggtggtgctggtaattttgttaagatggttcataatgggattgagtatggtgatatgcaacttatttctgaggcttatgatgttttgaagcatgttgggggtttgtcgaattccgaacttgcggatatttttgatgagtggaatagaggggagcttgagagttttctggttgagattactgcggatatttttaaggttaatgattacgagagtggctatgggtatttggtcgataagattttggataagactggtatgaagggtaccgggaaatggactgtgcaacaggcggctgagctgtcagtcgcagctccgacaattgctgcttcattggattgcaggtatttgagtgggttgaaggaggagagggagaatgctgcgagtgtgttgaaggaggctgggttgaatcaggaagttggggctttgagtagtggggttgataagaagaggttgattgatgatgttaggcaagctttgtatgcttctaagatttgtagctatgctcaagggatgaatcttttgagggctaagagtgttgagaaagggtgggatttgaatttcggggagttggcgaggatttggaaaggtgggtgtatcataagagctgtgttcttggataggatcaagaaagcttatcagaggaaccccaacttggctagtttgattgtggacccggaattcgcgagggaaatggttcagaggcagggagcatggagaagggttgtggggttggctatatcagctgggatcagcacaccggggatgtgtgccagtcttgcttactttgatacatataggagagcaaggcttccagctaaccttgttcaagctcagagggacttgtttggggctcacacttatgaaagggttgattgtcctggtgctttccacaccgagtggacaaaactcgctcgccagagcggtactactggagctggctctctcaattgatgatgctatcttcagtgtggttggttagttgtttgtttgttgatcacatatgcagaatttgagttcaaaattgaaattgtatgtttctttgaggatccttggttaggcagagcaactattgtttacttgctaactgtttttgcttttaataaggagtaaggcctgtgattcgcgaattcggccggctttttgcttgtttcaaggttgtttcctttggtagattccaaattgttggctgttgatgcttttgtctcgcaaacatgtttccaatttgaattatgataattacataacatggataccttcaaaggaattggttatagcatcacgcatatacatgaatttcttcatacaggatataatgaaaactgtgttcaagatttatcaacaatgatggaaatatccttccaagttttttttaggtaatgcttcttacacatcattttagagggagcacgtttgaccgaattatagcctaggtgagaagaaaacaagatgggcttgattatgtagagatgtatgcatgtgtattaatataacagtgtgtcctaaatgatttctttatttttctttactttatctggaattttgtcatgtatccatctctgttccgaataagaacctgcttgtg

SEQ ID NO: 3608 - DNA, 1872 bp, Chenopodium quinoa
ctctctcctcttcaacaatggcggccgcttctcaaattggcctcgcaggtctcgccgtcatgggccaaaacctcgccctcaacatcgccgagaaaggcttccctatctccgtctacaatcgcacctccaccaaagtcgatgaaaccatcgaccgcgctaaatccgaaggcgatctccctctcttcggccattacactcctcgcgatttcgtcctctcaatcgaacgacccagatccataatcatcctcgtcaaagccgggtcacccgtcgatcaaaccatccagtctctctcctctttcatggagcctggtgacaccattattgacggtggtaatgagtggtaccagaacactgaacgtcgtttatctgatgctcattctaatggacttctttacctcggaatgggggtttctggtggtgaagatggtgctcgtttcggtccttcgcttatgccgggtggcgattacgcggcgtatgaaaacgttgagaagatcttgaagaaggtagcagctcaggttgatgatggaccttgtgttacttacattggtgaaggtggttctgggaattttgtcaagatggttcataatgggattgaatatggtgatatgcaattgatttcggaagcgtatgatgtgttgaagaatgtgggtggtttgagtaatgatgaattagctgggatttttgatgagtggaataatagtgagcttgagagtttcttggttgagattactgctgatatcttcaaggttaaggatgatttagcagaaggtggattggttgataagattttggataagactgggatgaagggtactgggaaatggactgttcaacaagctgctgagttatctgttgctgctcctactattgctgcttctttggattgcaggttacctaagtgggctgaaggatgagagagaaaatgcagccaagatactagaagctgcagggatgaaggatgaggttcatgcagttcgagccggggttgataagacgaggttgattgatgatgtgaggcaagctttgtatgcttcaaagatctgtagttatgctcaagggatgaatttgttgagggcaaagagtgctgagaagggttgggatttgaatttaggggaattggcaaggatttggaaaggtggatgtattatcagggcagttttcttggacaggattaagcaggcatatcaaaggaaccccaacttagctagtctggtggttgaccctgagtttgcgaaagagatggttcagaggcaagcagcttggaggagggttgtgggtttggcagtttctgctgggataagtactcctggaatgtgtgcaagtctggcttatttcgatacttataggcgtgccaggcttccagctaaccttgttcaagctcagagggattactttggcgctcatacctatgagagggttgatcgtcctggtgcctaccacacagagtggtcaaagcttgctcgtaagagtaaccctgatgttgctgctgcccttcactgagctatgcttttttccccttgtcttgtggttttttttatcatgtatttttgttgtttcaaattgaaatcgggattttgtgtctccaacgatccctgattaggcataggaattgttatagtattgttttagctcagtagaatgatagtggaaactgatattaataagagcgtgccttttgaaatcaatacaagcaggcattgtgtgaaactaaattgagtttccctttctttacttgaagaacctattatactttcattgttcactatcagttatctgtacatgttattacattaatctctctgcagtctgcactgatgaaaaacaaatgggcataatagttgtctttatggttttagtgcttgctgtttgtgt

SEQ ID NO: 3609 - DNA, 2217 bp, Populus trichocarpa
cccttctcccccgcattcaccaaccccatttctttcattcgcctctttactctctgtctaccatggacgcctctactctttcacgcataggcctagcaggtctagccgtgatgggtcaaaacttagccctaaacattgccgaaaaaggttttccaatctcagtctataaccgaacaacttccaaagtcgacgaaactcttatccgtgctcaatccgaaggcccattctccctaactggtcactactctcctcgtgattttgttctctcaatccaaaggcctagatccatcatcatcttggtcaaagctggaaacccagttgaccaaacgatctctgctctgaccgagttcatggagcctggtgacactatcatcgatggtgggaatgagtggtaccagaatactgagaggagaattcaacaggtggcagataaagggattctttatttgggcatgggggtttccggtggcgaagaaggtgcaagacacgggccttcgttgatgcctggtggttcttttgaggcgtataagaatattgagtctgtcttgaagagtgttgcagctcaagttgatgacggtccttgtgttacttatattggcgaagggggttctggaaattttgttaaaatggttcataatgggattgagtatggagatatgcagttgatatcggaagcttatgatgttttgaagaatgttggtgggctttcgaatagcgaactggcggaaatttttggggagtggaatagaggggagttggagagtttcttgattgagattacgagtgatatttttaaggtcaaggataatttggttgatggggatttggttgataagatattggataagactggaatgaaagggacagggaaatggactgttcagcaagctgctgaattgtctgttgctgcaccgacgattgctgcttcgttggattgtagatatttgagtggtttgaaagaggagagggagagtgcggcggagattttgaaggaagctgggttggaggaggaagtggggagtgttaagagtggggttgataagaagaggttgattgatgatgtgaggaaagcattgtatgcatccaagatttgtagttatgctcaagggatgaacttgttgagggctaagagtgttgagaaaggttgggatttggattttggtgagctagctaggatttggaaaggtgggtgcattattagggctgtgtttttggataggattaaaaaggcttaccagaggaatcctaacttggcaagtttagttgtcgacccggagtttgccagggagatggtgcagaggcaggcggcttggaggagagttgtggggttggcgatttcagctggaattagcactccgggaatgtgtgccagtcttgcttattttgatacttataggcgtgctaggctgccagcaaatcttgttcaggctcagagagacttgtttggggcccatacttatgagaggactgatcgtccaggggcatttcatactgagtggacaaaacttgctcgcaagagcagtgctggtgctttcagttaagcatgttcatgggttgatcggctgtttgtttgtttcaattggctgttggtaatgtttctctttgagctgtagtacttgtatgtttccttgagaggattcgttgctgttattggttagcctcacagaatttgctgttaataagaaacgcatgcctcttgagtacagcaagtttgtttttttattttctgtagataggatacagttcagctctgctttatagattttgcttatttgctgctgaataatgtttacaactcctgtgaggctattcgatatgaaacttcttagttcgcatgctctatgaaagttccttgttccagtaataagcctgtttgaatgcgtcgtacatgttcatgaaaatcaatgctacaaggttggttgcagtgtgaaagcatgcttgttggcggggatgttaacttcatcttcagttcaagtttgctgttgatttgcttatattcaatgaacaattgatgatttgctgattttttggatcttgaatgctctgttaagagagaagggaatgcactctattccagcctttaaggtgtttgtggcagtttatcatcggttgctttttagtttgtgtttattccaaaccttttccatggaaatctttagttttcatgcatcatctgctatgaactttacatgatgctcaacttctgcacgattcacc

SEQ ID NO: 3610 - DNA, 1888 bp, Phaseolus vulgaris
cattctcaggcgtagttgttgcatcctccaaaactccttcgcactttacacactctcaacaatcttctctttttcgaatggagtcagcagctttgtcgcgcataggtctggctggcttggccgtgatgggccagaacctagccttaaacattgcggagaagggatttcccatttccgtctataaccgtacggcctccaaggtcgatgagaccgtagatcgggcccgcaatgagggcttcctaccgctcacggggcaatacaatcctcgtgaattcgtcttgtccatccagcgtcccagatctgttatcatcctcgtcaaggccggcgcccccgtcgatcaaaccattgccgcgctctccgaccacctcgagcccggcgactgcatcattgacggcggtaacgagtggtacgagaacactgagcgccgcatcagccaagtggcagataaaggtctcctctaccttggcatgggcgtgtctggcggggaagatggagcgcgttacggcccatctctgatgcccggcggttccaaaacagcctacaacaatgtacacgacatcctccacaaaatcgcagcgcaggtcgatgacgggccttgcgtcacgtacatcggggagggaggttctgggaacttcgtgaagatggtccacaacggaatcgaatacggagatatgcaactcatctcggaggcttacgacgtgttgaagcacgtcggtggcctgtcgaattccgagcttgcggatatcaacgcagagtggccattacggccggggagcttgagagtttcttgattgaaatcactgcggatatttttaaagtgaaggatgaggatggtgaagggtttttggtggataagattttggacaaaacagggatgaaggggacggggaaatggacggtgcagcaggcggcggagctgtcgatacccgtccccacgattgcggcgtcgttggattgcaggtacttgagcgggttaaaggaagagagggagaatgctgagatggtgttgaaggaggcggggatgagtgatgaattcgggagaattggtatgactggggtggaaaaaaagaggttgattgatgatgttaggcaggctttgtatgcttcaaagatttgtagctatgctcaaggaatgaatttgttgagggccaagagtaatcaaaaagggtggaacttgaatttgggggaattggctaggatttggaagggaggatgcattataagggcagccttcttggacaggatcaagaaggcttatcaaaggaaccctaatttggctaatttaatagttgacccggaatttacaagggaaatgatgcagaggttggctgcatggaaacgggttgtggggttgacagtttcagctgggattagtgctccaggaatgtgcgctagtcttgtttactttgatacctaccggaggggcacgatgccggcgaaccttgttcaggctcagagggacttgtttggggcccatacatatgagagggttgatcgtcctggagctttccataccgagtggacaaagcttgcacgccaaagtgggactggagttggtgctctcaattgatgatgagttttggttgtttggctgttggccctacagtgcagcctttgagttgtaattgtttgtttctttgaggatctttggtaggcagagcaactattgttttcttgctagaactgttttgttccttaataaaacgaaggcatgtcatttggcttttgcttcagtagagtacaagttgttgatgttcttgtcaaatgtatatttgtttgaaattatagctataattgcatttttggatttgattcctaaagtgaggaaggttaaagtaagtaatctaatcaaatgctcatgatttttgtatatatgtgcatatgatgc

SEQ ID NO: 3611 - DNA, 1856 bp, Phaseolus vulgaris
gtagttgttgcatcctccaaaactccttcgcactttacacactctcaacaatcttctctttttcgaatggagtcagcagctttgtcgcgcataggtctggctggcttggccgtgatgggccagaacctagccctaaacattgcggagaagggatttcccatctccgtctataaccgtacggcctccaaggtcgatgagaccgtagatcgggcccgcaatgagggctccctaccgctcacggggcaatacaatcctcgtgaattcgtcttgtccatccagcgtcccagatctgttatcatcctcgtcaaggccggcgcccccgtcgatcaaaccattgccgcgctctccgaccacctcgagcccggcgactgcatcattgacggcggtaacgagtggtacgagaacactgagcgccgcatcagccaagtggccgataaaggtctcctctaccttggcatgggcgtgtctggcggggaagatggagcgcgttacggcccatctctgatgcccggcggttccaaaacagcctacaacaatgtacacgacatcctccacaaaatcgccgcgcaggtcgatgacgggccttgcgtcacgtacatcggggagggaggttctgggaacttcgtgaagatggtccacaacggaatcgaatacggagatatgcaactcatctcggaggcttacgacgtgttgaagcacgtcggtggcctgtcgaatcccgagcttgcggatatcttcgcagagtggaacagtggggagcttgagagtttcttgattgaaatcactgcggatatttttaaagtgaaggatgaggatggtgaagggtttttggtggataagattttggacaaaacagggatgaaggggacggggaaatggacggtgcagcaggcggcggagctgtcgatacccgtccccacgattgcggcgtcgttggattgcaggtacttgagcgggttaaaggaagagagggagaatgctgagatggtgttgaaggaggcggggatgagtgatgaattcgggagaattggtatgactggggtggaaaaaaagaggttgattgatgatgttaggcaggctttgtatgcttcaaagatttgtagctatgctcaaggaatgaatttgttgagggccaagagtaatcaaaaagggtggaacttgaatttgggggaattggctaggatttggaagggaggatgcattataagggcagccttcttggacaggatcaagaaggcttatcaaaggaaccctaatttggctaatttaatagttgacccggaatttacaagggaaatgatgcagaggttggctgcatggaaacgggttgtggggttgacagtttcagctgggattagtgctccaggaatgtgcgctagtcttgtttactttgatacctaccggaggggcacgatgccggcgaaccttgttcaggctcagagggacttgtttggggcccatacatatgagagggttgatcgtcctggagctttccataccgagtggacaaagcttgcacgccaaagtgggactggagttggtgctctcaattgatgatgagttttggttgtttggctgttggccctacagtgcagcctttgagttgtaattgtttgtttctttgaggatctttggtaggcagagcaactattgttttcttgctagaactgttttgttccttaataaaacgaaggcatgtcatttggcttttgcttcagtagagtacaagttgttgatgttcttgtcaagtgtatatttgtttgaaattatagctataattgcatttttcgatttgattcctctaaagtgaggaaggttaaagtaagtaatctaatcaaatgctcatgatttttgta

SEQ ID NO: 3612 - DNA, 8339 bp, Phaseolus vulgaris
aaatgttaacatgagaggacatacataaggaagggggtgaggtggtgtgggttaggggcagagagagaattcgtatcaagttcattgatcttggaagtttccggtgtatcgtctctgaatatcgtctctgaaaatgaacgacgcagatgtctctagacaaatccagcagatggtgcggttcatccgccaggaagcagaggaaaaagccaacgagatcgctgtctccgccgaagaggaattcaatatcgagaagctgcagttggttgaagctgaaaagaagaagatcaggcaagagtatgaacgcaaagagcgccaagtggaaattcgcaagaagattgagtactcgatgcagctgaatgcttctcgaattaaagttcttcaagctcaagatgacgtgatcagttccatgaaagaagctgcttccaaggaacttttgagtgtgagtcatcatcatgattggactttgactcatcatgatcatgtgtacagaaagcttcttaaagatctcattgttcagtgtttgctaagactgaaagaaccttctgtcttgttgagatgtcggaaagatgacctgcccttggtagagcacgtgctggattctgctgcacaggagtatgctgacaaagcaaatgttgatcccccagaggtcattgttgacaaccaagtctatcttcctcctggacccagtcatcacaatgctcatgatatgtactgttctggtggggtggtgctagcttcttgtgatggaaagattgtgtgtgaaaatactcttgatgcacgacttgatgtagtgtttcggaaaaagcttcctgagatccgaaagcagctgtttggacaagttgttgcttgaggttttccattgtattgtttcgttaccccagattgtttatatcccgaagcattcgcttatcttggacctgaatagctttcgggccgttgaattataattattgtcttttgaataacaccatttatccttatttcagtttctcccatataggttatgatggggcatgtggtgttctcaaatttcgttagtgatgattgttatcactgctttgagcttactggtaattatgtagcatatacatacatacgtgtgtgttatatatatatattgaacactaggacattactgtcaacattgtgacagaaacataactggtgcaagttaaaaaaaagagtggagatagtgaaatttccagttcatgtgatgggagatgggaattggacagcattcaaagagtaatttcattcctaggatctggtctgaatgatagtataacatttctgaggtttttttaccatgatggggttatttttttttgtttttaccaaaatggagtccgtttaaaaaaaattacaaatttaggcaagttgtgccaattcggcacgacttcatatgcagaagtcgtcccaattaggcacgacttctgccctgtcatactgaagtcgtgccaacttggcacgatttctgccctgtcatattgaagttgtgtcaagttggcacgacttctgccctatcatactgaagtcgtgtcaatttgacacgacttctgccacgtcataattttttattttttattttttatttttaattttattgtttatatattgggtagtaagttatgtaatgttaaaaattaatttgagacataattttctaagagtgttagttttaagaaacaaaaaattggataattatgtatggatcatgtttaaattgaatgaataaatacatagataaagaaaatgaatgttctaagagtgttatgaatgaataaatacataaataaagaaaatgaggaaattaataatcaaacttaaattgaattttattattaagcttgtttgtgcggacaattatgacgtggtagaagtcgtgccaagttggcacgacttctgtatgacggggcagaagtcgtgctaagttggcacgacttcagtatgacggggcagaagtcgtgtcaagttggcacgacttcagttgggacagaagtcgtgtcaagttggcgactttagtatgacatggcagaagtcgtgtctaattgggacgacttctgtatatgaagtcgtaccgaattggtacgacttgactaaatttgtaaatttttttaaacggaccccattttggtaaaaaccaagacaaataacccatcatggtcaaaaaacccatttctgatatagaccatgaaaaataaatttacataacttgataattacagtcaaatactttattcaattagttacaaaatataaactttaattgaatatatttttcataaataaatacaagttatacattaattttatgaaaacataagaaataaagatataaacatgaggagtaaaataaatttataagtgtataaatttatgtatagctaaaaaattgattttgttcagttaattttcaaaataaaatctgaaaaatccaataaaagaacttgatattttttgttttgtttttgtttgtttggctttctatttgttcagttttcaaagttttggattgatctatttgtatttgtgtacatcggattgaaaattaatttattaacgtccctatttgacataaaataaattaaaaatgcataaatgaatattcttatttcttttattatctacacctattttacatgaagagtttgtataaaaagtttaatcacttttagtttataaaaaaaatggtatacattgatttatataaagagtttaaatgtttagttgttacaaatgtttcatataattttatagagtttaataattttttatttgtactaaattttataaattggtttatacaaaaggtttaaaccgtcttaactgtactaaatgatgtccactattctatataaatatattattcatcctggatttgtattaaatagcatacattgatatattcaaagaattaatgctacactttaaaatgcatgagcaatcaactattcataagcgattaaatttatcttcaaatgtttcaaatgcgtagtaaaaaattctatttaaatattttaaaatttagtttttcaatgagatctttactattaaagaaaaatatgaaaataagtctttcttcttacaaatattgagtacttattgtgtttgatggaagtaaatcattacatgttcaagtttctttttcttatagttgttcaagatttttactaaaattttgacatttgtgagtctcgagattgacttgcttcttaccgaaaagtgttaaaccacttcttaataatgttaatttccaaaacttattgattagatggttgagtcacatctcaagtaccaatatgttaaacttttttaaagtttgggtttctataagttatttcatcatcgtaaaagttgacaacttataaaaattgtccatcttcataaataaagttttaatttatatatatatatatatatataaactcttgccttcaaatacattaaaatttaaatatttgagttgattaacttttaaacttattcatttaagttttaaatcgaattaaaatagttgttaacgataaacccaaataaattagataataacacatgataattcaccaaaactatagtgtagaaaaggacttcaattatcattataaaaagagatgatccaattaaatcatctaccaattaaataaaaatttatataaatttttcaaatttaaaaggtttttttacctattgtgtccgaaatactcgtataactattataaattacttattattttccgaaatattcgtataactattataaattacttattattaactaaattaattgtcaaacttattaaaattacaatttcatagttgagttactaatatacattatttttatacaaaactagcgggatccaagcgctcatgcacttacattcgtattttttagtttttatttttattattattattatatatatatatatatatataaattcatgtgtatttgtatgtatgagagatatgttatcgggtttcaaaagatttgaggaaggagagagataaaataagagagaaaaaattaaaaaattattatacattcaaacttgcttctgatacttgttttaaataagagaatcaatctctttactattttttttagttaggtgtgagaacaaataaaataaaattttaaaattaaataactgcttatttaataaagaaaaatatcagtttaaaacagtaaagtaacaaacctgtcatctctcctgtcttaggtgacaacaagataaaattaacgtaacaatctctttacttttcctttagttagaaaacaaataaaataaaaattaaaaattaaaaaactgctttattaacttctaaaatgataaaatatccaaataatcaaaataaattaataaaatagaaaaacaatttagaacagttaaaatggagaatcttttatattaaaaaataactatattataattattcacattttatgtttgaagttaactaaaaaaatcatacaatgacatttttattctaagaagtattttcaacttatacctgcttttatatttaattttaggatattttatttatttattttctcgctaacttaaatattaaagtatcatttgcatttgcagatgcaattctatttaattcctgctcattccataataaaatccatagttcaaatgtgaataagaattacatgcatttatttcaacatcttaatggacaatagtaatgaattatttaattaataaaatgaatatatgacaatttatttaagatatgtttagacaattttgtataagaaaacattattttacaatctttttaaaatcttataaaaatttaagataaaagaagtgccttatatatttaaagtccttaaacctttttattttagatttgtaaatatgaattctaacacgtcaacataatattagtttaagaaaaaggtagccaccaaaagagggtggaccataagatatgaaatatatctaggttgactgatttggcgaaacataaaaacggtgtcgtttgataggggaggaaattcacattgtgcacgtcttggaggcaacgtcgtctatggcacctccttgttggtggttaagtcagtgtcctttcactccctcgacgagtccgccaaactcaccaacccaaacaaaaccccccaaaaatccctaattcctcctctggctaaactaaacactatttattaattagatagtaataataataaaattaataactatcaacagcaacactagatttataactacaaagacacattctcaggcgtagttgttgcatcctccaaaactccttcgcactttacacactctcaacaatcttctctttttcgaatggagtcagcagctttgtcgcgcataggtctggctggcttggccgtgatgggccagaacctagccttaaacattgcggagaagggatttcccatttccgtctataaccgtacggcctccaaggtcgatgagaccgtagatcgggcccgcaatgagggcttcctaccgctcacggggcaatacaatcctcgtgaattcgtcttgtccatccagcgtcccagatctgttatcatcctcgtcaaggccggcgcccccgtcgatcaaaccattgccgcgctctccgaccacctcgagcccggcgactgcatcattgacggcggtaacgagtggtacgagaacactgagcgccgcatcagccaagtggcagataaaggtctcctctaccttggcatgggcgtgtctggcggggaagatggagcgcgttacggcccatctctgatgcccggcggttccaaaacagcctacaacaatgtacacgacatcctccacaaaatcgcagcgcaggtcgatgacgggccttgcgtcacgtacatcggggagggaggttctgggaacttcgtgaagatggtccacaacggaatcgaatacggagatatgcaactcatctcggaggcttacgacgtgttgaagcacgtcggtggcctgtcgaatcccgagcttgcggacatcttcgcagagtggaacagtggggagcttgagagtttcttgattgaaatcactgcggatatttttaaagtgaaggatgaggatggtgaagggtttttggtggataaggttttggacaagacaggaatgaagggaacggggaaatggacggtgaagcaggcggcggatctgtcaatagcagccccgacgattgcggggtcgttggattgcaggtacttgagcgggttaaaggaggagagggagaatgctgcgacggtgttgaagaaggcggggttgagtgatggaattgatgtgagtggggtggataagaagaggttgattgatgatgttaggcaggctttgtatgcttcaaagatttgtagttatgctcaagggatgaatttgttgaaggccaagagtaatgagaaagggtggaacttgaatctggcagaattagctaggatctggaagggaggatgtatcataagggcagtgtttttggacaggatcaataaggcttatcggaggaaccctgatttggctaatttaatagtcgacccggactttgcaattgaaatggtgcagagggagtctgcctggagacgggttgtgaatttggcggtttcagctgggatttctactacaggaatgggtggtagtcttagttactttgataactaccggaggggcaggctgccggcgaaccttgttcaggctcagagggacttgtttggggcccatacatatgagagggttgatcgccctggatctttccatacagagtggacaaagcttgcacgccaaagtgggactggagttggttctctcaattgatgatgagttttggttgtttggctgttggtcctacagtgcagcctttgagttgtaattgtttgtttctttgaggatctttggtaggcagagcaactattgttttcttgctagaactgatttgtttcttaataaaacgaaggcatgtcatatggcttttgcttcagtagactgcaagttgttgatgttcttgtcaagtgtatatttgtttgaaattatagctataattgcatttttcgatttgattcctctaaagtgaggaaggttaaagtaagtaatctaatcaaatgctcatgatttttgtatatatgtgcatatgatgctccttgcttgattatccgaagtaaccctgtagaagaaaagattgatccctgcattttatattttatgatgaaacattccagagtaaagcaagaagtcttttacaatgttgaagtattaagaaatgtaatagctgatatttctatgcattcataatttcttgtgcaagtgatatctattttttctgtaaccagggtatctagacatcaattacactccttaagtctctctcacatgattggtccattttggaaatattggatccaaactttggttaaggtacctaatcaccaaaccatttatgcatgtgatgttgatggttgattcaaattgccagtttattctgtagaaagagatgatcatggtatagcgcctgattcttgtaatttgtttgaacaaattcatgaatttcttggcaaaatatgatgagaattgtgttgaaggtctatgtatcaagccaaatgtggtcggaacatcaaataaagctttaatgtatcatggtttcctgttcctttcattttaggtgattttggtgtatctgcaaattattttctttctttctggctttgtacctttacatgcttgtgcacctgtaaggttttatgcttcttgtcatgccttggtgaccaatttttagttttaccttttgttaaatgaaagcgtgtttttatattgtttttcttggggcaaccttgttgaggtaggactcggtaatgcttttgtgattttttttggagtttagcaactttcttttttgcgtcgcaactttttttcttttgctgaatgaagtgtcatagaaagaaatctaccgagacgtcttctcttaggagtggtgctgtgataagaactcgggtattattgaatgccaaagacgtcatgtttgggtgcattttgaatcataactatttcctgattcctgacatgggaaccaaccttggtctgtgtggtgtgttcaatggcattggttcaatacctgccccacataacctttttaaacctttgtaatgatatattatgctagactactgtttatagatcactttctaagtttaagtatgttagctgctgcttagatatttaaatttcagttgtagcacacctgattatattttttttaaaattcagttctggtggggtggtgctagcttcttgtgatggaaagattgtgtgtgaaaaatactcttgatgcacgacttgatgtagtgcttcgta

SEQ ID NO: 3613 - DNA, 649 bp, Brassica oleracea
  misc_feature (649)..(649): n is a, c, g, or t
gtttggctaaattttaaatacaaaaaagaagaaagagctgcgaaaatcaaatcagaaacagattgcactggaaattaaaagtttatctttcacgtaagactcgaagaaaatggcaagcactgtgatgactacactgcctcagttcaatggtcttcgagccagcaagatctctgcagctccagttcaaggcctggcaactgttgtgcccatgagacgcaagggaaatggagctttgggtgcaaaatgtgacttcattggttcatcaacaaatctgataatggtaacgtcgacgactctgatgctgttcgctgggagattcggactagcaccatcagccaataggaaggcgacagctggacttaagctagaggcacgtgactcgggtctacaaacgggtgacccagccgggttcactctcgccgacactttggcttgtggtaccgttggtcacatcatcggcgtcggagttgtccttggtctcaaaaacattggtgctatttaaacatgttcatttgtattcgtcgacttgtagatttttaaaacaaaattctcaagaacctgaggggagatctagtcaatgtttataatgtttgtatcgcattgtattcctctttaaaaccattagaacgaccgcatcttcaagtaaaan

SEQ ID NO: 3614 - DNA, 938 bp, Brassica rapa
gacacaacagccttatccagagttaagatgctgcgccaatagccactcgacgcgtcagcaaagagtagccaaaaccgaatccatttctgtggtagccaaagccacaagatgagccttggctaaattttaaatacaaaataagaagaaagaactgcgaaaatcaaatcagaaacagattgcactagaaattaaaagtttatctttcacgtaagactcgaagaaaatggcgagcactgtgatgactacactgcctcagttcaatggtcttcgagccagcaagatctctgcagctccagttcaaggcctggcaactgttgtgcccatgagacgcaagggaaatggagctttgggtgcaaaatgtgacttcattggttcatcaacaaatctgataatggtaacgtcgacgactctgatgctgttcgctgggagattcggactagcaccatcagccaataggaaggcaacagctggacttaagctagaggcacgtgactcgggtctacaaacgggtgacccagccgggttcactctcgccgacactttggcttgtggtaccgttggtcacatcatcggagttggagttgtccttggtctcaaaaacattggtgctatttaaacttgtagatttttaaaacaaaattctcaagaacctgaggggagatctagtcaatgtttcaagtttttatgtttataatgtttgactcgtattatatttttcattaaaacaattagaacgaccgcatcttcaagtatgtgaaccaaaagcattgttcccttgatagaaaacacctaacatttgtcctaggcagataagtagcattttcgttcataaatacctaacatgcattgggcggctcatcgaattagacatgaactatacgggtaaaaatgatatagcaagagagaataacacacagacttgaagcgaatctcctttg

SEQ ID NO: 3615 - DNA, 636 bp, Brassica napus
aattttaaatacaaaataagaagaaagagctgcgaaaatcaaatcagaaacagattgctctggaaattaaaagtttatctttcacgtaagactcgaagaaaatggcaagcactgtaatgactacactgcctcagttcaatggtcttcgagccagcaagatctctgcagctccagttcaaggcctggcaactgttgtgcccatgagacgcaagggaaatggagctttgggtgcaaaatgtgacttcattggttcatcaacaaatctgataatggtaacgtcgacgactctgatgctgttcgctgggagattcggactagcaccatcagccaataggaaggcgacagctggacttaagctagaggcacgtgactcgggtctacaaacgggtgacccagccgggttcactctcgccgacactttggcttgtggtaccgttggtcacatcatcggcgtcggagttgtccttggtctcaaaaacattggtgctatttaaacatgttcatttgtattcgtcgacttgtagatttttaaaacaaaattctcaagaacctgaggggagatctagtcaatgtttataatgtttgtatcgcattgtattcctctttaaaaccattagaacgaccgcatcttcaagt

SEQ ID NO: 3616 - DNA, 629 bp, Brassica napus
agaactgcgaaaatcaaatcagaaacagattgcactagaaattaaaagtttatctttcacgtaagactcgaagaaaatggcgagcactgtgatgactacactgcctcagttcaatggtcttcgagccagcaagatctctgcagctccagttcaaggcctggcaactgttgtgcccatgagacgcaagggaaatggagctttgggtgcaaaatgtgacttcattggttcatcaacaaatctgataatggtaacgtcgacgactctgatgctgttcgctgggagattcggactagcaccatcagccaataggaaggcaacagctggacttaagctagaggcacgtgactcgggtctacaaacgggtgacccagccgggttcactctcgccgacactttggcttgtggtaccgttggtcacatcatcggagttggagttgtccttggtctcaaaaacattggtgctatttaaacttgtagatttttaaaacaaaattctcaagaacctgaggggagatctagtcaatgtttcaagtttttatgtttataatgtttgactcgtattatattttcattaaaacaattagaacgaccgcatcttcaagtatgtgaaccaaaagcattgttccctt

SEQ ID NO: 3617 - DNA, 562 bp, Brassica napus
tctggaaattaaaagtttatctttcacgtaagactcgaagaaaatggcaagcactgtaatgactacactgcctcagttcaatggtcttcgagccagcaagatctctgcagctccagttcaaggcctggcaactgttgtgcccatgagacgcaagggaaatggagctttgggtgcaaaatgtgacttcattggttcatcaacaaatctgataatggtaacgtcgacgactctgatgctgttcgctgggagattcggactagcaccatcagccaataggaaggcgacagctggacttaagctagaggcacgtgactcgggtctacaaacgggtgacccagccgggttcactctcgccgacactttggcttgtggtaccgttggtcacatcatcggcgtcggagttgtccttggtctcaaaaacattggtgctatttaaacatgttcatttgtattcgtcgacttgtagtaatttttaaaacaaaattctacaagaacctgaggggagatctagtcaatgtttataatgtttgtatcgcattgtattcctactttaaaaccatta

SEQ ID NO: 3618 - DNA, 685 bp, Raphanus sativus
aaagacttatcagaagaaaaagttcaggtaaaatcaaaaataagaagactggttgcagaagaaaatataagttttttatttgctttcacgtaagagtcaaagaaaatggcgagcactgtgatgactacactgcctcagttcaatggtcttcgagctagcaagatctctgcagctccagtgcaaggcctggcaactgttgtgcccatgagacgcaaggggaatggagctttgggtgcaaagtgtgacttcattggttcatcaacaaatctgataatggtaacgtcgacgactctgatgttgttcgctgggagattcggactagcaccatcagccaataggaaggcgacagctgggcttaagttagaggcacgtgactcgggtctacaaacgggtgacccagccgggttcactctcgccgacactttggcttgtggtaccgttggtcatatcatcggcgtcggagttgtccttggtctcaaaaacattggtgctatttaaaaacatgttcatttgtattctgtcaacttgtagatttttaaaaaacaaagttctcaagaacccgaggggagatctagtcaatgtttataatgtttgtatcgcattgtattcctctttaaaacaactagaacgaccgcatcttcaagtatgtaacgtgaagcgaaggcattgttcccttgttagaaaa

SEQ ID NO: 3619 - DNA, 627 bp, Triticum aestivum
cttggctaaattttaaatacaaaaaagaagaaagagctgcgaaaatcaaatcagaaacagattgcactggaaattaaaagtttatctttcacgtaagactcgaagaaaatggcaagcactgtaatgactacactgcctcagttcaatggtcttcgagccagcaagatctctgcagctccagttcaaggcctggcaactgttgtgcccatgagacgcaagggaaatggagctttgggtgcaaaatgtgacttcattggttcatcaacaaatctgataatggtaacgtcgacgactctgatgctgttcgctgggagattcggactagcaccatcagccaataggaaggcgacagctggacttaagctagaggcacgtgactcgggtctacaaacgggtgacccagccgggttcactctcgccgacactttggcttgtggtaccgttggtcacatcatcggcgtcggagttgtccttggtctcaaaaacattggtgctatttaaacatgttcatttgtattcgtcgacttgtagatttttaaaacaaaattctcaagaacctgaggggagatctagtcaatgtttataatgtttgtatcgcattgtattcctctttaaaaccattagaac

SEQ ID NO: 3620 - DNA, 981 bp, Raphanus sativus
gtctcatggagagttcgatcctggctcaggatgaacgctggcggcatgcttaacacgtgcaagtcggacgggaagtggtgtttccagtggcggacgggtgagtaacgcgtaagaacctgcccttgggaggggaacaacagctggaaacggctgctaataccccgtaggctgaggagcaaaaggaggaatccgcccgaggaggggctcgcgtctgattagctagttggtgaggcaatagcttaccaagacgatgatccttggctaaatcattttaaagacttatcagaagaaaaaaatcaggtaaaatcaaaaataagaagactggttgcagaagaaaatataagttttttttttgctttcacgtaagagtcaaagaaaatggcgagcactgtgatgactacactgcctcagttcaatggtcttcgagctagcaagatctctgcagctccagtgcaaggcctggcaactgttgtgcccatgagtcgcaagggaaatggagctttgggtgcaaagtgtgacttcattggttcatcaacaaatctgataatggtaacgtcgacgactctgatgttgttcgctgggagattcggactagcaccatcagccaacaggaaggcgacagctggacttaagttagaggcacgtgactcgggtctacaaactggtgacccagccgggttcactctcgccgacactttggcttgtggtaccgttggtcatatcatcggcgtcggagttgtccttggtctcaaaaacattggtgctatttaaaaacatgtttatttgtattctgtcaacttgtagatttaaaaaaaaacaaagttctcaagaacccgagaggagatctagtcaatgtttataatctttgtatcgcattgtattcctctttaaaacaattagaacgaccgcatcttcaagtatgtaacgtgaaccgaaggcattgttcccttgatgataatatttaatagatcacatgagtaa

SEQ ID NO: 3621 - DNA, 676 bp, Brassica juncea
gatcgcactagaaaataaaagtattttcacgtaagagtcgaagaaatggcaagcactatgatgactacactgcctcagttcaatggtctacgagctaacaagatctctgcagctccagttcaaggcctggcaactgttgtgcccatgagacgcaagggaaatggagctttgggtgcaaagtgtgacttcattggttcatcaacaaatctgataatggtaacgtcgacgactctgatgttgttcgctgggagattcggactagcaccatcagccaataggaaggcgacagctggacttaagttagaggcacgtgactcgggtctacaaacgggtgacccagccgggttcactctcgccgacactttggcttgtggtaccgttggtcatatcatcggcgtcggagttgtccttggtctcaaaaacattggtgctatttgaaaacatgtccatttgtattcgtcaacttgtagattgttttaaaacaaaattctcaagaacctgaggggagatctagtcaatgtctataatgtttgtgtcgcattgtattcctctttaaaacaattagaacgaccgtatcttcgagtatgtcaactgtaagcattgttcccttgatagaaaacaccactaggtttaatcatcatccatgcatattcgaaaaaacaaagctagcatttgt

SEQ ID NO: 3622 - DNA, 515 bp, Brassica juncea
cattttaagaagaagaaaactgctacaatcaaaaacaaaggaaaactgatcgcactagaaaataaaagtattttcacgtaagagtcgaagaaatggcaagcactatgatgactacactgcctcagttcaatggtcttcgagctaccaagatctctgcagctccagttcaaggcctggcaactgttgtgcccatgagacgcaagggaaatggagctttgggtgcaaagtgtgacttcattggttcatcaacaaatctgataatggtaacgtcgacgactctgatgctgttcgctgggagattcggactagcaccatcagccaataggaaggcgacagctggacttaagctagaggcacgtgactcgggtctacaaacgggtgacccagccgggttcactctcgccgacactttggcttgtggtaccgttggtcacatcatcggcgtcggagttgtccttggtctcaaaaacattggtgctatttaaacatgttcatttgtattcgtcgacttgtag

SEQ ID NO: 3623 - DNA, 684 bp, Brassica juncea
tataatcataaatctgcaacacagatcgcccaagataatacaagtttttttcttttcgcgaaaataagtcagaagaaaatggcgagcactgtgatgactacactgcctcagttcaatggtcttagagccagcaagatctctgcagctcctgttcaaggcctggcaactgttcagcccatgagacgcaaggcaaatggagctttgggtgcaaagtgtggtgacttcattggttcatcaacaaatctgataatggtaacgtcgacaaccctgatgttgttcgcggggagattcggacttgcaccatcagcgaatagaaaagcaaccgctggacttaagctggaggcacgtgactcgggtctacaaacgggtgacccagccgggttcacgctcgctgacactttggcttgtggcaccgttggtcatatcatcggagtcggagttgttcttggcctcaaaaacatcggtgctatttaaaacttctttattgtgtatttgtaaccattgtagatttctaaaacaaaattctcaacagcctgaggggagatcaaatgaaatctttacatgtctttatgtttataatgtttgcatcgcatgcatatgttcaaatagaaaataccaccaggcttggaagttttacgtgagcttctaacaagatatgagatatacattcatcagatcgtcttc

SEQ ID NO: 3624 - DNA, 589 bp, Brassica juncea
gaagcctaaatcattttaaagacaactaagaacagaaagaaaaaaattagctaggatttaaaaaaaattagtaaaacagatcgccaagaaaatttatcacgtaagagtcgaagaaaatggcgagcattgtgatgactacactgcctcagtttaatggtcttcgtgccagcaagatctctgcagctcctgttcaaggcctggcaacagttcagcccatgagacgtaagggaaatggagcactgggtgcaaagtgtggtgacttcattggttcatcaacaaatctgataatggtaacgtcgacgacgctgatgctgttcgcggggagattcggacttgcaccatcagccaataggaaagcaacagctggacttaagctggaggcacgtgactcgggtctacaaacgggtgacccagccgggttcacgctcgctgacacgttggcttgtggcacggttggtcatatcatcggagtcggagttgtccttggcctcaaaaacattggcgctatttaaacttctttattgtagatttctaaaacaaaattctcaagaacctgaggggagatctaatgaaatctttacaagtcttg

SEQ ID NO: 3625 - DNA, 581 bp, Brassica nigra
ttttcacgtaagagtcgaagaaaatggcgagcactatgatgactacactgcctcagttcaatggtctacgagctaacaagatctctgcagctccagttcaaggcctggcaactgttgtgcccatgagacgcaagggaaatggagctttgggtgcaaagtgtgacttcattggttcatcaacaaatctgataatggtaacgtcgacgactctgatgctgttcgctgggagattcggactagcaccatcagccaataggaaggcgacagctggacttaagttagaggcacgtgactcgggtctacaaacgggtgacccagccgggctcactctcgccgacactttggcttgtggtaccgttggtcatatcatcggcgtcggagttgtccttggtctcaaaaacattggtgctatttgaaaacatgtccatttgtattcgtcaacttgtagattgttttaaaacaaaattctcaagaacctgaggggagatctagtcaatgtttataatgtttggtgtcgcattgtattcctctttaaaacaattagaacgaccgcatcttcgagtatgtcaactgtaagcatt

SEQ ID NO: 3626 - DNA, 835 bp, Brassica napus
agataatacaagtttttttttcacgaaaataagtcagaagaaaatggcgagcactgtgatgactacactgcctcagttcaatggtcttagagccagcaagatctctgcagctcctgttcaaggcctggcaacggttcagcccatgagacgcaaggcaaatggagctttgggtgcaaagtgtggtgacttcattggttcatcaacaaatctgataatggtaacgtcgacaaccctgatgttgttcgcggggagattcggacttgcaccatcagcgaatagaaaagcaaccgctggacttaagctcgaggcacgtgactcgggtctacaaacgggtgatccagccgggttcacgctcgctgacactttggcttgtggcaccgttggtcatatcatcggagtcggagttgttcttggcctcaaaaacatcggtgctatttaaaacttctttattgtgtatttgtaaccattgtagatttctaaaacaaaattctcaagagcctgaggggagatctaatgaaatctttacatgtctttatgtttataatgtttgcatcgcatgcatatgttcaaatagaaaatatcaccaggcttggaagttttacgtgagcttctaacaagatatgagatatgcattcatcagatcgtcttcaagattatagtgttttaaaacaactaggggcattgcctccacgcaaacgcagagttatgacattgttcttgtttcatcttaatatttgttagggttattgtaggtgaattttgcgttttgggttgatcaatgttttcaattttttattgttatagggttagagttgtgatgatgaattgtgtatgc

SEQ ID NO: 3627 - DNA, 664 bp, Brassica napus
tcataaatctgcaacacagatcgcccaagataatacaagtttttttcttcgcgaaaataagtcagaagaaaatggcgagcactgtgatgactacactgcctcagttcaatggtcttagagccagcaagatctctgcagctcctgttcaaggcctggcaactgttcagcccatgagacgcaaggcaaatggagctttgggtgcaaagtgtggtgacttcattggttcatcaacaaatctgataatggtaacgtcgacaaccctgatgttgttcgcggggagattcggacttgcaccatcagcgaatagaaaagcaaccgctggacttaagctggaggcacgtgactcgggtctacaaacgggtgacccagccgggttcacgctcgctgacactttggcttgtggcaccgttggtcatatcatcggagtcggagttgttcttggcctcaaaaacatcggtgctatttaaaacttctttattgtgtatttgtaaccattgtagatttctaaaacaaaattctcaagagcctgaggggagatctaatgaaatctttacatgtctttatgtttataatgtttgcatcgcatgcatatgttcaaatagaaaataccaccaggcttggaagttttacgtgagcttctaacaagatatgagatatacattca

SEQ ID NO: 3628 - DNA, 649 bp, Raphanus sativus
aaaaactgaaaaacagatcgcacagtaaaatttaagtttgtttaacgtaacagtcgaaggaaatggcgagcactgtaatgactacactgcctcagttcaatggtcttcgtgccagcaagatctccgcagctcctgttcaacgcctggcaactgttcagcccatgagacgcaagggaaatggtgcactcggtgcaaagtgtggtgacttcattggttcatcaacaaatctgataatggtaacatctacgaccctgatgctgttcgcggggagattcggacttgcaccatcagcgaatagaaaagcaactgccggacttaagctggaggcacgtgactcgggtctacaaacaggtgacccagccgggttcacgctcgctgacacgttggcttgtggtaccgttggtcatatcatcggagtaggagttgtccttggcctcaaaaacattggtgctatttaaaacttcttttattgtgtatttgtaaccattgtagatttctgaaacaaaattctcaagaacctgagggggagatctacataaatctttaagtgtctttatgtttataatgtctgcatcgcatgcatatgttcaaatagaaaataccaccaggcttagaagtttttacgtgagcttctaacaagatgaaaaaa

SEQ ID NO: 3629 - DNA, 631 bp, Raphanus sativus
aaaaactgaaaaacagatcgcacagtaaaatttaagtttgtttaacgtaacagtcaaaggaaatggcgagcactgtaatgactaccctgcctcagttcaatggtcttcgtgccagcaagatctccgcagctcctgttcaacgcctggcaactgttcagcccatgagacgtaagggaaatggtgcattaggtgcaaagtgtggtgacttcattggttcatcaacaaatctgataatggtaacatctacgaccctgatgctgttcgcggggagattcggacttgcaccatcagcaaataggaaagcaacagctggacttaagctggaggcacgtgactcgggtctacaaacgggtgatccagccggattcacgctcgctgacacgttggcctgtggcaccgttggtcatatcatcggagtaggagttgtccttggcctaaaaaacattggtgctatataaaacttattttattgtgtatttgtaaccattgtagatttcttaaacaaaattctcaagatacctgagggggagatctaaataaatatttaagtgtctttatgtttataatgtcttcatcgcatgcatttgttcaaatagaaaataccaccaggcttagaagttttacgtgagct

SEQ ID NO: 3630 - DNA, 565 bp, Triticum aestivum
gggataatcataaatctgcaacacagatcgcccaagataatacaagttttttcttcgcgaaaataagtcagaagaaaatggcgagcactgtgatgactacactgcctcagttcaatggtcttagagccagcaagatctctgcagctcctgttcaaggcctggcaactgttcagcccatgagacgcaaggcaaatggagctttgggtgcaaagtgtggtgacttcattggttcatcaacaaatctgataatggtaacgtcgacaaccctgatgttgttcgcggggagattcggacttgcaccatcagcgaatagaaaagcaaccgctggacttaagctggaggcacgtgactcgggtctacaaacgggtgacccagccgggttcacgctcgctgacactttggcttgtggcaccgttggtcatatcatcggagtcggagttgttcttggcctcaaaaacatcggtgctatttaaaacttctttattgtgtatttgtaaccattgtagatttctaaaacaaaattctcaagagcctgaggggagatctaatgaaatctttacatgcc

SEQ ID NO: 3631 - DNA, 448 bp, Brassica juncea
atcgcattagaaaataaaagttttttacacgtaagagttgaagaaaatggcgagcactatgatgactacactgcctcagttcaatggtcttcaagctatcaagatctctgcagctccagttcaaggcctggcaactgttgtgcccatgagacgcaagggaaatggagctttaggtgcaaagtgtgacttcattggttcatcaacaaatctgataatggtaacgtcgacgactctgatgctgtttgctgggagattcggattagcaccatcagccaataggaaggcgacagctggacttaagttagaggcacgtgactcgggtctacaaacgggtgacccagccgggttcactctcgccgacactttggcttgtggtaccgttggtcacaccatcggagttggagttgtccttggtctcaaaaacattggtgctatttaaacttgtaga

SEQ ID NO: 3632 - DNA, 595 bp, Raphanus sativus
aaaaactgaaaaacagatcgcacaataaaatttaagtttgtttaacgtaacagtcgaaggaaatggcgagcactgtgatgactacactgcctcagttcaatggtcttcgtgccagcaggatctccgcagctcctgttcaacgcctggcaactgttcagcccatgagacgcaagggaaatggtgcactcggtgcaaagtgtggtgacttcattggttcatcaacaaatctgataatggtaacatctacgaccctgatgctgttcgcggggagattcggacttgcaccatcagcaaataggaaagcaacagctgggcttaagctggaggcacgtgactcgggtctacaaacgggtgatccagccgggttcacgctcgctgacacgttggcttgtggcaccgttggtcatatcatcggagtaggagttgtccttggcctcaaaaacattggtgctatttaaaacttattttttattggtatctgtaaccattgtagatttctgaaacaaaattctcaagatacctgagggggagatctaaataaatctttaagtgtttatatttataatgtctgcatcgcatgcatatgttcaaatag

SEQ ID NO: 3633 - DNA, 731 bp, Eutrema parvulum
tgataggacacgacagccttatccagagttaaaatttgccaatagccactcgacacgtcagcaaggtgtaaccaaaacagaatccatttctgtgatcgccaaagccacacgatgattcttggctatatcattttaaagacaaataagaagaaaaaaactgctaaaataaaaaataaaacaaaataatttttttctttcacgtaagagtcgaagaaaatggcgagcactgtgatgactacactgcctcagttcagtggtcttcgagccagcaagatctctgcagctcctgttcaaggcctggccactgttcagcccatgagacgcaagggaaatggagctttgggtgcaaagtgtgacttcattggttcatcaactaatctgataatggtaacgtcgacgacactgatgctgttcgcggggagattcggacttgcaccatcggccaataggaaggcgacagctggacttaagctggaggcacgtgattcgggtctacaaacgggtgacccggccgggttcacgctcgccgacacgttggcttgtggctcctttggtcatatcatcggcgtcggagttgttcttggcctcaaaaacatcggtgctatttaaacttttatttaatatgtgtttgtatttctaaaattgtagattcttgaaaacaaattgtgtctaagaacctgagggaagatctaatggattttacaagtctttatgtttataataatgtctcc

SEQ ID NO: 3634 - DNA, 535 bp, Arabidopsis thaliana
gcaaaaacaaaaataaaaaaaacatcgcacaagaaaataaaagatttgtagaatcaactaagaaaatggctagcactatgatgactacattgcctcagttcaatggtcttcgagccaccaaaatctctgcagctcctgtacaaggcctggcaagtgttcagcccatgagacgcaagggaaatggagctttgggtgcaaagtgtgacttcatcggttcatcaacaaatctgataatggtaacgtcgacgaccctgatgttgttcgcggggagattcggacttgcgccatcagccaataggaaggcgacagctggacttaggttggaggcacgtgactcaggtctacaaacgggtgacccggccgggttcacgcttgcggacactttggcttgtggcaccgttggtcatatcatcggtgtaggagttgtccttggccttaaaaacattggtgctatttgaagttcctaaagctcttttatttgtatttgtaaaatttgtagatttttataacaatattctcatgcacctgaacgaga

SEQ ID NO: 3635 - DNA, 785 bp, Arabidopsis thaliana
ccaaagccacacgatgattcttgcctaaatcattttaaagactgtatagaggaaaacaaaactgcaaaaacaaaaataaaaaaaacatcgcacaagaaaataaaagatttgtagaatcaactaagaaaatggctagcactatgatgactacattgcctcagttcaatggtcttcgagccaccaaaatctctgcagctcctgtacaaggcctggcaagtgttcagcccatgagacgcaagggaaatggagctttgggtgcaaagtgtgacttcatcggttcatcaacaaatctgataatggtaacgtcgacgaccctgatgttgttcgcggggagattcggacttgcgccatcagccaataggaaggcgacagctggacttaggttggaggcacgtgactcaggtctacaaacgggtgacccggccgggttcacgcttgcggacactttggcttgtggcaccgttggtcatatcatcggtgtaggagttgtccttggccttaaaaacattggtgctatttgaagttcctaaagctcttttatttgtatttgtaaaatttgtagatttttataacaatattctcatgcacctgaacgagatctaatggattttacaagtctttatgtttatcttataatgttgtatcgcaatttatccccctttaatagtccataggttcgaagcatggaagaagcggtatatatgtgttagatctttggaattttgagtttttgttttagagaatttttgggtctgaagatttgatgcataagttatttttcaaaa

SEQ ID NO: 3636 - DNA, 1195 bp, Brassica rapa
atgataatgacacgacagccttatctagagttaaaattcaccaatacgtatatgacgcgtcagcaagaagtaacaaagcagaatccattctgtgatcgccaaagccacacgatgattcttggctaaatcattttaaagacaaataagaagaaaaaaactggtataatcataaatctgcaacacagatcgcccaagataatacaagtttttttttcacgaaaataagtcagaagaaaatggcgagcactttgatgactacactgcctcagttcagtggtcttagagccagcaagatctctgcagctcctgttcaaggcctcgcaactgttcagcccatgagacgcaaggcaaatggagctttgggtgcaaagtgtggtgacttcattggttcatcaacaaatctgataatggtaacgtcgacaaccctgatgttgttcgcggggagattcggacttgcaccatcagcgaatagaaaagcaaccgctggacttaagctggaggcacgtgactcgggtctacaaacgggtgacccagccgggttcacgctcgctgacactttggcttgtggcaccgttggtcatatcatcggagtcggagttgttcttggcctcaaaaacatcggtgctatttaaaacttctttattgtgtatttgtaaccattgtagatttctaaaacaaaattctcaacagcctgaggggagatcaaatgaaatctttacatgtctttatgtttataatgtttgcatcgcatgcatatgttcaaatagaaaataccaccaggcttggaagttttacgtgagcttctagcaagatatgagatatacattcatcagatcgtcttcaagattatagtgttttaaaacaactaggggcattgcctccatagaagcgtggagttatggacgtaattcttgtttcatctcaatatttgttagggttattgaatgttgctcgggttgatcattgttttcaagttttttattgttatatgattagagttgtgatgatgaattgtgtatgcactgttcttcactcatgatggattaaactgtgttagtaatgtgattgatatagtttgtggtgttgcttgctgtgtcattgaaacttattgtttgtttgtcttttaaatttgttacttgtactgttgagattacataaattatattaatgttgttgaaagtaacttttatttctg

SEQ ID NO: 3637 - DNA, 590 bp, Raphanus sativus
ggaaagacaactaagaacagaaactgctagagtttttttaaaaattgaaaaacagatcgccaagaaaattaaagtttatcacgtaagaggcgaagaaaatgacgagcattgtgatgactacattgcctcagtttaatggtcttcgtgccagcaagatctctgcagctcctgttcaaggcctggcaactgttcagcccatgagacgcaaggcaaatggagctttgggtgcaaagtgtggtgactttattggttcatcaacaaatttgataatggtaacgtcgacaaccctgatgttgttcgcgggaagattcggacttgcaccatcagcgaatagaaaagcaaccgccggacttaagttggaggcacgtgactcgggtctacaaacgggagacccagccgggttcacgctcgctgacacgttggcttgtggcaccgttggtcatatcatcggagtaggagttgtccttggcctcaaaaacattggtgctatttaaaacttcttttattgtgtatttgtaaccattgtagatttcttaaacaaaattctcaagaaactgagggagagatctaaataaatctttaagtgtctt

SEQ ID NO: 3638 - DNA, 696 bp, Brassica juncea
ctaagcctaaatcattttaaagacaactaagaacagaaaaaactgctagaattttttaaaaaattgaaaaatagatcgccaagaaaattaaagtttatcacataagagtccaagaaatgacgagcactgtgatgatgactgcactgcctcagtttaatggtcttcgtgccagcaagatctctgcagctcctgttcaaggcctggcaactgttcagcccatgagacgcaaggcaaatggagctttgggtgcaaagtgtggtgacttcattggttcatcaacaaatctgataatggtaacgtcgacaaccctgatgttgttcgcggggagattcggccttgcaccatcagcgaatagaaaagcaaccgctggacttaagctggaggcacgtgactcgggtctacaaactggtgacccagccgggttcacgctcgctgacacgttggcttgtggcaccgttgggcatatcatcggtgttggagttgttcttgggctcaaaaacatcggtgctatttaaaacttctttattgtgtatttgtaaccattgtagatttcttaaactaaattctcgagaacctgagggggagatctaatgaattttacaaaactaaacggtcggaaacatgaaggataattttatagatttattggtttatgaagaagtagtgagaagagtacaaaatttgacaagtgatgaa

SEQ ID NO: 3639 - DNA, 576 bp, Arabidopsis lyrata
gaggaaaaaaactgcaaaaacaaaaactaaaaaaaaccgatcgcacaagaaattaaaagatttgtagattcagctaagaaaatggcgagcactgtgatgactacattgcctcagttcaatggtcttcgagccaccaagatctctgctgctcctgttcaaggcctggcaagtgttcagcccatgagacgcaagggaaatggagctttgggtgcaaagtgtggtgacttcattggttcatcaacaaatctgataatggtaacatctacgacgctgatgttgttcgcggggagattcggactggcgccatcagccaataggaaggcgacagctggacttaggttggaggcacgtgactcgggtctacagacgggtgacccggccgggttcacgcttgcggatactctggcttgtggcaccgttgggcatatcatcggtgttggagttgtccttggccttaaaaaaattggtgctatttaaaattattaatgctcttttatttgttgtatttgtaaaatttgttataacaaatctcaagaacctgagggagatctaatggaatttgcaagtctttatgtt

SEQ ID NO: 3640 - DNA, 724 bp, Arabidopsis lyrata
ccaaagccacacgatgattcttgcctaaatcattttaaagactgtatagaggaaaaaaactgcaaaaacaaaaactaaaaaaaaccgatcgcacaagaaattaaaagatttgtagattcagctaagaaaatggcgagcactgtgatgactacattgcctcagttcaatggtcttcgagccaccaagatctctgctgctcctgttcaaggcctggcaagtgttcagcccatgagacgcaagggaaatggagctttgggtgcaaagtgtggtgacttcattggttcatcaacaaatctgataatggtaacatctacgacgctgatgttgttcgcggggagattcggactggcgccatcagccaataggaaggcgacagctggacttaggttggaggcacgtgactcgggtctacagacgggtgacccggccgggttcacgcttgcggatactctggcttgtggcaccgttgggcatatcatcggtgttggagttgtccttggccttaaaaaaattggtgctatttaaaattattaatgctcttttatttgttgtatttgtaaaatttgttataacaaatctcaagaacctgagggagatctaatggaatttgcaagtctttatgtttgtatcgtattttctcccttttatactccatagtccatagattcgaagcatggaagaaacggtatttgtgttggatctttgaattttgagtttttttttt

SEQ ID NO: 3641 - DNA, 606 bp, Eutrema halophilum
aaagagtcaatatcgcacaagaatataagaggtttttcgatttaactctaaaatttaagagtcgaggaaacatggccagcactgtgatgactacactgcctcagttcaatggacttcgagcctgcaagatctctgcagctcccgttcaaggcctggcaactgttcagcccatgaggcgcaagggaaatggagctttgggtgcaaagtgtggtgacttcattgggtcatcaacaaatctgataatggtaacgtcgacgaccctgatgctgttcgcggggagattcggacttgcaccatcagccaataggaaagcgacagctggacttaagctggagtcacgtgaatcgggtctacaaacgggtgacccggccgggttcaccctcgccgatacgttggcttgtggtagctttggtcatatcatcggcgtcggagttgtccttggcctcaaaaacattggtgctatttaaactttattaaaatgtctcttgagtatgtatttgtaaaatttgtagattcttaaaacaatttctcaagaaccggaggggtgatctaatggattttacaagtctttatgtttataatgtttgttttttgcatgatatttaa

SEQ ID NO: 3642 - DNA, 533 bp, Eutrema parvulum
ttcacgtaagagtcgaggaaacatggccagcactgtgatgactacactgcctcagttcaatggacttcgagcctgcaagatctctgcagctcccgttcaaggcctggcaactgttcagcccatgaggcgcaagggaaatggagctttgggtgcaaagtgtggtgacttcattgggtcatcaacaaatctgataatggtaacgtcgacgaccctgatgctgttcgcggggagattcggacttgcaccatcagccaataggaaagcgacagctggacttaagctggagtcacgtgaatcgggtctacaaacgggtgacccggccgggttcaccctcgccgatacgttggcttgtggtagctttggtcatatcatcggcgtcggagttgtccttggcctcaaaaacattggtgctatttaaactttattaaaatgtctcttgagtatgtatttgtaaaatttgtagattcttaaaacaatttctcaagaaccggaggggtgatctaatggattttacaagtctttatgtttataat

SEQ ID NO: 3643 - DNA, 785 bp, Eutrema halophilum
tgatatgacacgacagccttatccagaattaaaatccgccaatagccactcgacgagtcagcaagaagtgaccaaaacagaatccatttctgtgatcgccaaagccacacgatgattcttggctaaagcattttaaaaacaatacgaaggaaaactgcgaaaattaaagagtcaatatcgcacaagaatataagaggtttttcgatttaactctaaaatttaagagtcgaggaaacatggccagcactgtgatgactacactgcctcagttcaatggacttcgagcctgcaagatctctgcagctcccgttcaaggcctggcaactgttcagcccatgaggcgcaagggaaatggagctttgggtgcaaagtgtggtgacttcattgggtcatcaacaaatctgataatggtaacgtcgacgaccctgatgctgttcgcggggagattcggacttgcaccatcagccaataggaaagcgacagctggacttaagctggagtcacgtgaatcgggtctacaaacgggtgacccggccgggttcaccctcgccgatacgttggcttgtggtagctttggtcatatcatcggcgtcggagttgtccttggcctcaaaaacattggtgctatttaaactttattaaaatgtctcttgagtatgtatttgtaaaatttgtagattcttaaaacaatttctcaagaaccggaggggtgatctaatggattttacaagtctttatgtttataatgtttgttttttgcatgatatttaagctttttttccttc

SEQ ID NO: 3644 - DNA, 492 bp, Cleome gynandra
aaaaagaaagaaagaggagaaatggcaagcactgtgatgactacactgcctcagttcaatggtctgagaccaaacaagatctctgcagttccagttcaaggcctggccaatgttcaaccaatgagacgcaaaggaaaaggagctttaggagcaagatgtgacttcattggttcacccacaaatctgataatggtgacgtcgacgagtctgatgttgttcgccggaagattcgggctggcaccgtcggccaataggaaagcgacagctggactgaaactggaggcacgtgactcgggtctgcaaacgggcgacccggctggtttcactctcgctgacacgttggcatgtgggaccgtcggacacatcatcggtgtcggagttgttcttggtcttaagaacatcggtgcaatctaattatttattatcatgttttttaattttaaaaactgtgaaaacgctcaatactaatgcattatattttgattttgttta

SEQ ID NO: 3645 - DNA, 611 bp, Cleome spinosa
caggatgctttatgtggctgtctgaaactctctcaatgctttattcattttaagagcttcgcgcaaaaaaaaggaaaaaaaacaacagaagtcatcggagaaatggcaagcactgtgatgacgtcacttcctcaattcaacggtctgagaactcgcaagatctttgcatctccggttcatggcccgggtgctgttcaaccaatgagacgcaagggaaatggagctttgggtgcaagatgcgactttattggttcacccacaaatttgataatggtgacgtcgacgactctgatgctgttcgcgggaagattcggtctggctccatcggccaataggaaggcgacagccggactgaaactcgaggcccgtgactcgggcctgcaaacgggtgacccggccgggttcacgctcgctgacacgttggcatgtgggaccgtcggacacatcatcggcgtcggagttgtcctcggtctcaagaacatcggtgctctgtaaattaatcgtcataacgttatttacttaaaaacataaataaatattatgtttcgaagttttttataaccaaactctatctattttgttggtaatattttctgaattcgttacttttg

SEQ ID NO: 3646 - DNA, 464 bp, Cleome spinosa
caatcggagaaatggcaagcacggtgatgacaacactgtcactgcctcagttcaatggtctgagaccaaacaggatctctgcatgtccggtccaaggcctggtaacagttcaaccaatgggacgcaagggaaacggcgctttgggcgcaagatgtgacttcattggttcacccacaaatttgataatggtgacgtcgacgagcctgatgctgttcgccgggagattcgggcttgctccgtctgccaataggaaagcgacagctggactaaaactcgagggacgtgactcgggccttcaaacgggtgacccggccgggttcacactcgctgacacgttggcatgtgggaccgtcggacacatcatcggggtcggggtcgttctcggtcttaaaaacatcggtgctctgtaattattcattataatgttcttttataaaaactctatggaatgtaatttatctttc

SEQ ID NO: 3647 - DNA, 615 bp, Lotus japonicus
acaacataacatagccagccctttagctagcaacgaagcacaaggaaggaagagagattgattcaacacttctgtatttccatttcaacttcaaatggcaacaactgtgatgactactctccctcaattcagtggccttagacccaaattttcagcaacacctgtgcagaatttggttactgtccaacccatgaggcgtaagggaaatggtgctttgggagctcgctgtgacttcattggctcacccactaatctgattatggtagcttctacaaccctgatgctgtttgctggaaggtttggattagccccgtcagcaaataggaaagccactgcagggctaaagctggaggtgagggactcaggcttgcagactggtgacccagccgggttcacacttgctgatacgttggcctgtggaactgttggtcacatcattggggttggggttgtgcttggtcttaagaacataggctcactgtaaaattattggaactatgtggtaattgaatgtatctgaatgtaatcaatttcatttcatgtcctttatttttcacttcactaaggctgaacctttagtctatatatatctcaactctaatctctattccactc

SEQ ID NO: 3648 - DNA, 833 bp, Cajanus cajan
gtggttgccattagatacgcttgcaagttacatcaaatcccttgagcaacccagaaaacatttcaaacaaaaaagagagcttagagagaccaaacacattttcatttcctcttttgagttttaacaaatggcaaccactgtgatgaccactctcccccaattcactggtcttagaccccaattctcagctgcccctgtgcagaatttggttgctgttcaacccatgaggcgcaaggggaagggtgctttgggagctcgatgtgacttcattggttcatccactaatctgattatggtggcttctacaaccctgatgctgtttgctggaaggtttggattggctccatcagcaaacaggaaagcaactgccgggctaaagctggaggtgagggactcagggttgcagactggtgaccctgctggcttcacccttgctgacaccttggcctgtggaactgttggtcacatcattggggttggggttgttcttggtcttaagaacattggtgccctgtaaagtggaactgtaaaatttagtgcctcatgtttctgtaatcaaattaatgttgttatgtcctttattttcacatcaccctctattctttctcaaccttaatctgacttcagctaacacacaaaccttaatggatccgtgatgacaaatccatagatttcaattgctaccaattactaacctgcaatttatcatgcaacttcgtagactgtatgtaacacaggcttgtaaaactaagatgtcttagacatgacattaacttcattaatagtttgaaaaacattgcacaatatctcctataagggatattgttgtaaat

SEQ ID NO: 3649 - DNA, 489 bp, Vitis vinifera
aaaaaaccgaagagggagagaggttttgtgatcattctctttgaaatcaggcaatggcaaccactgtgatgaccactctcccacaattcaatggcctcagacccaaatcttccacatctcctgtacaaactctggcagcagttcaaccaatgaggcgcaagggtaggggagctttgggtgctcgctgtgatttcattggttcacccaccaatctgattatggtgacttcaacaagcctaatgctgtttgctgggcgatttgggttggctccatcggccaacaggaaggcgactgcgggattgaagcttgaggtaagggactcagggctgcagactggagacccagctggcttcacccttgcagataccttggcatgtggaactgttggtcacataattggggttggggttgttcttggacttaagaacataggtgtcctgtaaactattatccttttaaccatctcattctaatactcctttctctctc

SEQ ID NO: 3650 - DNA, 655 bp, Vitis vinifera
ctgaaaaaaccgaagagggagagaggttttgtgatcattctctttgaaatcaggcaatggcaaccactgtgatgaccactctcccacaattcaatggcctcagacccaaatcttccacatctcctgtacaaactctggcagcagttcaaccaatgaggcgcaaggggaagggagctttgggtgctcgctgtgatttcattggttcacccaccaatctgattatggtgacttcaacaagcctaatgctgtttgctgggcgatttgggttggctccatcggccaacaggaaggcgactgcgggattgaagcttgaggtaagggactcagggctgcagactggagacccagctggcttcacccttgcagataccttggcatgtggaactgtaggtcacataattggggttggggttgttcttggacttaagaacataggtgtcctgtaaactattatccttttaaccatctcattctaatactcctttctctctctctctctctctctccccttggtgctttgtttttccaccctgaaatgcctatttgccgacttcattgttgagtttgggatctttaagacctgagtaagcatgcaagcgttgaagataatggatgagaaataccatgaaagagcttgaaaaggaatttgttcatt

SEQ ID NO: 3651 - DNA, 793 bp, Vitis vinifera
ctcatgtggctgtgatgcacacctggcctctagtccttataactcttttaacaccctaatattgaaagcaaatattctgaaaaaaccgaagagggagagaggttttgtgatcattctctttgaaatcaggcaatggcaaccactgtgatgaccactctcccacaattcaatggcctcagacccaaatcttccacatctcctgtacaaactctggcagcagttcaaccaatgaggcgcaagggtaagggagctttgggtgctcgctgtgatttcattggttcacccaccaatctgattatggtgacttcaacaagcctaatgctgtttgctgggcgatttgggttggctccatcggccaacaggaaggcgactgcgggattgaagcttgaggtaagggactcagggctgcagactggagacccagctggcttcacccttgcagataccttggcatgtggaactgttggtcacataattggggttggggttgttcttggacttaagaacataggtgtcctgtaaactattatccttttaaccatctcattctaatactcctttctctctctctctctctctctctccttggtgctttgtttttccaccctgaaatgcctatttgccgacttcattgttgagtttgggatctttaagacctgagtaagcatgcaagcgttgaagataatggatgagaaataccatgaaagagcttgaaaaggaatttgttcatttatttgcactttaactattaagcttttttttttaataataaaatcaacttaattttttttaa

SEQ ID NO: 3652 - DNA, 617 bp, Eucalyptus grandis
attctgtaaagtcaaaatcatcaaaccccagcttgaaaaaaggagagactccagaaaatctgcagcttgatctctctctttttcttttagttctagcacgacaatggcgacaacagtgatgacatctctccctcagttcaatggcctcagacccgctgctccagcggctcctgtgcgaagcctggctgcggtcgttcagccgatgaggcgcaagggaaagggagcgctgggggctcgctgcgacttcatcggttcgcccactaacttgatcatggtgaccacaacaaccctgatgctgtttgctgggaggttcgggttggcgccgtcggcgaaccggaaggccaccgctgggctgaagttggaggcgagggactcggggctgcagaccggcgacccggccggcttcactctagccgacaccttggcttgcggctccttcggccacatcatcggtgtcggggttgttcttggcctcaagaacataggtgctctgtaaaaaaaataaggcaaaatgttgaggaagaaattccccctagtttttgatttgtttcgtgaatctcctgtccatacttttattctctcctactaatatcaaattaaaattttcccgaatggcc

SEQ ID NO: 3653 - DNA, 655 bp, Arachis hypogaea
agtggtatcaacgcagagtacgggggaaccacaccagaattctttcaaagaaaaaaaaaaaaatagggagagcttagagattcaagtaatggcaaccacaatgatgaccactctccctcagttcaatggtcttagacccaaattctcagcagcccctgtgcagaacttggttgctgtccaacccatgaggcgtaaggggaagggtgctctaggaactcgctgtgatttcattggttcagaaaccaatctgattatggtggcttctacaacactgatgctgtttgccggaaggtttggattggctccgtcggcaaacaggaaagcgactgcagggctgaagctggaggtgagggactcaggcttacagactggtgacccagctggtttcacccttgctgataccttggcttgtggaactgttggccacatcattggtgttgggattgttcttggtcttaagaatacgggtgccttgtaaattaaaacaagaaaaatgaacaaccattcctgcataatgcacctgtaatcaagtttagtgtgcttttaattttctcatcacttgagaatgaacattgtatgcctcaaatcttaatctatagttgctcccttccccaaaaaaaagaaaaaaaacaaaagtactctgcgttgataccac

SEQ ID NO: 3654 - DNA, 531 bp, Arachis hypogaea
agtggtatcaacgcagagtacggggagaattctttcaaagaaaaaaaaaaaatagggagagcttagagattcaagtaatggcaaccacaatgatgaccactctccctcagttcaatggtcttagacccaaattctcagcagcccctgtgcagaacttggttgctgtccaacccatgaggcgtaaggggaagggtgctctaggaactcgctgtgatttcattggttcagaaaccaatctgattatggtggcttctacaacactgatgctgtttgccggaaggtttggattggctccgtcggcaaacaggaaagcgactgcagggctgaagctggaggtgagggactcaggcttacagactggtgacccagctggtttcacccttgctgataccttggcttgtggaactgttggccacatcattggtgttgggattgttcttggtcttaagaatacgggtgccttgtaaattaaaacaagaaaaatgaacaaccattcctgcataatgcacctgtaatcaagtttagtgtgct

SEQ ID NO: 3655 - DNA, 691 bp, Solanum melongena
aatgccgcataaattctttacaccccaaatagattttataacaatttaaacatacaataagcaaacaagtattcctaaacaaagagaaaaaaataaaaaagaacttccatttattgataatcttgagtttcttgcaacaatggcttccaccatgatgactactcttccacaattcaatggcctcagaccccaagctttctcaacctctccagtccagggcttggtaccagttcaaccaaggaaaaacaaaggacaaggtgctatgggagctcgttgtgaattcattggctcatccactaatttgataatggtgacatcaacaaccctaatgttatttgctggtagatttggacttgcaccatcagcaaacaggaaggcaacagcagggctaaaacttgaagttagggactcaggcttacagacaggggaccctgctggatttacacttgctgatactttggcttgtgggactgtaggtcacattattggtgttggtgtggttcttggactcaaaaatataggtgctatttaaaatgtgtactaaaaatttctttatatttataaaattaaaccatcttttgtgaattattcatattttctgtgattccacgagatctagtttcattcaagtaacagattctagccaactgaaaggtagcttttcggaaaattaccaaatgaacaatttcaa

SEQ ID NO: 3656 - DNA, 627 bp, Humulus lupulus
ctcctactcctgtgtgtcgtgcatccctacgctactacgacgttaattattatttttaactaaaacaaataaaaaattaggagaaacttcttcttttcaaaaatctgtttctcctttgatcttggctgaaaatggcaactacagtggctacttctctccctcagttcaatgggctcagaccccagttctcagctactcctgttagaactctggctgcagttcagccaatgaagcgcaaggggaagggtgctttgggtgctcgatgtgatttcattggttctcccacaaatttgataatggtgaccagcacaactctaatgttgtttgctggaaggttcggactagccccatcggctaaccgaaaggcgacggctgggttgaagctcgaggcaagggactctggcctccagactggcgacccggccggtttcacccttgctgacaccttggcttgtggtacagttggtcacattattggtgttggggtggttcttggcctcaaaaacattggttccctgtaaaaataaaatgatgtgcaattttatgtacttgatttgtaaaaactgtttgtatgcttagttcaatgctttttttgttacctacttttttcttctaaagtagttgatc

SEQ ID NO: 3657 - DNA, 539 bp, Humulus lupulus
ttcttcttttcaaaaatctgtttctcctttgatcttggctgaaaatggcaactacagtggctacttctctccctcagttcaatgggctcagaccccagttctcagctactcctgttagaactctggctgcggttcagccaatgaagcgcaaggggaagggtgctttgggtgctcgatgtgatttcattggttctcccacaaatttgataatggtgaccagcacaactctaatgttgtttgctggaaggttcggactagccccatcggctaaccgaaaggcgacggctgggttgaagctcgaggcaagggactctggcctccagactggcgacccggccggtttcacccttgctgacaccttggcttgtggtacagttggtcacattattggtgttggggtggttcttggcctcaaaaacattggttccctgtaaaaataaaatgatgtgcaattttatgtacttgatttagtaaaaactgtttgtatgcttagttcaatgtcttttttgttacctactttttcttctaaagtagttgat

SEQ ID NO: 3658 - DNA, 544 bp, Solanum tuberosum
ccaaaacaaagagaaaaataaaacacatttccattgtttgattatcttgagttttttgcaacaatggcttccaccatgatgactactctaccacaattcaatgggctcaaaccccaacctttctcagcttctccagttcaaggcttggtggcaattcaaccaaggcgcaacaaaggacaaggtggtttgggagctcgttgtgatttcattggctcatccactaatttgataatggtgacatcaacaagcctaatgttgtttgctggtagatttgggctagcaccatcagcaaacaggaaggcaactgcagggctaaaacttgaagtgagggactctggcttacagacaggggaccctgctggatttacacttgctgatactttggcttgtggtactgttggtcatattattggtgttggagttgttcttggactcaaaaacattggtgctatctaaactttgtactatttactattatgtttataaaaccaaatcatcttttgtgaattattcatatttctaccacaaaaaaaaaaaaaaaaaa

SEQ ID NO: 3659 - DNA, 528 bp, Solanum phureja
gaaatattccaaaacaaagagagaaaaataaaacacatttccattgtttgataatcttgagtttttgcaacaatggcttccaccatgatgactactctaccacaattcaatgggctcaaaccccaacctttctcagcttctccagttcaaggcttggtggcaattcaaccaaggcgcaacaaaggacaaggtggtttgggagctcgttgtgatttcattggctcatccactaatttgataatggtgacatcaacaagcctaatgttgtttgctggtagatttgggctagcaccatcagcaaacaggaaggcaactgcagggctaaaacttgaagtgagggactctggcttacagacaggggaccctgctggatttacacttgctgatactttggcttgtggtactgttggtcatattattggtgttggagttgttcttggactcaaaaacattggtgctatctaaactttgtactatttactattatgtttataaaaccaaatcatcttttgtgaattattcatattt

SEQ ID NO: 3660 - DNA, 560 bp, Arachis hypogaea
aaaaaaaaaaaaagggagagcttagagattcaagtaatggcaaccacaatgatgaccactctccctcagttcaatggtcttagacccaaattctcagcagcccctgtgcagaacttggttgctgtccaacccatgaggcgtaagggaagggtgctctaggaactcgctgtgatttcattggttcagaaaccaatctgattatggtggcttctacaacactgatgctgtttgccggaaggtttggattggctccgtcggcaaacaggaaagcgactgcagggctgaagctggaggtgagggactcaggcttacagactggtgacccagctggtttcacccttgctgataccttggcttgtggaactgttggccacatcattggtgttgggattgttcttggtcttaagaatacgggtgccttgtaaattaaaacaagaaaaatgaacaaccattcctgcataatgcacctgtaatcaagtttagtgtgcttttaattttctcatcacttgagaatgaacattgtatgcctcaaatcttaatctatagttgctcccttcccc

SEQ ID NO: 3661 - DNA, 512 bp, Theobroma cacao
gaagtgtcaaactagaaacagagggagaaactgcttctgattatcatttcttctgctttgagattagcaaatggcagccactgcaatgaccactctccctcagttcagtgggctaagacccagaatttctgcagctccagttaggggcctggcagcggttcagccaatgaggcgcaaggggaagggagctttgggtgctcgctgtggttacattggttctcccacaaatttgataatggtgacaacaacaagccttatgctctttgctgggagatttgggttggctccctcagcaaacaggaaggccactgctgggctgaagctcgaagcaagggactccgggttgcagactggtgaccctgctggttttactctcgcagacaccttggcttgtggctctgttggccacattattggtgttgggattgttctaggccttaagaacattggtgctctgtaaaaatttaaaaataaaataaaatttaagcactgttcttttttatttgaaccaa

SEQ ID NO: 3662 - DNA, 698 bp, Glycine max
gccagaggaacccagaagataaatctttcaaagaaaaaaggagagtgcttagagagagagcaaaacatattattttcattttcatctttttttgagtatcaacaaatggcaaccactgtgatgaccactctcccccaattcagtggtcttagaccccaattctcagctgcccctgtgaagaacttggttgctgtgcaacccatgagtcgcaaggggaagggtgcattgggagctcgatgtgactacattggttcatccactaatctgattatggtggcttctacaaccctgatgctgtttgctggaaggtttggattggctccatcagcaaacaggaaagccactgcagggctaaagctggaggtgagggactcaggcttgcagactggtgaccctgctggcttcacccttgctgacaccttggcctgtggatctgttggccacatcattggggttggggttgttcttggtctcaagaacattggtgccctgtaaaaagcaactatataagtttagtgcttgatgcatctgtaatcaatgttattatgtacttcattttcacatcactctgcagtctttctcaaacttaacataatattcagtttctcccttttccctcctaatcccacacccaccccctcatacaaaaacaaaaaaagatctgttatggcaaatgatcaaatgctttgctatagaat

SEQ ID NO: 3663 - DNA, 572 bp, Theobroma cacao
ggctccaagggtctgctaggtttatgttctcttttaaactcaaagtgaaaagaaaaaatcatcgaagtgtcaaactagaaacagagggagaaactgcttctgattatcatttcttctgctttgagattagcaaatggcagccactgcaatgaccactctccctcagttcagtgggctaagacccagaatttctgcagctccagttaggggcctggcagcggttcagccaatgaggcgcaaggggaagggagctttgggtgctcgctgtggttacattggttctcccacaaatttgataatggtgacaacaacaagccttatgctctttgctgggagatttgggttggctccctcagcaaacaggaaggccactgctgggctgaagctcgaagcaagggactccgggttgcagactggtgaccctgctggttttactctcgcagacaccttggcttgtggctctgttggccacattattggtgttgggattgttttaggccttaagaacattggtgctctgtaaaaatttaaaaataaaataaaatttaagcactgttctttttattgaacca

SEQ ID NO: 3664 - DNA, 864 bp, Cannabis sativa
tccaaatctaccaacaccaagccacaaattgttcatgtggctgctgtgaaagttttgctcactcactacttttataattcatttcatcattttcaccaaattatatgctttttttttctaagaacaaaataaaaaattaagagatttgtcctttaattttggctaaaaaaatggcaaccacagttgctacttctctccctcaattcaatgggctcagaccccagatctcatctactcctgtcagaactctggctgcagttcagccaatgaaacgtaagggcaagggtgctttgggtgctcgatgtgatttcattggttctccaacaaatttgataatggtgactagcacaactctaatgttgtttgctggaaggttcgggctagccccatctgctaaccgaaaggcgacagctgggttgaagctcgagacaagggactccggtctgcagaccggtgacccggccggttttacccttgctgacactttggcttgtggtactgttggccacattattggtgttggggttgttcttggcctcaaaaacattggttccctgtaaaaaaattaaaataatgtgcaattttatgtacttgagttgtaaaaactgtttttttatgtctagttcaatgcttttttgttacctacttttttcttctaaagtaacttgattacttttaatccatttttccaagagatggaaccaaaatcagaaacatgcatactatttagaaaatataaataataatagaatcatagagagagagagaaaaaatgtatcaagcaatatttggaagaatgtggtacttactgactcaaaagttgaaaataatatgaagtggattaaattagggtattttcaaaaa

SEQ ID NO: 3665 - DNA, 553 bp, Carica papaya
gagaaattcatttgtgttttccggctagcaaatggcaaccactgtgatgacttctctccctcaattttctgggttaagacccaacttctcagcagctccagtgaaaaccctggcagctgttcgaccaatgaagagaaagggaaatggagcactgggtgctcgctgtgatttcattggctcccccactaacttgataatggtgacgagtacaagtctaatgttattcgcggggagattcgggttagctccatcggcaaatcgaaaggcgaccgcaggattaaagctagaagtgagggactcagggctgcaaacaggcgacccagctggatttacacttgcagacactttggcttgtggtgttgtgggtcatattattggtgttggtgttgttcttggccttaagaatcttggtgctttgtaaattaatttcgaatctttattttgatgaatatgtaaattttttttttcaaattacgatctaattgttatgaatatgttaatacccactttttgcctccgaaaaacttaaataaatctttgtacgagaacccta

SEQ ID NO: 3666 - DNA, 847 bp, Arachis hypogaea
tttcatgttacatcatttcatagaccccttaagaaacgaacgaaatcaaccacaccagaattctttcaaagaaaaaaaaaaaatagggagagcttagagattcaagtaatggcaaccacaatgatgaccactctccctcagttcaatggtcttagacccaaattctcagcagcccctgtgcagaacttggttgctgtccaacccatgaggcgtaaggcgaagggtgctctaggaactcgctgtgatttcattggttcagaaaccaatctgattatggtggcttctacaacactgatgctgtttgccggaaggtttggattggctccgtcggcaaacaggaaagcgactgcagggctgaagctggaggtgagggactcaggcttacagactggtgacccagctggtttcacccttgctgataccttggcttgtggaactgttggccacatcattggtgttgggattgttcttggtcttaagaatacgggtgccttgtaaattaaaacaagaaaaatgaacaaccattcctgcataatgcacctgtaatcaagtttagtgtgcttttaattttctcatcacttgagaatgaacattgtatgcctcaaatcttaatatatagttgctcccttcccccacttctacgctcacaaacagtaatcataaatcatcaaaatgtttggttatgaagccgtgacattgaggagaaattattagtcgtctttgaagctacattcatccatatattaagcgaaaggatgtacataatatgcataagagaaactagtgcgtgccctgcatggggtaaatattaatacagttgtaaaattaatttttgttactatttaat

SEQ ID NO: 3667 - DNA, 514 bp, Capsicum annuum
tcagcatagtagtggaaaaataaaaacttccattcttttgataatcttgagtttcaacaatggcttccaccatgatgactactctcccacaattcagtggcctcaaaccccaagctttctcaacttctccaattcaaggcttggtatcagttcaaccaagacgcaacaaaggacaaggtgctttgggagctcgttgtgatttcattggctcatccacaaatttgataatggtgacctcaacaaccctaatgttatttgctggaagatttggacttgcaccatcagcaaacaggaaggcaactgcagggctaaagcttgaggtgagggactctggcttacagactggggatcctgctggatttacacttgctgatactttggcttgtggtactgttggtcacattattggtgttggagttgttcttggactcaagaacattggtgctctctaaaatttgtatctctatgttcataaatcaaatcatctttttgtgaattattcatatttctatca

SEQ ID NO: 3668 - DNA, 482 bp, Pteridium aquilinum
aaactagaaacagagggagaaactgcttctgattatcatttcttctgctttgagattagcaaatggcagccactgcaatgaccactctccctcagttcagtgggctaagacccagaatttctgcagctccagttaggggcctggcagcggttcagccaatgaggcgcaaggggaagggagctttgggtgctcgctgtggttacattggttctcccacaaatttgataatggtgacaacaacaagccttatgctctttgctgggagatttgggttggctccctcagcaaacaggaaggccactgctgggctgaagctcgaagcaagggactccgggttgcagactggtgaccctgctggttttactctcgcagacaccttggcttgtggctctgttggccacattattggtgttgggattgttctaggccttaagaacattggtgctctgtaaaatttaaaataaataaatttaagcactgtt

SEQ ID NO: 3669 - DNA, 1674 bp, Glycine max
cccaaatcagataatgccacgtcggagtcacgtatctttggccatctcattttggcgtcctgaggccacaaatcgctcatgtggctgccattagatacgcatattgcatgttacatcatagcccttagaacagccagaggaacccagaagataaatctttcaaagaaaaaaggagagtgcttagagagagagcaaaacatattattttcattttcatctttttttgagtatcaacaaatggcaaccactgtgatgaccactctcccccaattcagtggtcttagaccccaattctcagctgcccctgtgaagaacttggttgctgtgcaacccatgagtcgcaaggggaagggtgcattgggagctcgatgtgactacattggttcatccactaatctgattatggtggcttctacaaccctgatgctgtttgctggaaggtttggattggctccatcagcaaacaggaaagccactgcagggctaaagctggaggtgagggactcaggcttgcagactggtgaccctgctggcttcacccttgctgacaccttggcctgtggatctgttggccacatcattggggttggggttgttcttggtctcaagaacattggtgccctgtaaaaagcaactatataagtttagtgcttgatgcatctgtaatcaatgttattatgtacttcattttcacatcactctgcagtctttctcaaacttaacataatattcagtttctcccttttccctcctaatcccacacccaccccctcatacaaaaacaaaaaaagatctgttatggcaaatgatcaaatgctttgctatagaattgagcattcttgactcgatgcatttgaattgctaccaatgattaaactgcatcatgcaaattcttaggcttaataaaataagttagaacacacgtttgcaagactaatatttctcctcaaaattataagatctgtaacaaattaacaataactatagaaaaatttggatttactgggtttcttgaaaaccaatattctcggtatttgggcagtctaaacatacatatgtaaaatatcagaatagttttatctactattgtgtaaaatgtcaaatatgcatggaaatggaaagacatattttctacttataattgtagggaattaacaaatcaaattcctttctttgtgaattcaagataggcactatgtggaagccaaaaagtaaagcgtagaagaataacattagaaattttaagtaaaaaatattttcaatgtaaggaaaacccacaagacatcttccaataaaagatccacatattctcggtatttgacttagcaaggaatcctgtgtcccatggccgtagcaagcacattgaaactaagtttcatttcttaagggatcaagttaacaaagggaggataaggttgaaacattgtgggccagatttgcaacttgctgatattatgacaaaggcgttgaaggctaatagattcaagttgctaagaaatatgctaggtgtggtgcatatttgatgtaatgttgttgtttgtataggaattaaaggggagtgttagaatagtaattcctattagtgatagttatttctttgttttagacacatgagatatgcagatcgagctagaacatgcgtatgtgtatgtaacttcatacctttcatagaat

SEQ ID NO: 3670 - DNA, 527 bp, Nicotiana tabacum
aaaataacacactttcaattctttgaactttctgcaacaatggctgccacaatgatgacttctctcccacagttcaatggactcaaacccaaaactttctcaacttctccagttcagggcttggtggcagttcaaccaatgaggcgtaaaggacatggcgctttgggagctcgctgcgatttcattggctcgcccacaaatttgataatggtgacttcaaccagcctaatgttgtttgctggtagatttgggttggcaccatcagcaaataggaaggcaactgcaggactaaagcttgaggtaagggactcaggcctacagactggggaccctgctggatttacacttgctgatactttggcttgtggtgttgttggtcacattattggtgttggggttgttcttggcctcaaaaatattggtgctatctaaaattgatttgtactactagacatctcatttatctctgtttatacccttaattaatcttttgtgaattattcctatttctagcatctttttctagc

SEQ ID NO: 3671 - DNA, 618 bp, Arachis hypogaea
agtggtatcaacgcagagtacggggggaattctttcaaagaaaaaaaaaaatagggagagcttagagattcaagtaatggcaaccacaatgatgaccactctccctcagttcaatggtcttagacccaaattctcagcagcccctgtgcagaacttggttgctgtccaacccatgaggcgtaaggggaagggtgctctaggaactcgctgtgatttcattggtcagaaaccaatctgattatggtggcttctacaacactgatgctgtttgccggaaggtttggattggctccgtcggcaaacaggaaagcgactgcagggctgaagctggaggtgagggactcaggcttacagactggtgacccagctggtttcacccttgctgataccttggcttgtggaactgttggccacatcattggtgttgggattgttcttggtcttaagaatacgggtgccttgtaaattaaaacaagaaaaatgaacaaccattcctgcataatgcacctgtaatcaagtttagtgtgcttttaattttctcatcacttgagaatgaacattgtatgcctcaaaaaaaaagaaaaaaaacaaaagtactctgcgttgataccactgctt

SEQ ID NO: 3672 - DNA, 571 bp, Prunus persica
aaataagaaagaaagagagagagagagagagagagagagacattgcagcacctcatcagcttctcacacaaaaaatctagcaaatggcagcagccactgtgaccacttctctcccccagttcaatgggctaaaatccaaagtctcatacgcaaatgtacaaagcctggcagcagttcaaccaatgaggcgcaagggccagggtgctttgggagctcgctgtgatttcattggctcacccaccaatttgataatggtgactactacaaccctaatgctatttgctgggaggtttgggttggccccatctgcaaacaggaaggcaacagcagggttgaagcttgagaccagggactctgggctgcagaccggtgacccagctgggttcactcttgctgataccttggcttgtggcactgtggggcacattattggggttggggttgttcttggccttaagaatattggttccctgtaattaattaaatcaaatttccaagcatttcaattttgtggtcttcaattttctttaactgatttgttccatgtccaaatcaaacaagaagttcgaat

SEQ ID NO: 3673 - DNA, 466 bp, Echinacea purpurea
gagggggaagaactgcatttgatctgcaaaaaatggcatcagttgtgatgacttcccttccacagttcaatggcctgaagccccaaacaacaactctctctcctgtcaggaatttggtagctgtacccatgagacgtaaaggacagggagctttgggtgcacgctgcgacttcatcggctcacccacaaatttgataatggttactgcgacgagtttgatgttgttcgctggtcgatttgggttggctccatcagcgaaccgaaaggcgacggccggtttgaaattggaggcaagagactcggggctccagaccggtgacccggccgggttcaccctagcggatacattggcatgtgggactgtgggtcatataattggggttggagttgtacttggcctcaagaacattggtgctatctaaaatttgtatctctgtttataaaccaaatcttttgtgaattactc

SEQ ID NO: 3674 - DNA, 683 bp, Arachis hypogaea
agtggtatcaacgcagagtacggggacaccagaattctttcaaagaaaaaaaaatagggagagcttagagattcaagtaatggcaaccacaatgatgaccactctccctcagttcaatggtcttagacccaaattctcagcatcccctgtgcagaacttggttgctgtccaacccatgaggcgtaaggcgaagggtgctctaggaactcgctgtgatttcattggttcagaaaccaatctgattatggtggcttctacaacactgatgctgtttgccggaaggtttggattggctccgtccgcaaacaggaaagcgactgcagggctgaagctcgaggtgagggactcaggcttacagactggtgacccagctggtttcacccttgctgataccttggcttgtggaactgttggccacatcattggtgttgggattgttcttggtcttaagaatacgggtgccttgtaaaacaagaaaaatgaacaaccattcctgcataatgcacctgtaatcaagtttagtgtgcttttaattttctcatcacttgagaatgaacattgtatgcctcaaatcttaatatatagttgctcccttcccccaaaaaaaagaaaaaaaacaaaagtactctgcgttgataccactgcttctgagactgccaaggcacacaggggataggcccccc

SEQ ID NO: 3675 - DNA, 606 bp, Arachis hypogaea
agcttagagattcaagtaatggcaaccacaatgatgaccactctccctcagttcaatggtcttagacccaaattctcagcatcccctgtgcagaacttggttgctgtccaacccatgaggcgtaaggcgaagggtgctctaggaactcgctgtgatttcattggttcagaaaccaatctgattatggtggcttctacaacactgatgctgtttgccggaaggtttggattggctccgtccgcaaacaggaaagcgactgcagggctgaagctcgaggtgagggactcaggcttacagactggtgacccagctggtttcacccttgctgataccttggcttgtggaactgttggccacatcattggtgttgggattgttcttggtcttaagaatacgggtgccttgtaaaacaagaaaaatgaacaaccattcctgcataatgcacctgtaatcaagtttagtgtgcttttaattttctcatcacttgagaatgaacattgtatgcctcaaatcttaatatatagttgctctctctaagactccaatggttggaccccaattaccaacacatcggaattgatgtgaactctattaaatccgctgacc

SEQ ID NO: 3676 - DNA, 543 bp, Nicotiana tabacum
ggccattacggccggggattcctaacaatacagaaactaacacacttccagttctttgaaatttctgcaacaatggctgccacaatgatgacttctctgccacagtttaatggactcaaacccaaaactttctcaacttctccagttcagggcttggtggccgttcaacctatgaggcgtaaaggacaaggcgctttgggagctcgctgtgatttcattggctcgcccacaaatttgataatggtgacttcaacaagcctaatgttgtttgctggtagatttgggttggcaccatcagcaaataggaaggcaacagcaggactaaagctagaggtaagggactcaggcctacagactggggaccctgctggatttacacttgctgatactttggcttgtggtgttgttggtcacattattggtgttggggttgttcttggcctcaagaatattggtgctctctaaaattgatttgtactactagacatctgatctatctctgtttatacccctaatcttttgtcaattattcctatttctagc

SEQ ID NO: 3677 - DNA, 596 bp, Solanum lycopersicum
ggccacaaactcttcataaacttctttccacacaactagatttataacaatttaaacatacaaaaacacaaagagattgaaaaataaaacacatattcattctttaataatcttagagtttttttttttgcaacaatggcttccaccatgatgactactctaccacaattcaatggactcaaaccccaacctttctcagcttctccaattcaaggcttggtggcaattcaaccaagacgcaacaaaggacaaggtggtttgggagctcgttgtgatttcattggctcatccactaatttgataatggtgacatcaacaagcctaatgttgtttgctggtagatttggtctagcaccatcagcaaacaggaaggcaactgcagggctaaaacttgaagtgagggactctgggttacagacaggggaccctgctggatttacacttgctgatactttggcttgtggtactgtgggtcatattattggtgttggagttgttcttggactcaaaaacattggtgctctctaaaatttgtattactccttatgtttataagaaaaacaaatcatcttttgtgaattattcatatttctatg

SEQ ID NO: 3678 - DNA, 581 bp, Solanum lycopersicum
ataacaatttaaacatacaaaaacacaaagagattgaaaaataaaacacatattcattctttaataatcttagagtttttttttttgcaacaatggcttccaccatgatgactactctaccacagttcaatggactcaaaccccaacctttctcagcttctccaattcaaggcttggtggcaattcaaccaagacgcaacaaaggacaaggtggtttgggagctcgttgtgatttcattggctcatccactaatttgataatggtgacatcaacaagcctgatgttgtttgctggtagatttggtctagcaccatcagcaaacaggaaggcaactgcagggctaaaacttgaagtgagggactctgggttacagacaggggaccctgctggatttacacttgctgatactttggcttgtggtactgtgggtcatattattggtgttggagttgttcttggactcaaaaacattggtgctctctaaaatttgtattactccttatgtttataagaaaaacaaatcatcttttgtgaattattcatatttctatgtacacttctttttcctaaatttggttgc

SEQ ID NO: 3679 - DNA, 425 bp, Triticum aestivum
gcaacaatggcttccaccatgatgactactctaccacagttcaatggactcaaaccccaacctttctcagcttctccaattcaaggcttggtggcaattcaaccaagacgcaacaaaggacaaggtggtttgggagctcgttgtgatttcattggctcatccactaatttgataatggtgacatcaacaagcctgatgttgtttgctggtagatttggtctagcaccatcagcaaacaggaaggcaactgcagggctaaaacttgaagtgagggactctgggttacagacaggggaccctgctggatttacacttgctgatactttggcttgtggtactgtgggtcatattattggtgttggagttgttcttggactcaaaaacattggtgctctctaaaatttgtattactccttatgtttata

SEQ ID NO: 3680 - DNA, 532 bp, Mesembryanthemum crystallinum
gaccatctaactcattagtagtgttggctaaacctagcatagcttcaatggcatctgctgtgatgacttctctgtctcttccacagttttctgggcttagagttagccctcagcactctacttcctctgtcaagagcttggcagtgtcttttccctctaagggtaaagggaacggagcattgggagcgaaatgcgaattcatcggttcatccaccaacttgataatggtgacttcaacaaccctaatgttgttcgctgggcgattcggattggccccatcagccaacaggaaagcaactgcaggactaaagttggaagcaagggattcagggttgcaaactggtgaccctgctggtttcacccttgcagatacattagcttgtggaactgttggtcacatcattggtgtaggagttgtcctcggtctcaagaatattggagctatctaagcttgtgtagcatttcttctttcttattgcattcaccatgtaaaactgtattatatacgtttgaagtaacattgttattttgc

SEQ ID NO: 3681 - DNA, 526 bp, Chenopodium quinoa
gtgaaagtagtagcatccctccatttttaagatctttcaaacaaacttcaacccactaacaatttaatttggtgaagttttggaaaataatactccgatagtttgaatggcatcagttgtgatgacttctcttccacacttcaccgggcttagaccccagcaagcttccttccctgttaagactttgtcatcaagtctgccaatgaggggcaaaggaaagggtgcattgggtgcacgatgtggtgatttcatcggctcatccactaacttgataatggtgacctcaacaacactaatgttgtttgctggaagatttgggctagcaccgtcagcgaataggaaagcaacagctggtttgaaattggaagtaagagactctggattacaaactggtgaccctgctggttttacacttgcagacactcttgcttgtggcactgttggtcacatcattggtgttggtgttgtacttggtctcaagaacatcggggctatttaatttaatgtcttcttatattatgtgttg

SEQ ID NO: 3682 - DNA, 550 bp, Chenopodium quinoa
gttgtgatgaaagtagtagcatcccaccatttttaagatctttgaaacaaacttcacccccactaaaaaatttgttgagctttaataatttgccattgatttggaaataattctttgaaacaatcttcaatggcatcagttgtaatgacttctcttccacacttcactgggcttagaccccagcaagcttctttccctgtcaaaagcttgtctgcaactctgccaatgaggggcaaaggaaagggtgcattgggtgcacgatgtggtgatttcatcggctcatccactaacttgataatggtgacctcaacaacactaatgttgtttgctggaagatttgggctagcaccgtcagcgaataggaaagcaacagctggtttgaaattggaagtaagagactctggattacaaactggtgaccctgctggttttacacttgcagacactcttgcttgtggcactgttggtcacatcattggtgttggtgttgtacttggtctcaagaacatcggggctatttaaatttaatgtcttcttatattatgtgttg

SEQ ID NO: 3683 - DNA, 886 bp, Prunus mume
caaaaccttatccaattgagtaaatccaatgggacaaagccaagtcagcaaccaggatcttggtgtatccaaatctaacattctgaagccacaagttgctcatgtggctgtgggtgcagactttctccctcaagagcttataatcttaggcattatggcctgcaaaagttcataaaattatcaaaaataagaaagagagagagagagagagagagagagagagacattgcagcacctcatcagcttctcacacaaaaaatctagcaaatggcagcagccactgtgaccacttctctcccccagttcaatgggctaaaatccaaagtctcatatgcaaatgtacaaagcctggcagcagttcaaccaatgaggcgcaagggccagggtgctttaggtgctcgctgtgatttcattggctcacccaccaatttgataatggtgactactacaagcctaatgctatttgctgggaggtttgggttggccccatctgcaaacaggaaggcaacagcagggttgaagcttgagaccagggactctgggttgcagactggtgacccagctgggttcactcttgctgataccttggcttgtggcactgtgggtcacattattggggttggggttgttcttggccttaagaatattggttccctgtaattaattaaatcaaatttctaagcatttcaattttaaggtcttcaattttctttaactaatttgttctttgtccaaatcaaacaacaagtttgaatctcgtccctcccgttgataagaacatacttaaaataggcataattttataggaattacgcgtttagatatgatcttactttatcgacaattataatcatggtaaaaaataaatttaacacggataaaagtt

SEQ ID NO: 3684 - DNA, 529 bp, Fraxinus spp
cataacttataatatttcaaaaatggcatcataatgaaaatatcacttgtgcaaaagggatattacatttattctttgatcaatttctaagctaagcaaaaatggctagtgccgtgattacttctctcccacaattcaatggtctcagattcgtaccagcatcagcttctcctgtcaaaagcttggttgctgctcaaccaatgaagcgtaaagggcagggagctttgggcgcacgctgcgatttcattggctccccaactaatttgataatggtgacttcaacaagcctgatgctgttcgctggtcggttcggtttggctccatctgcaaacaggaaggccactgcaggactaaagcttgaagtgagggactcggggcttcagacaggggatcctgctggtttcaccctggcagatacattggcatgtgggactgtgggtcacattatcggcgttggtgttgtacttggcctcaagacattggagccatctaaatttattttcactaaacctgttaatgactaaatatt

SEQ ID NO: 3685 - DNA, 492 bp, Triphysaria pusilla
ccccggatccttgtgttttgtgccttaaagaaaatggctacagctgttatcactacccttccacagttcaatggactcaagccccaatctgcctcagcttctcctttgaaaaacttggtagctgttcagcccatgaggcgtaaagggcagggcgctctaggcgcacgttgtgacttcattggctccccaactaatttgataatggttacttcgacaactttgatgttgtttgcgggtcggttcgggttggctccatctgcgaatcggaaggctacggctggattgaagttggagtctagggactcgggtttgcagacgggtgacccggcgggtttcacactggcggatacattggcctgtgggagttttggtcacattatcggggttggagttgtacttggtctcaagaacattggcgctatctaaatttattcatgttcataaattattgattgtaaaacattctatatagttctccatgcattctccttc

SEQ ID NO: 3686 - DNA, 446 bp, Ambrosia trifida
atggcaagtactgtcatgtcttctcttcctcaattcactggtttaaaagccacctcatcatcactttccccagttcaaagcatggtggcggtacaaccaatgaagcccaaggaaaagggagctttaggtgttcgatgtgatttcattggttcatcaacaaatttgataatggtgacatcaaccaccttgatgttgtttgctggacggtttgggttggcaccatcagcaaacaggaaggcgactgcagggctaaagctcgaggtgagggattcagggcttcaaaccggtgaccctgctgggttcacgcttgcagatacattggcttgtgggaccgttggtcacattattggtgttggtgttgttttaggcctcaaaaacattggtgccatctaaactagtttgttgtttgaaacatagtaacatgttaataacattgttattattgt

SEQ ID NO: 3687 - DNA, 608 bp, Phaseolus vulgaris
gccattagagacatcatagttcttctgcaaaccaaaccaacccacaaaacatttcaagaaaaaaagagaccaaacatattttcattttcctcttctcagttttaacaaatggcaaccactgctatgaccactctcccacaattcagtggtctcagaccccaattctcagctgcccctgtgcacaacctggttgctgtccaacccatgaggcgcaaggggaagggtgctttgggaactcgatgtgactacattggttcatccactaatctgattatggtggcttctacaagcctgatgctgtttgctggaaggtttggattggctccatcagcaaacaggaaagccactgcagggctaaagctggaggtgagggactcaggcttgcagactggtgaccctgctggcttcacccttgcagacaccttggcctgtggagctgttgggcacatcattggggttggggttgttcttggcctcaagaacattggtgctctgtaaaaaccaactatctgccttatgcatgcatctgtaatcaattaatcatctactttactctttctcaaccttaactcaatcttcagcttatcctctcccttctaaacacacac

SEQ ID NO: 3688 - DNA, 585 bp, Phaseolus vulgaris
gccattagatacatcatagttcttctgcaaaccaaaccaacccacaaaacatttcaagaaaaaaagagaccaaacatattttcattttcctcttctcagttttaacaaatggcaaccactgctatgaccactctcccacaattcagtggtctcagaccccaattctcagctgcccctgtgcacaacctggttgctgtccaacccatgaggcgcaaggggaagggtgctttgggaactcgatgtgactacattggttcatccactaatctgattatggtggcttctacaagcctgatgctgtttgctggaaggtttggattggctccatcagcaaacaggaaagccactgcagggctaaagctggaggtgagggactcaggcttgcagactggtgaccctgctggcttcacccttgcagacaccttggcctgtggagctgttgggcacatcattggggttggggttgttcttggcctcaagaacattggtgctctgtaaaaaccaactatctgccttatgcatgcatctgtaatcaattaatcatctactttactctttctcaaccttaactcaatcttcagctta

SEQ ID NO: 3689 - DNA, 649 bp, Bruguiera gymnorhiza
ggcagaattgcttgcttgctcacactttccatatctcaaagcttaaaaactatcaaaaggaggggaaaaggaaaatattagaattattccctgctcaatttgcaatcagactagcaaatggcagccgctatgatgaccactctcccacaattcaatgggctcagaccacagctcttagctgcccctgcaaaatccctgggagcagtccaacccatgaggcgaaagggaaatggagccctgggtgctcgcatggatttcattggttcacccactaacttgataatggtgaccagcaccagcctaatgctatttgctgggagatttgggctggctccatcggcaaacaggaaggccactgcaggactgaagcttgaagtgagggactctggcttacaaactggtgacccagctggttttacccttgctgacaccttggcatgtgggactgttggtcacatcattggtgttggaattgttcttggccttaagaacatcggtgcactgtaaagagaacaaacaaaagcaacgttccaatcctttcaatctaatggtctatgttcattctcactttttcagcatctcttggggacagctggtaggagttggtgaacttgattgctgtgaaagtgaatgttctctgacaagctct

SEQ ID NO: 3690 - DNA, 635 bp, Nicotiana benthamiana
tggccatgccacagaaacttctttccaccagaaaagggtttataacaatttaaacaaacaaaatcaacaaatatagaaaataacgcatttccaattctttgaaatttctgcaacaatggctgccacaatgatgacttctttgccacagttcaatggactcaaacccaaaactttctcaacttctccagttcagggcttggtggccgttcaaccaatgagacgcaaaggacaaggcgcgttgggagctcgctgtgatttcattggctcccccacaaatttgataatggtgacatcaacaagcctaatgctgtttgctggtagatttgggttggcaccatcagcaaacaggaaggcaacagcagggctaaagctagaggtaagggattcaggcctacagactggggaccctgctagatttacacttgctgatactttggcttgtggtgttgttggtcacattattggtgttggggttgttcttggcctcaagaatattggtgctctctaaaaaggatttgtactactagacatttgatctatctctgtttatacctctaattaatcttttgtgaattattcctatttctagcatctttttctagctagctcaattacacttttcttttctttttgaa

SEQ ID NO: 3691 - DNA, 744 bp, Tabernaemontana elegans
gctatggtacgccacagcttttcttagcaaatttataacacttttcatggacacaaatggtgaaattatcaaccaaaagaagccattttagatctttgatcatcactttcttcaagtttttgcacaatggcttctgccatgatgacttctcttcctcagttcaatggcctcacgcccatgactttctcagcttcccctgtgcaaggcctggtcgctgctcaaccaatgaagcgcaaaggacagggagctctaggcgctcgctgtgacttcattggctcaccaacaaatctgataatggtgacttcaacaagcctgatgctctttgctggtagatttggcttggctccatctgcaaacaggaaggccactgccggcctaaaactcgagattagggattccggcctacagaccggcgatcctgctggttttacccttgctgataccttggcatgtgggactgtaggccacataattggtgttggagttgtacttggcctcaaaaacattggtgttctctaaatttgttcataaatctctgcaataacaatcttttctcacttcatctttgtagcagtttcttggctttgcgtctctgtaacttcatcaatttcatttctcatttgcatatacagttctagcaaatgtacagaaccattatgaacatactttagttgagctcctgcaattgatcttcaggcattcaatgacaaaacaaaatatataaagattgaatcttgttgttat

SEQ ID NO: 3692 - DNA, 602 bp, Triphysaria pusilla
cacacaataatcagcatttgatcaaatctagctcaggaaaagaaaatggctactgctgttatcactacccttccacagttcaatggactcaagccccaatctgcctcagcttctcctttgaaaaacttggtagctgttcagcccatgaggcgtaaagggcagggcgctctaggcgcacgttgtgacttcattggctccccaactaatttgataatggttacttcgacaactttgatgttgtttgcgggtcggttcgggttggctccatctgcgaataggaaggctacggctggattgaagttggagtctagggactcgggtttgcagacgggtgacccggcgggtttcacactggcggatacattggcctgtgggagttttggtcacattattggggttggagttgtacttggtctcaagaacattggcgctatctaaatttattatttatgttcataaattattgattgtaaaacattccatatagttctccatgcattctccttcgactcttaactttgaatgaatgttgtttgtttataaaattaaattaatattattattgaatatcatatgagatatagaatgaattaaaaattaag

SEQ ID NO: 3693 - DNA, 623 bp, Triphysaria pusilla
tcctggaacttataacacacttgcatcacaaacaataatcagcatttgatcaaaatcaagttcaggaaaaaataaataattaaagtaaaagaaaaatggccactgctgttgtgactacccttccacagttcaatgggctcaaaccccaatcagtatcagcttctcccctgagaaacttggtagctgttcagcccatgaggcgtaaagggcagggcgctctgggcgctcgttgtgacttcattggctcgccaacaaatttgataatggttacttcgacaactttgatgttgtttgcgggtcggttcgggttggctccatctgcgaataggaaggctacggctggattgaagttggagtctagggactcgggtttgcagacgggtgacccggcgggtttcacactggcggatacattggcttgtgggagttttggtcacataatcggggttggagttgtacttggtctcaagaacattggcgctatctaaatttatttatgttgataaattattgattgtaaaacattctatatagttcgccatgcattctccttcgactcttaactttgaatgaatgttgtttgtttataaatttaaattaatattattatttgaatatcatat

SEQ ID NO: 3694 - DNA, 642 bp, Triphysaria pusilla
ctcaagtgtatccaaataatgcacaaactctctgtggctatggcacaactagattttctttcatcctgcaacttataatacacttgcatcacaaacaataatcagcatttgatcaaaatcaagttcaggaaaaaataaataaataaagtaaaagaaaaatggccactgctgttgtgactacccttccacagttcaatgggctcaaaccccaatcagtatcagcttctcccctgagaaacttggtagctgttcagcccatgaggcgtaaagggcagggcgctctgggcgctcgttgtgacttcattggctcgccaacaaatttgataatggttacttcgacaactttgatgttgtttgcgggtcggttcgggttggctccatctgcgaataggaaggctacggctggattgaagttggagtctagggactcgggtttgcagacgggtgacccggcgggtttcacactggcggatacattggcctgtgggagttttggtcacattattggggttggagttgtacttggtctcaagaacattggcgctatctaaatttattatttatgttcataaattattgattgtaaaacattccatatagttctccatgcattctccttcgactcttaactttgaatgaatg

SEQ ID NO: 3695 - DNA, 665 bp, Juglans hindsii x Juglans regia
  misc_feature (618)..(618): n is a, c, g, or t
ataaattagagaaaggagagagatattgggtattgtaagaacaaattttcaattgggattggaaaatggcaactactgtgatgacttctctcccacaatatagtgggctaagaccccaaatctcagcagctcctgtccgaaccctggcagcagttcaaccaatggggcgtaagggaaagggagctttgggtgctcgctgtgattacattggatcacccacaaatttgataatggtggcttctacaagcctgatgctatttgctgggaggtttgggttggcaccatcagcaaacagaaaggcgacggcaggactgaagcttgaagtgagggactccggcctgcagacaggtgacccagctggtttcactcttgcagataccttggcatgtggatcagttggtcacattattggggttggggttgttcttggccttaaaaacattggtgcactgtaaaattatctttaaatatcttctcctcttttgactgatctctttatgttgttctttgtttacaatgtgtacttggattaagaactcctaaaaaatgtgtttgctggtgttgaatcgttcattgtggaaacaacgggtgaattgatatgtacttatgccactcatnaaccaacaatggtgtgttaccaactgtggtatcacagaaacaatttc

SEQ ID NO: 3696 - DNA, 609 bp, Gossypium raimondii
agaaaagatcagagagagggtgagaggcaccttgtaattgtcttgaaccaattctgattatctcttgcatactatcaaatggcagctactgcagcaatcaccactctcccccagttcagtgggttaagacccaaagtttctactgctccagttaggagcctggcagcagttcaaccaatgaggcgcaaggggaagggtgctctcggtgctcgatgtgatttcatcggatcccccacaaatttgataatggtgactacaacaaccctgatgctgtttgctgggaggtttgggttggctccatcagcaaacagaaaggccaccgctggattgaagcttgaagtaagggactcaggcttgcagactggtgaccctgctggttttacacttgctgacactttggcttgtggtgttgttggccatatttttggtgttgggatcgttcttggtctcaagaacattggtgctctgtgatgtaaaatgtaactgagtactcttcttttgctgcaaattatgcttaaaatttgtaacaatttacttattccgaaaacgacactggcctctgtctttcaatataaaagccacttgctagttaaacaaagcaatttctcc

SEQ ID NO: 3697 - DNA, 743 bp, Amsonia hubrichtii
tagcttttcctatcaaatttatatcacttttcttagatagaaatggcgaaattatcaaccaaaaaagaagccattttagatctttgatcatcagtttcttgaagttttcgcacaatggcttctgccatgatgatgacttctcttccacagttcaatggcctcgggcacaagactttctcagcttcccctgtgcaaagcttggttgctgctcaaccaatgaagcgcaaaggacagggagctctaggcgctcgctgtgacttcattggctcaccaacaaatctgataatggtgacttcaacaagcctgatgctctttgctggtagatttggcttggctccatctgcaaacaggaaggccacagcaggtctaaaactggagagcagggactctgggctgcagaccggtgatcctgctggtttcacccttgctgataccttggcatgtgggactgtaggccacattattggtgttggagttgtacttggactgaaaaacattggtgctctctgaatttgttcataaatctctgtaataacaatcttttcccacttcatctttgcagcagtttcttggctttgaatctttgtagtttcatcaattttcatttgctcatacgattctaggaaaatgtacagaaccatatgaaaacataatttaatggacaaactttagttcagctccagggattgatctccaggcattcaatgacaaaatagataatataaaagttgtatttggttctc

SEQ ID NO: 3698 - DNA, 601 bp, Cicer arietinum
aacaatcaaaggaaccttgaaaatcacttgtttgagtaaagtggtagtagctcagagatagcaagaaattaagagagattcaaaacacaaattttatttttcactttcctctcatagttttaacaaatggcaacttctatgatgaccactttccctcaattcactggtcttagaccacaattctcggcttctcctgtccagggtttggtggccgtccaacccatgacaaggcgcaaggggaagggtgctttgggagttcgctgtgacttcattggttcatccactaatttgattatggtggcatctacaaccttaatgttgtttgctggaagatttggattggcaccctcagcaaacaggaaagcaactgcaggactaaagcttgagacaagggactcaggcttgcagactggtgatccagctggtttcactcttgctgatactttggcatgtggaagttttggccacattattggtgttggtgtggttcttggtcttaagaacattggtgctttgtaaaaaatggaaaaaatactatgttgtgaacttgtgttgtatctgtaatcagttttaatgtacttttattttgtatctgagactt

SEQ ID NO: 3699 - DNA, 638 bp, Cicer arietinum
ggaaccttgaaatcacttgtttgagtaaagtggtagtagctcagagatagcaagaattaagagagattcaaaacacaaattttattttctacttccttcctcatagttttaactaaatggcaacttctatgatgaccactttccctcaattcactggtcttagaccacaattctcagcttctcctgtccagggtttggttgccgtccaacccatgacaaggcgcaaggggaagggtgctttgggagttcgctgtgacttcattggttcatccactaatttgattatggtggcatctacaaccttaatgttgtttgctggaagatttggattggcaccctcagcaaacaggaaagcaactgcaggactaaagcttgagacaagggactcaggcttgcagactggtgatccagctggtttcactcttgctgatactttggcatgtggaagttttggccacattattggtgttggtgtggttcttggtcttaaaaacattggtgctttgtaaaaaatggagaaaaaaaaataactatgttgtgaacttgtgttgtatctgtaatcagttttaatgtacttttatttttgtatctgagacttcacctttactgtttcttaatctttagtttctaccctcaca

SEQ ID NO: 3700 - DNA, 706 bp, Gossypium hirsutum
atggaccttttaatctaaacctgaaatcaaactagaaaagatcagagagagggtgagaggcaccttgtaattgtcttgaaccaattctgattatctcttgcatactatcaaatggcagctactgcagcaatcaccactctcccccagttcagtgggttaagacccaaagtttctactgctccagttaggagcctggcagcagttcaaccaatgaggcgcaaggggaagggtgctctcggtgcacgatgtgatttcatcggatctcccacaaatttgataatggtgactacaacaaccctgatgctgtttgctgggaggtttgggttggctccatcagcaaacagaaaggccaccgctggattgaagcttgaagtaagggactcaggcttgcagactggtgaccctgctggttttacacttgctgacactttggcttgtggtgttgttggccatatttttggtgttgggatcgttcttggtctcaagaacattggtgctctgtgatgtaaaatgtaattgagtactcttcttttgctgcaaaattatgcttaaaatttgtaacaatttacttattcctaaaacgacactgtcctctgtctttcaatataaaagccacttgctagttaaacaaagcaatttctccatcaacattattagctcgcagtttcaggatcaaaatgttaggggatgaaactatgtttttctt

SEQ ID NO: 3701 - DNA, 916 bp, Gossypium raimondii
atggacctttttaatctaaacctgaaatcaaactagaaaagatcagagagagggtgagaggcaccttgtaattgtcttgaaccaattctgattatctcttgcatactatcaaatggcagctactgcagcaatcaccactctcccccagttcagtgggttaagacccaaagtttctactgctccagttaggagcctggcagcagttcaaccaatgaggcgcaaggggaagggtgctctcggtgcacgatgtgatttcatcggatctcccacaaatttgataatggtgactacaacaaccctgatgctgtttgctgggaggtttgggttggctccatcagcaaacagaaaggccaccgctggattgaagcttgaagtaagggactcaggcttgcagactggtgaccctgctggttttacacttgctgacactttggcttgtggtgttgttggccatatttttggtgttgggatcgttcttggtctcaagaacattggtgctctgtgatgtaaaatgtaattgagtactcttcttttgctgcaaaattatgcttaaaatttgtaacaatttacttattcctaaaacgacactgtcctctgtctttcaatataaaagccacttgctagttaaacaaagcaatttctccatcaacattattagctcgcaatttcaggatcaaaatgttaggggatgaaactatgtttttcttgtgtgtcaaataaaggaactttcattactaaaatttaaaacgaaacagtagcacgatagacaaagcgtccagcaatatcaaaattgacaaagctgcacatttaaagaaggtagttcgaaatacacaacaatcacagctattaccctctcagaagatgtgaacgaggtgactatgctggaaggtcgccaataaagtcctgcaacagataa

SEQ ID NO: 3702 - DNA, 610 bp, Rosa hybrid cultivar
aaaaaacaaagagagacttttgtagactcctaacatcagttgtgattagaaaatggcagcagctactgtgactacttctctcccccagttcagtgggttgagacccaagatctcatccaatgtacagagcttggctgctgttcaaccaatgaggcgcaagagccaaggtgccttgggagctcgctgtgatttcatcggttcacccaccaatttgataatggtgactactacaagcctaatgttgtttgctgggagattcgggttggcgccatctgcaaacaggaaggcaacagcaggattgaagcttgaaataagggactcagggcttcagaccggtgacccagctgggttcacccttgctgataccttggcttgtgggactgtgggtcacatcattggggttggggttgttcttggccttaagaacattggtgctctgtaaaaagtaatgtgaattcaaatttacgagtatttaatttcaaggttctttgctttcttcctctgctaacaaaaaaaaaaaaaacaaaaaaaaaaaacaaaaaaaaaaaacaaaaaaaaaaacaaaaaaaaacaaaaaacaagacatatctctctctccgcgcgcgcgacg

SEQ ID NO: 3703 - DNA, 543 bp, Lupinus angustifolius
agattcactttcatggtatcaacgcatagtgactgattaaggtatagagattcaacaatctattctcctttttgagttttaacaaatggcaacctctttgatgacaactcttcctcaattcaatggccttagacccagttcctcagcaacaccggtgcaaaacttggttgctgtacaacccatgaggcgcagagggaagggtgctttgagtgttcgttgtgacttcattggttctccaactaatctgattttagtggcttctacaagcataatgctgtttgctggaagatttggattggctccatcagcaaacagaaaagcaactgcagggctaaagcttgaagtgagggactcagggttgcagactggtgacccagctggattcacccttgctgatacattggcctgtggaactgttggccacatcattggagttggagttgttcttggccttaagaacattggtgccatataaataaaaacaatgaagtttcatgcatgatgtatctttagatttttatcaattttaatgtcctttatttt

SEQ ID NO: 3704 - DNA, 444 bp, Triphysaria pusilla
aatggctacagctgttatcactacccttccacagttcaatgggctcaagccccaatctgcctcagcttctcctctgaaaaacttggtagcagttcagcccatgaggcgtagaggacagggcgctctgggcgctcgttgtgacttcattggctccccaacaaatttgataatggttacttcgacaactttgatgttgtttgcgggtcggttcgggttggctccatctgcgaatcggaaggctacggctggattgaagttggagtctagggactcgggtttgcagacgggtgacccggcgggtttcacactggcggatacattggcttgtgggagttttggtcacataattggggttggagttgtacttggtctcaagaacattggcgctatttaaatttatttatgttcataaattattgattgtaaaacattccatatagttct

SEQ ID NO: 3705 - DNA, 552 bp, Triphysaria pusilla
cgcacaccatattttatttcctcttgcaactcataacacttgatgaactacacacaataatcaacatttgatcaaatctagttcaggaaaagaaaatggctactgctgttatcactacccttccacagttcaatgggctcaagccacaatctgcctcagcttctcctctgaaaaacttggtagcagttcagcccatgaggcgtagaggacagggcgctctgggcgctcgttgtgacttcattggctccccaacaaatttgataatggttacttcgacaactttgatgttgtttgcgggtcggtttgggttagctccatctgcgaatcggaaggctacggctggattgaagttggagtctagggactcgggtttgcagacgggtgacccggcgggtttcacactggccgatacattggcttgtgggagttttggtcacataattggggttggagttgtacttggtctcaagaatattggcgctatctaaatttattatttatgttcataaattattgattgtaaaacattctatatagttctccatgcattct

SEQ ID NO: 3706 - DNA, 801 bp, Phaseolus vulgaris
gtattgcactgcatgctacatcacattccctctgcaaccaaaccaacccagaaaacatttcaaagaaaaaggagagtttagggagaagagaccaaacatattttcatttcctcttttcagttttaacaaatggcaaccactgcgatgaccactctcccccaattcactggtcttagaccccaattctcagctgtccctgtgcagagtttggttgctgtccaaaccatgaggcgcaaggggaagggtgcattgggaactagatgtgactacattggatcatccactaatctgattatggtggcttctactagcctgatgctgtttgctggaaggtttggattggctccatcggcgaacaggaaagccactgcagggctaaagctggaggtgagggactcaggcttgcagactggtgaccctgctggcttcacccttgctgacaccttggcctgcggagctgttggccacatcattggggttggggttgttcttggactcaagaacattggtgccctttaaatagcaacaaccagtttagtaccttatatatatgctgcatctgtaatcaatttatcatcatctactttattttcacttcactctttctcaaccttaacctaaatcttcagcttatcccctcccttctaaacacagaaaaaaatataactgtgatgaaacaagtgatcaaatgttcccccatcagcatcagtggcaaaatgcatttgaattgctaccaattatgaacctgcatcatgcaacttcaaggactcaatataaaaagtacgaatacaggaagcaata

SEQ ID NO: 3707 - DNA, 1024 bp, Phaseolus vulgaris
tgtctgtagcatgaggccacacgaaatccttagcccaaaaacacgtttaaaagagaagacatagaatttagacagattcacggtggcatctatgacattatccgttatccgtttctcaaatcagataatgccacctcggactcacgtatcttggtcatctcattctgggcttctgaggccacaaattcctcatgtgatcactgccattagatagtattgcactgcatgctacatcacattccctctgcaaccaaaccaacccagaaaacatttcaaagaaaaaggagagtttagggagaagagaccaaacatattttcatttcctcttttcagttttaacaaatggcaaccactgcgatgaccactctcccccaattcactggtcttagaccccaattctcagctgtccctgtgcagagtttggttgctgtccaaaccatgaggcgcaaggggaagggtgcattgggaactagatgtgactacattggatcatccactaatctgattatggtggcttctactagcctgatgctgtttgctggaaggtttggattggctccatcggcgaacaggaaagccactgcagggctaaagctggaggtgagggactcaggcttgcagactggtgaccctgctggcttcacccttgctgacaccttggcctgcggagctgttggccacatcattggggttggggttgttcttggactcaagaacattggtgccctttaaatagcaacaaccagtttagtaccttatatatatgctgcatctgtaatcaatttatcatcatctactttattttcacttcactctttctcaaccttaacctaaatcttcagcttatcccctcccttctaaacacagaaaaaaatataactgtgatgaaacaagtgatcaaatgttcccccatcagcatcagtggcaaaatgcatttgaattgctaccaattatgaacctgcatcatgcaacttcaaggactcaatataaaaagtacgaatacaggaagcaatactatttatag

SEQ ID NO: 3708 - DNA, 502 bp, Manihot esculenta
ttacatcccaaaagaatttgtaaaattatcagataaaaggagaaaactacttgcagtttgctgttctgtgagcaaatggcagcctctatgatgaccactctccctcaattcaatgggctaaaaccccagatctcagttgctcctgtgaaatccgtggcagcagttcaacccatgaggagaaagggaaatggagctttgggagctcgcatggatttcattggttcacccacaaatttgataatggtgacaacaacaagcctgatgctatttgctgggagatttgggttggcaccatcagcaaacaggaaggcaactgcaggattgaagcttgaagcaagggactcagggttgcaaactggagacccagctggtttcactcttgctgatactttggcttgtgggactgttggtcatattatgggtgttgggattgttcttggcctcaagaaccttggtgctctgtaaaaattaaaattaaaaataatgatcttttgaacatctc

SEQ ID NO: 3709 - DNA, 552 bp, Vigna unguiculata
gacaaaacatttcaagaaaaaggagactcagagagaagaaaccaaacatattttcattttcctcttcttagttttaacaaatggcaaccactgcaatcaccactcttccccaattcactggtctcagaccccaattctcagctgcccctgtgcagaacttggttgctgtccaacccttgaggcgcaagggaaagggtggtttgggagttcgatgtgactacattggttcatccactaatctgatcatggtggcttctacaagcctgatgctgtttgctggaaggtttggattggctccatcagcaaacaggaaagcgactgcagggctaaagctggaggtgagggactcagggttgcagactggtgatcctgctggtttcactcttgcagacaccttggcctgtggtactgttggccacatcattggggttgggattgttcttggtctcaagaacattggtgcaatttaaacattcccttcactgaatctgtaatcaattactcatctactttattttccctctttcttctttctcaaaaaaaaaaaaaaaa

SEQ ID NO: 3710 - DNA, 1265 bp, Mimulus guttatus
gggaaataaatagataaaataaataaattgtgtagtatattatcaccttttgtttaggagggaaaaaaaaaaaaaacaagtccagtaatacatcataatcttatccagtagttatcatccaataataaactgccatgtcagcagcaagtatctgaagtgtatccaatgctctgctattctgaggccacaaactcctcgtgtggctaagcttataacactttcaatttatttaataatacaatcacttaagtgaaaaataatatttgagagactgcattttcaggggaaaaaagaaaagaaaagaaaaaaatggcatctgctgtgatgacttctcttccgcagttcaatgggctgaaaccccaaattgcccctgcttctcctgtgaaaagtttggtagctgttcaaccaatgaggcgtagagggcagggtgctttgggcgctcgttgtgatttcattggctcacctacaaatttgataatggtgacgtcaactagcctgatgctgttcgcgggtcggtttggattggctccatcagcgaaccggaaggcgacagcgggtctgaagctggaggcgagggattcgggtctgcaaacgggtgacccggcgggtttcacactggcggatactttgggctgtggggttgtgggtcacattattggggttggggttgtattgggcctcaagaacattggtgccctctgaattttatgttattaatttattaattaatattgtgaatcgtttgtgaatcattttttactttttaattattgcctcattctctctattttatatttggaaaagaaaatttaaatatatgataattcaattgtataaacaaatttaaattatacaatattaaaataattaattgtgaaattcaaattaccaaaataagtataacatcaaaatcaatttaaattaggtcggcaaaacaaaaaaaaaataaaaaatccacagtgcgtgtgttagcgagagagattttattttactcctttgataattaaagtataaattctttacatgggtgtgtgtaaaagaagggttaactgagaaattacaaaacaataaaatgatttgctaagaaagtaaaaaaaagaaaaactttaaaatatgagatgaaaaaaaaataataacaattaatttaataaaaatttataaatatatatgtcattagagcttcatgaattattagagtttcatgagttatcctaacgtttttagtttatatataaaagataattataaattttaactaatttttt

SEQ ID NO: 3711 - DNA, 591 bp, Olea europaea
acgggttacatttattcttcgaccaaattctaagcaaagcaaaaatggctagtgcagtgatgacttctctcccacaattcaatggtctcagactcaaaccagcatcagcttctcctgtcaaaagcttggtagccgctcaaccaatgaagcgtaaagggcagggagctttgggcgcacgctgcgatttcattggctccccaacgaatttgataatggtgacttcaactagcctgatgctgttcgccggtcggtttggtttggctccatctgcaaacaggaaggccactgcaggactaaagcttgaggtgagggactcgggccttcagacaggggatcctgctggtttcaccatagcagatacattggcatgtgggagtgtgggtcacattattggggttggcgttgtacttggtctcaagaacattggagtcatctaaatttaattcttcacgaacctgttaataactaaatattttgtgttaaactccatcaatctgcagtagtaatttcttctggctacaaaaaaaaaaaaaaaaaagaaaaacccaacaaggagggaaaaaaccgaggattcgggtttggctttcccaa

SEQ ID NO: 3712 - DNA, 722 bp, Lippia dulcis
atttacacttgatcacggataaaataatcactgggaaaagcactgcttttgacaggttctctttctgctactaaggaaaaaatggctactgctgtcatgacttcaattccacagttcaatgggctcaaagcgcagcccggatcagtttctcctgtgaaaaacttggtagctgttcgacccagtcttcgcaaatcgaggagagctctgggagcccgctgcgattttattggctcctccaccaatttgatcatggttacctcgacaagcctgatgctgtttgctggccggtttggattggctccgtcggcgaaccggaaggcaaccgcagggctaaagctggaagcaagagactcgggtctccagaccggtgacccagccgggttcaccttggctgatacgctggcttgcggaactgtgggtcacattattggggttggggttgtacttggcttgaagaacattggtgctatttaagtttctgttaatactatcaattagtatctctgttgtgaaatgacgtttacataataacttttatggcattttccttctttttatttataattgcatggggattcaatttgggtgaaggggcttaatctttgttcacgtggtaaaaccttgattttgagagatgttgaaatggcgcaacgaatctatatgtgttgttgttttttgcttgtaatctcgtagggtgcgttaaatctcacttgagaattggt

SEQ ID NO: 3713 - DNA, 681 bp, Senecio madagascariensis
agcgtggtcgcggccgaggtacgcgggggtcacaaatccatttttcaaactcaagaatcaaagtttttttcaacatcaaaaaaattataaaaaaaaatggcaactgctgttatgacttctcttcctcaattcactggtttaaaagccagttcaccatcagtttcccaagttcaaaacatggtagcattaccaatgaaacccaagggaaagggagctttaggtgttcgttgtgatttcatcggatcatcgacaaatttgataatggtgacatcaacaaccttgatgttgtttgctggtcgatttggattggcaccatccgcaaacaggaaggcaaccgcagggctaaagcttgaggttagggattcaggtcttcaaaccggtgaccctgctggcttcacacttgcggatacattggcttgtgggactgttggtcacattattggtgttggtgttgttttgggtctcaagaacattggtgccatctagtttcgttcttttgaaacaaagtatcatgttaataacaatttcgtgattgtcttcttttttgtattaatgtctatttggtttgagtttaatacgtttatgtaaaggttgttaaccactaatactaatatgcacataacaaaatcaaagaaaaatatgattcaaaaaaagtcgcgccgaaaactaataaacaaacta

SEQ ID NO: 3714 - DNA, 649 bp, Triphysaria pusilla
cgcacaccatattttatttcctcttgcaactcataacacttgatgaactacacacaataatcaacatttgatcaaatctagttcaggaaaagaaaatggctactgctgttatcactacccttccacagttcaatgggctcaagccccaatctgcctcagcttctcctctgaaaaacttggtagcagttcagcccatgaggcgtagaggacagggcgctctgggcgctcgttgtgacttcattggctccccaacaaatttgataatggttacttcgacaactttgatgttgtttgcgggtcggttcgggttggctccatctgcgaatcggaaggctacggctggattgaagttggagtctagggactcgggtttgcagacgggtgacccggcgggtttcacactggcggatacattggcctgtgggagttttggtcacattatcggggttggagttgtacttggtctcaagaacattggcgctatctaaatttattcatgttcataaattattgattgtaaaacattctatatagttctccatgcattctccttcgacttttaactttgaatgaatgttgtttgtttataaaattaaattaatattattattgaatattatatgagatatagaatgaattaaaaattaag

SEQ ID NO: 3715 - DNA, 511 bp, Ambrosia trifida
agaactcaccatcttccaaactcatatcaacgatggcaagtgctgtcatgtcttctcttcctcagttcactggtttaaaagccacctcaccatcacttccccagttcaaagcatggtggcactgcaaccaatgaagcctaagggaaagggagctttaggtgttcgatgtgatttcattggttcatcaacaaatttgataatggtcacatcaaccaccttgatgttgtttgctggacggtttgggttggcaccatcagcaaacaggaaggcgaccgcagggctaaagcttgaggtgagggattcagggcttcaaaccggtgaccctgctgggttcacgcttgcagatacattggcttgtgggaccgttggtcacattattggtgttggtgttgttttgggcctcaaaaacattggtgccatctaaactagtttgttgtttgaaacatattatcatgttaataacattattattattgtcttccttttgaaaaaagaaaaagtaccgactgcg

SEQ ID NO: 3716 - DNA, 550 bp, Glycine max
ttttttttttttttttttttgagttttaacaaatggcaacaaccactgtgatcatgaccactctcccccaattcagtggtcttagacctcaattctcagctgcccctgtgaagaacttggttgctgtccaacaacctatgaggcccaaggggaagggtgctttgggagctcgatgtgactacattggttcatccactaatctgattatggtggcttctacaaccctgatgctgtttgctggaaggtttggattggctccatcagcaaacaggaaagccactgcagggctaaagctggaggtgagggactcaggcttgcagactggtgaccctgctggcttcacccttgctgacaccttggcctgtggatctgttggccacatcattggggttggggttgtccttggtctcaagaacattggtgccctgtaaatgagcaactataatcaaatttagtgcttgttacatcagtaatcaatgttattatgtactttattttcacatcactcttcagtcttccctcaaccttacttaatctttagcttctccct

SEQ ID NO: 3717 - DNA, 1219 bp, Populus trichocarpa
cagaatgccaggcaacatcagcttaaaagatgattagccattatatttacattaaccgtaggactaattttcctagtttgggtaagacagatatcttgccaacaagctcagcaagaaaccttatccaactgagcagtcctatagccgaatgccaagtcagctacctgtatctaagtgtatccattcctaacgttctgaagccacaagagcaatttgtggctatggtcttttagatcccaaattgtactataaataaatttaaaaaaaattataaaataagggaggagagtggttttcctgggtcaatttttttcattcaaagaagcaaaaatggcagccactaccatgatgactgctactgctctcccacaattcagtggcctgagaccctcagctgcccctgtaaaatccctggcagctgttcagcctacaaggcgaaagggaaatggagccctgggtgctcgtatggatttcattggttcgcccacaaatttgataatggtaactagcacaagcctcatgctatttgctgggagatttgggttagccccatcagcaaacaggaaggcaactgcaggattgaagcttgaagtgagggactcgggcttacaaactggcgatccagctggtttcactcttgctgataccttggcatgtgggagtgttggtcacataattggtgttggagttgttcttggtcttaagaacattggtgcattgtaaaaatctttataagcatcttgatcgaagtactttgcttttaattctgtctctgccgttttcctccccatgtaaatgcttctttgtctgatattttgaggaacagcttgtcgtcaactatcaaattttgttcaacatcaagttaagagaacatcctacatggctaaagagtgaagaccaaagaaaaaaactgagaaaaaatgaagctgcaaatagcctaaaaactgttaaaatatagcttgtatattagtatattaggtagttaaataggctatttttatacaaatgccctggtggttcatatacagattatgaaaatacttttggtattatcatcaatttataatttatatatacatcaaataatgttaagataactttcctatgaattagatgaagaggcctatatgaaataactagagggttttgctctaccaaaaaataaatataaagtctgaaaattgattaaatttctatattgattgaaaaaggcacctaa

SEQ ID NO: 3718 - DNA, 933 bp, Glycine max
cagataatgccacgtcggagtcatgtatctttggccatctcatattggctttccgaggccacaaattgctcatgtggctgccattagatacgcatattgcatgttacatcataaccgttagcaaccaaagaaaaaggagagtgcttagagacagcagaacatattatcatttcctcttttttttttttttttttttttgagttttaacaaatggcaacaaccactgtgatcatgaccactctcccccaattcagtggtcttagacctcaattctcagctgcccctgtgaagaacttggttgctgtccaacaacctatgaggcccaaggggaagggtgctttgggagctcgatgtgactacattggttcatccactaatctgattatggtggcttctacaaccctgatgctgtttgctggaaggtttggattggctccatcagcaaacaggaaagccactgcagggctaaagctggaggtgagggactcaggcttgcagactggtgaccctgctggcttcacccttgctgacaccttggcctgtggatctgttggccacatcattggggttggggttgtccttggtctcaagaacattggtgccctgtaaatgagcaactataatcaaatttagtgcttgttacatcagtaatcaatgttattatgtactttattttcacatcactcttcagtcttccctcaaccttacttaatctttagcttctccctttccctcctatatatctatatatatatatatatatatatatatagttaaaaaatagtttaatgtttatgtattgacaaaataattttacagtattatttaattagtattatccaattacaaataatcgtttgaatcattttaagataattattttaaaaattagcaaatgtattatataaattatgattatatgtaaaaaaattt

SEQ ID NO: 3719 - DNA, 575 bp, Flaveria ramosissima
aagaataatggcagccagtgtcatgtcctctcttcctcagttcactggtttaaaagcgagttcatcatcactctccccggttcaaaacatggtagcagtgcaaccaatgaaaccaaagggcaagggaaaaggtgctttaggtgttcgttgtgatttcattggctcatcaacaaatttgataatggtgacatcaaccaccttgatgttgtttgcgggacgatttgggttggcaccatcagcaaacaggaaggcaactgcggggctaaagctcgaggtgagggactccggacttcaaactggcgaccctgctgggtttacacttgctgatacattggcttgtggaaccgttggtcacattatcggtgttggtgttgttttggggctcaaaaacattggtgccatataaagtggtttgttgtttgtaaacaaagtatcatgttaataacattgttgtaattgtttccttacaaattactgtttgagtttgaatactataaacaagaatattggcttaaggtaacatgtagtggtgccaatcgttgtcgggcttgggttgatatcaccagatccggaac

SEQ ID NO: 3720 - DNA, 527 bp, Flaveria ramosissima
attgggggaaaaactcttaaattcaattttgaaactcggtattccaacttgtttcaaattcaagaataatggcagccagtgtcatgtcctctcttcctcagttcactggtttaaaagcgagttcatcatcactctccccggttcaaaacatggtagcagtgcaaccaatgaaaccaaagggcaagggaaaggtgctttaggtgttcgttgtgatttcattggctcatcaacaaatttgataatggtgacatcaaccaccttgatgttgtttgcgggacgatttgggttggcaccatcagcaaacaggaaggcaactgcggggctaaagctcgaggtgagggactccggacttcaaactggcgaccctgctgggtttacacttgctgatacattggcttgtggaaccgttggtcacattatcggtgttggtgttgttttggggctcaaaaacattggtgccatataaagtggtttgttgtttgtaaacaaagtatcatgttaataacattgttgtaattgtttcctta

SEQ ID NO: 3721 - DNA, 1073 bp, Cicer arietinum
ggccatctaatatcaacattctgaagccacaaattgcttatgtggctaccattagattctgtttacatgttacatcatatctttgtccttcaacaatcaaaggaaccttgaaaatcacttgtttgagtaaagtggtagtagctcagagatagcaagaaattaagagagattcaaaacacaaattttatttttcactttcctctcatagttttaacaaatggcaacttctatgatgaccactttccctcaattcactggtcttagaccacaattctcggcttctcctgtccagggtttggtggccgtccaacccatgacaaggcgcaaggggaagggtgctttgggagttcgctgtgacttcattggttcatccactaatttgattatggtggcatctacaaccttaatgttgtttgctggaagatttggattggcaccctcagcaaacaggaaagcaactgcaggactaaagcttgagacaagggactcaggcttgcagactggtgatccagctggtttcactcttgctgatactttggcatgtggaagttttggccacattattggtgttgtgtggttcttggtcttaagaacattggtgctttgtaaaaaatggaaaaaaatactatgttgtgaacttgtgttgtatctgtaatcagttttaatgtacttttatttttgtatctgagactttacctttactgtttcttaatctttagtttctaccctcataccactttaaacatgtgcacagacaaagatttatgatgaaaaatagccaattagttacttaaggaatctgagtaatatttaggatagaaaagactcaatttagtcgttgagaaaaaatatagactaatttagttcctaaataaataagtattcacagtcaaattaattattttttattatttatttgtaggtaatttttagggataagtgtgagttggatttgacggcactgagagccaataatgattccacatgcatagtattgaccttcacatatttgggagatgttgattaaaatagattttggagattggattgagtctcatttcctttgtataaac

SEQ ID NO: 3722 - DNA, 692 bp, Castanea mollissima
taaaattataagactatcaaaggagagagagagaactattacacacatttcttgttagatcaaatttccattgagattggaagatggcaacaactgtgatgacttctctcccacaatttaatgggttaagacccaatttgtcagcagctcctgttaaaagcatggcagcaatccaaccaatgaggcgtaagggcaagggtgctcttggtgctcgttgcgaaggtttcattggttcacccacaaatttgataattgtgacttctacaagcttgatgctatttgctggaaggtttgggttggcaccatcggcaaacaggaaatccacggcaggattaaagcttgaagttagggactctggcctacagactggtgacccagctggtttcactcttgcagatactttggcatgtggatctgtgggtcacattattggggttggggttgttcttggccttaagaacattggtgcactgtaaattatcttaagcatcttattttatgttgttcttgtctgcaacatgtgtttggtttgataactccaaaaaaatgtgattggtagccaaagtttagggtaatgagagtttaaggttgtgctagttggagattggcataggaatcttcttttacttttcatttgccacaagttgaagacctaaaaaagattttaaaaacaaagagaaatattacccagt

SEQ ID NO: 3723 - DNA, 533 bp, Heritiera littoralis
atgacaatttatcaaactaggaagagagagatcaatcagagaacctttgagctgcttttgattaccatttgagattagcaaatggcagctactgcaatggtcactctcccccagttcagtgggctaagaccccagttttctgcagctccagttagaagcctggcagcagttcaaccaaagaggggcaacaagggaaagggtgctctaggtgctcgctgtgatttcatcggatctgccacaaacttgataatggtgacaacaacaagcctgatgctctttgctgggagattcgggttggctccgtcggcaaacaggaaggccactgctggactgaagcttgaagtaagggactccggcttgcagactggagacccagctggttttactcttgcagacactttggcttgtggcagtgttggccacattattggagttggggtcgttcttggccttaagaacattggtgctctgtaaaaaatataaaatttaagcttgtgttgatactcttctactgtttctatatatttgtcagc

SEQ ID NO: 3724 - DNA, 692 bp, Fragaria vesca
accacagttcagaaaattatccaaaaaacacagagagagacatttgcagactcctaacttcagttgtgactagaaatggcagcagctactatgactacttctctccctcagttcaatgggttgagacccaagatctcatccaatgtacagagcttggctgctgttcaaccaatgaggcgcaagagccaaggtgctttgggagctcgctgtgacttcataggttcacccaccaatttgatcatggtgactactacaagcctaatgttgtttgctgggagatttgggttggcaccatctgcaaacaggaaggcaacagcaggattgaagctcgaaatcagggagtcaggtcttcaaactggtgacccagctgggttcacccttgctgataccttggcttgtgggactgtaggtcacatgattggggttggggttgttcttggccttaagaacatgggtgctctgtaaaaagtaatgtgaatccaaatctgcacgtatttcatttctaagttgttttgtttctctgcttgacaaacacaagatttaaaagcttaatcttggattagggaataaggtaacaatatataacaagctagtgaagcggacatcaaataccatatctccaagtaactatagaacaatcgtattgtgaaaaagttaccccgattgttagtgtgttctcatgtctatatgga

SEQ ID NO: 3725 - DNA, 877 bp, Vinca minor
cggaatgacaagtaagtagaagtacaagtaaagttacttcagaacatcgtaaggtgtttatatgactacagttgattctcagcaacataaagttactgtgaccggaaacgtggaggctgaaatcttgatcaagaagctggtgaaaatcggtaaacaagcccagctttgtccagaaaattccgttgaattacaagcgcaaaagccgggcaacaagaagaagaaaaacaagaaccaaaaagaatcccaatcaggagacgaaaatgattccacaaagaatagtaatgatcaaccagtaacccagaagctagagaaaaggctgccgagtttatttcagaatggcttcagcaatgatgacttctcttcctcagttcaatggcctcaggcccaccatgactttctctgcctcccctgttcaaagcctggttactactcaaccaatgaaacgcagaggacagggagctcttggcgctcgctgtgacttcattggctcaccgacaaatctgataatggtgaccgcaacaagcataatgctatttgctggtagatttggtttggctccatctgcaaacaggaaggccactgccggtctaaaactcgaagttagggattccggcctacagaccggtgatccggctggtttcacccttgccgataccttggcatgtgggactgtaggtcacattattggtgttggagttgtacttggccttaaaaacatcggcgctctctaaatttttgttcataaatctttgtaataacaatcttttctttttctcacttctatctttgcagcagtttcttggcttttgcacctttgtaatttcatcaatttcatttctcatttgcatatagtaatctgaaacatgtacagaaatag

SEQ ID NO: 3726 - DNA, 589 bp, Arachis hypogaea
ggtatcaacgcagagtacgggggaaccacaccagaattctttcaaagaaaaaaaaaaaatagggagagcttagagattcaagtaatggcaaccacaatgatgaccactctccctcagttcaatggtcttagacccaaattctcagcatcccctgtgcagaacttggttgctgtccaacccatgaggcgtaaggcgaagggtgctctaggaactcgctgtgatttcattggttcagaaaccatctgattatggtggcttctacaacactgatgctgtttgccggaaggtttggattggctccgtccgcaacaggaaagcgactgcagggctgaagctcgaggtgagggactcaggcttacagactggtgacccagctggtttcacccttgctgataccttggcttgtggaactgttggccacatcattggtgttgggattgttcttggtcttaagatacgggtgccttagaaaacaagaaaatgaacaaccattcctgcataatgcacctgtaatcaagtttagtgtgcttttaatttctcatcacttgagaatgaacattgtatgcctcaaatcttaatatatagttgc

SEQ ID NO: 3727 - DNA, 670 bp, Chelidonium majus
aagttttagttaagaagaagctctagagagagaaactgtgaattgtgtttgataacttcacaggaaaatggcagcttacaagctcacatccccaactgctgtgatgacttctcttccacaattcagtggacttaggtccaaaccatcaagtgctcgtgtagagagtttggtcgttctacctatcaagcgcaaaggaaacggtgctttgggtgctcgttgtgacttcatcggttcaccaacaaatttgataatggtgactgcaactagcttaatgctatttgctggaaggtttgggttagctccatcagcaaacaggaaggccacagcaggtttaaagctggagacgagggattctggcttacaaactggagacccagctggtttcacccttgcagacaccttgggttgtggaactgtaggtcacattattggtgttggtgttgttttaggtcttaagaacattggtgcaatataaactcttcttatgggtaatatttatcagtactctttataaattctgttttgtaaattaatgcatgtttttctcctccaattcttattctgcacaaatgggattgaatcagattcgatttgacttgttcggtttaaacttgtctggatctcatacttgtcaaacttgataaactcaagctgacagttaaataccaag

SEQ ID NO: 3728 - DNA, 604 bp, Panax ginseng
tggtatcaacgcagagtacatggggatacaaattctttcaaatccacttgattgatctttcatacctcttgaaacaacaataatggcaactgctgtgatgacttctctcccccagttcaatgggcttaggccaaaaacttcctcagtttctcccgtccaaagcttggtagcagttcaaccaatgaagcgcagaggaaatggagccttgggagctcgctgcggttatatcggctcaccaactaacttgataatggtgactgctacaagcctgatgctctttgccggaaggttcggattggcgccatcggcaaacaggaaggcaactgcagggttgaagcttgaagcaagggattctgggctacaaacaggggaccctgctggttttacccttgccgataccttggcttgtgggagtgtaggtcacattattggggttggggttgttcttggccttaagaacattggtgcactctaaacatttgtaccaaattcttctgttaataacaatctcttgttatcttatctgcctatattattcaacttcttttgtggtttccatttcccacattttggatttcgtttaatattactttctgggttttac

SEQ ID NO: 3729 - DNA, 595 bp, Panax ginseng
atttatacaatttctttcaaatccacttgattgatatttcattcctcttgaaacaacaataatggcaactgctgtgatgacttctctcccccagttcaatgggcttaggccaaaaacttcctcagtttcccctgtccaaagcttggtagcagttcaaccaatgaagcgcagaggaaatggagccttgggagctcgatgcggttatatcggctcaccaactaacttgataatggtgactgctacaagcctgatgctctttgccggaaggttcggattggcgccatcggcaaacaggaaggcaactgcagggttgaagcttgaagcaagggattctgggctacaaacaggggaccctgctggttttacccttgccgataccttggcttgtgggagtgtaggtcacattattggggttggggtggttcttggccttaagaacattggtgcactctaaacatttgtaccaaattcatctgttaataacaatctcttgttatcttctcttctattatctgcctatattattctacttcttttgtggtttccatttcccacattttggattttgtttaatattactttctgggtttcacaa

SEQ ID NO: 3730 - DNA, 662 bp, Panax ginseng
ggattcttgcccatgtactctgcgttgataccactgcttaaagcagtggtatcaacgcagagtacatggggatacaaattctttcaaatccacttgattgatctttcatacctcttgaaacaacaataatggcaactgctgtgatgacttctctcccccagttcaatgggcttaggccaaaaacttcctcagtttctcccgtccaaagcttggtagcagttcaaccaatgaagcgcagaggaaatggagccttgggagctcgctgcggttatatcggctcaccaactaacttgataatggtgactgctacaagcctgatgctctttgccggaaggttcggattggcgccatcggcaaacaggaaggcaactgcagggttgaagcttgaagcaagggattctgggctacaaacaggggaccctgctggttttacccttgccgataccttggcttgtgggagtgtaggtcacattattggggttggggttgttcttggccttaagaacattggtgcactctaaacatttgtaccaaattcttctgttaataacaatctcttgttatcttatctgcctatattattcaacttcttttgtggtttccatttcccacattttggatttcgtttaatattactttctgggttttacaagaaataaaaa

SEQ ID NO: 3731 - DNA, 740 bp, Lupinus angustifolius
gtggctatctgttgttagattctcttgcatgttgttattacatcatagaccttaaccaacacacaaatcttcttaaacaaaatagtgaaaacaccataaagagtgcaacattttaatttccttcttcattttcaacaaatgacaacttctttgatgaccactcttcctcagttcagtggccttagacccaaattttcaccaggacctgtccaaaacttggttgcagtccaacccatgaggcgcaagggaaagggtggtttgggagttcgctgtgactttattggttcacccactaatctgatcatagtggcctctacaagcctgatgctgttcgccggaaggtttggattggctccatcagcaaacagaaaagcaacagcaggattaaagctggaggtgagggactcagggttgcaaactggtgacccagctgggttcacccttgctgataccttggcttgtggaactgttggacacatcattggtgttggtgttgttcttggtcttaagaacattggtgctatataaaaaaaacaaccataagtttcatgcatgatgtgtctctaaactgtaatctatgttaatgttctttgttttcatatcactgagactgaatctttagtcttactgaaccattatcttcagctacactctttccaacttcaacatacacaaaatagatatgtgatgattgatgacaaaatagtgaaatattgcccacaagacacaatattaagcat

SEQ ID NO: 3732 - DNA, 536 bp, Triphysaria pusilla
ctgttatcactacccttccacagttcaatggactcaagccccaatctgcctcagcttctcctttgaaaaacttggtagctgttcagcccatgaggcgtaaagggcagggcgctctgggcgctcgttgtgacttcattggctcgccaacaaatttgataatggttacttcgacaactttgatgttgtttgcgggtcggttcgggttggctccatctgcgaataggaaggctacggctggattgaagttggagtctagggactcgggtttgcagacgggtgacccggcgggtttcacactggcggatacattggcttgtgggagttttggtcacataatcggggttggagttgtacttggtctcaagaacattggcgctatctaaatttatttatgttgataaattattgattgtaaaacattctatatagttcgccatgcattctccttcgactcttaactttgaatgaatgttgtttgtttataaaattaaattaatattattatttgaatatcatatagtaaaaaaaaaaaaaaa

SEQ ID NO: 3733 - DNA, 1109 bp, Ricinus communis
atagtgccatctcagcaacaagtatctaagtgtatccaattctagcattctaaaagccacaaatttcacatgtggctgtggtgcagaattgcttttgttcagtttatattgcttttagatcccaatttataaaattgccaaaggaagggaattatctggaagttattctgtaatcaattttatacattcagaggtggaaatggcagcctccatgatgaccactctccctcaattcaatgggctgaagcctcagttgcctattgcttctgaaaaatccctggtagcagttcaacccatgaggcgcaagggaaatggagctttgggtgctcgcatggatttcattggttcaccaacaaatttgataatggtgacttctacaagtctaatgctatttgctggaagatttgggttggcaccatcagcaaacaggaaggcaactgcaggattgaagcttgaagtcagggactctggcttgcaaactggtgacccagctggtttcactcttgccgataccttggcttgtggtactgttggccacataattggtgttggggttgttcttggccttaaaaacattggtgctctctgaaaaaaaaaattgaaaaaagaaaagaagaaaaaagacattttagcccctcaattttattatcctcttaatccttgatttgtgccaactacttgtaaatgttctttttccacctcgtaatcttaaagaaggatcagcaaaattttgagatttcgtttcttatataataatgacagtgataataatcaaacaggtaatgccttcgaaataattaaacaacaaaatttgtgtagcaaaaacgttaaaaaacaaataataaaggcgaataaataattggaaggacgttatctgtctaaattaatttgtttagaataacttatgagtaattttatttattattaatcgaaagagttataatattggtgagatttaaatgctatgctctagaggagaggatgaagattattatttttattatagaagatgaagctacgatagtatacaattagtgtaaataataatttatattttcatttttaatctgcttaaattatatggttaagggtctaatatttaaccgagg

SEQ ID NO: 3734 - DNA, 775 bp, Panax ginseng
atttttttgtttttttacgcgggaaagccgccgccatcgtgtgttggtaccccgggaaattcggccattacggccggggaactctaatttatacaatttctttcaaatccacttgattgatatttcatacctcttgaaacaacaataatggcaactgctgtgatgacttctctcccccagttcaatgggcttaggccaaaaacttcctcagtttctcccgtccaaagcttggtagcagttcaaccaatgaagcgcagaggaaatggagccttgggagctcgctgcggttatatcggctcaccaactaacttgataatggtgactgctacaagcctgatgctctttgccggaaggttcggattggcgccatcggcaaacaggaaggcaactgcagggttgaagcttgaagcaagggattctgggctacaaacaggggaccctgctggttttacccttgccgataccttggcttgtgggagtgtaggtcacattattggggttggggttgttcttggccttaagaacattggtgcactctaaacatttgtaccaaattcttctgttaataacaatctcttgttatcttaaaaaaaaaaacacaaaccacccaaaaaacctgtcggcccccctcgggcccaacccaactctagaacccgagcaaggcttaatgcatgccgggccccaatttcgcagctcactttggcccaacttccgccccttatagtgaagcccgtatcaaccaattcaccttggcccgcgcgttttatacacaccg

SEQ ID NO: 3735 - DNA, 480 bp, Elaeis guineensis
tatgatgactacattgcctcagttcaatggtcttcgagccaccaaaatctctgcagctcctgtacaaggcctggcaagtgttcagcccatgagacgcaagggaaatggagctttgggtgcaaagtgtgacttcatcggttcatcaacaaatctgataatggtaacgtcgacgaccctgatgttgttcgcggggagattcggacttgcgccatcagccaataggaaggcgacagctggacttaggttggaggcacgtgactcaggtctacaaacgggtgacccggccgggttcacgcttgcggacactttggcttgtggcaccgttggtcatatcatcggtgtaggagttgtccttggccttaaaaaacattggtgctatttgaagttcctaaagctctttttattgtatttgtaaaatttgtagatttttataactaatattctcatgcacctgaacgagatctaatggtatttttaacg

SEQ ID NO: 3736 - DNA, 608 bp, Lippia dulcis
ctctccaaacttataatcactctaccaagttcataaccttaatattcactcaagaaaaacagagagagaaaactgcacttttttatcaccaaaaatggcatctgttgtgatgacttccctcccacagttcaatgggctcaagccccaaacagcaaccctctctcctgtcaagagtttggtggctgtccagcccatgaggcgcagaggacagggagctttgggtgctcgttgcgacttcatcggctcgcccacaaatttgatcatgattactgctactagtttgatgttgttcgcgggccgatttggactggctccatcggcgaaccgaaaggcaaccgccggattgaaattggaagcgagagactcgggactccagaccggtgacccagctggcttcaccctagcggatacattggcttgtgggaccgtgggtcatataatcggggttggggttgtacttggtctcaagaacattggtgctttgtaaatcatttatttctgagatgttttagaaacttttcaattctcatgagtgattcaaatatctatatctttgtggtttttttatatataaaggatctagtggtggtaatgtgattaaaaaagaa

SEQ ID NO: 3737 - DNA, 460 bp, Salvia sclarea
cctactagaccttggctgtcactcaaaaaaaagaattaggagagggaaaatttgcatttgatttagcaagaaaatggcatctgttgtgatgacttcccttccacagttcaatgggctgaagccgcagacacgaaccctctctcctgtcaagaatctggtggctgtgccgatgaggcgcagaggacagggtggtttgggtgctcgttgcgacttcatcgggtcgcccacaaatttgataatggttactgcgacgagtctgatgttgtttgcagggcgatttggattggctccatcggccaaccggaaggcgaccgccgggttgaaattggaggctcgtgactcggggctccagaccggtgacccagccggattcaccttagccgatacattggcgtgtggaactgtgggtcatatcattggagttggagttgtacttggcctcaagaacattggcgcttcg

SEQ ID NO: 3738 - DNA, 594 bp, Nicotiana tabacum
aaaaaaaaagaagagagaaaaaggttgagttgctgcaaaaatggctgccaccatgataacttctcttccacagttcaatggactcaaaatcaacaccttctctacttcccctattcagggtttggtggccgttcaaccaatgaggagtagagggcaaggtgctctgggagctcgctgtgatttcatcggttcgcccacaaatttgataatggtgacatcaacaagcctaatgctctttgctggtagatttgggttggctccatcagcaaacaggaaagcaacagcagggctaaagcttgaggttagggactcaggtctccagactggagatcctgctggatttacacttgctgacaccttggcttgtggtgttgttggtcacattattggtgttggggttgttcttggcctcaagaacattggtgctatctaaataatctcttctttataacaaaatatatattttcttgtgtattccagtttctagcatttatgttgctctcctcttttttcgttgctacaacaaaagtttttatgaaacaattgaagacacataagcaatatttatcgatgcgttgggttggaaagtcaccc

SEQ ID NO: 3739 - DNA, 530 bp, Nicotiana tabacum
ggcgggatcaacacttttgtcaaaggcattaactaaaaaaaaagaagagagaaaaaagttgagttgctgcaaaaatggctgccaccatcttaacttttcttccacagttcaatggactcaaaaccaacaccttctctacttcccctattcagggcttggtggccgttcaacccatgaggagtagagggcaaggtgctctgggtgctcgctgtgattttattggctcgcccacaaatttgataatggtgacatcaacaagcctaatgctctttgctggtagatttgggttggctccatcagcaaacaggaaagccacagcagggctaaagcttgaggttagggactcaggtctccagactggagatcctgctggatttacactcgctgacaccttggcttgtggtgttgttggtcacattattggtgttggggttgttcttggcctcaaaaacattggtgctatctaaataatctcttgtttataacaaaatattttcttgtgtattccagtttctagcatttatgttgct

SEQ ID NO: 3740 - DNA, 1663 bp, Cirsium arvense
cggccacgcagtcggttactttttcttttttgatagaagtgttagtggcatatacatagataacttgaactccataacaaacatgcataattggaaggagaaagcaattacgacaatgttattaacatgataatttgtttcaaaataacaagtctagatggctccaatgtttttaagccccaaaacaacaccaacaccaataatgtgaccaacggttccacaagccaatgtatctgcgagggtgaagccagcagggtcgccggtttggagtcccgaatcccttacctcaagctttagccctgcggtcgccttcctgtttgccgatggtgccaatccaaatcgaccagcaaacaacatcaacgttgttgacgtcaccattatcaaatttgtggacgagccgatgaaatcacaacgaacgcctagagctccctttcccttggtcttgggcttcattggttgaaatgccaccatggattgaattggggatgatgcagaagaagcccttagaccagtgaattgagggagagaagccatcacagcagttgccattttcgataattcaaagaaaaaaaattagagtttgaaaaatggagattttcaagtattttaaagaatcagaagcttggtttctacctttctcgctaaaatgtcaggaacagaaggatttgagggttttgagaatcttgaagatgaaagaagaagatctaaaattggatctttaaggaagaaggcgataaatgcttctaataagttgacccattcgataacgaaaaggggattaaggaaggttgattatcgggttccttcgatacaagatatacgcgatgcaagtgaagaacgagcggtccacgagctacgccaaaagctcatcgatatggacttgcttccggaaagacatgatgaatatcataccttactgagattcttgaaagcaagggatttcgacatcgagaaaacaatccgaatgtgggccgaaatgctaaattggcgaaaagagtacggaacagacacaatattggaggattatgtatttgaagaacttgaagaagtattgcagcattatcctcaaggataccatggagtcgatagggtaggaagaccgatttatatcgaaaggctcggcaaagctcaccccggtagacttatgcgtattacttctatcgaccgctaccttaaataccatgtccaagagtttgaacgggcttttatcgagaagtttcccgcttgttcaatcgcggctaaacgacagatttgttcgactacaactattttggatgtgcaaggcttgggattgaagaatttcactccaagtgctgctagtattcttggagctatggcaaaggttgacaataactattacccggagacgttacaccggatgtttgttgtcaatgctggctcaacgtttagaaaatatctatggccggctgctcaaaagttcctcgatgcaaaaacaattacaaaaatacaggttttggaaccgaagtcgttgggtaaactacacgaagccatcgatccaagccaattgcctgatttccttggtggttcctgcacatgttctgctgagggtggctgccttaggtctaatatgggtccatggaatgaccctgaaataatgaaggttgttattaatgcagaagccacatttgcaaggcaaatctct

SEQ ID NO: 3741 - DNA, 657 bp, Flaveria ramosissima
gaaactcggtattccaacttgtttcaacttcaagaataatggcaaccagtgtcatgtcctctcttcctcagttcactggtttaaaagccagttcaccatcactctctccagttcaatgcatggtagcattgcaaccaatgaaacccaagggcaagggaaggggtgctttaggtgttcgttgtgatttcattggctcatcgacgaatttgataatggtgacatcaaccaccttgatgttgtttgcgggacgatttgggttggcaccatcagcgaaccggaaggcaactgcggggctaaagctcgaggtaagggactcaggacttcaaactggcgaccctgctgggtttacacttgctgatacattggcttgtggaaccgtgggtcacattattggtgttggtgttgttttgggcctaaaaaacattggtgccatctaaagtagcttgtttgtaaacacagtatcatgttaataacattgttattatttattcctttcaaattattgtttgagtttgaatactttaacaggagtattggcttaaggtaacatgtagtggtggcaattgttgtcgggcttgggttgatatcacctaatcaaggcacaaaccagttttattaatcgtgttgaaaaacttaactttacacagaaaaaatatt

SEQ ID NO: 3742 - DNA, 505 bp, Flaveria ramosissima
aatggcaaccagtgtcatgtcctctcttcctcagtttactggtttaaaagccagttcaccatcactctcttcggttcaaaacatggtagcattgcaaccaatgaaacccaagggcaatggaaagggtgctttaggtgttcgttgtgatttcattggctcatcaacaaatttgataatggtgacatcaaccaccttgatgttgtttgcgggacgatttgggttggcaccatcagcaaaccggaaggcaactgcggggctaaagctcgaggtaagggactcaggacttcaaactggcgaccctgctgggtttacgcttgctgatacattggcttgtggaaccgttggtcacattattggtgttggtgttgttttgggtctcaaaaacattggtgccatctaaagtagcttgttgtttgtaaacacagtatcatgttaatagcattgttattatttcttactttcaaattattgcttgtagttgaatacttacaagagtatgctaagt

SEQ ID NO: 3743 - DNA, 511 bp, Flaveria ramosissima
aaaactattcaattcatttttgaaactcggtattccaacttgtttcaagttcaagaataatggcaaccagtgtcatgtcctctcttcctcagtttactggtttaaaagccagttcaccatcacttgtctcggttcaaagcatggtagcattgcaaccaatgaaacccaagggcaatggaaagggtgctttaggtgttcgttgtgatttcattggctcatcaacaaatttgataatggtgacatcaaccaccttgatgttgtttgcgggacgatttgggttggcaccatcagcaaacaggaaggcaactgcggggctaaagctcgaggtaagggactcaggacttcaaactggcgaccctgctgggtttacgcttgctgatacattggcttgtggaaccgttggtcacattattggtgttggtgttgttttgggcctcaaaaacattggtgccatctaaagtagcttgttgtttgtaaacacagtatcatgttaataacattgttattattt

SEQ ID NO: 3744 - DNA, 545 bp, Flaveria ramosissima
tcaaaactattcaattcatttttgaaactcggtattccaacttatttcaagttcaagaataatggcaaccagtgtcatgtactctcttcctcagttcaccggtttaaaagccagttcaccatcactctcctcggttcaaagcatggtagcattgcaaccaatgaaacccaagggcaatggaaagggtgctttaggtgttcgttgtgatttcattggctcatcgacaaatttgataatggtgacatcaaccaccttgatgttgtttgcgggacgatttgggttggcaccatcagcaaacaggaaggcaactgcggggctaaagctcgaggtaagggactcaggacttcaaaccggcgaccctgctgggtttacgcttgctgatacattggcttgtggaaccgttggtcacattattggtgttggtgttgttttgggtctcaaaaacattggtgccatctaaagtagtttgttgtttgtaaacacagtatcatgttaataacattgttattatttcttcctttcgaattattgtttgagttaaaata

SEQ ID NO: 3745 - DNA, 601 bp, Flaveria ramosissima
agatcttacaaactctcatctatttagaactcgattccaacttatttcaagttcaagaataatggcaaccagtgtcatgtcctctcttcctcagtttactggtttaaaagccagttcaccatcactctcttcggttcaaaacatggtagcattgcaaccaatgaaacccaagggcaatggaaagggtgctttaggtgttcgttgtgatttcattggctcatcaacaaatttgataatggtgacatcaaccaccttgatgttgtttgcgggacgatttgggttggcaccatcagcaaaccggaaggcaactgcggggctaaagctcgaggtaagggactcaggacttcaaactggcgaccctgctgggtttacgcttgctgatacattggcttgtggaaccgttggtcacattattggtgttggtgttgttttgggtctcaaaaacattggtgccatctaaagtagcttgttgtttgtaaacacagtatcatgttaataacattgttattatttcttactttcaaattattgtttgagtttgaatactttaactaagagtattggcttaagggtacatgtagtggtggcaatgttgtcgggc

SEQ ID NO: 3746 - DNA, 413 bp, Flaveria ramosissima
agaataatggcaaccagtgtcatgtactctcttcctcagttcaccggtttaaaagccagttcaccatcactctcctcggttcaaagcatggtagcattgcgaccaatgaaacccaatggcaagggaaatggtgctttaggtgttcgttgtgatttcattggctcatcgacaaatttgataatggtgacatcaaccaccttgatgttgtttgcgggacgatttgggttggcaccatcagcaaacaggaaggcaactgcggggctaaagctcgaggtaagggactcaggacttcaaactggcgaccctgctgggtttacgcttgctgatacattggcttgtggaaccgttggtcacattattggtgttggtgttgttttgggtctcaaaaacattggtgccatctaaagtagttt

SEQ ID NO: 3747 - DNA, 442 bp, Flaveria ramosissima
caagaataatggcaaccagtgtcatgtcctctcttcctcagtttactggtttaaaagccagttcaccatcactctcttcggttcaaaacatggtagcattgcaaccaatgaaacccaagggcaatggaaagggtgctttaggtgttcgttgtgatttcattggctcatcaacaaatttgataatggtgacatcaaccaccttgatgttgtttgcgggacgatttgggttggcaccatcagcaaaccggaaggcaactgcggggctaaagctcgaggtaagggactcaggacttcaaactggcgaccctgctgggtttacgcttgctgatacattggcttgtggaaccgttggtcacattattggtgttggtgttgttttgggtctcaaaaacattggtgccatctaaagtagcttgttgtttgtaaacacagtatcatgtta

SEQ ID NO: 3748 - DNA, 574 bp, Helianthus annuus
cggggatacatctttcaataaactccattttttaaaactcagaaatccaagttttttcaagatcacaaatggctgctgtcatgacttctcttcctcaattcactggtttaaaggccacttcatcatcactttccccggttcaaagcatggtatcattgcaaccaatgaaacccaagggaaagggaaagggagctttaggtgttcgttgcgatttcatcggttcatctacaaatctgataatggtgacatcaaccaccttgatgttgtttgctggccgattcggattggcaccgtcagcaaacaggaaggcgaccgcagggctaaagctcgaggtgagggattcagggcttcaaaccggcgaccctgctggcttcacacttgctgacacgttggcgtgcggaactgttggtcacattattggtgttggtgttgttttaggcctcaagaacattggtgccatctaaacttgtttgaaaacatattatcatgttaataacatttgcgcaatcatcttcgttttgagttaacgtttattcgttttggagtttaaattatgtatgtaaaggtggattaa

SEQ ID NO: 3749 - DNA, 517 bp, Centaurea maculosa
ttttctttgaatcagaaaaaatggcaactactgcaatggcttccctccctcaattcactggtctaagggcttcttcttcatcatccccaattcaatccatggtggcatttcaaccaatgaagcccaagaccaagggaaagggagctctaggcgttcgttgtgatttcatcggctcgtccacaaatttgataatggtgacgtcaacaacgttgatgttgtttgctggtcgatttggattggcaccatcggcaaacaggaaggccaccgcagggctaaagcttgaggtaagggattcaggactccaaaccggcgaccctgctggcttcaccctcgcagatacattggcttgtggaaccgttggtcacattattggtgttggtgttgttttggggcttaaaaacattggagccatctagactttttattttcaaacaaattatcatgttaataacattgtcgtaattgctttctccttctaattatgcatgtttgttatggagttaaagttatctatgta

SEQ ID NO: 3750 - DNA, 445 bp, Ambrosia trifida
atggcatgtgttgtcatgtcttctcttcctcagttcactggtttaaaagccacctcaccatcaccttccccaattcaaagcatggtggcagtgcaaccaatgaagcctaagggaaagggagctttaggtgttcgatgtgattttattggttcatcaacaaatttgataatggtcacatcaaccactttgatgttgtttgctggacggtttgggttggcaccatcagcaaacaggaaggcgaccgcagggctaaagctcgaggtgagggattcagggcttcaaaccggtgaccctgctgggtttacgcttgcagatacattggcttgtgggaccgttggtcacattattggtgttggtgttgttttgggcctaaaaacattggtgccatctaaactagtttgttgtttgaaacatattatcatgttaataacattgttattattgt

SEQ ID NO: 3751 - DNA, 431 bp, Jatropha curcas
ggcagcctctatgatgaccactcttcctcaattccatggcctaaagccccaattctcttctgctcctgtaaaatccctggcagcagttcaacccataaggcgaaagggaaatggagctttgggcactcgaatggatttcattggttctcccacaaacttgataatggtgacaagtacaagcctaatgttatttgctgggagatttgggttggcaccatcagcaaacaggaaggcgacagcaggattgaagcttgaagtgagggactctggtttggagagagtggcgaccctgctggttttactcttgctgataccttggcctgtggaactgttgggcacatcattggagttggtgttgttcttggccttaaaaacattggtgccctctaaattaacaatcaaatattttccccttctcttttaaaaaaaaa

SEQ ID NO: 3752 - DNA, 691 bp, Echinacea purpurea
caaggatcaaagtttatcctacttgaaactttacaaggccacaaacataactcttttatgtggcttctgctttaaagatctttcaataaactccattttttcaaacccagaaatccaagtttttcaacatcacaaatggctgctgtcatgacttctctccctcaattcactggtttaaaggccacttcatcatcactttcaccagttcaaagcatggtatcatttcaaccaatgaaacccaagggaaagggagctttaggtgttcgctgtgacttcatcggttcacctacaaatctgataatggtgacatcaaccaccttgatgttgtttgctggccgattcgggttagcaccgtcggcaaacaggaaggcaaccgcagggctaaagctcgaggtgagggattcggggcttcaaaccggagaccctgctggcttcacacttgctgatacgttggcgtgcgggactgttggtcacattattggtgttggtgttgttttaggcctcaagaacattggtgccctctaaacttgttgttccaaacatattgtcatgttaataacattcgtgtaattctcttctttttgagttaacgtttattcgtattcgactttaagttatctatgtaaaggggggttaagccatgattatttcaactatagtgacaccaaatcgaaatgaaagtcagatttga

SEQ ID NO: 3753 - DNA, 581 bp, Fagus grandifolia
ggaagcaaggaagggaaaatttataaaactatcaagagagagagagatcaatcatatttcttgttacatcaattttctttgagatcagaagatggcaacaactgtcatgacttctctcccacaatttaatgggctaagacccaatttttcagtagctcctgttcgaagcctggcagcaatccaaccaatgaggcgtaagggcaagggagctctaggtgctcgttgtggtttcattggttcacccacaaatttgataattgtgacttctacaaccctaatgctatttgctggaaggtttgggttggcaccaacggcaaacaggaagtccacagcaggattgaggcttgaagtgagggactctggcctacaaactggtgacccagctggtttcactcttgcagataccttggcatgtggaagtttgggtcacattattggggttggggttgttcttggccttaagaacattggtgcactgtaaattatcttaagcatcttattttatttctcttatgttgttcctgtacttacaacttgtgtttggtttgataactccacaaacatgtgattggtagccagag

SEQ ID NO: 3754 - DNA, 670 bp, Nicotiana benthamiana
gggcctatgtcacagaaacttgtttggaaccccagtagatttatacaaacaattttgtcaaaagccaattaaactaaaaaaagaagagaaaaaaaagttgagttgctgcaaattaaaatggctgccaccatgttaacttctcttccacagttcaatggactcaaaaccaacaccttctctacttcccctattcagggcttggtggcccttcaacccatgaggaatagagggcaaggtgctctgggtgctcgctgtgatttcattggctcgcccacaaatttgataatggtgacatcaacaagcctaatgctgtttgcaggtagatttgggttggctccatcagcaaacaggaaagcaacggcagggctaaagcttgaggttagggactcaggtctccagactggagatcctgctggatttacacttgctgacactttggcttgtggtgttgttggtcacattattggtgttggggttgttcttggcctcaagaatattggtgctatctaaataatctcttttttataacaaaatatatattttcttgtgtattccagtttctaccatttatgttgctctcctcttttttccttgctacaacaaagattttatgaaataattgaagacacaaaaacaatatttatcgatgcgttgggttggaaagtcaccc

SEQ ID NO: 3755 - DNA, 585 bp, Helianthus annuus
tcaacgcatattacgcgggggtggcttctggttttaaagatctttcaaaattctcatctttcaaactcagatcaacaatggcaagtgctgtcatgtcctctcttcctcagttcactggtttaaaagccacttcaccatcactttctccggttcaaaacatggtggcagtgcaaccagtgaagcccaagggaaagggagctttaggtgtccggtgtgatttcattggttcaccaacaaatttgataatggtgacatcaaccaccttgatgttgtttgctggacggtttgggttggcaccatcggcaaacaggaaggcgaccgcagggctaaagcttgaggtgagggattcagggcttcaaaccggagacccggctgggttcacgcttgctgatacattggcttgtgggaccgttggtcacattattggtgttggtgttgttttgggcctcaaaaacatcggtgccctctaagctagcttgttgtttgaaaacatagtatcatgttaataacattgttattattgtcttccttttgaattgatgttttgagtttaaacacttaaacaagagtgttgtcgggtcgggt

SEQ ID NO: 3756 - DNA, 692 bp, Tamarix hispida
agtatctgcccgcatgacttgcagccacggaattccttatgtggtccgctttgaatatcgattcaaatatggaaagccacacgttcctgggggattgtcagaagtttttacaccaacacctttggggtcaaatattaggtcctataacagagactccattaatcagagagcgaatcgaaatcgaattcaacaggaatggcaacaacaatgatggcttctcttcctcaattcagtgggctaagaccccaacaacaatcttctactccagtcaagagcctggctgcagttttgccaaagaaacgcaaagggaatggagctttgggcgcccgctgtgacttcattggctcacctacaaacttgataatggtgacatcgaccaccttaatgttgtttgctgggcgttttggattggctccatcagcaaacaggaaggcgactgcaggtctaaggcttgaagtgagagattcagggctacagaccggtgatcctgctggttttactctagctgatactttggcgtgtgggagctttggtcacattattggagtaggggttgttcttggccttaagaacattggtgccctgtaaaatttcttgttgtttatgcatactgggcagctattcaatgatttccaggtcggattaatttggtttatataaaaggattctgttcgagtatgccaaccttctga

SEQ ID NO: 3757 - DNA, 698 bp, Tropaeolum majus
ataacaatctcaccttcaacgttataaccttctagaaaacaattcgatcaaaatttaagcaaatcgatagaaaaaagaaaaaaaaatttggtgtttcttctggttattttagcaaaatggcaacaagtaccatgatgatgactactactcttccacaattcaacggtctaaaacccggaatcttctcttcttcacctgtacaaggccttgcaagtattcaaccaatcaaacgcaaagggaatggagcttcgggtgctcgttgtgaattcattggttcatccactaatttgataatggtgaccagcacgagtttaatgctattcgcagggagatttgggctagccccatcggcgaacaagaaggcaacagctgggttgaagcttgaagtgagggactcaggcttgcaaaccggtgacccggccggtttcactcttgctgataccttagcctgtggtactgtgggccacattatcggtgttggggttgttcttggcctcaagacattggtgctatataaacaaaattgtataatatttttcatgtgctttgttaagttctgaaaaatgcttttatttgaacaatttatgtcactcgttttactattcagagtgtctcattgtacattttcataagatttctcttggttttcgcataacaacactttaagtttcgaacaatgtgaatagatgttttacatg

SEQ ID NO: 3758 - DNA, 474 bp, Centaurea maculosa
tttttattacccgggatatggcaactactgcaatggcttccctccctcaattcactggtctaagggcttcttcttcatcatccccaattcaatccatggtggcatttcaaccaatgaagcccaagaccaagggaaagggagctctaggcgttcgttgtgatttcatcggctcgtccgcaaatttgataatggtgacgtcaacaacgttgatgttgtttgctggtcgatttggattggcaccatcggcaaacaggaaggccaccgcagggctaaagcttgaggtaagggattcaggactccaaaccggcgaccctgctggcttcaccctcgcagatacattggcttgtggaaccgttggtcacattattggtgttggtgttgttttggggcttaaaaacattggagccatctagactttttattttcaaacaaattatcatgttaataacattgtcgtaattgctttctccttct

SEQ ID NO: 3759 - DNA, 582 bp, Trifolium pratense
tgtgattcaaaacaaagttaatttttcattttctctcatagtttgaacaaatggcaacttctatgatgacaacaactttcactcaattcactggccttagatcacaattcaaaggttctcctgtgcagggtttggttgctgcccaacctatgacaagccgcagggggaagggcgctttgggagttcgttgcgacttcattggttcatccactaatgtgattatggtggcatctacaaccctaatgttgtttgctggaagatttggattggctccttcagcaaacaggaaagcaactgcaggactaaagttggaggcaagggactcaggcttgcagactggtgacccagctgggttcacccttgctgatactttggcatgtggaactgtaggacacatcattggtgttggtgttgttcttggtcttaagaacattggtgcaatttaaaaaggaaactgtgaacttgtgttctatctgtaataagttttaatgtcattttattttaatctctagttgttctctttcccacttaaaaatgcacagatatcgtacattaagtaaacctagcgatactatcaagtta

SEQ ID NO: 3760 - DNA, 585 bp, Flaveria ramosissima
ctttttaagatctttcaaaacttttcatttttgaaagtcggtaatccaacttgtttcaagttcaagaataatggcaactagtgtcatgtcctctcttcctcaattcactggtttaaaagccagttcatcatcactctccccaattcaaagcatgatagcatttcaaccaatgaaaccaaagggaaagggaaaaggagctttaggtgtccgttgtgatttcattggctcatcaacaaatttgataatggtgacatcaaccaccttgatgttgtttgcgggacgatttgggttggcaccatcagcaaacaggaaggcaaccgcggggctaaagctcgaggtaagggactcaggacttcaaaccggcgatcctgctgggttcacactcgctgatacattggcttgtggaacagttggtcacattattggtgttggtgttgttttgggccttaaaaacattggtgccatttaaagtagcttattgtttgtaaacacaacatcatgttaataacattgttattattttcttcccttcaaaatttaatgtttgtgtttgaatacttgaacaagagtattggcaaaaatatt

SEQ ID NO: 3761 - DNA, 453 bp, Flaveria ramosissima
aatggcaaccagtgtcatgtcctctcttcctcagtttactggtttaaaagccagttcaccatcactctcttcggttcaaaacatggtagcattgcaaccaatgaaacccaagggcaatggaaagggtgctttaggtgttcgttgtgatttcattggctcatcaacaaatttgataatggtgacatcaaccaccttgatgttgtttgcgggacgatttgggttggcaccatcagcaaacaggaaggcaactgcggggctaaagctcgaggtaagggactcaggacttcaaaccggcgaccctgctgggtttacgcttgctgatacattggcttgtggaaccgttggtcacattattggtggtggtgttgttttgggtctcaaaaacattggtgccatctaaagtagtttgttgtttgtaaacacagtatcatgttaatagcattgttattattt

SEQ ID NO: 3762 - DNA, 489 bp, Flaveria ramosissima
agttcaagaataatggcaaccagtgtcatgtcctctcttcctcagtttactggtttaaaagccagttcaccagcactctcctcggttcaaagcatggtagcattgcaaccaatgaaacccaagggcaagggaaatggtgctttaggtgttcgttgtgatttcattggctcatcaacaaatttgataatggtgacatcaaccaccttgatgttgtttgcgggacgatttgggttggcaccatcagcaaaccggaaggcaactgcggggctaaagctcgaggtaagggactcaggacttcaaaccggcgaccctgctgggtttacgcttgctgatacactggcttgtggaaccgtgggtcacattattggtgttggtgttgttttgggcctcaaaaacattggtgccatctaaagtagcttgtttgtaaacacagtatcatgttaataacattgttattatttcttactttcaaatttattgtttgagttt

SEQ ID NO: 3763 - DNA, 490 bp, Flaveria ramosissima
atgaaactcggtattccaacttgtttcaagttcaagataccaatggcaaccagtgtcatgtcctctcttcctcagtttactggtttaaaagccagttcaccatcactctcctcgcttcaaagcatggtagcattgcaaccaatgaaacccaagggcaatggaaagggtgctttaggtgttcgttgtgatttcattggctcatcaacaaatttgataatggtgacatcaaccaccttgatgttgtttgcgggacgatttgggttggcaccatcagcaaacaggaaggcaactgcggggctaaagctcgaggtaagggactcaggacttcaaaccggcgaccctgctgggtttacgcttgctgatacattggcttgtggaaccgttggtcacattattggtgttggtgttgttttgggtctcaaaaacattggtgccatctaaagtagtttgttgtttgtaaacacagtatcatgttaataacattgttatt

SEQ ID NO: 3764 - DNA, 1150 bp, Papaver somniferum
aaactgaaccaaatattattagtaaagacttcagaaataaaaaaacaagctctatagagaaaaagattcacaaagcaatggcatcttcatccgcagtcatgacttcactcccacagttcagtggccttaggtccaaaccatcagctcctcgggtagactctctggtgagcattgtaccaatgaagcgcaagggaaacggcgctttgggtgctcgttgcgactacatcggttcaccaacaaatttgataatggtcacctcaacaactttgatgttgtttgctggaagatttgggttggctccatcagcaaacaggaaagcaacagcaggtttaaagcttgaaggtagagattctggtttacaaactggagacccagctggtttcactctagctgatactttggcctgtggaagtttcggccacattattggtgttggtgttgttttaggtcttaagggcattggtgcactataaataactatccattcttagtttgggatcatacttcccaatggtagtactcttttataaattcttattttgtaaatttgaatccatatatgtctgtttccttccgcctatggttgctttgcaaaagggattgattggtttctgcattcttgacctggcttggtcacagatttgtcaatgtcgacaaactcgcatgatttagtttgaacatggccaaacttgggttttatcgacactgacttggtttacttcacaactgaactacaagtttttggtcttgtaagcgaaaatgcttttattgaagtgataagaacatggacagagaacaattactctctgtggtcaatagccttaagactagttttagataacacaattaggtattaatgaagaagggataaacaggttaaaggaggtaccttcctcgccttgctgatgtagattataccctctattagacaaaagctcttgaaatctatcagccaaaaaaagcagcgaacaatgaaactacaccaagttgttgatgtttgcttcaaaaatgctagaagtttataatgttgcattgcttcagtaggtgtaaacttcttaccccattcactatgccagagttaaggaagtaaaagttgatttcatgtcttcctgatttccgcttcaagtacttcatacccatctcctctata

SEQ ID NO: 3765 - DNA, 831 bp, Papaver somniferum
agttaaaatgtgacacatctgcaacaagtatctaaatgtatccagatctggcattttgaatccacaatcatttcatgtggttgtggttcagagcagttcttataattgtttaaagtttttgattctggaaaactgaaccaaatattactagtaaagacttcagaaataaaaaaacaagctctatagagaaaaagattcacaaagcaatggcatcttcatccgcagtcatgacttcactcccacagttcagtggccttaggtccaaaccatcagctcctcgggtagactctctggtgagcattgtaccaatgaagcgcaagggaaacggcgctttgggtgctcgttgcgactacatcggttcaccaacaaatttgataatggtcacctcaacaactttgatgttgtttgctggaagatttgggttggctccatcagcaaacaggaaagcaacagcaggtttaaagcttgaaggtagagattctggtttacaaactggagacccagctggtttcactctagctgatactttggcctgtggaagtttcggccacattattggtgttggtgttgttttaggtcttaagggcattggtgcactataaataactatccattcttggtttgggatcatacttcccaatggtagtactcttttataaattcttattttgtaaatttgaatccatatatgtctgtttccttccgcctatggttgctttgcaaaagggattgattggtttctgcattcttgacctggcttggtcagatttgtcaatgtcggacaaacttgcatgatttagtttgaacatggccaaacttgggttttatcga

SEQ ID NO: 3766 - DNA, 456 bp, Flaveria ramosissima
aatggcaaccagtgtcatgtcctctcttcctcagtttactggtttaaaagccagttcaccatcactctctccggttcaaagcatggtagcattgcaaccaatgaaacccaagggcaagggaaagggtgctttaggtgttcgttgtgatttcattggctcatcaacaaatttgataatggtgacatcaaccaccttgatgttgtttgcgggacgatttgggttggcaccatcagcaaacaggaaggcaactgcggggctaaagctcgaggtaagggactcaggacttcaaaccggcgaccctgctgggtttacgcttgctgatacattggcttgtggaaccgttggtcacgattattggtgttggtgttgttttgggtctacaaaaaactttggtgccatctaaagtagtttgttgtttgtaaacacagtatcatgttaatagcattgttattattt

SEQ ID NO: 3767 - DNA, 470 bp, Medicago truncatula
aaagagagattcataactcaattttatttttcatttgctctcatagtttgaacaaatggcaacttctatgatgataactttgcctcaattcactggtcttagatcacaactcaaaccttctcctatccagggtttggttgctgcccaacctatgacaaagcgcaagggaaagggtgctttgggagttcgttgtgacttcattggttcatcaactaatgtgattatggtggcatctacaaccctaatgttgtttgccggaagatttggattggctccatcagcaaacaggaaagcaacagcaggactaaagctggagacaagggactcaggcttgcagactggtgacccagctgggttcactcttgctgatactttggcatgtggaactgttggacacatcattggtgttggtgttgttcttggtcttaagaacattggtgcattgtaaaaaagaaaactatgttgtgaac

SEQ ID NO: 3768 - DNA, 624 bp, Manihot esculenta
gattcaaaattgcttactcattttatatttgattttagatccctaaacaatttacaaaattatcacagaagatcaaattggtggaaatggcagcagcatctatgatgaccactctcccacagttcaatgggttgaagccccaattctcagctgcccctataaaatccctggcattagttcggcccatgaggagaaagggaaatggagcattgggcactcgcatggatttcattggctcacccacaaatttgataatggtgacaacaacaagcctaatgctatttgctggtagatttgggttggctccatcagcaaataggaaggccactgcaggattaaagcttgaagcaagggactctggacttcaaaccggtgatccagctggtttcactcttgctgataccttggcttgtggtactgttggtcatattattggtgttggcattgttcttggccttaagaaccttggatctctgtaaatttttcaaattttcttttttttttttatttaaattcctttgaacatatctcaatgtaatattgttctcatactcctaatctcatttcgtacttattatatactcctaaatatttaaaccattatattaaaactgaattctgttt

SEQ ID NO: 3769 - DNA, 603 bp, Medicago truncatula
acatcataatatcataaccttcaaaatctttgtgtgtgacaaataaacttaaaagagagattcataactcaattttatttttcatttgctctcatagtttgaacaaatggcaacttctatgatgataactttgcctcaattcactggtcttagatcacaactcaaaccttctcctatccagggtttggttgctgcccaacctatgacaaagcgcaagggaaagggtgctttgggagttcgttgtgacttcattggttcatcaactaatgtgattatggtggcatctacaaccctaatgttgtttgccggaagatttggattggctccatcagcaaacaggaaagcaacagcaggactaaagctggagacaagggactcaggcttgcagactggtgacccagctgggttcactcttgctgatactttggcatgtggaactgttggacacatcattggtgttggtgttgttcttggtcttaagaacattggtgcattgtaaaaaagaaaactatgttgtgaacttgtgttctatctgtaataagttttaatgtcattttatttttgcatccttgagacttaacctttattctttcttaacggtga

SEQ ID NO: 3770 - DNA, 1006 bp, Vinca minor
tctaccaaatttataacactttttcttggaaacaaaatggtgaaattatcaacaaaaaagaaacccattttagatctctgatcatcctcagtttcttcctaagttttttggttgcagaatggcttctgctatgatgacttctcttcctcagttcaatggcctcaggcccaccatcaccttctcagcttcccctgttcgaagtttggttgctgctcaaccaatgaaacgcagaggacagggagctctcggagctcgctgcgacttcattggctcaccaacaaatctgataatggtgaccgcaacaagcctaatgctatttgctggtagatttggtttggctccatctgcaaacaggaaggcgaccgccggcctaaaactcgaggttagggaatccggtctacagaccggtgatccggccggtttcacccttgccgataccttggcatgtgggactgtaggtcacattattggtgttggagttgtacttggcctaaaaaacattggtgctctctaaatttgttcataatcaaatctttgtaataacaatcctttttttctttctcctcatcacttcatctttgcagcagttcctggatttgataccttgtaatttcatcaattacatttctcattcgcatatacgtactaatctagaatgaagaatgaataaagaaaaacttaattgaattactactaaaaaaataaattaatttccaacaatgaagtaacaaacttttggggaagcagaaatagagaaaacaatcaaacatgaatgtagagcatcaagtggctgctcacataaccctgcaatcctctggaggttgatcaccataatagtcacccgccgcccccaatgtagcgtctgtggtggtggccaccatatgtaggcggcgccatacggggataatcatgatatggaagcattccgggagggccatacgtggggcggagggccaagcagtcttcgaggcggccatggcggcaaagattttgacatatggtggtg

SEQ ID NO: 3771 - DNA, 616 bp, Echinacea purpurea
agatctttcaataaactccattttttcaaacccagaaatccaagtttttcaacatcacaaatggctgctgtcatgtcttctctccctcaattcactggtttaaaggccacttcatcatcactttcaccagttcaaagcatggtatcatttcaaccaatgaaacccaagggaaagggagctttaggtgttcgctgtgacttcatcggttcacctacaaatctgataatggtgacatcaaccaccttgatgttgtttgctggccgattcgggttggcaccgtcggcaaacaggaaggcaactgcagggctaaagctcgaggtgagggattcagggcttcaaaccggagaccctgctggcttcacacttgctgacacgttggcgtgcgggactgttggtcacattattggtgttggtgttgttttaggcctcaagaacattggtgccctctaaacttgttgttccaaacatattgtcatgttaataactttcgtgtttttgagttaatgtttattcgtattcgactttaagttatctatgtaaaggggggttaagccatgattatttcaattgtagtgacaccaaattcaaatgaaaatcagatttgattaacatcgcc

SEQ ID NO: 3772 - DNA, 731 bp, Citrus clementina
ctcaccgaggatctaagtgtatccaattcaagcgttctgaagccacaaatcgctcacgtgggccatcataaacgtctgcccactcagtttttaatatcgtttcaaaacttaacaaactaaaataattcccaagtattactcgttctccggtcattcaatttcctccgtagaaagctgaaaaatggcaacttctttgatgaccatgccacagttcagtgggctcagaccccaaatctcagcagctccagcacaaagcctggtagcagcccagccaatgaggaggaaatgcagtggagctttgggtgctcgttgtggcttcattggttcgcccacaaatttgataatggtgacaacaacaaccctgatgctatttgctgggagatttgggctggctccatcagcaaacaggaaagcaacggcaggattgaagcttgaagtgagggactctggcttgcaaactggtgacccagctgggttcactttggctgacacattggcttgtggcagtgttggtcacatcattggtgttggggtggtccttggccttaagaacttgggtgctctgtaaaaattttcgaagcagtttgttatgttaaatcgattgttaatactcgctgtgccatttctgttgcacctatctgcctggttttaatttttgatggcttcatttggatgttaaaaataatttatttattattctctagaataaatgataagtgatattagtgatt

SEQ ID NO: 3773 - DNA, 616 bp, Flaveria ramosissima
tagtacattggggatggccataaaccatcatcttttatgtggctcctgctttaagaatctttcgagaagcattcttttttcaaacccagaaatcagactgttttcaagatcacaaatggcaactgctgtcatgtcttctcttcctcaattcactggtttaaaggccacttcatcatcaccttcaccagttcaaagcatggtatcattgcaaccaatgaaacccaagggaaagagggctttaagtgttcgttgtgatttcattggttcatcaacaaatttgataatggtgacatcaaccaccttgatgttgtttgcgggtcgatttgggttggcaccatcggcaaacaggaaggcgaccgcagggctaaagctcgagatgagggactctggacttcaaaccggcgaccctgctggcttcacacttgctgatacattggcttgtgggaccgttggtcacattattggtgttggtgttgttttaggcctcaagaacattggtgccatctaaacttgtaattcgaaaacttgttaataacattcgcgtgatcatcatcttttcgaacttatgtttattcatcatcgagcttaaattatctatgcaacggtcgatagcctg

SEQ ID NO: 3774 - DNA, 582 bp, Flaveria ramosissima
gcaacaagatcaaagtttatcctgcttcaaactttccatggccataaaccatcatcttttatgtggctcctgctttaagaatctttcgagaagcattcttttttcaaacccagaaatcagactgttttcaagatcacaaatggcaactgctgtcatgtcttctcttcctcaattcactggtttaaaggccacttcatcatcaccttcaccagttcaaagcatggtatcattgcaaccaatgaaacccaagggaaagagggctttaagtgttcgttgtgatttcattggttcatcaacaaatttgataatggtgacatcaaccaccttgatgttgtttgcgggccgatttgggttggcaccatcggcaaacaggaaggcgaccgcagggctaaagctcgagatgagggactctgggcttcaaaccggcgaccctgctggcttcacacttgctgatacattggcttgtgggaccgttggtcacattattggtgttggtgttgttttaggcctcaagaacattggtgccatctaaacttgtaattcgaaaacttgttaataacattcgcgttatcatcttctttt

SEQ ID NO: 3775 - DNA, 492 bp, Flaveria ramosissima
aacattatttttacaaacccagaaatcaaagtttttcaagatcacaaatggcaactgctgtcatgtcttctcttcctcagttcactggtttaaaggctgcttcatcatcaccttcaccggttcaaagcatggtatcattgcaaccaatgaaacccaagggaaagagagctttaagtgttcgttgtgatttcattggttcatcaacaaatttgataatggtgacatcaaccaccttaatgttgtttgcggggcgatttgggttggcaccgtcggcaaacaggaaggcgaccgctgggctaaagctcgagatgagggactcagggcttcaaaccggcgaccctgctggcttcacactcgctgatacattggcttgtgggaccgttggtcacattattggtgttggtgttgttttaggcctcaagaacattggtgccatctaaacttgtaattcgaaaacttgttaataacattcgtgtgatcatcttcttttcg

SEQ ID NO: 3776 - DNA, 731 bp, Citrus sinensis
ctcaccgaggatctaagtgtatccaattcaagcgttctgaagccacaaatcgctcacgtgggccatcataaacgtctgcctactcagtttttaatatcgtttcaaaacttaacaaactaaaataattcccaagtattactcgttctccggtcattcaatttcctccgtagaaagctgaaaaatggcaacttctttgatgaccatgccacagttcagtgggctcagaccccaaatctcagcagctcctgcacaaagcctggtagcagcccagccaatgaggaggaaatgcagtggagctttgggtgctcgttgtggcttcattggttcgcccacaaatttgataatggtgacaacaacaaccctgatgctatttgctgggagatttgggctggctccatcagcaaacaggaaagcaacggcaggattgaagcttgaagtgagggactctggcttgcaaactggtgacccagctgggttcactttggctgacacattggcttgtggcagtgttggtcacatcattggtgttggggtggtccttggccttaagaacttgggtgctctgtaaaaattttcgaagcagtttgttatgttaaatcgattgttaatactcgctgtgccatttctgttgcacctatctgcctggttttaattttttatggcttcatttggatgttaaaaataatttatttattattctctagaataaatgataagtgatattagtgatt

SEQ ID NO: 3777 - DNA, 833 bp, Primula obconica
ccgaaaaaattcaatctaggctaaatcagagagagaaaaatggcaggtgtaatgagcacaatcccacagttcagtggcctcaaggccacagtttcttctaccacatcagtgcagagactggtagctgtgcaaccaatgaagcgaaggggaaatggtgctttaggagctcgctgtgatttcattggctcacctactaatttgataatggttgcttcaacaagcttaatgctgtttgcggggcggtttggcttggccccctcagccaatagggtggcgacagctggcctaaagctcgagacaagggattcggggttgcagactggtgacccggccgggttcacccttgctgacacgttggcatgtggcactgttggtcacattattggggttggggttgttcttggcctcaaaaacattggtgccctttaaattatttactactactataaatttatgtacaagactcttgtttatacctctttcaatttcttttgtaatctcattcaatataatcctccgtttcctccaaaaaaaaaaaaataccagggccgcccattacggccgaaatctttcttctctctcccttacgataccttatcgtgctcctttttctctctcaagatgcagatcttcgtgaagaccctcaccggcaagaccattcacgtctcgaggttgagagctccgacacgatcgacaatgtacaaagccaaaatccaggacgaaggacgggcactcccccagaccagcagtaggcttctatattggactggacgaacaggcgtcgaggactcggccgcaccttagccgactacaacatccagaaggagtctacc

SEQ ID NO: 3778 - DNA, 506 bp, Primula obconica
ctaaatcagagagagaaaaatggcaggtgtaatgagcacaatcccacagttcagtggcctcaaggccacagtttcttctaccacatcagtgcagagactggtagctgtgcaaccaatgaagcgaaggggaaatggtgctttaggagctcgctgtgatttcattggctcacctactaatttgataatggttgcttcaacaagcttaatgctgtttgcggggcggtttggcttggccccctcagccaatagggtggcgacagctggcctaaagctcgagacaagggattcggggttgcagactggtgacccggccgggttcacccttgctgacacgttggcatgtggcactgttggtcacattattggggttggggttgttcttggcctcaaaaacattggtgccctttaaattatttactactactataaatttatgtacaagactcttgtttatacctctttcaatttcttttgtaatctcattcaatataatcctccgtttcctc

SEQ ID NO: 3779 - DNA, 503 bp, Primula obconica
atctaggctaaatcagagagagaaaaatggcaggtgtaatgagcacaatcccacagttcagtggcctcaaggccacagtttcttctaccacatcagtgcagagactggtagctgtgcaaccaatgaagcgaaggggaaatggtgctttaggagctcgctgtgatttcattggctcacctactaatttgataatggttgcttcaacaagcttaatgctgtttgcggggcggtttggcttggccccctcagccaatagggtggcgacagctggcctaaagctcgagacaagggattcggggttgcagactggtgacccggccgggttcacccttgctgacacgttggcatgtggcactgttggtcacattattggggttggggttgttcttggcctcaaaaacattggtgccctttaaattatttactactactataaatttatgtacaagactcttgtttatacctctttcaatttcttttgtaatctcattcaatataatcct

SEQ ID NO: 3780 - DNA, 506 bp, Primula obconica
tctaggctaaatcagagagagtaaaaatggcaggtgtgatgagcacaatcccacaattcactggcctcaaggccacagtttcttctaccacatcagtgcagagactggtcgctgtgcaaccaatgaagcgaaggggaaatggtgctttaggagctcgctgtgatttcattggctcacctactaatttgataatggttgcttcaacaagcttgatgctgtttgcgggtcggttcgggttggccccgtcggccaatagggtggcaacagctggcctaaagctcgaaacgagggattcggggttgcagaccggtgacccagcggggttcacccttgctgacacgttagcatgtggcacggttggccacattattggggttggggttgttcttggcctcaaaaacattggtgccctttaaattggagtattactagtactataaatttatctacaagactcttgtttataccactttcaatttcttttgtaatctcatccaatataatcc

SEQ ID NO: 3781 - DNA, 622 bp, Primula obconica
ctaagatctaacccatcttccttactcgctaatcatgtcggacaagtagcggaaactgcgactgtgctgacaccagcaagtgtgtgaagaaaggaaacaactatggtgtcgatttcatcgagaccgagaagagctacatagatcccattacggccgaaaaaattcaatctaggctaaatcagagagagaaaaatggcaggtgtaatgagcacaatcccacagttcagtggcctcaaggccacagtttcttctaccacatcagtgcagagactggtagctgtgcaaccaatgaagcgaaggggaaatggtgctttaggagctcgctgtgatttcattggctcacctactaatttgataatggttgcttcaacaagcttaatgctgtttgcggggcggtttggcttggccccctcagccaatagggtggcgacagctggcctaaagctcgagacaagggattcggggttgcagactggtgacccggccgggttcacccttgctgacacgttggcatgtggcactgttggtcacattattggggttggggttgttcttggcctcaaaaacattggtgccctttaaattatttactactactataaatttatgtacaagactcttg

SEQ ID NO: 3782 - DNA, 636 bp, Sesamum indicum
accagatttattttcttctctgcagtctgcatatatacacttacatcatcacttccctcaattgtgtctctcttaattttcagcgcaaaaatggctactgctctcatgacttcccttccacacttcaatggcctcaagccccaatcaccctcactttctcctctcaaaaacttggtagctgttcaatccatggggcgtaaaggacagggagcgctgggtgctcgctgtgacttcatcggctcgcccactaatttgataatggtgacttcgacgagtttgatgttatttgcgggtcgatttggattggctccatcagcaaaccgaaaggccactgctgggctgaagctggaggcaagggattcgggtcttcagacgggtgacccggcgggtttcaccctggcggatacattggcatgtggggttgtgggtcacattattggggttggggttgtactgggcctaaagaacattggcgctatttaaatttctgtttataatataaaatctttcttttctctatcatttccacaattttcctccgacatccatctatatgacaaaagaccacattgcacctgtcttaaaagatactatttaaaataaattgatttaagttaccatttggctgacctcatt

SEQ ID NO: 3783 - DNA, 464 bp, Primula obconica
ctaaatcagagagagaaaaatggcaggtgtaatgagcacaatcccacagttcagtggcctcaaaggccacagtttcttctaccacatcagtgcagagactggtagctgtgcaaccaatgaagcgaaggggaaatggtgctttaggagctcgctgtgatttcattggctcacctactaatttgataatggttgcttcaacaagcttaatgctgtttgcggggcggtttggcttggccccctcagccaatagggtggcgacagctggccctaaagctcgagacaagggattcggggttgcagactggtgacccggccgggttcacccttgctgacacgttggcatgtggcactgttggtcacattattgggggttggggttgttcttggcctcaaaaaacattggtgccctttaaattatttactactactataaatttatgtacaagactcttgtttatacctct

SEQ ID NO: 3784 - DNA, 466 bp, Catharanthus roseus
ggcttctgctataatgacttctcttcctcagttcaatggactcaggcccctcactttctcagcttcccctgtccagggcttggggcaggttggtgctcaagctcaagcagtgaagcacaaaggacagggtgctcttggtgctcgctgcgacttcattggctcaccaactaatctgataatggtgacctcaacaagcctgatgttgtttgcgggtagattcgggttggctccatcagcaaacaggaaggccacagcgggtctaaaactggagataagggattcgggactgcagacgggcgacccggctggttttacacttgctgatacattggcttgtggaactgtaggccacattattggtgttggagttgtacttggccttaaaaacattggtgctctctaaatctgttcataaaaaaatttttaaaaaaatctctgtattattaattaattaacaatactttta

SEQ ID NO: 3785 - DNA, 592 bp, Arachis hypogaea
aaaaaaaaaaaatagggagagcttagagattcaagtaatggcaaccacaatgatgaccactctccctcagttcaatggtcttagacccaaattctcagcagcccctgtgcagaacttggttgctgtccaacccatgaggcgtaaggggaagggtgctctaggaactcgctgtgatttcattggttcagaaaccaatctgattatggtggcttctacaacactgatgctgtttgccggaaggtttggattggctccgtcggcaaacaggaaagcgactgcagggctgaagctggaggtgagggactcaggcttacagactggtgacccagctggtttcacccttgctgataccttggcttgtggaactgttggccacatcattggtgttgggattgttcttggtcttaagatacgggtgccttgtaaattaaaacaagaaaaatgaacaaccattcctgcataatgcacctgtaatcaagtttagtgtgcttttaattttctcatcacttgagaatgaacattgtatgcctcaaatcttaatctaaaaaaaaagaaaaaaaacaaaagtactctgcgttgataccactgctta

SEQ ID NO: 3786 - DNA, 554 bp, Antirrhinum majus
gcagcacttttgagcaacatattacaatcactaagaattgaataaataatatttcagtttcttttttttattcattcgagcaaaaaatggcctctaccgtgatgtcttcactttccctcccacagttcaatggattgaagcctcaaattgccccagtttctcctgtcaaaagctttgttgctgttaaatccatgaggggtaaaggacagggagctttgggcgctcgttgtgacttcattggctcacctacaaacctgattatggtgacctcaactagcctgatgttgtttgcgggtcggttcgggttggctccatctgctaaccggaaagcaactgctggcctaaaattggaggttagggactcgggtttgcaaacgggtgacccggctgggttcacactggcggatactttggcctgtggggtagtgggccacattattggggttggagtagttcttgggcttaagaacattggtgctatttaaatttcttgttaaatttgttaatatgaatcatcatcatctattgtgaatcatctttctagttctccactc

SEQ ID NO: 3787 - DNA, 707 bp, Cichorium intybus
gcgggggcggattctgctttagaccatttaaactccatttttgaactcaaaggaatccaaaatggcaactgctctcatgtctactctccctcaattcacaggcctcaaagccacctcaccatcgtcttctccgatcaaaagcatagtagcattgcaaccaatgaagcccaagggaaagggaaagggagctttgggtgttcgttgtgatttcattggctcgtccacaaacttgataatggtgacatcaacaaccttgatgttgtttgctggtcgatttggattggcaccatcagcaaacaggaaggcaaccgctgggctaaagcttgaagcaagggattctggactgcaaaccggcgacccggctggttttacacttgctgacacattggcttgtgggaccgttggtcacattattggtgttggtgttgttttgggccttaagaatattggtgccatctaagaattgtttattaaaacaaactttcatgttaataccattgtcgtgactgatttctgttttgattttgtttgttttggtatgggtttcaatttatttatgtaaaggtcgagaagtatcaaaactagtatgcacataacttcaacatgcatacaacgaattatgcaatttaccctagatgcttaaaaaaagaaaattgtatgtgtgtaatacaaagttaatcaaacaccaaacaaaatgttgatatgct

SEQ ID NO: 3788 - DNA, 646 bp, Flaveria ramosissima
gtattccaacttgtttcaaattcaagaataatggcaaccagtgtcatgtcctctcttcctcagttcactggtttaaaagcgatttcatcatcaccctccacagttcaaaacatggtagcactgcaaccaatgaaacccaagggtaagggaaagggtgctttaggtgttcgttgtgatttcattggctcatcaacaaatttgataatggtgacatcaaccaccttgatgttgtttgcgggacgatttgggttggcaccatcagcaaacaggaaagcaactgcagggctaaagctcgaggtaagggactcgggacttcaaactggcgaccctgctgggtttacacttgctgatacattggcttgtggaaccgttggtcacattattggtgttggtgttgttttgggcctcaaaaacattggtgccatataaagtagttagttgtttgtaaacaaagtatcatgttaataacattgttattattttttccttacaaattactgtttgagtttgaatactataaacaagaatattggcttaaggtaacatgtaatggtgggcctggtggtaattgttgtcgggcttgggttgatatcatcagatccggacacaacccagttttattaatcttgttgaaaaaattaaggtt

SEQ ID NO: 3789 - DNA, 918 bp, Populus trichocarpa
aagaagaaagacgagactcggaggatgtgcgttgattaccgcagcgttaatcagggattagttccctattctattcatcaaattaggatattaccactaagtttgggtagacagatcttgcaaacaatctcagcaaaaaaaaccctatccaactgagcagtcctatggcataatgccaagtcagctacctgtatccaagtttatccaattcgaagattcttaagccacagatttctcaagtgggtatgcatggtcttttggatcccaagttgtattatgaagaattataagagaagagagagtggctttctctggtcattttttgcgcattcaaagaagcaaaatggcagccgccgccatgatgactgctaataccctcccaagattcaatggcctaagaccctcagccgtccctgtaaaatccctggcagctgttcaaccagtgaggcgaaagggaaatggagctctaggtgctcgtatggatttcatcggttcacccacaaatttgataatggtgacaagcacaagcctcatgctatttgctggaagatttgggctagctccatcagcaaacaggaaggctacagcaggattgaagctcgaggtgagggactcaggcttacaaactggtgatctagctgggttcactcttgctgataccttggcgtgtggggctgttggccacataattggtgttggggttgtccttggtctcaagaacatgggtgcattgtaagaatcttcataagcatatgaattgaagtgctctgcttttaattctgttcgtgtaccattttcctacatgcagatgcttgttgtcttgaggaacaatttgttcgtaacccatcagaatttcaaattaattttatacatgtgttcgtatcttagagaaatctaatcaagaattgggaatttgat

SEQ ID NO: 3790 - DNA, 658 bp, Papaver somniferum
aaataaaaaaaacaagctctatagagaaaaagattcacaaagcaatggcatcttcatctgcagtcatgacttcactcccacagttcagtggccttaggtccaaaccatcagctcctcgggtagactctctggtgagcattctaccaatgaagcgcaagggaaacggtgctttgggtgctcgctgcgactacatcggttcaccaacaaatttgataatggtgacctcaacaaccttgatgttgtttgctggaagatttgggttggctccatcagcaaacaggaaagcaacagcaggtttaaagcttgaaggaagggattctggtctacaaactggagacccagctggtttcactctagctgatactttggcctgtggaagtttcggccacattattggtgttggcgttgttttaggtcttaagggcattggtgcactataaataactatccattcttagtttgggatcatacttcccaatggtagtactcttttataaattcttattttgtaaatttgaatccatatatgtctgttctttccacctatgtttgcaaagggattgattggtttctgcattcttgacctggctcagtaacagatttgtcaatgtctacaaactcatatgatttagtttgatcatggccaaacttgggtttt

SEQ ID NO: 3791 - DNA, 947 bp, Quercus alba
atgtggctgttgtgcagcatttcttgttcgctaatttataatacttttgaagcaaggaaatgctaaaattataagactatcaagggagagagagagagagagctattacacacatttcttgttagatcaaatttccattgaggttggaagatggcaacagctgtgatgacttctctcccacaatttaatgggttaagacccaatttgtcagcagctcctgttaaaagcatggcagcaatccaaccaatgaggcgtaagggcaagggtgctcttggtgctcgttgcgaaggtttcattggttcacccacaaatttgataattgtgacttctacaaccttgatgctatttgctggaaggtttgggttggcaccatcggcaaacaggaaatccacagcaggattaaagcttgaagttaggaactctggcctacagactggtgacccagctggtttcactcttgcagatactttggcatgtggatctttgggtcacattattggggttggggttgttcttggcctcaagaaccttggtgcactgtaaattatcttaagcatcttattttatgttgttcttgtttgcaacttgtgtttggtttgataactcccaaaaaatgtgattggtagccaaagtttggggtcatgagagtaaggttgggctagttggagattggcataggaatcttcttttacttttccatttgccacaagttaaagacctaaaagagattttaaaaacagaagggaaaaatattatcagtacatcagtcatttctagccatgttcagctttgataccataaaacttggcagactaaaggagtcctgcatacaaatacgcctgtgagatacatattgcgcagcatttgtgaaaaagcagaaacaaaattgccaagaatttggtctgtacttttttagcgatgacaaaaaagttgtcactaatgctttg

SEQ ID NO: 3792 - DNA, 650 bp, Quercus alba
atcaagggagagagagagagagagctattgcacacatttcttgttagatcaaatttccattgaggttggaagatggcaacagctgtgatgacttctctcccacaatttaatgggttaagacccaatttgtcagcagctcctgttaaaagcatggcagcaatcctaccaatgaggcgtaagggcaagggtgctcttggtgctcgttgcgaaggtttcattggttcacccacaaatttgataattgtgacttctacaaccttgatgctatttgctggaaggtttgggttggcaccatcggcaaacaggaaatccacagcaggattaaagcttgaagttaggaactctggcctacagactggtgacccagctggtttcactcttgcagatactttggcatgtggatctttgggtcacattattggggttggggttgttcttggcctcaagaaccttggtgcactgtaaattatcttaagcatcttattttatgttgttcttgtttgcaacttgtgtttggtttgataactcccaaaaaatgtgattggtagccaaagtttggggtcatgagagtaaggttgggctagttggagattggcataggaatcttcttttacttttccatttgccacaagttaaagacctaaaagaga

SEQ ID NO: 3793 - DNA, 624 bp, Camellia sinensis
ggggagctacagagctgccaacagttttataatccatttaaatcaaattaaagcaagaactgtaaaaatatcagcagagagagagagagatctatcattcattttttttttcaaatttgatcagtgtttgaagttgaggagatggcaacagcagtgatgacctctctcccacagttcagtgggctaagacccaaatcatcatcatctgcttcaccaattcaaaccctggtagcagttcaaccaatgagacgtagggggaagggagctttaggcgctcgctgcgatttcatcggctcccccacaaatttgataatggtgttttcaacaagcttgatgctgtttgcgggtcggttggggttggctccatcagcaaacaggaaagccacagcagggttgaagcttgagataagggagtctggccttcaaactggtgaccctgctggtttcacccttgcagataccttggcttgtggctcttttggtcacattattggtgtaggggttgttcttggcctcaagaacattggtgctctttgaataaacatatgttctaaaattggttaattaatatataatagaacttctctggttgtttcaatttacatcacggtgggtttggcaccc

SEQ ID NO: 3794 - DNA, 755 bp, Euphorbia peplus
cagatcaaaggaatttggaaaatggcagcctcagcttccttgatgacttctctccctcaattcaatggccttaaaccccaacttcctgctgctgcttctttcaaatctctggcagcagttcaagggagtaggcggaagggaaatggaggggcgttgggagctcggatggatttcataggttcaccaacaaatttgataatggtgacatcgacaagtctgatgctattcgcgggaagattcgggttagcaccatcggcaaacaggaaggcaacagcagggcttaagctagaagcaagggactcaggactccaaacaggagacccagcagggttcactttggctgatacattggcttgtggtaccgtcggtcacattattggtgttggagttgttcttggccttaaaaacattggcgctttctaattctatttactctaattcctaccttgttcattaccatatatgcatctcaattattttttccatcttcttacgattaattttcgttaggagatatcaacatcgttttatttgaattgatggaactattaaaaaattacttaaaaataaacaatacacgaaatttacgtggttccaaaccacggcaattgcctctacctgcatggtagaggaaaagcttttactgaagtcatcatcatgctcagtgtttttgaagtatcaattttagtctcaattttacttgaacaccatacacataaaccaatgaataaaagtttataattgaattgaaattg

SEQ ID NO: 3795 - DNA, 1174 bp, Quercus alba
atcaagggagagagagagagagagctattacacacattttcttgttagatcaaatttccattgaggttggaagatggcaacagctgtgatgacttctctcccacaattttaatgggttaagacccaatttgtcagcagctcctgttaaaagcatggcagcaatccaaccaatgaggcgtaagggcaagggtgctcttggtgctcgttgcgaaggtttcattggttcacccacaaatttgataattgtgacttctacaaccttgatgctatttgctggaaggtttgggttggcaccatcggcaaacaggaaatccacagcaggattaaagcttgaagttaggaactctggcctacagactggtgacccagctggtttcactcttgcagatactttggcatgtggatctttgggtcacattattggggttggggttgttcttggcctcaagaaccttggtgcactgtaaattatcttaagcatcttattttatgttgttcttgtttgcaacttgtgtttggtttgataactcccaaaaaatgtgattggtagccaaagtttggggtcatgagagtaaggttgggctagttggagattggcataggaatcttcttttacttttccatttgccacaagttaaagacctaaaagagattttaaaaacaaaagggaaaatattacccagtacatcactcatttctagccatattcagctttgataccataaatcttgtcaaactcaaggagtcctgcatacaaatacgccgtgacatacatactgtgcagcatttgtgaaaaagcagaagcaaaattgcaagaaatttggtctgttactttttagcgatgacaaaaaagctgtcactaatgctttgaatgttgtcgctattagtattcgcaacgacatttgttgacgctaattttcattgcatatatttagtttaaaaaaaattttagcttcaacattaatttcggtgtagatatgttactacttagtgacaacattaatgttgttgctaatagtaataaatttcatcatagataacgaaagaacccaaagcaataagtcgctcctaataggacattactaaatattaggcctaaatgtaaaactaatcttctaagtttcacattctatcatttcagtcctctaaattttaagtatagtcaattcagttc

SEQ ID NO: 3796 - DNA, 443 bp, Flaveria ramosissima
agaagcattcttttttcaaacccagaaatcacagtgttttcaagatcacaaatggcaactgctgtcatgtcttctcttcctcaattcactggtttaaaggccacttcatcatcaccttcaccagttcaaagcatggtatcattgcaaccgatgaaacccaagggaaagagagctttaagtgtgcgttgtgatttcattggttcatccaccaatctgataatggtgacatcaaccaccttgatgttgtttgcgggtcgatttgggttggcaccatcggcaaacaggaaggcgaccgcagggctaaagctcgagatgagggactctgggcttcaaaccggcgaccctgctggcttcacacttgctgatacattggcttgtgggaccgttggtcacattattggtgttggtgtcgttttaggcctcagaacattggtgccatctaa

SEQ ID NO: 3797 - DNA, 504 bp, Flaveria ramosissima
gggggtaaaacccgacggaaaataccgagtagacggtttttctaagaacgtacgcaaaattagggcaactgctgtcatgtcttctcttcctcaattcactggtttaaaggccacttcatcatcaccttcacccgttcaaagcatggtatcattgcaaccaatgaagcccaagggaaagagggctttaagtgttcgttgtgatttcattggttcatcaacaaatttgataatggtgacatcaaccaccttgatgttgtttgcgggccgatttgggttggcaccatcggcaaacaggaaggcgacagcagggctaaagctcgagatgagggactctgggcttcaaaccggcgaccctgctggcttcacacttgctgatacattggcttgtgggaccgttggtcacattattggtgttggtgttgttttaggcctcaagaacattggtgccatctgaacatgtaattcgaaaacttgttaataacattcgcgtgatcatcttctttt

SEQ ID NO: 3798 - DNA, 571 bp, Flaveria ramosissima
aaacacagaaatcaaagtttttcaagatcacaaatggcaactgctgtcatgtcttctcttcctcaattcactggtttaaaggccacttcatcatcaccttcaacggttcaaagcatggtgtcattgcaaccaatgaaacccaagggaaagagagctttaagtgtgcgttgtgatttcattggttcatccacaaatctgataatggtgacatcaaccaccttgatgttgtttgcgggccgatttgggttggcgccatcagcaaacaggaaggcaaccgcagggctaaagctcgagatgagggactctgggcttcaaaccggcgaccctgctggcttcacactcgctgatacgttggcttgtgggaccgttggtcacattattggtgttggtgttgttttaggcctcaagaacattggtgccatctaaacttgtaattcgaaaacttgttaataacattcgcgtgatcatcttcttttcgaatttatgtttattcattgttgagtttaaattatctatgtaacggtcgatagcctgcgatacttaatatgttattattttaactaagaagcta

SEQ ID NO: 3799 - DNA, 479 bp, Flaveria ramosissima
ggggtaaacccgacgaaacgtacacagcgttttctaagaatctacaaactaggcaactgctgtcatgtcttctcttcctcaattcactggtttaaaggccacttcatcatcaccttcaccagttcaaagcatggtatcattgcaaccgatgaaacccaagggaaagagagctttaagtgtgcgttgtgatttcattggttcatccaccaatctgataatggtgacatcaaccaccttgatgttgtttgcgggtcgatttgggttggcaccatcggcaaacaggaaggcgaccgcagggctaaagctcgagatgagggactctgggcttcaaaccggcgaccctgctggcttcacacttgctgatacattggcttgtgggaccgttggtcacattattggtgttggtgtcgttttaggcctcaagaacattggtgccatctaaacttgtaattcgaaaacttgttaataacattcgtgtg

SEQ ID NO: 3800 - DNA, 561 bp, Flaveria ramosissima
caggaagcattattttcacaaacacagaaatcaaagtttttctaagatcacaaatggcaactgctctcatgtcttctcttcctcaattcactggtttaaaggccacttcatcatcaccttcaccagttcaaagcatggtatcattgcaaccgatgaaacccaagggaaagagagctttaagtgtgcgttgtgatttcattggttcatccaccaatctgataatggtgacatcaaccaccttgatgttgtttgcgggtagatttgggttggcaccatcggcaaacaggaaggcgaccgcagggctaaagctcgagatgagggactctgggcttcaaaaccggcgaccctgctggcttcacacttgctgatacattggcttgtgggaccgttggtcacattattggtgttggtgtcgttttaggcctcaaaaacattggtgccatctaaacctgtaattcgaaaacttgttaataacattcgcgttatctatcttcttttcgaatttatgtttattcatcgtcgagcttaaattatctatgcaacggtcgataacctgccggt

SEQ ID NO: 3801 - DNA, 419 bp, Flaveria ramosissima
aatggcaactgctgtcatgtcttctcttcctcaattcactggtttaaaggccacttcatcatcaccttcaccagttcaaagcatggtatcattgcaaccaatgaaacccaagggaaagagggctttaagtgttcgttgtgatttcattggttcatcaacaaatttgataatggtgacatcaaccaccttgatgttgtttgcgggtcgatttgggttggcaaccatcggcaaacaggaaggcgaccgcagggctaaagctcgagatgagggactctgggcttcaaaccggcgaccctgctggcttcacacttgctgatacattggcttgtggggccgttggtcacattattggtgttggtgttgttttaggcctcaagaacattggtgccatacaaacttgtaattcgaaaacttgttaa

SEQ ID NO: 3802 - DNA, 514 bp, Flaveria ramosissima
gttcaacgaccacgaagtacgaatagggtacgaaataggacgaactagctgtcatgtcttctcttcctcaattcactggtttaaaggtctacttcatcatcaccttctccagttcaaagcatggtatcatttgcaaccaatgaaacccaagggaaagagggctttaagtgttcgttgtgatttcattggttcgtccacaaatctgataatggtaacatcaaccaccttgatgttgtttgcggggcggtttgggttggcaccatcggcaaacaggaaggcaaccgctgggctaaagctcgagatgagggactcagggcttcaaaccggtgaccccgcgggcttcacactcgctgatacgttggcttgtgggaccgttggtcacattattggtgttggtgttgttttaggcctcaagaacatcggtgccatctaaacttgtattcgaaaacttgttaataacattcgcgtgatcattcttcttttcgaattcatgtttattcattgttgagtttaa

SEQ ID NO: 3803 - DNA, 506 bp, Flaveria ramosissima
caaatggcaactgctctcatgtcttctcttcctcaattcactggtttaaaggccacttcatcatcaccttcaccagttcaaagcatggtatcattgcaaccgatgaaacccaagggaaagagagctttaagtgtgcgttgtgatttcattggttcatccaccaatctgataatggtgacatcaaccaccttgatgttgtttgcgggtagatttgggttggcaccatcggcaaacaggaaggcgaccgcagggctaaagctcgagatgagggacttctgggcttcaaaccggcgaccctgctggcttcacacttgctgatacattggcttgtgggaccgttggtcacattattggtgttggtgtcgttttaggcctcaaaaacaattggtgccatctaaacctgtaattcgaaaacttgttaataacattcgcgttatcatcttcttttcgaatttatgtttattcatcgtcgagcttaaattatctatgcaacggtcgataacctg

SEQ ID NO: 3804 - DNA, 636 bp, Actinidia deliciosa
atcactcctagtcttttatatccaatcaaacccagaaatctaaaaattatcagcaaagaattgaggcgagggagagagcatttcatcattgatccgtgtttaaagttgaggaaatggcaacatctatgatgacctctctcccacaattcactgggctaaggcccaaattatcaccagttaaatgcatggtaggagctcaaccaatgaggcgtagagggaacggacgtttaagcgttcgctgcgatttcatcggctcatccacaaatttgataatggtggcatccacaagcttgatgctgtttgcagggagatttgggttggctccatcagcaaacaggaaggccacagcagggctgaagcttgagaatagggactctggtctgcagactggtgaccctgctggcttcacccttgcagacaccttggcttgtggcactgtgggtcacatcattggggttggggttgtgcttggcctcaagaacttgggtgctatttgaggctgtctccataaaatttgttaataatatacctcctcttttgtaatcttaatttttcatcgtctgcctgattactgctaattggtgattttgcatattaatatcgttcaaaccaactcccccaaccccacataaaaaa

SEQ ID NO: 3805 - DNA, 643 bp, Olea europaea
aattattctttgatcagtttctgagttgagcaaaaatggctactgcagtgattacttctctaccacaattcagtggtctcagactcaaaccagcatcagcttcccctgtcaaaagcttggtagcagctcaaccgatgaagcataaagggcagggagctttgggcgcacgctgtgatttcattggctccccaacaaatctgataatggtgacctcaacaagtctgatgctgtttgccggtcggttcggtttggctccatctgcaaacaggaagggtactgcaggattaaagcttgaggtgagggactccgggctgcaaacaggggatccagctggtttcaccctagcagatacgctggcttgtggggttgtgggtcacattattggggttggggttgtaattggcctcaagaacattggtgccatctaaacaaaacatattttgtgttaattccatcagtattcatttggcttcatcttattccatatatcataagacattatcaaggcagctcttgttccctatcctattggggcggatctcgtgatgtcctcacaaagcgtcgggctggagcgatggaggcccttaaggttggggttcaatctttttgtttctcggaagagtatgtgtattagtgatagaga

SEQ ID NO: 3806 - DNA, 513 bp, Primula obconica
aaattcaatctaggctaaatcagagagagaaaaatggcaggtgtaatgagcacaatcccacagttcagtggcctcaaggccacagtttcttctaccacatcagtgcagagactggtagctgtgcaaccaatgaagcgaaggggaaatggtgctttaggagctcgctgtgatttcattggctcacctactaatttgataatggttgcttcaacaagcttaatgctgtttgcggggcggtttggcttggccccctcagccaatagggtggcgacagctggcctaaagctcgagacaagggattcgggggttgcagactggtgacccggcgggttcacccttgctgacacgttggcatgtggcactgttggtcacattattggggttggggttgttcttggcctcaaaaacattggtgccctttaaattatttactactactataaatttatgtacaagactcttgtttatacctctttcaatttcttttgtaatctcattcaatataatcctccg

SEQ ID NO: 3807 - DNA, 2396 bp, Brassica rapa
aatgaagttaatatattttgaatttaaatgtgtaagtttttggtggttgtcaagaaaatataatgggtgtaggcttttttggcttctctctatatatatactacacaatctgctctaaaaaccaacaagcccaccaatctcttctctgctccatatcttcttcttctctcactaagaaccaaacaatgctcaaaccgttgcttcttctccaatcgttcttgttctgtctcttcaatgttgctttcgtcggaggacggttaatcggcggcggttactcggcgcaggagaatccattcactcccaaagcatctcttgtccgttactggaacaaagagatccgcagcgacaaatcatccatcagatcggagtttctcatctccaaggcttcaccgcttaacgccgtcgagtccgccactttcgccaaactcgccgcccagaactcgctcccgactcgtctcccggacttctgctccgccgcgaacctcttctgcttcccggatttatccccgagcctcgagcagcacaacgccgacgtcaagttctccgtctacgaccagaagaacttcaccaactacggcaatgccgccgccggcggcaccgactcgttcaaaacctattccaaagacggcaacgtcgtcaccgattcgttccggagatacagccgcaacgccgccggtcacgacgataagttcaccgtctacggcgacagcagcaacgtcgtggaggaaaacttcaactcctacggaaccttcggaaccggcggcaccggagaattcaccaactaccaaaacggcgtcaacaacccgacgagccgattcacggcgtactccgacggcggcaacggaaaggctcagtcgttcaaaacctacactcacgaggccaacgccggggacggccagtcgttcacgagctacggcaagaacgggaacggagtgccgaacgagttcgcatcctacggcgtctccgccaacgtaatcggctccggcttctcgaactacggcgagaaaggaaacgccgccaacgactccttcacgagctacggcagcgacgggaacgtcccgcagaacaacttcaagaactatggcgcctccggtaacgccgcctccgacacgttcgcgaactacagagacaaatccaacgtcggagacgattccttctcctcctacgctaaagactcaaactccggtacggctaaattcaataattacggtcagtcattcaatcccggttcggagacattcaccggttatgggaaaggagccgaaggacacaagatcagcttcaaaacgtacacgcccaactctaccttcaaagactacgccaaaaacggcgtcggtttcgcgaagtacaacgtctcctccacgtcagcaaccctcggcgatggcaaaaccgtgaataagtggatcgaaccgggcaaattcttcagagaagcgtcgcttaaagaaggcacagtgattcccatgcctgacattaaggataaaatgcctaaaaggtcgtttttgccccggagcatcatctcgaagctccccttctccacctccaagctcgccgagatcaacaagatcttccacgccggagagaactccacgatggagaagatcatctccgacgcggtgacggaatgcgagaggtcgccgagtgttggagagacgaagcggtgcgttggttccgcggaggatatgattgatttcgctacttcggtgcttggtcggagcgtggtgctgcggacgacggagaatgtggcggggtcgaagcagaaggtgatgatcgggaaagtcaacgggatcaacggcgggaaagtgacgaaagctgtgtcgtgtcaccagagtttgtacccgtatctaatgtattactgccactccgttcctaaggttcgggtctacgaagcggatcttctagacttgaagagtaagaccaagatcaaccacgggatcgccatctgtcacatggacacgtcatcgtggggtccgaagcatggagctttcttagctctcgggtcgaaaccgggtctgatcgaggtttgtcactggatatttgagaacgacatgaactgggctatcgcggattaaaaccgggtccggtctggatctatcatgcttttttttttcaagtattaaatatgaatattatcttatcgccgagatttgaatagaggaatgttaattttctactattgttatatgttttcctaagccttttcagtaacagtaaagacttgttactgatttgtttgtggcggcacgaataatatttaagatatttagtgaatgtttgttgacgctatttatgatgattattataggtggttggttggattggctgattgaatatttattttatctataaatgaaggggttatgatatcatatggatttatcatgtgtatattataagag

SEQ ID NO: 3808 - DNA, 2064 bp, Brassica napus
tgtctcttcaatgttgctttcgtcggaggacggttaatcggcggcggttactcggcgcaggagaatccattcactcccaaagcatctcttgtccgttactggaacaaagagatccgcagcgacaaatcatccatcagatcggagtttctcatctccaaggcttcaccgcttaacgccgtcgagtccgccactttcgccaaactcgccgcccagaactcgctcccgactcgtctcccggacttctgctccgccgcgaacctcttctgtttcccggatttatccccgagcctcgagcagcataacgccgacgtcaagttctccgtctacgaccagaagaacttcaccaactacggcaatgccgccgccggcggcaccgactcgttcaaaacctactccaaagacggcaacgtcgtcaccgattcgttccggagatacagccgcaacgccgccggtcacgacgataagttcaccgtctacggcgacagcagcaacgtggtggaggaaaacttcaactcctacggaaccttcggaaccggcggcaccggagaattcaccaactaccaaaacggcgtcaacaacccgacgagccgattcacggcgtactccgacggcggcaacggaaaggctcagtctttcaaaacctacactcacgaggccaacgccgggaacggccagtcgttcacgagctacggcaagaacgggaacggagtgccgaacgagttcgcgtcctacggcgtctccgccaacgtaatcggctccggcttctcgaactacggcgagaaaggaaacgccgccaacgactccttcacgagctacggcagcgacgggaacgtcccgcagaacaacttcaagaactacggcgcctccggcaacgccgcctccgacacgttcgcgaactacagagacaaatccaacgtcggagacgattccttctcctcctacgctaaagactcgaactccggtacggctaaattcactaattacggtcagtcattcaatcccggttcggagacattcaccggttatgggaaaggagccgaaggacacaagattagcttcaaaacgtacacgcccaactccactttcaaggactacgccaaaaacggcgtcggtttcgcgaagtacaacgtctcctccacgtcagcaaccctcggcgatggcaaaaccgtgaataagtggatcgaaccgggcaaattcttcagagaagcgtctctcaaagaaggcacagtgattcccatgcctgacattaaggataaaatgcctaaaaggtcgtttttgccccggagcatcatctcgaagctccctttctccacttccaagctcgccgagatcaacaagatcttccacgccggagagaactccacgatggagaagatcatctccgacgcggtgacggaatgcgagaggtcgccgagtgttggagagacgaagcggtgcgttggttccgcggaggatatgattgatttcgctacttcggtgcttggccggagcgtggtgctgcgaacgacggagaatgtggcggggtcgaagcagaaggtggtgatcgggaaagtcaacgggatcaacggcgggaaagtgacgaaagctgtgtcgtgtcaccagagtttgtacccgtatctaatgtattactgccactccgttcctaaggttcgggtctacgaagcggatcttctagacttgaagagtaagaccaagatcaaccacggaatcgccatctgtcacatggacacgtcatcgtggggtccgaagcatggagctttcttagctctcgggtcgaaaccgggtctgatcgaggtttgtcactggatatttgagaacgacatgaactgggctatcgcggattaaaaccgggtcgggtctggatctatcatgtctttttttaagtattaaatatgaatattatcttatcgccgagatttgaatagaggaatgttaattttctactattgttatatgttttcctaaaagactttttacagtaacagtaaagacttgttactgatttgtttgtggcggcacgaataatatttaagatatttaagtaacaaaaaaaaaaaaaaaacg

SEQ ID NO: 3809 - DNA, 2077 bp, Brassica napus
aatgttgctttcgtcggaggacggttaatcggcggcggttactcggcgcaggagaatccattcactcccaaagcatctcttgtccgttactggaacaaagagatccgcagcgacaaatcatccatcagatcggagtttctcatctccaaggcttcaccgcttaacgccgtcgagtccgccactttcgccaaactcgccgcccagaactcgctcccgactcgtctcccggacttctgctccgccgcgaacctcttctgcttcccggatttatccccgagcctcgagcagcacaacgccgacgtcaagttctccgtctacgacgagaagaacttcaccaactacggcaatgccgccgccggcggcaccgactcgttcaaaacctactccaaagacggcaacgtcgtcaccgattcgttccggagatacagccgcaacgccgccggacacgacgataagttcaccgtctacggcgacagcagcaacgtcgtggaggaaaacttcaactcctacggaaccttcggaaccggcggcaccggagaattcaccaactaccaaaacggcgtcaacaacccgacgagccgattcacggcgtactccgacggcggcaacggaaaggctcagtctttcaaaacctacactcacgaggccaacgccggggacggccagtcgttcacgagctacggcaagaacgggaacggagttccgaacgagttcgcatcctacggcgtctccgccaacgtaatcggctccggcttctcgaactacggcgagaaaggaaacgccgccaacgactccttcacgagctacggcagcgacgggaacgtcccgcagaacaacttcaagaactatggcgcctccggtaacgccgcctccgacacgttcgcgaactacagagacaaatccaacgtcggagacgattccttctcctcctacgctaaagactcgaactccggtacggctaaattcactaattacggtcagtcattcaatcccggttcggagacattcaccggttatgggaaaggagccgaaggacacaagatcagcttcaaaacctacacgcccaactctaccttcaaagactacgctaaaaacggcgtcggtttcgcgaagtataacgtttcctccacgtcagcaaccctcggcgatggcaaaaccgtgaataagtggatcgagccgggcaaattcttcagagaagcgtctctcaaagaaggcacagtgattcccatgcctgacattaaggataaaatgcctaaaaggtcgtttttgccccggagcatcatctcgaagctccccttctccacctccaagctagccgagatcaacaagatcttccacgccggagagaactccacgatggagaagatcatctccgacgcggtgacggaatgcgagaggtcgccgagtgttggagagacgaagcggtgcgttggttccgcggaggatatgattgatttcgctacttcggtgcttggccggagcgtggtgctgcgaacgacggagaatgtggcggggtcgaagcagaaggtggtgatcgggaaagtcaacgggatcaacggcgggaaagtgacgaaagctgtgtcgtgtcaccagagtttgtacccgtatctaatgtattactgccactccgttcctaaggttcgggtctacgaagcggatcttctagacttgaagagtaagaccaagatcaaccacggaatcgccatctgtcacatggacacgtcatcgtggggtccgaagcatggagctttcttagctctcgggtcgaaaccgggtctgatcgaggtttgtcactggatatttgagaacgacatgaactgggctatcgcggattaaaaccgggtcgggtctggatctatcatgcttttttttttcaagtattaaatatgaatattatcttatcgccgagatttgaatagaggaatgttaattttctactattgttatatgttttcctaagccttttcagtaagagtaaagacttgttactgatttgtttgtggcggcacgaataatatttaagatatttagtgaatgtttgttgacgctatttatgatgattattatagctggttgg

SEQ ID NO: 3810 - DNA, 2083 bp, Brassica napus
gttgcctttgtcggaggacggttaatcggcggcggtttctcggcggaggagaatccattcactcccaaagcatctcttgtccgttactggaacaaagagatccgcagcgacaaatcatctctcagatcggagttcctcatctccaaggcttcaccgcttaacgccgtcgagtccgccactttcgccaaactcgccgcccagaactcgctcccgacacgtctcccggacttctgctccgccgcgaacctcttctgcttcccggatttatccccgagcctcgagcagcacaacgccgacgtcaagttctccgtctacgaccagaagaacttcaccaactacggcaatgccgccgccggcggcgccgactcgttcaaaacctactccaaagacggcaacgtagtcaccgattcgttccggagatacagccgcaacgccgccggacacgacgataagttcaccgtctacggcgacagcagcaacgtcgtggaggaaaacttcaactcctacgggaccttcggaaccggcggcaccggagaattcaccaactaccaaaacggcgttaacaacccgacgagccgattcacggcgtactccgacggcggaaacggaaaggctcagtcgttcaaaacctacactcacgaggccaacgccgggaacggccagtcgttcacgagctacggcaagaacgggaacggagtgccgaacgagttcgcctcgtacggcgtctccgccaacgtaatcggctccggcttctcgaactacggcgagaaaggaaacgccgccaacgactccttcacgagctacggcagcgacgggaatgtcccgcagaacaacttcaaaaactacggcgcctccggcaacgccgcctccgacacgttcgcgaactacagagacaaatccaacgtcggagacgactccttctcctcctacgctaaagactcaaactccggtacggctaaattcactaattacggtcagtcattcaatcccggttcggagacattcaccggttatggcaaaggagccgaaggacacaagatcagcttcaaaacctacacgcccaactccactttcaaggactacgccaaaaacggcgtcggtttcgcgaagtacaacgtctcctccacgtcagcaaccctcggcgatggcaaaaccgtgaataagtggatcgagccgggcaaattcttcagagaggcgtcgcttaaagaaggcacagtgattcctatgcctgacattaaggataaaatgcctgaaaggtcgtttttgccccggagcatcatctcgaagctccccttctccacctccaagctcgccgagatcaacaagatcttccacgccggagagaactccacgatggagaagatcatctccgacgcggtgacggaatgcgagaggtcgccgagtgttggagagacgaagcggtgcgttggttccgccgaggatatgatcgatttcgccacgtcggtgcttggtcggagcgtggtgctgcgaacgacggagaatgtggcggggtcgaagcagaaggtggtgatcgggaaagtcaacggaatcaacggcgggaaagtgacgaaagctgtgtcatgtcaccagagtttgtacccgtatctaatgtattactgccactccgttcctaaggttcgggtctacgaagcggatcttcttgacttgaagagtaagaccaagatcaaccacgggatcgccatctgtcacattgacacgtcatcgtggggtccgaagcacggagctttcttagctcttgggtcgaaaccgggtctgattgaggtttgtcactggatatttgagaacgacatgaactgggccatcgctgattaaaaccgggtcgggtgtggatctatcatgcttttttttaagtattaaatatgaatattatcttatcgccgagatttgaatagaggaatgttaattttctactattgttatatgttttcctaagcttttacagtaacagtaaagacttgttactgatttgtttgtggcggcacgaataatatttaagatattcagtgaatgtttgttgacgctatttatgatgattatagctggttggttggattggctgatt

SEQ ID NO: 3811 - DNA, 2431 bp, Eutrema parvulum
aatgaatttataaattttaaagctttagatatttaattttaattatcgacaaaatataattggtgtaggctttttggcttctatatatatagacatatatatatatactacacaatcgtctctcaaacccaacaagcccaccaatctcttctctgctctatatcttcttcttctttttttttctctctctttcttcactaagaaccaaaaatgctcaaaccgttgcttcttctccaatcgttcttgttctgcctcttcaatgttgttttcgtcggaggacggttaattggcggcggtttctcggcggaggagaatccattcactcccaaagcatctctggttcgttactggaacaaagaaatccgcggcgataagtatctcagatcggagtttcttatctccaaggcgtccccgcttaacgccgtcgactcggctactttcgctaaactcgccgcccagaactcgctcccgactcgtcttcctgatttctgctccgccgcgaacctcttctgtttcccggatttgagcccgagccttgagaagcacaacaacgacgttaagttctccgtctacgaccagaaaaacttcaccaactacggcaatgcccgtgccggcggcaccgactctttcatgacctactcgaaagagggcaacgtcgtcaccgattctttccggagatacagccgtggcgcggcgggtcacaacgaaaaattcaacgtctactccaacaacgacaacgtcgtcgaggagaatttcaactcctacgggaccttcggaacaggcggcgcaggagacttcaccaactaccaaaacggcgttaacaatccgaccagccgattcacggcgtattccgacggcggaaacggacggtctcagacgttcaagacctacactcacgaggccaacgccggtgaaggccaatcgttcacaagctacggcaaaaacggaaacgggttaccgaatgagttcgcctcttacggcgtctccgccaacgtcgtcggctctggtttctctaactacggcgagaaaggaaacgccgccaacgactccttcacaagctacggaaccgacggaaatgtgccgcagaacaacttcaaaaactacggcgcctccggtaacgccgccgtggacactttcgcgaattacagagataaggccaacgtcggcgacgattctttctcctcctacgctaaagactccagctccgggaaggtcaaattcacaaactacggccagtctttcaatcccggatcggaaactttcaccggttacggcaaaggagctgaagggcacaaggtcagtttcaagacctacacaccaaactccaccttcaaggattacgctaaaaacggcgtcggtttctccaaatacaacgtttcttccctttcatccaccgtcggcgatggcaaaaccgtgaataagtggatcgagccgggcaaattcttcagggaatcgacgcttaaagaaggaacagtgattcctatgcctgacattaaggataaaatgcctaaaaggtcgtttttgccccgaagcatcatctccaaattacctttcgccacttcaaaactcggcgagatcaagaggatcttccacgccggagagaactcgacgatggagaagataatctccgacgccgtgaccgaatgcgagaggtctcccagcgccggagagacgaagcggtgcgtcggatcggcggaggacatgatagatttcgccacgtcggtactcggacgtagcgtggtgctccgaacaacggagaatgtggcagggtcaaagcagaaggtggtgatcgggaaagtcaacggaatcaacggcgggaaattgacgaaagcagtatcgtgtcaccagagtttgtacccgtacctattgtattactgccactcggttccaaaggtccgggtatacgaagctgatattctggagctgaacagcaagaccaagatcaaccacggaatcgccatctgtcacatggacacgtcatcatggggtccgaaccacggagctttcttagctctcgggtcgaaaccgggtcggattgaagtttgtcactggatatttgagaacgacatgaactgggctatcgccgattaaaaccgagtcgggtcggatctggatttatcatccggtttttttaagtatcaaaatattattatcttatcgccgagattttaaatagaggaatgttaattttctactattggctttatatatgtttttaagtttttcagtaacagtaaaggcttgtttactgatttgtatgtggcggtacgaataatattaaaagaaaatatttagtgaatgtttgtttgttgactcaatttatgattatggctgagtggttagattggctgattggatatttattattatctgtaaatgaagggattataaatttgatatggatatatcatgtgttgtagtataatataag

SEQ ID NO: 3812 - DNA, 2458 bp, Eutrema parvulum
aatgaatttataaattttaaagctttagatatttaattttaattatcgacaaaatataattggtgtaggctttttggcttctatatatatagacatatatatatatactacacaatcgtctctcaaacccaacaagcccaccaatctcttctctgctctgtatcttatttttcctctctctcactaagaaccaaacaaaaaaatgctcaaaccgttgcttcttctccaatcgttcttgttctgcctcttcaatgttgttctcgtcggaggacggttaatcggcggcggtttctcggcggaggagaatccattcactccaaaagcatctctggttcgttactggaacaaagaaatccgcagcgacaaatatctcagatcggagtttctaatctccaaagcgtccccgctcaacgccgtcgactcagccactttcgcaaaactcgccgcccaaaactcgctcccgactcgtctccctgatttctgctccgccgcgaacctcttctgtttcccggatttaagcccgagcctcaagaaacacaacaacgacgtcaagttctccgtctacaaccagaaaaacttcaccaactacggcaatgcccgtgccggcggcaccgactctttcatgacctactcgaaagagggcaacgtcgtcaccgattctttccggagatacagccgtggcgcggcgggtcacaacgaaaaattcaacgtctactccaacaacgacaacgtcgtcgaggagaatttcaactcctacgggaccttcggaacaggcggcgcaggagacttcaccaactaccaaaacggcgttaacaatccgaccagccgattcacggcgtattccgacggcggaaacggacggtctcagacgttcaagacctacactcacgaggccaacgccggtgaaggccaatcgttcacaagctacggcaaaaacggaaacgggttaccgaatgagttcgcctcttacggcgtctccgccaacgtcgtcggctctggtttctctaactacggcgagaaaggaaacgccgccaacgactccttcacaagctacggaaccgacggaaatgtgccgcagaacaacttcaaaaactacggcgcctccggtaacgccgccgtggacactttcgcgaattacagagataaggccaacgtcggcgacgattctttctcctcctacgctaaagactccagctccgggaaggtcaaattcacaaactacggccagtctttcaatcccggatcggaaactttcaccggttacggcaaaggagctgaagggcacaaggtcagtttcaagacctacacaccaaactccaccttcaaggattacgctaaaaacggcgtcggtttctccaaatacaacgtttcttccctttcatccaccgtcggcgatggcaaaaccgtgaataagtggatcgagccgggcaaattcttcagggaatcgacgcttaaagaaggaacagtgattcctatgcctgacattaaggataaaatgcctaaaaggtcgtttttgccccgaagcatcatctccaaattacctttcgccacttcaaaactcggcgagatcaagaggatcttccacgccggagataactcgacgatggagaacataatctccgacgcggtgaaggagtgcgagaggccagcgagcgtcggagagacgaaacgctgcgtcggatcggcggaggatatgatcgatttcgccacgtcggtgctcggacgaagcgtggtgctccgaacaacggagaatgtggccgggtcaaagcagaaggtcgtgatcggaaaagtcaacggaatcaacggtgggaaattgacgaaagcggtttcgtgtcaccagagcttgtacccgtacctattgtattactgccactcggtcccgaaggttcgggtctacgaagctgaccttcttgagttgaacagtaagaccaagatcaaccacgggatcgccatctgtcacatggacacgtcatcatggggtccgacccacggagctttcttagctctcgggtcaaaaccgggtcggatcgaagtctgtcactggatatttgagaacgatatgaactgggctatcgccgattaagttacaaaaatccgagcccgatagatcggtggttcgatctggatttatctctttttttaagtatcaatattattatcttatcgccgagatttaaatagaggaatgttaattttctactattggtatatgtttttaagtttttcagtaacagtaaaggcttgtttactgatttgtatgtggcggtacgaataatattaaaagaaaatatttagtgaatgtttgtttgttgactcaatttatgattatggctgagtggttagattggctgattggatatttattattatctgtaaatgaagggattataaatttgatatggatatatcatgtgttgtagtataatataaggtgaaaataatataataaaatgtagac

SEQ ID NO: 3813 - DNA, 2462 bp, Eutrema halophilum
aatgaaaaaagtataatagattttgttaaatttaatagtgtaggttttagttgtcgacaaaaacataattgtgtaagttttttggcttatatatatatagacatatatatacaacaatcggctctcaaaacacaacaagcccaccaatctcttctctgctctgtatcttatttttcctctctctcactaagaaccaaacaaaaaaaatgctcaaaccgttgcttcttctccaatcgttcttgttctgcctcttcaatgttgttctcgtcggaggacggttaatcggcggcggtttctcggcggaggagaatccattcactccaaaagcatctctggttcgttactggaacaaagagatccgcagcgacaaatctctcagatcggagtttctaatctccaaagcgtctccgctcaacgccgtcgactcagccactttcgcaaaactcgccgcccaaaactcgctcccgactcgtctccctgatttttgctccgccgctaatctcttctgtttcccggatttaaccccgagcctcaacaaacacgacgacgacgtcaagttctccgtctacaaccagaaaaacttcaccaactacggcaatgcccgcgccggcggcgccgactcgttcaaaacctactccaaagacggcaacgtcgtcaccgattcgttccggcgatacagccgtggcgcggcgggtcacgacgataaattcaccgtttactccgataacagcaacgtcgtcgaggaaaacttcaattcctacgggaccttcggaaccggaggcgccggagagttcaccaactaccaaaacggagtcaacaatccgacgagcagattcacggcgtattccgacggcggaaacggccggtcacaatcgtttaattcctacacgcacgaggctaacgccggaaacggccaatcgttcacgagctacggcaaaaacggaaacgggttaccgaactcgttttcctcctacggcgtctccgccaacgtgatcggctccggtttctcgaattacggcgagaagggaaacgccgcgaacgattccttcacgaattacggaaacgacggtaatgtgcctcagaacaacttcaaaaactacggcgcctccggtaacgccgccgtcgacacgttctcgaattacagagacaaggcgaacgtaggagacgattcgttctcctcctacgctaaagactcgaactcggggaaggtcaatttcgtaaattacggccaatctttcaatcccggatcggaaagtttcaccggttatggtaaaggagctgaaggacacaaaatcggattcaaaacctacacaccaaactccaccttcaaggattacgccaaaaacggcgtcggattctccaaatacaacgtctcttcgttttcagccgccaccgtcggcgatggcaaaaccgtgaataagtggattgagccgggtaagttctttagggaatcgacgcttaaagaaggaacagtgattcctatgcctgacattagggataaaatgcctaaaaggtcgtttttgccccggagcatcatctcgaaattacccttctccacctccaaaatcggagagatcaagaggatcttccacgccggagataactcgacgatggagaacataatctccgacgcggtgaaggagtgcgagaggccagcgagcgtcggagagacgaaacgctgcgtcggatcggcggaggatatgatcgatttcgccacgtcggtgctcggacgaagcgtggtgctccggacgacggagaacgtggccgggtcaaagcagaaggtcgtgatcggaaaagtcaacggaatcaacggtgggaaattgacgaaagcggtttcgtgtcaccagagcttgtacccgtacctattgtattactgccactcggtcccgaaggttcgggtctacgaagctgaccttcttgagttgaacagtaagaccaagatcaaccacgggatcgccatctgtcacatggacacgtcatcatggggtccgacccacggagctttcttagctctcgggtcaaaaccgggtcggatcgaagtctgtcactggatatttgagaacgatatgaactgggctatcgccgattaagttacaaaaaatccgcgcccgatagatcggtggttcgatctgcgtatgatggatttttctctttcttaatttaaatattatcttatcgccgagatttaaatagaggaaaatgaatgttaattttctactattgttgtatgttaaaaagttttttcagtaacacagtaaaggcttgttactgatttgtttgtggcggtacgaataattttttttaaaaaaaaaagatagtatttttcaagtgaatgtctgttgatgcaatttatgattatggctggttggttggattggctgattgagatatttatttttatctataagtgaagggattatgaaatgatatggatatatcatgtgtacatatataatataaga

SEQ ID NO: 3814 - DNA, 2374 bp, Eutrema halophilum
aatgaaaaaagtataatagattttgttaaatttaatagtgtaggttttagttgtcgacaaaaacataattgtgtaagttttttggcttatatatatatagacatatatatacaacaatcggctctcaaaacacaacaagcccaccaatctcttctctgctctgtatcttatttttcctctctctcactaagaaccaaacaaaaaaaatgctcaaaccgttgcttcttctccaatcgttcttgttctgcctcttcaatgttgttctcgtcggaggacggttaatcggcggcggtttctcggcggaggagaatccattcactccaaaagcatctctggttcgttactggaacaaagagatccgcagcgacaaatctctcagatcggagtttctaatctccaaagcgtctccgctcaacgccgtcgactcagccactttcgcaaaactcgccgcccaaaactcgctcccgactcgtctccctgatttttgctccgccgctaatctcttctgtttcccggatttaaccccgagcctcaacaaacacgacgacgacgtcaagttctccgtctacaaccagaaaaacttcaccaactacggcaatgcccgcgccggcggcgccgactcgttcaaaacctactccaaagacggcaacgtcgtcaccgattcgttccggcgatacagccgtggcgcggcgggtcacgacgataaattcaccgtttactccgataacagcaacgtcgtcgaggaaaacttcaattcctacgggaccttcggaaccggaggcgccggagagttcaccaactaccaaaacggagtcaacaatccgacgagcagattcacggcgtattccgacggcggaaacggccggtcacaatcgtttaattcctacacgcacgaggctaacgccggaaacggccaatcgttcacgagctacggcaaaaacggaaacgggttaccgaactcgttttcctcctacggcgtctccgccaacgtgatcggctccggtttctcgaattacggcgagaagggaaacgccgcgaacgattccttcacgaattacggaaacgacggtaatgtgcctcagaacaacttcaaaaactacggcgcctccggtaacgccgccgtcgacacgttctcgaattacagagacaaggcgaacgtaggagacgattcgttctcctcctacgctaaagactcgaactcggggaaggtcaatttcgtaaattacggccaatctttcaatcccggatcggaaagtttcaccggttatggtaaaggagctgaaggacacaaaatcggattcaaaacctacacaccaaactccaccttcaaggattacgccaaaaacggcgtcggattctccaaatacaacgtctcttcgttttcagccgccaccgtcggcgatggcaaaaccgtgaataagtggattgagccgggtaagttctttagggaatcgacgcttaaagaaggaacagtgattcctatgcctgacattagggataaaatgcctaaaaggtcgtttttgccccggagcatcatctcgaaattacccttctccacctccaaaatcggagagatcaagaggatcttccacgccggagataactcgacgatggagaacataatctccgacgcggtgaaggagtgcgagaggccagcgagcgtcggagagacgaaacgctgcgtcggatcggcggaggatatgatcgatttcgccacgtcggtgctcggacgaagcgtggtgctccggacgacggagaacgtggccgggtcaaagcagaaggtcgtgatcggaaaagtcaacggaatcaacggtgggaaattgacgaaagcggtttcgtgtcaccagagcttgtacccgtacctattgtattactgccactcggtcccgaaggttcgggtctacgaagctgaccttcttgagttgaacagtaagaccaagatcaaccacgggatcgccatctgtcacatggacacgtcatcatggggtccgacccacggagctttcttagctctcgggtcaaaaccgggtcggatcgaagtctgtcactggatatttgagaacgatatgaactgggctatcgccgattaagttacaaaaaatccgcgcccgatagatcggtggttcgatctgcgtatgatggatttttctctttcttaatttaaatattatcttatcgccgagatttaaatagaggaaaatgaatgttaattttctactattgttgtatgttaaaaagttttttcagtaacacagtaaaggcttgttactgatttgtttgtggcggtacgaataattttttttaaaaaaaaaagatagtatttttcaagtgaatgtctgttgatgcaatttatgattatggctggttggttgga

SEQ ID NO: 3815 - DNA, 2234 bp, Arabidopsis lyrata
agtctataattagatttaaatttaattgtgtagggtttagttatggaaaaaaaaaacataaatgtgtaagctttttggcttctatatatattaccacatatatataatacacaatcccctctcaaacccaaccaagcccaccaatctcttcttctcttttctctcacttgaagaagaaagaacaaaaatgctcaaacagtttcttcttctccaatccttctccttcttcctcttcaatgttgttatcgtcggaggaaagttaatcggcggcggtttctcagcggaggagaatccatttactccaaaagcatctttggttcgttactggaacaaagagatccgtggagaatctcccagatcggagtttttaatctctaaagcttcaccactcaacgccgtagactcagcaactttctcaaaactcgccgccgcgaactcgctcccgactcggtttcctgatttctgctccgccgcgaatctcttctgttttcctgatttaggagcgagtctcgagaaacacgacgacgacgttaaattctctgtctatgaccagaagaacttcactaactacggcaatgctcgtgccggaggagcagattcgttcaaaaactactcaagagacggtaatgttgtaaccgattcgttccggagatacagtcgtaacgcggcgggtcacgacgataaattcaccgtctacggcgataacagtaacgtcgtggaggaaggtttcaattcatacggaacattcggaaccggcggcgccggagttttcactaactaccaaaacaacgtcaacaatccgacgagtcgattcacggcgtattcagacggaggtaacggaagatctcaatcattcaaaacctacacacacgacgctaacgccggtaacggccaatcgttctccagctacggcaaaaacggaaacggagctccgaacgaattcgcttcttacggcgtctcctccaacgttatcggctccggtttctcaaattacggcgagagtggaaacgccgccaacgataccttcacaagctacggaagcgacggaaatgtaccgcagaacaatttcaaaaactacggtgcctcaggtaacgccgccgtggacactttcgcgaattacagagacaaagccaacgtcggcgacgattcgttctcttcctatgccaaagattcgaattcggagaaggtcaatttcgtaaattacggtcaatctttcaatcccggttcagaaacgttcaccggttatggcaaaggagctgaaggaaacaaaatcagtttcaaaacctatactccgaattcaaccttcaaagactacaccaaaaacggcgtcgcttttgctaaatacaacgcttcaaccatcaccgcgaacaccgtcggcgatggcaaaaccgtaaataaatggatagaaccgggtaaattctttagagaatcgtcgcttaaagaaggtacagtgattcctatgcctgatattaaagataaaatgcctaaaaggtcgtttttaccccggagtataattacgaaactacccttctccacttcaaaactcggagagattaagagaatcttccacgccggtgagaactcgacgatggagggtataatcaccgacgccgtgacggagtgcgagagaccaccgagcgtcggagagacgaaacggtgcgtaggatcggcggaggacatgatcgatttcgcgacgtcggtgttaggtcgtagcgtggtgctcagaacaacggagaacgtagccgggtcaaagcaaaaggtagtgatcgggaaagtcaacggaatcaacggtgggaaattaacgaaagctgtgtcgtgtcatcagagtttgtacccgtatctattgtattactgccactccgtacctaaggttcgggtatacgaagctgatcttctagagttgaatagtaagaagaagattaaccacgggattgccatctgtcacatggacacgtcatcatggggtccgagtcatggagctttcttagctctcgggtcaaaaccgggtcggatcgaagtttgtcactggatatttgagaacgacatgaactgggctattgctgattagaccagaccggggttatggatttatcaatatgattattattattgtcttatcgccgagttttattacatagaggaatgttaattttctactattatatatttgaagttttttcagtaacatgtaaaaaaacttgttactgatttgtggcggtacgaataatttttat

SEQ ID NO: 3816 - DNA, 2348 bp, Arabidopsis lyrata
agtctataattagatttaaatttaattgtgtagggtttagttatggaaaaaaaaaacataaatgtgtaagctttttggcttctatatatattaccacatatatataatacacaatcccctctcaaacccaaccaagcccaccaatctcttcttctcttttctctcacttgaagaagaaagaacaaaaatgctcaaacagtttcttcttctccaatccttctccttcttcctcttcaatgttgttatcgtcggaggaaagttaatcggcggcggtttctcagcggaggagaatccatttactccaaaagcatctttggttcgttactggaacaaagagatccgtggagaatctcccagatcggagtttttaatctctaaagcttcaccactcaacgccgtagactcagcaactttctcaaaactcgccgccgcgaactcgctcccgactcggtttcctgatttctgctccgccgcgaatctcttctgttttcctgatttaggagcgagtctcgagaaacacgacgacgacgttaaattctctgtctatgaccagaagaacttcactaactacggcaatgctcgtgccggaggagcagattcgttcaaaaactactcaagagacggtaatgttgtaaccgattcgttccggagatacagtcgtaacgcggcgggtcacgacgataaattcaccgtctacggcgataacagtaacgtcgtggaggaaggtttcaattcatacggaacattcggaaccggcggcgccggagttttcactaactaccaaaacaacgtcaacaatccgacgagtcgattcacggcgtattcagacggaggtaacggaagatctcaatcattcaaaacctacacacacgacgctaacgccggtaacggccaatcgttctccagctacggcaaaaacggaaacggagctccgaacgaattcgcttcttacggcgtctcctccaacgttatcggctccggtttctcaaattacggcgagagtggaaacgccgccaacgataccttcacaagctacggaagcgacggaaatgtaccgcagaacaatttcaaaaactacggtgcctcaggtaacgccgccgtggacactttcgcgaattacagagacaaagccaacgtcggcgacgattcgttctcttcctatgccaaagattcgaattcggagaaggtcaatttcgtaaattacggtcaatctttcaatcccggttcagaaacgttcaccggttatggcaaaggagctgaaggaaacaaaatcagtttcaaaacctatactccgaattcaaccttcaaagactacaccaaaaacggcgtcgcttttgctaaatacaacgcttcaaccatcaccgcgaacaccgtcggcgatggcaaaaccgtaaataaatggatagaaccgggtaaattctttagagaatcgtcgcttaaagaaggtacagtgattcctatgcctgatattaaagataaaatgcctaaaaggtcgtttttaccccggagtataattacgaaactacccttctccacttcaaaactcggagagattaagagaatcttccacgccggtgagaactcgacgatggagggtataatcaccgacgccgtgacggagtgcgagagaccaccgagcgtcggagagacgaaacggtgcgtaggatcggcggaggacatgatcgatttcgcgacgtcggtgttaggtcgtagcgtggtgctcagaacaacggagaacgtagccgggtcaaagcaaaaggtagtgatcgggaaagtcaacggaatcaacggtgggaaattaacgaaagctgtgtcgtgtcatcagagtttgtacccgtatctattgtattactgccactccgtacctaaggttcgggtatacgaagctgatcttctagagttgaatagtaagaagaagattaaccacgggattgccatctgtcacatggacacgtcatcatggggtccgagtcatggagctttcttagctctcgggtcaaaaccgggtcggatcgaagtttgtcactggatatttgagaacgacatgaactgggctattgctgattagaccagaccggggttatggatttatcaatatgattattattattgtcttatcgccgagttttattacatagaggaatgttaattttctactattatatatttgaagttttttcagtaacatgtaaaaaaacttgttactgatttgtggcggtacgaataatttttatcattaaaaatgaagattttagtgaatgtctgtttggcgttgacgcaatttatgatttctggttgtattggtagatatttaaattttatctataaatgaagaggattatgaaatt

SEQ ID NO: 3817 - DNA, 2258 bp, Arabidopsis thaliana
agtctataaatagatttaaatttaattgtgtagggtttagttatggagaaaacataattgtgtaagtttttttggcttctatatatattaccacaaatatataacacaatccgctctcaaacccaaacaagcccaccaatctcttcttctctgctcttctctctctgtagacactagaagaagaacaaaaatgctcaaacagtttcttcttctccaatccttctccttcttcctcttcaatgtagttatcgtcggaggaagaacattcggcggcggtttctcagcggaggagaatccatttactccaaaagcatctctagttcgttactggaacaaagagattcgtggccaatctcccagatcggagtttttaatctcaaaagcttcaccactcaacgccgtagactcagcaactttctcaaaactcgccgccgcgaactcgctgccgactcgttttcccgatttctgctccgccgcgaatctcttctgttttcctgatttaggagcgagtctcgagaaacacgacgacgacgttaaattctccgtttatgaccagaagaacttcactaactacggcaatgctcgtgccggaggagcagattcgttcaaaaactactcgaaagacggtaatgtcgtaaccgattcgttccggagatacagccgtaacgcggcgggtcacgacgataaattcactgtctacggtgaaaacagtaacgtggtagaggaaggattcaattcatacggaacattcggaaccggcggcgccggagatttcactaactaccaaaacaacgtgaacaatccaacgagtcgattcacggcgtattccgacggaggtaacggtcgatctcaaacattcaaaacctacacacacgaagctaacgccggtaacggtcaatcattcacaagctacggcaaaaacggaaacggagttcctaacgagttcacttcttacggcgtctcctccaatgtaatcggctccggtttctctaactacggcgagagtggaaacgcggcgaacgataccttcacaagctacggaagcgacggtaatgtacctcagaacaattttaataactacggtgcttccggtaacgccgccgtggataccttcgcgaattacagagacaaggccaacgtcggagacgattcgttctcatcctatgcgaaagattcgaattcggagaaggttaatttcgtaaattacggtcaatctttcaatcccggttcagaaactttcaccggttatggcaaaggagctgaaggaagcaaactcagcttcaaaacctatacaccaaactctactttcaaggactacgccaaaaagggcgtcgcttttgctaaatacaacgtttcaacaaccaccgcgaacaccgtcggcgatggcaaaaccgtaaataaatggatcgaaccgggtaaattctttagagaatcgtcgcttaaagaaggtacagtgattcctatgcctgatattaaagataaaatgcctaaaaggtcgtttttaccccggagtataattacgaaactacccttctctacttctaaactcggtgagattaagagaatcttccacgccgttgagaattcgacgatgggaggtataatcaccgacgcagtgacggagtgcgagaggccaccgagcgtcggagagacgaaacggtgcgtaggatcagcggaggatatgatcgatttcgcgacgtcggtgttaggtcgtagcgtggtgcttagaacaacggagaacgtagccgggtcaaaggaaaaggtagtgatcgggaaagtcaacggaatcaacggtgggaaattaacgaaagctgtgtcgtgtcatcagagtttgtacccgtatctattgtattactgccactccgtaccaaaggttcgggtatacgaagctgatcttctagagttgaatagtaagaagaagattaaccacgggattgccatctgtcacatggacacgtcatcatggggtccgagtcatggagctttcttagctctcgggtcaaaaccgggtcggatcgaagtttgtcactggatatttgagaacgacatgaactgggctatcgctgattagaccggtggttatggacttatcaaatagtatgattattactatcttatcgccgagttttaattacatagaggaatgttaattttctattatcattactataatattttgaagttttttcagtaacatgtaaagaatgcttgttactgatttgtggtggtgcaaaataatttttatgaagattttagtg

SEQ ID NO: 3818 - DNA, 2476 bp, Arabidopsis thaliana
agtctataaatagatttaaatttaattgtgtagggtttagttatggagaaaacataattgtgtaagtttttttggcttctatatatattaccacaaatatataacacaatccgctctcaaacccaaacaagcccaccaatctcttcttctctgctcttctctctctgtagacactagaagaagaacaaaaatgctcaaacagtttcttcttctccaatccttctccttcttcctcttcaatgtagttatcgtcggaggaagaacattcggcggcggtttctcagcggaggagaatccatttactccaaaagcatctctagttcgttactggaacaaagagattcgtggccaatctcccagatcggagtttttaatctcaaaagcttcaccactcaacgccgtagactcagcaactttctcaaaactcgccgccgcgaactcgctgccgactcgttttcccgatttctgctccgccgcgaatctcttctgttttcctgatttaggagcgagtctcgagaaacacgacgacgacgttaaattctccgtttatgaccagaagaacttcactaactacggcaatgctcgtgccggaggagcagattcgttcaaaaactactcgaaagacggtaatgtcgtaaccgattcgttccggagatacagccgtaacgcggcgggtcacgacgataaattcactgtctacggtgaaaacagtaacgtggtagaggaaggattcaattcatacggaacattcggaaccggcggcgccggagatttcactaactaccaaaacaacgtgaacaatccaacgagtcgattcacggcgtattccgacggaggtaacggtcgatctcaaacattcaaaacctacacacacgaagctaacgccggtaacggtcaatcattcacaagctacggcaaaaacggaaacggagttcctaacgagttcacttcttacggcgtctcctccaatgtaatcggctccggtttctctaactacggcgagagtggaaacgcggcgaacgataccttcacaagctacggaagcgacggtaatgtacctcagaacaattttaataactacggtgcttccggtaacgccgccgtggataccttcgcgaattacagagacaaggccaacgtcggagacgattcgttctcatcctatgcgaaagattcgaattcggagaaggttaatttcgtaaattacggtcaatctttcaatcccggttcagaaactttcaccggttatggcaaaggagctgaaggaagcaaactcagcttcaaaacctatacaccaaactctactttcaaggactacgccaaaaagggcgtcgcttttgctaaatacaacgtttcaacaaccaccgcgaacaccgtcggcgatggcaaaaccgtaaataaatggatcgaaccgggtaaattctttagagaatcgtcgcttaaagaaggtacagtgattcctatgcctgatattaaagataaaatgcctaaaaggtcgtttttaccccggagtataattacgaaactacccttctctacttctaaactcggtgagattaagagaatcttccacgccgttgagaattcgacgatgggaggtataatcaccgacgcagtgacggagtgcgagaggccaccgagcgtcggagagacgaaacggtgcgtaggatcagcggaggatatgatcgatttcgcgacgtcggtgttaggtcgtagcgtggtgcttagaacaacggagaacgtagccgggtcaaaggaaaaggtagtgatcgggaaagtcaacggaatcaacggtgggaaattaacgaaagctgtgtcgtgtcatcagagtttgtacccgtatctattgtattactgccactccgtaccaaaggttcgggtatacgaagctgatcttctagagttgaatagtaagaagaagattaaccacgggattgccatctgtcacatggacacgtcatcatggggtccgagtcatggagctttcttagctctcgggtcaaaaccgggtcggatcgaagtttgtcactggatatttgagaacgacatgaactgggctatcgctgattagaccggtggttatggacttatcaaatagtatgattattactatcttatcgccgagttttaattacatagaggaatgttaattttctattatcattactataatattttgaagttttttcagtaacatgtaaagaatgcttgttactgatttgtggtggtgcaaaataatttttatgaagattttagtgaatgtctgttgagcgttgacgcaatttatgatatctggttggattggtcgatatttatattttatctataaagtgaatgggattatgaaattgaaatggatatatttgtttatataatataaggtgaaaaaaacatataaaagaagatggggatagtgatggtgttttcaattacatgtgctgagttatgtccacagaccacaagatgttgtaggcgt

SEQ ID NO: 3819 - DNA, 594 bp, Brassica napus
cttggcttcccctctcctccacagattggtctatacacttggagctaaatcaatcaagatgcagaacgaagagggtcagatcacagaactatacgttcctaggaaatgctctgctactaaccggatgatcacatcaaaggatcatgcctctgttcagctcaacattgggcatttagatgctgatggcatctacaccggacagttcactacctttgctctctgcggttttgttcgcgcccagggagatgcagacagtggcgtggacaggctgtggcagaagaagaaggtcgaagccaaacaaatctaaagatgctttattaagctgtcgttctcttttgttatttagttgaaagaaagatcatcgggtttactgaagtaatcatttttgcttgacccttggttataacgctattgcttgtcatacatttttctctagtgtgagatactataaacctttctcattctctagttctcgatttaaccatcgaggaaagatcacctattatcaaagtaaatgtaaaccagaccaaaatgctattatattcttattattatctggttaacccagctcgaggttgcttcaggtgttgttgt

SEQ ID NO: 3820 - DNA, 729 bp, Brassica napus
cgtagtcactaccacgtctatccctttaacttttgttaaccttcgtagtcacgttacttccttgcgtcttaaggtaccgtgtagcttcctacgtccagtcgatactgaccgtccgcccgcgaaccttagctgagtccatctgaggctgtgcgacgagcggcggaggatgatgagtgagtcagggtaggcgtttcgacccgaagcagatcggcgtggaagtgttgaggtttcgtcactggcgtgcttctctcctatcttctttctaaccgttttttttaagtctttctctaccctcgccgcacttgcttttgcttctcctccctcagtctagctaatcttccaagatgcaaaacgaagagggtcagatcacagagttatacgttcctaggaaatgctctgctactaaccggatgatcacatcgaaggaccatgcctctgtgcagctcaacattggtcatttagatgctgatggtatctacaccggacagttcactacctttgccctctgcggtttcgttcgtgcccagggagatgcagacagtggtgtggacaggctatggcagaagaaaaaggttgaagccaaacaaatttaaagatgctttattaagctgtgttttttttttatcgttttcggacatacacttaagtaatgaattttgcttgcccttttgttttatagtactcagtgaacttgtttcttctgattcgctagtaagattataacttcaa

SEQ ID NO: 3821 - DNA, 544 bp, Raphanus sativus
gggccgttgccgcacttgctttgcttctcctcagttttttggatttagattgatctatacaattcaagctaatcaatcaagatgcagaacgaagagggtcagatcacagaactatacgttcctaggaaatgctctgctactaacaggatgatcacatcaaaggatcatgcctctgtccagctcaacattggtcatttagatgctgatggcatctacactggacagttcactacctttgctctctgcggtttcgttcgtgcccagggagatgcagacagtggcgtggacaggttgtggcagaagaagaaggtcgaagccaaacaaatctaagatgcttatccaagttgtcgttctctctcttttgttatttaattaaaagaaagaccatcggatattttactaaagtaatgattttttgctagaccctttggttttaatgctattgcctgtcaagcattttggtataaatctttctcagtttcgagttctagatttaactattgaggatgatcgtctattatcaatgtaagcaattgacattgca

SEQ ID NO: 3822 - DNA, 444 bp, Brassica napus
cttgcttttgcttctcctccctcagtgtttggatttagaatagtcttagctaatcttccaagatgcaaaacgaagagggtcagatcacagagttatacgttcctaggaaatgctctgctactaaccggatgatcacatcgaaggaccatgcctctgtgcagctcaacattggtcatttagatgctgatggtatctacaccggacagttcactacctttgctctctgcggtttcgttcgtgcccagggagatgcagacagtggtgtggacaggctatggcagaagcagaaggtcgaagccaaacagatttaaagagcttataaagctgttttttttttatcgttctcggacatacactgaagtaatgattttttgcttgaccttttgttttattgcaatcggtgaacttgtttcttctgattcgctagtaagattataacttcaa

SEQ ID NO: 3823 - DNA, 487 bp, Raphanus sativus
  misc_feature (440)..(440): n is a, c, g, or t
gtttctcttgccgttgccgcacttgctttgcttctcctcagtgttttggattttggattgatctacaattcaagctaataaatcaagatgcagaacgaagagggtcagatcacagaactatacgttcctaggaaatgctctgctactaaccggatgatcacatcaaaggatcatgcctctgtccagctcaacattggtcatttagatgctgatggcgtctacacagggcaattcactacctttgctctctgcggtttcgttcgtgcccagggagatgcagacagtggcgtggacaggttgtggcagaaaaagaaggtcgaagccaaacaaatctaagatgcttattttaagctgtcgttctctcttttgttatttaattaaaagaaagaccatcggatattactgaagtaatgatttttttgctagacccttggttctantgctattgcttgtcgagctttttcgctagtaaaatctttctcagtct

SEQ ID NO: 3824 - DNA, 548 bp, Raphanus sativus
ggaaaacggggtttgcgtctccgtctcgccgtttctcttgccgttgccgcacttgctttgcttctcctcagtgttttggattttggattgatctacaattcaagctaataaatcaagatgcagaacgaagagggtcagatcacagaactatacgttcctaggaaatgctctgctactaaccggatgatcacatcaaaggatcatgcctctgtccagctcaacattggtcatttagatgctgatggcgtctacaccgggcaattcactacctttgctctctgtggttttgttcgtgcccagggagacgcagacagtggcgtggacaggctgtggcagaagaagaaggtcgaagccaaacaaatttaagatgctcttatttaagctttttttttcttttgttatttaattaaacaaagattattgacaattccgaagtaattgattcttgctctctatgcttggttttattttctcttgcttgttctgaatattcatctagtgagagattgcagtataagacctttcttacttcttataaaaaaaaaaaa

SEQ ID NO: 3825 - DNA, 418 bp, Raphanus sativus
  misc_feature (40)..(40): n is a, c, g, or t
  misc_feature (311)..(311): n is a, c, g, or t
gggccgttgccgcacttgctttgcttctcctcagtgtttntacaccttcaagctaatcaatcaagatgcagaacgaagagggtcagatcacagaactatacgttcctaggaaatgctctgctactaacaggatgatcacatcaaaggatcatgcctctgtccagctcaacattggtcatttagatgctgatggcatctatactggacagttcactacctttgctctctgcggtttcgttcgtgcccagggggatgcagacagtggcgtggacaggttgtggcagaagaagaaggtcgaagccaaacaattntaagatgcttatttaagttgtcgttctctctcttttgttatttaattaaaaagaaagacatcggatattttactgaagtaatgaattttgctagacccttggtttta

SEQ ID NO: 3826 - DNA, 433 bp, Brassica juncea
agctaatcttcaagatgcagaacgaagagggtcagaccacagaactatacattcctaggaaatgctctgctactaaccggatgatcacatcaaaggaccatgcctctgttcagctcaacattggtcatttagatgctgatggaatctacaccggacagttcactacctttgctctctgcggttttgttcgcgcccagggagatgcagacagtggtgtggacaggctgtggcagaagaagaaggttgaagccaaacaaatctaaagagagcctttttaagctgtctttttgctttgttctgaatgttgttattgaattccaaaagagttcatcggacatactgaagtaatgatatttgcttgactcttggttttaatgcttcttatgtacactggcttgttctgaatttccttatatcttcacaatttgttaaa

SEQ ID NO: 3827 - DNA, 878 bp, Brassica juncea
gttggaatgatgtacgtgagagcgttgccgacgacggacgtgaatcggaacacggagtggttcacgtatccaggggtgtggacgacttacatcctcatcctcttcttctcgtggctcctcgttctatccatcttcaattgttcccctggcatggcctggaccatcgtccacctcgcccatttctccgttacgtatcatttgtttcactggaagaaaggaacaccgtttggggatgatcaggggatctacaataggctgacttggtgggaacagattgacaacggcaagcaactcactcgcaatcgcaagttcctcactcttgttcccgttgtcttgtacttgatagcatcgcacacgacagactatcaaaacccgatgctgtttctcaacacgcttgctgtatttataatggtggttgcaaagttcccgcacatgcacaaggttcgcatctttggaatcaatgcagaacgaagagggtcaggtcacggaactctacattcctaggaaatgctctgctactaaccggatgatcacatcaaaggatcatgcctctgtgcaactcaacattggtcatttagatgctgatggtatctacaccggacaattcactaccttggctctctgcggttttgttcgtgcccagggagacgctgacagtggtgtggacaggctgtggcagaagaagaaggtcgaagccaaacaaatctaaagagagcctttttaagctgtctttttgctttgttctgaatgttgttatttaattcagaaatgatcatcggacatacggaagtaacgatgtttgcttgactcttggttttaatgcttcttatgtacactggcttgttctgaatttccttatatcttcacaatttgttaaa

SEQ ID NO: 3828 - DNA, 442 bp, Brassica juncea
cttcctttgccgcacttgctttgcttctcctcagtgtttgaatttagaagatatcgtctacttgaattcaagatgcagaacgaagagggtcaggttacggaactatacattcctaggaaatgctctgctacaaaccggatgatcacatcaaaggatcatgcatctgtgcaactcaacattggtcacttagatgctgatggcatctacaccggacagttcactaccttagctctctgcggttttgttcgtgcccagggagatgctgacagtggcgtggacaggctgtggcagaagaagaaggtcgaagccaaacaaatctaaaaagagtcttattaagctatctttttgctttgttctgaatgttgttattgaattccaaaagagatcatcggacatactgaagtaatgatatttgcttgactcttggttttaatgcttctta

SEQ ID NO: 3829 - DNA, 575 bp, Brassica rapa
acgctgtgtcttctcagttgtgtggcttctcttcctttgccgcacttgctttgcttctcctcagtgtttgaatttagaagatatcgtctacttgaattcaagatgcagaacgaagagggtcaggtcacggaactctacattcctaggaaatgctctgctactaaccggatgatcacatcaaaggaccatgcctcggtgcaactcaacattggtcatttagatgctgatggcatctacaccggtcaattcactaccttggctctctgcggttttgttcgtgcccagggagacgctgacagtggagtggacaggctgtggcagaagaagaaggtcgaagccaaacaaatctaaagagagccttattaagctgtctttttgctttgttctgaatgttgttatttaattcaaaaatgatcatcggacatactgaagtaacgatgtttgcttgactcttggttttaatgcttcttgtgcactggcttgttctgattttcctcagatcttcaaaatttgtcaaacctttctcatttacgaacaatatttaaagaattgggataagctgaacccgaaccaaa

SEQ ID NO: 3830 - DNA, 557 bp, Brassica napus
gtgcaggccatttaggccgtgcagcccccccccccgctcctcctttgccgcacttgctttgcttctcctcagtgtttgaattttagatatcgtctacttgaattcaagatgcagaacgaagagggtcaggtcacggaactctacattcctaggaaatgctctgctactaaccggatgatcacatcaaaggatcatgcctctgtgcaactcaacattggtcatttagatgctgatggcatctacaccggtcaattcactaccttggctctctgcggttttgttcgtgcccagggagacgctgacagtggggtggacaggctgtggcagaagaagaaggtcgaagccaaacaaatctaaagagcctgattaagctgtccttttgctttgttctgaatgttgttatttaattcaaaaatgatcatcggacatactgaagtaatgatgatatttgcttgactcttggttttaatgcttcttgtgttctgattttcctcacatcttcaaaatttgtcaaacctttctcattttcgaacaatctttaaagaattgggataagc

SEQ ID NO: 3831 - DNA, 570 bp, Brassica napus
gagcttctagattatttgtcctcctcgtactaattcactataaccttgaacgttgtcgtttaatatcggatttttttacaatgaattctgtttgaatttagaagatatcgtctacttgaattcaagatgcagaacgaagagggtcaggtcacggaactctacattcctaggaaatgctctgctactaaccggatgatcacatcaaaggaccatgcctcggtgcaactcaacattggtcatttagatgctgatggcatctacaccggtcaattcactaccttggctctctgcggttttgttcgtgcccagggagacgctgacagtggagtggacaggctgtggcagaagaagaaggtcgaagccaaacaaatctaaagagagtcttattaagctgtcttttactctgttctggatgttgttacttaattcaaaaatgatcatcggacatactgaagtaatgatgatatttgcttttgactcttggttttaatgcttcttgtgcactggcttgttctgattttcctcagatcttcaaaatttgtcaaacctttctcatttacgaacaatatt

SEQ ID NO: 3832 - DNA, 555 bp, Raphanus sativus
gccgcacttgctttgcttctcctcagtgtttgaatttatagagtcgtctactcttcaagatgcagaacgaagagggtcaggtcacggaactatacattcctaggaaatgctctgctactaaccggatgatcacgtcaaaggatcatgcctctgtgcaactcaacattggtcatttagatgctgatggcatctacaccggtcaattcactaccttggctctctgcggttttgttcgtgcccagggagatgctgacagtggggtggacaggctgtggcagaagaagaaggtcgaagccaaacaaatctaaagagcctaattaagctgtctttttttgctttgttctgaatgttggttatttaatttaaaaagctcatcggacataacgatatttgcttgactcttgggtttaatgcttcttgcactggcttgttctaatcttcctctagtgagataatatcttcacaatttgtcgaacctttcttgtttcaagttgtacatttcctattcattcgttcaagacttcgagtataatttaaaaaaaaaatccttaacca

SEQ ID NO: 3833 - DNA, 520 bp, Raphanus sativus
ggctctttctttgccgcacttgctttgcttctcctcagtgtttgaatttatagagtcgtctactcttcaagatgcagaacgaagagggtcaggtcacggaactatacattcctaggaaatgctctgctactaaccggatgatcacgtcaaaggatcatgcctccgtgcaactcaacattggtcatttagatgccgatggcatctacaccggtcaattcactaccttggctctctgcggttttgttcgtgcccagggagatgctgacagtggtgtggacaggctgtggcagaagaagaaggtcgaagccaaacaaatctaaagagcctaattaagctgtctttttttcttttgctttgttctgaatgttggttatttaattcaaaaagatcatcggacataatgatatttgctcgactcttggtgttataatgcttctttcactggcttgttctaattttcctccagtgagatatatttcacaatttgtcgaacctttctcgtttcaagttgtacatttcc

SEQ ID NO: 3834 - DNA, 311 bp, Eutrema halophilum
gtctttggatttagattcgtctactcttcaagctaaatcttcacgatgcaaaacgaagagggtcagatcacagagttgtacattcctaggaaatgctccgctactaaccggttgattacatctaaggatcatgcctctgtgcagcttaacattggtcatttagatgccgatgggatctacaccggacaattcaccacttttgctctctgcgggtttgttcgtgcccagggagatgcggacagtggcgtagacaggctgtggcagaagaagaaggtcgaagctaaacaataagagctgaagctgtctatttt

SEQ ID NO: 3835 - DNA, 292 bp, Eutrema halophilum
agtctttggatttagattcgtctactcttcaagctaaatcttcacgatgcaaaacgaagagggtcagatcacagagttgtacattcctaggaaatgctccgctactaaccggttgattacatctaaggatcatgcctctgtgcagcttaacattggtcatttagatgccgatgggatctacaccggacaattcaccacttttgctctctgcgggtttgttcgtgcccagggagatgcggacagtggcgtagacaggctgtggcagaagaagaaggtcgaagctaaacaataa

SEQ ID NO: 3836 - DNA, 367 bp, Brassica oleracea
  misc_feature (350)..(350): n is a, c, g, or t
gcagaacgaagagggtcaggtcacggaactctacattcctaggaaatgctctgctactaaccggatgatcacatcaaaggatcatgcctctgtgcaactcaacattggtcatttagatgctgatggcatctacaccggtcaattcactaccttggctctctgcggttttgttcgtgcccagggagacgctgacagtggggtggacaggctgtggcagaagaagaaggtcgaagccaaacaaatctaaagagcctgattaagctgtccttttgctttgttctgaatgttgttatttaattcaaaaatgatcatcggacatactgaagtaatgatgatatttgcttgactcntggttttaatgcttctc

SEQ ID NO: 3837 - DNA, 507 bp, Brassica napus
cgggattcggccttatggccgggggccgcacttgctttgcttctcctcagtgtttgaatttagaagatatcgtctacttgaattcaagatgcagaacgaagagggtcaggtcacggaactctacattcctaggaaatgctctgctactaaccggatgatcacatcaaaggatcatgcctctgtgcaactcaacattggtcatttagatgctgatggcatctacaccggacaattcactaccttggctctctgcggttttgttcgtgcccagggagatgctgacagcggggtggacaggctgtggcagaagaaggtcgaagccaaacaaatctaaagagagcctttttaagctgtctttttgctttgttctgaatgtttgttatttaattcagaaatgatcatcggacatactgaagtaacgatgtttgcttgactcttggttttaatacttgttctgattttcctatatctcttcttcacaatttttcaaacattcctcattttcga

SEQ ID NO: 3838 - DNA, 507 bp, Raphanus sativus
gccgcacttgctttgcttctcctcagtgtttgaatttatagagtcgtctactcttcaagatgcagaacgaagagggtcaggtcacggaactatacattcctaggaaatgctctgctactaaccggatgatcacgtcaaaggatcatgcctctgtgcaactcaacattggtcatttagatgctgatggcatctacaccggtcaattcactaccttggctctctgcggttttgttcgtgcccagggagatgctgacagtggtgtggacaggctgtggcagaaaaagaaggtcgaagccaaacaactctaaagagcctaattaagctgtctttctttactttgttctgaatgtcggttatttaattcagaagatcatcggacataatgatatttgcttgactcttggttttaatgcttcttgcactggcttgttctaatctttctctagtgagatcatatcttcacaatttgtcgaacctttctcgtttcaagttatacatttcctcttc

SEQ ID NO: 3839 - DNA, 470 bp, Eutrema halophilum
aattgctgcttgctgcgtcttctacatctgcacttgaaaaagctttaaaaaatctccaaagatgcagaacgaagaaggtcaaatcactgagctttacattccaaggaaatgttcagcgacgaacaggttgatcacttcaaaggatcatgcttccgtgcagctcaacattggtcatctagatgctgatggaatctacaccggccagttcactacctttgctctctgcggttttgtccgtgctcagggtgatgctgacagtggagtcgacaggctctggcagaagaagaaggttgaaactaagcagcagtaagagcaataaaagcttgttttctagatttttcaaaactttgttgtttatccggatgtgaacttatgttttctttttcttctcccgcaatgataatattggtttgaaatactgagatggttggttcttattttcccgggaattattagctctatcttgtgtc

SEQ ID NO: 3840 - DNA, 473 bp, Eutrema halophilum
gccaattgctgcttgctgcgtcttctacatctgcacttgaaaaagctttaaaaaatctccaaagatgcagaacgaagaaggtcaaatcactgagctttacattccaaggaaatgttcagcgacgaacaggttgatcacttcaaaggatcatgcttccgtgcagctcaacattggtcatctagatgctgatggaatctacaccggccagttcactacctttgctctctgcggttttgtccgtgctcagggtgatgctgacagtggagtcgacaggctctggcagaagaagaaggttgaaactaagcagcagtaagagcaataaaagcttgttttctagatttttcaaaactttgttgtttatccggatgtgaacttatgttttctttttcttctcccgcaatgataatattggtttgaaatactgagatggttggttcttattttcccgggaattattagctctatcttgtgtc

SEQ ID NO: 3841 - DNA, 536 bp, Eutrema parvulum
acgctgtggcttctcagccgcgtggtttctcttccgttgccgcacttgctttgcttctcctcagtcttttggatttagaatcgtctaagctaatcttcaagatgcaaaacgaagagggtcagatcacagagctatacattcctaggaaatgctctgctactaaccgtttgatcacatcaaaggatcatgcctctgtgcagctcaacgttggtcatctagatgccgatggcatctacaccggacaattctcaacctttgctctctgcggttttgttcgtgcccagggagatgcagacagtggcgtggacaggctttggcagaagaagaaggtcgaagccaaacaaatctaagacctttagctgcctttttttgttatttaattaaaaagatcatcggacatactgaagtaatgatttttgcttgactcttggatttaaagctcttgtgcacttgcttgttctgatattcttctactaagaattaagataattatcttcagtttgtcgaacctttctcgttctcaagttctacatttc

SEQ ID NO: 3842 - DNA, 451 bp, Eutrema parvulum
cacctcaaaagctttgagaatctccaaagatgcagaacgaagaaggtcaaatcactgagctttacattccaaggaaatgttcagcaactaataggttgatcacatcaaaggatcatgcttctgtgcagctcaacattggtcatttagatgctgatggtatctacaccggccaattcactacctttgctctctgcggttttgtccgtgctcagggtgatgctgacagtggagtcgacaggctctggcagaagaagaaggttgaaacaaaacagcagtagatcaaagaagaagcttgttttctagattttgaactttgttgtttatcatgatgtgaacttgtgtctgttttttttctttttctgcaatgataatgtttgctttcaaagacgttgcaatgcaatgagatggttggttcttattttaccgggaattattagctctgtgtttcgtc

SEQ ID NO: 3843 - DNA, 481 bp, Eutrema parvulum
ccaattgctgtttgctgcttctaccatctgcacctcaaaagctttgagaatctccaaagatgcagaacgaagaaggtcaaatcactgagctttacattccaaggaaatgttcagcaactaataggttgatcacatcaaaggatcatgcttctgtgcagctcaacattggtcatttagatgctgatggtatctacaccggccaattcactacctttgctctctgcggttttgtccgtgctcagggtgatgctgacagtggagtcgacaggctctggcagaagaagaaggttgaaacaaaacagcagtagatcaaagaagaagcttgttttctagattttgaactttgttgtttatcatgatgtgaacttgtgtctgttttttttctttttctgcaatgataatgtttgctttcaaagacgttgcaatgcaatgagatggttggttcttattttaccgggaattattagctctgtgtttcgtc

SEQ ID NO: 3844 - DNA, 449 bp, Arabidopsis thaliana
gttgccgcacctgcttcgcttctcctctctcgctctctactcaggactcgtttactctttcaaagctaagctttcaagatgcaaaacgaagagggtcaggtcactgagctttacattcctaggaaatgttctgctactaaccggttgatcacatccaaggatcatgcctctgttcagctcaacattggtcatttagatgctaatggcttgtacaccggacagttcacaacctttgctctctgcggttttgtccgtgctcagggagacgctgacagtggtgtcgacaggttgtggcagaagaagaaggttgaagccaaacaaaactaagagcttaatctgtcttgttttttgtcgaatcttgtttttttttttccgaaagattgcctcatactgaagtaatgattttggctttgggtcgtggaacttaacttaaatgcttttgtgcacca

SEQ ID NO: 3845 - DNA, 410 bp, Arabidopsis lyrata
aggattcgtctactcttcaaagctaatcttcaagatgcaaaacgaagagggtcagaccactgagctttacattcctaggaaatgctctgctactaaccggttgatcacttccaaggatcatgcctctgttcagctcaacattggtcatttagatgctaatggcgtgtacaccggacaattcaccacctttgctctctgtggtttcgtccgtgcccagggagacgctgacagtggtgtcgacaggctgtggcagaagaagaaggtcgaagccaagcaaaactaagtgtttaagctgtcgttttttggtcgaatcttgatatttttttccgaaagattgtctcatactgaagtaatgattttggcttgagtcttggaacttaacttaatgcttttgtgcaccagtcttctaa

SEQ ID NO: 3846 - DNA, 460 bp, Arabidopsis lyrata
cccgttgccgcacctgcttcgcttctcctctctgctctcaggattcgtctactcttcaaagctaatcttcaagatgcaaaacgaagagggtcagaccactgagctttacattcctaggaaatgctctgctactaaccggttgatcacttccaaggatcatgcctctgttcagctcaacattggtcatttagatgctaatggcgtgtacaccggacaattcaccacctttgctctctgtggtttcgtccgtgcccagggagacgctgacagtggtgtcgacaggctgtggcagaagaagaaggtcgaagccaagcaaaactaagtgtttaagctgtcgttttttggtcgaatcttgatatttttttccgaaagattgtctcatactgaagtaatgattttggcttgagtcttggaacttaacttaatgcttttgtgcaccagtcttctaacacttttatca

SEQ ID NO: 3847 - DNA, 600 bp, Arabidopsis thaliana
aaaactctcgctttcttcatcatctctttctccggttgccgcacctgcttcgcttctcctctctcgctctctactcaggactcgtttactctttcaaagctaagctttcaagatgcaaaacgaagagggtcaggtcactgagctttacattcctaggaaatgttctgctactaaccggttgatcacatccaaggatcatgcctctgttcagctcaacattggtcatttagatgctaatggcttgtacaccggacagttcacaacctttgctctctgcggttttgtccgtgctcagggagacgctgacagtggtgtcgacaggttgtggcagaagaagaaggttgaagccaaacaaaactaagagcttaatctgtcttgttttttgtcgaatcttgtttttttttttccgaaagattgcctcatactgaagtaatgattttggctttgggtcgtggaacttaacttaaatgcttttgtgcaccatgtcttctaatttttcaccagttcgatatagtatctccagtttctcgacctttttatcattctgaggtgttagtctttagagttcgaatcggaatgaataagcgttattaccccctt

SEQ ID NO: 3848 - DNA, 480 bp, Brassica juncea
ggccgcactttgctttgcttctcctcctcagtgtttggacttagattacacttaaagctaatcttcaagatgcaaaatgaagagggtcaggtcacggaactatacattcctaggaaatgctctgctactaaccggatgatcacatcaaaggatcatgcctctgttcagctcaacattggtcatttagatgctgatggcgtctacaccggacaattcactaccttggctctctgcggtttcgttcgtgcccagggagatgcaggcagtggcgtagacaggctatggcagaagaagaaggtcgaagccaaacaaatgtaagacagcttattaagctgtcttttaacgattgggagtttttctatttaatttaaaaggatcattcggacaattatattgaagttaatgatttttgattgactctttattttaatgctattggtgcacttgcttcttctgtcatagcctgtctacgccactgtc

SEQ ID NO: 3849 - DNA, 445 bp, Brassica juncea
caatatttccatcgccgccgcactgctctctccgtttagattattcttcctctcagatcgttttaccaagctagaatcatgcagaacgaggaaggagtcgtcacagagctttacattccgaggaaatgctcggccacaaacagattgatcacctcaaaggatcacgcctctgttcagcttaacattggtcatcttgatgcagatggtatctacactggccagttcaccactcttgctctctgcggttttgtccgtgctcagggagacgcagacagtggtgtcgacaggctctggcagaagaagaaggtcgaagccaaacaacagtgagatagagatacatagaatctatgagctgtctgtcacctcttgttattctcggcatgtttcattgaattttctccagctttgaactcacggttgtgctttctgatttatgaaagataat

SEQ ID NO: 3850 - DNA, 459 bp, Raphanus sativus
ggatcgccgccgcactgctctctctctctctgttcagattattcttccgcgcagatcgatttttgcaagctaaaaaatcatgcagaacgaggaaggagtcgtcacagagctttacattccgaggaaatgctcggcaacaaacagattgatcacctcaaaggatcatgcctctgttcagctcaacattggtcatcttgacgccgatggtatctacactggccagttcaccactcttgctctctgcggctttgtccgtgctcagggagacgcagacagtggcgtcgacaggctctggcagaagaagaaagtcgaagccaaacaacagtgagagatagagattaatctataagctgccctctcttgttgttttttgacatgtttccttgaattttctctagctacgaactcgtgtctttttttctcatctataaaggatatttaagtttcggtgccaactga

SEQ ID NO: 3851 - DNA, 475 bp, Raphanus sativus
cgccgccgcactgctctctccgattagattattcttctgctcagatcgatttttgcaacctaaaaaatcatgcagaacgaggaaggagtcgtcaccgagctttacattccaaggaaatgctcggccacaaacagattgatcacctcaaaggatcatgcctctgttcagcttaacattggtcatcttgacgccgatggtatctacactggccagttcaccactctcgctctctgcggctttgtccgtgctcagggagacgcagacagtggcgttgacaggctctggcagaagaagaaggtcgaagccaaacaacagtgagagatagagatcatctttaagctgccctctcttgttgtttttgccatgtttctttgaatattttctagctacgaactcgcgtcttttttttcttttttgctgatctataaaagatattttaagtttcggtgccaattgaatcagttctcttgattat

SEQ ID NO: 3852 - DNA, 595 bp, Raphanus sativus
  misc_feature (23)..(23): n is a, c, g, or t
ggataaataacataaattgcttntcagtctatttttccaacgccgccgctctgctctctccgattagattattcttctgctcagatcgatttttccaagctaagaaatcatgcagaacgaggaaggagtcgtcaccgagctttacattccaaggaaatgctcggccacaaacagattgatcacctcaaaggatcacgcctctgttcagcttaacattggtcatcttgacgctgatggtatctacactggccagttcaccactcttgctctctgcggctttgtccgtgctcagggagacgcagacagtggcgttgacaggctctggcagaagaagaaggttgaagctaaacaacagtgagagatagagatcatctatatgctgcccgctcttgtttttggcaatgtttccttgaattttctctagctacgaacaagtatctctctttttctgatcgataaaagatatttaagtttttttttggtgccaattgattcagtcctcttgattatctatacattgagaactgccacttcattgaacttactgattatgctgcatgaacttgataacttgaaatcgatttgcgttatacca

SEQ ID NO: 3853 - DNA, 455 bp, Eutrema parvulum
atcgaaattttcaagttaaaatcatgcagaacgaagaaggagtcgtcacagagctatacattccgagaaaatgctcggccacaaacagattgatcacctcaaaggatcatgcttctgttcagcttaacattggtcatcttgatgccgatggtatctacaccggccaattcaccacatttgctctctgcggatttgtccgagctcagggagatgcagacagtggcgtggacaggctctggcagaagaagaaggtcgaaaccaaacaacagtgagagagagagaatctaaggttccttcttgttatttttggaatgtttccattgaattatctcttgatgcgaactcgtattttggttttctgatttatgaagatgatattaagttttgatgtccatcgaatcagattctacagttcaattattttctcgtaatgttctatacataagaacaactac

SEQ ID NO: 3854 - DNA, 441 bp, Eutrema parvulum
gatcagatcgtatttttcaagctaaaatcatgcaaaacgaagaagggcagattactgagctatacattccgagaaaatgctcggccacaaacagattgatcacctccaaggatcatgcttctgttcagcttaacattggtcatcttggtcccgatggtgtctacactggccaattcaccacatttgctctctgcggatttgtccgagctcagggagacgcagacagtggcgtggacaggctctggcagaagaagaaggtcgaaaccaaacaacagtgagagagagcgtgaatctaaagctgcctctagtttgtttttgaatgtttcattgaatttcgtctacatgcgaactcgtatttttgttttctgattatgaaagataggttttgatgccaatgaaatcagattctacagttaaattctaatctctaatgttctatac

SEQ ID NO: 3855 - DNA, 494 bp, Arabidopsis lyrata
tcttcgtcgccgccaaactgctctctcagattcttcttcctcgcagatcgttttttgttcaagctaaatctcaaaatggagaacgaagaagggaagatcacagagctctacattccgagaaaatgctcggcaacaaacagattgatcacatcaaaggatcatgcttcagttcagcttaacattggtcatcttgatgctaatggtgtctacactggccaattcaccacctttgctctctgcggatttgtccgtgctcagggagacgcagacagtggcgtggacaggctctggcagaagaagaaggtcgaagccaaacaacagtgagagacaatgtcataaggctctaccacctcttgtttgttttttgaggttttcattttattagcaatgtgacttcgttattgaattgaatgttactttctctacttgcgaattcatgttttggatttttctgctttatgaaagattattattagtctttgtgaggccaatgg

SEQ ID NO: 3856 - DNA, 494 bp, Arabidopsis lyrata
tcttcgtcgccgccaaactgctctctcagattcttcttcctcgcagctaaatctcaaaatggagaacgaagaagggaagatcacagagctctacattccgagaaaatgctcggcaacaaacagattgatcacatcaaaggatcatgcttcagttcagcttaacattggtcatcttgatgctaatggtgtctacactggccaattcaccacctttgctctctgcggatttgtccgtgctcagggagacgcagacagtggcgtggacaggctctggcagaagaagaaggtcgaagccaaacaacagtgagagacaatgtcataaggctctaccacctcttgtttgttttttgaggttttcattttattagcaatgtgacttcgttattgaattgaatgttactttctctacttgcgaattcatgttttggatttttctgctttatgaaagattattattagtctttgtgaggccaatggaatcagatttctatcta

SEQ ID NO: 3857 - DNA, 471 bp, Brassica juncea
gccgccgcactgctctctccgttttagattcttcttccgctcagatcgatttttccaagctaaaaatcatgcagaacgaggaaggagtcgtcactgagctttacattccgaggaaatgctcggcgacaaacagattgatcacttcaaaggatcacgcctctgttcagcttaacattggtcatcttgatgccgatggtatctacactggccagttcaccactcttgctctctgcggttttgtccgtgctcagggagacgcagacagtggcgtcgacaggctctggcagaagaagaaagtcgaaaccaaacaacagtgagatagatagagacgtagaatctataagctgttgctacttattgttttggcatgtttcattgagttttctctatctgcgaactcgtatctttgttttctgatttatgaaaaataattaagtttggtggcatttgaatcagtcctacaattcaact

SEQ ID NO: 3858 - DNA, 691 bp, Brassica juncea
gtataaattgctttttagtctcgttttccatcgccgccggactgctctctctccacagattcttcttcttctcagatcggtttttaaagctaagaatcatgcaaaacgaagaaggtgtcgtcactgagctatacattcccaggaaatgctcggccacaaacagattgatcacctcaaaggatcatgcctctgttcagcttaacattggtcatcttgatgccgatggtatctacactggccagttcaccacccttgctctctgcggatttgtccgagctcagggagacgcagacagtggcgtcgacaggctctggcagaagaagaaggtcgagaccaaacaacagtgagggggtatagagagtctatgctgcttcctcttgttacttttgttatgtttcatttgaattttctctagttgcgaacttgtatttgggttttctggtttatgaaagataattgccaagtttttggtgccaatggattcatatcctacttttcaattatattttcgtagacatctatactaaagaactgctacatcactcattccatggtggaatgtcttccactcggttttacggccggaggaaccgcttcaaacaactctttccgaacattcccaatctgcatggctcaattcaaactaaactaaaaatagtctgaaaagtgtgttgttgttttagggcggggc

SEQ ID NO: 3859 - DNA, 454 bp, Brassica juncea
ggccggactgctctctctctctccacacattcttcttctcacagatcgattttaaaaagctaagaaccatgcaaaacgaagaaggtgtcgtcactgagctatacattcccaggaaatgctcggccacaaacagattgatcacatcaaaggatcacgcctctgttcagcttaacattggtcatcttgatgccgatggtatctacactggccagttcaccacccttgctctctgcgggtttgtccgtgctcagggagacgcagacagtggcgtcgacaggctctggcagaagaagaaggtcgaaaccaaacaacagtgatataagaagagattgagagaatctttgctgctacctcttttttttttgggatgttttttgtttgaattttccttagtttcgaactctgtatttgtgtttcctggtttatgaaagacaattactaacttttaaatgcc

SEQ ID NO: 3860 - DNA, 316 bp, Brassica juncea
atcgccgccgcactactctctcctcccagatcgatttttccaagcaataatcatgcagaacgaggaaggagtcgtcacagagctatacattccgaggaaatgctcggccacaaacagattgataacctcaaaggatcatgcatctgttcagcttaacattggccatcttgatgccgatggtatctacactggacagttcaccacacttgctctctgcggttttgtccgtgctcagggagacgcagacagtggcgtggacaggctctggcagaagaagaaggtcgaaaccaaacaactgtgagtgagtgtgagagat

SEQ ID NO: 3861 - DNA, 571 bp, Brassica juncea
gccgccgaactgctctatcctctcagatcgaattttccaagcaataatcatgcagaacgaggaaggagtcgtcacagagctatacattccaaggaaatgctcggctacaaacagattgatcacatcaaaggatcatgcatctgttcagcttaacattggccatcttgatgccgatggtatctacactggacagttcaccacacttgcgctctgcggtttcgtccgtgctcagggagacgcagacagtggcgtggacaggctctggcagaagaagaaggtcgaaaccaaacaactgtgagtgagtgagagagattgagaaatctaaaaagctgctgcgctttgcctctttgttatttttgggatgttttgttgaattttctctctagctgcagacaagtattttgagtttctggtttatgaaagataattaagctttggtggcagctgaatcatattctacagttcagttactattctcgtaatttttctttacaggaacgttttgatcaaaaacaaaatttcactacaccatctttaaattacatcttccgaacttccccattatgtaatt

SEQ ID NO: 3862 - DNA, 345 bp, Brassica juncea
gccgccgcactgctccctcctctcagatcgattttttttccaagcaataatcatgcaaaacgaggaaggagtcgtcacagagctatacattccgagaaaatgctcggcgaccaacagattgatcacatcaaaggatcatgcgtctgttcagcttaacattggtcatcttgatgccgatggtatctacactggtcaattcaccacacttgctctctgcggattcgtccgtgctcagggagacgcagacagtggtgtggacaggctctggcagaagaagaaggtcgaaaccaaacaacagtgagtgagagagaatattagctctgctgcttgcctcttgatgtttta

SEQ ID NO: 3863 - DNA, 499 bp, Brassica oleracea
gaaaatacataatttgcatttttattctccttttccatcgccgccgaactgctctcttctctcagatcgattctttcaagcaataatcatgcagaacgaggaaggagtcgtcacagagctatacattccgaggaaatgctcggcgacaaacagattgataacatcaaaggatcatgcatctgttcagcttaacattggccatcttgatgctgatggtatctacactggacagttcaccacacttgctctctgcggatttgtccgtgctcagggagacgcagacagtggcgtggacaggctctggcagaagaagaaggtcgaaaccaaacaactttgagtgagtgagagagatagagtatctaagctgcctgcttcctcttgttatctttgggatgtttcattgaattttctctagatgcgaacttgtgttttgcttttctaatttatggaagataattttataagttttttgtggcaattgaatcagattttacgcgtc

SEQ ID NO: 3864 - DNA, 500 bp, Brassica oleracea
gctggactgctctcactccacacgttcttctacttcttctcacagatcgattttaaaagctaagaatcatgcaaaacgaagaaggtgtcgtcactgagctatacattcccaggaaatgctcggccacaaacagattgatcacatcaaaggatcatgcctctgttcagcttaacatcggtcatcttgacgccgatggtatctacactggccagttcaccacccttgctctctgtgggtttgtccgtgctcagggagacgcagacagtggcgtcgacaggctctggcagaagaagaaggtcgaaaccaaacaacagtgatataagaagagattgagagaatctatgctgctgcctctttttttatttttgggatgttttttatttgaattttccttagtttcgaactctgtttgggttttctggtttatgaaagattactaagttttaaatgaactatcttgaaattggcatcgatcaatcaagtagagagtagttttctct

SEQ ID NO: 3865 - DNA, 474 bp, Brassica oleracea
gaacagaaattgcttctcagtcaatttttccatcgccgccgcactgctctctccgttttagattcttctcccgctcagatcgaattttccaagctaaaaatcatgcagaacgaggaaggagtcgtcactgagctttacattccgaggaaatgctcggcgacaaacagattgatcacctcaaaggatcacgcctctgttcagcttaacattggtcatcttgacgccgacggtatctacactggccagttcaccactcttgctctttgcggattcgtccgtgctcagggagacgcagacagtggcgtcgacaggctctggcagaagaagaaagtcgaaactaaacaacagtgagatagatagagacatagaatctataagctgttgtttttgccatgtttcattattgagttttctctttctgcgaactcgtatctttgttttctgatttatgaaaaataattacgttttggtggc

SEQ ID NO: 3866 - DNA, 659 bp, Brassica rapa
gcaactataaatcgcttttgtagtctcgtttcccctcgccgccggactgctctctctccacaccttcttctacttcctatcacagatcgattttaaaagctaagaaccatgcaaaacgaagaaggtgtcgtcactgagctatacattccgaggaaatgctcggccacaaacagattgatcacatcaaaggatcacgcctctgttcagcttaacattggtcatcttgatgccgatggtatctacactggccagttcaccacccttgctctctgcgggtttgtccgtgctcagggagacgcagacagtggcgtcgacaggctctggcagaagaagaaggtcgaaaccaaacaacagtgatataagaagagattgagagaatctttgctgctgcctcttttttatttttgggatgttttttatttgaattttccttagtttcgaactctgtatttcggttttctggtttatgatagacaattactaagtttttaatgaactatcttgaaattggcatcgatcaatcaagtagaggtagttttctctatattcagaggagagaaatggttaaggttacttcaacatctcaccaatcccaaagctcttcatctgtcttactaagctccagaaaatgcagacttactgtatccgttggggtaaaa

SEQ ID NO: 3867 - DNA, 610 bp, Brassica rapa
ataaatgacataatttgctttttattctgtttttccatcgccgccgaactgctctatcctctcagatcgaattttccaagcaataatcatgcagaacgaggaaggagtcgtcacagagctatacattccaaggaaatgctcggctacaaacagattgatcacatcaaaggatcatgcatctgttcagcttaacattggccatcttgatgccgatggtatctacactggacagttcaccacacttgcgctctgcggtttcgtccgtgctcagggagacgcagacagtggcgtggacaggctctggcagaagaagaaggtcgaaaccaaacaactgtgagtgagtgagagagattgagaaatctaaaaagctgctgcgctttgcctctttgttatttttgggatgttttgttgaattttctctctagctgcaaacaagtattttgagtttctggtttatgaaagataattaagttttggtggcagctgaatcatattctacggttcagttactattctcgtaatttttctttacaggaacgttttgatcaaaaacaaaatttcactacaccatctttaaattacatcttccgaacttccccattatgtaatt

SEQ ID NO: 3868 - DNA, 465 bp, Brassica napus
taaattgcttctcagtcaatttttccatcgccgccgcactgctctctccgttttagaatcttcttccgctcagatcgaattttccaagcttaaaatcatgcagaacgaggaaggagtcgtcactgagctttacattccgaggaaatgctcggcgacaaacagattgatcacctcaaaggatcacgcctctgttcagcttaacattggtcatcttgacgccgacggtatctacactggccagttcaccactcttgctctttgcggattcgtccgtgctcagggagacgcagacagtggcgtcgacaggctctggcagaagaagaaagtcgaaaccaaacaacagtgagatagatagagacatagaatctataagctgttgctacttgttgtttttgccatgtttcattattgagttttctctttctgcgaactcgtatctttgttttctgatttatgaaaaataat

SEQ ID NO: 3869 - DNA, 434 bp, Brassica napus
cactgctctctccgttttagattcttcttccgctcagatcgatttttccaagctaaaaatcatgcagaacgaggagggagtcgtcactgagctttacattccgaggaaatgctcggcgacaaacagattgatcacttcaaaggatcacgcctctgttcagcttaacattggtcatcttgatgccgatggtatctacactggccagttcaccactcttgctctctgcggattcgtccgtgctcagggagacgcagacagtggcgtcgacaggctctggcagaagaagaaagtcgaaaccaaacaacagtgagatagatagagacatagaatctataagctgttgctacttgttgtttttggcatgtttcattgagttttctctatctgcgaactcgtatctttgttttctgatttatgaaaaataattaagtttg

SEQ ID NO: 3870 - DNA, 405 bp, Brassica napus
gaactataaattgcttttgtagtctcgcttcccctcgccgccggactgctctctctccacacattcttcttctacttcttctcacagatcgattttaaaagctaagaatcatgcaaaacgaagaaggtgtcgtcactgagctatacattcccaggaaatgctcggccacaaacagattgatcacatcaaaggatcacgcctctgttcagcttaacattggtcatcttgatgccgatggtatctacactggccagttcaccacccttgctctctgcgggtttgtccgtgctcagggagacgcagacagtggcgtcgacaggctctggcagaagaagaaggtcgaaaccaaacaacagtgacataagaagagattgagagaatctatgctgctgcctcttttttatt

SEQ ID NO: 3871 - DNA, 519 bp, Brassica napus
tgctctctctccacaccttcttctacttcctatcacagatcgattttaaaagctaagaaccatgcaaaacgaagaaggtgtcgtcactgagctatacattccgaggaaatgctcggccacaaacagattgatcacatcaaaggatcacgcctctgttcagcttaacattggtcatcttgatgccgatggtatctacactggccagttcaccacccttgctctctgcgggtttgtccgtgctcagggagacgcagacagtggcgtcgacaggctctggcagaagaagaaggtcgaaaccaaacaacagtgatataagaagagattgagagaatctttgctgctgcctctttttattttgggatgtttgatttgaatttttcttagtttcgaaactctgtatttcggttttctggtttatgatagacaattactaagtttttaatgaactatcttgaaattggcatcgatcaatcaagtagaggtagttttctctatattcagaggagagaaatggttaag

SEQ ID NO: 3872 - DNA, 489 bp, Brassica napus
atcgccgccgaactgctctatcctctcagatcgaattttccaagcaataatcatgcagaacgaggaaggagtcgtcacagagctatacattccaaggaaatgctcggctacaaacagattgatcacatcaaaggatcatgcatctgttcagcttaacattggccatcttgatgccgatggtatctacactggacagttcaccacacttgcgctctgcggtttcgtccgtgctcagggagacgcagacagtggcgtggacaggctctggcagaagaagaaggtcgaaaccaaacaactgtgagtgagtgagagagattgagaaatctaaaaagctgctgcgctttgcctctttgttatttttgggatgttttgttgaattttctctctagctgcagacaagtattttgagtttctggtttatgaaagataattaagttttggtggcagctgaatcatattctacagttcagttactattctcgtaatttt

SEQ ID NO: 3873 - DNA, 522 bp, Brassica napus
ggactgctctctctccacacattcttcttcttctcagatcgattttaaaaagctaagaatcatgcaaaacgaagaaggtgtcgtcactgagctatacattcccaggaaatgctcggccacaaacagattgatcacatcaaaggatcacgcctctgttcagcttaacattggtcatcttgatgccgatggtatctacactggccagttcaccacccttgctctctgcgggtttgtccgtgctcagggagacgcagacagtggcgtcgacaggctctggcagaagaagaaggtcgaaaccaaacagcagtgataagaagagattgagagaatctttgctgctacctctttttacttttgggatgtttgatttgaatttttctttagtttcgaagaactttgtatttcagttttctggtttatgaaagacaattactaagttttaaatgaactatcttgaaattggcatcgatcaatcaagtagagaatagttttctctatactcagaggagagaaatggttaag

SEQ ID NO: 3874 - DNA, 470 bp, Brassica napus
gctctctcctctctcagatcgattctttcaagcaataatcatgcagaacgaggaaggagtcgtcacagagctatacattccgagaaaatgctcggccacaaacagattgatcacatcaaaggatcatgcatctgttcagcttaacattggccatcttgatgctgatggtatctacactggacagttcaccacacttgctctctgcggatttgtccgtgctcagggagacgcagacagtggcgtggacaggctctggcagaagaagaaggtcgaaaccaaacaactttgagtgagtgagagagataagagtatctaagctgcctgcttcctcttgttatctttgggatgtttcattgaattttctcctgggttttgcttttctaatttatggaaagataattttatcagtttttgtggcaattgaatcagattttacgcttcattaagtttaagcacaaacgtctttatca

SEQ ID NO: 3875 - DNA, 671 bp, Brassica napus
cgaacacaccagaactcatcacctctctactcaaatctctgcctcactcaatgacagaagctgctttgatgctagactcttcttttgtctacttcagcttcgtttgttacctacaaatcttacttagtttttacctttaaaaaaaaaaaaagtaaagaagatcacaatataacacaaagactcttgttcagtttattcctccttttccatcgccgccgaactgctctcttctctcagatcgattctttcaagcaataatcatgcagaacgaggaaggagtcgtcacagagctatacattccgaggaaatgctcggcgacaaacagattgataacatcaaaggatcatgcatctgttcagcttaacattggccatcttgatgctgatggtatctacactggacagttcaccacacttgctctctgcggatttgtccgtgctcagggagacgcagacagtggcgtggacaggctctggcagaagaagaaggtcgaaaccaaacaactttgagtgagtgagagagatagagtatctaagctgcctgcttcctcttgttatctttgggatgtttcattgaattttctctagatgcgaacttgtgttttgcttttctaatttatggaagataattttataagttttttgtggcaattgaatcagattttacgcgtc

SEQ ID NO: 3876 - DNA, 564 bp, Cleome gynandra
cggggatgtttcgagacacttttgcacccgtcgtcttcgtctcctgtttctgcattgtcattggagatagaatctttggttaaatttcaatctccaaagatgcagaacgaagagggtcagatcacagagctttacatccccagaaaatgctctgccacaaacaggttgatcacctcgaaagatcatgcctctgtccagatcaacatcggtcatttggacgctgatggcatctacactggccagttcaccacctttgctctctgtggtttcgtccgtgcgcagggagatgccgacagtgccattgacaggctctggcagaagaagaaggtcgaagcccgacagcagtaagaggaagaagcttcttcttacagacaaaagagggtctgggttttgtcccagtgctttcatgtttttagggtttatctttcagacttttgttttcctgtactactgagataattttctctgtttcttcgctttctacttacctctaattaatcgatatgtttctgagttctctctaaacatatattccatggtgagaaaggaaaaaaccaaatttag

SEQ ID NO: 3877 - DNA, 500 bp, Cleome gynandra
aacctaatatattcaaattccactaacccagcagagaaaccctagccatctccctcgctgccgcttgcagagcacagaatcggttaagtattttcggagctatagtccttaatctcccaagatgcagaatgaagagggtcagatcaccgagctttacatcccaaggaaatgctctgcaaccaacaggttgatcacttcaaaggatcatgcctccgtccaaatcaacattggtcatctcgatgctgatggaatctacactggccagttcaccacctttgctctctgcggttttgtccgcgctcagggggatgccgacagcgccatcgacaggctgtggcagaaaaagaaggtggaagcccgacagcagtaatgaattttgttgttcttctaggttgttgaatgaagctttgatttttggtctgatcagacatactgaaaacctgtttcttttatttcctctaagataacacatgtctggtttgtgaactctgttcttcatt

SEQ ID NO: 3878 - DNA, 484 bp, Cleome gynandra
tcggggtctagttatctcactcgctgccgtttgtggacgattgtctttttcagtcattacgagctaggatccgtaatttccaagatgcaaaacgaagagggtcagatcaccgagctttatatcccaaggaaatgctctgcaaccaacaggttgatcacctcaaaggatcatgcttctgtccaaatcaatattggtcatctcgatgctgatggcatttacactggccagtttaccacttttgctctctgtggttttgtccgtgctcagggagatgctgacagtgcaatcgacaggctgtggcagaagaagaaggtggaagcacgtcagcagtaattagtttttgcgcttcctttgtcttatgaagtaacttctttttggtctaatcagacttaatgcttctcgagtagtaagcctgatttcattttgtttccctgagataatatatatgccattgtttctgaactctattcatttgcaaaaaaaa

SEQ ID NO: 3879 - DNA, 512 bp, Cleome spinosa
gagagaagggctctttcgcttgccgcttgccgagcacttagtcgaatcagtgttccggagctcgagtccttaaatctctgaagatgcagaacgaagagggtcagatcactgagctttacatccccaggaaatgctcagcgaccaacaggttgatcacctcaaaggatcacgcttctgtccaaatcaacatcggtcatctcgatgctgatggcatctacactggccagttcaccacctttgctctttgcggttttgtccgcgcccagggagatgccgacagtgctatcgacaggctgtggcagaagaagaaggtcgaagcccggcaacagtaatgatgttttttggggtgttcctcgaggttagtctcatgaagcattaattttttgtctgaactctctgtttttcattttcatttggagaaagtagttttctgtctcgatctggaaaaagggttatctgggattttctttgtattggattttcatgttcaacattgccttaatcccagattt

SEQ ID NO: 3880 - DNA, 333 bp, Cleome spinosa
gtagcaatctcgctcgctgccgattgaggaggacagcgttgcttcaggagctagaatctcttaatctaagaagatgcagaacgaagagggtcagatcaccgagctttacatcccgaggaaatgctctgcgaccaacaggttgatcacatcgaaggaccatgcctctgtccaaatcaacatcggccatctcgatgcagatggcatctacactggccagttcaccacctttgcactctgtggtttcgtccgtgctcagggagatgctgacagcgcaatcgacaggctgtggcagaagaagaaggtcgaagcccgacagtaatcatatttccggtg

SEQ ID NO: 3881 - DNA, 484 bp, Raphanus sativus
gggccgccgaactgctctctttctctcgctccacagactcttcttcttctcagatcgatttttaaagctaagaatcatgcaaaacgaagaaggtgttgtcactgagctatacattcccaggaaatgctcggccacgaacagattgatcacttcaaaggatcacgcctctgttcagcttaacattggccatcttgatgccgatggcatctacactggccaattcaccacacttgctctctgcgggtttgtccgtgctcagggagacgcagacagtggcgtggacaggctctggcagaagaagaaggtcgagaccaaacaacagtgaagggggtacagagagagtctatgcttctgcctgttgttatttttgttatgtttcatttgaattttctctagttgcgaactcgtgtttgtcttttctggtttatgaaagataattaccaagttttttggttccaatagactcgtatcctacatttaaatt

SEQ ID NO: 3882 - DNA, 504 bp, Raphanus sativus
gggccgccggactgctctctttctctctcgctacacacactcttcttcttctcagatcgatttttaaaagctaagaatcatgcaaaacgaagaaggtgtcgtcactgagctatacattcccaggaaatgctcggccacgaacagattgatcacttcaaaggatcacgcctctgttcagcttaacattggccatcttgatgccgatggcatctacactggccaattcaccacacttgctctctgcgggtttgtccgtgctcagggagacgcagacagtggcgtggacaggctctggcagaagaagaaggtcgagaccaaacaacagtgaagggggtacagagagagtctatacttctgcctcttgttatttttgttatgtttcatttgaattctctctagttgcgaactcgtgtttggcttttctggtttatgaaagataattaccaagctttttggtgccaatagactcatattttacttttcaattatattctcgtagtcatc

SEQ ID NO: 3883 - DNA, 514 bp, Raphanus sativus
gggccgccggactgctctttctctctctctcgctccacagattcttcttcttttcagatcgatttttaaagctaagaatcatgcaaaacgaagaaggtgttgtcactgagctttacattcccaggaaatgctcggccacaaacagattgatcacttcaaaggatcacgcctctgttcagcttaacattggtcatcttgatgccgatggtatctacactggccaattcaccacacttgctctctgcggctttgtccgtgctcagggagacgcagacagtggcgtggacaggctctggcagaagaagaaggtcgagaccaaacaacagtgaaggggtctatgcttctgcctcttgttatttttgttatgttcaatttggattttctctagttgcgaactcgtgtttggcttttctggtttatgaaagataattaccaagctttttggtgccaatagacccgtatcctacatttaaattaatattctcgtagtcatctatacaaaaaaacttgctac

SEQ ID NO: 3884 - DNA, 582 bp, Raphanus sativus
tccatcgccgccgcactgctctctccgattagattattcttctgctcagatcgatttttgcaagctaataaatcatgcagaacgaggaaggagtcgtcacagagctttacattccaaggaaatgctcggcaacaaacagattgatcacctcaaaggatcacgcctctgttcagcttaacattggtcatcttgacgccgatggtatctacactgcccagttcaccactcttgctctctgcggatttgtccgtgctcagggagacgcagacagtggcgttgacaggctctggcagaagaagaaggtcgaagccaaacagcagtgagagatggagataatctatatgctgcccgctcttgtttttggcaatgtttccttgaattttctctagctacgaacaagtatctctgttttctgatcgataaaagatatttaagtttttttggtgccaattgaatcagttctcttgattatctatacattgagaactgccacgtcactcagcttgatgattatgtaacatgaacgtgataagttgatgattatgcaacatgaatttgatgacttgaaattgatttgtgtta

SEQ ID NO: 3885 - DNA, 475 bp, Raphanus sativus
  misc_feature (86)..(86): n is a, c, g, or t
  misc_feature (297)..(297): n is a, c, g, or t
gggatcgccgccggaacaactctctcctctcagaccagatcgatttttccaagcaataaatcatgcagaacgaggaaggagtcgtnacagagctatacattccgagaaaatgctcggccacaaacaggttgatcacatcaaaggatcacgcatctgttcagcttaacattggtcaccttgatgccgatggtatctacactggccagttcaccacacttgctctctgcggtttcgtccgtgctcagggagacgcagacagtggcgtggacaggctctggcagaagaagaaggtcgaanccaaacaacagtgagtatgagagaatataagctgctgcttgctttgcctcttgttatttttggggatgtttcattgaattttctctagatgcgaacttgtgtttttgctgttctaattttatgaaaagataattttaaaagttttagtggcaaatgctatcagattctacggttcatt

SEQ ID NO: 3886 - DNA, 429 bp, Raphanus sativus
gggccgccgcactgctccctcctctcagatcgatttttttttttctaagtaataatcatgcaaaacgaggaaggagtcgtcacagagctctacattccgagaaaatgctcggccacaaacaggttgatcacatcaaaggatcacgcatctgttcagcttaacattggtcatcttgatgccgatggtatctacactggacagttcaccacccttgctctctgcggtttcgtccgtgctcagggagacgcagacagtggcgtagacaggctctggcagaagaagaaggtcgaaaccaaacaacagtgagttagagagaatataagctgcttcttgcctctttgttacttttgggatgtttcattgaattttctctagatgcgaacttgtgttttgctgttcttatttatgaaagataattttgaaagtttt

SEQ ID NO: 3887 - DNA, 408 bp, Eutrema halophilum
taaaatcatgcaaaacgaagaagggcagattactgagctatacattccgagaaaatgctcggccacaaacagattgatcacctccaaggatcatgcttctgttcagcttaacattggtcatcttggtcccgatggtgtctacactggccaattcaccacatttgctctctgcggatttgtccgagctcagggagacgcagacagtggcgtggacaggctctggcagaagaagaaggtcgaaaccaaacaacagtgagagagagcgtgaatctaaagctgcctctagtttgttttttgatgtttcattgaatttcgtctacatgcgaactcgtatttttgttttctgattatgaaagataggttttgatgccaatgaaatcagattctacagttaaattctaatctcta

SEQ ID NO: 3888 - DNA, 493 bp, Eutrema halophilum
catcgccgccggattgcactcagattcttcttcctctcagatcagatcgtatttttcaagctaaaatcatgcaaaacgaagaagggcagattactgagctatacattccgagaaaatgctcggccacaaacagattgatcacctccaaggatcatgcttctgttcagcttaacattggtcatcttggtcccgatggtgtctacactggccaattcaccacatttgctctctgcggatttgtccgagctcagggagacgcagacagtggcgtggacaggctctggcagaagaagaaggtcgaaaccaaacaacagtgagagagagcgtgaatctaaagctgcctctagtttgttttttgatgtttcattgaatttcgtctacatgcgaactcgtatttttgttttctgattatgaaagataggttttgatgccaatgaaatcagattctacagttaaattctaatctctaatgtgttttctataccaagtaact

SEQ ID NO: 3889 - DNA, 1464 bp, Brassica rapa
ataaataacataaattgcttctcagtcaatctttccatcgccgccgcactgctctctccgttttagattcttcttccgctcagatcgatttttccaagctaaaaatcatgcagaacgaggagggagtcgtcactgagctttacattccgaggaaatgctcggcgacaaacagattgatcacttcaaaggatcacgcctctgttcagcttaacattggtcatcttgatgccgatggtatctacactggccagttcaccactcttgctctctgcggattcgtccgtgctcagggagacgcagacagtggcgtcgacaggctctggcagaagaagaaagtcgaaaccaaacaacagtgagatagatagagacatagaatctataagctgttgctacttgttgtttttggcatgtttcattgagttttctctatctgcgaactcgtatctttgttttctgatttatgaaaaataattaagtttggtggcatttgaatcagtcctacaattcaactacatttttattttctacacaagagaactgctactacaccaatcagcgtcatgatttgcaacaggaacttgtgaacttgtgttgcgtattattgccatcgattaattagaaaaagaaggaaagagttatggttaaccattgaaattcaacaaaaacacatttttgaatcatatttcaccatcccaaagctcttcaagtgtcttgtaaggactcatagtctcatgaacgaacgatgtaccttggaccaacctagcctgcgcagttaatacaacaaaaaaacaatatttagactcttcgttgaattacaattatgcggaagtgatgtggttgtggttttacttgcctgttctatctgagaaaacttgtcaaacatttcttttggaattgaccatcccagtacatcgaagttctccctgatcctcgcttcatttgtgcttttgggaagcacactatgacccatttgaacaccccatcgaagtgcggtttgcgcaggagacttactgagttctttagccaccgtttccaggaccggactctttagaacatctgctttcacccacgttgttcctggagaacccaatggcgaatacccctgcaacaatcaaacattcacatgtgtaagaaactgaagatttatgattcctttcccttgagagactgtaatgattttggacaatgttgggtggttcaaacttactgacaagtgaatccctttggacttgcagaactcatgaagcttatgttgttgccatgaagggtgacattccacctggtttacagctggaggaacccgagcgacctccacaagatccgagagtttctttgtagagaagttgcttatcccaatggctcgtgccttgcctgagtcatacagtgcttccattgctttccatgtgctaggaatatcgataggcataatgttctctggcttaaactcaacactgcctttcttca

SEQ ID NO: 3890 - DNA, 513 bp, Arabidopsis thaliana
atgaattaagcaaaccctatctttgtcgccgccaaacctctctcagattcttcttcttcctcgcagatcgatttttttttgaagctaaatctcaaaaatggagaacgacgcaggtcaggtcacagagctctacattccaaggaaatgctcggcaacaaacagaatgatcacatcaaaggatcatgcttcagttcagcttaacattggtcatcttgatgctaatggtctctacactggccaattcaccacttttgctctctgcggatttgtccgtgctcagggagacgcagacagtggcgtggacaggctctggcagaagaagaaggtcgaagctaaacaacagtgagagacaatctgacaatgtcataagctcttgtttgttttttgaggtttcgatttattagctatgtggctttgtcattgaattgaaaatgttagtttctctttatgcgaattcatgttttcgatttttctgctttattaaagataattattaggctttgaggccaatgg

SEQ ID NO: 3891 - DNA, 484 bp, Arabidopsis thaliana
tctttgtcgccgccaaacctctctcagattcttcttcttcctcgcagatcgatttttttttgaagctaaatctcaaaaatggagaacgacgcaggtcaggtcacagagctctacattccaaggaaatgctcggcaacaaacagaatgatcacatcaaaggatcatgcttcagttcagcttaacattggtcatcttgatgctaatggtctctacactggccaattcaccacttttgctctctgcggatttgtccgtgctcagggagacgcagacagtggcgtggacaggctctggcagaagaagaaggtcgaagctaaacaacagtgagagacaatctgacaatgtcataagctcttgtttgttttttgaggtttcgatttattagctatgtggctttgtcattgaattgaaaatgttagtttctctttatgcgaattcatgttttcgatttttctgctttattaaagataattattaggctttg

SEQ ID NO: 3892 - DNA, 356 bp, Brassica juncea
atcgccgccggaactgctctctcctctcagatcgaattttcgaagctataatcatgcagaacgaggaaggagtcgtcacagagctttacatcccgagaaaatgctcggcaacaaacagattgatcacatcaaaggaccatgcatctgttcagcttaacattggccatcttgatgccgatggtatctacactggccaattcaccacacttgctctctgcggttttgtccgtgctcagggagacgcagacagtggtgtggacaggctctggcagaagaccaaggttgaaacaaaacaacagtgagaagagttatatctatgcttgctgctgcgcttgcctctttctattttttttgga

SEQ ID NO: 3893 - DNA, 536 bp, Cleome spinosa
agcctgtctcatctcactccccgccgcttgttgacgacagaatcgcttcagtctttcggagctagaatccataatctctcaagatgcagaacgaagagggtcagatcaccgagctttacatcccgaggaaatgctctgcaacgaacaggttgatcacctcgaaggaccatgcctctgtccaaatcaacattggtcatctcgatgccgatggcatctacactggccagttcaccacttttgctctctgcggtttcgtccgtgctcagggtgatgctgacagcgccatcgacaggctgtggcagaagaagaaggtcgaaacccgacagcagtgattgtgacttctggtgttttcatcgtaggttgtcttacgaagaaatgagtttttttttttgttctaatcaaacttaatatttctgtcaagtactgaagcctgtcttgattttgtttcgctgagataatgcatgccatggtttctgaactctattcacttgcaaaagtagatttcttgatccaattgaagggacggtatttgtgcc

SEQ ID NO: 3894 - DNA, 487 bp, Elaeis guineensis
attcttcttcttcctcgcagattcgattttttttgtaagtctaaatactcaaaataggagaacgacgcaggtcaggtcacagagctctacattccaaggaaatgctcggcaacaaacagaatgatcacatcaaaggatcatgcttcagttcagcttaacattggtcatcttgatgctaatggtctctacactggccaattcaccacttttgctctctgcggatttgtccgtgctcagggagacgcagacagtggcgtggacaggctctggcagaagaagaaggtcgaagctaaacaacagtgagagacaatctgacaatgtcataagctcttgtttgttttttgaggtttcgatttattagctatgtggctttgtcattgaattgaaaatgttagtttctctttatgcgaattcatgttttcgatttttctgctttattaaagataattattaggctttgaggccaatggagtcaaaaaaaaaaaaa

SEQ ID NO: 3895 - DNA, 436 bp, Brassica juncea
gatcgccgccggactgcattctcctctcctctcagatcgttttttttgcaagctaaaatcatgcagaacgaggaaggagtcgtcactgagctttacattccgaggaaatgctcggcgacaaacagattgatcacctcaaaggatcacgcctctgttcagcttaacattggtcatcttgacgccgatggtatctacactggccagttcaccactcttgctctctgcggatttgtccgtgctcagggagacgcagacagtggcgtcgacaggctctggcagaagacgaagctcgaaaccaaacaacagtgagataagagataatctataagctgcccgctcttgatgtttttggcagtgtttccttgaattttctctagctgcgaactcggtttttctctgttttctgatctatgaaagataattatgtttcagtgcc

SEQ ID NO: 3896 - DNA, 639 bp, Cleome spinosa
gcttgctgctgctgcttctgcatcgtctttgaagctagaactgttggttcgattcaatctcccaagatgcagaacgaagagggtcagatcaccgagctttacatacccaggaaatgttctgccactaacaggctgatcacctccaaggatcatgcctctgtccagatcaacattggacatctggatgccgatggcatctacactggccagttcaccacctttgctctctgcggtttcgtccgtgcccagggagatgctgacagcgccattgacaggctctggcagaagaagaaggctgaaacccgacaacagtaagagcgaacccgtcttcctgccggccagatagggtctgagatgtacttgaatggtatcaggattttttgtacgaagaacaaagttttctcccttcagacttgtgtttgaagcactcgacacatgccttgctgttccttggcagagataatccatgtttggcttctcaacctttttcccttgtttagaagagtaggtttcggtttctctgctaacgaccaaaatggtttagaagacatcatacgtggaggtctgatcatacctttacaaatatgttgaattatcactgtagaaatacatgaaatgtacatacgtttcacaaaaaaa

SEQ ID NO: 3897 - DNA, 451 bp, Cleome spinosa
gtcttcgtcgccccctgcctgctgttttctgcatcgtctttggagctagtacatttggttcaatttaatccccaaagatgcagaacgaagagggtcagatcactgagctttacatccccaggaaatgctcagccacaaacaggctgatcacctcgaaggatcatgcctctgtccagatcaacatcggtcatcttgattctgatggcatctacaccggccagttctccacctttgctctctgcggtttcatccgtgcccagggagatgctgacagtgctatcgacaggctatggcagaagaagaaggtcgaagcccgtcaacagtagggagaggatctctcctatttataccatttatgtcattttgttaaaagaatttttcgtatgaagaacaaagttttgcccaatcagatttgacatttttggaagagtagattcctctccttgtgaca

SEQ ID NO: 3898 - DNA, 268 bp, Brassica rapa
tcttctaaagatacagaacgaagaaggtcaaatcactgagctttacattccaaggaaatgttcagcgacaaacaggttggtcacatcaaaggatcatgcttctgtgcagctcaacattggccatctcgatgctgatggaatctataccggccaattcactaccttagctctctgcggttttgtccgtgctcagggtgatgctgacagtggagtcgacaggctctggcagaagaaggaggttgaaactaaacaacattaagaccagaaa

SEQ ID NO: 3899 - DNA, 488 bp, Rosa hybrid cultivar
gagattttcgcagccgcctccaggatttgttgcctttgcggaagtaatcaactcattcatcaagatgcagaacgaagagggtcaaatcactgagctctacattcccaggaaatgctcagcaactaacaggctgatcacctcgaaggatcatgcatctgttcagatcaacatcgggcatcttgatgagaatggcatctatactggccagttctccacttttgctctttgtggttacgtccgtgctcagggagacgctgacagtggtcttgaccgactctggcagaagaagaaagcagaagtgaaacaacagtagaagaagcaagctgaacttgagctgatttttctagtattttgagtttatgttttagagtatggaagtgaaccaatatatggtgttttgtatttgtttttgatgacggttgcaactagttggcatcattttgctattgacttccgaagtatctagttatgcaagcttaagtttccca

SEQ ID NO: 3900 - DNA, 366 bp, Brassica napus
aaaaatcatgcagaacgaggagggagtcgtcactgagctttacattccgaggaaatgctcggcgacaaacagattgatcacttcaaaggatcacgcctctgttcagcttaacattggtcatcttgatgccgatggtatctacactggccaagttccaccactcttgctctctgcggattcgtccgtgctcagggagacgcagacagtggcgtcgacaggctctggcagaagaagaagtcgaaaccaacaacagtgagatagatagagacatagaatctataagctgttgctacttgttgtttttggcatgtttcatttgagttttctctatctgcgactcgtatcttgtttctgatttatgaaaaa

SEQ ID NO: 3901 - DNA, 424 bp, Abies balsamea
acagaatgcagaacgaagaaggacagaatgtcgatctttacattccaagaaaatgctctgcaaccaatcgactgataacttcaaaggaccatgcatcggtgcaattaaatattgggcacctggacgagaacggaatatacacaggccagttcacaactttcgctctctccggctttgtccgagcacagggagatgctgacagtggggttgataggctctggcagaagaagaaagctgaacttggtcagtaatttttgcaagacggtgaacatgtaggatttcaatctgagaagattttgtatactttaaaatttaaattgctttatggcaatatacatctgtggtgacaattggggttctgtttaagagttaaatatgatttcccacgactttaatttgtctcaactcaaatttttgatttaac

SEQ ID NO: 3902 - DNA, 931 bp, Cannabis sativa
ataattggttcatcttcgaaggctaatatatactttagcgccggcccttctgtaaaacccttcgcctcttttgcttctctgcaatctgcatcttaagccttcaaatctagattttacagagaagttaagttcactcgccaatatgcagaacgacgaaggtgttatcacagagctctacattcccaggaaatgctctgcaaccaacaggttgatcacttcaaaggaccatgcatctgttcagatcaacattgggcatttggatgagaatggtgtctacaccggccagttctctaccttcgctctttgtggttttgttcgtgctcagggagatgctgacagcggtatcgacaggctctggcagaagaagaaagttgaagttaaacaacagtagaaagtttcatcaaatatgttatggttgaatgaattagaatcatatctcgtttgccttaattttgaatggtgacaatggaagttgacatttttagttggagactcagactcctagtttttgttggtactatgtagttggggttgattttttactatgaagttatttaacttttaagtattattcaaatttatatgcctctttatccatgcatcgttgcaatagctttcccagtttccctatcataaatttcttaaatcatcaaatgtgttggcaaggcataaagtggctaagctatttgtttgaggtttcaccattttttttcttctgctgaaaatgaaacttcaggttgaataaaggtgaagtagaatattatcaaagtagttttttttaaaaaaataatttatgttgtttttagtacttttttagtgttcaagaaaatagagcattacaagattgtatcatatttaaaggttcataccattgcatactttctgtttgcactattatctgttgaagtaatggtatcttatggtttttgaa

SEQ ID NO: 3903 - DNA, 469 bp, Humulus lupulus
tttgcttctctgtatctcaagtctcatcacatctaggttttccagagaagttaaattcactcgccaatatgcagaacgacgaaggtgttatcacagagctctacattcccaggaaatgctctgcaaccaacaggctgatcacttcaaaggatcatgcatctgttcagattaacattggacatttagatgagaatggtgtctacactggccagttctctacctttgctctttgtggtttcgttcgtgctcagggagatgctgacagcggtatcgacaggctctggcagaagaagaaggttgaagttaaacaacagtagaaagtatcatcaaatatgttgtggcagaatgaatcagaaccacatctctttttccctgtcttttgaatgataaaccatgaaaattgacatttttttagttggagactttagtttttggtgatattatgtagttgggattgatttttactatg

SEQ ID NO: 3904 - DNA, 588 bp, Tropaeolum majus
tccgatttctcttcattctcaggctagcagctccttcattttccaggtatttgagctccgtgtctttgtgatcaaccaaccaccagccaagatgcagaacgaagaggggcaaaacatggatctttacattccaaggaagtgctctgctacaaacagactcatcacctcaaaggaccacgcatctgtccagattaacattggacatctggatgctgatggtgtctacactggccagttcaccacgtttgccctctgcgggttcatccgtgcccagggtgatgccgacagtggcattgacagactttggcaaaagaagaaggtcgaagttcgacaacagtgaagctctttgagttggatgattgctactgcatctcttgcttgaaaagagaatgcataggcctcaatttagttttagtttatatttcttggcaatattgaagcttcctactgttggtctggactaatttatgtttaatatctgggaatcagttttgaatccattttcttttcgttatctaaaactcatcttaattgctttgtctaaattcttcacaatttacctagtgcccaacaatgaaatttatagta

SEQ ID NO: 3905 - DNA, 546 bp, Tropaeolum majus
agaatacggttcatagtttgtatttccccaactggtttctctgcttcctggtttagtacaaatctcagtcaagatgcagaacgaagaaggtcaaaacatggatctctacattcctaggaagtgctctgctacaaataggctcatcacttcaaaggatcacgcatctgttcagatcaatattggacatttggatgcagatggtgtctacactggccagttcaccacatttgctctctgtggttttatccgtgctcagggtgatgctgacagtggcatcgataggctctggcaaaagaagaaagttgaagttcgacaacaataacttcaatctgcttgggtatctcccaacacttgagtgactgttttgtactaaatatgattttgttgaagtgaaaaaaaattctcggtcagttttctaaactagttttgttttgacaattagtctctttgatatattattatttatttgatcaaagatttttttaaattgaaacttgaccaaatattaattttgtcttttgtatattcaatttatttatattcaat

SEQ ID NO: 3906 - DNA, 626 bp, Prunus mume
cgaacgcagagcactagagttcagcagctgccgccaccacttctcaatctcatatctgttcaaagggtttcaactcaatcgacaatatgcagaacgaggagggacaaatcactgagctttacattcccaggaaatgctcggccacaaacaggctgatcacttcaaaggaccacgcatccgttcagattaacattgggcatctggatgagaatggcatctacactggccagttctccactttcgctctctgtggctatgtccgcgctcagggagaggctgacagtggtctggaccgtctctggcagaagaagaaatctgaagttaaacaacagtagaaagagatgatttttcttatgtggtttcttttctggacgtatgttattgacaatggaagtgttgttttagtgaactaaaatatatgttgagcgtttttcttttccaattagtagtgaatgttgcaattagctcccaaccttttggtgttcttgaattgggctgttcttttgacggcgaagtagtgaaacttttactccttggagtattttaaatatatttccctgctttacggcactttttacactggtaatgcatgatgattgaaatccagggcagtatatgttttgaga

SEQ ID NO: 3907 - DNA, 679 bp, Prunus mume
aaaaccctaacgaacgcagagcactacagttcagcagctgccgccaccacttctcaatatcatatctgttcaaagggtttcaactcaatcgacaatatgcagaacgaggagggacaaatcactgagctttacattcccaggaaatgctcggccacaaacaggctgatcacttcaaaggaccacgcatccgttcagattaacattgggcatctggatgagaatggcatctacactggccagttctccactttcgctctctgtggctatgtccgcgctcagggagaggctgacagtggtctggaccgtctctggcagaagaagaaatctgaagttaaacaacagtagaaagagatgatttttcttatgtggtttcttttctggacgtatgttattgacaatggaagtgttgttttagtgaactaaaatatatgttgagcgtttttcttttccaattagtagtgaatgttgcaattagctcccaaccttttggtgttcttgaattgggctgttcttttgacggcgaagtagtgaaacttttactccttggagtattttaaatatatttccctgctttacggcactttttacactggtaatgcatgatgattgaaatccagggcagtatatgttttgagagcttgtgactaaagatttgtagttggcaattcatatctattgc

SEQ ID NO: 3908 - DNA, 636 bp, Prunus persica
aaaaccctaacgaacgcagagcactacagttcagcagctgccgccactacttctcaatctcatatctgtgcaaagggtttcaactcaatcgacaatatgcagaacgaggagggacaaatcactgagctttacattcccaggaaatgctcggccacaaacaggctgatcacttcaaaggaccacgcgtccgttcagattaacattgggcatctggacgagaatggcatctacactggccagttctccactttcgccctctgtggctatgtccgcgctcagggagaggctgacagtggtctggaccgtctctggcagaagaagaaatctgaagttaaacagtagaaagagatgatttttcttatgtggtttcttttctggacgtctgttattgacaatgaaagtgttgttttagtgaaccaaaatatatgatgtcgagcgtttttcttttccaattagtattgaatgttgcaactagctcccaactttttggtgttcttgaattgggctgttcttttgacggcgaagtagtgaaacttttactccttggagtattttagatatatttctctgctttacggcactatttacactggtaatgcatgatgattgaaatccagggcagtatatgttttgaga

SEQ ID NO: 3909 - DNA, 702 bp, Picea glauca
taggatgtataaaaccctaaccctaaaatgcttcatagcaggtcatgaataatatgagaggcagagagaagtagtcggcagtcgaagaggtcattcaatcgcgattttgtgaggcagagagaagtagtcggtagtcgaagaggtcattcattcgccatcaagatgcagaacgaagaaggacagaatatcgatctttacattccaaggaaatgctctgcaaccaatcgactgataacttcaaaggaccatgcatcggtgcaattaaatatcgggcatctggacgagaatggaatatacacgggccagttcacgacctttgctctctcaggctttgtccgagcacagggggatgccgacagtgggattgataggctctggcagaagaagaaagtagaacttggtcagtaatttttgcaagatggcgaagatggaggattttttgaatctgaaaagaatgtgtaaacattatggagacaattggggttctgtttaatagttaaatatgatttcctaggactttaattttgctcaactcaaatttttgatttaacatagctgaacttacctcattgttgagcatatcttttattggttggtactgtaattaaaagtcatcttattgtctatataacagtagccgtgggagattaaataagcaatgtaaggtgaaggtttttatacaaagatatctttttctatgca

SEQ ID NO: 3910 - DNA, 799 bp, Picea glauca
ttaattaaattatcccccccccccccgagtgaaaaagtcgtcaatccctcgtcactaaaccaccttttttcttcactgccttcatgaaaccctaaaccctaactcgagggtaccgggtgaacaagtggtcatccttagcaagccctaacgcatggcatataaaaggggcaaattagtgccccagaggctctgtaaactgtttcgattgatgctgggaggctgtgatttcgtatctggattgaataatctgtgagatagagagaagtaattcattcgccatcaagatgcagaacgaagaaggacagaatatcgatctttacattccaaggaaatgctctgcaaccaatcgtctgataacttcaaaggaccatgcatcggtgcaattaaatatcgggcacctggacgagaacggaatatacacgggccagttcacaacctttgctctctccggctttgtccgagcacagggagatgctgacagtgggattgataggctctggcagaagaagaaagtagaacttggtcagtaatttttgcaagacagcgaagatgtaggagttgaatctggaaagaatgtgttgactttattaaattgctctatggcaaaagacatttatggagacaattggggttctatttaatagttaaacatgatttcctaggacttcaattttgctcaactcaaatttttgatttaatagagctgaacttacctcattgtcaagcttgccttttattggttggtactctaatgaaaagttatcttattgtctataaaaaaaaaaaaaaaagagctctt

SEQ ID NO: 3911 - DNA, 999 bp, Picea glauca
ggccttcacagttgaatttcatctgcacaagcgagtcccttcattactacacgatccctcgtcactaaaccacctttctcttccctgccttcatgaaaccctaaaccctaactcgagggtaccgggtgaataagtgatcatccttagcaagccctaacgcatggcatataaaaagggcaaattagtgccttagaggctctgtaaactgtttcgattgatgctgggaggctgtgatttcgtgtctggattgagtaatccgtgagatagagagaagtaattcattcgccatcaagatgcagaacgaagaaggacagaatatcgatctttacattccaaggaaatgctctgcaaccaatcgtctgataacttcaaaggaccatgcatcggtgcaattaaatatcgggcaccttgacgagaacggaatatacacgggccagttcacaacctttgctctctccggctttgtccgagcacagggagatgctgacagtgggattgataggctctggcagaagaagaaagtagaacttggccagtaatttttgcaagacggcgaagatgtaggatttgaatccggaaagaatgtgtagactttattaaattgctctatggcaatagacatttatggagacaattggggttctatttaatagttaaacatgatttcctaggacttcaattttgctcaactcaaatttttgatttaatagagccgaacttacctcattgcaagcttgccttttatttggtactctaatgaaaagttatcttattgtctatatataatattagctttgggagattaaataagccatgtaagatgaaggtttctatacaaaggaatctttttccatgcatgatattttgcaggatataaacaattgaaagacttggtcactattgaagtctgcccaaaaatgaattaatggtaattcatttttctaacatgaagcatcacaaccagtttcaatctggaaaccaattgtgggaactcacatg

SEQ ID NO: 3912 - DNA, 424 bp, Picea glauca
cggggaggtcatgaataatatgagaggcagagagaagtagtcggcagtcgaagaggtcattcaatcgcgattttgtgaggcagagagaagtagtcggtagtcgaagaggtcattcattcgccagcaagatgcagaacgaagaaggacagaatatcgatctttacattccaaggaaatgctctgcaaccaatcgactgataacttcaaaggaccatgcatcggtgcaattaaatatcgggcatctggacgagaatggaatatacacgggccagttcacgacctttgctctctcaggctttgtccgagcacagggggatgccgacagtgggattgataggctctggcagaagaagaaagtagaacttggtcagtaatttttgcaagatggcgaagatggaggattttttgaatctgaaaagaatgt

SEQ ID NO: 3913 - DNA, 664 bp, Fragaria vesca
ttgtagacttgtagtagtgggctttgatagaagaatatccaaagccctaagcccagttcttcttttataaacctaagtgtgtctctcattctccattcactcaagctctcgccgcctgcagcctccagcctccaggattttgtcgtcgttgcgggagtaatcaactcattcatcaagatgcaaaatgaggagggacaaatcactgagctctacattcccaggaaatgctcagcgactaacaggctgatcacctcgaaggatcatgcatctgttcagatcaacattgggcatcttgatgagaatggcaactacactggccagttctccacttttgctctctgcggttacgtccgtgctcagggagatgctgacagtggtctcgaccgactctggcagaagaagaaagctgaagtgaaacaacagtaatgaagcaagactgaacttgagctgatttttctagtattttgaaatttctttttagagtatggaagtgaaccaatctataatgatgttgtgtatttgttttgatgacgggatcaactagttggtggcatcttttttgcgacttttaaattatctagatattcaagcttaagtttgccagattttattgtttccgtgttctgtggttttgataaattgccaaagcatatttttgagcaaa

SEQ ID NO: 3914 - DNA, 666 bp, Citrullus lanatus
tgactcctaaattttgggttttcgcatttttggtaattgcaattgtatttgttcttatgaaacattgatgggatctttttaaagcaggttttctagttctaaagtattagttgatacacttcaagatgcagaacgaagagggtaaaatcacagagctttatattcccagaaaatgctccgcaacgaaccggctgattacttccaaggaccatgcttctgtccagatcaacattgggcatttggatgagaatggcatctacaccggccaattttccacttttgctctctgtggtttcattcgggcccagggagatgctgacagtggactggatcggctctggcagaagaagaaagtcgaagtgcgtcaacaatagatgattgtgctgttctggttcatctctatatcaaagtttaaaaggatagagacacacttaaaatttttttttgaaccactcatagttaagtagtttcttttgacaacttaaactcattagtttctttaaatgcaaacttaactacgtctgagacagtacaagcattgatgtgggtcaaaagagggccaaaactaagttgaatgacatgttgaatttcattttccattaaaaatatttactagagagattcaatatggccatatgtgaatgtgatgttgatatgataaggatg

SEQ ID NO: 3915 - DNA, 694 bp, Tropaeolum majus
attggccagacggcccattacagaaacccgacccggttttcaagacgttttgttagggcttcggatatacactagacgctgctctgttttctcttcattctcaggcgcagctccttctgctttccaggtgttttgagctcttagtcttttgattgattaacaaacaaccagccaagatgcagaacgaagaagggcaaaacatggatctttacattcccaggaagtgctctgccacaaataggctcatcacctcaaaggaccacgcatctgtccagatcaacattggacatttggatgctgatggtgtctacactggccagttcaccactttcgccctctgtgggttcatccgtgcccagggtgatgccgacagtggcatcgacaggctttggcaaaaaaagaggttgaggctcgacaacagtgaaagaaagccctttgagttccgatgattgctagtgcatctcttgcttttggaagagaatgcgtagtaggcatatcaatttatgtttaatatcttgaaatcagttttgtttacaccatttttctaaaagatataaaattcattgctattgactattttaattttcctttctaaatcgttcactcgtaattaaagtgaatgagttctaatatttcagctctttttcttatgtgaccacgtaaagattatgcattgtccaaatataaaatttat

SEQ ID NO: 3916 - DNA, 694 bp, Picea glauca
tataaaaagggcaaaattagtgccctagaggctctgtaaactgtttcgattgatgctgggaggctgtgatttcgtatctggattgaataatctgtgagatagagagaagtaattcattcgccatcaagatgcagaacgaagaaggacagaatatcgatctttacattccaaggaaatgctctgcaaccaatcgactgataacttcaaaggaccatgcatcggtgacaattaaatatcgggcatctggacgagaatggaatatacacgggccagttcacgacctttgctctctccggctttgtccgagcacaggaagatgctgacagtgggattgataggctctggcagaagaagaaagtagaacttggtcagtaatttttgcaagacggcgaagatgtaggatttgaatccggaaagaatgtgtagactttattaaattgctctatggcaatagacatttatggagacaattggggttctatttaatagttaaacatgatttcctaggacttcaattttgctcaactcaaatttttgatttaacatagctgaacttacctcattgttgagcatatcttttattggttggtactgtaattaaaagtcatcttattgtctatataacagtagccgtgggagattaaataagcaatgtaaggtgaaggtttttatacaaagatatctttttctatgc

SEQ ID NO: 3917 - DNA, 529 bp, Manihot esculenta
ataattccgcagaagattaaccttgttttatatctttcgagctgagcccttgttattcgccgtcatcctcttccggtattttctattgatttttcggttagcgaaccaatcaaccaagatgcagaacgaagagggtcagaatatggatctctacatccccaggaaatgctctgcaacaaacaggctcatcacctccaaggatcacgcttctgtccagcttaacattgggcacttggatgccaatggccactacactggtcaatttaccacttttgctctctctggtttcgtccgagctcagggtgatgctgacagtgccctggacagactttggcaaaagaagaaggttgaacatcgccaacaatagtcccagtttgagcatgttgttttcttgttttagacattgttagtcaaaggacagtaactgcatttacctagctgttccattccattaatatggtcgttttttggttatttgatatgaaggacagattaatatcaaagatttagcattgtttttatgtcgaac

SEQ ID NO: 3918 - DNA, 1221 bp, Ricinus communis
gacgaagaggacatagaagtaatttaagattatacaattagggtttgagtagcatataaagctgcaaagagaagttcctaattcttttcagctcagcctcttgtattttgccgtcgccactgtcttccggttttgataaacaaagtttttgggaagcgaatcaaaccaaaaattcaagatgcagaacgaagagggacagaacatggatctttacatcccaagaaaatgctctgctacaaacaggcttatcacttccaaagatcatgcatctgttcagattaacattggacatttggatgctaatggtcactacactggtcaattcaccacttttgctctctgtggcttcgtccgtgctcagggcgatgctgacagtgctctcgacaggctttggcaaaagaagaaggtcgaactccgtcaacaataagcggggttggagtatgttcttcgttttagtttaatcttagttgaagaagacagtgggacagcagtgactgcgctcttccattttatcactgtgactgtttttagcgatttgtcaaccaagacaagataatttctagtacttatttgtttcatgatctttaatttggtattttaaacttcggaagttttgtctctttactctcgagttgcaatatattgaagtgatttttgtttttacaccaaagcggataccttttccagctgcaactaattatttgcccggcttggctggaagctgcttgtccaagtaatagcgagatgcttgctgcaaaaataaatgggcatataatatccttttcttctcccaggtctttattgctctattcagttttatggcatgcaggagctgtctgaggaggcaatgctcatgccaaaacatcccaccagtattcacatttcacaaggacatgcttcttcgcattaaaaaggatatgctgatatacgaattaaggagatgaagtactcagtaaatgagtattagtaaacatgacgagttgcctgcctctggtactcaactacaatataactggaaagatatcgtagagccgttgtcccaagctctagtcagttttcttggtgtcgaactacctgtattttatcactaatggtccttctggatttaagggcgccggtccattggcgtccatagtccataatgcaagaattgttgaaaaaacccatcattcatgatccttccaaatttttgatctaatgggcccatagtccatagctctt

SEQ ID NO: 3919 - DNA, 479 bp, Cedrus atlantica
gcattccttctttagcaggcgtgggacttcggcttggtgtctctggatttgaataatctgcgcggtagagggtagtagcgggcaaccaaagaggtcattcattcgctatcaacatgcagaacgaagaaggacagaatgtcgatctttatattccaagaaaatgttccgcaaccaatcgactgataacttcaaaagatcatgcatcggtgcaattaaatattgggcacctggacgagaacggaatatatacgggccagttcacaactttcgctctctccggctttgtccgagcacagggggatgctgacagtgcgattgataggctctggcagaagaagaaagtagaacttggtcagtaatttttgcaagatggcaaacatgtaggatttgaatctgagaatgtgtaaactttaaattgctttatggcaatatgcatttatggagacagttaggttctatttaacagttgaacatgattt

SEQ ID NO: 3920 - DNA, 548 bp, Hevea brasiliensis
ggggcttctatagcagttgtaatcctcttcatcgggtgatttgagctaagtggttttttgggtagcgaatcaatcattcaagatgcagaacgaagagggtcagaatatggatctgtacatccccaggaaatgctctgccacaaacaggctcatcacctccaaggatcatgcttctgtccagattaacattgggcatttggatgccaatggccactacactggtcaatttaccacttttgctctctgtggtttcgtccgagctcagggtgatgctgacagtgccttggacaggctttggcaaaagaagaaggttgaactccgccaacaataattgcagttggagcatatgttctgttttgttttaaacgttgttgctccatgaaagagtgactgcagttacctagctattccattgcacttttatggttgtttttagttatttgttatcatggatgagttaatatctagtacttagtttgagtttgatttttatgttgaacttgtttttggcatgattttctataatatcatcctgcattttaagtttt

SEQ ID NO: 3921 - DNA, 683 bp, Humulus lupulus
ggttatcgaagtctagcgccggccctcctctaaatcccttcttcgctttgcttctctgtatctcaagtgagtccatcacatctaggttttccagagaagttaaattcactcgccaatatgcagaacgacgaaggtgttatcacagagctctacattcccaggaaatgctctgcaaccaacaggctgatcacttcaaaggatcatgcatctgttcagattaacattggacatttagatgagaatggtgtctacactggccagttctctacctttgctctttgtggtttcattcgtgctcagggagatgctgacagcggtatcgacaggctctggcagaagaagaaggttgaagttaaacaacagtagaaagtatcatcaaatatgttgtagcagaatgaatcagaaccacatctctttttccctgtcttttgaatgataaaccatgaaaattgacatttttttagttggagactttagtttttggtgatattatgtagttgggattgatttttaagtgttattcaaatttatatgcctcttaatcatgcatcattggcttcttcttcatcataagtttctaaaatcaccaaatgcttgttagtgcctagctcagggcatcgaccagagacattcccatgcattatatttacgaaagagtaactaagcttgtttgaggttttgcc

SEQ ID NO: 3922 - DNA, 684 bp, Pinus pinaster
ctacactcctcttacgtgcaccgtgtagcatttattcgatcaaacgaggccgccttacctttcttaccatacgtccgacaagtagtagagcattcccacctcgcctttctttagcataatctgtgaggcagagagacgccatcaacatgcagaacgaagaaggacagaatatcgatctttacattccaaggaaatgctctgcaaccaatcgactgataacttcaaaggaccatgcatcggtgcaattaaatatcgggcacctggacgagaacggaatatacacgggccagttcacaacctttgctctctctggctttgtccgagcacagggggatgctgacagtgcgtttgataggctctggcaaaagaagaaagtagaacttggtcagtaatttttgcaagatggtgaaatgcaggatttgaatttgagaaaaatgtgtaaactttaaattgctttatggcaacatatatttataaacacaattggggttctgtttagtttagtagttaatatgatctcgtaggacttttaattttgatcatctcaattttttaatttaaaatagctaaactttcctcattgttgagcatttctttttattggttgatactgtaatgaaaattcatcttggggtcgtatataatagtagcagtgggaggatgaaataaagaccatgtaaggag

SEQ ID NO: 3923 - DNA, 893 bp, Pinus pinaster
cattctaggttttgttgggagacatttcacttagagaaataggtgtttggttctaacaaattggagcagtaatgaattatagagccactagtcatgcccttgcccttgtcttcgtcctcgatctctcatagctcgacttggaggtagtatctacagtagatttgattcttaggtttggtgaaggaagccattatgtgcaagtagtttgggggtatatttctcgaaaggcaaagctttgaaaaccctaaccctacactgctcttagcctacaccgtgtggcacaacattcaagcaagcgaatccgccttacctgcctcacgatacgtccgacagcaagtatagcatcccttgtgcgcccttctttagcataatctgtgaggcagagagacgccatcaacatgcagaacgaagaaggacagaatatcgatctttacattccaaggaaatgctctgcaactaatcggctgataacttcaaaggaccatgcatcggtgcaattaaatatcgggcacctggacgagaacgggatatacacgggccagttcacaacctttgctctctccggctttgtacgagcacagggggatgctgacagtgcgtttgataggctctggcagaagaagaaagtagaacttggtcagtaattttgcaagccgacgaaggtgtaggatttgaatttttgggaagaatgtgtaaacttacatttctctatgacaatatacattgatggagacaattggggttctgttttatagttaaatatgaactcctatgaatttaattttgctcaactcaaactttcgatctaaaataacagaattttcctcattgtcgagcatatcttttattggttgatagtatgataccataatgaaaattcatcttatggtcta

SEQ ID NO: 3924 - DNA, 821 bp, Pinus pinaster
atgggatgaaaccctaaccttaaaacgatctgttttatgctagtattttattgctcctgataggggaatagttataaaaccctactactaacttgtcttactattttcgcgctccttcagcttcagcataatctgtgaggcatagagaggtagtcggcacttgaagcggtcattcctgcgccaccaacatgcagaacgaggaaggacagaatatcgatctttacattccaagaaaatgctctgcaaccaatcgactgataacttcaaaggaccatgcatcggtgcagctaaatatcgggcacctagacgagaacggaatatacacgggccaattcacaacctttgctctctccggctttgtccgagcacagggggatgctgacagtgcatttgataggctctggcagaagaagaaagtagaacttggtcagtaattttgcaagatggcgaagatgttggatttggatgagaagatgtaacatttaaatttccctatggcaatatacatttatagagacaattggggtgctgtttaatagctaaatatgatctcctatgactctaatttatgccaactcaaaacttggatttgaaattgctgaactttccttgtcgagcatgtcttttattggttgatactgtagcgaaaattcatctgatggtctatataatagtagcagtggtgattaaataagtcatgtacggtgaaagatgtcttttccatgcattttttttgcaggataaaagcaattgaatgataagccatgtaaggtgaaggtttttagtatttatgacgaggatgtcgtcttttacatgcatga

SEQ ID NO: 3925 - DNA, 586 bp, Cucumis melo
tctaaattttagggtttcttcagcacgcctctttctccctttcggatagttcgtttcctctgttgtgcttgcgggttgattcacttatcaagatgcagaacgaagagggtaaaattacagagctttatattcccagaaaatgctccgcaacgaatcggctgattacttccaaggaccatgcttctgttcagatcaacattgggcatttggatgagaatggcatctacactgggcaattttctacttttgctctctgcggtttcattcgggcccagggagatgctgacagtgcactggatcgtctctggcaaaagaagaaagtcgaagtgcgtcaacaatagatgattgtgtctttctggttcatctctatatcaaagttttcaagtatagagatacagttctaagattttttgaaccactcgcagttaagtagtttctttcgacaatttaaactcgttagttcctttaaatgcgaactcaacttcattgaggttggacaagctctgatgagtcaaaagaggaccaaaactaagttgaatgaaatacgttgaagttacattttccattaaaaatatttagtagagcc

SEQ ID NO: 3926 - DNA, 525 bp, Cucumis melo
agaactctaatttctcgtcgttaatccatcgtttccttgctttcttatctagatttttgatcaaacatcaaggccaaaatgcagaacgaagagggaaagatcaccgagctctacattcccaggaagtgctctgccacaaaccgactcattacttctaaggatcacgcctcggttcagattaacattgggcacttggacgagaatggcatctacacaggccaattctccactttcgctctctgcggtttcatccgtgctcagggagatgccgacagtgcattggataggttgtggcagaagaagaaagtagaagttcgccaacagtagaaaatccaaaatctcttctacttgaaatattatgtttctaatttagtgttccattgagaatttatgaatattgagagagcctagcctgccttttgctgctaaaatttgtagtttttgttggagtctttatgtgatgaagctggtttttgataatttcttactggattcatatttgctcgtttggttaatcgatttttt

SEQ ID NO: 3927 - DNA, 552 bp, Tropaeolum majus
gtttcccgaatctctatataaccaatacttctctttgaaattagggcttccaactgcagattcagggttgaactttggatcgccttaccggtttatcttctccctgatatagaacagatctcagtcaagatgcagaacgaagaaggtcaaaacatggatctttacattcccaggaagtgctctgctacaaataggctcatcacttcaaaggatcacgcatctgtccagattaacattggacatttggattcagatggtgtgtacactggccagttcaccacatttgctctctgcggttttatccgtgcccagggtgatgccgacagtggcattgataggctctggcaaaagaagaaagtggaagttcgacaacaataagttaagttcgttccgctacgatgttgctaaatagaattttatttccccgagaggagtggctttttttgttttagattaattctatgctaatatgatctacttcaggttgtgtgaattatgggttgttatctaaacaagcttatattgctagaaagtggtttgactaatgctatg

SEQ ID NO: 3928 - DNA, 649 bp, Cajanus cajan
ctctacggcattcatcttcgttcttcgttttctcaggtttacggatctttttgaaggagctttacaacacccaaccgaagatgcagaacgaggaaggacaaatcaccgagctttacattcccaggaagtgctctgcaacaaacagattgatcactgcaaaggaccatgcttcggtccagatcaacattgggcatttggatgagaatggtgtctacaatggtcaattttccacttttgccctctgtggcttcatccgtgctcagggtgatgccgacagtgctctagatcgtttgtggcagaagaagaaagttgaagctaagcaacagtagatgctcatgatagtttgttactttgctatgtattaagttctactcttgctagagatattcgagtattatgatcatcattttgagcaagtacaagttctgaatttttgttggtacctcagctaatgttgctttttgattgtttgacttttaagtattcggttgtctcctatttcaatcatagatttcatgttttggtatttttcttttgcaagtcctgttatataacaaaatagaacgccttgcccatccatagattctgatgaatggtgtattcagcttccaggcttctacaactttaataactgaattccaatgaacaa

SEQ ID NO: 3929 - DNA, 684 bp, Cajanus cajan
ctacggcattcatcttcgttcttcgttttctcaggtttacggatctttttgaaggagctttacaacacccaaccgaagatgcagaacgaggaaggacaaatcaccgagctttacattcccaggaagtgctctgcaacaaacagattgatcactgcaaaggaccatgcttcggtccagatcaacattgggcatttggatgagaatggtgtctacaatggtcaattttccacttttgccctctgtggcttcatccgtgctcagggtgatgccgacagtgctctagatcgtttgtggcagaagaagaaagttgaagctaagcaacagtagatgctcatgatagtttgttactttgctatgtattaagttctactcttgctagagatattcgagtattatgatcatcattttgagcaagtacaagttctgaatttttgttggtacctcagctaatgttgctttttgattgtttgacttttaagtattcggttgtctcctatttcaatcatagatttcatgttttggtatttttcttttgcaagtcctgttatataacaaaatagaacgccttgcccatccatagattctgatgaatggtgtattcagcttccaggcttctacaactttaataactgaattccaatgaacaacctggcattttgataatggcattttgataatgaagaa

SEQ ID NO: 3930 - DNA, 830 bp, Pinus taeda
atgtgcaagtagtttggtggtatatttctcgaaaggcaaagccttggaaaccctaaccctacactgctcttaacctacaccgtgttgcacattcaagcaatcgaatccgccttacctgcctcacgatacgtccgacagcaagtctagcatcccttctgcgctcttctttagcataatctgtgagaccgagagacgccatcaacatgcagaacgaagaaggacagaatatcgatctttacattccaaggaaatgctctgcaactaatcggctgataacttcaaaggaccatgcatcggtgcaattaaatatcgggcacctggacgagaacgggatatacacgggccagttcacaacctttgctctctccggctttgtacgagcacagggggatgctgacagtgcgtttgataggctctggcagaagaagaaagtagaacttggtcagtaatttttgcaagccaacgaaggtgtaggatttgaatttgagaagaatgtgtaaacttacatttctctatgacaatatacattgacggagacaattggggttctgttttatagttaaatatgaactcgtaggaatttaattttgctcaactcaaactttcgatctaaaataacagaattttcctcattgtcgagcatgtcttttattggttgatagtatgatgccataatgaaaattcatcttatggtctatataatagtagccgtgggaagattaaataagccatgtaagctgaaatgtctttttctatgcatgtctttttgctggataaaaacaactgaatgataaaccatgtaagatgaaggtttttatacaaagatgtct

SEQ ID NO: 3931 - DNA, 820 bp, Pinus taeda
atgaaaccctaaccttaaaacgatctgttttatgctagtattttattgctcctgataggggaatagttataaaaccctactcctaacttgtcttactatcttcgccctccttgagcttcagcataagctgtgaggcatagagaggtagtcggcactcgaagcggtcattcctgcgccaccaacatgcagaacgaggaaggacagaatatcgatctttacattccaagaaaatgctctgcaaccaatcgactgataacttcaaaggaccatgcatcggtgcagctaaatatcgggcacctagacgagaacggaatatacacgggccagttcacaacctttgctctctccggctttgtccgagcacagggggatgctgacagtgcatttgataggctctggcagaagaagaaagtagaacttggtcagtaattttgcaagatggcgaagattttggatttggatttggatgagaagatgtaacatttaattttccctatggcaatatacatttatagagacaattggggtgctgtttaatagttaaatatgatctcctaggactctaatttttgccaactcaaattttggatttaaaatagcttaactttctttgtcgagcatgtcttttattggttgatactgtagcgaaaattcatctgatggtctatataatagtagcagtggtgattaaataagtcatgtaaggtgaaagatgtctttttccatgcattttttttgcaggataaaagcaattgaatgataagccatgtaagatgaaggtttttagtatttatgatgatgatgtcgtctttttacatgc

SEQ ID NO: 3932 - DNA, 689 bp, Populus trichocarpa
tttccgtccatatatcctcacaccaatatactagggttttgcaggcatatataaaaaccgcaaagcaagccatgatctcctcctcagcttaccgtagcagttgcagcctctcctcttcctggtgattaagagctttaactgtatttttgggtagcaaaacaagacagtcaagatgcagaacgaggagggacagaacatggatctttacatccccaggaaatgctctgccaccaacaggcttattacctctaaggaccatgcgtctgttcagattaacattggtcacttggatgctagtggtcattacactggccagttcaccacttttgctctctgtggtttcgttcgtgcccagggtgatgctgacagtgccgtggacaggctttggcaaaagaagaagactgaactccgccagcagtaactgcgttagagaatacttttttttttgtcttaaacattgttagtgcaagaagagtggtgtgatagcagtgacaactgctctcattttcgtgaaaccatgtttaatttagttctctgcctgaacaagtttatcttttagcttgattatattttgaactcttcctagatccaagattttaatttttggttgccatcaagttttttgctagtttgaacgtcttgaactccaagtgaggtggggttatctccatctcttgaattctcgaggt

SEQ ID NO: 3933 - DNA, 638 bp, Populus trichocarpa
tgcagccatataaaaaaccgtaaagaaagccttcatctcctactcagcttaccctagcagtggcagcctctcctcttcctggtgatttagagcttaaactgtatttggggtagaaaatcaaaaccagacaagatgcagaacgaagagggacaaaacatggatctttacatccccaggaaatgctccgccacaaacaggcttatcacctctaaggaccatgcgtctgttcagattaatattggtcatttggatgccagtggtcattacactggccagttcaccacttttgcgctatgtggcttcgtccgtgcccagggtgatgctgacagtgccgtggacaggctttggcaaaagaagaagactgaactccgccagcagtaactgcattagagttttgtttttgtcctttaaacattgttagtgcaagaaagtgaccaactgctctcattttcgtgaaccatgttcttttagctctctgcccgaacaagaatctattacttagctattatattttgaaatttcgttatgtccaagattttaataattttccattcaagttttgaaagttttagaatcctcattttttagtgagttccatcacgttgaagacccgtttagtattgggatcatttgcagtc

SEQ ID NO: 3934 - DNA, 568 bp, Populus trichocarpa
gcaggcatatataaaaaccgcaaagcaagccatgatctcctcctcagcttaccgtagcagttgcagcctctcctcttcctggtgattaagagctttaactgtatttttgggtagcaaaacaagacagtcaagatgcagaacgaggagggacagaacatggatctttacatccccaggaaatgctctgccaccaacaggcttattacctctaaggaccatgcgtctgttcagattaacattggtcacttggatgctagtggtcattacactggccagttcaccacttttgctctctgtggtttcgttcgtgcccagggtgatgctgacagtgccgtggacaggctttggcaaaagaagaagactgaactccgccagcagtaactgcatctggctttcaaggaattgacgctatgtgcttccaaagtttctggctactaaacatgggctagttctagcttggaaccagggctacagaaagatcatctccaattcaaacttcataaatgcctagagattgatgaaaatttcatttttattttaaatggatattaaggaatttcttttaata

SEQ ID NO: 3935 - DNA, 270 bp, Prunus persica
tcattgaccaagatgcagaacgaagagggagttatcactgagctttacattcccaggaaatgctcggccaccaacaggttgataacttcaaaggaccacgcgtccgttcagatcaacgtcgggcatctggatgagaatggcatctacacaggccagttctccacttttgctctctgtggttacgtccgcgctcagggagatgccgacagtggtctggaccgactctggcagaagaagaaagatgaagttaaacaacactaggaagagaaa

SEQ ID NO: 3936 - DNA, 1776 bp, Malus domestica
aaccctaacaaacgcagagcttctcacttccagcagctgccgccaccactccgacttccccaaagggttataatctcgaccgccaagatgcaaaacgaggagggaatcatcaccgagctctacatcccgaggaaatgctcggcgacgaacaggctgatcacctccaaggaccacgcctctgttcagattaacattgggcatttggatgagcatggcatctacactggccagtgctccacctttgctctctgcggctacgtccgcgctcagggagaggccgacagtggtttggaccgtctctggcagaagaagaaaaccgaagttaaacagtagaaagagattattcttcttcagttcatggggatgagttgtttaatttctgaactaaattatgtgatgtcttattccattagtactgaatgttgcaagtagttcccaaccttttggtgttcttgaaatgggctgttcttttgacgattaagtagtgaaacttctacccattgagtatcttaattatatttctggtttcgtaaaattatttccactgatgatatgcatgattattcttatgatctatgtcaaaaattgtccacggatgataattcttttgagcatcgacatagataatgttctgtgggtattgccttctctagcaagccgtggtggactactagaggcggcagcgccacgcaaaggcttacgagttccgaacgccgcggcgactcagttttcaaatcggcattcgccggcagccatggattcgagcagctcgggctccacgaagcttgattacttcgacgacacgtggaagctccaatccaccgccacattgctatccgtatctaaaggggaagatggacgaaccgccttggtattggaccggacgatcttctatccccaaggtggcgggcaacctgcggacaccggcttcatcgccgcttccgattccggggtcaaattcgtagtagaagatgtgcggtcccgagacggcatagtttaccactacggtttcattgaaaattccggtgaggaatcggagtcgaaattcgagaaagggaaagaggtgctgttgtgtgtggatgagtctaggcgcaggcttaatgctaggcttcactcagctgggcatttgctggatacatgtatgagaaatatgggattgggtgatttagagccaaccaaaggctaccatttccctcagggaccatatgtggaatataaaggcacagttccacaaaaagatacagaaagtaagcgaaaggagttggaggtagaagctaatgcgttaatatcgagaggaggaaaagtttctgctgccttgttaccatatgaagaagcgtgtaagctgtgtggtgattgccttcccgattatattgcaaaggacagcactcctcgcattgtgaagctaggggacagccttggctgcccatgtggcggtacccatgtttctgatatatcagagatcaagagcattacggttactcaagtacggacaaagaaaggatcgacaaaggtcttttacaatatcgggtgactcgggtcctatttcttgatgtaatattttgcactctcattgatacaaagatctgcatcattgtgtagaaactagaaattgacaatttatatttttattatagagtgttcttgtaaaactataaatttttcgggcttttaaaaggattttacgagtagtgaatcactggttgtaatttgtttgtattgtgtacatgatgtattcagtatttaattaaacagccgccgcttaattagtatatacag

SEQ ID NO: 3937 - DNA, 455 bp, Euphorbia peplus
gttatttaggtatttaacgaaacatcgtagccaaaatgcagaacgaagagggaaagatcaccgagctttacattcctaggaagtgctctgccacaaaccgactcatcacctccaaggaccacgcctcggttcagattaacattggtcacttggatgagaatggcatctacacaggccaattctccactttcgctctctgtggtttcatccgtgctcagggagacgcggacagtgctttggataggttgtggcagaagaaaaaagcagaagttcgccaacatagaaagtggaaattttcttctacttgaaattttatgtttctaattaagtttagttttattgcgaattatgaatgttgagagagcctagcctgcctttgcttctaaagttgtagtgtttgttggaatcttcattcggtgaagctggtttttgatcatttattagtggatttattc

SEQ ID NO: 3938 - DNA, 594 bp, Panax ginseng
ttctggtattttgtttttgtaaacttcgcggctgtgggaacattttgtcaagatgcagaacgaggagggacaaaacatggacctttacatccccaggaagtgctctgccactaataggctgattacttctaaggatcatgcatctgtccagattaatattgggcatttggatgagaggggcatctacactggtcaattctccacgtttgctctctgtggtttcatccgagcccagggggatgctgacagtgcccttgataggctctggcagaagaagaaagttgaagcccgccaatgattcgtatcaatagtttgttttgcatcaaatattccaatttagtattgtaattgagcaattactgctcagcagcaactttgtttatgtacttggatatgatcatttaatcttatttgaagataattgaccatcttaaaaaaaaaaaaacttagctgttcaccttgttgaatggttttgttactgtattcctttcaaggctctcaatgttggaaagttattcaatcagcaactagttggaatcatgtaaaacgggactaatggtgggtcatgtttatatccaaatgcccgattcatta

SEQ ID NO: 3939 - DNA, 390 bp, Medicago truncatula
cctctgcgtctgtctgcatctctaacctctctctcgatttttgttgtcaagggaatttctcagcaaacctcaagatgcagaacgaagaaggacaaatcaccgagctctacattcctaggaagtgttctgctacaaacagattgatcactgcgaaggatcatgcttcagttcagcttaacataggtcatttggatgagagcggtgtttacaatggtcacttctccacttttgctctctgtggcttcactcgtgctcagggagatgctgacagtggaattgatcgcctgtggcagaagaagaaaaccgaattgaagcagtagatgaaatgatcacatctttattatgtggttttttacatattgtcatgtgttgaattcaactttgttagag

SEQ ID NO: 3940 - DNA, 394 bp, Abies balsamea
cgtttattgtgtctggactcgaataatctgcgaggcggatgaagtaacgcgtaggcaaagaggtcactcagtcgccatcaacatgcagaacgaagaagggcagaatgtcgatctttacattccaagaaaatgctctgcaaccaatcgattgataacttcaaaggaccatgcatcggtgcagttaaatatcgggcacttggacgagaacggtgtatacacgggccagtttacaacttttgctctctccggttttgtccgagcacagggggatgctgacagtgggattgataggctctggcagaagaagaaaatagaacttagtcagtaatttttgcaagatggtaaacatgtagcaagactataaactttaacttgctttatggcattatactat

SEQ ID NO: 3941 - DNA, 729 bp, Amborella trichopoda
tgggatcaagagcggtcctttatatttcattttgagactagggtttttgcttctcgctcctccttccctggacgtcatttacggttcttctcttcggtacgtggacctttactttgtaaggatttaaaaatcttggcaagatgcagaacgaggaagggcaaaacatggatctctacattccgagaaaatgctcggccacaaatagacttatcacctccaaggaccatgcatcggtccaaattaacattggccacgtagatgaggatgggatttacagaggccaattcaccacgtttgccctttgtggatttgtccgtgcccagggcgatgccgacagtgcggtggaccggctttggcaaaagaagaaggctgagttgaggcagtaggatgtttcaaatgacttgaagcatcattgtgttttatggaaaccttaattttcattatacaaagactttgggtgggcctatggctctgttgattggactcgttttgcttttgaggttaagcaagccatttaccttctatgcttcagggattcctttgaggttatgattcagtaaagtattccttacgttggctagatgtgaaggtttaactgtgctctttgctcagtttttgttgaagattcgattttgtttcagatgaaactatttcaatatgctgctttttatatttatatatttatttaagggtgtggtttgaataaggccaaggccctaaacaatcaaa

SEQ ID NO: 3942 - DNA, 602 bp, Malus domestica
ttagaaaaccctaacaaacgcagagcttctcacttccagcagctgccgccaccactccgacttccccaaagggttataatctcgaccgccaagatgcaaaacgaggagggaatcatcaccgagctctacatcccgaggaaatgctcggcgacgaacaggctgatcacctccaaggaccacgcgtctgttcagattaacattgggcatttggatgagcatggcatctacactggccagtgctccacctttgctctctgcggctacgtccgcgctcagggagaggccgacagtggtttggaccgtctctggcagaagaagaaaaccgaagttaaacagtagaaagagatgattcttcttcagttcatggggatgagttgtttaatttctgaactaaattatgtgatgtcttattccattagtactgaatgttgcaagtagttcccaaccttttggtgttcttgaaatgggctgttcttttgacgattaggtagtgaaacttctacccattgagtatcttaattatatttctggtttcgtaaaattatttccactgatgatatgcatgattattcttatgatctatgtcaaaaattgtccccgga

SEQ ID NO: 3943 - DNA, 349 bp, Brassica oleracea
gttcctaggaaatgctctgctactaaccgtctgatcacatcgaaggaccatgcctctgtgcagctcaacattggtcatttagatgctgatggtatctacaccggacagttcactacctttgctctctgcggtttcgttcgtgcccagggagatgcagacagtggtgtggacaggctatggcagaagcagaaggtcgaagccaaacagatttaaagagcttataaagctgtttttttttttatcgttctcggacatacactgaagtaatgattttttgcttgaccttttgttttattgcaatcggtgaacttgtttcttctgattcgctagtaagattataacttcaact

SEQ ID NO: 3944 - DNA, 389 bp, Cannabis sativa
ccctagcaacctcttcttcttcaccatcatcatcgttttctctctctctctctctctctagccgaatcaagatgcagaacgacgaaggagtgatcacagagctttacattccacgtaaatgctcggccacaaacaggctcatcacctccaaggaccatgcgtccgtacaggtcaacattggacaccttgatgagaatggtgtctacactggccagttcactacttatgctctctgtggcttcgtccgtgctcagggtgatgctgacagtgcaattgataggctttggcaaaaaaagaagagtgaagtgaaacaacagtaataataataataatagaatgtaggaagaggattcaattgtctttgtgatgagtcttttttgtttagtcat

SEQ ID NO: 3945 - DNA, 457 bp, Cannabis sativa
tagcaacctcttcttcttcttcaccatcatcatcatcgttttctctctctctctctctagccgaatcaagatgcagaacgacgaaggagtcatcacagagctttacattccacgtaaatgctcggccacaaacaggctcatcacctccaaggaccatgcgtccgtacaggtcaacattggacaccttgatgagaatggtgtctacactggccagttcactacttatgctctctgtggcttcgtccgtgctcagggtgatgctgacagtgcaattgataggctttggcaaaaaaagaagagtgaagtgaaacaacagtaataataataataatagaatgtaggaagaggattcaattgtctttgtgatgagtcttttttgtttagtcatatgaaaatctttctatgtttgtttttggatttatgtttggtattatttagaaacaccattgagttttta

SEQ ID NO: 3946 - DNA, 699 bp, Catharanthus roseus
caaaacctcatatgatctagggtttttaacagaactataaaagctgatccgaccacatctgaagctctctccttagtcagccgctcctgcaactgcctttcaacttctttttgctggtgttgagatttgtggataaaagtactgagccaagatgcagaacgaggagggacagaatatggatctctacattccgaggaagtgttctgccacaaataggctgatcacttctaaggatcatgcatctatccaaatgaacattggacatttggatgcaaatggattgtatactggacaattcacaacttttgctctctgcggatttgttcgtgcacagggagatgctgatagtgctcttgatagactctggcagaagaagaaagttgagcttcgtcaacagtgatttgttacttaagcaactagagtcttgcacaaggaaaaattttgttgaatgtagactctctgaaagtatacttcgtcaacatgaaggaaatctctttaatatttttaatttaaacaagctcaattggcaatacttgttattaaaatgtttggttttaagacatgtatgcatcctctgtcttgaatactattatataatctcttttctgcttcatttctccctgtatcttcattgtcttatgaggttgatcttgggtgcctcttgcatgctctgggagagttttctttctgttgggagaa

SEQ ID NO: 3947 - DNA, 650 bp, Vigna unguiculata
ggatttataataaccatcgtgtcgctcacaaaccctcctctacggctctcatattcgttcctcgtcttctctgagatttctgtgaaggagtttttacaaagttcaaccaaagatgcagaacgaggaaggacagatcactgagctttacatccctaggaagtgttctgctacaaacagattgattaccgcgaaagaccatgcttcggttcagattaacattgggcatgtggatgagaatggtatctacaatggtcaattctccacctttgccctctgtggcttcatccgtgctcagggtgatgctgacagtgccctagatcgcttgtggcagaagaagaaagttgaagttaagcaacagtaggctaccatgatactttgttatgtattgatttctacctttgctagtaatatttgaggattatgattgtcattttgagcaaatacttgttctgaattttcgttggtacttggtaccccagctaaggttgtttttttgacaatgcgttgaagttttcggttgtcttatatttcaatcttagattatttcttgctgtagtttttttaagtttgactttacaacaccatagatgaaggttatgaagttaatttttgaatgtttaattgttgaggttttcaaaaaaaaaaaaaaa

SEQ ID NO: 3948 - DNA, 637 bp, Cucumis sativus
gctgccgactggtattaactattggactttttcccgattcctctagctgtttgttcattcgtatgtgtgttagaagttaaatttcttggcgttaattcatcgtttacttgccgaagcaggtttttattagatttttgatcaaacatcaaagccaaaatgcagaacgaagaaggaaagattaccgagctttacattcctaggaagtgctctgccacaaatcgactcattacttccaaggatcacgcctcggttcagattaacattgggcacttggacgagaatggcatctacacaggccaattctccacttttgctctctgcggtttcatccgtgctcagggagatgcagacagtgcattggataggttgtggcagaagaagaaagccgaagttcgccaacagtagaaaatccaaaccttcttctacttgaaatattatgtttctaattaagttagtgtttcattgagaatttatgaatattgagagagcctagcctgccttttgctgctaaaatttgtagtttttgttggaatcttcatgtggtgaagctggtttttgataatttcttcgtggattcatatttgtgctcttcggttaatccatatttttctagcacttggggatttttttcctcttt

SEQ ID NO: 3949 - DNA, 521 bp, Euphorbia peplus
ccgtagccgtttctttctggtgaattgagataagagttttctgaggtagcaaaccaaccagtcaagatgcagaacgaagaaggacagaacatggatctttacatccccaggaaatgctccgccacaaacaggctcataacctcaaaagatcatgcttctgtgcagatcaatattgggcatttggatgccaatggccattacactggtcaatataccacttttgctctctgcggttttgtccgtgcccagggtgacgctgacagtgcccttgacaggctttggcaaaagaagaaggttgaactccgccaatgattaccctttttgactgtcccttatgaacactgttagaatgttgtgagggtgagcagagtgacagcagtgactatttttgttaatttggttttagatatttgttggcggagacagcttctatatgtagaacctagcatgattttgtgttgaacttcgtgatggtcatgttttgattttatatttcacttaaaatgaaatttcttcaaaat

SEQ ID NO: 3950 - DNA, 480 bp, Flaveria ramosissima
actcgttgcagccgtcgaccttcgcaacacgcagcagcttacgatctagctttgtgttcttgttgctgttctagaaatcgccaaaatgcagaatgaggagggacaaaacatggatctctacatccctagaaagtgctctgctactaacaggttgatcacttcaaaggatcatgcatctgttcagattaacatcggccatttggatgagtctggccgttacactggccagttttccacttttgccctctgcggttttgtacgagcccagggagatgctgatagtgcacttgacaggctgtggcagaagaagaaagttgaagctcgccaatagtaacgttacctgtttagcatttgcttccatgatgttaaacaacaattttcatgtcttgagttttttatttactaggagcatgagggatattgcatcaagtttgttggcttaatttggatcttatgttggcaatggaacatacatcgagt

SEQ ID NO: 3951 - DNA, 376 bp, Flaveria ramosissima
cagccgtcgacctttgcaacacgcagctgcagaaagagactgattaagttccgatcttgttgctgtttcagaaatcgtcaagatgcaaaatgaggagggacaaaacatggatctctacatccccagaaagtgctctgctactaacaggttgatcacttcaaaagatcatgcatctgttcagattaacattggccatttggatgagtctggccgctacactggccagttttccacttttgccctctgcggttttgtacgagcccagggtgatgctgacagtgcacttgacaggctgtggcagaagaagaaagtcgaagctcgccaatagttactctacttgtttaccatttgcttctgtgatgttacacaacaattt

SEQ ID NO: 3952 - DNA, 870 bp, Lactuca sativa
caagctccaagggtcaaatgtggtttaacctataatgacactatttgggccctttgtatcatttataaatggagttagggttttacatcccttccagccgtctacattctcaatacgcagcagccgaagaagctctcacatcaccgagtaaatcccgatccagttgctgtttgccaagatgcagaatgaggagggacaaaacatggatctctacatcccaagaaagtgctctgctactaataggttgatcacttcaaaggatcatgcttctgttcagatcaatgttggtcatttggatgagtctggtcgctacactggccagttttccacttttgccctctgtggttttgtcagagcccagggagatgccgatagtgcccttgacaggttgtggcagaagaagaaagttgaagctaagcaatagtttctttcatggtgacaaaatggcaattttcattttcatgtcttacatttcagttattagaagcatgaaggattattatattacatgaagtttgtagttcaacttttgatttcatttgggttatgacttattacattgagtcagaatttttatttttgtgtgtgaagtttgaattgctattatgagttttgctcttatcatattttccaccgaattcacaaccaattctttctcaatcatggggtaaaagcttatttcaaaccaaggttaagctatggatttacaagatcaaacccaatgtatgaatctcaagagaattttaatttaaatttgttgaattaaaaacttttgtgataggaaaaatttcttgtggacttgactgattttgatgtattcttaacactctatcacgtatgtttattgcatggattagtaattgtagcaca

SEQ ID NO: 3953 - DNA, 517 bp, Glycyrrhiza uralensis
gctctcatcttctcttctaacttctgctgcgcgctctctccctctcaacaaaggattcgtgtgaatttgactaagatctatagtacgatgcagaacgaggaaggacagatcactgagctttacattcctaggaagtgctctgctacaaacaggttgataacatcgaaggaccatgcctcggttcagattaacattggccatttagatgagagtggtgtctacaatggtcacttctccaccttcgccctatgtggcttcgttcgcgcacagggtgatggcgacagtgcactggatcgcctgtggcagaagaagaaagttgaaaccaagcaacagtagattgcatgatagtttgtttatgttttaagttcaactcttgctagagatatttgaggattttgatctatgtattgcaatactagttttgaatttcctttggtgccttcaactgaagttgctttggtaactgtctgacagtgctttgaaaagtatttatttgacagtgattttacttgttaaa

SEQ ID NO: 3954 - DNA, 505 bp, Medicago truncatula
cggcccataacattaatggttttaagggtttatgggattatatatacatacattcttttttgcgaatgtgattcagaagaaaccctaaaaatgcagaacgaagaaggccaaatcaccgaactctacattcctagaaaatgttctgctacaaacagattgatcactgcgaaggatcatgcttcagttcagcttaacataggtcatttggatgagagcggtgtttacaatggtcacttctccacttttgctctctgtggcttcactcgtgctcagggagatgctgacagtggaattgatcgcttatggcagaaaaagaaagctgaaattaagcaatagatgtcatgaccacatctttctttattatgtgctgagtttaatttttgctagagatattattggatcattgtgatctatgtattgcaatatcatttttgaatttctttttggtaccttcaactgaagttgctctcttattaattgctttaaaatataagttgctctctta

SEQ ID NO: 3955 - DNA, 593 bp, Medicago truncatula
acggccggggactgcccccctctgcgtctgtctgcatctctaacctctctctcgatttttgttgtcaagggaatttctcagcaaacctcaagatgcagaacgaagaaggacaaatcaccgagctctacattcctaggaagtgttctgctacaaacagattgatcactgcgaaggatcatgcttcagttcagcttaacataggtcatttggatgagagcggtgtttacaatggtcacttctccacttttgctctctgtggcttcactcgtgctcagggagatgctgacagtggaattgatcgcctgtggcagaagaagaaaaccgaattgaagcagtagatgaaatgatcacatctttattatgtggttttttacatattgtcatgtgttgaattcaactttgttagagatattggattattctatgtaatgtgatgcctgttttgaaattcatttggtacctttaaggcattcactaagttgctttttaattaagtgcttcaaaaaagaaatagttgttttctactacatttctgaggttgatttacttattgtcatcgtttgtaattgtaagtttagtttggcatttgccaa

SEQ ID NO: 3956 - DNA, 554 bp, Momordica charantia
tcttcctcacggatagctcgtttcctctggtgcggttttctaattctaaagaagtagttgatacacatatcaagatgcagaacgaagagggaaaaatcacagagctttatattcccagaaaatgctctgcgacgaatcggcttattacttcaaaggaccatgcttctgttcagatcaacattgggcatgtggatgagaatggcatctacaccggccagttctccacttttgctctttgtggtttcattagagcccagggagatgctgacagtgccctggatcggctctggcagaagaagaaagtcgaagtgcgtcaacaatagatgatttgctgttctggttcatctctatatcaaagttttcaaagatggagatacactttcaaactcttcctctcgtgttcttcaagtattttcttttgacaatttaaactcatttatttaaatgcaaactcaactaccgctgagacagtccaagctttgatgggctatgagaaggtgaatgaaatatgatgaactctaatgttccttgaaaatttttaccagagtgaggtt

SEQ ID NO: 3957 - DNA, 590 bp, Carica papaya
cccgacgaaggcgaattagggttttttctccattcgaatcccttggggtataaaagccatattttagccttctctctagcctagcaggattttaccgctgagctacctccccgattcaagtccaccggcaactggtttttgtctcgccgggagtctcttgctagcttagttgccaagatgcagaacgaagatggtcagaacatggatctttacatccccagaaaatgttctgcaacaaatcgactcatcacggcaaaggatcacgcatctgtccagattaatgttggacatttggatgccgatggtgtctacactggacagttcaccacttttgccctctgtggatttgttcgtgcccagggtgatgctgacagtgccctcgacaggctctggcaaaagaagaaagttgaggcccgccaacaatgagtagtttccatggttggttctcttgggtttaaaagaaaggaacttgatagctgtattcatctattcccatttggtctttttgtgaactacttcaaagttggttatttgtctggaccaagttatttttcgagcttaatttgaaaacgaagttttatttggtgcgt

SEQ ID NO: 3958 - DNA, 605 bp, Prunus mume
gtagtcgattcattgaccaagatgcagaacgaagagggagttatcactgagctttacattcccaggaaatgttcggccaccaacaggttgataacttcaaaggaccacgcttccgttcagatcaacgttgggcatctggatgagaatggcatctacacaggccagttctccacttttgctctctgtggttatgtccgtgctcagggagatgccgacggtggtctggaccgactctggcagaagaagaaagctgaagttaaacaacactaggaagagaaaactgtttttctcgtgtttcttctttggacatgtgttcttgagtatggaagtgtttaactagtgaactgatacattatgttgagcaattttctctccattcgtgttgtacgttgcaactagttagcaactttttggtgttacgtcttgcattgggttttttttttttactgttattaagtagtaaaacttttacttattggagtatcgtgaaactatttccaccagcaatgcataatgatctgaaaatccatgttttagttcatcatggatgtgagacaccaaaagagaaaaaaaaaatacatggataatacatggatgaccaaggc

SEQ ID NO: 3959 - DNA, 556 bp, Salvia sclarea
ctactagaccttggctgtcactcatacccttcgttcagcttctgcaactgctagcttcaagagcttcttccgttcccatctaaatcgacgtagttttcgaagagacctgccaaaatgcagaatgaagaggggcaaaacatggacctttacatcccgcggaaatgctctgcgaccaaccgtctgattacttccaaggatcatgcttcagtgcagcttaacatcggacatgtcgacgagagaggcatttacactggccaattctctacatttgccctctgtggattcatccgtgctcagggtgatgccgacagtgctttggatcgcctctggcagaagaagaaagtagaggcccgacaacagtagaccgttatgttattgtttcgtgcttcagtctttaaccttagtgttgagtttaaaaacctactcattcttggatgtttctctttttgagaattgtgtgttagtgactttgatgttgatgcgattttgtgccattacaatcattttggacccgacttatattgcagctgcttcgcagtgagtgacaggctagtag

SEQ ID NO: 3960 - DNA, 639 bp, Fragaria vesca
gtcaaaacccctttcattgtgcaaagcagccgtagtccctctccttcgtgactgttaccaaaggtagtggaagtaatcgacgtgttgacccaagatgcagaacgaagaaggagttatcactgagctttacattcccaggaaatgctcagcgacgaacaggctaatcacctcaaaagaccatgcatctgtccagattaacatcgggcatctcgatgagaatggtttctacattggccaattctccactttcgctctctgtggttacgtccgtgctcagggagatgctgacagtggtctagaccgactctggcaaaaaaagaaagttgaagtcagacaacagtagaaggagagaattctcttttttctattgttacttctctcgaattgtatttcgctctttaggatggaattgtctaattagtgaaccaatatatgaggctaagtataactcatttttcatatgtggcgagtgttgcaaactagttggcaactttttgtgttacttaagttgggtaaaagatgagatgctactcccatgttttgaactttagttgtaagcaaagttctttaagttctgttgtttgatcacctactgtttattacaacagcacactgttgtttgaatgcacagagtagtca

SEQ ID NO: 3961 - DNA, 521 bp, Citrullus lanatus
gcaggttgttatttaggtatttaacgaaacatcgtagccaaaatgcagaacgaagagggaaagatcaccgagctttacattcctaggaagtgctctgccacaaaccgactcatcacctccaaggaccacgcctcggttcagattaacattggtcacttggatgagaatggcatctacacaggccaattctccactttcgctctctgtggtttcatccgtgctcagggagacgcggacagtgctttggataggttgtggcagaagaaaaaagcagaagttcgccaacagtagaaagtggaaattttcttctacttgaaattttatgtttctaattaagtttagttttattgcgaattatgaatgttgagagagcctagcctgcctttgcttctaaagttgtagtgtttgttggaatcttcattcggtgaagctggtttttgatcatttattagtggatttattcacatttccgtgtttcatttaatatcattttcattttctagcaccttcctccttttttt

SEQ ID NO: 3962 - DNA, 360 bp, Citrullus lanatus
catcgtagccaaaatgcagaacgaagagggaaagatcaccgagctttacattcctaggaagtgctctgccacaaaccgactcatcacctccaaggaccacgcctcggttcagattaacattggtcacttggatgagaatggcatctacacaggccaattctccactttcgctctctgtggtttcatccgtgctcagggagacgcggacagtgctttggataggttgtggcagaagaaaaaagcagaagttcgccaacagtagaaagtggaaattttcttctacttgaaattttatgtttctaattaagtttagttttattgcgaattatgaatgttgagagagcctagcctgcctttgct

SEQ ID NO: 3963 - DNA, 496 bp, Euphorbia esula
  misc_feature (105)..(105): n is a, c, g, or t
gttatttaggtatttaacgaaacatcgtagccaaaatgcagaacgaagagggaaagatcaccgagctttacattcctaggaagtgctctgccacaaaccgactcntcacctccaaggaccacgcctcggttcagattaacattggtcacttggatgagaatggcatctacacaggccaattctccactttcgctctctgtggtttcatccgtgctcagggagacgcggacagtgctttggataggttgtggcagaagaaaaaagcagaagttcgccaacatagaaagtggaaattttcttctacttgaaattttatgtttctaattaagtttagttttattgcgaattatgaatgttgagagagcctagcctgcctttgcttctaaagttgtagtgtttgttggaatcttcattcggtgaagctggtttttgatcatttattagtggatttattcacatttccgtgtttcatttaatatcattttcattttctagc

SEQ ID NO: 3964 - DNA, 544 bp, Camellia sinensis
gggggaagcttcttcttccatacggaactctcacttccgtctctctcgctcctattctcggtgctttgagctttgcaaagttgttggcttttgaaccaatcttgccaagatgcagaatgaggagggacagaacatggatctttacatccccaggaagtgttctgccacgaacaggctgatcactgctaaggatcatgcatctgtccaaattaacgttgggcatttggatgaggctggctgttatactggtcaattcaccacttttgcgctctgtggatttgttcgtgccagggagatgctgacagtgctgttgataggctctggcagaagaagaaagttgaagcccgacaacagtgattcacattgtcagttctttgtgtttctaatacgcacccttgagttttagggagtttacaaaagtgactttctatttctatggccaatgttgaagttgattagtagcatgaatgagattctttgaatgtggtgaacatattttgaatacttctaatattctcaaaccaaaatttagatcaatatcttt

SEQ ID NO: 3965 - DNA, 709 bp, Echinacea purpurea
accaccacctcgtttattgcgatttaagttagggttttacactctcgcagccgtcgacattcgcgataagcagctgctgagagatcgttcgtataactgattatcatccgatcgagttgctgttagagaaaaccaccaagatgcaaaacgaggaggggcaaaacatggatctctacatccccaggaagtgctccgctactaataggttgatcacttcaaaggatcatgcatctgttcagatcaacattggccatttggacgagtctggtcgttacactggccagttttccacttttgccctttgtggttttgtacgtgcccagggagatgccgatagtgcacttgacaggctgtggcagaagaagaaagttgaaattcgccagtagttaccttattgggttggtgtttggtttcatgatgttaaaatagcagttttcatattttaagtttcaattattagaagcatgaaggatattgcattaaatttgtgggtttaatttggatcttagtgccattcgtcgtccatgatgttggttttgaagttgttttaattgatataacatacatcctagtaaactatcaactcatggttagtgattacattaaccaccatattattctggtgttaaagtaacagtgatttcagatgaaatcactcctctaggtgcaccgggtcaaaccgagtgaagcatgcatggattgtgggttt

SEQ ID NO: 3966 - DNA, 690 bp, Panax ginseng
agtggtatcaacgcagagtacatgggggctccccagtcgtctttcgctcctctttctggtattttgtttttgggaacttcgcgactgtgggaacattttgtcaagatgcagaacgaggagggacaaaacatggacctttacatccccaggaagtgctctgccactaataggctgattacttctaaggatcatgcatctgtccagattaatgttgggcatttggatgagaggggcatctacactggtcaattttccacgtttgctctctgtggtttcatccgggcccagggggatgctgacagcgcccttgataggctctggcagaagaagaaagttgaagcccgccaatgattcgtatcaacagtttgttttgcatcaaatattccaatttagttttgtaattgagcaattactgctcggcagcaactttgttttaggtacttggatatgatcatttaatcttatttgaagataattgaccatcttgtgagcttagctgttcaccttgttgaatggttttgttactgtattcctttcaaggctctcaatgttggaaagttattcaatcagcaactagttggaatcatgtaatacgggtcgaatggtgggtcaagtttatatccaaatgcccgattcattagctttccaacgtttcgggcactcaaattcaactccggcattggaattcca

SEQ ID NO: 3967 - DNA, 485 bp, Lupinus angustifolius
accccagtgttttgttcttgtaacttgtgattcaggctttgtaggtttttacattaaccattaacatgcagaacgacgaaggacaaatcactgagctatatatccctaggaagtgctctgctacaaatagattgataacttccaaagatcatgcctctgtccaaattaacattggccatttggatgagagtggtgtttacaatggaaatttcaccacagttgccctatctggattcgttcgtgcacagggtgatgccgacagttcggtagatcgtctgtggacaaagaagaaggttgaagttaagcaacagtaggcgtgcatgatagttttgccatgtattaagatttttgagcattatgacctgcattatgctatacttgttttgaatttccaatgggttttaaggatgattttcgactgcttgatagcccacttaaaattatttggttgtttcccaatattgcaagcatagattcatgttact

SEQ ID NO: 3968 - DNA, 406 bp, Medicago truncatula
gcgaatgtgattcagaagaaaccctaaaaatgcagaacgaagaaggccaaatcaccgaactctacattcctagaaaatgttctgctacaaatcgattgattactgccaaggatcacgcttcagttcagattaacgttggtcatttggatgaaagcggtgtctacaatggtcaattttccacttttgccctttgtggcttcactcgcgcacagggagatgctgacagtggaattgatcgcttatggcagaaaaagaaagctgaaattaagcaatagatgtcatgaccacatctttctttattatgtgctgagtttaatttttgctagagatattattggatcattgtgatctatgtattgcaatatcatttttgaatttctttttggtaccttcaactgaagttgct

SEQ ID NO: 3969 - DNA, 576 bp, Malus domestica
cgaacgcagagctcttcacttccagcagctgccgccaccactccgacttccccagagggttgtgatctcgatcgccaagatgcaaaacgaggaaggaatcatcaccgagctctacatcccgaggaaatgctcggcgacgaacaggctgatcacctccaaggaccacgcttctgttcagatcaacgttgggcatttggatgagcatggcatctacaccggccaattctccaccttcgcgctgtgcggctacgtccgtgctcagggagaggccgacggtggtttggaccgactctggcagaagaagaaaactgaagttaaacaacagtagaaagagatgatgattcttgttgcttcctcgaaccttcggttcttggggatggaagtgtttaatttctgaagtaaaatgtgacgttgagagggcttttcttattcaattagtactgctttttgcaagtagttgccgatgttttggtgttgttgaattgggcttcttttgactgttaaagtagtgaaacttctactcatttgactactttaaatatattcctggtttcttgaaatgatttacactcgtaa

SEQ ID NO: 3970 - DNA, 501 bp, Persea americana
ttttgggtttttgccgcctcacagtcgccggtgtttgaatctttcttcagtgtgtcgttgaagcaaccgccaaaatgcagaatgaggagggacaaaacatggatctttacatcccaaggaaatgttctgcaacaaacaggcttatcacttcgaaggatcatgcatctgttcagataaatattggacatttggatgaaagtggcatatatactggtcacttcactacctttgccctttgtggatttgttcgagctcagggtgatgctgacggtgctgttgataggctttggcagaagaagaaagcagagctccgccagcagtagggcagtggaatttatgacaccatttttgctttatttcttgaggacatggtatttttcaggtggtgaaatgtgaccaaaacctagtattaggtgtttttgttgtatcacggatctactgacattggattagatatatcatgtgtggacgggagtttggataatacatttcatttaaact

SEQ ID NO: 3971 - DNA, 257 bp, Brassica juncea
ttcttcttcttctcagatcgatttttaaagctaagaatcatgcaaaacgaagaaggtgtcgtcactgagctatacattcccaggaaatgctcggccacgaacagattgataacctcaaaggatcatgcctctgttcagcttaacattggtcatcttgatgccgacggtatctacaccggccagttcaccactcttgctctctgcgggtttgtccgagctcagggagacgcagacagtggcgtcgacaggctctggca

SEQ ID NO: 3972 - DNA, 594 bp, Manihot esculenta
atgattcatttttcctagtcttttgccttgagcttctcgcagctgcagtcttcctcatcaggtgatttgagctaagtgtttttctgggtagccaatcaatcattcaagatgcagaacgaagagggtcagaatatggatctgtacatccccaggaaatgctctgccacaaataggctcatcacctccaaggatcatgcttctgtccagattaacattggccacttggatgccaatggccactacactggtcaattttccacttttgccctctgtggtttcgtccgagctcagggtgatgccgacagtgctttggacaggctttggcaaaagaagaaggcagagctccgccaataattgcactgggaggatgttctgttttctttcaaacgttgttagtccatgaagagtgactgcagttacctggctgttccgttttgtttctgtggttttagatttgttatcatggagttaatatctagtactgagcttgattctatgttgaaccttttttggcatgattttatataatatcgtgttgcagttctaagttttgaagatttcaatccataaatagaagtgaaatatttcagcaaa

SEQ ID NO: 3973 - DNA, 341 bp, Chelidonium majus
gagctgtttcaaaattcgccaagatgatgaacgaagaagggcaaaacatggatctttacatcccaaggaaatgttcagctacaaataggttgatcacctcgaaggaccatgcgtcggtccagcttaacattggacatgtggacgagaatggcatttacaacggtcaattctccacatttgccctatgtggtttcgtccgagctcagggagatgctgacagtgccattgatcggctctggcagaagaagaaagttgaagctcgacaacaataggccaatgtattatctttgtcatttttgcacttggcggccagtctgctttttaagagagtagaagacatg

SEQ ID NO: 3974 - DNA, 855 bp, Cicer arietinum
atttataaaaaaagtacgaatcagcccacgaagcttttgttgggccagtacagaaaaacccggcccataaagcgattttagggtttatgaatttacatagtcttccttcttttcatttggtaactgtctctcactgccactcatcccataatttgttaaggcgattcaagaaaacctaaagatgcagaacgaagatggacaaatcaccgagctctacattcctaggaaatgttctgctacaaacagattgataactgctaaggatcacgcttcagttcaaattaacattggtcatttggatgagagcggtgtctacaatggtcacttctccactttcgctctctgtggctacgttcgcgcacagggagatgccgacagtggacttgatcgcctgtggcagaaaaagaaagttgaacttaaacagtaaaggggtttaagcatgctcacatctttgttatgtgttgagttctacttttgctagaaattttggattatgtattttgatacatgttttgaatttgatttggtaacttcaactgaagctgtttttagctttaaaacatatttagttttctctaccctgcacattttacgaccatttcttttgttgcggtaatttgttgttccaatttaatagtattgttttcagttgtttttggttgaaacaccaattttcagttgtttttggttgaatcacacaatgagatttgagaactatgtagcatgtgttttttagttttacatgcaataattgttgattttcttaatgcaagatttgctcaaaaactttaaagacaatcgaatttaaattgtactttgttgaaaatttgagttgagatttcagatttaatccct

SEQ ID NO: 3975 - DNA, 670 bp, Citrus clementina
gagggcgagagtctgggtcacattcgtcattaagaaatattttgaggacattttcgtccatcaatcacagttagggttttagatacagtatttataactctccaaagccagcgcccctcagtcgccgtctctcctcgcgctcggtatttggatactagtatttccggccgtcaaaaggaagaagaaggaaaaaaaagaaaaaagaaaaaaactcagccaagatgcagaacgaggagggtcaaaacatggatctctatatccccaggaagtgttccgccacaaacaggctcatcacctccaaggatcacgccgctgtccagatcaacatcgggcacgttgatgctgatggcatttacaccggccaattctccactttcgctctctgcggcttcgtccgcgctcagggtgacggtgacagcgccattgacaggctttggcaaaagaagaaagttgaggtccgacaacaataattttccattaaagcaagttatgtgtcttctctagcagttgtcttcttctgcaagggttggaatgtgattgcaacgactcgtttgttctagttttacttatgtggaccatgttgaaatttacttctgcttttggaccatgattagcacttagtttgtttatctgtcgaacttaatatatggtcacgatttgctttacagct

SEQ ID NO: 3976 - DNA, 585 bp, Citrus clementina
acataaaattggggtctcaataaataacagagtctaggcaatagcagaagagccgctcctgcctcgtattcggtattttgatattagtatttccagccgtcaagagaaaaaaactcagtcaagatgcagaacgaggagggtcaaaatatggatctctatattcccaggaagtgttccgccacaaacaggctcatcacctccaaggatcacgccgctgtccagatcaacatcgggcaccttgatgctgatggcatttacaccggccaattctccacttttgctctctgcggcttcgtccgtgcccagggtgatggtgacagcgcccttgacaggctttggcaaaagaagaaggctgaggtccgacaacagtaatttccattaaagcgagttatgcgtcttctctagcagttttttccttctgtaagggggaatgtgattagcaacaactcatttactccagtttacttttgtggaccatgttgaaatttatttttgtttttggactatgattaatacttagtttatttatctgttggacttaatatatggtaatgatttgcttttagggctatggatgatcttgaa

SEQ ID NO: 3977 - DNA, 628 bp, Coffea canephora
ccctcacgccgcagagctaagatttcctcctcaattgcccgccaccgaaatctgccgcatttggccaggttctttgacaaactgttgcaaagatgcagaacgaggaaggacagaacatggatctttacatcccaaggaaatgttccgctacaaataggttgatcacctcaaaggatcatgcctctgttcaggtcaacgttgggcatttggatgagaggggcatctacactggcaacttctctacttttgctctctgtggttttgttcgtgcccagggtgacgctgacagtgcccttgatcgtctttggcaaaagaagaaagttgaagctcgtcaacagtagaattagactataatgagattttgcattgatctaaattcctattttgtttagcaattgagtgaattttctgttttggaactgagatcttttctgttgtgtactatgccaactttggccctagcttgaaaattttaaggctatatcttgaatgacatattcagctggtgaaccttcagtcatggtgttaaggttctggcaaatgttttgcatgagagcagctttgccatggtcaataggcaaatgaatggtagctgtgtgaaacagatgtcaaatttctatttgtagtc

SEQ ID NO: 3978 - DNA, 576 bp, Cucumis sativus
aaattttagggtttcttcaccacgcctctttctccctttcggatagttcgtttcctctgttgtgcttgcggtttcattcacttatcaagatgcagaacgaagagggtaaaatcacagagctttatattcccagaaaatgctccgcaacgaatcccctgattacttccaaggaccatgtttctgttcagatcaacattgggcatttggatgagaatggcatctacactgggcaattttctacttttgctctctgtggtttcattcgggcccagggagatgctgacagtgcactggatcgcctctggcagaagaagaaagttgaagtgcgtcaacaatagatgattgtgcagttctggttcatctctatatcaaagttttcaagtatagagatacacttttaagattttttgaaccactcgtagttaagtagtttcctttgacaatttaaactcgttagtttctttaaatgcaaactcaacttcattgagtctggacaagcaatgatgagtcaaaggaggaccaaaactaagttgaatgaaatacgttgaagttcattttccattaaaaatattgagt

SEQ ID NO: 3979 - DNA, 436 bp, Cucurbita pepo
tcgttcgaactcatctctcgcagcagttggccgactggtttttagcatcgaagccaatatgcagaacgaagaaggaaagatcactgagctctacattcctaggaaatgctctgcgacgaaccgactgatcacctctaaggaccacgcctcggttcagattaatgttggtcacttggacgagaatggcatctacacaggccaattctccaccttcgcactctgcggttacatccgtgctcagggagatgcggacagtgctatagacaggttatggcagaagaagaaagtagaagttcgccaacagtagatgtttctattttcttctactttaaatttatttccatttgagtttttagttaattgcgtattatggatgttgtgagaatgcctttggtaaccttttgatgaacgcttttataaaattctagtgtttgtt

SEQ ID NO: 3980 - DNA, 481 bp, Cucurbita pepo
ttcctcttcttcgaatttcccctcccgcagcggttggccgacaggtttgtctctagttcaaattaagtcgccgaatccaaaatgcagaacgaagaggggaagatcaccgagctttacattcctaggaagtgctctgcgacaaacagacttatcacttcaaaggaccatgcctcggttcaaattaacgtcggtcacttagatgagaatggcatctacactggccagttctccactttcgcactctgcggttacatccgtgctcagggagatgcggacagcgctttggacaggttgtggcagaagaagaaagtagaagttcgccaacagtaggaaatgcaatattttcctctacttcgagattttatatttaagatgttagctatattgcaaattatgaatgatgagagcctcccgcgtttatgttttgatgaatgcttctaaagttgtgtttgttggattattacttcagagaagttagttt

SEQ ID NO: 3981 - DNA, 469 bp, Cucurbita pepo
ttcctcttcttcgaatttcccctcccgcagcggttggccgacaggtttgtctctagttcaaattaagttgccgaatccaaaatgcagaacgaggagggaaagatcaccgagctttacattcctaggaagtgctctgcgacaaacagacttatcacttcaaaggaccatgcctcggttcaaattaacgtcggtcacttagatgagaatggcatctacactggccagttctccactttcgcactctgcggttacatccgtgctcagggagatgcggacagcgctttggacaggttgtggcagaagaagaaagtagaagttcgccaacagtaggaaatgcaatattttcctctacttcgagattttatatttaagatgttagctatattgcaaattatgaatgatgagagcctcccgcgtttatgttttgatgaatgcttctaaagttgtgtttgttggattattacttcag

SEQ ID NO: 3982 - DNA, 477 bp, Cucurbita pepo
caccgtatttcctcttcttcgaatttcccctccctcagcagttggccgacaggtttgtctctagttcaaattaagttgccgaatccaaaatgcagaacgaggagggaaagatcaccgagctttacattcctaggaagtgctctgcgacaaacagacttatcacttcaaaggaccatgcctcggttcagattaacgtcggtcacttagatgagaatggcatctacacgggccagttctccactttcgcactctgcggttacatccgtgctcagggagatgcagacagcgctttggacaggttgtggcagaagaagaaagtagaagttcgccaacagtaggaaatgcaatattttcttctacttcgagattttatatttaagatgttagctatattgcaaattatgactgatgagagcctcccgcgtttatgttttgatgaatgcttctaaagttgtgtttgttggattattacttcag

SEQ ID NO: 3983 - DNA, 477 bp, Cucurbita pepo
ttcgaactcccctctcgcagcagttggccgactggtttttagcatcgaagccaatatgcagaacgaagaaggaaagatcactgagctctacattcctaggaaatgctctgcgacgaaccgactgatcacctctaaggaccacgcctcggttcagattaatgttggtcacttggacgagaatggcatctacacaggccaattctccaccttcgcactctgcggttacatccgtgctcagggagatgcggacagtgctatagacaggttatggcagaagaagaaagtagaagttcgccaacagtagtagtttctatttttcttctacttcaaatttatttccatttgagtttttagttaattgcgtatttatggatgttgtgaggatgcctttggtaaccttttgatgaacgcttttataaaattctagtgtttgtttaaatgttcatttgatgaaacctgatttttgatcactcatta

SEQ ID NO: 3984 - DNA, 462 bp, Cucurbita pepo
ttcctcttcttcgaatttcccctcccgcagcggttggccgacaggtttgtctctagttcaaattaagttgccgaatccaaaatgcagaacgaggagggaaagatcaccgagctttacattcctaggaagtgctctgcgacaaacagacttatcacttcaaaggaccatgcctcggttcaaattaacgtcggtcacttagatgagaatggcatctacactggccagttctccactttcgcactctgcggttacatccgtgctcagggagatgcggacagcgctttggacaggttgtggcagaagaagaaagtagaagttcgccaacagtaggaaatgcaatatttccttctacttcgagatttattatttaagatgttagctatattgcaaattaatgaatgatgagagcctcccgcgtttattgttttgtatgaatgcttctaaagttgtgtttgttggatt

SEQ ID NO: 3985 - DNA, 605 bp, Cucurbita pepo
tcttcctttcggatagctcgctttcctctttgcgctgcggttttcgatttctaaagaatttgttgatccaagatgcagaacgaagagggaaagatcacagagctttatattcccagaaaatgctccgccacgaatcggctgattacttccaaggatcatgcttcggttcagataaacgttgggcatttggatgacaatggcatctacactggccagttctccacttttgctctctgtggtttcattcgggcgcagggagatgctgacagcgccctggatcggctctggcacaagaagaaagtcgaagttcatcaacaatagatgattgtgctggtccggttcatctctacatcaacgttttcaaggatagagatgcacttttaaaattttttgaacctattaaactcattagtttctttcgacaatttaaactcgttagtttctttcaattcatacttgactgcacccgagtcggtacaagctttggtgtgtgaaaagggaacaaaactaaggtgaatgagatatgttgaatttcattttccattgaaaggaattaccaaagtgagcttctatatggcctcatgttttgttgatatgataggatg

SEQ ID NO: 3986 - DNA, 543 bp, Solanum melongena
aactagggtggataaaatttgtcatctgtttaaatggagactttgcgtcgcttcttcacactttgcccccattgaagagctctcccttaatctcagtcaggttgttgaagcttgatttcagtactcaagaaccaccagccaagatgcagaacgaagagggacagaacatggatctttacatccccaggaaatgttcagctacgaataggctgattacttcaaaggatcatgcttctgttcagcttaatgttggtcatttggatgataggggcgtctacacgggcagtttcacaacctttgctctctgtggcttcatccgtgctcagggtgatgctgacagtgccctggaccgcctctggcagaagaagaaagttgaagctagacaagagtagaaaaatagatttattttgatgttactttttgaaggattctggataacatttaaatttcagttgaattagacaatgttctcccagctatattttggttcgactttctttatgttttgaatttgacctgtctttagtcatgattttgatctcg

SEQ ID NO: 3987 - DNA, 542 bp, Eschscholzia californica
gagctttattagttgattcaaacttgtttggagttctttcaaattaccaagatgcagaacgaagaaggacaaaacatggatctttacatcccaaggaaatgctctgcaacaaataggctgattacctcaaaggatcatgcttcagtccagctgaatattggacatttggatgagaatggtatctatactggccaattctccacttttgccctctgtgggttcgtccgtgcccagggagatgctgacagtgcaattgataggttgtggcagaagcagaaagcagaagttggacaacagtaagttttatatagatggtcttcgacacatctatgggttttgcaatttgtagcaagtttacatttgaaatgtagaagacataagcaatgaaaagattctgatcttgttagggtttcataattaagcaatgacagttaaaacatctatgtgtttgatcagattttagttcatttcttgaagttttgaagaattacatttggtagttaaggttctaaaaaaaagtacgttagggaggacaaggacac

SEQ ID NO: 3988 - DNA, 529 bp, Eschscholzia californica
ttcaagtttcgccggtttcttctatctaaagttgcagacttcgtctttcatctgttgatttatactatctctcgtaagctagggtttttcaaagaatcatcaagatgcagaacgaagaaggacaaaacatggatctttacatcccaaggaaatgttcagccacaaacaggctgattacttcaaaagatcatgcttctgttcaactcaatatcggacatttggatgaaaatggcatctacactggcagtttctccacctttgccctttgtggtttcgttcgtgctcagggagatgctgacagtgcaattgacaggctctggcagaagacaaaagtcgaagttcgacaacagtaggtagaagtcattgatatggtttctctcctgactgcaagtctattttgtctgcgttttctatgagtaggaattatatgatgttatgaagttcttatatttttctccggaaaggttaaatgacaatgaatttaatctgagacacgcaacagggataggaaggcgacacagggataggc

SEQ ID NO: 3989 - DNA, 518 bp, Eschscholzia californica
tttttctctgcttgattgtgttgttcctgaagacttaaaaaggaaaccttaaagatgcagaatgaagaagggcaaaatatggatctttacattccaaggaaatgttcggcaacgaacaggttgattacctctaaggatcatgcttcagttcagcttaatatcggacatttggatgagaatggaatttataccggcaccttctccacttttgctctttgcggtttcgtccgtgcccagggagatgctgacagcgcaattgatcggctctggcagaagacgaaagtcgaagttcaacaacagtaggtagagatgtaaatcatctctatgtgttaactcatcaagccttcatctagggaaaagtagacattgtcattattaatgttaaaacgtcaatgagttttggttaattttgagagttttcatcattcatgaattatgaatattaatttgactctagtctatctcaattcctattctagattttcgacctcttttggataattggtgtgttcctaatg

SEQ ID NO: 3990 - DNA, 457 bp, Eschscholzia californica
gcagacttcgtctttcatctgttgatttatactctctctcgtaagctagggtttttcaaagaatcatcaagatgcagaacgaagaaggacaaaacatggatctttacatcccaaggaaatgttcagccacaaacaggttgattacttcaaaagatcatgcttctgttcaactcaatatcggacatttggatgaaaatggcatctacactggcagtttctccacctttgccctttgtggtttcgttcgtgctcagggagatgctgacagtgcaattgacaggctctggcagaagacgaaagtcgaagttcgacaacagtaggtagaagtcatcgctatggtttctctcctcactgcaagtctattttgtctgcgttttctatgagtaggaattatatgatgttatgaagttcttatatttttctccggaaaggttaaatgacaatgaatttaatcaat

SEQ ID NO: 3991 - DNA, 508 bp, Eschscholzia californica
tttttctctgcttgattgtgttgttcctgaagacttaaaaaaggaaaccttaaaagatgcagaatgaagaagggcaaaatatggatctttacattccaaggaaatgttccgcaacgaacaggttgattacctctaaggatcatgcttcagttcagcttaatatcggacatttggatgagaatggaatctataccggcaccttctccacttttgctctctgcggtttcgtccgtgcccagggagatgctgacagcgcaattgatcggctctggcagaagacgaaagtcgaagttcaacaacagtaggtagagatgtaaatcatctctatgtgttaactcatcaagccttcatctggggaaaagtagacattgtcattaatgttaaaacgtcaatgagttttggttcattttgagagttttcatcattcatgaatattaatttgacacttatctcaattcctattctagattttcgacctctttgtggataattggtgtgttcctaatgt

SEQ ID NO: 3992 - DNA, 427 bp, Euphorbia peplus
tccgagttactaaccagatactcaagatgcagaacgaagagggacagaatatggatctctacatccccaggaaatgctcggccacaaacaggctaatcacttcgaaagatcatgcgtctgtgcagatgaatattgggcatttggatgccaatggccactacactggtcaattctctacttttgctctctgcggttttgtccgtgctcagggtgatgctgacagtgcccttgacaggctttggcaaaagaagaagactgaacttcgccaatgatttcccgtccttgtttttgaacactcttagaatgtttagagtgacgacttttgttaatttggtttaagctatatgttggtgaggatgacttggtacttatcacgatttattatgtccaatttcttgatggtacggtttctttttatattaagctt

SEQ ID NO: 3993 - DNA, 422 bp, Euphorbia peplus
cgcttcctccggtgatttgaactaagaattctctgaattagtcaagatgcagaacgaagagggacagaatatggatctctacatcccgaggaaatgctcggccactaacaggctcatcacctccaaagatcatgcctctgtgcagatcaatattgggcatttagatgccaatggcctctacactggtcaattctctacttttgctctctgcggttttgtccgtgctcagggtgatgctgacagtgccctggacaggctttggcaaaagaagaagaccgaacttcgtcaatgattgccctttgttttttttaacagtgatagaatgtggagagtgagaatttttgttaatttggtttaagctatttgttagcgtggatgacttattatatgtgtacttagcatgatttatgttgaacttcttg

SEQ ID NO: 3994 - DNA, 505 bp, Flaveria ramosissima
cagccgtcgacctttgcaacacgcagcagcagaaagagacagattcaacaaacatctaagttttctgatcgagttactgctccagaaattgtcaagatgcagaatgaggagggacaaaacatggatctctacatccccagaaagtgctctgctactaacaggttgatcacttcaaaggatcatgcatctgttcagattaacattggtcatttggacgagtctggccgttacactagccagttttccacttttgccctctgtggttttgtacgagcccagggagatgctgatagtgcacttgacaggctgtggcagaagaagaaagtcgaagctcgccaatagtcactttacctgtttagcatttgcttccatgatgttaaacaataatttcatgtcataggtttcatttactagaagcatgagggatattgcatcaagtttgttggctttatttggatcgtatgttggcaatgaaacatatattcagtcagattttaaagtaact

SEQ ID NO: 3995 - DNA, 410 bp, Flaveria ramosissima
atgcagaatgaggagggacaaagcatggatctctacatccctagaaagtgctctgctactaacaggttgatcacttcaaaggatcatgcatctgttcagattaacgtcggccatttggatgagtctggccgttacactggccagttttccacttttgccctctgcggttttgtacgagcccagggtgatgctgacagtgcacttgacaggctgtggcagaagaagaaagtcgaagctcgccaatagttactttacctgtttagcatttgctcccatgatgttaaacaacaattttcatgtcttgattttcatttactataagcctgagggatattgcatcaagtttgttggtttaatttggatcttattttggccatgaaacatacattgagtcagaatttaattatatt

SEQ ID NO: 3996 - DNA, 621 bp, Linum usitatissimum
agccgtcgttcagttttctagctctctgtactcacaaactcggcgaattttgagctctgaaagttcttgttcccggattaatcaaccaagatgcagaacgaagaaggccagaacgtggatctctacatcccgaggaaatgctcggccaccaacaggctgattacctccaaggatcatgcttccgtccagattaacgtcggtcatttggatgctaacggccgttacactggccagttcaccacttttgctctctgtggattcgtccgtgctcagggtgatggagacagtggactcgacaggctgtggcaaaagaagaaggcagaacttcgccagtgatctgtctgcctgcagcaagaatccaaacatgttttagtctgaggaacagaggtggtgtttgtagtatgaacacacctgggattcaacttttttttgtcttggatttatgttcagattcaaccgttttccttccaacatatgacaaatcattttcgctaccttatgaatggcaacaaacgtctgaattcctagcacgtctgtaatgttacatttcttctccgttacaaactcgaaatgccaaccatttactcattttaatagactctttactgctcctttcccccc

SEQ ID NO: 3997 - DNA, 586 bp, Linum usitatissimum
ggcgggaggatatataatggaagcgaaatgccgctcatgttcgttccagctcaaaacccagccgtcttccagttgtttcatcgctctcggcactcgcaaactcggcgaattctgagctctgaaagttctcgttcccggattaatcagccaagatgcagaacgaagaaggtcagaacgtggatctctacatcccgaggaaatgctcggccaccaacaggctgattacctccaaggatcacgcttccgtccagattaacgtcggtcatttggatgctaacggccgttacactggccagttcactacttttgctctctgtggattcgtccgtgctcagggtgatggagacagtggactcgacaggctgtggcaaaagaaaaaggcagagcttcgccagtgatctgtttatctgcagcaagaatccaaccatgttttagtcgtcggaccagcgagatggtgtttgtagtatgaacacacttgagattcaacttttttgttatggattttatgttcagaatcaatcgttttcctcctaacatatgacaaatcatttcgctacctcatgaatggcaacacacgtttggattc

SEQ ID NO: 3998 - DNA, 725 bp, Vitis vinifera
ggacaaccctaaccctccatttgcggttgcagtctctcctcttcctggtattttgagatccgtatattgggagcatttaaacaaccagccaagatgcagaacgaagagggacagaacatggatctttacatccctaggaagtgctctgccactaataggctcatcacttcaaaggatcatgcctcagtccagattaacattgggcatttagatgagagtggaacttacaccggtcaatttactacctttgctctttgcggctttgtccgagctcagggtgatgcagacagtgcccttgataggctctggcaaaagaagaaagccgaagtccggcaacagtagttccagtctctttaaacattttccttcatgatagaaggtggggagataacatggctgcaatagcaatttctatggactttgttttgcaatggctttttttcattaccaagtactattgttgaagttgaatattggctttgttggttgattctagcatattctgtgaactgagttcatggtcattattggatctatgtaaccttgcactggttagggttttttgttcttcagtgggcatttaaatgcaacctaaaagttcctaagattttgaaattgaagagtattcattagttatatcattatacccagaacttagtttgcagacgcctcgtcagatttgcatccattcctggaagcacataaaaatataaccattttcagtc

SEQ ID NO: 3999 - DNA, 590 bp, Jatropha curcas
cggccgcctaaactagtgatcccgggctgcaggagtcgtcgtctcttctggtatttgagttaagtgttttcggggaacgaaacaatcttccaagatgcagaacgacgagggtcagaacatggatctttatatcccaaggaaatgctctgccacaaacaggctaatcacttccaaagatcatgcttctgttcagatcaacattggtcacttagatgccaatggtaactacaccggtcaatttaccacttttgctctctgtggtttcgtccgagcccagggtgacgctgacagtgcccttgacaggctttggctgaagaagaaggttgaacttcgccaacaatagatttagttggagtatgttatttttctttggacaatgtttgtcaaatgagagaatgttaacattttgatacctcagttgctgctttggttgctttagttatttgttagcgaggacatattaatatctagtacttgcatgattactttaatattgcattttaagttttaaagctgtctcgataatttgatatgctatattttactgtccactttctaccataggtcagccttcatgcaatcatctgagt

SEQ ID NO: 4000 - DNA, 349 bp, Momordica charantia
actcctcccaacatccctctctcagcagtcggccgattggtttttctccagatctttgacgaacttagtcgccgcagccaaaatgcagaacgaagagggaaagatcacggagctttacattcctaggaagtgttccgctacaaatcggctcatcacttccaaggaccacgcctcggttcagatcaacatcggtcacgtcgatgagaatggcatctatacaggccaattctccactttcgcactttgtggtttcatccgtgctcagggagatgccgacagtgctttggacaggctgtggcagaagaagaaagccgaagttcgtcaacagtagaagaatccaaaatttctt

SEQ ID NO: 4001 - DNA, 544 bp, Nuphar advena
  misc_feature (492)..(493): n is a, c, g, or t
  misc_feature (495)..(497): n is a, c, g, or t
  misc_feature (503)..(503): n is a, c, g, or t
  misc_feature (506)..(507): n is a, c, g, or t
  misc_feature (509)..(511): n is a, c, g, or t
tctctctctctctctctgtagtgcttgtactgctggttctgtattctttgaaaaaaaggtagattgaacttgcgtagcacttcttaaatcactgacaagatgcagaatgaagagggtcaatacatggatctttacatcccaaggaaatgttctgcaacgaatcgtctcattacttcaaaggatcatgcctctgttcagataaaccttggacatctggatgagaatggcatttacactggtcaattcaccacttttgcgctctgtggtttcgtccgagcacagggggatgcagacagtgctttggacaggttgtggcaaaagaagaaggcagaaattcgacagtaggagaaattttctcaagatttttgcctgttgagagcttaaagtttcttgctgtcttggattttgtctggcttctatttcgtttcaagagtttagacgtttatctggtgtattccatatctatttaaacatcatttggttttcgtaaannannncatttnaanntnnncttcagctcctcagcttgaatggaggccacttt

SEQ ID NO: 4002 - DNA, 669 bp, Citrus sinensis
gagggcgagagtctgggtcacattcgtcattaagaaatattttgaggacattttcgtccatcaatcacagttagggttttagatacagtatttataactctccaaagacagcgcccagcagtcgccgtctctcctcgcgctcggtatttggatactagtatttccggccgtcaaaaggaagaagaaggaaaaaaagaaaaaagaaaaaaactcagccaagatgcagaacgaggagggtcaaaacatggatctctatatccccaggaagtgttccgccacaaacaggctcatcacctccaaggatcacgccgctgtccagatcaacatcgggcacgttgatgctgatggcatttacaccggccaattctccactttcgctctctgcggcttcgtccgcgctcagggtgacggtgacagcgccattgacaggctttggcaaaagaagaaagttgaggtccgacaacaataattttccattaaagcaagttatgtgtcttctctagcagttgtcttcttctgtaagggttggaatgtgattgcaacgattcgtttgttctagttttacttatgtggaccatgttgaaatttacttctgcttttggaccatgattagcacttagtttgtttatctgtcgaacttaatatatggtcatgatttgctttacagct

SEQ ID NO: 4003 - DNA, 503 bp, Capsicum annuum
ccctcgctcagcttgattttagtgctcaagaacatcagccaagatgcagaacgaggagggacaaaacatggatctttacatccccaggaaatgttctgctaccaataggctcatcacttcaaaggatcatgcctctgttcagctcaatgttggtcatttggatgataggggcgtgtacacaggcactttcactacctttgctctctgtggtttcatccgtgctcagggtgatgctgacagcgcactggaccgcctctggcagaagaagaaagttgaagctagacaagagtagaaaaatagatttgcattttgatattactttatgatgaaggattctcgataacatttaaatttcagccgagttggacaatgttctcttgatattactttatgatgaaggattctcgataacatttaaatttcagccgagttagacaatgttctcccagctatattttggatagattatcttcatctttggatattcaatttgcccctcgtgc

SEQ ID NO: 4004 - DNA, 588 bp, Solanum tuberosum
cacactttacctccattgtagacctctcccttaatctcactcaggttgttagagctttatttcggtacttaagagccaccagccaagatgcagaacgatgagggacaaaacatggatctttacatccccaggaaatgttctgctacaaataggctgatcacttcaaaggaccatgcttctgttcaactcaatgttggtcatttggatgataggggtatctacactgggagtttcacaacttttgctctctgtggtttcatccgtgctcagggtgatgctgacagcgcaatggaccgtctctggcagaagaagaaagttgaagctagacaagagtagaaaaaatagatttgaattttgatattactttatgatgaaggattctggataacatttaaatttcagttgagttagacaatgttctcctagctatatgttggattcatctttggatatttgacttgcccctttgcttgtgattttgatttcattttctgattagttttttgatgactgtggttagtttcctttgcactttttcatagttttatttcccaacagtactgagggggtttgaatcataatctgatt

SEQ ID NO: 4005 - DNA, 724 bp, Pseudotsuga menziesii
cccttcgcccttcattagcacgaagaaggctcgagcttgtgtatcaggactctcataatctggtcggcagagagaagtagtagattgttgaaggggtcattcattcgccatcaacatgcagaacgaagaaggacagaatatcgatctctacattccaagaaaatgctctgcaaccaatcgactgataacttcaaaggaccatgcatcggtgcaactaaatattgggcacgtggacgagaacggaatatacactggccagttcacaacttttgctctctccggctttgtccgagcacagggggatgctgacagtgcgattgataggctctggcaaaagaagaaaacagaacttggtcagtagtttttgcaggagggcgagtatctaggatatgaatctgaaaagaatgtgtaaactttgaattgctccatgacaatatacatttatggagacaattggggttctgtttaatagttaaatatgatttcctaggactttaattttgctcaacttgaatttttgatttaacattgctgaacttatctcaatgtagagcatgccttttattcgttggtactgtaatgaaaagtcatcttattgattatataatagagtagctgtgagagattaaataagacacgtatgatgaagatttctatagaaggatgtctttccaagcatgattttttcctagataaaacattgcaatgacttggtcactaattc

SEQ ID NO: 4006 - DNA, 608 bp, Solanum phureja
ggaagctttgcgtcgcttcttcacactttacctccattgtagacctctcccttaatctcactcaggttgttagagctttatttcggtacttaagagccaccagccaagatgcagaacgatgagggacaaaacatggatctttacatccccaggaaatgttctgctacaaataggctgatcacttcaaaggaccatgcttctgttcaactcaatgttggtcatttggatgataggggtatctacactgggagtttcacaacttttgctctctgtggtttcatccgtgctcagggtgatgctgacagcgcaatggaccgtctctggcagaagaagaaagttgaagctagacaagagtagaaaaaatagatttgaattttgatattactttatgatgaaggattctggataacatttaaatttcagttgtgttagacaatgttctcctagctatatgttggattcatctttggatatttgacttgcccctttgcttgtgattttgatttcattttctgattagttttttgatgactctggttagtttcctttgcactttttcatagttttatttcccaacagtactgaggggggttgaatcataatctgat

SEQ ID NO: 4007 - DNA, 513 bp, Euphorbia esula
  misc_feature (80)..(80): n is a, c, g, or t
  misc_feature (116)..(116): n is a, c, g, or t
gcttcctctggtgatttgagctaagagttctccgagttactaaccagatactcaagatgcagaacgaagagggacagaanatggatctctacatccccaggaaatgctcggccacnaacaggctaatcacctcgaaagatcatgcgtctgtgcagatgaatattgggcatttggatgccaatggccactacactggtcaattctctacttttgctctctgcggttttgtccgtgctcagggtgatgctgacagtgcccttgacaggctttggcaaaagaagaagactgaactccgccaatgatttcccatccttgtttttgaacactctttgaatgtttagagtgacaaatttttgttaattttgtttaaactatgttggccgggatgacttagtacttagcatgatttatgttaaacttcttgatggtagggtttctttttattaatcatgttatgtgttgttaacttaagttcaactagtattaatgaaaatgtcacaaattgaatggggc

SEQ ID NO: 4008 - DNA, 483 bp, Euphorbia esula
  misc_feature (7)..(8): n is a, c, g, or t
ctcacannctatcttcgccgtcgcttcctccggtgatttgaactaagaattctctgaattagtcaagatgcagaacgaagagggacagaatatggatctctacatcccgaggaaatgctcggccactaacaggctcatcacctccaaagatcatgcctctgtgcagatcaatattgggcatttagatgccaatggcctctacactggtcaattctctacttttgctctctgcggttttgtccgtgctcagggtgatgctgacagtgccctggacaggctttggcaaaagaagaagaccgaacttcgtcaatgattgccctttgttttttttaacagtgatagaatgtggagagtgagaatttttgttaatttggtttaagctatttgttagcgtggatgacttattatatgtgtacttagcatgatttatgttgaacttcttggtggtacggtttctttttatattaaggttagttctccatt

SEQ ID NO: 4009 - DNA, 515 bp, Helianthus annuus
agccgtcgacattcgcaacaagcaggctgctgagagatcgttcgtatcacttataatcaaccgatcaagttgctgctactagtataaattgccaagatgcaaaacgaggaggggcaaaacatggatctctacatccccaggaagtgctctgccactaataggttgatcacttcaaaagatcatgcatctgttcagattaacgttggccacttggatgagtccggtctttacactggccagttctctacttttgccctctgtggttttgtacgagcccagggagacgctgatagtgcacttgaccggctgtggcagaagaagaaagtcgaagcacgccaatagttactttaccagtttggtgtttggtttcatgacaatttgtatgtctcaaatttcagttattacatcacgtttcttgtttaacgtctatcttatttgggagtcatgaggcgtacagcatccaagtaccatctcatcattggtgttgaatgtttttatgatgactgatctttctg

SEQ ID NO: 4010 - DNA, 517 bp, Helianthus annuus
cagacgcctcatctcaccgcagctccaacgccgtcgtttaaggtttagcctgtgttcaaagaccttgcaaacatgcagaacgaggaggggcaaaacatggatctttatatccccaggaagtgctcggccaccaataggctgatcacttcaaaggatcatgcttcagtccaaattaatgttggtcatttggacgaaaatggtctatataccggtcaattttccacctttgcactttgcggttttgtgagagctcagggagatgctgacagtgcacttgataggctgtggcaaaagaagaaagttgaagcccgtcaatagtttcttcttcggattcaattcaaggcgttgcagtctcagactatgtcaaattttccttagtgaagtttcttgttttttgtctaagacatggtatttttaaagaaatactgatgcatcagttttgatgttaatgtttggtatgtttttactatgttttgccagactttaaagcctactcatcttaatgctgtgcttttat

SEQ ID NO: 4011 - DNA, 679 bp, Helianthus annuus
gaattgagttagggttttacactctttaacagccgtcgacattcccaacaagcaggctgctgagagatcgttcgtatcacttataatcatccgatcaagttgctgctagtataaattgccaagatgcaaaacgaggaggggcaaaacatggatctctacatccccaggaagtgctctgctactaataggttgatcacttcaaaagatcatgcatctgttcagattaacgttggccacttggatgagtccggtctttacactggccagttctctacttttgccctctgtggttttgtacgagcccagggagacgctgatagtgcacttgaccggctgtggcagaagaagaaagtcgaagcacgccaatagttactataccagtttggtgtttggtttcatgataatttgtatgtctcaaatttcagttattacatcacgtttcttgtttaacgtctatcttgtttgggagtcatgaggcgtacagcatcctagtaccatctcatcattagtgtcgactgttttttatgatgactgctctttctgcctttggtattctttgattgtgtgatgcttgagactttgtagtagcctacaaatacttcatggctgttcatcatgcaggtcgggtttgtatgaaggtttggccatatgaacttgacaattttgcgggtttatttat

SEQ ID NO: 4012 - DNA, 610 bp, Camellia sinensis
gccttctcattttctaagacagtcgcttccatctcccgtctctgtttttgaatcttctatagggcttttaaacctacatcaaagatgcagaacgaaaagggacaaaacacggacctttacatccctaggaaatgttccgccacaaataggttaattactgcaaaggaccatgcatctgtacagattaatgttggacatttggatgagaatggcatctatactggtcaatttaccacctttgctctttgtggttttgtccgtgcccagggagatgctgacagtgcagttgatcgtctctggcagaagaaaaaaactgaacttcgacaacaatagagaagtcagagaacggtgactgcagatggcctttttgccgtttgaaaaaattttcttattttgttattagagaactggagtctctgtagtataatggcttatgtttgatgctttatctattttgtgattgggtgtgttggtgccagtacttatgtggatttattactgtggtctaatcttttaacgtgagacattattattttatggtggatgatgatttctttgtttttgttaccaatgaatatattgataccatgtcggccgcctcggcctatgt

SEQ ID NO: 4013 - DNA, 471 bp, Trigonella foenum-graecum
gcaaaggcgattcacagaacaaaccctaaaaatgcagaacgaagaaggtcaaattacggaactctacattcctagaaaatgttctgctacaaatcgattgattacagccaaggatcatgcttcggttcagattaacatcggtcatttggatgaaagcggtgtctacaatggtcatttctccacttttgccctttgcggcttcactcgcgcacagggagatgctgacagtggaattgatcgcttatggcaaaaaaagaaagctgagattaaacaataatgtcaaccaagtcttttcatattataggttgtgtttgagtttaatttttgcatagatatgggataattgcataattgcaatctacgtattgcattgcaatattttttgaacctcttttttagcccttcaactaagttgctaatgcaatactttttgaacctctttttagcccttcaactaagttgctttctatt

SEQ ID NO: 4014 - DNA, 545 bp, Valeriana officinalis
tacctttagctttcttctcgcaaatcctcgacaggtgtttggatatctttgaacagaaaccaagatgcagaacgatgaaggacagatgatggatctttacatccctaggaagtgctctgcaacaaacaggctgatcacttcaaaggaccatgcttctgttcagctcaacgttggacatttggatgaggctggtcgttacactggccagtttactacttttgctctatgtgggttcgttcgtgcccagggagatgctgacagcgctcttgatcggctctggcagaagaagaaagttgaaattcagcaataagctggtttcatgattcactgttttgtttaagtagcttataatagaaagctgaatttggtgatggagagatttctgttttcagtttatttgttttaatttgattcagagtttttgtggagtttgatgtttaatcatgtatcacattagataattatcattttggaaactttttcagcaaaaccttgaattcaaagttttatgtgctgctaaatatttaaaaagtatttttaatgac

SEQ ID NO: 4015 - DNA, 635 bp, Juglans hindsii x Juglans regia
cggccgggggcccgcagtcgtactcgtttcttttgccgtttgctcatctcttcttcgctgatcgggaagcgtttgacgaagcagtaaacagaagccaagatgcagaacgaagagggggttataaccgagctttacattcccaggaaatgttcggctacaaacagattgattacatcaaaggaccatgcttcggttcagatcaatgttgggcatttggatgagaatggcgtgtacaatggccatttctccacctttgctctgtgtggattcgtccgtgctcagggagatgctgacagtgcgctggatcgtctctggcagaaaaagaaagtcgaagctcgacaacagtagagcaagggagagaatataattgatttctgtttttgaagttctgcttgagggtagaaaaatgtggttgaaggattttgactccttttagtcagttattatggaatattgcaacttctttgaactgccatgaatcaaaatgttttatgttaccgtgctaaggtactcaatatcagattgctttagttattgagcattgctattcaaattatatcttcttgttgtggtcagtgaagttgtgctctgtggatttttaggactaattaatgcatcttttaatcttctatatg

SEQ ID NO: 4016 - DNA, 613 bp, Juglans hindsii x Juglans regia
cgcagtcgtctcttttgccgtttgttcatctcttcttcgctgatcggtaagcgtttgacgaagcagtaaacagaagccaagatgcagaacgaagagggggttataaccgagctttacattcccaggaaatgttcggctacaaacagattgattacatcaaaggaccatgcttcggttcagatcaacgttgggcatttggatgagaatggcgtgtacaatggccatttctccacctttgctctgtgtggattcgtccgtgctcagggagatgctgacagtgcgctggatcgtctctggcagaaaaagaaagtcgaagctcgacaacagtagagcaagggagagaatataattgatttctgtttttgaagttctgcttgagggtagaaaattgtggttgaaggattctgactccttttcgtcagttattatggaatattgcaacctctttgaactgccatgaatcaaaatgttttatgttactgtgctaaggtactcaatatcagattgttttagttattgagcattgctatattatatcttcttgttgtggtcagtgaagttgtgctttgtggatttttaggactaattaatgcatcttttaatcttctatatg

SEQ ID NO: 4017 - DNA, 936 bp, Zamia vazquezii
  misc_feature (364)..(364): n is a, c, g, or t
  misc_feature (442)..(442): n is a, c, g, or t
tactctctcgcaaccctaacgtggaagcttcaggtttctgtatttgtctgggctaccaaaggaaaggaaaggaaagcaaggaaggaatttggcattgtcatatttgaggaagggaattggatagggaaatcggccggtcatcatgcaaaacgaagagggacagaacgttgatctgtacatccccagaaaatgctcggccaccaatcgcctgataacctcgaaggaccatgggtcagtgcaaataaacattggacacctcgacgagaacgggatatacacgggacagttcaccactttcgctctctgtggatttgttcgagcacagggagatgctgatagtgctattgataggctatggcaaaanaagaaagcagaacttggtcaataggatttggaaagtgaggagagcacagcattgttttatttgaatagaagaatgcanacttaaaaacgttgtagtatgctattaaaattttggaatggttatggaggtctaactatggtaatatttagggacacatttgtaagagagatgttgaacttaacatcattaagcttgtgtttttggtattgaacattccatggttgattggtatgttattgtctacgttataatcaaaatgtgatgacaaagtatgcattgtgttgccttttttaagttagccatgaagaagaaagcttatagaataagataagcttataggataagatataatcaaagtttcatatttaccttgctggtttgtacattagaaatgaggcttcattttgttcttttgtaatggtgtggcgtttcaattgttaacaaaaggtggtggtttccattgtatttggcctccttttctctcatgttagccttttggagttgaaaggccttcaatgctacttagtttgtatatctattttttacttattaaatatcaggattttgtgtta

SEQ ID NO: 4018 - DNA, 561 bp, Ocimum basilicum
aagccgctccatcgttcagctgctccaatcttctcccatcttcttccacagtttctccggagtgcttgaaatacccaacaagatgcagaacgaagaggggcaaaacatggatctctatatcccgaggaagtgctcggccactaacaggctgatcacttccaaggatcacgcttctgtccagatcaacattggtcatctggatgagactggccgatacaccggccagttctccacctttgctctctgtggattcattcgtgctcagggtgatgcggacagtgcactcgataggctgtggcagaaaaagaaagtcgaaacccgacaacagtgaacgggcttcgtccatggtatttgtgtcttttaagtattttgagattagattatgatgctgtttgaggaagaaaaatatatgttactattgacatttaaaggagtgtgtttgaagttggactactatcggcagattactagcttcctttaactctgtaccttctattcctttgattttgaagaacaacttttgttcaacctcgctcaacgaagatttttacgcagttgtgt

SEQ ID NO: 4019 - DNA, 549 bp, Phaseolus vulgaris
ctctaccgcactccttcgttcatcgtcttctctggtttatagatttttgtgaaggaattttgcaacgctcaaccaaagatgcagaacgaggaaggacagatcactgagctttacatccctaggaagtgttccgctacaaacagattgatcaccgccaaagatcatgcttcggttcagattaacattgggcatgtggatgagaatggtatctacaatggtcaattctccacctttgccctttgtggatacatccgcgctcagggtgatgctgacagtgccctagatcgcctgtggcagaagaagaaagctgaagttaagcaacagtagaccccatgataatttgttactttttcatgtgttaatttctacccttactagaaatatttgaggattatgattgtcgttttgagcaaatacttctgaatttttgttggtacttggtacctcttctaaggttgtttttcttacaatgctttgattagtattcggttgtcttatattttaatattagggtgtatgttacctagttttctaaagtttacttcacaa

SEQ ID NO: 4020 - DNA, 674 bp, Echinacea purpurea
cttgcaaccagacgcctaatctcgccgcacctctccgtcggagtaaaccgctgtcgtcgaagattagctggtgttcaaagaccttgcaaacatgcagaatgaggagggacaaaacatggatctctatatcccccggaagtgctctgctactaataggttgatcacttcaaaggatcatgcatctgttcagattaacgttggccatttagatgagtcgggtcgttacactggccagttctctacgtttgctctctgtggttttgtaagagcccagggagatgctgatagtgcacttgatcgactctggcagaagaagaaagtcgaagtacgccaatagttgctttacccagtttactgtttagtttcatgacgattttcttgtctcaaatttcaattatcacatcaagtggtctagtttaacttttaatttatttgggagccatgaagcatacagtatccaagtatccatctcatcgttgacgttaaccggtttttattatgatgactgattttttgcctttggtattctttgattgtgtgctgtttgagactttgtagtactagtataaaaacgtcatagctgtccatcatgcaggttgggttcgaatgaaggttcgttcatatgaacttggcaattttgtgggtttattatgttcacggatatatgccttttt

SEQ ID NO: 4021 - DNA, 588 bp, Echinacea purpurea
tataaataatcataataaaatgacacaattactttttgtattcttgtaaaacgaattagggttttacactcgtagccgccgtcgacattcgcaatacgcagcagctttgagaacttcatatcacttccgattttgttgctgcttcaagaaataccaaccatgcagaatgaggagggacaaaacatggatctttacatcccccggaagtgctctgctactaataggttgatcacttcaaaggatcatgcatctgttcagattaatgttggccatttagatgagtcgggtcgttacactggccagttctctacgtttgctctctgtggttttgtaagagcccagggagatgctgatagtgcacttgatcgactctggcagaagaagaaagtcgaagtacgccaatagttgctttacccagttcactgtttagtttcatgacgattttcttgtctcaaatttcaattatcacatcaagtggtctagtttaacttttaatttatttgggagccatgaagcatacagtatccaagtatccatctcatcgttgacattaatcggtttttattatgatgactgattttttgcctc

SEQ ID NO: 4022 - DNA, 582 bp, Vitis vinifera
ctcgtccttcacgtttcctgatttcggtgtagtcgcaaacacaaggcaaaatgcagaacgaagagggtcaaaacatggatctgtacatccccaggaaatgttctgccacaaataggctaattacttcaaaggaccatgcatctgttcagataaacatagggcatgtggacgaggacggagtgttcactggtcaattctccaccttcgctctatgtggttttgtccgtgctcagggagatgccgacagcgctgtggatcggctctggcagaagaagaaggcggaagtccgacagcattagaaaaagataatcaagctttttatccagtaaaaatgttaaatatgtagttgcgtgtagtagggaggtaggcgtgtgcaaggatttttgactcctctattactagtcatgaatttagggtttttccccatttgagtgttagaatatctatgttaccaagcaatattaactctacttcagttgcttacatattgctttaaacttggaaattttcaaacaaccttgatgagggatgtttgtttagggcttatgtttatcaagtaagacaaactctaggttgttccaa

SEQ ID NO: 4023 - DNA, 627 bp, Vitis vinifera
attttataactggactagggttttgagccacctatatataatgccacgggacaaccctaaccctccatttgcggttgcagtctctcttctcttcctggtattttgagatccgtatattgggagcatttaaacaaccagccaagatgcagaacgaagagggacagaacatggatctttacatccctaggaagtgctctgccactaataggctcatcacttcaaaggatcatgcctcagtccagattaacgttgggcatttagatgagagtggaacttacaccggtcaatttactacctttgctctttgcggctttgtccgagctcagggtgatgcagacagtgcccttgataggctctggcaaaagaagaaagccgaagtccggcaacagtagttccagtctctttaaacattttccttcatgatagaaggtggggagataacatggctgcaatagcaatttctatggactttgttttgcaatggctttttttcattaccaagtactattgttgaagttgaatattggctttgttggttgattctagcatattctgtgaactgagttcatggtcattattggatctatgtaaccttgcactggttagggttttttgttcttcagtggg

SEQ ID NO: 4024 - DNA, 514 bp, Glycine max
ctctaccgcattagcactcgtctttggttctggtttatagatctctgtgaagtcgctttataacactcaacctaagatgcagaacgaggaaggacagatcaccgagctttacattcctaggaagtgctctgccacaaaccgattgattaccgctaaggaccatgcttcggttcaggttaacattgggcatgtggatgagaatggcgtctacaatggccatttctccacttttgctctctgcggcttcatacgtgctcagggtgatgctgacagtgccctagatcgcttgtggcagaagaagaaagttgaagttaagcaacagtagacacccatgatagtttgttactttgctatgtattaatttctacgcttgctagagatatttgagtactatgattgtcgtcttgagcaaatactcattctaaattttcgttggtatttggtaccgccagctaaatttgcttttttgacagtttgccagtgcgttgataaatatttggttgtcttatatttc

SEQ ID NO: 4025 - DNA, 535 bp, Glycine max
ctctacggcactcgttttcgttctcgttctggtttatagatctttgcgaaggaggtttacagcgctcaaccaaagatgcagaacgaggaaggacagatcactgagctttacattcctaggaagtgctccgccacaaacagattgattaccgctaaggaccatgcttcggttcagatcaacattgggcatgtggatgagaatggcgtctacaatggccatttctccacttttgccctctgcggattcatccgtgctcagggtgatgctgacagtgctctagaccgcttgtggcagaagaagaaagttgaagttaagcaacagtagacacccatgatagtttgttacttcgttatgtattaatttctactcttgctagagatatttgagtactatgattgtcgttttgagcaaatactcattctgaattttcgtcggcatttggtgcctccagctaaggtggttacttttttgacagtttgccagtgcgttgataaatattctgtcatatttcaatcatataaattttgttaccgtg

SEQ ID NO: 4026 - DNA, 518 bp, Solanum lycopersicum
tttaaatggaggctttgcgtcgcttcttcacactttgcctccattgaagactctcccttagactcactcaggttgttagagctttatttcggcacttcagaaccaccagccaagatgcagaacgatgagggacaaaacatggatctttacatccccaggaaatgttctgctacaaacaggctgatcacttcaaaggaccatgcttctgttcaacttaatgtcggtcatttggacgataggggtgtctacactgggagtttcacaacttttgctctctgtggtttcatccgtgctcagggtgatgctgacagcgcaatggaccgtctctggcagaagaagaaagttgaagctagacaagagtagaaaaaatagatttgcattttgatattattttatgatgaaggattctggataacatttaaatttcagttgagttagacaatgttctcccagctgtaagctatatgttggattcatctttggatatctgagttgcccctttgctcatgattttgatt

SEQ ID NO: 4027 - DNA, 426 bp, Acacia harpophylla
ccacgcgtccgcgcttccttcgattttcaacagagcagattatacaatctcataaaagatgcagaacgaggagggacaaatcactgagctttacattccaaggaaatgctcggcaacaaacagattgatcactgctaaggatcatgcttctgttcagattaacgttgggcatttggatgagaccggcgtgtataatggccaattttttacttttgccctgtgtggtttcatttgtgcacagggagatgctgacagtgctttagatcgattgtggcaaaagaagaaagtcgaagtcaagcaacagtagatgaggaagctagttttatctccgtcttgtgatgctataattaaatactgcggaactagaacttgagactttttatcttttagctatgaatgttgtggtgcttattttgttcctacagt

SEQ ID NO: 4028 - DNA, 547 bp, Ambrosia trifida
cagacgccccaattgcagtaaaacgccgtcgttcgtttaagatttagcctggtgttcaaagaccttgcaaacatgcagaacgaggagggacaaaacatggatctctatatcccaaggaagtgctctgctaccaataggctgatcacttcaaaggatcatgcttcagtccaaattaatgttggtcatttggacgaaagtggccgatatactggtcaattttccacctttgcgctctgtggtttcgtgagagcccagggagatgccgacagtgcacttgataggctctggcagaagaagaaagttgaaacccgccaatagtttcttcatcgggattgcttcacttgaaggctatatgagtcctcagactatggcaaatttttcttagtgaagttttcttgttcttttgtgtaagccatggttttacttttatcaaggaaagacaaatattacatcagatttgatgttaatgttttggaatgttttcccagacttttaaagattcatcttaatgctgtgttttgagctttatgttaatgcagcgtattga

SEQ ID NO: 4029 - DNA, 492 bp, Ambrosia trifida
cattcgcaatacccagcaagcaactgagagagcttcatttagtctttgatttataaatctagtaagttgctgctccaagaaattagcaaccatgcagaatgaagagggacaaaacatggatctttacatccccaggaagtgctctgccactaacaggttgatcacttcgaaggatcacgcatctgttcagattaacgttggccatttggacgagtctggccgttacactggccagttttccacttttgccctatgtggttttgtacgcgcacagggagatgctgatagtgcacttgacaggctgtggcagaagaagaaggtcgaaactcgccagtagttactttatcggttggctccatgatgttaaacaacagttttatgtcttaagtttcaatgggtagaagcatgagggatattgcatcaagtttgtttgttggtttaattttggatattgtttgaaccatgaagcatacattgagttagaatctaagt

SEQ ID NO: 4030 - DNA, 537 bp, Ambrosia trifida
tccataaacttcacgcctccttcagcgcagctgtcaaccggcttaaacaatctttatcaaagagttagctggttctcaaagacttagcgaaaatgcaaaacgaagaagggcaaaacatggatctttatatccccaggaagtgctctgccactaacaggctgatcacttctaaggatcatgcttccgtccaaattaacgttggtcatttggacgaatctggccgatacactggccagttctccacttttgccctatgcggttttgtgcgagctcagggagatgctgacagtgccctcgataggctttggcagaagaagaaggttgaaactcgccaatagttatcttattcggtttgtgtttcacctcaaggctatttgaatccaggacaatgtttgatttttcctagtgaaattttcttgttttctgtctagacttggtttcgctttttataaggtaatgagaaatattgcattgagtttggcatgaatgttggatgttttttgtgcaagtattgcaatatattttgtcatactttaa

SEQ ID NO: 4031 - DNA, 592 bp, Antirrhinum majus
  misc_feature (589)..(589): n is a, c, g, or t
  misc_feature (591)..(592): n is a, c, g, or t
tcaaagcatccaaattgcatcaactccgaagttcgaaggtgctttgagctcagtgaatttgtgttgagtgcttgtaaaatttaggcaagatgcagaacgaagaaggacaaaacatggatctctatatccccaggaagtgctctgcgacaaacaggctgattacttcaaaggatcacgcttcggtgcagattaacgtcgggcatttggatgagactggccgatacaccggccagttctccacttttgctctctgtggattcgtccgtgctcagggcgatgctgacagtgctcttgataggctctggcagaaaaagaaagctgaagcccgacagtagtttattagatctttttttgagccctttattacgagttttgcattatgtcaagcgacacttgtgccggacaaaaatttcagatgtgcgactaatatttgaagacacatttatcttgcgctgcaggatgaaaatctattttacattttgagcttaagacagtttttgttgggtgtgtcataattctttctttctgacttctgaattgagatgggtgtttgctttaccattgtttatgaaagtgttcacttgccatncnn

SEQ ID NO: 4032 - DNA, 625 bp, Antirrhinum majus
  misc_feature (531)..(531): n is a, c, g, or t
ctatttaccttagccgcagtcttcttctcaatctccatcttctgctttggtaaattttgtggagtgctagaaaaatttaggcaagatgcagaacgaagagggacaaaacatggatctctatatccccaggaagtgctccgccacaaacaggctgatcacttcgaaggatcacgcctccgtccagattaatgtcgggcatttggacgagaccggccgatacactggccaattctccacctttgctctctgtggatttgttcgcgcccagggtgatgccgacagcgctcttgataggctctggcagaaaaagaaagcggaagcccgacaatagtgatttgttgctggttgggttctcaccttaagctgtggaatttgttgctaagcttctctcatgttttgagcacttttacctatttaattttacgttgttgctcaaaatatttgcgttagattgatatttaaaattttggaattgaagtttggagacatattaccctcttgctgcttgagatatctatagtagattatggncatgtgagtaagttctctcttagttgtgccctcggttctggtctgaaaatggatgtgtgtttttaccttgttgtctccattttgctttccctcc

SEQ ID NO: 4033 - DNA, 977 bp, Aristolochia fimbriata
ccgagccgctcaggtagtcagaattcagtcgagaacccgacgctggcctcagtcatcctggtggtgtaaaacatttctgttgaaatcttgttgtcaaagcagctgtcagaatgcagaacgaagagggtcagcacatggatctttacatccctaggaaatgttctgctacaaacagacttataacctcaaaggaccatgcctccgttcaaataaacatagggcacttggatgagagtggagtttacactgggcagttgtccacatttgctctctgtggcttcgtccgtgcccaaggtgatgctgacagtgctcttgacaggctctggcagaaaaagaaggccgaagttaaacagcagtgagtttgagccatgctagttttgtatttggtattaacagattcgacaacaatgagaaaaatcagcttagtctttttgcttccgtgagatgtaattctgatggttatactattgcgcccttctaatgtgattgtgtgaagttttaaaggatttcagtagttacgtactccaaaagtacatgattgatgtgggcttctatttgataggttttgtctgaatatttcgttgtagcggatattttagattttggtggttaatatgatccgattcggattttgatgatttggtgtcctagtcagaaaaccttagaaattatgtccgtggctttggaactagacttgggatcctttggtgaacttttttcaattaattgaaatagaaaggttgcaggttccttttgatagttatagttttgaatgtggcgaaagagagcgtgctggtcagacacgtttgggcatggtgagaacattccctcaagcgtcaactgtgagaccaaatgagtagacaaaactcttgcagaagtatgatgtcagaaagtaatatctagtttagcatctcctaccaatgataaatgccgcagcatggcattcgtacataaattgctaatggattttattgatt

SEQ ID NO: 4034 - DNA, 915 bp, Aristolochia fimbriata
tactgttgagtcttcgaagctctgtccgcagtccgccgtctactccgacgtcctcgctgttgtctcctctgagctggtgttcattgttgaatcaaccaaaatgcagaacgaagaggggcaacacatggatctttacatccccaggaaatgctctgctacaaacagactcattacttcaaaggaccatgcatctgttcagataaacatagggcacttggatgagagtggcatttacactggacaactctcaacctttgctctctgtggttttgttcgtgcccaaggagatgcagacagtgctcttgacaggctctggcaaaaaaagaaagcagaagtcagacagcagtagatcttttaaccatgaccgtgttagtttttgtgtttttgattaccagattttgagaaccatgatgagcactctgacaaattattttgtagcttgcgaattgcttgatgatttatgaggattttaaaattgatggaagcagcagttttaaaattttgcattggatggtccatctttttcaagtaaataatagttcctgaaagacctgcagtttgggaagcaggctaaggaaaattgatgttggatgcttggtgcaatgtcaaatctgtaggtagcaatggcactttgagcgttcacttaggtgcccttgtgattagaaactgaaggaaggaagaagttgtttcctagaggatttggtttccagtccaaaaataagaccaatactgttccaaaatgtatgtaaaattgtttgatgaaatcgactgtttcgaaaagtatcattccagaaatttcattaggttaatttatgggttgagatttgtgattgatcttcacacctgatctctgttaaatcttctttgaggacaatatgccttgtacaaccaatataacttgccactcatctgaaa

SEQ ID NO: 4035 - DNA, 544 bp, Artemisia annua
accaggcaaagcagcggcgcgctcatctctcatattttagattagttgctgtttaaagaagctatcaagatgcagaacgaagaaggacagaacatggatctctacatccccaggaagtgctctgctactaacagactgatcacctcaaaggatcatgcatctgttcagatcaacgttggacatttggatgagagtggccgatacactggccagttctcgacttttgctctttgtggttttgtgcgagctcagggagatgcggacagtgccctcgacaggctatggcagaagaagaaagttgaaacacatcaatagattcgtgttgtctgggacggttccatcaatatgtttttaccagtggatttctgtttttcatttcgtgattggtttttgactcgaggaatgtaaaatcaaagtttgtttagactggatttatgcgcctggctttttatgatcattttggtgagttggtacgaaaaatagggaccacacgaaaccaagtactatacaagaaaaccaaaagggtgaagacaccacaaaccaa

SEQ ID NO: 4036 - DNA, 576 bp, Artemisia annua
gattttcatatccttaacttctcattgcaaagccgccctctgccggaacactcaattcatcatcttcttctcaggcttagccggtattcaaaaagtttgacaacatgcagaacgaggaaggacaaaacatggatctctacatccccaggaagtgctctgccaccaacaggttgatcacttcaaaggatcatgcttcagttcaaatcaatgttggacatttggatgaatctggccgatacaccggtcagttctccacctttgctctttgcggctttgtccgagctcagggagatgctgacagtgcacttgataggttgtggcaaaagaagaaagttgagacccaccaataagttatctgattggtgttttcaactaaagacaatgctgaacttttgttagtgaaatgttctatttttctatctagacttggttctaccttttcttaggcaatgaaagtttgaacattaattttggatgttttgtgagcaagattatcattatgttatgctagccttatcaatgttatctgcgtttgatttggagcttattgacttttctgtttgtgctatattgatt

SEQ ID NO: 4037 - DNA, 622 bp, Phaseolus vulgaris
cctctaccgcactccttcgttcatcgtcttctctggtttatagattttgtgaaggaattttgcaacactcaaccaaagatgcagaacgaggaaggacagatcactgagctttacatccctaggaagtgttctgctacaaacagattgatcactgccaaagatcatgcttcggttcagattaacatcgggcatgtggatgagaatggtatctacaatggtcaattctccacctttgccctttgtggctatatccgcgctcagggtgatgctgacagtgccctagatcgcctgtggcagaagaagaaagctgaagttaagcaacagtagactccatgataatttgttactttttcatgtgttaatttctacccttactagtaatatttgaggattatgattgtcgttttgagcaaatacttctgaatttttgttggtacttggtacctccttctaaggttgtttttcttacaatgctttgattagtattcggttgtcttatattttaatattagggtatatgttacctagttttctgaagtttacttcacaacacaacagaatgcttcgctgaatttctatttaaaattagtgatggtaaattttcgtaaatttttactaaagt

SEQ ID NO: 4038 - DNA, 524 bp, Bupleurum chinense
actctaaacaacacctttgtctctcacttctactctcgtcctcgccgttgcagattttttaacagtagttgaaagtaaaatcaaacacctgtcaagatgatgaacgaggagggtcaaaacatggatctttacatccctagaaagtgttctgctacaaatcgtttgatcacatccaaggaccatgcttctgttcagatcaatgttggacatttggatgagaggggaatttacactggtggttttaccacttttgcactttgcggctttgtccgtgctcagggagatgcagatggtgctgttgataggctatggcagaagaagaaaactgaacttaaacaatagaaagttactattacccgtcctttgtatttgctaggcttgttttctgtttaaagcagaaggaatttctatgcagaatttttctagcttgtgatcatgaacttctggattttgtttgacctataatttgattcggacgtgtttttgtttgagttataacttctggattaattataaaatctttt

SEQ ID NO: 4039 - DNA, 817 bp, Ricinus communis
attcaagaaaaggccatgaggtaatagagcctgagataatttccgctggcccatcaacaaaaacagtgtcaatataaacacccgctttaaaccctaattccgctttcgagctctctctgatactacagatagatacccagttagtctcctgctatcctatcttctggtgtattaagtacctgttttagatttccaaacaatcagtgaagatgcagaacgaggagggagtgaatatggatctctacatccccaggaaatgctctgcaacaaataggctgattacttcaaaagatcatgcatctgttcagattaacatcgggcacttggatgaccgtggcatttataatggtcaatttactacgtttgccctttgtggttttatccgtgcacagggggatggtgacagtgcaattgatcgcctttggcagaagaagaaagttgaagcccgccagcagtagaaaaaaagaaaagaaaagaaagaaatgatagggccccttctgaaggggggggagagtttttgtaatgtggggacattttagatgtttttacactatcagcgttgaaaattgagataattttcgtaaggtgttttactacttaaaagtagatatggtgtttctgataatgtaaaagacctccagaagttccaagtttgggttgctaagttaatttattttgcgcatatgttgaatgtggtgtgatttgcttgtgtttctgctatgaagcctcttttctcttctctttttttttatattttttttaaggccatgttgacattgaacccatctttctaaatacaagaagaattcatctcaaa

SEQ ID NO: 4040 - DNA, 579 bp, Centaurea maculosa
tattcgcaataagcagcagccgagagagaagagctcccatcaatccctaatcttccgatctagttgctgtctgaagaaatcgccaagatgcagaacgaggagggacaaaacatggacctgtacatccccaggaagtgctctgctactaataggttgatcacttcaaaggatcatgcatctgttcagattaacgttggccatttggatgagactggccgctacactggccagttctccacttttgccctctgtggttttgtgcgagcgcagggagatgcggatagcgcattggacaggctgtggcagaagaagaaagtcgaaactcgccaatagtcactttgccggttgtttaatttagtggtttattcggttatcatgtgtttgaatttgaatcaagttaggagggaaattacatttaagttttgagatgttaagaaacctttttcatatccttctgggcttgagttttgctgatatcaagttgtggtttttattggtaatcttcaccttatgcttaaagctgattttaccaacagctgtttgactgctttttaattctttttaatgattgtgtatgaa

SEQ ID NO: 4041 - DNA, 508 bp, Centaurea maculosa
cggggggtcgatttcgcataagcagcagccgagagagaagagctaccatcaatccctaatcttccgatctagttgctgtctgaagaaatcgccaagatgcagaacgaggagggacaaaacatggacctgtacatccccaggaagtgctctgctactaataggttgatcacttcaaaggatcatgcatctgttcagattaacgttggccatttggatgagactggccgctacactggccagttctccacttttgccctctgtggttttgtgcgagcgcagggagatgcggatagcgcactggacaggctgtggcagaagaagaaagtcgaaactcgccaatagtcactttgccggttgtttattttagtggtttattcggttatcatgtgtttgaatttgaatcaagttaggagggaaattacatttaagttttgagatgttaagaaacctttttcatatccttctgggcttgagttttgctgatatcaagttagtggttttttttggt

SEQ ID NO: 4042 - DNA, 1377 bp, Cicer arietinum
tttaattgtcacgtcattataccttagaaaaataggaaaattttatcccatatcccattaattatatatatactctcaaatcaaaaatgaaattacgtttttactctatttaaataataaaactttaaaaaatttatcatttaccatttttcattgcaagttttctgcaactcaatagtgagttttttttctaaacttacgaagaacttgaatacaagttttccggtacacacgatacactctggaaaacttgtttgaagttctccggtacataacactatttcaaaaataaggtgtgtaccggaattcttcaaaaaagttttttaaaaatgataaaatagttataaaaaaaaaataactttaaattgataaaataggaagaaatttttttttggcattttcataacattataggggtataggtatagaaatgaggatacagggtaaatttttcaaaaaatagtttaattgggccaaatcatattagcccataatatgactacttgggccattatttggaaaaaaccggcccataagaataatgatactagggtttatgggaatttgatttatataagcttgttggctttttttcgcgtaataacatcaaaaatacgtgtttgatatctagtttgttatatttcaattaaggatttttttgtagattttttagaggaggcgattcataacaaaccctaaaagatgcagaacgaagacggacaaatcactgagctctatattcccaggaagtgttctgctacaaacagattgataactgctaaggatcacgcttccgttcaaatcaacattggtcatttggatgaatccggtgtctacaatggtcacttcaccacttttgccctctgtggctatactcgcgcacagggagatgctgacagtggacttgatcgtttgtggcagaaaaagaaaaccgaaattaagcagtagatgacatcacaacgtatctgtttgctatgtgttgagtttaactttttttagagatattggataattttgatcgatgtattgctagagatattgaattatttatatctatgtattgctagagatgttggatgatttttatccagtattgcagtatctgcttttaatttccttttgggggtaccttcaactaaagctacgtttgtattaattgcttttaaaaaaagttatctctcgcatttcaaaagttggtttaactatggtcatatttgccaactgccctgcccctgcgcatcttatcattagggggaatccggttttgttttttgaatttgatctcaaacaatatggaaaagggataaaatttaaaaaaattaaaatcagttttgagtttttaggtttagttgagtattcaatattcaatttttagtt

SEQ ID NO: 4043 - DNA, 536 bp, Cichorium intybus
gggggcgtctcattctcatccgcagcagccgagggagctctcgtatcatattgtaatctccgatctagctgctctttgaagaagttgccaagatgcagaatgaagagggacaaaacatggatctttacatcccaaggaagtgctctgctactaacaggttgatcacttcaaaggatcatgcttcagttcagatcaatgttggtcatgtggatgaatctggtcgctacactggccaattttccacttttgccctctgtggttttgtccgagcccagggagatgccgatagtgcccttgacaggctgtggcaaaagaagaaagttgaagctcgccaatagttactttgccagttttgtggtggcaaaatgggaattatgtcttaatttcagttattagaagcatgaaaggattattacgttaatttgtagtttgactttgggatcgtttgtgctatgaagcattacaatttacattgactgagatttaagttctgttatgcttatttcaaacaaaacatacaaaaaaaataaaaggtc

SEQ ID NO: 4044 - DNA, 518 bp, Cirsium arvense
cggggatagccgtcggttgatattcgaatacgcagcagcaatcactcaccaatttccgatctagttgctgtgtgaagaaatcgccaagatgcagaacgaagaaggacaaaacatggatctctacatccccaggaagtgttctgctactaataggttgatcacttcaaaggatcatgcatctgttcagattaatgttggtcatgtggatgagactggtcgctacactggccagttttccacttttgccctctgtggttttgtccgagcccagggagatgcggatagtgcacttgacaggctgtggcaaaagaagaaagtcgaagctcgccaatagtgtgttacgttgccagttggttgggtgacggttttaacgacaattttcatgtttttgatttgaattgttaagaaattacatcaagtttgtagtttaagtttgagatgttaagaaaccttttttttcatgattaatgctccttgaattttgctgcaaaaagaaaaagtaccgactgcgactctgc

SEQ ID NO: 4045 - DNA, 459 bp, Cirsium arvense
gcttaccaacatgcagaacgaggaaggacagaacatggatctctatatccccaggaagtgctctgctaccaacaggctgattacctcaaaggatcatgcttccgtccaaattaacgttggtcatctggacgagactggccgatacaccggtcaattctccacctttgctctgtgcggctttgtgagagcccagggtgatgctgacagcgcgctcgataggctttggcagaagaagaaagttgaaacccgccaataattgatttctcattcaagtgttggtttcaacttcagggcaatgttgaattttcgtagcgaaattttcttgtgttctatctagacttggttttactttattagggaaatgaaaagtactattattaaagtttgaatattgagttggatgttttgtcatcaaggttttcaccatcttttgttaactttaagcttcatttttatgtt

SEQ ID NO: 4046 - DNA, 577 bp, Cirsium arvense
tccctaaagccatcagacgcctgcctcttagcaacgcagctctccgccggattaatccatcttaatcgcttagcgagtgttgaaaagagcttgccaacatgcagaacgaagaaggacagaacatggatctctatatccccaggaagtgctctgctaccaacaggctgattacctcaaaggatcatgcttccgtccaaattaacgttggtcatcttgacgagactggccgatacaccggtcaattctctacctttgctctgtgcggctttgtgcgagcccagggtgatgctgatagcgcactcgataggctttggcagaagaagaaagttgaaacccgccaatgattgattttccatccgagcgttgtttcaacttcagggcaatgttgaatttttcgtagtgaaactttcttgtgttctatctagacttggttttactttattagggaatgaaaggtactagtattaagtttgaatattgagtttggatgttttatcatgaagtttttcatcatcttttgttaactataagcttcatttttatgttgttttgagctatgtgatatgattatgaatca

SEQ ID NO: 4047 - DNA, 555 bp, Cucurbita pepo
tttcggatagctcgctttcctctttgcgctgcggttttcgatttctaaagaattagttgattcaagatgcagaacgaagagggaaagatcacagagctttatattcccagaaaatgctccgccacgaatcggctgattacttccaaggatcatgcttcggttcagataaacgttgggcatttggatgacaatggcatctacactggccagttctccacttttgctctctgtggtttcattcgggcgcagggagatgctgacagcgccctggatcggctctggcacaagaagaaaggcgaagttcatcaacaatagatgattgtgctggtccggttcatctctacatcaacgttttcaaggatagagatgcacttttaaaaaattttgaacctattaaactcattcgtttctttcgacaatttaaactcgttagtttctttcaatgcaaacttgactgcacccgaatcggtacaagctttggtgggtgaaaatgggacaaaactaaggtgaatgagatatgttgaatttcattttccattgaaaggaattaccaaa

SEQ ID NO: 4048 - DNA, 606 bp, Solanum melongena
ttctcttctcatctccttcgctgctttcgtctctgtctgccttccactggagcttcccacatctaaagtctattcgcttaaagcaaattccaagatgcagaacgaggagggacaaaacatggacctttacattcccaggaaatgctctgccactaacaggttgatcacttccaaggatcatgcatctgtgcagctcaatattggtcatttggatgagtctggccgatacactggccagttcaccacatatgctctctgtggattcattcgtgcccagggggacgctgatagtgcgcttgataggctctggcagaagaaaaaagctgaaattggacaacaatgagagttgattgttacttctatattaccaccagttctttggtggtgttagtggcctgttctgttttcaagtttaaacattattagacaactattttggtgctgtaagttgatatcctattgttgagaaatttttggagatgaggaacaatatgagctctctttgaaacatttagcctaccttttccatttatttgtggcaaatgggattgattctgatgccatgagaattacgtccaattaaatcaaattccaattacatgaaag

SEQ ID NO: 4049 - DNA, 560 bp, Solanum melongena
ttcttcttctccaagcacattcggtctctgtctgtcttccaggagttttccaattcttaagtatattcgtgtagagtcattgtcaagatgcagaatgaggagggacagaatatggacctctacatcccgaggaagtgctctgccactaacaggctgataacttccaaggatcatgcatctgtccagcttaatgttgggcatttggatgagtctggccgatacactggacaattcaccacttttgctctttgtggatttattcgcgcccagggagatgccgatagtgctcttgataggctctggcagaagaaaaaggctgaagttggacaacaatgagagttttctatttactgttaccattctcaaaaaatgagagttttctatttagttttgtattatcggcagttctttgttggtcttagttctattttatgttaaagttcattatctgacaaatggaacatgcctgttactattttagtgcatcaacttgattttatactgttgaggaaacttttggagatgacaaaacaatatgagttgtgttaatcaattggcct

SEQ ID NO: 4050 - DNA, 372 bp, Euphorbia peplus
gatgcagaacgaagaaggacagaacatggatctctacatcccaaggaaatgctcggcgactaacaggctcatcacctcgaaagatcatgcttccgtgcagatcaatgtcgggcatttggatgccaacggccactacaccggtcaattctcgacctttgctctctgcggcttcgtccgtgctcagggtgatgctgacagtgccctcgacaggctttggcaaaagaagaagactgaacttcgccaatgattgagcttgtttgcttgctcccctttgaacactgttagaatgtcgagagtgacaaattttgttaatttggattaagctatttgttggccatgatgacagccttattatatatgtagtaagacctt

SEQ ID NO: 4051 - DNA, 374 bp, Euphorbia peplus
cagaacgaagagggtcagaatatggatctctacatccccaggaaatgctcggcgactaacaggctcatcacctccaaagatcatgcctctgtgcagatcaatattggccatttggatgccaatggccactacactggtcaattctctacttttgctctctgcggttttgtccgtgctcagggtgatgccgacagtgctcttgacaggctttggcaaaagaaaaagaccgaacttcgccagtgattgcccgctccctttttttaacaccgttcagaatgtggagagtgacaatttttgttaattttgtttaagctatttgttcgcgaggaggatgacttgttatatttgtagtacctagcatgatttatgtcgag

SEQ ID NO: 4052 - DNA, 473 bp, Flaveria ramosissima
cctcatctcaaagcagctcatcgtaatcgcagatttagctggtgtttagagaccttgtcaagatgcagaacgaggagggacaaaacatggatctctatatccccaggaagtgctctgctaccaacaggttgatcacttcgaaggatcatgcttcagttcaaattaatgttggtcatttggatgaaactggccgatatactggtcaattttccacctttgctctttgtggttttgtgagagcccagggagatgctgacagtgcacttgataggctatggcagaagaagaaagtcgaaattcgacagtagttttgtttgtcagggatttgacttctgccgaaggctgtattagtcttgggctatgtcaaaattttcttagtgaaattttcttgtgttttttatctaagacttgggttttttttattaaggtaagacagatattgcatcaattttgatgttaacgtttgcaaggtt

SEQ ID NO: 4053 - DNA, 518 bp, Flaveria ramosissima
accctcagcctcttcgcaccgcagctctcgccggagttatcaatcttcatcctagatttagcttgctctcaaacactttgccaagatgcagaacgaggaaggacagaacatggatctctacatccccaggaagtgctctgccactaacaggttgatcacttcaaaggatcatgcttctgttcaaatcaatgttggacatttggatgaatctggccgatacactggtcaattctccacctttgctctatgtggttttgtccgagcccagggagatgctgacagtgcgcttgataggctgtggcagaagaagaaagttgaaatccgccaatagtttaattatctggtttgtgttaaacctgaaggtgatttgaatccaggacaatgttaagtttttcttagtgaaattttcttgttctctatttagtttgatctgaattttggggttctctgtgcaagtttgcactgtattttgtttgactaaaggctttattttaaatgatgtgttttgagctctagac

SEQ ID NO: 4054 - DNA, 502 bp, Flaveria ramosissima
gcctctttgcaccgcagctctcgccggagtaatcaatcttcatagtagaattagctttctcgaacactttgccaagatgcagaacgaggagggacagaacatggatctttacatccccaggaagtgctctgccactaacaggctgatcacttcaaaggatcatgcttctgttcaaatcaatgttggtcatttggatgaatctggccgatacactggtcaattctccaccttcgctttatgtggttttgtgcgagcccagggagatgctgacagtgcgctcgataggctctggcagaagaagaaagttgaaatccgccaatagtttattcatccggtttgtgttaaaccttaaggtgatttgaatccaggataatgttgaatttttcttagtgaaattttcttgttttctatctagtttcatctggacgttgggtgttctctgtgcaagtttgcactgtattttgtttaactaaaggctttattttaaatgatgtgttttgag

SEQ ID NO: 4055 - DNA, 433 bp, Flaveria ramosissima
ctcttgcaaccaaacgcctcatctcaaagcagctcatcgtaatcgcagttttagctggtgtctagagaccttgccaagatgcagaacgaggaggggcaaaacatggatctctatatccccaggaagtgctctgctaccaacaggttgatcacttcaaaggatcatgcttcggtccaaattaatgttggtcatttggatgaaactggccgatatactggtcaattttccacctttgccctttgtggttttgtgagagctcagggagatgctgacagtgcgcttgataggctatggcagaagaagaaagtcgaaattcgccagtagttttattagtcaggggtttgtcttcacccgaaggctgtattacttgggctatgtcaaatttttcttagtgaaattttcttgttcttttatctaagacttggtttttatt

SEQ ID NO: 4056 - DNA, 489 bp, Flaveria ramosissima
ccctcagcctctttgcaccgcagctctcgccggagtaatcaatcttcatcttagatttagcttgctctcgaacactttgccaagatgcagaacgaagagggacagaacatggatctttacatccccaggaagtgctctgctaccaacaggctgatcacttcaaaggatcatgcttctgttcaaatcaatgttggacatttggatgaatctggccgatacactggtcaattctccaccttcgccttatgtggttttgtgcgagcccagggagatgctgacagtgcgctcgataggctgtggcaaaagaagaaagttgaaatccgccaatagtttattcatccggtttgtgttaaacctgaaggtgatttgaatccaggacaatgttgagtttttcttagtgaaatttcttgttctctatttagtttgatctgaacgttgcggttctctgtgcaagtttgcactgtattttgtttgactaaaggctttatt

SEQ ID NO: 4057 - DNA, 431 bp, Flaveria ramosissima
ctcttgcaaccaaacgcctcatctcaaagtagctcatcgtaatcgcagatttagctggtgtttagagaccttgtcaagatgcagaacgaggagggacaaaacatggatctctatatccccaggaagtgctctgctaccaacaggttgatcacttcgaaggatcatgcttctgtccaaattaatgttggtcatttggatgaaactggccgatatactggtcaattttccacctttgctctttgtggttttgtgagagcccagggagatgctgacagtgcacttgataggctatggcagaagaagaaagttgaaattcgccagtagttttatttatcaggggtttgtcttcagcctaaggctgtattagtcttgggctatgtcaattttttcttagtgaaattttcttgtttttttatctaagactttgggtt

SEQ ID NO: 4058 - DNA, 462 bp, Flaveria ramosissima
atgggggcaatcaaacgcctcatctcaaagtagctcatcgtaatcgcagatttagctggtgtttagagaccttgtcaagatgcagaacgaggagggacaaaacatggatctctatatccccaggaagtgctctgctaccaacaggttgatcacttcgaaggatcatgcttcagttcaaattaatgttggtcatttggatgaaactggccgatatactggtcaattttccacctttgctctttgtggttttgtgagagcccagggagatgctgacagtgcacttgataggctatggcagaagaagaaagtcgaaattcgacagtagttttatttgtcagggatttgacttcagccgaaggctgtattagtcttgggctatgtcaaaatttttcttagtgtaaattttcttgttttttatctaagacttggggtattttttataaggtaagtacagtatattgc

SEQ ID NO: 4059 - DNA, 579 bp, Flaveria ramosissima
gggatccattagtttcacccctcgcatacacctatttaaacgaatgcaattagggttttcaaaccctcagcctctttgcatcgcagctctcgccggagtaatcaatcttcatcgtagatttagcttgctctcgaacacttgccaagatgcagaacgaagagggacaaaacatggatctttacatccccaggaagtgctctgctaccaacaggctgatcacttcaaaggatcatgcttctgttcaaatcaatgtcggacatttggatgaatctggccgatacactggtcaattctccacctttgcactatgtggttttgtgcgagcccagggagatgctgacagtgcgctagataggctgtggcagaagaagaaagttgaaatccgccaatagtttatttatccggtttgtgttaaacctgaaagtgatttgaatccaggacaatgttaagtttttcttagtgaaattttcttgttctctatttagtttgatctgaacgttgcggttctctgtgcaagtttgcactgtattttgtttgactaaaggctttattttaaattgatgtgctttgagctctagt

SEQ ID NO: 4060 - DNA, 526 bp, Flaveria ramosissima
cctcagcctctttgcaccgcagctctcgccggagtaatcaatcttcatcatttagcttgctcttgaacactttgccaagatgcagaacgaggaaggacagaacatggatctctacatccccaggaagtgctctgccactaacaggttgatcacttcaaaggatcatgcttctgttcaaatcaatgttggacatttggatgaatctggccgatacactggtcaattctccacctttgctctatgtggttttgtccgagcccagggagatgctgacagtgcgcttgataggctgtggcagaagaagaaagttgaaatccgccaatagtttattcatccggtttgtgttaaacctgaaggtgatttgaatccaagacaatgttaagtttttcttagtgaaattttcttgttctctatttagtttgatctgaacgttgcggttctctgtgcaagtttgcactgtattttgtttgactaaaggctttattttaaacgatgtgttttgagctctagtatgttaccatgtgtt

SEQ ID NO: 4061 - DNA, 337 bp, Flaveria ramosissima
atttagctggtgtttagagaccttgccaagatgcagaacgaggagggacaaaacatggatctctatatccccaggaagtgctctgctaccaacaggttgatcacttcgaaggatcatgcttctgtccaaattaacgttggtcatttggatgaaactggccgatatactggtcaattttccacctttgctctttgtggtttcgtgagagcccagggagatgctgacagtgcgcttgataggctatggcagaagaagaaagtcgaaactcgacagtagttttatttgtcaaggatttgtcttcagccgaaggctgtattagtcttggtctatgtctaaa

SEQ ID NO: 4062 - DNA, 497 bp, Flaveria ramosissima
gggaccttcagcctctttgcaccgcagctctcgccggagtaatcaatcttcatcgtaggtttagcttgctctcgaacactttgccaagatgcagaacgaagaaggacagaacatggatctttacatccctaggaagtgctctgctactaacaggctgatcacttcaaaggatcatgcttctgttcaaatcaatgttggacatttggatgaatctggccgatacactggtcaattctccacctttgccctatgtggttttgtccgagctcagggagatgctgacagtgcgctcgataggctgtggcagaagaagaaagttgaaatccgccaatagttgattcatccggtttgtgttaaacctgaaggtggtttgaatccaggacaatgttgaatttttcttagtgaaattttcttgttttctatttagcttgatctggacgttgggtgttatcagtgcaaaagtttgcgctgtattttgtttgactaaaggctttatt

SEQ ID NO: 4063 - DNA, 561 bp, Flaveria ramosissima
gcaaccaaacgcctcatctcaaagcagctcatcgtaatcgcagatttagctggtgtttagagaccttgccaagatgcagaacgaggagggacaaaacatggatctctatatccccaggaagtgctctgctaccaacaggttgatcacttcgaaggatcatgcttcagtgcaaattaatgttggtcatttggatgaaactggccgatatactggtcaattttccacctttgctctttgtggttttgtgagagctcagggagatgctgacagtgcgcttgataggctatggcagaagaagaaagtcgaaattcgccagtagatttattcatcaggggtttgtcttcacccgaaggctgtattagtcatgggctatgtctaaattttcgtagtgaaattttcttgttctttatctaagaattatttttattaaggtaagacaaatattgcatcattttgaagttaatgtttggaatgttttcactatattttgtcagacttaaagttttatctcagtgttttgttttgtatcattagtttataaatcatgtttcatattaatgc

SEQ ID NO: 4064 - DNA, 532 bp, Linum usitatissimum
tcaaaatccctgcgcactcttgctcctcaaccctcgaacttcagtttccccggcggattttcttatcagtaaggcaagatgcagaacgaagagggtaacaacgtggatctctacatcccgaggaaatgctccgccactaacaggctgattacctcgaaggaccacgcctccgtccagatcaatgttggacatttggacgctaacggccgttacaccggccagttcaccacctttgccctctgcggattcgtccgtgctcagggtgatggagacagcggccttgacaggctgtggcagaagaagaaagccgaactcaggcaatgataggatcacagccgctgtgtttgcaacgttgttacgagcgaggtggagagaagtgggtttgagagtgtttcgctagggttttaccatgttatgctacagttttgttgtttaatgatgttcgactttatcgtcatatgtgtggaatgcaacagaattgatcaatctttcttctctacctgtctctttatattatccatgctttgcttgt

SEQ ID NO: 4065 - DNA, 538 bp, Linum usitatissimum
gctcaaaacccctgcgcagcttttgctccttagctccctaactccagttttccggcggattttcttatcaggcagccaagatgcagaacgaagaaggtaacaacgtggatctctacatcccgaggaaatgctccgccactaacaggctgattacctcgaaggaccacgcctccgtccagatcaatgttggacatttggacgcgaacggccgttacaccggccagttcaccacctttgctctctgtggattcgtccgtgctcagggtgatggagacagcggccttgacaggctgtggcagaagaagaaagccgagctccggcaatgatcggtgatccactgctgtgtttgcaacgcttgttacaagcgaggtggagagaagtgggttgagagtgtttcacgagggttttataccatgttatgctacagttttgttgtttaatgttgttctgactttattgtcatatgagtggaatgcaacagaatttatcagtctttcttctctgcctgtcgctttatattgtccatcgtttactggtt

SEQ ID NO: 4066 - DNA, 888 bp, Vitis vinifera
gaagagggcatttaagcccattatcagattcaaagtggtttttaaaaacacctttttaatttccctcgttagacgcccaagcatcatccaagggcccaagctgccttaagcccagtcaactcatataatgggccgacttgtaagaactggactttcggcccatccatattagggttttgcccttttaaggtctgccggtttgcaactctgctccctgcagcttctctcgtccttcacgtttcctgatttcggtgtagtcgcaaacacaaggcaaaatgcagaacgaagagggtcaaaacatggatctgtacatccccaggaaatgttctgccacaaataggctaattacttcaaaggaccatgcatctgttcagataaacatagggcatgtggacgaggatggagtgttcactggtcaattctccaccttcgctctatgtggttttgtccgtgctcagggagatgccgacagcgctgtggatcggctctggcagaagaagaaggcggaagtccgacagcattagaaaaagataatcaagctttttatccagtaaaaatgttaaatatgtagttgcgtgtagtagggaggtaggcgtgtgcaaggatttttgactcctctattactagtcatgaatttagggtttttccccatttgagtgttagaatatctatgttaccaagcaatattaactctacttcagttgcttacatattgctttaaacttggaaattttcaaacaaccttgatgagggatgtttgtttagggcttatgtttatcaagtaagacaaactctaggttgttccaattgggtgaagaagatatgatggatttgtgatatattcccatcttggttcataaattgattttacaaattgttggttctgtt

SEQ ID NO: 4067 - DNA, 517 bp, Guizotia abyssinica
cttgcagccaatctcaccgcagctctccgccggacatcatcacagatttagctggtgttcagagacgttgccaagatgcagaacgaagagggacaaaacatggatctctatatccccaggaagtgctctgctaccaacaggttgatcacttcaaaggatcatgcttccgtccaaattaatgttggtcatttggatgaatctggccgatacaccggtcaattttccacctttgccctctgtggttttgtgagagcacagggagatgccgacagcgcactcgataggttgtggcaaaagaagaaagtcgaaatccgccaatagtttcttcattgggtttgtcttcgcctggtccatttcaattctccttatgtcaagtttatcctagtgaaattatcctgttttcttttttgagactatgttttacttttgttaagggaagacaaatatttacatcaaatttgatgttactgattggttgttttgtgagcaatattttcactatatttgtctgacttta

SEQ ID NO: 4068 - DNA, 584 bp, Hevea brasiliensis
gctgtttcctcttcaggttgattgctgaattaggtgatttgagccaagtgatttgttgggagcttatcagtcatccaagatgcagaacgaagagggtcagaatatggatctgtacatccccaggaaatgctctgccacaaacaggctcatcacctccaaggatcacgcttctgtccagattaacattgggcacttggatgccaatggcctatacgttggtcagtgtaccactattgctctctgtggtttcgtccgagctcagggtgatgctgacagtgccctggacaggctttggcaaaagaagaaggttgaacaccgccaacaatgattgcagttggtgcatgttttgttttcttttaaacattgttagtacaaggagagtgactgctctggttttttttaagatatttgatatgaaggacaagttaatatctagtacttagcattgtttttatgtcgaatttgtttgttgcatgattttctataatattatgttgcactttaaagttttgcatccataatttgaacctgaatgttttaccattgcaatttgtaatacttcggcttattcacaattcaccaat

SEQ ID NO: 4069 - DNA, 650 bp, Carpinus betulus
agagtctcaagctttcgcccaccacatcgtcactgtgtgcacctcctcttcttcttcttcacagattactaagtgttagaacaagtaaaccaagatgcagaacgaagagggggttatcaccgagctttacattccaaggaaatgttcagccacaaacaggctgattacttcaaaggaccatgcttccgttcagattaacgttgggcatttggatgagaatggtgtgtacaatggccatttttccacctttgctctctgtggatttgttcgtgctcagggagatgctgacagtggattggaccgtctctggcagaagaagaaagctgaaatccgacaacagtagagcaagggagaaagaatctggttaattgttgtcttcgaaattttgttcaagggtagagactatgtactcttaaggattttgcctccatttgacaaatactttttactctttcatgtgttgctgtttgaattgtggttattatgacaattaaaatatcaatgttactgtcctaaaaaaaaaacaaaaaaaaaaaaaaaaaaaaaaaacaaaaaaaaaaaaaaaaaaaaaaaaacaaaaaaaaaaaaaaaaaaaaaaaaaaaaaaaacacacaacacacacacacacacacacacagacatacatagac

SEQ ID NO: 4070 - DNA, 639 bp, Carpinus betulus
cggcttaattctaaggctctaaaaaaccctagctttcgcccaccgcatctctccagtcaccgtgtgctcatcctcttcttcttcttcacagattagcaagtgtttgaacacataaaccaagatgcagaacgaagagggggttatcactgagctttacattccaaggaaatgttcagccacaaacaggctgatcacttccaaggaccatgcctccgttcagattaacgttgggcatttggatgagaacggcgtgtacaatggccatttttccacctttgctctctgtggatttgttcgtgctcagggagatgctgacagtggattggaccgtctctggcagaagaagaaagctgaaatccgacaacagtagggcaagggagaaagaatttggttaattgttgtcttcgaaattctgttcaagggtagagactatgtactcttaaggattttgccgccatttgacaactactttttactttttcatgtgttgctgtttgaattgtggttattatgacaattgaaatattcatgttactgtcttaaggtacttttcactatgtattgctctgtgagctgcatttgttgaaggtttgagattttttttggagccttttatgaataattttgcagtttgtactt

SEQ ID NO: 4071 - DNA, 584 bp, Carpinus betulus
ctcaagaccgcatcgtcacgtgttcaagctctcaagcttccgcccaccgcatcgttactgtgtgctcaagctctcaagctttcgcccaccgcatcgtcaccgtgtgctcaagctcttcttcttcttcttcatagattagcaagtgtttgaacacacaaaccaagatgcagaacgaagagggggttatcaccgagctttacattccaaggaaatgttcagccacaaataggctgattacttcaaaggaccatgcctctgttcagattaatgttgggcatttggatgagaacggcgtgtacaatggccatttttccacctttgctctctgtggatttgttcgtgctcagggagatgctgacagtggattggaccgtctctggcagaagaagaaagctgaaattcgacaacagtagggcaaaggagaaagaatctagttaattgttgtcttcgaaatctgttaagggtagagactatgtactcttaaggattttgcctccatttgacaactactttttacttttcatgtgtcgctgtttgaattgtggttattatgacaattaaaatattcatgttactgtgttaag

SEQ ID NO: 4072 - DNA, 543 bp, Lactuca sativa
tttcttgattttacagttgtcataagaacttgcaaagatgcagaacgaagagggtcagaacatggatctttatatcccaaggaaatgctctgctacaaacaggctaattacctcaaaagatcatgcttcagtccaaatcaacgtagggcatttggatgaaagtggccgatatactggtcagttttccacatttgccctctgtggttttgtccgtgcccagggagatgctgatagtgcacttgataggctgtggcagaagaagaaagttgaaacccagcaatagatattttatgacgattgtgcccctccttaaatttgctttaaccccatgggaatgttgagtttttcttggtggaattttgttggacttttatttagattctgtttcacttctatccgggaatgaaagattgcatttagtttgaatatcaagtttggagttttatctcaaagttgtgttttgggctacatatttgtaaaacaaaccaaacgaagtaagtttagcttaacaaacaaaaatatatatacaaacaaacgtgcaaa

SEQ ID NO: 4073 - DNA, 515 bp, Glycyrrhiza uralensis
gatcaaaagattcaaaaccctttgcccaaactctttcgcttctcgcggtttctagatttttgacgaagaggcttatacactgagaccataagatgcagaacgaggagggaaagctcactgagctatacgttccaaggaaatgctctgccaccaacagactgataacttcaaaggaccatgcctccgttcaaattaacattggccatttggatgagagtggagtctactctggtcatttttccacttttgccctctgtggtttcgtccgagcacagggagatggtgacagtgcgctagatcgcttgtggcagaagaagaaagctgaagttaagcaacattaaaagtgattataatttttgtctgaagttctactgttattactggagatatttcagtattatgattgtggaacttagtcaatttagttttataaattctgcaacatttgtttttgctcattttaaactttttgactgattgacacttcattcaaatatatttgattgtttcctcct

SEQ ID NO: 4074 - DNA, 796 bp, Liriodendron tulipifera
aacaaggcaatccgcgtccccttctttcgcccgcagctagggtttttctgcaacatataaaagtctcgttgcctctattttctctccccttgcatccctcccaggcagcttcgattcactctccagccctcggatctcctccgcctccaatccagccgtcgaaactcgccttcgccaagatgcagaacgaggaagggcagaacatggacctctacatccccaggaaatgctctgcgacgaaccgtctgatcacctcgaaggaccatgcgtccgtacagataaacgtcgggcacttggacgagagcggaatgtacaccggacacttcacgaccttcgcactatgcggattcgtccgtgctcagggagatgctgacagtgctcttgatagactctggcagaagaagaaggttgagcttcgtcagtagtagaaatgtcgtcatccattttgcatcttcactagtaaattgagagtagaatttttactgaggtgatgaatacattatagcttttctctatatctctactcgaaccgagtaaaaagataagatgatatctatttgtctttgatgtgtttcttggaaatttagagacctgcctcatttgaccatttgaattaattattgcctcattccaggtcaattgatagagatgtctgtagtagtttttagaattgataaatctctcttcatctatagcagggtttaaaagtgtcatttgccagggaagcgcgagggtcagatgactgtttggttgtatctttagattaattattacctgctggaaaattttgggctgt

SEQ ID NO: 4075 - DNA, 648 bp, Liriodendron tulipifera
  misc_feature (618)..(618): n is a, c, g, or t
cagcagttcttcgtcccctcttccattcagcaggttcttcgatttcatcaccaccgtcaaaatgcagaacgaggagggacagaacatggatctctacatccccaggaaatgttctgcaacgaatcggcttattacatcgaaggatcatgcttctgttcagataaatgttggacatttggacgagagtggcatgtatacgggccacttcaccacctttgcactttgtggttttgtccgagctcagggagatgccgacagtggtctcgataggctctggcagaagaagaaagctgaaatacgtcagtaggattgctgcccttttgtgtgctattctcctgtggggactgcctgtgaacaggggggggaatactccaaagatgatgaaacccatttgagctttctttctatttgaatgcctttagtggactttagtactgaatgtagcatcccttttgcatttgtctaaagatggtgaaatccagatgagctttttccaatctattagggcccgtttggatactactaaataagttactttttctacttacagcagtagataagtaacttatttcagataagtaagtttggtttatgattagtagtaacttttttacttanaaagtacataatcacttcagctagtttttt

SEQ ID NO: 4076 - DNA, 548 bp, Quercus alba
cttcgcctcctctgatttactaagttgtttgaagaagcacttgacacgtactagccaacatgcagaacgaagagggagttattactgagctttacattcctaggaaatgctcggccaccaacaggctgattaccgcaaaggaccacgcctccgttcagatcaatgtaggccatttggatgagaatggtgtgtacaacggccatttctccacctttgctctctgcggttttgtccgtgctcagggagatgcagacagtgggctggaccgtctctggcaaaagaagaaagccgaagcccgacaacagtagaacaagagacagtagatcaaaaagggagagactcaagtttgcttttgtttgtgaaattttgcttagagaaaagacaatgttgtctgttgatgttgagtacttttaatcatttattcaaaatattacaactagctttagctcttccatgtgttgctgttttaatgtggttgttcaacaattaaaatatttatgctaatgtgtcaaatttctttctacacatgtatcgatttgcttattgaa

SEQ ID NO: 4077 - DNA, 520 bp, Olea europaea
aacccaacttacttccctctcagcagctctagcaatattcatcatctgtatcttccggtgcttaacctttgtttgcagttgaacaattttccaagatgcagaacgaggagggacaaaatatggatctctacattcccagaaagtgttctgccacaaacaggctgatcacgtccaaggatcatgcatctgtccagatcaacgttggtcatttggatgaaactggccgatacactggccaattctccacctttgctctctgtggatttgtccgcgctcagggcgatgctgacagtgctctcgacagactctggcagaaaaagaaagttgaggtccgacagcagtgatgcgttttggcttctggtctcaagcagttcaatttctttgcttatgctttctttctgggtctctgttatagttcccttttagaatctccatctatgaagttttactatgacttctgtgctagaattgaaaattaatgtttattaaaaatggttttggagattatttgcctgaggta

SEQ ID NO: 4078 - DNA, 650 bp, Olea europaea
tttcttcccccaaccgactgatctctctgtctcgcgcgtcttcacctgcgtattctgggactggtgctctcagctttgtgaattccttgaatactaggacaattagccaagatgcagaatgaagaaggacaaaacatggatctctacatccccaggaagtgctctgccacaaacaggctgatcacttctaaggatcatgcatctgtccagatcaatgttggacacctggatgaaactggccgatacactggccagttctccacctttgctctttgtggatttgttcgtgcccagggtgatgctgacagtgctcttgataggctctggcagaaaaagaaagttgaagttcgacagcagtgatctggttggtgaacttctgatctcaagtcattcagagccctttttcggtttattttaggatttttatgtgtgaagcttcaattatgggctgggattgaaatttaatgtttgcaattaaaattgatactatttgacctttgcgaagctttggtggtgtttatgtgcttttgagatatttaattgtttttaattttaatttagttgtttcacataaatctgttttgagatactggaaaaataatcgaagaaattactgaatgcataaagtagcaaggattcttcgattattt

SEQ ID NO: 4079 - DNA, 584 bp, Citrus sinensis
acataaaattggggtctcaataaataacagagtctaggcaaccgcagaagagccgctcctgcctcgtactcggtattttgatattagtatttccagccgtcaagagaaaaaaactcagccaagatgcagaacgaggagggtcaaaatatggatctctatattcccaggaagtgttccgccacaaacaggctcatcacctccaaggatcacgccgctgtccagatcaacatcgggcacgttgatgctgatggcatttacaccggccaattctccacttttgctctctgcggcttcgtccgtgctcagggtgatggtgacagcgcccttgacaggctttggcaaaagaagaaggctgaggtccgacaacagtaatttccattaaagcgagttatgcgtcttctctagcagttttttccttctgtaagggggaatgtgatagcaacaactcatttattccagtttacttttgtggaccatgttgaaatatatttttgtttttggactatgattaatacttagtttatttatctgttggacttaatatatggtaatgatttgcttttagggctatggatgatcttgaa

SEQ ID NO: 4080 - DNA, 621 bp, Orobanche aegyptiaca
tctgtggctcgtcttctccaactgcaaaccattaatttagttgtcaaagacacctgacaagatgcagaacgatgagggaaagaacatggatctctacattccccggaaatgctctgctacgaaccggttgatcacctccaaggatcatgcatcagtgcagattaacattggccatttggatgagagaggcgtgtacactggtggattcacaacctttgctctctgcggtttcatccgtgctcagggtgatgctgacagtgctgtcgaccgcctctggcagaaaaagaaagttgaagcccggcagtagaatgtttaacttaatgaagttgaaactatgattttgtcgtgagtttgaaaaattgctataatttgcagacttatattttaatcgtgttcttttttgaaatttggaaacaacttagcgtcactcgtgtgctccttgaagtttgttaagccaatctatcctgtttctgtaatttgtagtgttggttactttaggttggctttgttttgatggatgcctttattgaatctagtcctagggttcagcacatttgatgaaaatttcaattatcttcgaaattattattgttttaaaaggtatacaaaaaaaaaaaaaaa

SEQ ID NO: 4081 - DNA, 602 bp, Parthenium argentatum
cctcacctcaccaccggactaaaacgccgtcgtttaagatttagccggtgtacaaagaccttgcaatcatgcagaacgaggagggacaaaacatggatctctatatccctaggaagtgctctgctactaacaggttgatcacttcaaaggaccatgcttcagttcaaattaatgttggtcatttggatgaaagtggccgatacaccggtcaattttccacctttgctctctgtggtttcgttagagcccagggagatgccgacagtgcacttgataggctctggcagaagaagaaagtcgaaacccaccaatagtttcttagtcgggtttgtcttcacctgacggctatttcagtcgtcggactatgtcaaatttttcttaaggaagttttcttgttcttttgtcttaagacatggttttactttattaccaaggaaagacagatattacatcagatttgatgttaatgtttggaatgtttttactacattttggcagactttgaagtttgaagcttcatcttaatgctgtattttgatatattagtcatgtttaatgcttaatattagtgctagttgaacttcctggtaaaaaaaaaaaaa

SEQ ID NO: 4082 - DNA, 523 bp, Lippia dulcis
agggttttactcgtcgttcagcttccgtcgtctgctcttttcttcgccagctgagaattaatcagtcgacgtggtgttaagagagacctgccaaaatgcagaatgaagaggggcagaacatggatctttacatcccgcggaaatgctccgctaccaaccggctgattacgtcaaaggatcatgcttcggtgcagcttaatgtcgggcatgtggatgagaggggcatttacactggccaattctctacgtttgccctatgtggtttcatccgtgcccagggtgatgcggacagtgctttggatcgcctctgggagaagaagaaagttgaggcccgacaacagtagaccatcatgttctcgtccttcggtctttaatgtagcactgggttcaacaacttactcattcttggatgtttctctttttgcaaattatgcgttagtgactttgatgtggatgcaattttgtgccattactcactaagttattctaatactattacaatcattttgggcccaaaaaagaa

SEQ ID NO: 4083 - DNA, 487 bp, Prunus mume
cgttgtagtcgattcaatgaccaagatgcaaaacgaagagggagttttcactgagctttacgttcccaggaaatgctcggccaccaacaggttgataacttcaaaggaccatgcgtcggttcagatcaacgtcgggcatctggatgagaatggcatctacacaggccagttctccacttctgctctctgtggttacgtccttgctcagggagatgccgacagtggtctggaccgactctggcagaagaagaaagctgaagttaaacgacactaggaagagaaaactgtttttctagtgtttcttctttggacatgtgttcttgagtatggaagtgtttaattagtgaactgatacattatgttgagcaattttctctccattcgtattgtacgttgcaaatagttggcaactttttggtgttacgtcttgcgttgggtttgttttactgttattaagtagtgaaacttttacttattggagtatcgt

SEQ ID NO: 4084 - DNA, 493 bp, Salvia sclarea
gcacgaggctgcattttcctatctcggtgatttgagattaattggattgcattgagtttggaagactcagccaagatgcagaatgaggaggggcaaaacatggatctttatattcccaggaagtgctctgccaccaacagactgatcacttccaaggatcacgcatctgtccagatcaacattgggcatgtggatgagagtggcagatacactgggcaattctcaacctttgctctttgtggattcattcgcgcccagggagacgctgacagtgcactcgataggctctggcagaaaaagaaagttgaagcccaacaacagtaattgagctttgctcatcgtagaggttgaagtagttcttcaatggtttttccagagtactaaggattaatttaatactttatgtgaggaggccatatttttgttaatggtgaaattttaggaacaaatcagacatctatctacaatctacatgtttgctcgaaaaaaaaaa

SEQ ID NO: 4085 - DNA, 528 bp, Salvia sclarea
ctactagaccttggctgtcactcagagcctctgtttcctgcattttccctctcttcaggtgtttgttgatttggtgatatttcttgagctcttcaaaaaactcagcaaatatgcagaatgaggagggacagaacatggatctctatatcccgaggaaatgctcggccacgaacaggctgatcacttccaaggatcatgcctctgtccagatcaacattgggcatgtggatgagagtggcagatacactggtcaattctcgactttcgctctttgcggattcattcgtgcccagggtgatgccgacagtgcccttgataggctgtggcagaagaagaaagtagaagcccaacagcagtagtcgagcttctccatggctggcagtggaattcgaagtttctccacaacattttatgaactgttgaagttttagtggatttttcgtcgaatcttggaatactacaattttgttgcccttttgttaatctctatattcacaagtcacttcgcagtgagtgacaggctagtag

SEQ ID NO: 4086 - DNA, 560 bp, Sarracenia psittacina
cgctctcatttttcgaactcggacgcttgtctccgcctcaggacgtcgaaacctgatcagcaaagatgcagaacgaagaggggcaaaacgtggatctttacatccctaggaaatgttctgccactaataggttaattaccgcaaaggaccatgcatccgtacagattaatgttggacatttggatgagaatggcatctacactggtcaatttaccacttttgctctttgtggttttgttcgttcccagggagatgctgacagtggtctcgatcgtctctggcaaaagaagaaagccgaacttcgacaatagatcgaggaaagatatatttatgatgaatattgtttggaactttttcctttgaaaaaattctgttgctttatcggcagatctttgaagtccaaggcttgtgtttttggcgtttgatgggtatgtttatgtttattgtgggtgtctgatctggatatcatatattttatttatgaacctaacttttgatagaatcttagtttgttcatttgttgcaatgccactcatatcccaaatccattaatgtttgat

SEQ ID NO: 4087 - DNA, 496 bp, Senecio madagascariensis
aaagcagtggtatcaacgcagcccggagtaaaccaatctttatcgccgagttagtttgtaatcaaagagtttgccaagatgcagaatgaggagggacaaaacatggatctttacatcccaaggaagtgctccgcaaccaacaggttgattacctcaaaggaccatgcttcagtccagatcaatgttggtcatgttgacgagactggccgatataccggtcagttctccacctttgccctttgtggatttgtccgagctcagggagatgctgatagtgctctcgataggttgtggcagaagaagaaggttgaagcccgccaatagtcattttacttttatgttccttgaaagttgtttcatcccagaacaatgtttcatttttcttagcaagattttccggtattctgtctagacttggttttgtttctattagtgaatgaaagatattgcatcgagtttgaccaaaaaaaaaagaaaagttggagtaccgactgcg

SEQ ID NO: 4088 - DNA, 619 bp, Glycine max
atttatatccatggtgtctcccccaatgcctcctctaccgcattagcactcgtctttggttctggtttatagatctctgtgaagtcgctttataacactcaacctaagatgcagaacgaggaaggacagatcaccgagctttacattcctaggaagtgctctgccacaaaccgattgattaccgctaaggaccatgcttcggttcaggttaacattgggcatgtggatgagaatggcgtctacaatggccatttctccacttttgctctctgcggcttcatacgtgctcagggtgatgctgacagtgccctagatcgcttgtggcagaagaagaaagttgaagttaagcaacagtagacacccatgatagtttgttactttgctatgtattaatttctacgcttgctagagatatttgagtactatgattgtcgtcttgagcaaatactcattctaaattttcgttggtatttggtaccgccagctaaatttgcttttttgacagtttgccagtgcgttgataaatatttggttgtcttatatttcaatcatagattttttgttaccgtattgtttgatttaacaacaaaactgacctcttcggtgaaggtgatcgcga

SEQ ID NO: 4089 - DNA, 1616 bp, Glycine max
ctctacggcactcgttttcgttctcgttctggtttatagatctttgcgaaggaggtttacagcgctcaaccaaagatgcagaacgaggaaggacagatcactgagctttacattcctaggaagtgctccgccacaaacagattgattaccgctaaggaccatgcttcggttcagatcaacattgggcatgtggatgagaatggcgtctacaatggccatttctccacttttgccctctgcggattcatccgtgctcagggtgatgctgacagtgctctagaccgcttgtggcagaagaagaaagttgaagttaagcaacagtagacacccatgatagtttgttacttcgttatgtattaatttctactcttgctagagatatttgagtactatgattgtcgttttgagcaaatactcattctgaattttcgtcggcatttggtgcctccagctaaggtggttacttttttgacagtttgccagtgcgttgataaatattctgtcatatttcaatcatataaattttgttaccgtggattttatgtgaagtttgatttaactgcaaaacagaacgcttcactcaaggtgaacgtgatgaatgacatagtggccttctataaaaccggagtgatgaaatttctgtagaccgtgaccatctgaaaatattgaagaatgtaattgttgggtggcctttaaaatgctgtctagtaatgattggatcctagatttagaattttaaaattctcctggcaatttaaggatattcttcaactagagtatttaacattctagtaaacgggcaccaagctttgccctcaaacataagcttatccctcctactgattaagcacactgattgaagggagcatacgtagggaattggacccaaccttgatgactatacgaggtttcaaacatttttattaactctttagcatacgtagctttgtgagtttatgctatggtctggacggtcaatagtaggtgtgtgtttagcataaacctacggatccaactattttttccctttaaacctacggatccaactattttttcccttttctctaggttatcttgctaccgtagcagtgaagttaattccaagagtaacctcactgtaatgaaaatgaaggaattgttgtgataatgttctccaacaaagatgaattatcagcaaaattcagttcacaccaatgtcgagacaacaaaaataatttatagtaaatttattagctaaaaaaaagaagagaagggtgctgactgctgaggatgaaagactattctacacgcacaccactcttcttcccatctctgccatccgaatttccaacgacctcgctcgctttcttcctttcatttcaacactcattctttcttcttcagccattttctcttttctctctttgatttctccctctctattccactatatgtttgcttttcactgcgtttgcgtagctgcattctgagctccttcactctctttggcgttcgcttccattctccgctatctattcgtaagtgcctttccccctttttcctaatgatggagtttttgtgttctgtatttcctttgtcgtttccgtcttcctctcttttgggttttgttagttttg

SEQ ID NO: 4090 - DNA, 417 bp, Helianthus annuus
accagacgcctcatttcaccgcagctctaaacgccgtcgtttaaggtttagcctgtgttcaaagacgttgcaaacatgcagaacgaggagggacaaaacatggatctctatatccccaggaagtgttcggccaccaataggctgatcacttcaaaggatcatgcttcagtccaaattaatgttggtcatttggacgaaaatggtctatataccggtcaattttccacctttgcactctgcggtttcgtgagagcccagggagatgctgacagtgcacttgatcggctgtggcaaaagaagaaagttgaaacccgccaatagtttgttctttggattcaattcaaggcgttgcagtctcagactatgtcaaattttccgtagcgaagttttcttgtttttttgtctaagacatggtat

SEQ ID NO: 4091 - DNA, 622 bp, Helianthus annuus
ccgcagctctaacgccgtcgtttaagtttagcctgtgttcaaagaccttgcaaacatgcagaacgaggagggacaaaacatggatctctatatccccaggaagtgttcggccaccaataggctgatcacttcaaaggatcatgcttcagtccaaattaatgttggtcatttggacgaaaatggtctatataccggtcaattttccacctttgcactctgcggtttcgtgagagcccagggagatgctgacagtgcacttgatcggctgtggcaaaagaagaaagttgaaacccgccaatagtttcttcttcggattcaattcaaggcgttgcagtctcagactttgtcaaattttccttagtgaagttttcttgttttttttgtctaagacatggtattttaaagaaatactgatgcatcagttttgatgttaatgtttggaatgtttttactatattttgccagactttaaagcctactcatcttaatgctgtgcttttattattcaattttttttttttgcaaaaaaaaaccttgtgggcggccggggcccattggatttttaacaaaaccaagtttttccatggggcaaaatttcccgcaaaatggacggtttttcttt

SEQ ID NO: 4092 - DNA, 510 bp, Helianthus annuus
tcttataaaacgatttagggttttacactcgtcacacacgcagcagctgctagagctttcatatcgccgatttacttccgaactagttgctgtttcaagaaatcaccgacaatgcagaatgaagagggacaaaacatggatctttacatccccagaaagtgctctgccactaacaggttgatcacttcaaaggatcacgcatctgttcagattaatgttggccatttggatgagtctggcctttacactggccagttttccacttttgccctctgtggttttgtacgtgcccagggtgatgccgatagtgcgcttgacaggctgtggcagaagaagaaagtcgaaactcgccagtagtaactttattggtttagtgtttggttccatgatgttaaacagcagttttcgtttcaatcactagaagcatgagggatgttgcttcaagtctgtaggtttaatttggatcttgtttgaaccatgaatcatacaatctaagcgctatttcaccat

SEQ ID NO: 4093 - DNA, 730 bp, Helianthus annuus
cattcgcaacagcaggctgctgagagatcgttcgtatcacttataatcatccgatcaagttgctgctagtataaattgccaagatgcaaaacgaggaggggcaaaacatggatctctacatccccagaaagtgctctgctacgaataggttgatcccgtcaaaagatcatgcatctgttcagattaacgttggccacttggatgagtccggtctttacactggccagttctctacttttgccctctgtggttttgtacgagcccagggagacgctgatagtgcacttgaccggctgtggcagaagaagaaagtcgaagcacgccaatagttactttaccagtttggtgtttgctttcatgacaatttgtatgtctcaaatttcagttattacatcaagtttcttgtttaacgtccatcttatttgggagtcatgaggcatacagcatccaagtaccatttcatcattagtgttgactgtttttttatgatgactgatctttctgcctttggtattctttgattgtgtgatgcttgagactttgtagtagcctacaaaaacttcatggctgttcatcatgcaggtcgggtttgtatgaaggtttggccatatgaacttgacaattttgcgggtttatttatatttggaggtgtaggtgtttatttaattatgtatgttaagttgcgatggactaaaatgttataagaacttgacaactaatgatttgtggc

SEQ ID NO: 4094 - DNA, 517 bp, Helianthus annuus
cagacgcctcatttcaccgcagctctaaacaccgtcgtttaaggtttagcctgtgttcaaagaccttgcaaacatgcagaacgaggagggacaaaacatggatctctatatccccaggaagtgctcggccaccaataggctgatcacttcaaaggatcatgcttcagtccaaattaatgttggtcatttggacgaaaatggtctatataccggtcaattttccacctttgcactctgcggtttcgtgagagcccagggagatgctgacagtgcacttgataggctgtggcaaaagaagaaagttgaaacccgccaatagtttcttcttcggatcagttcaaggcgttgcagtctcagactatgtcaaattttccgtagcgaagttttcttgttttttgttctaagacatggtattttaaagaaatactgatgcatcagttttgatgttaatgtttggaatgttttactagtattttgctagactttaaagcctactcatcttaatgctgtgcttttt

SEQ ID NO: 4095 - DNA, 630 bp, Solanum lycopersicum
aactagggttagataaaatttctcatctgtttaaatggaggctttgcgtcgcttcttcacactttgcctccattgaagactctcccttagactcactcaggttgttagagctttatttcggcacttcagaaccaccagccaagatgcagaacgatgagggacaaaacatggatctttacatccccaggaaatgttctgctacaaacaggctgatcacttcaaaggaccatgcttctgttcaacttaatgttggtcatttggacgataggggtgtctacactgggagtttcacaacttttgctctctgtggtttcatccgtgctcagggtgatgctgacagcgcaatggaccgtctctggcagaagaagaaagttgaagctagacaagagtagaaaaaatagatttgcattttgatattattttatgatgaaggattctggataacatttaaatttcagttgagttagacaatgttctcccagctataagctatatgttggattcatctttggatatctgagttgcccctttgctcatgattttgatttcattttctgattagttttttgattactctggttctattccttggctgtttttcatagttatattttccaacaatactgaggg

SEQ ID NO: 4096 - DNA, 535 bp, Tragopogon dubius
gggggggagccgtccatatttgcaataagcagcagccgagggaactctcatatcgccgactactttccgatctagttgctgttcaaagaattagccaagatgcagaacgaagagggacaaaacatggatctttacatccccaggaagtgctctgctaccaataggttgatcacttcaaaggatcacgcttctgttcaaatcaatgttggtcatttggatgagtctggtcgctacactggccagttttccacttttgctctctgtggtttcgtacgagcccagggtgatgctgatagtgcacttgacaggctgtggcagaagaagaaagttgaaaatcgccaataattattttgccagattaatggaggtttcatattaaatttggttattagaaacatgaaggattattacattaagttttgatttcattttggatcgtgaagaattattgagtcagatttgaagtattaaattgcagtttgattagctatatgcatcttatgaatttataagttaaaatagggaaaattgaaaa

SEQ ID NO: 4097 - DNA, 533 bp, Trigonella foenum-graecum
accatttgcattgcctccttcatccatcgcctctctctctctttgattttgttgttaaggagatttcacagcaacaaacctcaggatgcagaacgatgaagggcaaattacggaactctacattcctaggaagtgttctgctacaaacagattgattaccgcgaaggatcatgcttcagttcagattaacataggtcatttagatgagaccggtgtttacaatggccacttctccacttttgctctctgtggcttcactcgtgctcagggagatgccgacagtggaattgatcgcctctggcagaaaaagaaaaccgaacttaagcagtagaggtcatgatcacatcttgtttatgtgatttttttgaaagattatgtgttgagttcaacttttattagagatattggattattttgatctatgtaatgcagtacttgtttttaatttgctttggtattggtaccttcaaggctcattcaactaagttgctgttaaattaagtcctatattttctattacatttctatcacat

SEQ ID NO: 4098 - DNA, 455 bp, Vinca minor
acatttgcaaccttcgcctatcgtcctcctccgagcaaaacaagagttaataccaccaccagtcaagatgcagaacgaagaggggcaaaacatggatctttacatccctaggaaatgctctgcaaccaataggttgattacttcaaaggatcatgcttctatccagatcaaccttggtcatttggatgagaggggtatctatactggtggcttttccacattcgctctttgtggctttgtccgtgctcagggtgatgctgacagtgcagttgatcgcctgtggcagaagaagaaagttgaagttcgtcaacagtagacagataaatactgcttttgtatttgctgacagataaatactgcttttgtatttgcgtatcagcttgttagatgccggatgaattttctttctagaattaatacgattttgtctctatggtactaattatttttggtac

SEQ ID NO: 4099 - DNA, 2336 bp, Centaurea maculosa
ggttatggaagaaagcaaaaggaggatgtctactttgcagttttgttgttttctgttgatcggttgcttgatttcgcagatttatgcatcttctgaggctgtgttttacgagtcgtttgatgagtcgtttgaaggtagttggatcgcgtctgagaaggaggagtattctggtgtatggaagcactcaaagagcgaaggacacgatgactacggacttctcgtgagtgagaaggccagaaagtatgccatcgttaaggagctagagaaacctgttgagctcaaggatggtacaatcgttctccaattcgaagtccgccttcaaaacggtcttgaatgtggtggtgcatatttgaaatatctccgcccacaggaggctggctggactgccaagggattcgacaacgagtctccttactctatcatgtttggccctgacaaatgtggtgccaccaataaggtccacttcatcttaaaacacaagaaccccaagagcggagaattcgttgaacaccatctcaaattccccccttccgtcccttcagacaaattgacccatgtgtacaccgccatcttgaaacccgacaatgaggtcataatcctggttgacggtgaagagaaaaagaaggctaacttcctatcatctgaagacttcgaacccgcactaatcccgtcaaaaaccattcctgaccccgatgacaaaaagcccgaagactgggatgagagggccaagatccccgacccagaggcaacaaaacctgatgactgggatgaggatgcaccaatggaaattcttgacgaggaagctgagaagcccgaaggatggctagaagatgagcctgaagaaatcgatgatcccgaggccgtgaagcccgaggattgggatgatgaggaggacggtgagtgggaggctcccaagatcgacaaccctaaatgtgaagctgcatccggatgcggagaatggagaagaccgttgaaaaggaacccagcttacaagggcaaatggcatgctcctcttatcgacaaccctgcttacaagggtatctggaagcctcaagaaattccaaaccctaactactttgaacttgaaacccctaactttgagccaattgcggctatcggtattgagatctggaccatgcaagatggcatcttgttcgataacatcttgatcgcgagtgacgagaagactgcagagacaatcagggaaaccacatggaagcccaagtttaaggtggaggaagagaaacagaaggctgaagaaccagctggtttcgatggtctcaagggtatccagaaaactgtgtttgatgttctctacaagatcgctgatctgcctttcttgggcgaccacaagatcaaggttttggaactgattgagaaggccgaaaaacaaccaaacattacaatcggtgtcataatttcgatcatcgttgtgatcttgagtgtcttgttcaagctgttgtttggtggaaagaaaacggcaaaggtgaataacaatgtagcagcagcagcagcaaagaaggaagaaggcgaggaggcttcaagcaccccagcagaagataaagaggaagagaagaaagacgaagatgcagctgctcctcgtaggaggaccacaaggcgcgacaactagaaaagagagatttttattagtagaatcatcatatcatcatcttgtagtgtttagttgttgggaatgggggtattatttgctgagatcttctactgttacctactaattacatggtttttgtttgatggttggttaaaatacattgaaacagtttttgttgtaagtaaatcagagaatttttatcatgtagaattttcacttaaactttaagcaaaaaagaaaaaagtaccgactgcgactcaatattcaaacttaataatagtacttttcatttccctaataaagtaaaaccaagtctagatagaacacaagaaaatttcactacgaaaaactcaacattgccctgaagttgaaacatcgctctgattgggaaatcaaattattggcgggtttcaaccttcttcttctgccaaagcctatcgagtgcgctgtcagcatcaccctgggctctcacaaagccgcacagagcgaaggtggagaattgaccggtgtatcggccagtctcgtccaagtgacctacgttaatttggacagaagcatgatcctttgaggtgatcagcctgttggtagcagagcacttcctggggatgtagagatccatgttctgtccttcttcgttctgcatgttggcaagctctttcaacactggctaagcgatttacgatggattaatccggcggagagctgcgatgctaagaggcaggcg

SEQ ID NO: 4100 - DNA, 499 bp, Cucurbita pepo
gcttcaggtttcttcagacgcctcttccttcctttcggatagctcgctttcctctttgcgctgcggttttcgatttctaaagaattagttgattcaagatgcagaacgaagagggaaagatcacagagctttatattcccagaaaatgctccgccacgaatcggctgattacttccaaggatcatgcttcggttcagataaacgttgggcatttggatgacaatggcatctacactggccagttctccacttttgctctctgtggtttcattcgggcgcagggagatgctgacagcgccctggatcggctctggcacaagagaaaggcgaagttcatcaacaatagatgattgtgctggtccggttcatctctacatcaacgtttcaaggatagagatgcacttttaaaatttgaacctattaactcattcgtttctttcgactaatttaactcgtttagtttctttctaatgtacaaactttggactgcaccgatcgg

SEQ ID NO: 4101 - DNA, 475 bp, Carpinus betulus
gtcaccgtgtgctcatcctcctcttcttctttttcacagattaggaagtgtttgaacacataaaccaagatgcagaacgaagaggggggttatcaccgagctttacattccaaggaaatgttcagccacaaacaggctgattacttcaaaggaccatgcctctgttcagattaatgttgggcatttggatgagaacggcgtgtacaatggccatttttccacctttgctctctgtggatttgttcgtgcccagggagatgctgacagtggattggaccgtctctggcagaagaagaaagctgaaatccgacaacagtagggcaagggagaaagaatctgtttaatttttgtctttgaaattctgttcaagggtagagactatgtactcttaaggagtttgcctccatttgacaactactttttactctttcatgtgttgctgtttgaattgtgattattatgacaattaaaatat

SEQ ID NO: 4102 - DNA, 357 bp, Carpinus betulus
tcaagctttcgcccaccacatcgtcactgtgtgcacctcctcttcttcttcttcacaggctttgttggttcagattactaagtgttagaacaagtaaaccaagatgcagaacgaagagggggttatcaccgagctttacattccaaggaaatgttcagccacaaacaggctgattacttcaaaggaccatgcttccgttcagattaacgttgggcatttggatgagaacggtgtgtacaatggccatttttccacctttgctctctgtggatttgttcgtgctcagggagatgctgacagtggattggaccgtctctggcagaagaagaaagctagaaatccgacaacaggtagggc

SEQ ID NO: 4103 - DNA, 456 bp, Carpinus betulus
tcaagctttcgcccaccacatcgtcactgtgtgcacctcctcttcttcttcttcacagattactaagtgttagaacaagtaaaccaagatgcagaacgaagagggggttatcaccgagctttacattccaaggaaatgttcagccacaaacaggctgattacttcaaaggaccatgcttccgttcagattaacgttgggcatttggatgagaacggtgtgtacaatggcctatttttccacctttgctctctgtggatttgttcgtgctcagggagatgctgacagtggattggaccgtctctggcagaagaagaaagctagaaatccgacaacagtagggcaaggggagaaagatctagttaattgttgtctttcgaaaatttgtacaagggtagagtactatgtactcttaaggtattttgccttcatttgaactaaattactttttactcttt

SEQ ID NO: 4104 - DNA, 418 bp, Lippia dulcis
tgactgctctgctctcttcgccaactgagacattgataagtcgacgtagtgttcgaagagacctgccaaaatgcagaatgagagggccagaacatggatctttacatcccgcggaaatgctccgccaccaaccgcctgattacttccaaggatcatgcttccgtgcagcttaacatcggacatgtggacgagaggggcatttacactggacaattctccacttttgccctctgtggtttcatccgtgctcagggtgatgctgacagtgctttggatcgcctctggcagaagaagaaaatcgaagcccgacaacagtagacccttattttcattgtttcaaaaacaagcttattctgggatgtttctctttttttgtcaaatcgtgttagtgactttgatgtggatgcaatttttcgcc

SEQ ID NO: 4105 - DNA, 1412 bp, Papaver somniferum
gaaccaagaaaactgcttttgaagttctaacagaacattaaatcataacatagagaatatatcaaagaagcctaatgatccgatgtagaaactgttataacagacaaaatgtaagcgcatttgttttaaaacacaaatgaagaacgtataacaaaatcctccagggtcattttgctgattgaaatctactcctaaataaaccgctaacaaattatggcattgaccttaataagaaaaagaaagaaagagccttctcccaaagacaacaccctcatcatagatatcccaagtgacgtttgaaactggttactgctgcttctcttcaactttcttcttttgccaaagacggtctactgcactatctgcatctccctgagctctgacgaaaccagagagtgcaaaggtgctgaattggttagtgtaaatgccactctcattaagatgtccaatattgagctgaacagaagcatgatcttttgcggtaataatcctatttgttgcagaacatttcctagggatgtaaagatccatattctgtccttcttcgttcatcatcttggcaagttggtaatggatccgaaacaaggttataaaagatcaaacatagagatcaagtgataaaactaggaaagaaaccaaaaagcaacaaaaaaatggctactacttttacagagaaacaagaagctttggtcaaggaatcatgggaattgatgaaacaaaacatccctgaattgagtgttcgtttcttcaccactgttatagagatagcaccacaagcaaagcctatgttctcattcttgaaggatacagatgaaatcccacagaacaatcctaagctcaaagcccatgctatgaaggttttcaagatgacctgcgaatcagctgtgcaactacgggagaaaggtgaagttgtcgtcgccgacagcacgctagcgtacttgggtgcagtccatgttaagaaaggtgttatcgatccccatttcgaggtggtcaaggaagcactgttgaggacactggaatcaggattaggagataagtggaatgaagaaatgaaatgtgcttggagtgaagcttatgatcaattggctactgctatcaaagatgagatgaaagaagagagggctaaagctgatgcctaaaccaattttagctttcgcttttcattttaatttggaatttggtgatgatgcttgtgcttgtgcttgatatttccaacatgttttcctttgaataatgattgattaatcaagatttgggtgtgattctaaatcgagtttgcggtttgttcaaatatttctgtttgtttaattctggactggggctgggtgttgcgccctgtttgtttgttaccaccacttaaatccaattcgatctggattctggaatggggatgatattttgaggcaaaaaaa

SEQ ID NO: 4106 - DNA, 545 bp, Camellia sinensis
aatttctcaccatccactatcaatcttattcgttcgctttccctgatcttttactgtcaattcaaacacccgccaagatgcagaatgaagagggtcaaacatggatctttacatccccagaaaatgttctgcaacaaataggctaattactgcaaaggaccatgcgtctgtccagcttaatgtcgggcattggatgatagtggtgtttataccggaaccttcaccacctttgctcttgtggtttcgttcgtgctcagggagatgcagacagcgctgtagataggctgtggcagaagaagaaagttgaagcaagacaacagtagaaagagagttttatgggtttcttggatcaaaatttgcttgaggcatagatgttgccatgaatcttttatcagttgctgtgaaatgtgcagctagttttcgtttcgttcctttgttaacccattgaatttcaattttgctttcagtttttatgcacttgttttagacttatctaaaaatatgttgtgtaagctaataaaagctaataatctaaaattagaagt

SEQ ID NO: 4107 - DNA, 903 bp, Brassica napus
cttcggcacgaggtttcttcaaaaaaaaaaaagttagagaggtattaccagaaaagcaaagatgggctgcataggtcttatcaatttaacaagtaccaatatttatcggccggtgcttacaagaacatcaaacaaaccctacatcacaagaggaccatcgatggctgctattcgagctgagtcagtggctactgagaaattaggaatctttatcgagaagaatcctcccgagtccaaactcacccaactcggtgttcgtagttggcccaagtggggttgtcctccaagcaagtttccgtggacttatgatgcaaaggagacttgttttctgctagaggggaaagtgaaagtgtaccctgatgggtccgatgaaggcgtggagattgaagcaggcgactttgttgttttccctaaagggatgagttgcacttgggatgtatccgttgctgttgataaacactaccaattcgagtgaatggttatcagtttctgctccgcatatttggtgatatgttcgatataacttcactgtctttgtatgttgacttaattttgtgtgtcatgtatcagtctatgcattgctgggatttatttgcttcgatatctaagtgatttctcgtcatgtaatgtcccgttgctggcatttcctgcccgatcctcatcatcctaacttaggttagagcgtcgaggatctaggggtttaattgttttggtatgttcttttggctgcctaggacaggcttgaagtatgagactattagagaatttcggttagaagtttttttgcgttattttagaatttttaaggactttgtgcttgacatgtcctaggataagcagataaagaaaaccagagaaataaatattagcactagatttgttcattatgaatctagctattca

SEQ ID NO: 4108 - DNA, 642 bp, Raphanus sativus
  misc_feature (640)..(640): n is a, c, g, or t
agagaaattaaacaaaacgaaaaaaaaatagagaggtattaccagtgaagcgagatgggctgcatcggtcttatcgattcagccagtatcaatatttaccggccggtgcttacaagaacatcaaacaaaccctacacgagaagaggactatcgatggctgcgattcgagctgagtcaatggctactgaaaaattagggatctttatcgagaagaatcctcccgagtccaaactcacccaactaggtgttcgtagttggcccaagtggggttgtcctccaagcaagtttccatggacttacgatgcaaaggagacttgttttctgctagaagggaaagtgaaagtttaccctaatggatccgatgaaggcgtggagatcgaagcaggagactttgttgttttccctaaaggaatgagttgcacttgggacgtctctgttgcagttgataagcactaccaattcgagtgaatggctatttacttctgctcctcatattggtgatatgtttgatatatcttcactgtctttgtatgttgtggatacttaattttgtgtcatgtatcagtatcactctatgcattgctgggatttgtttgctccgatatctaagtaatttttgcgttatttaagactttttaanga

SEQ ID NO: 4109 - DNA, 684 bp, Raphanus sativus
  misc_feature (38)..(38): n is a, c, g, or t
  misc_feature (358)..(358): n is a, c, g, or t
  misc_feature (473)..(473): n is a, c, g, or t
  misc_feature (528)..(528): n is a, c, g, or t
  misc_feature (551)..(551): n is a, c, g, or t
ggaaaacaaaataaagtttcacgtgcagttggaaacanagaaattaaacaaaacgaaaaaaaaatagagaggtattaccagagaagcaagatgggctgcattggtcttatcgattcagccagtatcaatatttaccggccggtgctcacaagaacatcaaacaaaccctacacgagaagaggactatcgatggctgcgattcgagctgagtcaatggctactgaaaaattagggatctttatcgagaagaatcctcccgagtcaaaactcacccaactaggtgttcgtaattggcccaagtggggttgtcctccaagcaagtttccatggacttacgatgcaaaggagacttgtttcntgctagaggggaaagtgaaagtgtaccctgatgggtccgatgaaggcgtggagatcgaagcaggcgactttgttgttttccctaaaggaatgagttgcacttgggacgtctctgntgcagttgataagcactaccaattcgagtgaatggctatttacttctgctccgcntattggtgatatgtttgatatancttcactgtctttgtatgttgtggatacttaatatagaagttcttttgcgttatttaagactttttaaggactttgtgcatgacatgtcccaggataaagcagataaagaaaatcagagttcagatttgtaca

SEQ ID NO: 4110 - DNA, 686 bp, Raphanus sativus
acgtgcagttggaaacagagaaattaaacaaaaacgaaaaaaaaagatagagaggtattaccagagaagcaagatgggctgcattggtcttatcgattcagccagtatcaatatttaccggccggtgcttacaagaacatcaaacaaaccctacacgagaagaggactatcgatggctgcgagtcgagctgagtcaatggctactgaaaaattagggatctttatcgagaagaatcctcccgagtccaaactcacccaactaggtgttcgtagttggcccaagtggggttgtcctccaagcaagtttccatggacttacgatgcaaaggagacttgttttctgctagaagggaaagtgaaagtttaccctaatggatccgatgaaggcgtggagatcgaagcaggcgactttgttgttttccctaaaggaatgagttgcacttgggacgtctctgttgcagttgataagcactaccaattcgagtgaatggctatttacttctacgtactccgcatattggtgatatgtttgatatagcttcactgtctttgtatgttgtggatacttaatatagaagttcgtttgcgttatttaagactttttaaggactttgtgcatgacatgtcccaggataaagcagataaagaaaatcagagttcagatttgttcattatgaatctagcta

SEQ ID NO: 4111 - DNA, 562 bp, Brassica juncea
aagcaagatgggttgcattggtcttatcgatttaacaagtatcaatatttatcggccggtgcttacaagaacatcaaacaaaccctacacgagaagaggactaccgacggctgcgattcgagctgagtcaatggctactgaaaaattaggaatctttatcgagaagaatcctccagagtccaaactcacccaactcggtgttcgtaattggcccaagtggggttgtcctccaagcaagtttccatggacttacgatgcaaaggagacttgttttctgctagaggggaaagtgaaagtgtaccctaatggctccgacgaaggcgtagagattgaagcaggcgactttgttgttttccctaaaggaatgagttgcacttgggacgtctctgttgctgttgataaacactaccaattcgagtgaatggctatcagtttctgatccgcatatgttagatatagcttcaccgtctttgtatgttgatggatacttaattttgtttgtcatgtatcagtctatgcgttgctgggatttatttgcttcgatatctaagtaatttctcgt

SEQ ID NO: 4112 - DNA, 654 bp, Raphanus sativus
agagaaattaaacaaaaacgaaaaaaaaaatagaggggtattaccagtgaagcgagatgggctgcatcggtcttatcgattcagccagtaccaatatttaccggccggtgcttacaagaacatcaaacaaaccctacacgagaagaggactatcgatggctgcgagtcgagctgagtcaatggctactgaaaaattagggatctttatcgagaagaatcctcccgagtccaaactcacccaactaggcgttcgtaattggcccaagtggggttgtcctccaagcaagtttccatggacttacgatgcaaaggagacttgttttctgctagaggggaaagtgaaagtttaccctgatggttctgatgaaggcgtggagatcgaagcaggcgactttgctgttttccctaaaggaatgagttgcacttgggacgtctctgttgcagttgataagcactaccaattcgagtgaatggctatttacttctacgtactccgcatgttggtgatatgtttgatatagcttcactgtctttgtatgttgtggatacttgatatagaagttcttttgcgttatttaagaccttttaaagactttgtgcatgacaagtcccaggataaagtagataaagaaaatcagagttcagatttgttca

SEQ ID NO: 4113 - DNA, 645 bp, Raphanus sativus
aaacaaaaacgaaaaaaaaatagagaggtattaccagagaagcaagatgggctgcattggtcttatcgattcagccagtatcaatatttaccggccggtgcctacaagaaaatcaaacaaaccctacacgagaagaagactatcgatggctgcgagtcgagctgagtcaatggctactgaaaaactagggatctttatcgagaagaatcctcccgagtccaaactcacccaactaggcgttcgtaattggcccaagtggggttgtcctccaagcaagtttccatggacttacgatgcaaaggagacttgttttctgctagaagggaaagtgaaagtttaccctaatggatccgatgaaggcgtggagatcgaagcaggcgactttgttgttttccctaaaggaatgagttgcacttgggacgtctctgttgcagttgataagcactaccaattcgagtgaatggctatttacttctgctccgcgtattggtgatatgtttgatatatcttcactgtctttgtatgttgtggatacttaatatagaagttcttttgcgttatttaagactttttaaggactttgtgcatgacatgtcccaggataaagcacataaagaaaatcagagttcagatttgttcattatg

SEQ ID NO: 4114 - DNA, 568 bp, Raphanus sativus
  misc_feature (158)..(158): n is a, c, g, or t
accagagaagcgagatgggctgcattggtcttatcgattcagccagtatcagtatttaccggccggtgcttacaagaacatcaaacaaaccctacacgagaagaagactatccatggctgcgactcgagctgagtcaatggctactgaaaaattaggnatctttatcgagaagaatcctcccgagtccaaactcacccaactaggtgttcgtaattggcccaagtggggttgtcctccgagcaagtttccatggacttacgatgcaaaggagacttgtttcctgctagaggggaaagtgaaagtgtaccctgatgggtccgatgaaggcgtggagatcgaagcaggcgactttgttgttttccctaaaggaatgagttgcacttgggacgtctctgttgcagttgataagcactaccaattcgagtgaatggctatttacttatactcctcatattggtgatatgtttgatataggcttcactgtctttgtatgttgtggatacttaattttgtgtgtcatgtatcagtctatgcattgctgggatttgtttgcttcgatatctaagt

SEQ ID NO: 4115 - DNA, 475 bp, Arabidopsis lyrata
ctgaaaacaattaaatttaaaggaatgcaataatgggctgcatcggtgttgtgaatttaacaagcatcaatccatatctcacaagaacatcaaacaaaccctacaattcaagaagagcatcatccatggctgctgcgattagagctgagtcagtagctactgagaaattagggattacaattgagaagaacccacctgagtccaaactcacccaactcggtgttcgtaattggcccaggtggggttgtcctccaagcaagtttccatggacttacagtgcaaaggagacttgttatctgctagaggggaaagtgaaagtgtaccctaatggatccgatgaaggcgtagagatcgaagcaggcgactttgttgtcttccctaaaggaatgagttgcacttgggatgtctctgttgctgttgataaacattaccaattcgagtgaatggatatcaatctctgctctacgtattcgtg

SEQ ID NO: 4116 - DNA, 621 bp, Arabidopsis lyrata
tatacgataataaattggacagaaaagaaaaaataaaaatagagttttaattcgattgcagttctttgtgacttcgtgaaaatctgaaaacaattaaatttaaaggaatgcaataatgggctgcatcggtgttgtgaatttaacaagcatcaatccatatctcacaagaacatcaaacaaaccctacaattcaagaagagcatcatccatggctgctgcgattagagctgagtcagtagctactgagaaattagggattacaattgagaagaacccacctgagtccaaactcacccaactcggtgttcgtaattggcccaggtggggttgtcctccaagcaagtttccatggacttacagtgcaaaggagacttgttatctgctagaggggaaagtgaaagtgtaccctaatggatccgatgaaggcgtagagatcgaagcaggcgactttgttgtcttccctaaaggaatgagttgcacttgggatgtctctgttgctgttgataaacattaccaattcgagtgaatggatatcaatctctgctctacgtattcgtgggttgaccatctttgtatgttgatgtatacttatttcatatatatcagtctgcgcttgtggga

SEQ ID NO: 4117 - DNA, 612 bp, Eutrema halophilum
aattgaattatgatgccaaaaaacaaaaaggagtttcggttagagtcggaagcaaaatgggttgtatcggtcttgtcaattcatcgagtatcaatttttatcggccggtgctcacaaaaacatcacacaaaccctacagctcaagaggatccatggctgcgattcgagccgagtcaatggctactgagaaattagggatcttaattgagaagaatcctcccgagtccaaactcacccaactcggtgtccgtaattggcccaagtggggttgtcctccaagcaagtttccatggacttacagtgcaaaggagacttgctatctgctacaagggaaagtgaaagtgtaccctgatggttccgatgaaggcgtagagatcgaagcaggtgactttgttgttttccctaaaggaatgagttgcacttgggatgtatctgttactgttgataaacactatcaattcgagtgaaatgcatctcaatacctgctctgctctgcatatcggtgaattcgattaggcgtgaccatcttttgtatattgggatagatgcttggttttgttggtcctgtatcagtctatgcgtttgtttgatttcatataaatgatttctcgt

SEQ ID NO: 4118 - DNA, 643 bp, Eutrema halophilum
ccaaaaaacaaaaaggagtttcggttagagtcggaagcaaaatgggttgtatcggtcttgtcaattcatcgagtatcaatttttatcggccggtgctcacaaaaacatcacacaaaccctacagctcaagaggatccatggctgcgattcgagccgagtcaatggctactgagaaattagggatcttaattgagaagaatcctcccgagtccaaactcacccaactcggtgtccgtaattggcccaagtggggttgtcctccaagcaagtttccatggacttacagtgcaaaggagacttgctatctgctacaagggaaagtgaaagtgtaccctgatggttccgatgaaggcgtagagatcgaagcaggtgactttgttgttttccctaaaggaatgagttgcacttgggatgtatctgttactgttgataaacactatcaattcgagtgaaatgcatctcaatacctgctctgctctgcatatcggtgaattcgattaggcgtgaccatcttttgtatattgggatagatgcttggttttgttggtcctgtatcagtctatgcgtttgtttgatttcatataaatgatttctcgttttttcctgctagtggcgctaactcgtctatcttcgtgaaccaaac

SEQ ID NO: 4119 - DNA, 638 bp, Arabidopsis thaliana
attatattggacagaaaatgaaaaatttaaaatggagttttctattgcattttgtaagctgagaacaactaagttaaagggaaagcaaaaatgggctgcatcggtgttgtgaatgtaacaagcataaatccatatctcacaagaagatcaaacaaaccctacaattcaagaagaccatcatccatggctgctgcgattagagctgagtctactgagaaattagggattacaattgaaaagaatcctcctgagtccaaactaacccaactcggtgttcgtagttggcccaagtggggttgtcctccaagcaagtttccatggacttacagtgcaaaggagacttgttatttactacaaggaaaagtgaaagtgtaccctaatggatccgatgaaggcgtagagatcgaagcaggcgactttgttgttttccctaaaggaatgagttgcacttgggatgtctctgttgctgttgataaacattaccaattcgagtgaatggctgctatcaatctctgctctacgtattcgtgtattcgataggacttgaccatctttgtatgttgatggatacttactttaagcttgtgtgaagttttttactttagtggaaatagaggagtcatatatggacgcattat

SEQ ID NO: 4120 - DNA, 712 bp, Arabidopsis thaliana
atatgctatacgattatattggacagaaaatgaaaaatttaaaatggagttttctattgcattttgtaagctgagaacaactaagttaaagggaaagcaaaaatgggctgcatcggtgttgtgaatgtaacaagcataaatccatatctcacaagaagatcaaacaaaccctacaattcaagaagaccatcatccatggctgctgcgattagagctgagtctactgagaaattagggattacaattgaaaagaatcctcctgagtccaaactaacccaactcggtgttcgtagttggcccaagtggggttgtcctccaagcaagtttccatggacttacagtgcaaaggagacttgttatttactacaaggaaaagtgaaagtgtaccctaatggatccgatgaaggcgtagagatcgaagcaggcgactttgttgttttccctaaaggaatgagttgcacttgggatgtctctgttgctgttgataaacattaccaattcgagtgaatggctgctatcaatctctgctctacgtattcgtgtattcgataggacttgaccatctttgtatgttgatggatacttactttaagcttgtgtgaagttttttactttagtggaaatagaggagtcatatatggacgcattatctcattcaacaccaaagtcattcgaagttcgatacaataacatgtatagtgtttactgtcga

SEQ ID NO: 4121 - DNA, 815 bp, Brassica napus
gttatcattatctgtgtgaaccagagcgtggccttagaccaatcgacatggtttccacaccattccactccatcatctttctcttcctcgccttttccggcggagtcaaaatctccgtcgctgatgagccgaagaccgagcctgttcctgcgccatggccggagcagttccacgcgttgatgctcatgaataaatctggttccattgagattgttgacctatggtacgactggatcaatggccgtaactttaacatcattcagaagcagcttggcaaactaacctacgaccttgaatggaacaatgggacatctttttactatacactcgacgcttccaaaacttgccgcaccgttcatttcgaggttggaatcttgaggccaaactggctggatggagcaaactatttgggtcaacgaaatgtgagtgggtttctctgcaacgtatgggagaaggttgacttcttatggtattatgaagatgttgtcaccaagagacctgttcaatggatcttctatacaggtagagaagctcatgtgatgacatttgaggtcggagctgtcctagaggacgaaaaatggcaggctccagtctattgtttccacaatgaaaacaaaagcagtgagtaattgaagaatttgaaactgcgttttcattatatgtagagttttcgaaatctttcaagaaatcaaacgtttcattaagtagtcattttcatcttttatcatgcagtagatacagagttgttttcgtggagcataaataaaagtagatgtcttcttaatacacaggcctttactgggcctcactttttt

SEQ ID NO: 4122 - DNA, 676 bp, Brassica oleracea
  misc_feature (549)..(549): n is a, c, g, or t
ggtggccttgaaccaatcgacatggtttccacaccattccactccatcatctttctcttcctcgccttttccggcggagtcaaaatctccgtcgctgatgagccgaagaccgatcctgttcctgcgccatggccggagcagttccacgcgttgatgctcatgaataaatctggttccattgagattgttgacctatggtacgactggatcaatggccgtaactttaacatcattcagaagcagcttggcaaactaacctacgaccttgaatggaacaatgggacatctttttactatacactcgacgcttccaaaacttgccgcaccgttcatttcgaggttggaatcttgaggccaaactggctggatggagcaaactatttgggtcaacgaaatgtgagtgggtttctctgcaacgtatgggagaaggttgacttcttatggtattatgaagatgttgtcaccgagagacctgttcaatggatcttctatacaggtagagaagctcatgtgatgacatttgaggtcggagctgtcctagaggacganaaatggcaggctccagtctattgttttcacaatgaaaacaaaagcagtgagtaattgaagagtttgaaactgcgttttcattatatgtagagttttcgaaatctttcaagaaatcaaacgtttcagt

SEQ ID NO: 4123 - DNA, 882 bp, Brassica juncea
ctttagagttatcattatctgtgtgaaccagagcgtggccttagaccaatcgacatggtttccacaccaatccactccatcatctttctcttcctcgtcttttccgccggacttaaaatctctatcgctgataagccggtgacggagcctgttcctgcgccatggccggagcagttccacgcgttgatgctgatgaacaaatctggttcgcttgagattattgacctctggtacgactggatcaatggccgtaacttcaacatcattcagaagcagctcggcaagctaacctacgaccttgaatggaacaacggcacatctttctactacacgcttgacgcttccagaacttgccgcaccgttcatttggaggttggaatcttgaggccaaactggctggatggagcaaactatttgggtcaacgaaatgtgagtgggtttctctgcaacgtatgggagaaggttgacttcttatggtactacgaggatgttgttaccaagagacctgttcaatggatcttctatacaggtagagaagctcatgtgatgacatttgaggtcggagctgtcctggaggacgagaaatggcaggctccagtctattgtttccacgaggagttgaagagcagtgagtaatttgataagttgagactgtgttttcattgtttgaagacttttgggaatctttcaagaaatgaaacgttcattaaggagaccattttcatcttttatcaaaaactttattatggagcagatagacttgtttctggtggattataaataaaagtagatgttttcttaatccacagggctttgttgggcttcacttgcttttatgtggttaaggtctaagaagcaagtacattcaaatttggtccctaa

SEQ ID NO: 4124 - DNA, 805 bp, Eutrema parvulum
tattatcaatatttatactccaccatggaaaaatatcagaactttttcattattgtgattcttgagttatcatcatcatctgtctcttagcccaatggcttccacaccaatacactccctcgtcgttcttttcctcgtcttctccgcccgagttaaaatctccgtcgctgatgagccggagacggagcctgttcctgcgccgtggccggagcagttccacgcgttgatgttgatgaacaaatctggctctctggagattgtggacctctggtacgactgggtcaatggacgtaactttaacatcatccagaagcagcttggtaaactcacctacgaccttgaatggaacaatggcacttctttctactacacactcgacgcttcaagaacttgccgcaccgttcatttcgaggttggaatcttgaggccaaactggttggatggagcaaactatttgggtcaaagacatgtgaatgggtttctctgcaacgtatgggagaaagttgaattcttatggtattatgaagatgttgtcaccaagagacctgtacaatggatcttctacacaggtagagaagctcatgtgatgacatttgaagttggagctgtcctagaagacgagaattggcaagctcctgtctattgtttccacaacgagacaaagaacaatgagtagtttagaatctgagtctgtgtttcattatatgttgagtcaatttcatttttttttatcaaaaactttaagtagtagataagagatttttgttttagtggagcataaataaaagtagatgccttcttaatc

SEQ ID NO: 4125 - DNA, 796 bp, Eutrema parvulum
tatttatactccaccatggaaaaatatcagaactttttcattattgtgattcttgagttatcatcatcatctgtctcttagcccaatggcttccacaccaatacactccctcgtcgttcttttcctcgtcttctccgcccgagttaaaatctccgtcgctgatgagccggagacggagcctgttcctgcgccgtggccggagcagttccacgcgttgatgttgatgaacaaatctggctctctggagattgtggacctctggtacgactgggtcaatggacgtaactttaacatcatccagaagcagcttggtaaactcacctacgaccttgaatggaacaatggcacttctttctactacacactcgacgcttcaagaacttgccgcaccgttcatttcgaggttggaatcttgaggccaaactggttggatggagcaaactatttgggtcaaagacatgtgaatgggtttctctgcaacgtatgggagaaagttgaattcttatggtattatgaagatgttgtcaccaagagacctgtacaatggatcttctacacaggtagagaagctcatgtgatgacatttgaagttggagctgtcctagaagacgagaattggcaagctcctgtctattgtttccacaacgagacaaagaacaatgagtagtttagaatctgagtctgtgtttcattatatgttgagtcaatttcatttttttttatcaaaaactttaagtagtagataagagatttttgttttagtggagcataaataaaagtagatgccttcttaatc

SEQ ID NO: 4126 - DNA, 777 bp, Eutrema halophilum
tatttaataagatattccaccatggaaaatatctgaattatacataactgttgagttatcatcttcatgtggccttacccaatcgacatggtatccataccaatcctttccctcatcgttctcttcctcgtcttctccgccggcgttcaattctccgtcgccgatgagccggttccggcaccatggccggagcagttccacgcgttgatgttgatgaacaaatctgggtctctagagatagtggacctctggtacgattgggtcaatgaccgtaactttaatatcattcagaagcagcttggtaaactcacctacgaccttgaatggaacaatggcacctctttctactataccctcgacgcttcaagaacttgccgtaccgttcacttcgaggttggaatcctgagaccaaattggctagatggagcaaagtatttgggtcaacgacatgtgaatgggtttctctgcaacgtgtgggagaaggttgacttcttgtggtattatgaggatgttgtaagcaagagacctgttcaatggatcttctatacaggtagagaagctcatgtgatgacatttgaagttggagctgtcttagaagacgagaaatggcaggctcctgtctactgtttccacaatgacaataagaacagtgagtagtgaggaattgtgtttcataatgtgtagagtttcattgaggagaattttggtctttaacaaaaactttattatgtagacttttttgatagtggagcataaataaaagtagacgtcttaatc

SEQ ID NO: 4127 - DNA, 779 bp, Eutrema halophilum
aatatttaataagatattccaccatggaaaatatctgaattatacataactgttgagttatcatcttcatgtggccttacccaatcgacatggtatccataccaatcctttccctcatcgttctcttcctcgtcttctccgccggcgttcaattctccgtcgccgatgagccggttccggcaccatggccggagcagttccacgcgttgatgttgatgaacaaatctgggtctctagagatagtggacctctggtacgattgggtcaatgaccgtaactttaatatcattcagaagcagcttggtaaactcacctacgaccttgaatggaacaatggcacctctttctactataccctcgacgcttcaagaacttgccgtaccgttcacttcgaggttggaatcctgagaccaaattggctagatggagcaaagtatttgggtcaacgacatgtgaatgggtttctctgcaacgtgtgggagaaggttgacttcttgtggtattatgaggatgttgtaagcaagagacctgttcaatggatcttctatacaggtagagaagctcatgtgatgacatttgaagttggagctgtcttagaagacgagaaatggcaggctcctgtctactgtttccacaatgacaataagaacagtgagtagtgaggaattgtgtttcataatgtgtagagtttcattgaggagaattttggtctttaacaaaaactttattatgtagacttttttgatagtggagcataaataaaagtagacgtcttaatc

SEQ ID NO: 4128 - DNA, 751 bp, Arabidopsis thaliana
atttatctgaaccagaactcatcaagcgacatggtcttaaaaccaatccattccttcatcgttatcctcctcctcgttctctccgtcggtgacaaaatatccgccggtactgagccggagaaggagccagttcctgcggtatggccggagcagttccacgcgttgatgttgatgaacaaatcagggtcattggagattgtggatctttggtatgactgggtcaatggacgtaactttaacatcattcagaagcagcttggtaagctcacttatgacctcgaatggaacaatggcacttctttctactacactcttgacgcttctaaaacttgtcgcaccgttcatttcgaggttggaatcttgagaccaaattggctagatggagcaaagtatatgggtcaacgacatgtaaatgggtttttatgcaacgtatgggaaaaagttgagttcttatggtactatgaagatgttgtcaccaagagacctgtacagtggatcttctatacaggtagagaagctcatgtgatgacatttgaagttggagctgtcctagaagacgagaaatggcaggctcctgtatattgtttccacaatgagaagaaagaagtacaatgagtaaatgattttgtgtttcatttctatgtagagttttgggcatcttttgaatatatatcaaccgttcaatgaggaggtcattttcgtttttaatcaaatacacttggaagcataaataaaagtgatgtcttaatct

SEQ ID NO: 4129 - DNA, 749 bp, Arabidopsis lyrata
atttgtctgaaccagagctcaagcgacatggtctcaaaaccactccactccttcatcgttatcctcctcgtcctctccgccggtgacaaaacagccgccgttaatgagccggagctggagatggagccggttccggcggtatggccggagcagttccacgcgttgatgttgatgaacaaatctggagccttggagattgtggatctttggtacgactgggtcaatggacgtaactttaacatcattcagaagcaacttggtaaactcacttatgacctcgaatggaacaatggcacttctttctactacactctcgacgcttctagaacttgtcgcaccgttcactttgaggttggaatcttgaggccaaattggctagatggagcaaagtatttgggtcaacgacatgtaaatggttttttatgcaacgtatgggagaaagttgagttcttatggtactatgaagatattgtcaccaagagacctgtacaatggatcttctatacaggtagagaagctcatgtgatgacatttgatgttggagctgtcctagaagacgagaaatggcaggctcctgtctattgtttccacaatgagaaaaaagaagtacaatgagtaattgattttgtgtttcattatatgtagagttttgggtatcttttgaatatatatcaaccgttcaatgaggaggtcattttcgttttgttgtcaaattcttggagcataaataaaagtagatgtcttaatct

SEQ ID NO: 4130 - DNA, 845 bp, Raphanus sativus
  misc_feature (36)..(36): n is a, c, g, or t
  misc_feature (813)..(813): n is a, c, g, or t
ggcagtggttatcaacgcagtggccattacgggggngatctcaacagttactatcattatctgtgtgaaccagagcgtggctttagaccaatcgacatggtttccacaccattccactccatcatctttctcttcttcgtcttctccgccggagttaaaatctctgtcgctgataagccggtgacgcagcctgttcctgcgccatggccggagcagttccacgcgttgatgttgatgaacaaatctggttccattgagattgttgacctatggtacgactggatcaatggccgtaacttcaacatcattcagaagcagcttggcaaagtaacctacgaccttgaatggaacaatggcacatctttctactatacacttgacgcttccaaaacttgccgcaccgttcatttcgaggttggaatcttgaggccaaactggctggatggagccacctatttgggtcaacgaaatgtgagtgggtttctctgcaacgtatgggagaaggttgacttcttatggtactacgaggatgttgtcaccaagagacctgttcaatggatcttctacacaggtagagaagctcatgtgatgacatttgaggtcggagctgtcctagaggacgagaaatggcaggctccagtctattgttttcacaacgagaagaagagcagtgagtaatttgataacttgagactgtgtttttattgtatgtagacttttgggaatctttcaagaaatcaaatgttcatcaaggaggccattttcatcttttatcaaaaactttattatgtagcagatagagacttgtttttngtggatcataaataaaagcagatgtcttctta

SEQ ID NO: 4131 - DNA, 872 bp, Cajanus cajan
ggagaaaccctcatcactcatcactgcagctcgcagctcgcagctcgcagcacacgcctacagtcagcacactcgtccccgtcgtcctccatagacacgtctcgccggagcgttgcgtcgtgttagggctaagtgccaagtgctgaagctgctgatattgtgacttgttggtaaagatgagactgctaacacataacatgctgtcatcgaacattaagggtgtggtgaatggatttccattgcgcattgaagcagagaaagtggtggaaaagacagtggaaatgaacggtgagtttctgaaaaagatgtttgagaagattgattggaaggcttttgtggatgcatcgcgggccatgggatacactgaactacctgaggaggctgactcttccatgctggattctgatgagtttttgaacaggtttcaccatgctctcttggaactccaccttgaagaaggcgcccttgtttgccccgagactggaagacgctttcccgttaataagggaattccaaatatgcttcttcacgaggatgaggtctgagttttgctattaattatcagcttcacctgtttagtggcactaggttttttgactccagttaagaatgttggtgatggaactgaatcagaatttatagttgtgggtgtcaagtttttaacaaatgtatttggctgggctattcttggatagtttgattattcccaatttcacgttatattaaaccgcagcaatagcgtaaggcttttattttatttgtatgtgtttctattactatctcctaccttttgtattgatgccagttgttcttgaatgagtgtttatttcccctctagaacatgtcttatgcccacaaagcatacttttctg

SEQ ID NO: 4132 - DNA, 1103 bp, Glycine max
ataggataccgaggcaccaaatcagccttaaatctataatttaaaatgagaattcatattttcgtaaaccttttaagaacctagactagactagactacatcatcacctaatacccagaccatctcgccgcacacagcgcactgcagcgttgtgtcttcgcacgccgccgtcgacgtcgtccgccatcgtcacatctcgccggagcgtcgcgtcgctggctaagtgccaagtgctgctgctgattttgtggcttgttgataaaaatgagacttataacacataacatgctgtcatcgaacataaagggtgttgtaaatggatttcctttgcggattgaagcagagaaagttgtagaaaagactgtggaaatgaacggtgagtttctgaaaaagatgtttgagaagattgattggaaggcttttgttgatgcatcacgagcaatgggatacaccgagctacctgaggaggccgactcttccatgctggattctgatgaatttctgaacaggtttcaccatgctctcttggaactccaccttgaagaaggtgtccttgtttgccctgagaccggacgtcgctttccagtcagtaagggcattccaaatatgcttcttcacgaggacgaagtctgagttttgtttttaatcatcaccttcacctatttagtggcactaggtttattgacactctatttaagaatgctggtaagggaactgcaatcaaaatttatagttgttgtgggcgtcaatattatcttctttttgtcgacaaatgttgtatcctttggctgggatatgcttgcataattttgctttgatcatccctctgttggcaaagcatgtgctggattttatctgtatggtgtagaagttagttcccattgactgtgggtagtgtgttactcggttattattgcacttgaattgatatgtttccttggttctgttttactattcatgtcacaaatttctcttttacaagttctctcttcaattgaagggttggatgcaattgaattgatatgtttccttgtggaagcatacttttccttctatagcaataactttcgactggaatttgctttcaacttgggcaatgttta

SEQ ID NO: 4133 - DNA, 884 bp, Vigna unguiculata
attattgtttaaagaacctagattacctcctcacccatctacccaggccacctcgccgcacacagcagtattgtgactgcagttcgcaacgccatcgcaaacccaaacccaaactttcctcacaacgtccttcgccatagcgtagccgtcagggcttagtttcaagtgctgctgctgatattctgacttgtaagcaaagatgagactgctaacacataacatgctgtcatcgaacataaagggtgtggtgaatggattcccattgcgcattgaagttgagaaagtggtggaaaagactgtggaaatgaatggggagtttctgaaaaagatgtttgagaaggttgattggaaggctttgattgatgcatcacgggccatgggatacactgaactacctgaggaggccgactcttccatgctggactctgatgaatttctgaacaggtttcaccatgctctcttggaaatccaccttgaggaaggggctcttgtttgccctgagactggacgacgctttcctgtcaacaagggcattccaaatatgcttcttcacgaggacgaggtctgagttttgttattactcatcacctctacctgtttagtggcactagttttctggacgctctagttaagaatgctggtaatggaactgcagactttaaaagttgtggctgtcaagtttaccttcttttactagcacatgatgtatcctttggctgggctgttcttggatagtttgactattcctgaatgcaggttgcattagactgcagcattagaaattagcttcaaagatttctttatatgcttgttttctagtactatttactgcattttgtggtgatgcctatgatgcacgaatacaatacgagtatcggacacga

SEQ ID NO: 4134 - DNA, 517 bp, Lotus japonicus
gatatcgaattgttgggaaaatgagactactaacacacaacatgctatcatcaaacataaagggcgtggtgaatggattcccactgcgcatcgaagcagtgaaagtggtggaaaagacggtggaaatgaatggtgacttcctgaaaaaaatgtttgataagattgattggaaggcttttgtggttgcatcacaggccatgggatacactgagctacctgaggaggctgactcttctatgctagattcaaatgaattcctgaacaggtttcaccatgccctcttggaactccaccttgaagaaggcgctcttgtttgcccagagaccggacgacgcttccctgtcagtaagggcattccgaacatgcttcttcacgaggacgaggtctgaattttgctgttaatccatgatcaccttcccctgtacgagcacccttctctgtttactatgttctctgtcactatgtagttaaaaatgctagtactggaaagaattcaacttcaatggatttatagttt

SEQ ID NO: 4135 - DNA, 1056 bp, Glycine max
cttaaattaaatctaatttaaaataagaattcgtattttcgtaaaccttttaagaacctagaccgcctcatcacccaatacccagacagaccatctcgccgccacagcacactgcagcgttgtgtcttcgcactccgccgtcgacgtcttccgccaccgtcacatctcgccggagcgtcgcgtttccgtcagggctaagtgccaagtgttgctgctgatattgtgacttgttgataaagatgagacttataacacataacatgctgtcatcgaacataaagggtgtggtgaatggatttcctttgcgcattgaagcagagaaagtgatggaaaagaccatggaaatgaacagtgagtttctggaaaagatgtttgagaaggttgattggaaggcttttgttgatgcatcgcgggcaatgggatatactgaactacctgaggaggccaactcttccatgctagattctgatgaatttctgaacaggtttcaccatgctctcttggaactcgaccttgaagaaggtgcccttgtttgccctgagactggacgacgttttccagtcagcaagggcattccgaatatgcttcttcatgaggacgaagtctgagttgtgtttttaatcatcaccttcaactgtttagtggcactaggttttttgacactatttaagaatgctggtaatggaactgcaattaaaatttatagttgtgggtgtcaattttacccttctttttgttgacaaatgttgtatcctttggccgggctattcttggatagttttgccgagatcattcctcagctgacagagcatgtgctggattttatgtgtagaagttagttgccattgaccgtgagttagtgtgttactcggttcattttcacttcattatttttgcacttgaattgatatgtttacatggttctgttggtattttagtctgataactttttcacagtgaaatattggcgttaatttttatgtttgaagaaacaaggtagtcatgtctttcttgaccctatttttttttcaggttccttccttggaaatgaaaatt

SEQ ID NO: 4136 - DNA, 1207 bp, Glycine max
cttaaattaaatctaatttaaaataagaattcgtattttcgtaaaccttttaagaacctagaccgcctcatcacccaatacccagacagaccatctcgccgccacagcacactgcagcgttgtgtcttcgcactccgccgtcgacgtcttccgccaccgtcacatctcgccggagcgtcgcgtttccgtcagggctaagtgccaagtgttgctgctgatattgtgacttgttgataaagatgagacttataacacataacatgctgtcatcgaacataaagggtgtggtgaatggatttcctttgcgcattgaagcagagaaagtgatggaaaagaccatggaaatgaacagtgagtttctggaaaagatgtttgagaaggttgattggaaggcttttgttgatgcatcgcgggcaatgggatatactgaactacctgaggaggccaactcttccatgctagattctgatgaatttctgaacaggtttcaccatgctctcttggaactcgaccttgaagaaggtgcccttgtttgccctgagactggacgacgttttccagtcagcaagggcattccgaatatgcttcttcatgaggacgaagtctgagttgtgtttttaatcatcaccttcaactgtttagtggcactaggttttttgacactatttaagaatgctggtaatggaactgcaattaaaatttatagttgtgggtgtcaattttacccttctttttgttgacaaatgttgtatcctttggccgggctattcttggatagttttgccgagatcattcctcagctgacagagcatgtgctggattttatgtgtagaagttagttgccattgaccgtgagttagtgtgttactcggttcattttcacttcattatttttgcacttgaattgatatgtttacatggttctgttggtattttagtctgataactttttcacagtgaaatattggcgttaatttttatgtttgaagaaacaaggtagtcatgtctttcttgaccctatttttttttcaggttccttccttggaaatgaaaattcttgtggaaatatacttttcctaatatagcaataactttcggcgggaattttcttttagcttgggcaatgtttacgcctgtgaatgactctgcatgcaaactatattttggacgaacatttgaattgggataatgccattttttacaattg

SEQ ID NO: 4137 - DNA, 817 bp, Medicago truncatula
aattgaaattttgaagggttcagcaatctgaaacatcgccgcaaaaccctttctctctacgaagagttgagccgtctgtgtccacatcgccgccacccacccaccgatcctatcttctgtcgccagctaccatcacgccgttccgggacataggagttctgaaattgtagggcggaagatttgatcaatttggaaagatgagactgttaacacacaatatgctatcttcaaacattaagggtgtggtgaatggttttccattgcgcatagaagcagagaaagtggtggaaaagaatgtggaaatgaatggtgactttctgaaaaagatgtttgagaagattgagtggaaggcttttgtggaagcatcgcggggaatgggatacactgaactacctgaagaggctgactcttccatgctggattcaaatgaatttctgaaccggtttcaccatgccctcttggaactccaccttgaagaaggtgctcttgtttgcccagagactggacgacggttccctgtcaaaaagggcattccaaatatgcttcttcacgaggatgaggtctgatattttgtaattagctgatgaattttgaacaccctaccctgttttgaagcaccctcatctgcttgctggtaatggatagaaatcaatcgcagttaggatttatcgttttaatcaagtttacttcattatgttgacaaatgttattatgaatgcattgttggactattgtttgattatttcactatttccaactgcaacaataggtatttttggttttaatgagtttcttctgttattccttttgaatctct

SEQ ID NO: 4138 - DNA, 814 bp, Medicago truncatula
gaaattttgaagggttcagcaatctgaaacatcgccgcaaaaccctttctctctacgaagagttgagccgtctgtgtccacatcgccgccacccacccaccgatcctatcttctgtcgccagctaccatcacgccgttccgggacataggagttctgaaattgtagggcggaagatttgatcaatttggaaagatgagactgttaacacacaatatgctatcttcaaacattaagggtgtggtgaatggttttccattgcgcatagaagcagagaaagtggtggaaaagaatgtggaaatgaatggtgactttctgaaaaagatgtttgagaagattgagtggaaggcttttgtggaagcatcgcggggaatgggatacactgaactacctgaagaggctgactcttccatgctggattcaaatgaatttctgaaccggtttcaccatgccctcttggaactccaccttgaagaaggtgctcttgtttgcccagagactggacgacggttccctgtcaaaaagggcattccaaatatgcttcttcacgaggatgaggtctgatattttgtaattagctgatgaattttgaacaccctaccctgttttgaagcaccctcatctgcttgctggtaatggatagaaatcaatcgcagttaggatttatcgttttaatcaagtttacttcattatgttgacaaatgttattatgaatgcattgttggactattgtttgattatttcactatttccaactgcaacaataggtatttttggttttaatgagtttcttctgttattccttttgaatctctg

SEQ ID NO: 4139 - DNA, 681 bp, Trigonella foenum-graecum
ggagttctgaaattgtagggctgaagatttgacctgtttggaaagatgagactgttaacacacaatatgctatcttcaaacattaaaggtgtggtgaatggatttccattgcgcatagaagccgagaaagtggtagaaaagaatgtggaaatgaatggtgactttctgaaaaagatgtttgagaagattgagtggaaggcttttgtggaagcatcgcggggaatgggatacactgaactacctgaggaggctgactcttccatgctggattcggatgagtttctgagccggtttcaccatgcgctcttggaactccaccttgaagaaggtgctcttgtttgtccagagaccggacgacgcttccccatcaaaaaggggattccgaatatgcttcttcacgaggatgaggtctgaaattttgtaattagctggtgatgacgacgcttccctgttttgaagcaccctcttctgtttgctggtaatggatagaaatcaattgcagttaggatttattgttttgatcaagtttacctcatttatgttgacaaatgttgtatggatgcattgttggactattgtttgataatttcactattcccaactgcatgttatattaaacttcaaccatagcatcaaagtgtttttggttttaatgagtttctgttattccttttgaattcc

SEQ ID NO: 4140 - DNA, 834 bp, Cicer arietinum
tagtctgttactattccatcttcccgttcacccaaaactccaaaacaatcctcactttgccatcacacatcgagcttccaccttccggcagcgttttccggcaaccggcaaccggcacccggcaccgtccttccttctttctcttcgtttagttctggtgaacttgtgggtttgagattgtgatctcttaggaaagatgagactgctaacacacaacatgctgtcatcaaacataaggggcgtggtgaatgggtttccattgcgcattgaagcagggaaagtggtggaaaagaatgtggaaataaatggtgattttctaaagaacatgtttgtcaagattgattggaaggcttttgttgaagcttcacaatccatgggatacactgaattacctgaggaggctgactcatccatgttggattcagatgagtttttgaacaggtttcaccatgcactcttggaactccaccttgaagaaggtgctcttgtttgccctgagacaggacgacgattccctgtcagtaaaggcattccaaatatgcttcttcatgaggacgaggtttgaattttgttattagcctattatcaccttcacctgttttgtagaacactcatgagttattatgttttttgtcactctgtagttaaaatgctggtaacggaaagaatttaactgaaatttgagtttatataaaactctgtttattatgttatgacaaatgttgtatgctctggctaactgatttgattattgtttgataatttcactatctccaactgcatgttacgttaaactgcaacactagcatcaaagggttttcttttatatttgtg

SEQ ID NO: 4141 - DNA, 1147 bp, Cicer arietinum
caaattagagagaagaatctaacaaaatgttttacgcactaaaaccatatttctaccgtgttacgggataaatagctccataaacccttaaaactcactactattgtctcttaccattccatctaccctttcgcccaaaactccaaaaccagactttgccgtcacccaagaccacctaccatccaacttccggcagcgtttttctgcaaccggcaccgttctttctgctttatcaatcgtacattcctggggaacttgtggggctgatattgtgatccattaggaaagatgagattgctaacacacaacatgctgtcatcaaacataagaggcgtggtgaatgggtttccattgcgcatcgaagtggggaaagtggtggaaaagaatgtggaaatgaatggtgactttctaaagaacatgtttgtcaagattgattggaaggcttttgtggaagcttcacaatccatgggatacactgaattacctgaggaggctgatttatccatgttggattcagatgagtttctgaacaggtttcatcatgcactcttggaactccaccttgaagaaggtgctcttgtttgccctgagacaggacggcggttccctgtcagtaaaggcattccaaatatgcttcttcatgaggatgaggtttgaattttgctattagcctattatcaccttcaacggttttgtagaacactaatgagttattatgttctttgtcactctgtaattaaaatgtttggtagcgaaacgaattcaactgcaatttgaatttatataaaactctgtttatgatgtcgtgactatgctttggctcactggtttggctattgtttgataatttcactatctccaactgcatgttacattaaattgcaacacattggtgagctcctataacatgttgtgttccccaaaatcaacaatccataagccataagtagtggatatatatttttctaataaaaatcacctagcatgcaatagagtgaaactttgtttaaacccttcaagcttatattgaggttttatgtgtaaagtgctaacctcagattccaattaactagttatcaagtcaatgaaagataaaataatatctgtttgaaatatgtttttgacaaaatagatagaccctccagca

SEQ ID NO: 4142 - DNA, 488 bp, Trigonella foenum-graecum
tactcgctggaaaagatgaaactgttaacacacaacatgctatcatcaaacataaggggcgtagtgaatggttttccattacgcatcgaagcagcgaaagtgattgaaaagagtgtcgagatgaatagtgattttctcaagaacatgtttgagaagattgaatggaaggcttttgtggaagcttcaagatccatgggatacactgaattgcctgaggaagctgattcttctatgttggattctgatgattttttgaataggtttcatcatgcgcttttggaacttcaccttgaagaaggtgctcttgtttgtcctgagactggaagaaggtttcctgttagtaagggtattcctaatatgcttcttcatgaagatgaggtttgaattttattattattatgaaattcacttgttttgtagttattactagttaaacaatggtggtgattgaaagaattcaactaaaattataatttatatgaaactct

SEQ ID NO: 4143 - DNA, 578 bp, Trifolium pratense
acacaatatgctatcttcaaacattaagggtgtggtgaatggatttccattacgaatagaagccgagaaagtggtggaaaagaatgtggaaatgaatggtgactttttgaaaaagatgtttgagaagattgagtggaaggcttttgtggaagcatcacggggaatggggtacaccgaactacctgaggaggctgacacttccatgctggattcagatgaatttctgagccggtttcaccatgccctcttggaactccatcttgaagaaggtgctcttgtttgcccagagaccggacgacgcttccccgtcaaaaagggcattccaaatatgctgcttcacgaggatgaagtctgaaattttgtaattagctgattaacaccctcctctggttgccggtaatggaaagaaatcaactgcagttaggatttgttgttttaatcgagtttacctcgtatatgttgacagatgttgtatggctgcatttttggactattgtttgataatttcactattcccaactgcatgttatatagaactgtaactggagcatcatagtgttttgattttgatgagtttg

SEQ ID NO: 4144 - DNA, 370 bp, Medicago truncatula
atgggactgttaacacacaacatgctatcatcaaacataagaggcgtagtgaacggttttccattacggatcgaagcagtgaaagtggttgaaaagaatgtggaaatgaatacagattttctcaagaacatgtttgagaagattgattggaaggcttttgttgaagcttcaatatccatgggatatactgaattacctaaggaagctgattcttctttgttggattctgatgattttttgaataggtttcatcacgcgcttttggaacttcaccttgaagaaggtgctcttgtttgtcctgaaactagaagaaggtttcctgttagtaagggtattcctcatatgcttcttcatgaagatgaagtttgaa

SEQ ID NO: 4145 - DNA, 390 bp, Phaseolus vulgaris
atgagactgctaacacataacatgctgtcatcgaacataaagggtgtggtgaatgggttcccactgcgcattgaagcagagaaagtagcagaaaagagtgtggaaatgaatagggaatttctgaaaaagatgtttcagaaggttcattggaaggctttcgttgatgcatcacgagccatgggatacactgaactacctgagaaggcagactcttccatgctgaactctgatgaatttctgaacaggtttcaccatgctctcttggaactccaccttgaggaaggagctcttgtttgccctgaaactgggcgacgctttcctgtcaacaagggtattccaaatatgcttcttccccaagaagaagttttgttatcaataatcatatgttga

SEQ ID NO: 4146 - DNA, 745 bp, Arachis hypogaea
tgatagagcgagtggtattcaacgtcagagtacggggggttcttcttctttgtcatagtggaaacagagcgctttaggtagaagatgaggctgctaacgcacaacatgctatcgtcgaatataaagggagtggagaaggggtttccgcttcggatcgaggcggagaaggtagttgagaagccggttgagatgaacgcggattttctgcggaagatgtttgagaaggtggagtggaaggcatttgtggaagcttctagaagcatggggtacgcccagctcccggaggaggtagattccggcatgcttgagtcggacgagttcttgagtaggttccaccacgcactcctcgagctccacctcgaagaaggcgccctcgtctgtcccgagaccggccgcagattccccgttaacaagggtatccctaacatgctcctccatgaggacgaggtctgattaccaatctgccttttctttgattactagacttgtattgtcttttgtgtaccctctcaatctcattaggtttggctgtaattcaccgctaaaagtgtttctttaattttcatcatatatttagttacttctttccatgataaacattgtacaaatcattactcagtaaaatcattactcagtagcgtattcctatattaaagataatgcagcaggtctctatcgaccatgaatctctaaaaaaagaaaaaacaaaagtactctgcgttgataccactgcttcgctctatca

SEQ ID NO: 4147 - DNA, 781 bp, Arachis hypogaea
ggggagggttcttcttctttgtcatagtggaaacagagcgctttaggtagaagatgaggctgctaacgcacaacatgctatcgtcgaatataaagggagtggagaaggggtttccgcttcggatcgaggcggagaaggtagttgagaagccggttgagatgaacgcggattttctgcggaagatgtttgagaaggtggagtggaaggcatttgtggaagcttctagaagcatggggtacgcccagctcccggaggaggtagattccggcatgcttgagtcggacgagttcttgagtaggttccaccacgcactcctcgagctccacctcgaagaaggcgccctcgtctgtcccgagaccggccgcagattccccgttaacaagggtatccctaacatgctcctccatgaggacgaggtctgattaccaatctgccttttctttgattactagacttgtattgtcttttgtgtaccctctcaatctcattaggtttggctgtaattcaccgctaaaagtgtttctttaattttcatcatatatttagttacttctttccatgataaacattgtacaaatcattactcagtaaaatcattactcagtagcgtattcctatattaaagataatgcagcaggtctctatcgaccatgaatctctatagtcgctgtcttcctgattttgtacctttgataccaactacgccataaactgcattggtagttcaagtgctcgaattacagctgactttgaagttttgaaataaagtgatttaataatt

SEQ ID NO: 4148 - DNA, 720 bp, Fagus grandifolia
gactaggcctagccacctagggttggattaataatttaatattaccaaattatccctctcttccttctatctcctcccttctctcacaacaaaacacaagtctcaagtctcaaccccatcgttgattgttgctgccacggccaaccgtcgcgccaccagtgtctgccgctgaatcttccaacaagcatccagaaaaggtgaaagtagcactcgccttcctcatcttctctgagaaaagagaaaccgtgagagtagatatgaggctgctaacccacaacatgctctcatcaaacatcaaaggcgttagcaatgggttccctctccgcattgaggtagagaaagtgatagagaagcatgtggactttaacgccgatttcctccgcaacatgttccccaagattgagtggaaggcctttgtcgatgctgccaagaccattggctacgctgagctccccgaggaggctgactcgtccatgctcgactcggatgagttcttgaacaagttccaccatgccctccttgagctccaccttgaggaaggcggtctcgtttgtcccgagactggtcgtcgcttccccgtcagtaagggtattcccaacatgctccttcacgaggacgaggtctgaatcttatttttatataatttaatgcccttttgagatagtgttggtctttgtacttagggttcttggctaggcttttgctcttgttataattgga

SEQ ID NO: 4149 - DNA, 647 bp, Arachis hypogaea
ggggaagggttcttcttctttgtcatagtagaaacagagcgctctaggtagagatgaggctgctgacgcacaacatgctatcgtcgaatataaagggagtggagaaggggtttccgctgcggatcgaggcggagaaggtggttgagaagccggttgagatgaacgcggatttcctgcggaagatgttcgagaaggtggagtggaaggcattcttagaagcttctagaagcatggggtatgcgcagctcccggaggaggtggattccggcatgcttgagtcggacgagttcctgagtaggttccaccatgcactcctcgagctccaccttgaagaaggcgccctcgtctgtcccgagaccggccgccgattccccgtcaacaagggtatccctaacatgctcctccatgaggacgaggtctgattaccagcccgccttttctttgattattagacttgtgttatcttttgtaccctctcaatctcattaggtttggctgtaattcaccactaaaagtgtttctttaattttcatatatatatttggatactctttctatgataaacattgtacaaatcattcagttattcctatattaaagataatgcagcaggtctctatcgaccatgaatatctgtagtcgctatc

SEQ ID NO: 4150 - DNA, 1042 bp, Arachis hypogaea
cggtacgtacgagtacgtacgtacgtacgtacgtacgacgtacggtaacggtaacggtacgtacgtagtacgtacgtacgacgacgtacggtacggtacggtacgtagtagtagtacgtacgacgacgacgtacggtacgtacgagtagtagtatacgcgacagacggtaggacgacgagtagtctacgtacacgaccggtaggtagaccgcgtgattcgaacccagagtacgggtaagcacgtggtatcaacggcagagtaccgggttaagaccagtggtagtctaacgcacgagtaccgggtaaggaccacgtaggtagtactacgacagaagtacggcggaagcagtggtatcaacgcagagtacggggggggttcttcttctttgtcatagtagaaacagagcgctctaggtagagatgaggctgctgacgcacaacatgctatcgtcgaatataaagggagtggagaaggggtttccgctgcggatcgaggcggagaaggtggttgagaagccggttgagatgaacgcggatttcctgcggaagatgttcgagaaggtggagtggaaggcattcttagaagcttctagaagcatggggtatgcgcagctcccggaggaggtggattccggcatgcttgagtcggacgagttcctgagtaggttccaccatgcactcctcgagctccaccttgaagaaggcgccctcgtctgtcccgagaccggccgccgattccccgtcaacaagggtatccctaacatgctcctccatgaggacgaggtctgattaccagcccgccttttctttgattattagacttgtgttatcttttgtaccctctcaatctcattaggtttggctgtaattcaccactaaaagtgtttctttaattttcatatatatatttggatactctttctatgataaacattgtacaaatcattcagttattcctatattaaagataatgcagcaggtctctatcgaccatgaaaaaaaaaagaaaaaaaacaaaagtactctgcgttgataccactgc

SEQ ID NO: 4151 - DNA, 1846 bp, Eucalyptus grandis
gcttcccatcgtctcttcctcagttctctagctagcctcctcctcgccgcgtcgccgccgccgatcgccgccccgcatcctcgccgccggaacccgccaccgcacccctcgtccgtctattcctgcttccgtctccccttcttgtcagtccgctctccgaatctctagctgcatctcctgttcgttttcaccatctcggagcttttgttcggattcttccgactgcggcgtgatgagcggcgcgcgtctcttcaaagagagtcgccgtccggcggaaagccgccgatttgttctttcttcgatcgcgattttgatgataaattctgggttgtgcaaagattggaaaatgggatttggctggatatatgggttccaagatctcgatttgttgtcttaattgatgttaatacatccaagaattgctgcggcttgtgcgaattcagttgtgggttttgcgcatttcactatatgcatcgacggcttttttccttttatgaatttgcgtgtgtgctgcgattcttcttggactggtaaggttggccgattcggctgcagattgatcggaaaaagcactgatcttctccggccagcatgccctgtcgtgtaatcggaatggctgatttatggtcctctttcttgatgctttgtttttctttctcctattcagtccttcttggactgatcggaaatggctggtttccgacccatatgatcagatatgagctactgtccaacctaagtccccggtttggcgtcctctgttctgcagttggaaaccttttattgaagcctttttgttttgggcgagaatgttctttggctttgctttattgggatttctagtgttcttatctttactttgggcatttgccttggactttccttgtaaacatagaaatatgaagtcgagtttgagcaatttccaggagacggcttgaaacatccattagattccataaatgatgatggcatttacatctttgttacatcttcattgatactgtagtgtgttcatcttgttgcttatggatactggggttgagtattgagctctatcaaatgctgattgctgatcggagtgctttccttctctcaggcacggtgaaaggtgtggaaggatcagcagaagaatctagactagtgaaagactcgcgagacagataacttttcgagatgaggctcttaacccacaacatgctttcttcaaacatcaagggagtaatcaatggcttcccgcttggcattgtggtggagaaagtaatagagaagccagtggagatgaatcctgacttcctcaagaatatgtttgccaagattgagtggaaagctcttgtggatgcatctcggtccatgggctacaccgagcttcctgaacaggcggattcctcaatgctcgactctgtcgattttctgcagaggtttcatcatgccctcttagagctccaccttgaggaaggtgcattggtttgcccagagactgggagaaagtttcctgtcaacaagggaatacccaacatgctcctccatgaagatgaagtctgattttggttgaaccgacttgactttattgtgccatttgcgagtcaagatttagtgaagttattttaggcggaggtgcaaattaattaaccacctattactttgcttgtttaactagagactaggggttttgtggtttggatgatgcaagagggtttaatagcagagagagcttccaatgcattttgagtcaatgtaattattgttttttttttacctgatctaatcataatgagttgtctcttgacatttgaggtatacatttgccatgtcaatctacgattgctcggtccagatagtcatgtta

SEQ ID NO: 4152 - DNA, 756 bp, Lactuca sativa
taaaacccctgaaggctgaagcctcttttaaacccttaacagcagttaactcctcatccccgccgccgcccagagaagacaccatcaccggagacgcgaacgagaagatgaggctattgacccacaacatgctctcttcgaacatcaagggagtaatcaatggtttccctctccgaatcgaagtagaaaaagtcgtcgagaagcaagtcgatttcaatcctgatttcctcaagaacatgttctccaagatcgattggaaagccctagcggacgcttcaaagatcatgggatacgccgagctgcctgaagaagtccccgacgcgtcggtgcttgattccgatgagtttttgcagaaattccaccacgcacttcttgaacttcacctcgaggaaggtgcactcgtttgcccggagaccggtcgccggttccctgttaacaaggggatacctaatatgcttcttcatgaagatgaggtgtgataaacatttttcattacagtttctcgtttattagaaccgtatgtaatatgtgcttgaaatacatgaaaatttgctgcgatttgaagattagggttcttaatggatcacgttgcccctcttttgctattaattcatgtttcccgaatcttcaaaaaagttcagtgtcatgaaatttactgattctagtattcaattttctaaatccgatttgataccattccattcatgtataattgacattgttagctatcaaccttgaattgtggcagattttggt

SEQ ID NO: 4153 - DNA, 840 bp, Lupinus angustifolius
atagaagcctaagcccagtttttatgggttgggctgaaaatacgggtatttacttataacatagccgcaatcatcaaacaagggcacactcacttctcgtattttctttcattcttcttcaaagttgaaacagagaaaaagagagagaagaaaataggtatgagacttttaacacacaacatgctttcgtccaacataaagggcgtcaccaacggtttccccctccgcatcgaagtggtgaaagtggaagagaagacggtggagataaatgccgattttctgaagaatatgttccagaaaatcgattggaaagctttaacagaagcttcaagatccatgggatacacggagctacctgaagaatcagaattttcattgcttgaatcggatgagtttttgagtagattccaccatgcgctattggaattgcaccttgaagaaggtgctcttgtttgtcctgaatctggtagaagattccctgttagtaagggtattcctaatatgcttcttcatgaggatgaggtctgaatttttgtgttttgtcactttgtattagaagcaatctaagcaatttgataatcagtgttttttattgactttatgttgtacctatattattcggtggcgattttgaagattttctataattatttccaattattcttcatttccttagttagcgtaatgtgtgatgacttcattatttttgtaacatttctgttgctgcaatcaatgttatatcactaactggacttgaaaatggttctctattgtaatcttaggggttgaactgcatcaacaatgcatgtaaagttcttaatagcttgggcaaagccattc

SEQ ID NO: 4154 - DNA, 795 bp, Lupinus angustifolius
gggcactcacttatatagttatattttccttcaccttcttcttccaaatcgaaacagagaaaaggaagtaaggaacgaaaagaaaataggtatgagactgttaacacacaacatgctatcgtccaacataaagggcgtgaccaacggttttccactgcgaatcgaagtggtgaaagtggaggagaagacggttgagatgaacaccgattttctgaagaacatgttcgtgaaaattgattggaaggttttagtggaagcttctagaacattgggatacgcagagctacctgaggagggagattcttcgtttctggaatcggatgaatttctgagtaggtttcatcatgctctcttggaacttcatcttgaagaaggtgctcttatttgtcctgagactggtcgacgttttcctgttactaagggtattcctaacatgcttcttcatgaggatgaggtttgaatttcctttattgttatgtggttggttttagtggcatggacatgttcgctattatcttctttggtactatgtaatagatgcaaagcaacttaagtgtttgatcatctatgttctttatttcgtgtagtacctctattgttacgtcgtgatttagtttttttcctatttacttcctgttaattttcattcggtattttaactagttagattaatgcgtgaattttttatggtttcgttatttctgattcttgatattccgcaaatgtaaattctgatcaaatttatgtgtattcaatagttagttattcacattgcaaaagccgaaaacattgcct

SEQ ID NO: 4155 - DNA, 739 bp, Cichorium intybus
gggacaatcactcccctttgggctctggtgtacgaaaatattttattacttccataaaaccccagaagtctcttttaaacccttgaacatcagttactgcttctcgaccccgccgccgccgccgagcgcaaaacaccatcaccggagtagcgatcgagaagatgaggctattaacccacaacatgctttcatcgaacatcaaaggagtcatcaacggcttccctctccgaatcgaagtagaaaaagtcgtcgaaaagcaagtcgattttaatcctgatttcctcaagaacatgttctccaagatcgattggaaagccctagccgacgcttcaaagatcatgggatacgccgagctccctgacgaagtccctgatgcgtcggtgctcgattctgatgagtttttgcagaaatttcaccacgcacttcttgagcttcacctcgaggaaggcgcgctcgtttgcccggagactggtcgccggttccctgttaacaaggggatacctaatatgcttctccatgaagatgaggtgtgattaacaattttctttacggtttatcgtttattagatcgtatgtaatatgtgattgacatacatgaaagtttgctccgatttgaagattagggttcttaatgatcaggttgcccctcttttgctataaatctaagattcccgaatcgtcaaaaagttcattatcttgaagtttacgtaatattaaatattctgaattcaattcgtta

SEQ ID NO: 4156 - DNA, 426 bp, Bruguiera gymnorhiza
gaaggatgagactgcttacccacaacatgctgtcctcgaatatcaagggagtgtccaacggctttcctctccggattgaggcggagaaagtaatagagaagcaagttgacttcaacctcgattttctcaaaaacatgttttccaaggttgagtggaaagcccttgttgatgctgcccgaacattgggctatgctgagcttcctgatgaggttgactcttcgatgcttggctccgaggagtttctgagaaggtttcaccatgcacttctagagctccaccttgaggaaggtgctttggtttgtccggagacaggtcgcaagtttccggttaacaaggggattcccaatatgcttcttcatgaagacgaggtctagcaagcacgtccaaactttcattgttattccgtaggtgcttggttttgaggga

SEQ ID NO: 4157 - DNA, 616 bp, Manihot esculenta
gtgatattttcatccatccattggcaaatccactttgcgctgttccttctggcaattgctcgccgctctgaaagaaagagaaagagatgaggctcctaactcacaacatgctttcctccaatatcaagggagtctccaatggcttccctctgcgaatcgaggtagagaaagtgatagaaaaagaagttgactgcaaccctgattttctcataaacatgttcgcaaagatcgagtggaaggccctcgtggatgcggcaagaaccatgggctacgctgaacttccagaagaggctgaatcgtcgatgcttgattcggatgagtttttgaggaagttccaccatgctcttttggagcttcatcttgaagagggagctctggtttgtcctgagacgggtcgtaagttcccagtgaataaagggattcctaatatgctgcttcacgaagatgaggtttgagtactttttctttgaagctattatgagatgtagattagggttttgtatttgggaatgggtttggggttttagatacagtgttttgacaattttgagttatgaaatcatgaaatcgaacattgagagtatatgaaaatttcttttgggatgttcaatcagtt

SEQ ID NO: 4158 - DNA, 749 bp, Cucurbita pepo
catctggcgccattcgatcgctttgcttcgatctcctccgcttcaacagacaggaatttagaattggtagccatcatcttgtgctagagcgccgctaacacattctgataccaaatagctaacagagaggcgaaagagcatagtaaaaagatgaggctacttacccacaacatgctctcctccaacatcaagggtgttgtcaatggcttccctctccgaatcgaggttgagaaagttgtcgagaagcaggtcgacttcaaccccgacttcctcaagaacatgttctccaagatcgaatggaagcccctcgtcgatgcctcttgcgctatgggctatgctgagcttcccgaggaggccgagtcgtcgatgctcgattcccatgactttctgcaacgattccaccatgcgcttctggagctacatcttgaggaaggcgctcttatttgcccggagactgcccgtcgatttcccgtcaataaaggtatccccaatttgcttcttcacgaagacgaggtctgagtttgagattttatgaattcctctgttttcgattgttgaattcggtgcgagcaagcgagtttttagaattcatctctggatgttcttgtgaattggaaaattagggtttatgcctttggccaggccatgaatgcgactgaaaacatctttgttactacaaaattttgacgataaattagatgtggacatttactgaaaatatctagaataaacgtggaaatttgtctact

SEQ ID NO: 4159 - DNA, 738 bp, Cucurbita pepo
ctcccccaacaggctgcttcaagtgaagcttactctcccaatattgaaccctaaaccctcccagatcgcgaagcgcaaattcagacgagtttccaccggtagatggtggcggccgcaatcagaacaccataagcagttcctatcatcttgtaccatccgatcgcttcgatcttcttcgacaggaattttgaatttggtaacgatcattgcaagagtggcgcttgcaagcgaaagggctgaaaaagatgaggctacttacacacaacatgctctcctccaacatcaagggcgttgtcaatggcttccctctccgaatcgaggttgagaaagttgtcgagaagcaggtcgacttcaacccagacttcctcaagaacatgttctccaagattgaatggaagccccttgtcgatgcctctcgcactatgggctatgccgaacttcccgaggaggcggagtcgtcaatgctcgattcccatgactttttgcaacgattccaccatgcgcttttggagctacatctcgaggaaggcgctcttatttgcccggagacgggccgccgattccccgtcaataaaggtatccccaatttgcttcttcacgaggacgaagtatgagttcgagttccataatgtatgaattcctccgttatattcagtgagagaaagcaagtttccagaattcatatctggatgtttatgtgaattggaaaattaggattgaagctaatttattatttac

SEQ ID NO: 4160 - DNA, 779 bp, Cucurbita pepo
ttctcccgggagccgcaattcgaagagccctaacatctggcgccattcgatcgcttcgcttcgatctcctccgcttcaagagaacaggaatttagaatttggtatcaatcattttgtgcaagagcgctgcttacacattgcgataccaaatagctaacagagagccagaggaagaggcgaaagagcgtagtaaaaagatgaggctacttacccacaacatgctctcctccaacatcaagggtgttgtcaatggcttccctctccgaatcgaggttgagaaagttgtcgagaagcaggtcgacttcaaccccgacttcctcaagaacatgttctccaagatagaatggaagcccctcgttgatgcctctcgcgctatgggctatgctgagcttcccgaggaggccgagtcgtcgatgctcgattcccatgactttctgcaacgattccaccatgcgcttctggagctacatcttgaggaaggcgctcttatttgcccggagactgcccgtcgatttcccgtcaataaaggtatccccaatttgcttcttcacgaagacgaggtctgagtttgagattttatgaattcctctgttttcgattgttgaattcggtgcgagcaagcgagtttttagaattcatctctggatgttcttgtgaattggaaaattagggtttatgcctttggccaggccatgaatgcgactgaaaatatctttgttactaactaaaatttagacgaataaattaagatgtggacatttactgaaaataatctagaa

SEQ ID NO: 4161 - DNA, 663 bp, Quercus alba
ttttaggcaaaaacagcacccgacccagccaccctcaccttcctcgacttcgaaatcgtgagacagagatgaggctgttaacacacaacatgctttcatcgaacatcaagggcgtaagcaacgggtttcctcttcgaatcgaggtagagaaagtggtggagaagcaagtcgacttcaacgccgacttcctccgcaacatgtttcccaagatcgagtggaaggccttcgtcgacgccgctaagaccgtaggctacgcggagctccctgaggaggtcgaatcgtctgcgctcgaatcggaagagttcttaaacaagttccaccatgcccttctcgagctccacctcgaggaaggcgcccttgtttgccctgagaccggtcgccgcttccctgtcagtaagggaatccccaacatgctcctccatgaggacgaggtctgaattttgtgttggtttttttctagtttataattagggttcttggctttgctaataggatcaagtgaagcgatcactgatttgaattggaaaacagggttttgtttcttgggttttgttaattatgaattggagtattacctctttttttatttattttgtttttgtggttgtttttgaagtataattatgtgcaaaaattcgcaaaaaaatgtgggtgacgcttatt

SEQ ID NO: 4162 - DNA, 581 bp, Salvia sclarea
gcacgaggcttttcttcgtcttcgcctgctacgaacagagacgccgttttcaggcgtttggaggtcactgcgtgctacaatacgccgggtattcttgagagagtgaagcccgaaaaacagcaggagagaccaagaatgagactcttaactcataatatgttatcatcaaacatcaaaggtgttaccaatggattcccgcttcggattgaggtggagaaaatggtagagaaggaggtggagttgaacgcagacttcctccggaacatgtttgccaaggttgagtggaaggcactcgtggaggcctcaaaaaccttggggtatactgagctacccgacaatgctgaaccctccatgctcgactctgatgagttcctgcacaggttccaccacgccctcctcgagctccatcttgaggagggcgcattggtctgccctgagactggccggaaattcccggtcaacaaagggatccctaatatgctgcttcatgaagacgaggtttgattgctgcctttgctgaacgtatgtccttgtatggtcgtgtttaggaatatatttgtcgatgttaggatgtaagagca

SEQ ID NO: 4163 - DNA, 784 bp, Cirsium arvense
tcgggaacaaccaacagttatattttcaaagcaaaactggatcgtgtgagaagtgaacttaaggtgagaagcgtaagaaaagatcttgactctggttcacttttaatcccaagcccacccatgactgacgcttgatacggagattgatccggtgcatctcggtgtatcttatctcgcacttcactcctccatctttctccctgtccgccgccaccgaagatacgatgaggctattaactcacaacatgctctcctcaaacatcaagggagtaatcaatggcttccctctccgaatcgaagcagaaagagtcgtcgagaagcaagtcgatttcaatcccgatttcctcaagaacatgttctccaagatcgattggaaagccctagccgacgcttcaaagatcatgggatacgctgaactacctgatgaagtccccgatccttcggtgctcgattccgaggagtttttgcagaaattccaccacgcactcctagagcttcaccttgaggaaggcgcactcgtttgcccggagaccggtcgccggttccctgttaacaaggggatacctaatatgctcctccatgaagatgaggtctgattaacaattccttttgagttttatccgtttattagatcgtatgtaatatgtgtttgaaatacgtggaaattttctgaggtttgaagattatggttctttgggatcactgtgttcctctcgtgttacgaatttagggtttctgaatcttaaaaaattcagtattatgaaaacatgaacattactgattc

SEQ ID NO: 4164 - DNA, 746 bp, Antirrhinum majus
ccgacgccctaagcgttcattattttcaagctcgccggatttagtgcaggactgcaggaaaattaaagtgtccaaagtgtgaagtttctcacaaaaccggaaaaatgaggcttttaactcataacatgctgtcgtcaaacatcaaaggcgtgactaatggcttcccactgagaatcgaggcagagaaagtggtggaaaaggaagttgagttcaatatcgactttcttaaaaacatgtttgccaagattgaatggaagccgttggtggaagccgctaaaaccatggggtactctgagttaccggacaatgtggagtcctccttgctcgattctgatgagttccttcacaagtttcatcatgccctccttgaacttcatcttgaggaaggtgcgctagtatgtcctgagactggtcgtaagtttcctgttagcaaggggattccgaatatgctgcttcacgaagatgaggtctgattgcttgttcaacaaccgaccttgggtttttgtaccatgttaagatttagattttggatgttagggtgttatgagggtgtttgataggtatcattggctgccatactagtcaaaaatgtagttgaatatttgaagggttatgtttttggggagaagagaaacgtgggttgctttttcctagtccatgtttgttttttctgtctacatgaatctatactttagcttggtttcatggatctgagctatgggagtctgagaaatgacatgttatga

SEQ ID NO: 4165 - DNA, 515 bp, Malus domestica
aggctaagatagtgagagagatgaggctgctaacccacaacatgctatcatccaacatcaaaggcgtgaccaacggcttccctctgcgcattgaaatcgagaaggtggtcgaaaagcaggttgaattcaaccccgacttcctcaagaacatgttccctaagatcgagtggaaggcacttgtcaatgcctctcatagtatggggtatgttgagctccctgaggaggttgagccttctaggcttgattctgaagattttcttcacaagttccatcacgcccttttggagcttcatctcgaggagggggcgcttgtctgccctgagactggtcgccgctttccagtgagcaagggcatacccaatatgctacttcatgaagacgaagtgtgattcgcgtcagatggtggatcggacttgccattgctcttcttgtacttactaaaacttagggtttatgtaccgcagattttggcattatgaaatggaatatgctttcgttttgtttagttatgtgtt

SEQ ID NO: 4166 - DNA, 804 bp, Cannabis sativa
tttatatatttatatatattgatacagccgacgtggaatacacttattttaaaccacgttataattagggttagggctttttttttgctgtgttgaaatcagtctgaactgttaagagaaaaaaaagaaaacaagaaaaaatcagtctctgaactctgaagtttggaagagagaatagttgtacaatatgagactccttactcataacatgctctcctctaacatcaagggggtcaccaatggcttccctctccggatcgaagtggtgaaagtggtcgagaaagaggttgaactaaaccccgattttctcaaatccatgttctccaaaattgactggaaagccctagtcgaggccgctcgcgcaatcggctacactgagctccccaacgaggttgatccttctatgctcgactccgacgacttccttcgtcgttttcaccacgccctcctccaacttcacctcgaagaaggcgccctcatctgccccgagactggtcgccggttcccggtcaccaagggaatccccaatatgcttctccacgaggatgaggtttgattggttttaagccacttttagtttagactcactgggtttgaggactgtttctttttccatatacagagtaggactcattatttatttatcaatttttggttaaatctgtatcaaaattaaaaaccttgttctataaatatgtgtttagctttttcgtttctttgttcactatacaagtgttttacttttactagccttaccttcaggatttgagaaatttttagttaatggttataaaactttagata

SEQ ID NO: 4167 - DNA, 664 bp, Cucumis sativus
aaggcttcggttttatcagaattagccgccagactccccatcttccattcttctccgtgagcgccagcggcaacgatcacacactctctcttcacttcaccagcaccctccacaccacgctgccgacttccctccgccgtcctccacggtcgtgaccacggagcacaaccgccgtttaagccgtcgcctccgtttttcgtcagaaccgtctgccagcattgtttgaggtaacttgaagaggagaagatgaggctactgactcataacatgctctcatctaacatcaagggtgtcatcaatggcttccctcttcgaattgaggtcgagaaagttgttgagaagccagttgacttcaatccagacttcctcaagaacatgttctccaagattgaatggaaaccccttgtcgatgcctctcggactatgggctatgccgagcttcccgaggaggccgatgcatcaatgctagactcccatgactttctccaacggtttcaccatgcacttctggagttgcatcttgaggaaggcgctcttttttgcccagagaccaacagaagattccccgtcaataaaggcattcccaatatgcttcttcacgaagacgaggtctgagtttgagattttacaaaatcctctattttctcctatatctaattcaatg

SEQ ID NO: 4168 - DNA, 879 bp, Cucumis melo
gttttacttgagaaataaaaataaaatgaaaacaaggcttcggttttatcagaattagccgccagacttcccatcttccaatttttctccgtgagcgccagcgccaacgaccacacactctctcttcatcttccccagcatcctccacggtcgcgaccacggtgcacaaccgccgtttaggccgtcgccgccgtttgtcgtcagaaccgtctgccagcattgtttgaggtagctagaagaggagaagatgaggctactgactcataacatgctttcatctaacatcaagggtgtcatcaatggcttccctctccgaattgaggtcgagaaagtcgtcgagaagccagtcgacttcaatccagacttcctcaagaacatgttctccaagattgaatggaaacccctcgtcgatgcctctcggactatgggctatgccgagcttcccgaggaggccgatgcatcgatgctagactcccatgactttctccaacgatttcaccatgcacttctagagttgcatcttgaggaaggcgctcttatttgcccagagaccaacagaagattccccgtcaataaaggcattcccaatatgcttcttcacgaagacgaggtctgagtttgagattttacaaattcctctattttctcctattgtattcagtgctgatttttacaaattcctctattttcccaatatgcatcgatgctatcttgggtttcactagacgaagcacagggtctgtcatgagtttggaaatttgggtttacgcctttctttgcttttgttagctgtgaacgagattattagatctttgtttactgatttgataggtgtaaactgcttcggaatatatgatttctatatgaattctagtacta

SEQ ID NO: 4169 - DNA, 792 bp, Mimulus guttatus
aaagggttcttcttcgtctatgccaatctcccaaacactcactattttcagacttcaccgtccgctttttgtctccgccgccgacccacgccaagccagactcctatcgccgccgccgtgcaacttcatagaggagtggtaagaatgaggcttctaactcataatatgctatcgtcgaacatcaagggcgtgactaacggtttcccgttacttatcgaggcggtgaaagtggtggagaaggaagtggatttcaacgaagatttcctcaaaaacatgtttgtgaaagtcgaatggaaggctcttgtagaagcttctagaacccttgggtacaccgagctgccggaaagtgcggaagcttccatgctcgattctgacgagtttcttcgtaagttccaccatgcccttcttgagcttcatctcgaagatggtgcgttggtttgtcctgaaacaggtcgtaaatttcctgtcagcaaaggaatcccgaatatgctgcttcatgaagacgaggtgtagtttgtgacttgaatgagttgttgatgtttagggtcttaaacgggacttttatttacgtgcgagttattggcaatactattcaaaatatgtaaccgaatattttcaagggtttcttcttattgagaaaaatgtgtgattgtcattcccgagtttgtacgttttcgtatccggtaattgttgtgtagattggaattaacgggggcgttttctttatccttcgatttgatatctatttaggcctctttgcttggtataagtgagtcgaatattaatttcgac

SEQ ID NO: 4170 - DNA, 621 bp, Capsicum annuum
gcacgagggacgactgagagtacaatttcaccataaaggcctgtaatatccttccaacgtccaaatgagactgttaactcacaacatgctatcatcgaacatcaagggagtcgcaaatggattcccgttaaagatcgaggttgtgacagttgtcgagaaggaggttgaattcaatatcgaattccttaagaagatgttcagtaaagttgaatggaaggcacttgcggaagcttctagaacaatgggatacaccgagctgcccgaaaatgctgatgcatctatgcttgattcggatgattttctgcataagtttcaccatgcgcttcttgagcttcatctggaagaaggggcgttggtttgtccggagaccggtaggaagtttccggttaataaaggggttcctaatatgctccttcatgaagatgaggtttgattaggttttttttgggtattaatgtgttttggtttggagaaatgggcactattattagggtttaaggggtttgttatgattttatcatcttgattgtagggcgctatcattggaagacattgttgatattaaggtgtaattgtcattacttctttgttgcatcactatatttgagatattgtgttgta

SEQ ID NO: 4171 - DNA, 746 bp, Citrullus lanatus
gctcttaaaaacgggaatatagtatttggtatcgattttcttgtggtgctgtgatactgaatacctattgcctaacaggtaactagaggagtgaaaagatgaggctactgactcataacatgctctcatctaacatcaagggcgttgtcaatggcttccctctccgaatcgaggtcgagaaagtcgtcgagaagcaggtcgacttcaatccagatttcctcaagaacatgttctccaagatcgaatggaagccccttgttgatgcttctcgaactatgggctatgccgagcttcctgaggaggccgaggcatcgatgctagactcccatgattttctgcaacgattccaccatgcacttctagagttgcatctggaggaaggcgctcttatttgcccagagactggccggcgattccctgtcaataaaggtattcccaatttgcttcttcacgaagacgaggtctgagtttgagattttacaaattcctctattttccaattgtattcgatgttagaaaggaaaagcctagagtttcactggaccaagcatagggtatattgtggatgctgtcatgaattgggaaattagggcttaggcctttctttgcttttgtttgctgtgaatgggattattagatctttgtttactaatgtgatgggtgagaactgcttcgtaacacataatttctatacgatttttagtactatgcttaaagcaagaataatgcaaaatgggaaaatcgaa

SEQ ID NO: 4172 - DNA, 2654 bp, Vigna unguiculata
cgactcgctctactcaccaaatattatagtaaaaaaagggatttctactcattggatctcacgtctcaattaagaggagtcatggaaagaacaggttcaaaatcgcgatcaattcctttttcaaatcctgcggcagctgcgcgagctcttcccgcgtgccataaatggcctacaaatagaaagaatcctagaacaaaatgagaagtagctaaccaacttctaggagaaacataattgactgcattaatctctgtagctacgccacccacggaatttaatgaacctaaaggagcatgagtcatatattccgcagaacgacgttcttgccaaggctgtatatcttttttcagtctactcaagtctaaaccattaggaccccttagaggttctaaccaaggagcacgcaaatcccaaaaacgcatagtttctccgccaaaaataacttctccagtcggggaacgcattagatatttacctaaacctgtaggtccttgagcagatcctacattagccccaagacgttggtctctaactagaaaagtaaatgcttgagcttgagaagcttctggaccagtgggcccataaaactcactaggataagcggtattattaaaccagacaaagcaacaagcaataaaaccaaaaacagataaagcacctaaactataagataagtaagcttctccagaccatacaagtgcacgccgagcccatgcaaagggtttggttaagatatgccagattccaccaagtatacaaatggaacccaaccatacatgccctccaataatatcttccaaatcgtccacactaacaatccacccttcgcccccaaaaggcgattttaataaatatccaaatagaatacttggactaagggtcaaattggttatttttcttacatctcccccccccggagcccatgtatcatatatacctccaaaataaagagccttgaatactagaagaaaagcacctatacctaacaagattaagtgaatacccaaaattgtagtcattttatttctatctttccatacataaccgaagaacggaaaagattcttcaagagtctcaggtcccagaagtgcatgataaataccgccaaagcccaatactgcagaggaaattaagtgaagtactccagacacaaagtatggaaaagtgtctataacttcccccccaggacctactccccaacctagagtagctaggtggggaagcaaaattaaaccttgttcatacatgggcttctcgggtacgaaatgagccacttcaaaaaggttcattgctccggcccagaatactattaatccagcatgggctacatgggcccctaatagtttaccagataaattgataagtcgggcattcccggcccaccaagcgaaaccggtagtttcctggtcacgaccagttaaagctaaagttccattaaagagcgtttccacgtggtagaacctcctcagggaatataaggttttcatgaggctgatcttgagctgccatccacgcacgaataccttcgtttaagagaatattttttgtgtagaaagtctcaaattcaggatcttccgctgcgcggatttcttgagaaacgaagtcataagcacgtaggttcagggccaaaccgactaccccaagagcactcatccataaaccagttactggtacaaataacataaagaaatgtaaccaacgtttattggaaaaagcaaccccaaagatttgggaccaaaagcgattagcagtaaccattgaataagtttcttcagcttgggttgggttaaaagcacggaatgtatttgcgccatcaccatcttcaaataaagtattttctacggttgcaccatgaatagcgcatagtagtgcagcgcccaatacaccagcaactcccatcatatgaaatgggtttaatgtccaattatgaaatccttggaaaaagaggatgaatcgaaatatagctgctacaccaaaacttggagcaaagaaccaaccagactgacccagtggataaataaggaatacagaaacaaaaacagcaattggacctgagaatgcgattgcattataaggtcgcaattgaacagatcgagcaagttcaaattgacgtaacatgaaacctattaatccgaaagcaccgtggagagcaacaaaagtccacagaccgcctaactgacaccaacgggtaaaatctccctgtgcttcaggaccccacagtaacaacaaagagtgtgctaaactattagcgggagtggaaactgcagcggttaagaagttgcagccttctaaataagaacttgccaagccgtgagtataccatgaagttacaaaggtcgtacctgtaaaccaaccccccaaggcgaaataggcgcaaggaaagagtaatagaccggaccaacccacaaaaacgaaacggtccctccgcaaccagtcatccataatatcaaataaatcattttcatctttggtaaatttaccaagagctatagtcatagcgatcctcctattcaactacttcaaccatttcccaacacctcatagagcattttcagagatgggacggaccttgatcatttatctctattcatttctctctctatatatatatagaatatataagtatactttcccttgttttctaatcggtttcg

SEQ ID NO: 4173 - DNA, 1991 bp, Glycine max
atgaaaaccttatattccctgaggaggttctaccacgtggaaacgctctttaatggaactttagctttaactggtcgtgaccaggaaactaccggtttcgcttggtgggccgggaatgcccgacttatcaatttatccggcaaactactaggagcccatgtagcccatgctggattaatagtattctgggccggagcaatgaacctttttgaagtggctcatttcgtacccgagaagcccatgtatgaacaaggtttaattttacttccccatctagctactctaggttggggggtaggtcctgggggggaagttatagacacctttccatactttgtgtctggagtacttcacttaatttcctctgcagtattgggctttggcggtatttatcatgcacttttgggacctgagactcttgaagaatcttttccattcttcggttatgtatggaaagatagaaataaaatgactacaattttgggtattcacttaatcttgttaggtataggtgcgtttcttctagtattcaaggctctttattttggaggtatatatgatacgtgggctccggggggcggagatgtaagaaaaataaccaatttgacccttagtccaagtattatatttggatatttattaaaatcaccttttgggggagaagggtggattgttagtgtggacgatttggaagatataattggggggcatgtatggttgggttccatttgtatacttggtggaatctggcatatcttaaccaaaccttttgcatgggctcggcgtgcacttgtatggtctggagaagcttacttatcttatagtttaggtgctttatctgtttttggttttattgcttgttgctttgtctggtttaataataccgcttatcctagtgagttttacgggcccactgggccagaagcttctcaagctcaagcatttacttttctagttagagaccaacgtcttggggctaatgtaggatctgctcaaggacctacaggtttaggtaaatatctaatgcgttccccgacaggagaagttatttttgggggagaaactatgcgtttttgggatttgcgtgctccttggttagaacctctaaggggtccgaatggtttagacttgagtagactgaaaaaagatatacagccttggcaagaacgccgttctgcggaatatatgactcatgctcctttaggttccttaaattccgtgggtggcgtagctacagagattaatgcagtcaattatgtttctcctagaagttggttagctacttctcattttgttctaggattcttcctatttgtaggccatttatggcacgcgggaagagctcgcgcagctgccgcaggatttgaaaaaggaattgatcgagattttgaaccagttctttccatgactcctcttaattgagacatgagatcctatgaagtagaaatcacttttattttactataaatattactataaatattgggttgaattgagcgggtcgtatttaaataagaatttcttttccttttttcttagtttctatcgaaaaaaaaaagattcgatagaaactaagaaaataaacaaattgattcgccgagaaagaggagagagagggattcgaaccctcgatagttctttgttccgaactataccggttttcaagaccggggctatcaaccactcagccatctctccaaaagctaatttatattttatctttattccactgaatagaacatgagcatataaatggataccctttatattatctatctttatattatctataaagggtaaagatatccgatgtgaatctatttgtttagttttctatcggtatgtatataggtgaataatccaacatgcctttttgtgaagtaaaaaaactaccctcgatccatgcctcaaaagggttgataataagtaaaaaaaatcaatgaattcatgataaaacccttctgcgtttttttattataaatttttttgtc

SEQ ID NO: 4174 - DNA, 2648 bp, Cajanus cajan
gatcactatgactatagctcttggtaaatttaccaaagatgaaaatgatttatttgatattatggatgactggttacggagggaccgtttcgtttttgtaggttggtccggtctattgctctttccttgcgcctatttcgccgtggggggttggttcacaggtacaacctttgtaacttcatggtatactcatggattggcaagttcctatttggaaggttgcaacttcttaaccgctgcagtctctactcctgctaatagtttagcacactctttgttgttactatggggtcccgaagcacaaggagattttacccgttggtgtcaattaggcggtctgtggacttttgttgctctccacggtgctttcggattaataggtttcatgttacgtcaatttgaacttgctcgatctgttcaattgcggccttataatgcaatcgccttctctggtccaattgcagtttttgtttctgtattcctgatttatccactgggtcagtctggttggttctttgcgcctagttttggtgtagcagctatatttcgattcatcctctttttccaagggtttcataattggacattgaacccatttcatatgatgggagttgctggtgtattgggcgctgcgctactatgcgctattcatggtgccaccgtagaaaatactttatttgaagatggtgatggcgcaaatacattccgtgcttttaacccaacccaagctgaagaaacttattcaatggttactgctaaccgcttttggtcccaaatctttggggttgctttttccaataaacgttggttacatttctttatgttatttgtaccagtaactggtttatggatgagtgctcttggagtagtcggtctggccctgaacctacgtgcctatgacttcgtttctcaagaaatccgcgcagcggaagatcctgaatttgagactttctacaccaaaaatattctcttaaacgaaggtattcgtgcgtggatggcggctcaagatcagcctcatgaaaaccttatattccctgaggaggttctaccacgtggaaacgctctttaatggaactttagctttaactggtcgtgaccaagaaactaccggtttcgcttggtgggccgggaatgcccgacttatcaatttatccggtaaattattaggggcccatgtagcccatgctggattaatagtattctgggccggagcaatgaacctttttgaagtggctcatttcgtacccgagaagcccatgtatgaacaaggtttaattttacttccccatctagctactctagggtggggggtaggtcctggaggggaagttatagacacctttccatactttgtgtctggagtacttcacttaatttcttctgcagtattgggctttggcggcatttatcatgcacttctgggacctgagactcttgaagaatcttttccattcttcggttatgtatggaaagatagaaataaaatgactacaattttgggtattcacttaatcttgttaggtataggtgcttttcttctagtattcaaggctctttattttggaggtgtatatgatacctgggctccaggggggggagatgtaagaaaaattaccaacttaacccttagtccaagtattatatttggttatttactaaaatcaccttttggaggagaagggtggattgttagtgtagacgatttggaagatataattggaggacatgtatggttgggttccatttgtatacttggtggaatctggcatatcttaaccaaaccttttgcatgggcgcgccgtgcacttgtatggtctggagaagcttacttgtcttatagtttaggtgctttatctgtttttggttttattgcttgttgctttgtttggtttaataataccgcttatcctagtgagttttacgggcccactggaccagaagcttctcaagctcaagcatttacttttctagttagagaccaacgtcttggggctaacgtaggatctgctcaaggacctaccggtttaggtaaatatctaatgcgttccccgaccggagaagttatttttgggggagaaactatgcgtttttgggatctacgtgctccctggttagaacctctaaggggtcccaatggtttggacttgagtagactgaaaaaagacatacagccttggcaagaacgtcgctccgcggaatatatgactcatgctcccttaggttctttaaattccgtgggtggcgtagctacagagatcaatgcagtcaattatgtatcgcctagaagttggttagctacctctcattttgttctaggattcttcctattcgtaggtcatttatggcacgcgggaagagctcgcgcagctgcagcaggatttgaaaaaggcattgatcgggattttgaacctgttctttccatgactcctcttaattgagacatgagatccaatgcaatgcttgaagtaggaatcactttgatttcaccatacatgttgggttgagtggagcaggtcatattgaaaaagtattcccttttcctttcttttcaactcatttatatctaatctttttgggctcggctataccaccacttagccgagccattcccttttagaaaataaactgagccaaccaaaaccataaaa

SEQ ID NO: 4175 - DNA, 3453 bp, Cajanus cajan
aggtcgttcttgtaaaagcccaattttccgatctgaggtgttgggaaatggttgaagtagttgaataggaggatcactatgactatagctcttggtaaatttaccaaagatgaaaatgatttatttgacattatggatgactggttgcgcagggatcgtttcgtttttgtgggttggtctggtctattactctttccttgcgcctatttcgccttggggggttggttcacaggtacaacctttgtaacttcatggtatactcatggattggcaagttcttatttggaaggatgcaacttcttaaccgcagcagtctccactcctgctaatagcttagcacactctttgttgttactgtggggtcctgaagcacagggagattttacccgttggtgtcaattaggtggtctgtggacttttgttgctctccacggtgctttcggattaataggtttcatgttacgtcaatttgaacttgctcgatctgttcaattgcggccttataatgcaattgcattctcaggtccaattgctgtttttgtttctgtattccttatttatccactgggtcagtctggttggttctttgctcctagttttggtgtagcagctatatttcgatttatcctatttttccaggggtttcataattggacattaaacccatttcatatgatgggagttgctggtgtattgggcgctgcgctactatgcgctattcatggtgccaccgtagaaaatactttatttgaagatggtgatggcgcaaatacattccgtgcttttaacccaacccaagctgaagaaacttattcaatggttactgctaaccgcttttggtcccaaatctttggggttgctttttccaataaacgttggttacatttctttatgttatttgtaccagtaactggtttatggatgagtgctcttggagtagtcggtctggccctgaacctacgtgcctatgacttcgtttctcaagaaatccgcgcagcggaagatcctgaatttgagactttctacaccaaaaatattctcttaaacgaaggtattcgtgcgtggatggcggctcaagatcagcctcatgaaaaccttatattccctgaggaggttctaccacgtggaaacgctctttaatggaactttagctttaactggtcgtgaccaagaaactaccggtttcgcttggtgggccgggaatgcccgacttatcaatttatccggtaaattattaggggcccatgtagcccatgctggattaatagtattctgggccggagcaatgaacctttttgaagtggctcatttcgtacccgagaagcccatgtatgaacaaggtttaattttacttccccatctagctactctagggtggggggtaggtcctggaggggaagttatagacacctttccatactttgtgtctggagtacttcacttaatttcttctgcagtattgggctttggcggcatttatcatgcacttctgggacctgagactcttgaagaatcttttccattcttcggttatgtatggaaagatagaaataaaatgactacaattttgggtattcacttaatcttgttaggtataggtgcttttcttctagtattcaaggctctttattttggaggtatatacgatacatgggctccggggggcggagatgtaagaaaaataaccaatttgacccttagtccaagtattatatttggatatttattaaaatccccttttggaggagaaggatggattgttagtgtggacgatttggaagatataattggagggcatgtatggttgggttccatttgtatatttggtggaatctggcatatcttaaccaaaccctttgcatgggctcggcgtgcacttgtatggtctggagaagcttacttatcttatagtttaggtgctttatctgtttttggttttattgcttgttgctttgtttggtttaataataccgcttatcctagtgagttttacgggcccactggaccagaagcttctcaagctcaagcatttacttttctagttagagaccaacgtcttggggctaacgtaggatcggctcaaggaccgacaggtttaggtaaatatctaatgcgttctcccactggagaagttatttttgggggagaaactatgcgtttttgggatttgcgtgctccttggttagaacctctaaggggtcccaatggtttagacttgagtagactaaaaaaagacatacagccctggcaagaacgtcgttccgcggaatatatgactcatgctcctttaggttccttaaattccgtgggtggcgtagctacagagattaatgcagtcaattatgtctctcctagaagttggttagctacttctcattttgttctaggattcttcctatttgttggccatttatggcacgcgggaagagctcgtgcagctgctgcaggatttgaaaaaggaattgatcgagattttgaacctgttctttccatgactcctcttaattaagatatgagatccaatgaagtagaaatcacttcaatcttactatacatattgggttgagttgagcaggtcgtattgaaatcagatttttcctttttttctcatttctatctaatcttttcgggttgggctatatcatcacgtagcccagcccgaaaagattagatagaaactactcaaatataaaaatatattcgccgagaaaaaggagagagagggattcgaaccctcgatagttctttgtttcgaactataccggttttcaagaccggggctatcaaccactcagccatctctccaaaagataatttctattttatctttattccactgaatagaacatgagcatatgaattgataccctttttatattatctatccgcggtaaaggtatctcatgtgaatctatcgatttagttgtctatcggtatgtatatagatgcaaaatccagcaggcctttttgtgaagtaaaaaaaactaccctcgatccatgcctcaaaagggttgataataagtcataaaaaataaaaaagaattcttgagaaaacccttttgcgtttttattaccaatttttttgtcgataagggggattaaattaaggggtggggggatcaaatggtatagttcttttgttggtaaattggaggattagaaacatgactattgctttccaattagctgtttttgcattaattgctatttcatttattttattgattagtgtacctgttgtatttgcttctcccgaaggttggtcgagtaacaaaaatgttgtattttccggtacatcattatggattggattagtatttctagtgggtattcttaattctctcatttcttgaagctatttattctagatcaaaaaacgaaatgacccctcccccagaattctttcggattgtcaggcacattaaaaaaacggaatagataagtccctaaaaa

SEQ ID NO: 4176 - DNA, 1500 bp, Cajanus cajan
caccaaaaatattctcttaaacgaaggtattcgtgcgtggatggcggctcaagatcagcctcatgaaaaccttatattccctgaggaggttctaccacgtggaaacgctctttaatggaactttagctttaactggtcgtgaccaagaaactaccggtttcgcttggtgggccgggaatgcccgacttatcaatttatccggtaaattattaggggcccatgtagcccatgctggattaatagtattctgggccggagcaatgaacctttttgaagtggctcatttcgtacccgagaagcccatgtatgaacaaggtttaattttacttccccatctagctactctagggtggggggtaggtcctggaggggaagttatagacacctttccatactttgtgtctggagtacttcacttaatttcttctgcagtattgggctttggcggcatttatcatgcacttctgggacctgagactcttgaagaatcttttccattcttcggttatgtatggaaagatagaaataaaatgactacaattttgggtattcacttaatcttgttaggtataggtgcttttcttctagtattcaaggctctttattttggaggtatatacgatacatgggctccggggggcggagatgtaagaaaaataaccaatttgacccttagtccaagtattatatttggatatttattaaaatccccttttggaggagaaggatggattgttagtgtggacgatttggaagatataattggagggcatgtatggttgggttccatttgtatatttggtggaatctggcatatcttaaccaaaccctttgcatgggctcggcgtgcacttgtatggtctggagaagcttacttatcttatagtttaggtgctttatctgtttttggttttattgcttgttgctttgtttggtttaataataccgcttatcctagtgagttttacgggcccactggaccagaagcttctcaagctcaagcatttacttttctagttagagaccaacgtcttggggctaacgtaggatcggctcaaggaccgacaggtttaggtaaatatctaatgcgttctcccactggagaagttatttttgggggagaaactatgcgtttttgggatttgcgtgctccttggttagaacctctaaggggtcccaatggtttagacttgagtagactaaaaaaagacatacagccctggcaagaacgtcgttccgcggaatatatgactcatgctcctttaggttccttaaattccgtgggtggcgtagctacagagattaatgcagtcaattatgtctctcctagaagttggttagctacttctcattttgttctaggattcttcctatttgttggccatttatggcacgcgggaagagctcgtgcagctgctgcaggatttgaaaaaggaattgatcgagattttgaacctgttctttccatgactcctcttaattaagatatgagatccaatg

SEQ ID NO: 4177 - DNA, 3483 bp, Cajanus cajan
tttgacccctccctataattttttcattttctttatttgcattttgggggcttagattccattttaatgtgtctcacaatccgaaagaattcgggggaggggtcatttcatttttagatctagaacaaataggttcaagagatgagagaattaagaatacccactagaaagactaatccaatccataatgatgtaccggaaaatacaacatttttgttactcgaccaaccatcaggagaagcaaatacaacagggacaccaatcagtaaaattgatgaagtagcaattaatgcaaaaacagccaattggaaagcaatagtcatgtttctaatcctccaatttaccaacaaaagaactataccatttgagccctttatcgacaaaaaatttgtaataaaaaaaatgtatcatagagggttttaccatgaatgacttattaccaccccctttcgggcatggatcgagggtagtttttttttttacttcacattcacaaaagggcatgctggatcctgcatgtatatatacagatagaaaaatagacctatagattcacaccggatatctttcctatagataggaagggtatcaactcatatggtcatgttctattcggtggaataacgataaaatagaaattagcttatggagagatggctgagtggttgatagctccggtcttgaaaaccggtatagttcgaaacaaagaactatcgagggttcgaatccctctctctccttttgctcggcaaatggatttttttatggttttggttggctcagtttattttctaaaagggaatggctcggctaagtggtggtatagccgagcccaaaaagattagatataaatgagttgaaaagaaaggaaaagggaatactttttcaatatgacctgctccactcaacccaacatgtatggtgaaatcaaagtgattcctacttcaagcattgcattggatctcatgtctcaattaagaggagtcatggaaagaacaggttcaaaatcccgatcaatgcctttttcaaatcctgctgcagctgcgcgagctcttcccgcgtgccataaatgacctacgaataggaagaatcctagaacaaaatgagaggtagctaaccaacttctaggcgatacataattgactgcattgatctctgtagctacgccacccacggaatttaaagaacctaagggagcatgagtcatatattccgcggagcgacgttcttgccaaggctgtatgtcttttttcagtctactcaagtccaaaccattgggaccccttagaggttctaaccagggagcacgtagatcccaaaaacgcatagtttctcccccaaaaataacttctccggtcggggaacgcattagatatttacctaaaccggtaggtccttgagcagatcctacgttagccccaagacgttggtctctaactagaaaagtaaatgcttgagcttgagaagcttctggtccagtgggcccgtaaaactcactaggataagcggtattattaaaccaaacaaagcaacaagcaataaaaccaaaaacagataaagcacctaaactataagacaagtaagcttctccagaccatacaagtgcacggcgcgcccatgcaaaaggtttggttaagatatgccagattccaccaagtatacaaatggaacccaaccatacatgtcctccaattatatcttccaaatcgtctacactaacaatccacccttctcctccaaaaggtgattttagtaaataaccaaatataatacttggactaagggttaagttggtaatttttcttacatctcccccccctggagcccaggtatcatatacacctccaaaataaagagccttgaatactagaagaaaagcacctatacctaacaagattaagtgaatacccaaaattgtagtcattttatttctatctttccatacataaccgaagaatggaaaagattcttcaagagtctcaggtcccagaagtgcatgataaatgccgccaaagcccaatactgcagaagaaattaagtgaagtactccagacacaaagtatggaaaggtgtctataacttcccctccaggacctaccccccaccctagagtagctagatggggaagtaaaattaaaccttgttcatacatgggcttctcgggtacgaaatgagccacttcaaaaaggttcattgctccggcccagaatactattaatccagcatgggctacatgggcccctaataatttaccggataaattgataagtcgggcattcccggcccaccaagcgaaaccggtagtttcttggtcacgaccagttaaagctaaagttccattaaagagcgtttccacgtggtagaacctcctcagggaatataaggttttcatgaggctgatcttgagccgccatccacgcacgaataccttcgtttaagagaatatttttggtgtagaaagtctcaaattcaggatcttccgctgcgcggatttcttgagaaacgaagtcataggcacgtaggttcagggccagaccgactactccaagagcactcatccataaaccagttactggtacaaataacataaagaaatgtaaccaacgtttattggaaaaagcaaccccaaagatttgggaccaaaagcggttagcagtaaccattgaataagtttcttcagcttgggttgggttaaaagcacggaatgtatttgcgccatcaccatcttcaaataaagtattttctacggtggcaccatgaatagcgcatagtagcgcagcgcccaatacaccagcaactcccatcatatgaaatgggttcaatgtccaattatgaaacccttggaaaaagaggatgaatcgaaatatagctgctacaccaaaactaggcgcaaagaaccaaccagactgacccagtggataaatcaggaatacagaaacaaaaactgcaattggaccagagaaggcgattgcattataaggccgcaattgaacagatcgagcaagttcaaattgacgtaacatgaaacctattaatccgaaagcaccgtggagagcaacaaaagtccacagaccgcctaattgacaccaacgggtaaaatctccttgtgcttcgggaccccatagtaacaacaaagagtgtgctaaactattagcaggagtagagactgcagcggttaagaagttgcaaccttccaaataggaacttgccaatccatgagtataccatgaagttacaaaggttgtacctgtgaaccaaccccccacggcgaaataggcgcaaggaaagagcaatagaccggaccaacctacaaaaacgaaacggtccctccgtaaccagtcatccataatatcaaataaatcattttcatctttggtaaatttaccaagagctatagtcatagtgatcctcctattcaactacttcaaccatttccgaacacctcataccattttcagggccagggccttctttatcatttct

SEQ ID NO: 4178 - DNA, 3026 bp, Lotus japonicus
aaaaaataatataaatatataaatgaaataaagcaactcgaaggtcctgtccttgaaaatattatgaggtgttcgaaaatggttgaagtagttgaataggaggatcactatgactatagctcttggtaaatttaccaaagatgaaaatgatttatttgatattatggatgactggttacgtcgggaccgtttcgtttttgtgggttggtccggtctattgctcttcccttgtgcctatttcgccttggggggttggttcacaggtaccacctttgtaacttcatggtatactcatggattggcaagttcctatttggagggctgtaatttcttaaccgctgcagtttcgacccctgctaatagtttagcacactctttgttgttactatggggtcctgaagcacagggagattttacccgttggtgtcaattaggaggtctgtggacttttgttgctctccacggtgctttcggattaataggtttcatgttacgtcaatttgaactcgctcgatctgttcaattacggccttataatgcaattgcattttctggtccaattgctgtttttgtttctgtattcctgatttatccactaggtcagtctggttggttctttgcacctagttttggtgtagcagctatatttcgattcatcctctttttccaagggtttcataattggacattgaacccatttcatatgatgggagttgcaggtgtattgggcgctgccctactatgcgctattcatggtgctaccgtggaaaatacattatttgaagatggtgatggcgcaaatacattccgtgcttttaacccaacccaagctgaagaaacttattcgatggtcaccgctaaccgtttttggtctcaaatctttggggttgctttttccaataaacgttggttacatttctttatgttatttgtaccagtaactggtttgtggatgagtgctcttggagtagtcggtctggccctgaacctacgtgcctatgatttcgtttctcaagaaatacgcgcagcggaagatcctgaatttgagactttctacacaaaaaatattctcttaaacgaaggtattcgtgcgtggatggcagctcaagatcagcctcatgaaaaccttatattccctgaggaggttctaccacgtggaaacgctctttaatggaactttagctttaaccggtcgtgaccaagaaactaccggttttgcttggtgggccgggaatgcccgacttatcaatttatctggtaaacttctgggggcccatgtagcccatgctggattaatagtattctgggccggagcaatgaacctatttgaagtggctcattttgtacccgagaagcccatgtatgaacaaggcttaattttacttccccatctagctactctaggttggggggtcggtcctgggggagaggttatagacaccttcccatactttgtttctggagtacttcacttaatttcctctgcggtattaggatttggcggtatttatcatgcacttctgggacctgagactcttgaagaatcttttccatttttcggttatgtatggaaagatagaaataaaatgactaccattttgggtattcacttaatcttgttaggtataggggcttttcttctagtattcaaggcttcttattttgggggtatatatgatacttgggctcccgggggaggagatgtaagaaaaattaccaatttgacccttagtccaagtattatatttggttatttactaaaatcaccttttgggggagaggggtggattgttagtgtggacgatttggaagacataattgggggacatgtatggttgggttccatttgtatacttggtggaatctggcatattttaacaaaaccctttgcatgggctcggcgtgcactagtatggtctggagaagcttacttgtcttatagtttagcagctttatccgtttttggttttattgcttgttgctttgtctggtttaataataccgcttatcctagtgagttttatggacccactggaccagaagcttctcaagctcaagcatttacttttctagttagagaccaacgtcttggggctaatgtaggatccgctcaagggcctaccggtttaggtaaatacctaatgcgttctccgaccggagaagtcatttttggaggagaaactatgcggttttgggatcttcgtgctccttggttggaacctctaaggggtccaaatggtttggacttgagtagactcaaaaaagacatacagccttggcaagaacgtcgttccgcggaatatatgactcacgctcctttaggttccttaaattccgtggggggtgtagctacggagatcaatgcagtcaattacgtttctcctagaagttggttagctacttctcactttgttctaggattctttctattcgtgggtcatttatggcacgctggaagagctcgcgcagctgccgcgggatttgaaaaaggaattgatcgagattttgaacctgttctttccatgactccacttaattgagacatgagatctaatgcttgacgtagtaatcattttgatttgactatatattgggttgagtggagcagatcatattgaaaaagtattttcttttcaacttatttatatatctaattttttcgggcttggctaagtggtgatatagccaagcccgaaaaaacgagccaaccaagaatcaaaaaaaaaaccattcgacaaaaaaaggagagagagggattcgaaccctcgataattctttcaaactataccggttttcaagaccggggctatcaaccactcagccatctctccaaaagctaatttctattttatcgttattccactgaatagaacataaccatacgaatagataccccctttttaccctatctatagtaaagatatctggtgtgaatcttctattggtctagttttgtatctatatatatatatatacatgatccaacatgcccgtttgttttgtttgtgaagtaaaaaaaaaaaact

SEQ ID NO: 4179 - DNA, 4228 bp, Arachis hypogaea
cgcctatttcgctttggggggttggttcacaggtacaacctttgtaacttcatggtatactcatggattggcaagttcctatttggaaggctgtaacttcttaaccgctgcagtctctactcctgctaatagtttagcacactctttgttgttactatggggtcctgaagcacaaggagattttacccgttggtgtcaattaggtggtctgtggacttttgttgctctccacggcgctttcgcattaataggtttcatgttacgtcaatttgaacttgctcgatctgttcaattgcgcccttataatgcaatcgcattctctggtccaattgctgtttttgtttccgtattcctgatttatccactgggtcagtctggttggttctttgcacccagttttggtgtagcagctatatttcgattcatcctatttttccaagggtttcataattggacattaaacccatttcatatgatgggagttgctggtgtattgggcgctgcactactatgcgctattcatggtgctaccgtggaaaatactttatttgaagatggtgatggcgcaaatacattccgtgcttttaacccaacccaagctgaagaaacttattcaatggtcaccgctaaccgcttttggtcccaaatctttggggttgctttttccaataaacgttggttacatttctttatgttatttgtacctgtaactggtttatggatgagtgctcttggagtagtcggcctggccttgaacctacgtgcctatgacttcgtttctcaagaaatacgtgcagcagaagatcctgaatttgagactttctacaccaaaaatattcttttaaacgaaggtattcgcgcgtggatggcggctcaagatcagcctcatgaaaaccttatattccctgaggaggttctaccacgtggaaacgctctttaatggaactttagctttaacaggtcgtgaccaagaaactaccggtttcgcttggtgggccggaaatgcccgacttatcaatttatccggtaaactactgggagctcatgtagcccatgccggattaatagtattctgggccggagcaatgaacctatttgaagtggctcatttcgtacccgagaagcccatgtatgagcaaggcttaattttacttccccatctagcaactctaggttgggggtaggtcctgggggggaggttatagacacctttccatactttgtgtccggagtacttcacttaatttcctctgcagtattgggctttggtggtatttatcatgcacttctgggacctgagactcttgaagaatcttttccattcttcggttatgtatggaaagatagaaataaaatgactacaattttaggtattcacttaatcttgttaggcataggtgcttttcttctagtattcaaggctctttattttgggggtatatatgatacctgggctccgggaaggggggatgtaagaaaaattaccaacttgacccttagtccaagtattatatttggttatttactaaaatcaccttttggaggagagggatggattgttagtgtggacgatttggaagatataattggggggcatgtatggttgggttcgatttgtatacttggtggaatttggcatattttaaccaaaccttttgcgtgggctcggcgtgcacttgtatggtccggagaagcttatttgtcttatagtttaggtgctttatctgtttttggctttattgcttgttgctttgtctggtttaataataccgcttatccgagtgaattttacgggcccactggtccagaagcttctcaagctcaagcatttacttttctagttagagaccaacgtcttggggctaatgtaggatccgctcagggacctaccggtttaggtaaatatttaatgcgttccccgaccggagaagtaatttttgggggagaaactatgcgtttttgggatctacgtgctccctggttagaacctctaagaggtcccaatggtttggacttgagtagacttaaaaaagacatacagccttggcaagaacgtcgttccgcggaatatatgactcatgctcctttaggttctttaaattccgtgggtggcgtagctaccgagatcaatgcagtcaattatgtctctcctagaagttggttagctacttctcattttgttctaggattcttcctattcgtaggtcatttatggcacgcgggaagagctcgcgcagctgccgcaggatttgaaaaaggaattgatcgcgattttgaacctgttctttccatgactcctcttaattgagatatgagatctaatgcttgaagtaggaatcacgttgattttaccatacatatagggttgagtcgagcgggtcagattaaaatcaaaaataaaaagtattttacttctcgttttaatccatttctatctaatctaattatatcgaaattctgaatcttttttttttcgggctcggctaagtggtagtatcgccgagcccgaaaaaaccgaaccaaccaaaaccaataaaagaaaaagaatactttcgtcgagcaaaaacaaaaggagagagagggattcgaaccctcgatagttcgtgttgtgaactataccggttttcaagaccggggctatcaaccactcagccatctctccaaccaaaaagccaatttctattttatctttattctactgaatagaacataactatatgaattaatatagttagtatcgatcgatgatcgatggcatagatatccagtgtgaatcaattggtcacttttaattcttcaaaatattatagaagatgcatgatccagcatgtctttttctgaaataaaaacaaaccttcgatccatgcctaaaaagaaaggggtaggtaatacgtcatataaaatcaatagattcatgataaaaccccaaaatatgttttttattacaattttttttgataacggaatcgaggagttgggatcaaatggtatagttttcttttgttggtaaattggaggattagaaacatgactatagctttccaattggctgtttttgcattaattgctacttcattaattttattgattagtgtaccggttgtatttgcttctcctgatggttggtcaagtaacaaaaatgttgtattttccggtacctcattatggattgtattagttttttagtgggtattcttaattctatcatctcttgaagctatttgttatagatcgaaaaatgaactgaaatgacccctccccacgaattctttcgaattgtgaggcacattaaaattaaaaaatggaatatataagcccccaaataaaaataaagaaaactaagacattatagggaggggtcaaacttttttttctattggaaaaatcttctatacttaatatttatatcatcttatatttatatatagggagggtatattgttatggtatattgtaaaacttaaaaacaaatctcaaaatagaaattgaattcaactttcaaaatctataaatttaatataattaaatttatagaataaaatcacaaaataaaaaaaatagtaatagaaaaatgaatttgaatattcaataggagtaatatattcagatttatagattttattaatctattaaatttcgaatctattcgaaatcctctataaagattctcttctcaaattgaatactattcaatactattctatttatttattctatttatacgactaatttctacgattaatccttttatattataagtattaatatagaagtattaatagaaagaactattactaaattaatcttctattaatagataaatccttattaatagaatagggagatctcatatatatatttcatatattttccatttttcgactttctttcaaattacgcctaacggagtatcaaacctagctctgcacaaataagattgatatattacgtatcaaatacgattcaaaaatgcggatatagtcgaatggtaaaatttctctttgccaaggagaagacgcgggttcgattcccgctatccgcccctgcccttagtactttattaaatcgattattaaattattaaaaagtaataaaaattgttagagttgactgtgatagtatctcccccccttttcttgaattcctgcttttatcaaaaactgttgcggagacgggatttgaacccgtgacctcaaggttatgagccttgcgagctaccaagctgctc

SEQ ID NO: 4180 - DNA, 5947 bp, Cicer arietinum
gatcagaaaatttttgggccgagctggatttgaaccagcgtagacatattgccaacgaatttacagtccgtccccattaacccctcgggcatcgacccaagaagaatctatttaattctttattgataatccctgatccatttcctttcgtagtaccctacccccaggggaagtcgaatccccgttgcctccttgaaagagagatgtcctaaaccactagacgatgggggcatgcttgcccgaccgccattctactatgctcatagtatgaacagttttttgaaattgtcaatataatggaatgatatgattcgatcagaagtatctttccatttcagaattccttaaaattttttgattcaccatttctatttggaaattgttcattccaactaccaattaagtaatccgaaagaaaacaaaagaaagagagaatcctttcggggaatggttgatttgctggaacaggccaggcattaaaaccaaatttctttcactttcattcaatgttaagaaggttgaattaggtatatttctatatcatcctaagccgggaattaaaaaaacgaaaaaaaatctggaaattagataattaaaggataaggatcaataagaattgggttgagggacaggacaaatggaatctatttatcaacgattcgatgaaatatttaaattaatgggtacatgtttcaatgaaatgaatttcgtgttaggatgaggattacttcaattcgaattggtaaaaaaaaaacattccattgatatttatcaaatcctatatcaataaatagtttttttaacttttaactatagtatttactaggtaaatcctatttattgttccttaatgagtgagtagaaaaaatagatctatgtacatatattctaatgtgatttatatatatatatatattaatcaaataagtatatctatataattaagtatatgcagtaacaaatacatgtactaaactcatattcatattggctggttccttattcgagaattgattcaaacggggcccttttaactcagtgtggtagagtaacgccatggtaaggcgtaagtcatcggttcaaatccgataaggggctttttttgtcataaaatgacaacagtaattttcctatttgaagtcagaatagagatattcgtgatatttgtaagaagtttccgtttgtaattaaaaaaaaaactaaggaatagtttaatttcatgaaaaaatcgaattttaattctaatctaaaaggaattctagttagaaagtgaaatagtattctttagctatctatatatatatatttagagatatttcctttaattgtcagatatttctattttggtccaataaaaaaatacgaaagattctaaaaaaagtaagtggacctaacccattgaatcataactatatctactattctgatattcaaattcgatagaaataaaattcgatacaatatttaaaaatttgacagatagataaaaaaaataaatagaaaaaaatattcgaatttcttacctggatctgcaaaaaagtatactttgggatttttttaatatgaacgaaacaaaaaaagaacaaagaagacaataaaagaaataaatgtcaaatagaaagaaaaaatatgatcctctagttgtttcctagacatacacaatataaaaaacccctttttttttatttcacgaacaacattcaagaataagataagattatttgataaaaggagagtagtatatctggggatccgctgggaacgagagtgataaaagcgatcatttgtttctggaacagttctttaaataatttatttataggatttacgagtcagaagtcaattcccaattcatgatttagggaatttgaaaaagaatagaaaggaataaccaaatgaagttcagggattttacatagattaggtatcaatcgacaaaaaaagggatttttctattcgaaacccagtagaaaagaaggggcagtctacgagaaatcatatcatatgtaaaatgaaaaaagactcgaagattccatccctgaaaatgctaggaggtgttcggaaatggttgaagtagttgaataggaggatgactatgactatcgctcttggtaaatttaccaaagatcaaaatgatttatttgatattatggatgactggttacggagggaccgtttcgtttttgtgggttggtctggtctattgctttttccttgcgcctatttcgccgtggggggttggttcacaggtaccacctttgtaacttcatggtatactcatggattggcaagttcctatttggaaggttgtaacttcttaactgctgcagtctctactcctgctaatagtttagcacactctttgttgttactttggggtcctgaagcacaaggagattttacccgttggtgtcaattaggtggtctgtggacttttgttgctctccacggtgctttcggattaataggttttatgttacgtcaatttgaacttgctcgatctgttcaattgcggccttataatgcaatcgcattctccggtccaattgctgtttttgtttctgtattccttatttatccactgggtcagtctggttggttctttgcacctagttttggtgtagcagctatatttcgattcattctctttttccaagggtttcataattggacattgaacccatttcatatgatgggcgttgctggtgtattgggtgctgccctactatgcgctattcatggtgctaccgtagaaaatactttatttgaagatggtgatggcgcaaatacattccgtgcttttaacccaacgcaagcggaagaaacttattcaatggtcaccgctaaccgcttttggtcccaaatttttggggttgctttttccaataaacgttggttacatttctttatgttatttgtaccagtaactggtttatggatgagtgctcttggagtagtcggtctggccctgaacctacgtgcctatgactttgtttctcaagaaatccgcgcagcggaagatcctgaatttgagactttctacaccaaaaatattcttttaaacgaaggtattcgtgcgtggatggcggctcaagatcagcctcatgaaaaccttatattccctgaggaggttctaccacgtggaaacgctctttaatggaactttagctttaactggtcgtgaccaagaaactaccggttttgcttggtgggccgggaatgcccgacttatcaatttatctggtaaactactgggggcccatgtagcccatgccggattaatagtattctgggccggagcaatgaacctatttgaagtcgctcatttcgtacctgagaagcccatgtatgaacaaggcttaattttacttccccatctagctactctaggttggggggtaggtcctggaggggaagtaatagatacctttccatactttgtgtctggagtacttcacttaatttcctccgcagtattgggctttggcggtatttatcatgcacttctgggacctgaaactcttgaagaatcttttccattctttggttatgtatggaaagacagaaataaaatgactactattttaggtattcacttaatattgttaggtataggggcttttcttctagtatttaaggcttcttattttggaggtatatatgatacctgggctccaggagggggagatgtaagaaaaattacaaacttaacccttagtccaagtattatattcggttatttactaaaatctccttttgggggagaaggatggattgttagtgtggatgatttggaagacataattggagggcatgtatggttgggttccatttgtatacttggtggaatctggcatatattaaccaagccctttgcgtgggctcgccgtgcactagtatggtctggagaagcttacttgtcttatagtttaggtgctttagccgtttttggttttatagcttgttgctttgtctggtttaataatactgcttatcctagtgagttttatggtccgactggaccagaagcttctcaggctcaagcatttacttttctagttagagaccaacgtcttggagctaatgtaggatcggctcaaggacctaccggtttgggtaaatatctaatgcgttccccgactggggaagttatttttgggggagaaactatgcgtttttgggatctgcgtgctccctggttagaacctttaaggggtcctaatggtttggacttgagtagactgaaaaaagacatacagccttggcaagaacgtcgttccgcggaatatatgactcatgctcctttaggttctttaaattccgttggtggcgtagctacagagattaatgcagtcaattatgtctctcctagaagttggttagctacttctcattttgttctaggattcttcctattcgtaggtcatttatggcacgcgggaagagctcgcgcagctgctgcaggatttgaaaaaggaattgatcgagattttgagcctgttctttccatgactcctcttaattgagacatgaaatcctatgcttgacgtaggaatcactttgattttagtatacatattgggttgaatcgaggagatcatattgaaaaagtatttttttttcaattcatttatatctaatattttttggggctccgctatatcaccacttagccgagccccaaaaaactgagctaatctaaacaaaaaaaacaagtcgccaagaaaaaggagagagggggattcgaaccctcgatagttctttgtttcgaactataccggttttcaagaccggagctatcaaccactcagccatctctccaaaagctaatttctattttatctttattccactcaatagaacattaccatacgaattaataccctttttctctattgatagataaatggtaaagatactcagtgtgaatctattggtctagttctctatccgtatatatatgcatgatccagcatgcccttaatttctgaagtaaaaaaaatactcctcgatccatgcctcaaaagggggtgtcatataaaatcaatggattcatgataaaaccctccataatgcattcattttttattacattattagaaattttttaaggggtcaaggggttgggggatcaaatggtatagttcttttgttggtaaattggaggattagaaacatgactattgcttttcaattagccgtttttgcattaattgctacttcattcattttattgattagtgtacctgttgtatttgcttctcctgatggttggtcaagtaacaaaaatgttgtattttccggtacatcattatggattggattagtatttctagtgggtattcttaattctctcatctcttgaaactattcattctagatcaaaaaacgaaatgacccctccccccgaataatttcgggttgtgaggcacattaaaatggaatatataagaccccacaaataaagaaaacgaaaacattattattattatagggaggggtcaaacttcttctattaaaaacctcttatatcttatacttaatagatatatatatctatagtaaaagtaaaaagaagataacaaaatacaaaaatacaatattcctattatataggttaatatattcgaattgatttttcgatattctataaatttagaattacttttgattaatactttataaaatataaaaataatatatatatatatatatggaatacgaatttgaattcgattatcgaatagaaagatatatagatatatagatattctatatcttttatttttatagatttttaataaatctattatattatatataatagatatatagatttcgattttttatattacctttaatagacatcagacactgctctgcataaatagaattgatatataaagtatcaagtacaataaaaataaaaatgcggatatagttgaat

SEQ ID NO: 4181 - DNA, 3110 bp, Cicer arietinum
ctaaaatcaaagtgattcctacgtcaagcataggatttcatgtctcaattaagaggagtcatggaaagaacaggctcaaaatctcgatcaattcctttttcaaatcctgcagcagctgcgcgagctcttcccgcgtgccataaatgacctacgaataggaagaatcctagaacaaaatgagaagtagctaaccaacttctaggagagacataattgactgcattaatctctgtagctacgccaccaacggaatttaaagaacctaaaggagcatgagtcatatattccgcggaacgacgttcttgccaaggctgtatgtcttttttcagtctactcaagtccaaaccattaggaccccttaaaggttctaaccagggagcacgcagatcccaaaaacgcatagtttctcccccaaaaataacttccccagtcggggaacgcattagatatttacccaaaccggtaggtccttgagccgatcctacattagctccaagacgttggtctctaactagaaaagtaaatgcttgagcctgagaagcttctggtccagtcggaccataaaactcactaggataagcagtattattaaaccagacaaagcaacaagctataaaaccaaaaacggctaaagcacctaaactataagacaagtaagcttctccagaccatactagtgcacggcgagcccacgcaaagggcttggttaatatatgccagattccaccaagtatacaaatggaacccaaccatacatgccctccaattatgtcttccaaatcatccacactaacaatccatccttctcccccaaaaggagattttagtaaataaccgaatataatacttggactaagggttaagtttgtaatttttcttacatctccccctcctggagcccaggtatcatatatacctccaaaataagaagccttaaatactagaagaaaagcccctatacctaacaatattaagtgaatacctaaaatagtagtcattttatttctgtctttccatacataaccaaagaatggaaaagattcttcaagagtttcaggtcccagaagtgcatgataaataccgccaaagcccaatactgcggaggaaattaagtgaagtactccagacacaaagtatggaaaggtatctattacttcccctccaggacctaccccccaacctagagtagctagatggggaagtaaaattaagccttgttcatacatgggcttctcaggtacgaaatgagcgacttcaaataggttcattgctccggcccagaatactattaatccggcatgggctacatgggcccccagtagtttaccagataaattgataagtcgggcattcccggcccaccaagcaaaaccggtagtttcttggtcacgaccagttaaagctaaagttccattaaagagcgtttccacgtggtagaacctcctcagggaatataaggttttcatgaggctgatcttgagccgccatccacgcacgaataccttcgtttaaaagaatatttttggtgtagaaagtctcaaattcaggatcttccgctgcgcggatttcttgagaaacaaagtcataggcacgtaggttcagggccagaccgactactccaagagcactcatccataaaccagttactggtacaaataacataaagaaatgtaaccaacgtttattggaaaaagcaaccccaaaaatttgggaccaaaagcggttagcggtgaccattgaataagtttcttccgcttgcgttgggttaaaagcacggaatgtatttgcgccatcaccatcttcaaataaagtattttctacggtagcaccatgaatagcgcatagtagggcagcacccaatacaccagcaacgcccatcatatgaaatgggttcaatgtccaattatgaaacccttggaaaaagagaatgaatcgaaatatagctgctacaccaaaactaggtgcaaagaaccaaccagactgacccagtggataaataaggaatacagaaacaaaaacagcaattggaccggagaatgcgattgcattataaggccgcaattgaacagatcgagcaagttcaaattgacgtaacataaaacctattaatccgaaagcaccgtggagagcaacaaaagtccacagaccacctaattgacaccaacgggtaaaatctccttgtgcttcaggaccccaaagtaacaacaaagagtgtgctaaactattagcaggagtagagactgcagcagttaagaagttacaaccttccaaataggaacttgccaatccatgagtataccatgaagttacaaaggtggtacctgtgaaccaaccccccacggcgaaataggcgcaaggaaaaagcaatagaccagaccaacccacaaaaacgaaacggtccctccgtaaccagtcatccataatatcaaataaatcattttgatctttggtaaatttaccaagagcgatagtcatagtcatcctcctattcaactacttcaaccatttccgaacacctcctagcattttcagggatggaatcttcgagtcttttttcattttacatatgatatgatttctcgtagactgccccttcttttctactgggtttcgaatagaaaaatccctttttttgtcgattgatacctaatctatgtaaaatccctgaacttcatttggttattcctttctattctttttcaaattccctaaatcatgaattgggaattgacttctgactcgtaaatcctataaataaattatttaaagaactgttccagaaacaaatgatcgcttttatcactctcgttcccagcggatccccagatatactactctccttttatcaaataatcttatcttattcttgaatgttgttcgtgaaataaaaaaaggggtttttatattgtgtatgtctaggaaacaactagaggatcatattttttctttctatttgacatttatttcttttattgtcttctttgttcttttttgtttcgttcatattaaaaaatcccaaagtatacttttttgcagatccaggtaagaaattcgaatattttttctatttatttttttatctatctgtcaaatttttaaatattgtatcg

SEQ ID NO: 4182 - DNA, 3229 bp, Cicer arietinum
tggcgacttgtttttttgtttagattagctcagttttttggggctcggctaagtggtgatatagcggagccccaaaaatattagatataaatgaattgaaaaaaatactttttcaatatgatctcctcgattcaacccaatatgtatactaaaatcaaagtgattcctacgtcaagcataggatttcatgtctcaattaagaggagtcatggaaagaacaggctcaaaatctcgatcaattcctttttcaaatcctgcagcagctgcgcgagctcttcccgcgtgccataaatgacctacgaataggaagaatcctagaacaaaatgagaagtagctaaccaacttctaggagagacataattgactgcattaatctctgtagctacgccaccaacggaatttaaagaacctaaaggagcatgagtcatatattccgcggaacgacgttcttgccaaggctgtatgtcttttttcagtctactcaagtccaaaccattaggaccccttaaaggttctaaccagggagcacgcagatcccaaaaacgcatagtttctcccccaaaaataacttccccagtcggggaacgcattagatatttacccaaaccggtaggtccttgagccgatcctacattagctccaagacgttggtctctaactagaaaagtaaatgcttgagcctgagaagcttctggtccagtcggaccataaaactcactaggataagcagtattattaaaccagacaaagcaacaagctataaaaccaaaaacggctaaagcacctaaactataagacaagtaagcttctccagaccatactagtgcacggcgagcccacgcaaagggcttggttaatatatgccagattccaccaagtatacaaatggaacccaaccatacatgccctccaattatgtcttccaaatcatccacactaacaatccatccttctcccccaaaaggagattttagtaaataaccgaatataatacttggactaagggttaagtttgtaatttttcttacatctccccctcctggagcccaggtatcatatatacctccaaaataagaagccttaaatactagaagaaaagcccctatacctaacaatattaagtgaatacctaaaatagtagtcattttatttctgtctttccatacataaccaaagaatggaaaagattcttcaagagtttcaggtcccagaagtgcatgataaataccgccaaagcccaatactgcggaggaaattaagtgaagtactccagacacaaagtatggaaaggtatctattacttcccctccaggacctaccccccaacctagagtagctagatggggaagtaaaattaagccttgttcatacatgggcttctcaggtacgaaatgagcgacttcaaataggttcattgctccggcccagaatactattaatccggcatgggctacatgggcccccagtagtttaccagataaattgataagtcgggcattcccggcccaccaagcaaaaccggtagtttcttggtcacgaccagttaaagctaaagttccattaaagagcgtttccacgtggtagaacctcctcagggaatataaggttttcatgaggctgatcttgagccgccatccacgcacgaataccttcgtttaaaagaatatttttggtgtagaaagtctcaaattcaggatcttccgctgcgcggatttcttgagaaacaaagtcataggcacgtaggttcagggccagaccgactactccaagagcactcatccataaaccagttactggtacaaataacataaagaaatgtaaccaacgtttattggaaaaagcaaccccaaaaatttgggaccaaaagcggttagcggtgaccattgaataagtttcttccgcttgcgttgggttaaaagcacggaatgtatttgcgccatcaccatcttcaaataaagtattttctacggtagcaccatgaatagcgcatagtagggcagcacccaatacaccagcaacgcccatcatatgaaatgggttcaatgtccaattatgaaacccttggaaaaagagaatgaatcgaaatatagctgctacaccaaaactaggtgcaaagaaccaaccagactgacccagtggataaataaggaatacagaaacaaaaacagcaattggaccggagaatgcgattgcattataaggccgcaattgaacagatcgagcaagttcaaattgacgtaacataaaacctattaatccgaaagcaccgtggagagcaacaaaagtccacagaccacctaattgacaccaacgggtaaaatctccttgtgcttcaggaccccaaagtaacaacaaagagtgtgctaaactattagcaggagtagagactgcagcagttaagaagttacaaccttccaaataggaacttgccaatccatgagtataccatgaagttacaaaggtggtacctgtgaaccaaccccccacggcgaaataggcgcaaggaaaaagcaatagaccagaccaacccacaaaaacgaaacggtccctccgtaaccagtcatccataatatcaaataaatcattttgatctttggtaaatttaccaagagcgatagtcatagtcatcctcctattcaactacttcaaccatttccgaacacctcctagcattttcagggatggaatcttcgagtcttttttcattttacatatgatatgatttctcgtagactgccccttcttttctactgggtttcgaatagaaaaatccctttttttgtcgattgatacctaatctatgtaaaatccctgaacttcatttggttattcctttctattctttttcaaattccctaaatcatgaattgggaattgacttctgactcgtaaatcctataaataaattatttaaagaactgttccagaaacaaatgatcgcttttatcactctcgttcccagcggatccccagatatactactctccttttatcaaataatcttatcttattcttgaatgttgttcgtgaaataaaaaaaaggggtttttattattgtgtatgtctaggaaacaactagaggatcatattttttctttctatttgacatttatttcttttattgtcttctttgttctttttttgtttcgttcatattaaaaaaatcccaaagtatacttttttgcagatccaggtaagaaattcgaatattttttctatttatttttt

SEQ ID NO: 4183 - DNA, 2431 bp, Pisum sativum
tcaattaagaggagtcatggaaagaacaggctcaaaatctctatcaattcctttttcaaatcctgcggcagctgcgcgagctcttcccgcgtgccataaatgacctacgaataggaagaatcctagaacaaaatgagaagtagctaaccaacttctaggagagacataattgactgcattaatctctgtagctacgccacccacggaatttaaagaacctaaaggagcatgagtcatatattccgcggaacgacgttcttgccaaggctgtatatcttttttcagtctactcaagtccaaaccattaggacctcttagaggttctaaccagggagcacgcagatcccaaaaacgcatagtttctcctccaaaaatgacttctccggtcggagaacgcattagatatttacctaaaccggtaggcccttgagcggagcctacattagctccaagacgttggtctctaactagaaaagtaaatgcttgagcttgagaagcttccggtccagtgggaccataaaactcactaggataagcagtattattaaaccagacaaagcaacaagctataaaaccaaaaacggctaaagcacctaaactataagataagtaagcttctccagaccatactagtgcacgccgagcccatgcaaagggtttggttaagatatgccagattccaccaagtatacaaatggaacccaaccatacatgtcccccaattatatcttccaaatcgtccacactaacaatccaaccttctcccccaaaaggggattttagtaaataaccaaatagaatgcttggactaagggtgaagttggtaatttttcttacatctccccctcctggagcccaggtatcatatatacctccaaaataaaaagccttaaatactagaagaaaagaccctatacctaacaaaattaagtgaatacctaaaatagtagtcattttatttctatctttccatacataaccaaagaatggaaaagattcttcaagagtctcaggtcccagaagtgcatgataaataccgccaaagcccaatactgcagaggaaattaagtgaagtactccagacacaaagtatggaaaggtgtcgataacttcccctccaggacctaccccccaacctagagttgctagatggggaagtaaaattaagccttgttcatacatgggcttctcgggtacgaaatgagcaacttcaaataggttcattgctccggcccagaatactattaatccggcatgggctacatgggcccccagtagtttaccggataaattgataagtcgggcattcccggcccaccaagcaaaaccagtagtttcttggtcacgaccagttaaagctaaagttccattaaagagcgtttccacgtggtagaacctcctcagggaatataaggttttcatgaggctgatcttgagtcgccatccacgcacgaataccttcgtttaagagaatatttttggtgtagaaagtctcaaattcaggatcttccgctgcgcggatttcttgagaaacaaagtcataggcacgtaggttcagggccagaccgactactccaagagcactcatccataaaccagttactggtacaaataacataaagaaatataaccaacgtttattggaaaaagcaaccccaaagatttgggaccaaaagcggttagcagtaaccattgaataagtttcttctgcttgggttgggttaaaagcccggaatgtatttgcgccatcaccatcttcaaataaggtattttctacaatagcgccatgaatagcgcatagtagggcagcgcccaatacaccagcaactcccatcatatgaaatgggtttaatgtccaattatgaaacccttggaaaaagagaatgaatcgaaatatagctgctacaccaaaactaggcgcaaagaaccaaccagactggcccagtggataaataaggaatacagaaacaaaaacagcaattggaccggagaatgcgattgcattataaggccgcaattgaacagatcgagcaagttcaaattgacgtaacataaaacctattaatccgaaagcaccgtgaagagcaacaaaagtccacagaccacctaattgacaccaacgggtcaaatctccctgtgcttcaggaccccatagtaacaacaaagagtgtgctaaactattagcaggagtagagactgctgcagttaagaagttacaaccttccaaataggaacttgccaatccatgagtataccatgaagttacaaaggtggtacctgtgaaccaaccccccacggcaaaataggcgcaaggaaagagcaatagaccggaccaacccacaaaaacaaaacggtccctccgtaaccagtcatccataatatcaaataaatcattttgatctttggtaaatttaccaagagctatagtcat

SEQ ID NO: 4184 - DNA, 2431 bp, Jatropha curcas
atgactatagcccttggtaaatttaccaaagacgaaaatgatttatttgatattatggatgactggttacggagggaccgtttcgtttttgtaggttggtccggtctattgctctttccttgcgcctatttcgccttagggggttggttcacaggtacaacctttgtaacctcatggtatacccatggattggctagttcctatttggaaggctgcaacttcttaaccgctgcagtttctactcctgctaatagtttagcgcattctttgttattactatggggtcccgaagcacaaggggattttactcgttggtgtcaattaggcggtttgtggacttttgttgctctccacggtgctttcggactaataggttttatgttacgtcaatttgaacttgctcgatccgtgcaattgcgaccttataatgcaatcgcattctctggtccaattgctgtttttgtttctgtattcctgatttatccactaggtcagtctggttggttttttgcgcctagttttggtgtagcagctatatttcgattcatcctctttttccaagggtttcataactggacgctgaacccatttcatatgatgggggttgccggcgtattaggtgctgctctgctatgcgctattcatggtgctactgtagaaaatactttatttgaagatggtgatggtgcaaatacattccgtgcttttaacccaactcaagccgaagaaacttattcaatggttaccgctaaccgcttttggtcccaaatctttggggttgctttttccaataaacgttggttacatttctttatgttatttgtaccagtaaccggtttatggatgagtgctcttggagtagtcggtctggctctgaatctacgtgcctatgacttcgtttctcaggagatccgtgcagcggaagatcctgaatttgagactttctacactaaaaatattctcttaaacgaaggtattcgtgcttggatggcggctcaagatcagcctcatgaaaaccttatattccctgaggaggttctaccacgtggaaacgctctttaatggaactttatctttagccggtcgtgaccaagaaactaccggtttcgcttggtgggccgggaatgcccgacttatcaatttatccggtaaactactgggagctcatgtagctcatgctggattaatcgtattctgggccggagcaatgaacctatttgaagtggctcatttcgtaccggagaaaccaatgtatgaacaaggattaattttacttccccacctagctactctaggttggggggtaggtcctggtggggaagttatagacacctttccatactttgtatctggcgtacttcacttaatttcctctgcagtattgggctttggcggtatttatcatgcacttctgggtcctgagactcttgaagaatcttttccattttttggttatgtatggaaagatagaaataaaatgacaacaattttaggtattcacttaatcttgctaggtataggtgcttttcttctagtattcaaggctctttattttgggggcgtatatgatacctgggctccgggggggggagatgtaagaaaaattaccaacttgacccttagcccaagtgttatttttggttatttactaaaatccccctttggaggagaaggatggattgttagtgtggacgatttggaagatataattggagggcatgtatggttaggttccatttgtatacttgggggaatctggcatatcttaaccaaaccctttgcatgggctcgccgtgcacttgtatggtccggagaggcttacttgtcttatagtttaggtgctttatccgtttttggtttcattgcttgttgctttgtctggttcaataataccgcttatcctagtgagttttacgggcctactggaccggaagcttctcaagctcaagcttttacttttctagttagagatcaacgtcttggggctaacgtgggatccgctcaaggacctaccgggttaggtaaatatttaatgcgttcgcctactggagaagttatttttggaggagaaactatgcgtttttgggatctacgtgctccttggttagaacctctaagaggtccaaatggtttggacttgagtaggttgaaaaaagacatacaaccttggcaagaacgccgttccgcggaatatatgacccatgcgcctttaggttcgttgaattctgtaggtggcgtagctaccgagatcaatgcagtcaattatgtctctcctagaagttggttagctacctctcattttgttctagggttcttcctattcgtaggtcatttatggcacgcgggaagggctcgtgcagctgcagcaggatttgaaaaaggaattgatcgtgattttgaacctgttctttccatgactcctcttaactaa

SEQ ID NO: 4185 - DNA, 2638 bp, Malus domestica
tttggtggaatcaatttgattcctacttcaagcattggatctctgtctcagttaagaggagtcatggaaagaacaggttcaaaatcacgatcaattcctttttcaaatcctgctgcagctgcacgagcccttcccgcgtgccataaatgacctacgaataggaagaatcctagaacaaaatgagaagtagctaaccaacttctaggagaaacataattgactgcgttgatctcggtagctacgccacccacggaatttaaagaacctaaaggagcatgagtcatatattccgcagaacgtcgttcttgccaaggctgtatgtcttttttcaacctactcaagtccaaaccattaggaccccttaagggttctaaccagggagcacgcagatcccagaaacgcatagtttctcctccaaaaataacttccccggtcggcgaacgcattagatatttacctaaaccggtaggtccttgagcggatcctacgttagccccaagacgttggtctctaaccaaaaaagtaaatgcttgagcttgagaagcttctggtccagtgggtccataaaactcactaggataggcggtattattgaaccaaacaaagcaacaagcaataaaaccaaaaacggataaagcacctaaactataagacaagtaagcctctccagaccatacaagtgcacggcgagcccatgcaaagggtttggttaagatatgccagattccaccaagtatacaaatggaacctaaccatacatgcccaccaattatatcttccaaatcgtctacactaacgatccacccttctccgccaaagggggattttagtaaataaccaaatacaatacttgggctaagggtcaagttggtaatttttcttacatctcccccgcccggagcccaggtatcatatacacccccaaaataaagagccttgaatactagaagaaaagcacctatacctaacaagattaagtgaatacccaaaattgtagtcattttatttctatctttccatacataaccgaagaatggaaaagattcttcaagagtctcgggtcccagaagtgcatgataaataccgccaaagcccaatactgcagaggaaattaagtgaagtactccagacacaaagtatggaaaggtgtctagaacttccccacccggacctaccccccaacctagagtagctaggtgaggaagtaaaattaatccttgttcatacataggcttctctggtacgaaatgagccacttcaaataggttcattgctccggcccagaatacgattaatccggcatgggctacatgagcccccagtagtttaccggataaattgataagtcgggcattcccggcccaccaggcgaaaccggtggtttcttggtcacgaccggctaaagctaaagttccattaaagagcgtttccacggggtagaacctcctcagggaatataaggttttcatgaggctgatcttgagccgccatccaagcacgaataccttcgtttaagagaatatttttggtgtagaaagtctcaaattcaggatcttccgctgcacggatttcctgagaaacgaagtcataggcacgtaggttcagggccagacctactactccaagagcactcatccataaaccggttactggtacaaataacataaagaaatgtaaccaacgtttattggaaaaagcaaccccaaagatttgggaccaaaaacggttagcggtgaccattgaataagtttcttcagcttgagttgggttaaaagcacggaatgtatttgcaccatcaccatcttcaaataaagtattttctacggtagcaccatgaatagcgcataacagagcagcgcccaacaccccagcaactcccatcatatgaaatgggttcaatgtccaattatgaaacccctggaaaaagaggatgaatcgaaatatagctgctacaccaaaactgggcgcaaagaaccaaccagactgacctaacggataaattaggaatacagaaacaaaaacagcaattggaccggagaatgcgattgcattataaggtcgcaattgaacagatcgagcaagctcaaattgacgtaacataaaacctattagtccgaaagcgccatgtagagcaacaaaagtccatagaccgcctaattgacaccaacgagtaaaatctccttgtgcttcaggaccccatagtaacaacaacgagtgcgctaaactattagccggagtggaaactgccgcggttaagaagttacagccttccaaataggaacttgctaatccatgggtataccatgaagttacaaaggttgtacctgtgaaccaaccccctaaagcgaaataggcacaaggaaagagtaataggccagaccaacctacaaaaacgaagcggtccctccgtaaccagtcatccataatatcaaataaatcattttcgtctttggtaaatttaccaagggctatagtcatagtgatcctcctattcaactacttcaaccattttcgaacacctcatagcattttctgaacgttcgaggcttctatcatttctgtatgatttgatttctcgtacactgccccttcttttgacttttgaatgggtttcgaatagaaaaatcatttattaatc

SEQ ID NO: 4186 - DNA, 3991 bp, Ricinus communis
aaattacaaaaaaaagtttgatttgacccctccctttaattttttgttttctttatttgtattttgcattttcggaacttaggcttatattgaattttaatgtgtttcgcaacccgaaaggattcgggggggggggggtcgttttcatttcatttttgtatctgaaacaactaggttcaagagatgagagaattaaggatacctaccaaaaaaactaatccaatccataatgatgtaccggaaaatacaacatttttattactcgaccaaccatcaggagaagaaaaaacaacgggtacactaatcaataagattgatgaagtaacaattaatgcaaaaacagccaattggaaagcaatagtcatgtttctaatcctccaagctaccaacaaaagaactataccatttgatccctctatcagtcaaaaaaaaattgtaaaaaaaaatgcatcatggggggattgtgccatgaatccattgattctatatgacttataaccaccctttcccattttatgcccattttatggggtcaagagtcgttttttacttcacaaatggtcatgctagatcctgcatctatctctatattacagatagataaatagacttatcgacttacaccaaatatctttctccaaatatctttctatagtacagtgatggtatcaactccgatggccgtgttctattctattcggcagaataaaaataaaatagtaaaatagaaattatctttcggagagatggccgagtggttgatagctccggtcttgaaaaccggtatagttctttgcgaactatcgagggttcgaatccctctctctccttttctcgatgaatagatttatgtctttattggttttgaccggcccagtatcataaatgtaaatggctcggctagatgggatagccgagccagaaaaaaatagattagatctaaatgaattgaaaagaaaggaaaaaggaatactttttaagatcgatttaactattggatctcttgtctcagttagttaagaggagtcatggaaagaacgggttcaaaatcacgatcaattcccttttcaaatcctgctgcagctgcacgagcccttcccgcgtgccataaatgacctacgaataggaagaaccctagaacaaaatgagaggtagctaaccaacttctaggagagacataattgactgcattgatttcggtagctacgccacctacagaatttaacgaacctaaaggcgcgtgggtcatatattctgcggaacggcgttcttgccaaggttgtatgtcttttttcaacctactcaagtccaaaccatttggacctcttagaggttctaaccaaggagcacgcagatcccaaaaacgcatagtttcgcctccaaaaataacttctccggtaggcgaacgcattaaatatttacctaacccggtaggtccttgagcagatcccacgttagccccaagacgttgatctcgaactagaaaagtaaaagcttgagcttgagaagcttctggtccagtaggcccgtaaaactcactagggtaagcggtattattgaaccagacaaagcaacaagcaatgaaaccaaaaacggataaagcacctaaactataagacaagtaagcctctccagaccatacaagtgcacggcgagcccatgcaaagggtttggttaagatatgccagattccacccagtatacaaatggaacctaaccatacatgccctccaattatatcttccaaatcgtccacactaacaatccatccttctcctccaaaaggggattttagtaaataaccgaaaataacacttgggctaagggttaagttagtaatttttcttacatctcccccccccggagcccaggtatcatatacgcccccaaaataaagagccttgaatactagaagaaaagcacctatacctagcaagattaagtgaatacctaaaattgttgtcattttatttctatctttccatacataaccaaaaaatggaaaagattcttcaagagtctcaggacccagaagtgcatgataaataccgccaaagcccaatactgcggaggaaattaagtgaagtacgccagatacaaagtatggaaaggtgtctataacttccccaccagggcctaccccccaacctagagtagctaggtggggaagtaaaattaatccttgttcatacattggcttctctggtacgaaatgagccacttcgaataggttcattgctccggcccagaatacgattaatccagcatgggctacatgggctcccagtagtttaccggataaattgataagtcgggcattcccagcccaccaagcgaaaccggtggtttcttggtcacgaccggctaaagataaagttccattaaagagcgtttccacgtggtagaacctcctcagggaatataaggttttcatgaggctgatcttgagccgccatccaagcccgaataccttcgtttaagagaatatttttagtgtagaaagtctcaaattcaggatcttccgctgcacgaatttcctgagaaacgaagtcataggcacgtagattcagagccagaccgactactccaagagcgctcatccataaaccggttacgggtacaaataacataaagaaatgtaaccaacgtttattggaaaaagcaaccccaaagatttgagaccaaaagcggttagcggtgaccattgaataagtttcttcagcttgagttgggttaaaagcacggaatgtatttgcaccatcaccatcttcaaataaagtattttctacagtagcaccatgaatagcgcacagcagagcagcgcccaatacgccggcaactcccatcatatgaaatgggttcagcgtccagttatgaaacccttggaaaaagaggatgaatcgaaatatagctgctacaccaaaactaggcgcaaaaaaccaaccagactgacctagtggataaatcaggaatacagaaacaaaaacagcaattggaccagagaatgcgattgcattataaggtcgcaattgcacagatcgagcaagttcaaattgacgtaacataaaacctattagcccgaaagcaccgtggagagcaacaaaagtccacaaaccacctaattgacaccaacgagtaaaatctccttgtgcttcaggaccccatagtaataacaaagaatgtgctaaactattagcaggagtagaaactgcggcggttaagaagttgcaaccttccaaataggaactggccaatccgtgggtataccatgaggttacaaaggttgtacctgtgaaccaaccccctacggcgaaataggcacaaggaaagagcaatagaccggaccaacctacaaaaacgaaacggtccctccgtaaccagtcatccataatatcaaataaatcattttcgtctttggtaaatttaccaagggctatagtcatagtgatcctcctattcaactacttcaaccatttccgaacacctcatagcattttcagggcctttgaagcttctatcatttatgtatgatttgatttcttgtacactgccctttctaatttctaatgggtttcgaagaaaaaaattctttatcggtccataacctgacttaggtaaattcatgaattcaattcggttattcttttttatagtcttaataaccatatgaaccatgaatttttttatgactcatcaaatcaatcagatagatgaattttttaaaagcactgttcaaggaacaagtgatccccctctccttactagtggatcctcagacttatttctctcattctatcaaactaatcttattcttggatcttgttcgtaagatttctaaaaatcaatatttttacgtattcttctaatttctatatgcattaaactgttacagtatcctatattttattattttatattttattctttctcgccaactttcttatattttctttttgccatttttgttatatttctttttacttcagataaa

SEQ ID NO: 4187 - DNA, 1971 bp, Catharanthus roseus
tctttcggagagatggctgagtggttgatagccccggtcttgaaaaccggtatagttttgaacaagaactatcgagggttcgaatccctctctctccttttttgttcattgaataggttctttctttattagtttttcccggactggtatcataaagaagggagaatggctcggctatcccaccgagccaagccgaaaaatagattctgattatataaatgagttgaaaaaaaaaagatttgaaatatgacccgatcccagggcctatgatggaatgaaagggattattcctatttcaagcattggatgtcctatcttatcttatctcaattaagaggggtcatggaaagaacaggttcaaaatcacgatcaattcctttttcaaatcctgctgcagctgcacgagccctccccgcgtgccacaaatgacctacgaacaagaagaatcctagaacaaaatgagaggtagctaaccaacttctaggagagacataattgactgcattgatctccgtagctacgccacccacggaatttaaagaacctaaaggagcatgagtcatatattctgcggaacgccgttcttgccaaggttgtatgtcttttttcaacctactcaagtccaacccatttggcccccttagaggttctaaccagggagcacgcagatcccaaaaacgcatcgtttctcctccaaaaatgacttctccggttggggaacgcattagatatttacctaaaccagtaggcccttgagcggatcccacgttagccccaagacgttggtctctaactagaaaagtaaatgcttgagcttgagaagcttctggcccagtgggtccgtaaaactcactaggataagctgtattattgaaccagacaaaacaacacgcaatgaaaccgaagacggataaagcccctaaactatacgataagtaagcctctccagaccatacaagtgcgcgtcgagcccacgcgaagggtttagttaagatatgccagattccaccaagtatacaaatggaacctaaccatacatgtcctccgattatatcttctaaatcgtccacactaacaatccatccttcccctccaaagggcgattttagtaaataaccaaatatgatactcgggctaagagtcaagttagtaatttttcttacactctcccccccccggagcccaagtatcatacacgcccccaaaatatagagccttgaatactagaagaaaagcacctagacctaacaagattaagtgaatacctaaaattgtggtcattttatttctatctttccatacataaccgaagaatggaaaagattcttcaagcgtctcaggaccaagaagcgcatgataaataccgccaaagcccaaaaccgcagaggaaattaaatgaagtactccagatacaaagtacggaaaggtgtctataacttctcccccaggaccgactccccaacctagagtagctaggtggggaagtaaaattaacccttgttcatacataggtttctctggtacgaaatgagccacttcaaacaggttcattgctccggcccagaatacgattaatccggcgtgggctacatgagctcctagtagtttaccggataaattgataagtcgggcatttccggcccaccaagcaaaaccggtggtttcttggtcacgaccagctaaagctaaagttccattaaagagcgtttccacgtggtagaacctcctcagggaatataaggttttcatgaggctgatcttgagccgccatccaagcacgaataccttcgtttaagagaatatttttggtgtagaaagtctcaaattccggatcttccgctgctcgaatttcctgagaaacgaagtcataggcacgtaggttcagggctagaccaactactccaagagcactcatccataaaccggttactggtacaaataacataaagaaatgtaaccaacgtttattgg

SEQ ID NO: 4188 - DNA, 3159 bp, Cicer arietinum
aaaaaatactttttcaatatgatctcctcgattcaacccaatatgtatactaaaatcaaagtgattcctacgtcaagcataggatttcatgtctcaattaagaggagtcatggaaagaacaggctcaaaatctcgatcaattccttttcaaatcctgcagcagctgcgcgagctcttcccgcgtgccataaatgacctacgaataggaagaatcctagaacaaaatgagaagtagctaaccaacttctaggagagacataattgactgcattaatctctgtagctacgccaccaacggaatttaaagaacctaaaggagcatgagtcatatattccgcggaacgacgttcttgccaaggctgtatgtcttttttcagtctactcaagtccaaaccattaggaccccttaaaggttctaaccagggagcacgcagatcccaaaaacgcatagtttctccccaaaaataacttccccagtcggggaacgcattagatatttacccaaaccggtaggtccttgagccgatcctacattagctccaagacgttggtctctaactagaaaagtaaatgcttgagcctgagaagcttctggtccagtcggaccataaaactcactaggataagcagtattattaaaccagacaaagcaacaagctataaaaccaaaaacggctaaagcacctaaactataagacaagtaagcttctccagaccatactagtgcacggcgagcccacgcaaagggcttggttaatatatgccagattccaccaagtatacaaatggaacccaaccatacatgccctccaattatgtcttccaaatcatccacactaacaatccatccttctcccccaaaaggagattttagtaaataaccgaatataatacttggactaagggttaagtttgtaatttttcttacatctccccctcctggagcccaggtatcatatatacctccaaaataagaagccttaaatactagaagaaaagcccctatacctaacaatattaagtgaatacctaaaatagtagtcattttatttctgtctttccatacataaccaaagaatggaaaagattcttcaagagtttcaggtcccagaagtgcatgataaataccgccaaagcccaatactgcggaggaaattaagtgaagtactccagacacaaagtatggaaaggtatctattacttcccctccaggacctaccccccaacctagagtagctagatggggaagtaaaattaagccttgttcatacatgggcttctcaggtacgaaatgagcgacttcaaataggttcattgctccggcccagaatactattaatccggcatgggctacatgggcccccagtagtttaccagataaattgataagtcgggcattcccggcccaccaagcaaaaccggtagtttcttggtcacgaccagttaaagctaaagttccattaaagagcgtttccacgtggtagaacctcctcagggaatataaggttttcatgaggctgatcttgagccgccatccacgcacgaataccttcgtttaaaagatatttttggtgtagaaagtctcaaattcaggatcttccgctgcgcggatttcttgagaaacaaagtcataggcacgtaggttcagggccagaccgactactccaagagcactcatccataaaccagttactggtacaaataacataaagaaatgtaaccaacgtttattggaaaaagcaacccaaaaattgggaccaaaagcggttagcggtgaccattgaataagttcttccgcttgcgttgggttaaaagcacggaatgtatttgcgccatcaccatcttcaaataaagattttctacggtagcaccatgaatagcgcatagtagggcagcacccaatacaccagcaacgcccatcatatgaaatgggttcaatgtccaattatgaaacccttggaaaaagagaatgaatcgaaatatagctgctacaccaaaactaggtgcaaagaaccaaccagactgacccagtggataaataaggaatacagaaacaaaaaacagcaattggaccggagaatgcgattgcattataaggccgcaattgaacagatcgagcaagttcaaattgacgtaacataaaacctattaatccgaaagcaccgtggagagcaacaaaagtccacagaccacctaattgacaccaacgggtaaaatctccttgtgcttcaggaccccaaagtaacaacaaagagtgtgctaaactattagcaggagtagagactgcagcagttaagaagttacaaccttccaaataggaacttgccaatccatgagtataccatgaagttacaaaggtggtacctgtgaaccaaccccccacggcgaaataggcgcaaggaaaaagcaatagaccagaccaacccacaaaaacgaaacggtccctccgtaaccagtcatccataatatcaaataaatcattttgatctttggtaaatttaccaagagcgatagtcatagtcatcctcctattcaactacttcaaccatttccgaacacctcctagcattttcagggatggaatcttcgagtcttttttcattttacatatgatatgatttctcgtagactgccccttcttttctactgggtttcgaatagaaaaatcccttttttgtcgattgatacctaatctatgtaaaatccctgaacttcatttggttattcctttctattctttttcaaattccctaaatcatgaattgggaattgacttctgactcgtaaatcctataaataaattatttaaagaactgttccagaaacaaatgatcgcttttatcactctcgttcccagcggatccccagatatactactctccttttatcaaataatcttatcttattcttgaatgttgttcgtgaaataaaaaaaaggggtttttatattgtgtatgtctaggaaacaactagaggatcatattttttctttctatttgacatttatttcttttattgtcttctttgttctttttttgtttcgttcatattaaaaaaatcccaaagtatacttttttgcagatccaggtaagaaattcgaatatttttttctatttatttttttatctatctgtcaaatttttaaatattgtatcgaat

SEQ ID NO: 4189 - DNA, 22169 bp, Ricinus communis
tttgtatttttgtatttattatttaatttagtatttttttagtatttggtatatttttttatttcttataaaaaatttgttataattatttgtttgttatccctatcagtcaaataaaataaaaggatggtttctctgggaagaaccaatcaaaaaatttcatgaatttcattataccccttctaagatcgtcccctttcgtctggtatttcataggaataaacactacacagatataaacagcagagaatatatattttctatattttcttttctgttattaaaacgaataaaagatagcctaatagatcctggaatgtctcttactaatgactaatggcctctcacccgatttggaatagagtaatagtaatatgttctatgtaaaaaaaaaaaaaaaaaaaaaacataagtaaaatataaagtagtctcggctagaaacttttaattaagataggaatatactaggttgcacaaaaaattgtttttgcgttaattcaaagcccagaaaggtccgttgagcgccttgtggctatgtcataatagatccgaacacttgccctggatcgacttccagatcataattgctctagtgaataactaaagaaactagataagataaatgggagatagaagagaaagaaactaattataagtatctctcataggttcactaattgcttgactcgattgttggcgggtctctttatatgcgttgtccggaaagaggaggactcaatgattattcgttcgccggaaccagaagtaaaaattttggtagatagggatcccgtcaaaacttctttcgaggaatgggctagaccgggtcatttctcaagaacaatagctaaaggaccagatactaccacttggatctggaacctacatgctgatgctcacgatttcgatagccataccagtgatttggaggagatttctcgaaaagtatttagtgctcatttcggccaactctcaatcatctttctttggctgagtggcatgtatttccacggtgctcgtttttccaattatgaagcatggctaagtgatcctactcacattggacctagtgcccaagtggtttggccaatagtgggccaagaaatattgaatggtgatgtggggggggggttccgaggaatacaaataacctccggtttttttcagatttggagagcatctggaataactagtgaattacaactgtattgtaccgcaattggtgcattggtctttgcagcccttatgctttttgccggttggttccattatcacaaagctgcgccaaaattggcttggttccaagatgtagaatctatgttgaatcaccatttagcggggctactaggacttgggtctctttcttgggcagggcatcaagtacatgtctctttaccaattaaccagtttctaaacgctggagtggatcctaaagaaatcccacttcctcatgaatttatcttgaatcgggatcttttggctcaactttatcccagttttgctgagggagcaaccccatttttcaccttgaattggtcaaaatattcggaatttcttacttttcgtggaggattagatccagtgactgggggtctatggctgaccgatattgcacaccatcatttagctattgcaattcttttcctggtagctggtcacatgtataggactaactggggtattggtcatggtataaaagatattttagaggctcataaaggcccatttacaggtcagggccataaaggcctatatgagatcctaacaacgtcgtggcatgctcaattatctcttaacctagctatgttgggttctttaaccattgttgtagctcaccatatgtattccatgcctccttatccatatctagctactgactatggtacacaactgtcattgttcacacatcacatgtggattggtggatttctcatagttggtgctgctgcgcatgcagccatttttatggtaagagactatgatccaactactcgatacaacgatctattagatcgtgtcctgaggcatcgcgatgcaatcatatcacatctcaattgggtatgtatatttttaggctttcacagttttggtttatatattcataatgataccatgagtgctttagggcgccctcaagatatgttttcagatactgctatacaattacaacccgtctttgctcaatggatacaaaacacccatgctattgcaccgggtgcaacggctcctggtgcaatagcaagcaccagtttgacttgggggggtggcgatttagtggcagtgggtggcaaggttgctttgttaccgattccattaggaaccgcggattttatggtacatcacattcatgcatttacgattcatgtgacagtattgatacttctgaaaggagttctatttgcccgtagctctcgtttgataccggataaagcaaatcttggttttcgtttcccttgtgatggacctggaagagggggaacatgtcaagtatccgcttgggatcatgtcttcttagggctgttttggatgtacaattcaatttcggtagtaatattccatttcagttggaaaatgcagtcagatgtttggggtagtataagtgatcaaggggtggtaactcatatcacgggaggaaactttgcacagagttccattactgttaatgggtggctccgcgatttcttatgggcacaggcatcccaggtaattcagtcttatggttcttcattatctgcatatggcctttttttcctaggcgctcattttgtatgggcttttagtttaatgtttctattcagtggtcgtggttattggcaagaacttattgaatcaatcgtgtgggctcataataaattaaaagttgctcctgctactcagcctcgagccttgagcattatacaaggacgtgctgtaggagtaacccattaccttctgggtggaattgccacaacatgggcgttcttcttagcaagaattattgcagtaggataatggctaggaggatttgaaaggcattatggcattaagatttccaaggtttagccaaggcttagctcaggaccccactactcgtcgtatttggtttggtattgctaccgcgcatgacttcgagagtcatgatgatattacggaggaacgtctttatcagaatatttttgcttctcacttcggacaattagcaataatttttctgtggacttccggaaatctctttcatgtagcttggcaaggaaattttgaagcatgggtacaggaccctttacacgtaagacctattgctcatgcaatttgggatcctcattttggtcaaccggccgtggaagcttttactcgggggggtgcgcctggcccagtgaatatcgcttattctggtgtttatcaatggtggtatacaatcggtttacgtactaatgaagatctttatatcggagctctttttctattatttctttctgccctagccttactagcgggttggttacacctacaaccaaaatggaaaccgagcgtttcgtggttcaaaaatgctgaatctcgtctcaatcatcatttgtcaggactattcggagtaagctctttagcttggacaggacatttagtccatgtcgctattcctggcgctaggggagaatacgttcgatggaataatttcttagatgtattaccacatccccaaggattaggcccactttttacaggtcagtggaatctttatgctcaaaatcccgattccggtaatcatttatttggtacctcccaaggagcaggaactgccattctaacccttctcggggggttccatccacaaacacaaagtttatggctgaccgatattgcacaccatcatttagctattgcatttatttttctcgttgccggtcatatgtatagaactaacttcgggattgggcacagtataaaagatcttttagaagcgcatattcctccgggagggcgattggggcgtggacataagggtctttatgacacaatcaacaattcacttcattttcaattaggccttgctctagcttctttaggggttattacttccttagtagctcagcacatgtactcattacctgcttatgcgttcatagcgcaagactttactactcaagctgcgttatatactcatcaccaatacatcgcaggattcatcatgacaggagcttttgctcatggagctatattttttattagagattacaatccggaacagaatgagaataatgtattggcaagaatgttagaccataaagaagctatcatatcccatttaagttgggccagcctctttttgggattccatactttgggactttatgttcataatgacgtcatgcttgcttttggtactccggagaaacaaatcttgatcgaacccatatttgcccaatggatacaatctgctcacggtaaaacttcatatgggttcgatgtacttttatcttcaacgaatagtccagccttcaatgcaggtcgaagcatatggttgcccggctggttaaatgctattaatgaaaatagtaattcattattcttaacaatagggcccggagacttcttggttcatcatgctattgctctaggattacatacaaccacattgatcttagtaaaaggtgctttagatgcacgtggttcaaagttaatgccagataaaaaggattttggttatagttttccttgcgatggtccaggacgcggcggtacttgtgatatttcggcttgggacgcattttatttggcggttttctggatgttaaataccattggatgggttactttttattggcattggaagcacatcacattatggcagggtaatgtttcacagtttaatgaatcttccacttatttgatgggatggttaagagattatctatggttaaactcttcgcaacttatcaatggatataacccttttggtatgaatagcttatcggtctgggcgtggatgttcttatttggacatcttgtttgggctactggatttatgtttttaatttcttggcgtggatattggcaggaattgattgaaactttagcatgggcccatgaacgtacacctttggctaatttgattcgatggagagataaaccagtagctctttccattgtgcaagcaagattggttggattagcccacttttctgtaggttatatcttcacttatgcggctttcttgattgcctctacatcaggtaaatttggttaattctttttgtgctgtatccacgaaaatctcattttttcgatggataaggcgactttttctatttctacatctaggatccgacttgtatcagcgacactactaagaagtgaaatattatggcaagaaaaagtttgattcagcgggagaagaagaggcaaaaattggaacaaaaatatcatttgattcgtcgatcctcaaaaaaagaaataagcaaagttccgtcgttgagtgataaatgggaaattcatggaaagttacaatccccaccgcgaaatagtgcaccgacacgtcttcatcgacgctgtttttcgactggaagaccgagagctaactatcgagactttggactatccggacacatacttcgtgaaatggttcatgcatgtttgttaccgggggcaacaagatcgagttggtaaggattaaaaatttcccttcatttttctagttatttttatgatcatcgatcgtagaggggtccctttaccattctgtataaatgcgctattctatttgtacagatatggtagaggggcacattcaatctttgtttgtccattagattagtttccagttcttcgcttcattacgcggggtagagcagcttggtagctcgcaaggctcataaccttgaagtcacgggttcaaatcccgtctccgcaacatttttttttttatttttagagggaggagtttctttttttcttttttggagcagggggaaagaaaagaaagaagataggggatagaatcactatactatcatggtcaactatactgaatcctttatcctatttaaaaaattaccttaccttgggcttgggcggatagcgggaatcgaacccgcgtcttctccttggcaaagagaaattttaccattcgactatatccgcatccgcatttttttttttcgttcttgatacacaatatctggatcatatttgtgaacagctatgctcgatatttcagggcgattattattataattatttataattattatattattaatttgaatattcaatttaatattaattatttataattaataattatttatattaatttatattatttattatactatatatattatatattaatttattatactataatttattacataattacatataaatatatataaatatatataaatataaattaatataaattataaatataaattaatataaattttattattttttttatttctatttattattttttttatttctattttatttctaatagattcatttataattataataatttttttatcccattagactaaagactaaattttacatttaattacatttacaaattacaaaaaaaagtttgatttgacccctccctttaattttttgttttctttatttgtattttgcattttcggaacttaggcttatattgaattttaatgtgtttcgcaacccgaaaggattcgggggggggggggtcgttttcatttcatttttgtatctgaaacaactaggttcaagagatgagagaattaaggatacctaccaaaaaaactaatccaatccataatgatgtaccggaaaatacaacatttttattactcgaccaaccatcaggagaagaaaaaacaacgggtacactaatcaataagattgatgaagtaacaattaatgcaaaaacagccaattggaaagcaatagtcatgtttctaatcctccaagctaccaacaaaagaactataccatttgatccctctatcagtcaaaaaaaaattgtaaaaaaaaatgcatcatggggggattgtgccatgaatccattgattctatatgacttataaccaccctttcccattttatgcccattttatggggtcaagagtcgttttttacttcacaaatggtcatgctagatcctgcatctatctctatattacagatagataaatagacttatcgacttacaccaaatatctttctccaaatatctttctatagtacagtgatggtatcaactccgatggccgtgttctattctattcggcagaataaaaataaaatagtaaaatagaaattatctttcggagagatggccgagtggttgatagctccggtcttgaaaaccggtatagttctttgcgaactatcgagggttcgaatccctctctctccttttctcgatgaatagatttatgtctttattggttttgaccggcccagtatcataaatgtaaatggctcggctagatgggatagccgagccagaaaaaaatagattagatctaaatgaattgaaaagaaaggaaaaaggaatactttttaagatcgatttaactattggatctcttgtctcagttagttaagaggagtcatggaaagaacgggttcaaaatcacgatcaattcccttttcaaatcctgctgcagctgcacgagcccttcccgcgtgccataaatgacctacgaataggaagaaccctagaacaaaatgagaggtagctaaccaacttctaggagagacataattgactgcattgatttcggtagctacgccacctacagaatttaacgaacctaaaggcgcgtgggtcatatattctgcggaacggcgttcttgccaaggttgtatgtcttttttcaacctactcaagtccaaaccatttggacctcttagaggttctaaccaaggagcacgcagatcccaaaaacgcatagtttcgcctccaaaaataacttctccggtaggcgaacgcattaaatatttacctaacccggtaggtccttgagcagatcccacgttagccccaagacgttgatctcgaactagaaaagtaaaagcttgagcttgagaagcttctggtccagtaggcccgtaaaactcactagggtaagcggtattattgaaccagacaaagcaacaagcaatgaaaccaaaaacggataaagcacctaaactataagacaagtaagcctctccagaccatacaagtgcacggcgagcccatgcaaagggtttggttaagatatgccagattccacccagtatacaaatggaacctaaccatacatgccctccaattatatcttccaaatcgtccacactaacaatccatccttctcctccaaaaggggattttagtaaataaccgaaaataacacttgggctaagggttaagttagtaatttttcttacatctcccccccccggagcccaggtatcatatacgcccccaaaataaagagccttgaatactagaagaaaagcacctatacctagcaagattaagtgaatacctaaaattgttgtcattttatttctatctttccatacataaccaaaaaatggaaaagattcttcaagagtctcaggacccagaagtgcatgataaataccgccaaagcccaatactgcggaggaaattaagtgaagtacgccagatacaaagtatggaaaggtgtctataacttccccaccagggcctaccccccaacctagagtagctaggtggggaagtaaaattaatccttgttcatacattggcttctctggtacgaaatgagccacttcgaataggttcattgctccggcccagaatacgattaatccagcatgggctacatgggctcccagtagtttaccggataaattgataagtcgggcattcccagcccaccaagcgaaaccggtggtttcttggtcacgaccggctaaagataaagttccattaaagagcgtttccacgtggtagaacctcctcagggaatataaggttttcatgaggctgatcttgagccgccatccaagcccgaataccttcgtttaagagaatatttttagtgtagaaagtctcaaattcaggatcttccgctgcacgaatttcctgagaaacgaagtcataggcacgtagattcagagccagaccgactactccaagagcgctcatccataaaccggttacgggtacaaataacataaagaaatgtaaccaacgtttattggaaaaagcaaccccaaagatttgagaccaaaagcggttagcggtgaccattgaataagtttcttcagcttgagttgggttaaaagcacggaatgtatttgcaccatcaccatcttcaaataaagtattttctacagtagcaccatgaatagcgcacagcagagcagcgcccaatacgccggcaactcccatcatatgaaatgggttcagcgtccagttatgaaacccttggaaaaagaggatgaatcgaaatatagctgctacaccaaaactaggcgcaaaaaaccaaccagactgacctagtggataaatcaggaatacagaaacaaaaacagcaattggaccagagaatgcgattgcattataaggtcgcaattgcacagatcgagcaagttcaaattgacgtaacataaaacctattagcccgaaagcaccgtggagagcaacaaaagtccacaaaccacctaattgacaccaacgagtaaaatctccttgtgcttcaggaccccatagtaataacaaagaatgtgctaaactattagcaggagtagaaactgcggcggttaagaagttgcaaccttccaaataggaactggccaatccgtgggtataccatgaggttacaaaggttgtacctgtgaaccaaccccctacggcgaaataggcacaaggaaagagcaatagaccggaccaacctacaaaaacgaaacggtccctccgtaaccagtcatccataatatcaaataaatcattttcgtctttggtaaatttaccaagggctatagtcatagtgatcctcctattcaactacttcaaccatttccgaacacctcatagcattttcagggcctttgaagcttctatcatttatgtatgatttgatttcttgtacactgccctttctaatttctaatgggtttcgaagaaaaaaattctttatcggtccataacctgacttaggtaaattcatgaattcaattcggttattcttttttatagtcttaataaccatatgaaccatgaatttttttatgactcatcaaatcaatcagatagatgaattttttaaaagcactgttcaaggaacaagtgatccccctctccttactagtggatcctcagacttatttctctcattctatcaaactaatcttattcttggatcttgttcgtaagatttctaaaaatcaatatttttacgtattcttctaatttctatatgcattaaactgttacagtatcctatattttattattttatattttattctttctcgccaactttcttatattttctttttgccatttttgttatatttctttttacttcagataaaataaaaaagaaatcagataaaataaataaaaaaaaaaccagaatattttgtaggtcaaagcaagaaagacgcttcgaatagtttttttatttacttgactttatatctgtcagaaaagaagaaagagaatgaattttcctattattaaattcaatacaatattaaataaatagaaaactttaaatgaaaggatttaaaaatgaaagtatttttctcacacctattctacattacattgtcggaataaaaatattgtatgtatcgataccaaaatatttggtacaggaagccatgatctgatagatatatcaatcttattatatataaatcttatatacctataaatagcaatataaattgattttgtgtcctggaatcaaagaaagatatttaaaaagtatcttctatgtcttatgttatgacttcgaataaacttttctatggaggagggaaatagttatttattcctatagaataactaggagcaagaagatttaatcagaaatatcgacagattttttggagtccaaagaaaacgaaatatgaaaaggaaagaaaaagcagagctactgtttcaatttcatctatatcgaattttactatcagaatagtagatatagttatgatgcaataagttaggtccacttactttttcttttattgatttctaatataatctttagaattgatttgattggaatagaataatggaaaataagaaaattttgcgatttaagagccaatttctcattattctgtttaatataataaacaaatgttcaactttataactatattctataatatattctataattatataattatagaatatatttttaatatagaattaaaatgaatattttctaactatatgaaatagaatataatcaaaatatactctattactattactctattttatattttatatagtaaaaatttatatactaaaaatcattataaaaaatcattataatattcgtttaatagagttttaatagagtattgatatggtataacttattataatgtataatgttaattttcaaaaatttctaatttccattttagaattaatttaaattctagagtttcttactttttttatgacaaatatcaacaatatttctattccctcttcaaatagaaatattatcaaataggaatattatcgcaggttttttctttttatttctttttattaaaattaaaaagaaaaaaaggccaaagccccttatcggatttgaaccgatgacttacgccttaccatggcgttactctaccactgagttaaaagggcccgtttgattcaattcctgaatgagctactatgtggataagatagatctatagaaaaaaaaataagtaaataaataaagtaaatctataaatctattttaatattttaatattatttaaatattttaatatattttaatataataatttgatttttaatataataatattaatatttgatttttaatataataatattaatatttgattttaatattttaatatatttgaatatatttatattaatatattaatattttaatattaatatatatttatattattatattataatattaatattatatttatttaatattcaatttattaaattagaatataattctaatatctaatatatatatataaattagaatctaatatatatataattatatataaatttagaatctaatatatagaatgaaattagaatataattctaatctaatatataaaattagaatatatataatattctaataaatattatatatttatatataataaattattaatattaaattataataaagattaaataaatattataattattatatattataataaaaataaaatataatataaataaatataatataatataaataaattataaatataatataaataaatataatataaataaatataatattaatataatataataataaatatatatatataatatataataaattataataataaaaataaaattataataataaatatatataattagaataataaatatataatatatataataaattataataaatattataataaataaatatttatttaaataaataaatattatttatattatttaaataaataaatattaaataaataaaataaataaatattttaatctaaaatataaaataataacattattttttaatactattattagatattagaaaaattagattattctaaacatggaatattattattctaatttagaattctattctaaattcataaattctaatagaaactaatataaattagaataagtatattatacatactaagtataggaagtagattcatagtagttcatttataagcgaaaggtttgatttacctagtgagtttagactaaactagtgaatataggtaaaaaaagagtttattgatattgaatttgataaatataaatatcaatgtaatgaatttatcaaggccgaacctcaccaccgaaattcgcttgattgatacatgtatttagcaattcaacatagatccaagatatttcatcgaatcgctgatgaaaagattctatttgtcccctcaaccaaattcttaaaatcaaattggataacttgttgatgcctatccctcttcccagatttctcatttgttaaattactggtttagtgtgagagagagatatgcctatttatcttaacaatgagtgaattaatgaacgaaagcgaaagaagtaaggtttaaccctattttctggttttctggcagacccgttgaaagaatctttcgtattatttctattttttttttttttctattttgtttttttattaaatattcaatttgtactaaattcaaaaatatatatataatattaatatataatattaataattaattctattatattactaatattaatagaattatgaattctaaattcattctttctaaattcattctatttatatttattatatttatatattaattattaatttttttctattttattttctatttattttatattaatttattaattcttattattaattcttattaatttaattctatttattttatttatatttaatatttatttattaaattaattctatttaatattcttagaattattgattattcttagaatggataatggcgaatataagaatcacaaaattctatcgaatcatgaagggcggaaagattcttcgaatctagtcataccatttcgttatattgacaatttcaaaaaactgttcatactatgagcatagtatgctggtggtcgggcaaatgcgcccccatcgtctagtggttcaggacatctctctttcaaggaggcagcggggattcgacttcccctgggggtagggtattacgaaaggaagttgatcatggattcttaataagtctggaattgattcttcctgggtcgatgcccgagcggttaatggggacggactgtaaattcgttggcaatatgtctacgctggttcaaatccagctcggcccaataattcactgatccgccatgaatgatataacccctttgttctctcgaaatgcctgatacagaaaaaaaaaaagtcataatttcggatatatctttacctgttctttatttgatttgctttattttatttagtttttttctcataaattctgatcttgctaatgatctagattcagattttgaaataacgaaaagctgactagtactccctatcccttttagcactaaagtgcatatccatgtggatatcaatatactacccccgtttctgttatatacaacgcggtgattccagtctaaaaccgaaatagtaaaatttaaatagtaaatagaaggggtatgaatgaaatcataagaatatatatgctgtacactttcttgtattgcatttcccggggattgtagttcaagtggtcagagcaccgccctgtcaaggcggaagctgcgggttcgagccccgtcagtcccgacggatccaaatccaataatctaataaaaaatacattaattcatctttcccttttctgcgaaagggggacaaatagcataatttcattcccaaggggaccatttattttcttttcgttttacatttctcatctaagtaaatacaaatacgggaattttcattttttcaaccagtactgattgatagggacatatgtggattagtacaattattggtaacgttatatccaagattcaaaaagatactatactgagtttggattttttgattactcccgacccatataatgaaatcgaatcaagtaccatatcttttccggtaacgcatacacaaatggaatttttatttatttgtatgtatgtatgtacgatacaaaatcaatttaattgctttgatagaatccttttaatctttatctgaaaagtctctttttttttggctccgattttgtgtaatctcaattacaaatttgaatttgaaacaatctatctcattcaaattgcgcactgaagtttttttatttttaatatattctatgcattccattaccaaagaatggggatattaataaaataaatatcaaataaaaaaaaaagaaagtaatggaaaaaaaaattatcaattgaatcaagaatccagccatttttgaattcagtatggataaacgatctttctatgttatactattcaattctcgacgatgaatcgatttgataactcagatattgttattcatgatattgatcagactcgatatcatcgagatggaattcatcccattgaatttagaggcgaaagattttttatttattatctctatgggattaaatcccgagttattacgaagtaaagaaaaagaaacgatgagattatggaagtaaatattcttgcgtttattgctactgccctgttcattctagttcctactgcttttttacttataatttacgtaaaaacggttagtcaaagtgattaatttgaatgaaacttgacttctttgacttcttagttcttatcaatgattgaagaaaaaaaatgaaaaggattccttttttgagtcttaaatgaaatgagcagactagaattagcagtattctatgagatccgatagtatgatagaaagaaatctatttctttctatcatactatccgtttttttttattctagtgtatacagttgtactatataaagatataggcttaatctagatataaattaatctatatctataatatcatctcatattcatatgtctagatatcaattatctatatggaatgtccataacgtcccaattctatttcttcatctatttgatttgtgttgattccaattaatgtcgaaaggcaactcttactcttacttttaggattctaattcctagatttctgattatttaaaatatgaatcctaccatgtaccgaaacaataaaatcaatcaaaaggaattctataaaaaaactttataaaaaaactttttcagatttcaacgaaaaggattagtaaaccctgccgattttgaacctttgaatcataatatgaaatgagtcaaatcaataaggtatagcacaaatccaatttctctaaaataataaaacaaatactaaactaagcactaagcaagaaaatatcttagtatgcgtagtatctcattggagaaccactatgtctatcttatttcccataaaaaattcacttaatttaatcacttttaataactaataaaagaactgctttcgtttctctttgaacagaaaaaagacaaaaaaaaggggggggttctgttcttcctcattgttcatatataattctggtaagaaccagtttaccgaaatagagaatttaggaagaattgggttggaataaatttcctatcgtttgtattccctttcctttcgaaatatgaacacgagaatcattgaaatatttgtttgattatgattaaaaggctattattcatatattattcatagaatacattacttcgctcgaatccaatatactttggaaatgaagatatgaagatatttttaattcaatttctaaatttggaagaaattagaaattgaattaaataattcaatattcaatttaattattaattaataaattcaaaaatctttaatctttgcagaacgatctataaaacaagcgatagagtttgatttctcaactcaattagtaatacccctaaagtccacttcttccccatactacgagcgaaagggaaaatgtaaagactaccattaaagcagcccaagcgagacttactatatccatgtgaattatgtcctctatctctatgaatatgaatgaatttttccattattgttcactaataatagtagaattgttggcacagagtcaaaaaaaaagattctgttcaatatagtgatgaaaaaaaatccaaaaatccaattaattcaaagaagttcttatcttattcttataagattgatagtagaatcgaaaaatgtttagtacaatttttagtacaaacaaaatagccagcaataccctgggaagtatcagtatcaagaagccttttcctccgcgtacttctgttgggagcaaatttgataagttatatcagcaaaaaaagggaataagatattttgcgttttttgttgatcaggcgacacccggatttgaactggggaaaaaggatttgcagtcccccgccttaccactcggccatgccgccaaggcaacacaaaatagacgaaaatattcccacccttttttttttttttttttttttttttagagggaggagtttctttttttcttttttggattggatctatcttttccatttattttgtatagtatctcaaaacacacactatctaaatttttctattatctattgaaatgaaaagtcaattttcagtcacaaactcaaaaattaaggacaaattggaaccattaactattaactgtgaattcataaacgattcttggatttcaatcgaaaattgtatttctctaatcctaatgatataagaaaataaaaattgatacgtaaccaatccgtattgattcttttcaataaaaaaaaattcttctcagtttcaattataacaacaattatgagtatatgtaaaccctagaacataaaattttatgcggatatctatcttatccgtctatgattcctataggaaaatttctattcaatgaaaatggaatataaattttgatagagcatgacatgcgctgtccaaaatagaactgcagtaaaaggagagacgtatatatagtatagatagctataattatgagatagctatagttatgcccgcatatgtttaataagccttcttatgtttgttttatgttatgcacttcaatcgtattatatgaactcgattaaaaaaaagatataaaaaaatctctcttctatgcaaatttttttgaactaaacaatgaaatccgcgaaaaagctaagtgctaaaaaaaaaatcaaaaaatcaactttatattgtttcggattattggttttttctctcatcgaaagatttaatcccgaattcagttattttattggtatccaagcgtattggaaattggtatccaagcgtattggaatatgtaatatcataataatggtagaaattgaatcactttttgttttgctattctatacaaaatttcataagtctaaggtaagtggaatttctcaattcttttccagctgtctctgttgcaaattcgaatttgagtataaacttctctttattcctccgttcatacgtatttcatacattccatatctatggagatagataaaattttatgtgattctgtaaacagaatataaattccatcattgctagatcgatccatataatttgaatgaagaacgatccaatacaataatggaatttttttaataaacgggaaattcaaaatgctcggggatggaaatgagggaatgtctacaatacctggattgaatcagatacaatttgaaggattttgtaggttcattgatcagggcttaacagaagaactttataagtttccaaaaattgaagatacagatcaagaaattgaatttcaattatttgtggaaacatatcaattagtagaaccgttgataaaagaaggagatgctgtatatgaatcacttacatattcttctgaattatatatatccgcgggattaatttggaaaactagtagggatatgcaagaacaaactatttttattggaaacattcctctaatgaattccctgggaacttttataataaatggaatatacagaattgtgatcaatcaaatattgcaaagtcccggtatctattaccggtcagaattggatcataacggaatttcggtctataccggcaccataatatcagattggggggggcgagtagaattagagattgatagaaaagcaaggatatgggctcgtgtaagtaggaaacagaaaatatctattctagttctattatccgctatgggtttgaatctaagagaaattttagagaatgtgcgctaccctgaaattttcttatctttcctgaatgataaggaaaaaaaaaaaattgggtcaaaggaaaatgccattttggagttttatcaacaatttacttgtgtaggcggagatccggtattttctgaatccttatgtaaggaattacaaaagaaattctttcaacaaagatgtgaattaggaaggattggtcgattaaatatgaaccggagactgaatcttgatatacctcataacaatacatttttgttaccgcgagatatattggcagctgcggatcatttgattggaatgaaatttggaatgggtacacttgacgatatgaatcatttaaaaaataaacgtattcgttctgtagcggatcttttacaagatcaattcggattggctctgattcgtttagaaaatgtggttagagggactatatgtggagcaattaggcataaattgataccgactcctcaaactttggtaacttcaactccattaacaaccacttatgaatcttttttcgggttacacccattatctcaagttttggatcgaactaatccattgacacaaatagttcatgggagaaaatcgagttatttgggtcctggaggattgacagggcgaactgctagttttcggatacgagatatccaccctagtcactatgggcggatttgcccaattgacacatctgaaggaatcaatgttggacttattggatctttagcaattcatgccaagattggtcattgggggtctttagaaagcccattttatgtaatctctgaggaatcaaaaaaagtacggatgttttatttatcaccaaatagagaggaataccatatggtagcggcaggaaattctttggcgctaaatcgaggtgttcaggaagaacaggttgccccagctcgatatcgtcaagaattcctgactattgcatgggaacaagtgcatcttcgaagtatttttcccttccaatatttttctatcggagcttccctcattccttttatcgagcataatgatgcgaatcgggctttaatgagttctaatatgcaacgtcaagcagttccactttctcggtccgaaaaatgcattgttgggactggattggaacgccaagtggctctagattcaggggttcccgctatagccgaacgcgaaggaaagataatttatactgatattgacaagatcattttatcgggcaatggggatactctacgcattccattagttatgtatcaacgttccaacaaaaatacttgtatgcatcaaaaaccccaggttccgcggggtaaatgcattaaaaagggacaagttttagcggatggtgccgctacaattggtggcgaactcgccttgggcaaaaacgtattagtggcttatatgccgtgggaaggttacaattttgaggatgcggtactcattagcgaacgtctggtatatgaagatatttatacttcttttcacatacggaaatatgaaattcagactcatgtgacaagccaaggacctgaaaggatcactaatgaaataccgcatctagaagcccatttactccgaaatttagacaaaaatggaattgtgatgctaggatcttgggtagagacgggcgatattttagtaggtaaattaacgcctcaaatggcgaaagaatcatcgtatgctcccgaagatagattattaagagccatacttggtattcaggtatctacttcaaaggaaacttgtctaaaactacctataggtggtagggggcgagttattgatgtgagatgggtccagaaaaaggggggttccagttataatccggaaacgattcgtatatatattttacagaaacgtgaaatcaaagtgggtgataaagtcgctggaagacatggaaataaaggcatcatttccaaaattttgcctagacaagatatgccttatttgcaagatggaaggcctgttgatatggtcttcaacccattaggagtaccttcacgaatgaatgtaggacagatatttgaatgctcactcgggttagcgggaggtctgctagatagacattatcgaatagcaccctttgatgagagatatgaacaagaggcctcgagaaaacttgtattttctgaattatatgaagccagtaagcaaacagcaaatccgtgggtatttgaacccgaatatccgggaaaaagtagaatatttgatggaagaacgggggatccctttgagcagcctgttataataggaaagccttatatcttgaaattaattcatcaagttgatgataaaatacatggacgttccagtggacattatgcacttgttacccaacaaccccttagaggaagggccaagcaagggggacaacgagtcggagaaatggaggtttgggctctagaaggatttggtgtttctcatattttacaagaaatgcttacttataaatctgatcatattagagctcgccaagaagtgcttggtactacaatcatcggaggaacaatacctaaacctgaagacgctccagaatcttttcgattgctcgttcgagaactacgatctttggctctggaactgaatcatttccttgtatctgagaagaacttccagatgaataggaaggaagcttaatcgggatgaatcagaatttttcttctatgattgatcggtataaacatcaacaactccgaattggatcagtttcgcctcaacaaataagtgcttgggccaaaaaaatcctacctaatggggagattgttggagaagtgacaaaaccctatacttttcattacaaaaccaataaacctgaaaaaggtggattgttttgtgaaagaatttttgggcctataaaaagtggaatttgtgcttgtggaaattatcgagtaatcagaaatgaaaaagaagaccaaaaattttgtgaacaatgcggagtcgaatttgttgattctcggatacgaagatatcaaatgggctacatcaaactggcatgcccagtaactcatgtgtggtatttgaaacgtcttcctagttatatcgcaaatcttttagataaacctcttaaagaattagaaggcctagtatattgcgatgtgtgatttgatcg

SEQ ID NO: 4190 - DNA, 5149 bp, Panax ginseng
ctgcgccctgaccttgaaagttaggtcgtaacattggtatcgcgaatgggcatttctggaacgtgaggttgccaaggaagcttctgacatggttttagtagatgataattctagcacaattgttgctgctgttggcgaaggcaggtctatctacaactatatgaagcccttcatcaggtccatttatcttcctctctgcttttgtagcttttagatcagtcagctttagatcaaaatagatatttttgattacagatttcttgttcaatttattataatatcatctcaagtatttaagtcaagtaatagcagttataatggatgtaatatctgaaatatataggtgttttatcaaataaaaattgtctttatataatttccaatgagatcataaaagaagtagattggaaagaatccaccggaataatttaaacggagttccctggtctactgagttatagtatagtagtttagtgaatagttctaaagttgaacatttgttcagtaaattagaattatgatgaataatgataagtcgtctctggaatcaccaaacattcctattttccattttgctaatcaaatgcattgtaaagattagaaatcaacaaaagaaaaaataagtggacctgacccattgaatcatgactatatccgctattctgatattaaaattcgataaagataaaattggaacaagttaaccccttttattttcatttctttggactccgcaagaatttgtcgatatttccaataattcaatcttattgttcctagatattccataggaataaattgttattccgttcctccacagagaaacttttattccaagtcacaacataagagccattctttgattacagatcaaggttcatttatatctatatacgatttatttatatctatataagatttataatcagatttatttatttagatgtatatctatcagatcgtagcttcatgtaccaaatatttccatattacagcatccaagatttttgttccgacagcgtgatggagaatggatgcgtggaaaatacttccatttccagtctcttagttatttattttatattgtattgattttaaggaaaaataggaaattctttctttttctaacagaacaaaaaagaaaaaaatccgaagtctttttcttgcttcgacccgtggaaagatatactctggagttttagatttctcggaaggaaggggagatataataaagaagacactaaaagaaaatgaaaaaaataaattaataaaataaggatactgtagtagtttagtatacatagaaattggaagaatttataaagatattttttttctcaatttcacgaacaagatctaagaataaatttagttgatggagcaataagggggtaggtctgaggatcaactggtaacgagagaggggattgctttttccttgaacagttctttccaaaaattcatctatcgaattgatgagtcataagaagacaattcatggttcagatgcttagtaagaataaaagaaagaaggaataagcaaatcgagttcgtggatttacctaggtgagtttatgggccaataaaggatttttatcttcgaaacccattgaaagttaaaagggggagtgcacgagaaatcaaatcatacaaaaatgatcgaatcggtggatacccccaaaatgctatgaggtgttcggaaatggtcgaagtagttgaataggaggattactatgactatagcccttggtaaatttaccgaagacgaaaaggatttatttgatattatggatgactggttacggagggaccgtttcgtttttgtaggttggtccggtttattgctctttccttgtgcctatttcgctttagggggttggttcacaggtacaacctttgtaacttcatggtatacccatggattggccagttcctatttggaaggctgcaatttcttaactgccgcagtttctactcctgctaatagtttagcacattctttattgttactatggggtcctgaagcacaaggggattttactcgttggtgtcaattaggcggtctgtggacttttgttgctctccatggcgctttcggactaataggtttcatgttacgtcaattcgaacttgctcgatctgttcaattgcgaccttataatgcaatcgcattctctggtccaattgctgtttttgtttctgtattcttgatttatccactaggtcagtctggttggttctttgcccctagttttggtgtagcagctatatttcgattcatcctcttttttcaaggatttcataattggacgttaaacccatttcatatgatgggagttgccggggtattgggcgctgctttgctatgcgctattcatggtgctactgtagaaaatactttatttgaagatggtgatggtgcaaatacattccgtgcttttaacccaactcaagctgaagaaacttattcaatggtcaccgctaaccgcttttggtcccaaatctttggggttgctttttccaataaacgttggttacatttctttatgttatttgtaccagtaaccggtttatggatgagtgctcttggagtagtcggtctggccctgaacctacgtgcctatgacttcgtttctcaggaaattcgtgcggcggaagatcctgaatttgagactttctacaccaaaaatattctcttaaacgaaggtattcgtgcttggatggcagctcaagatcagcctcatgaaaaccttatattccctgaggaggttctaccccgtggaaacgctctttaatggaactttagctttagctggtcgtgaccaagaaaccactggtttcgcttggtgggccgggaatgcccggcttatcaatttatccggtaaactactcggggctcatgtagcccatgccggattaattgtattctgggccggaggaatgaacctatttgaagtggctcatttcgtaccagagaagcctatgtatgaacaaggattaattttacttccccacctagctactctaggttggggggtaggtcctggtggggaagttatagacacttttccatactttgtatctggagtacttcatttaatttcctctgcagtattgggctttggtggtatttatcatgcacttctagggcctgagacgcttgaagaatcttttccattcttcggttatgtatggaaagatagaaataaaatgactacaattttaggtattcacttaatcttattaggtataggtgcttttcttctagtattcaaggctctttattttggtggcgtatatgatacctgggctccgggggggggagatgtaagaaaaattaccaacttgacccttagcccaagtattatatttggttatttactaaaatcgccctttggaggggaaggatggattgttagtgtagatgatttggaagatataatcggaggacatgtatggttaggttccatttgtatacttggtggaatctggcatatcttaaccaaacccttcgcatgggctcgacgcgcacttgtgtggtctggggaggcttacttatcttatagtttaggggctttatccgtctttggtttcattgcttgttgttttgtctggttcaataataccgcctatcctagcgagttttacggacccactggaccagaagcttcccaagctcaagcatttacttttctagttagagaccaacgccttggggctaacgtgggatccgctcaaggacctactggtttaggtaaatatttaatgcgttccccgaccggagaagtcatttttggaggagaaactatgcgtttttgggatctgcgtgccccttggttagaacctctaaggggtccaaatgggttggacttgagtaggctgaaaaaagacatacaaccttggcaagaacggcgttctgcagaatatatgacccatgctcctttaggttctttaaattctgtgggtggcgtagctaccgagatcaatgcagtcaattatgtctctcctagaagttggttagctacttctcattttgttctaggattcttcttgttcgtaggtcatttgtggcacgcgggaagggctcgtgcagctgcagcagggtttgaaaaaggaattgatcgtgattttgaacctgttctttccatgacccctcttaattgagacaggaaatccaatacttgaagtagaaatcactttgattccatcatattggaatcaggtcatacttaaaaaaagtaaattttttcaactcatttatatctaatcttttttctggcttggctaggtgggatagccgagccactaccctttcgttatgatcctgtccgggcaaaaccaataaagaaaaatctattcaacgagcaaaaaaaggagagagagggattcgaaccctcgatagttctttgttcaaaactatgccggttttcaagaccggagctatcaaccactcagccatctctccgaaagacaatttttattttattcctccgaatagaacatggctatatgagtcgatataacactactatctgtagaaagatctcgggtgtgaatctactggtcgatctatacgtatatatagatagaagtatgatccagcatgcccatttgtaaaataaaaaaattccgttttcccccgactccatgtatgaataaagtggtaatgttaataataaggggtagtaataagtcatataaaatcaatagatttatggtaaaatccctgtatgatgtaatgtattttaatacaatttttagggatcaaatggtatagttcatttgttggtagcttggaggattaaaagcatgactcttgctttccaattagctgtttttgcattaattgctacgtcattaatcttattaattggcgtacccgttgtatttgcttctcctgatggttggtcaagtaacaaaaatgttttattttccggtacatcattatggattggattagtctttctggtgggtatccttaattctctcatctcttgaacctattcgtcccagatccaaaacccaaacgacccccccccgaatttttctcggttgtgagacacagcaaaattcaataaaagtccccaaaatgcaaataaagaaaacaaaaaattagaggggggtcgcacttcttgttcttgaatttgaa

SEQ ID NO: 4191 - DNA, 4370 bp, Solanum lycopersicum
gaaattgttttttttttttttttttgattttttttatttcatttttttgttttggactccacaagaatttgtcgatatttccgattaaatcttcttgttactagattttctataggaaaaattatcggaataatttgttattcctttcctctacagagaaacctttcttccaaggcacaccataagagccatttattatttttctttgattctagatcaaagattaatttcatctatattatatattaattatattaagtagattgtagattgatttcgatgtatatctatcagatcatggcttcatgtaccaaatatttcaatatcgttgcatccggtatttttgttttgttccaccagtgtgatgaagaatagatccgagaaagagactttcatttccagtctcctatttatttattgaattttagattttctaaaaggaaaaatagtagattatctctttttctaacagataaaagaatctaaaaatcaatattcgatcgaactgtcttttttccttcgatccgtggaaagatatactctggggttttcgatttatttatatgaagtatgaaggaaagggaccgtttggtccttgaagagttctttcaaaacaagggattgattgaattatcttattaagacaattcatggttcatatgcttagtcagaaggaataatccaatggagttcatggatttacctaggtcagtttatgggctaatcaataaaggatttttatcttcgaaacccattgggaagggcagtgcaagagaaatcagacaaaaatgatcggatcttgggacgccccgaaaaagatatgaggtgctcggaaatggtcgaagtagttgaataggaggatcactatgactatagccattggtaagtttaccaaagacgaaaatgatttatttgatattatggatgactggttacggagggaccgtttcgtttttgtaggctggtccggtctattgctctttccttgtgcctatttcgctgtagggggtttcatgttacgtcaattcgagcttgctcgatctgttcaattgagaccttataatgcaatcgcattctctggtccaattgctgtttttgtttctgtatttctgatttatccactaggtcagtctgggtttcataattggaccttgaacccctttcatatgatgggagttgccggtaaaatactttatttgaagacggtgatggtgcaaatacattccgtgcttttaacccaactcaagccgaagaaacttattcaatggtcaccgctaaccgcttttgtgaccggtttatggatgagtgctcttggagtagtcggtctagctctgaacctacgtgcctatgacttcgtttctcaggaaattcgcgcagcggaagatcctgaatttgagactttctacaccaaaaatattctcttaaacgaaggtattcgcgcttggatggcggctcaagatcagcctcatgaaaaccttatattccctgaggaggttctaccacgtggaaacgctctttaatggaactttagccttagctggtcgtgaccaagaaaccacaggtttcgcttggtgggccgggaatgcccgacttatcaatctatccggtaaactactaggggctcatgtagcccatgctggattaatcgtattctgggccggagcaatgaacctatttgaagtggcccatttcgtacccgagaagcctatgtatgaacaaggattgattttacttccccacctagctactctaggttggggggtaggccctgggggagaagttatagatacctttccatactttgtatctggagtacttcatttaatttcttctgcagtattgggctttggcggcatttatcatgcacttctgggacctgagacacttgaagaatcttttcccttctttggttatgtctggaaagatcgaaataaaatgaccacaattttaggtattcacttaatcttgttaggtataggtgcttttcttctagtattcaaggctctttattttgggggcgtatatgatacctgggctccgggagggggagatgtaagaaaaattaccaacttgacccttagcccgagtatcatatttggttatttactaaaatccccttttggaggagaagggtggattgttagtgtggacgatttagaagatataatcggaggacatgtatggttaggttccatttgtatacttggtggaatctggcatatcttaaccaaacccttcgcatgggctcgacgcgcacttgtatggtctggagaggcttacttatcttatagtttaggggctttagccgtctttggtttcattgcttgttgttttgtctggttcaataataccgcttatcctagtgaattttacgggcctactggaccagaagcttctcaagctcaagcatttacttttctagttagagaccaacgtcttggggctaacgtgggatccgctcaaggacctactggtttaggtaaatatctaatgcgttccccaaccggagaagtcatttttggaggagaaactatgcgtttttgggatctgcgtgctccatggttagagcctctaaggggtccaaatgggttagacttgagtaggttgaaaaaagacatacaaccttggcaggaacggcgttccgcggaatatatgactcatgctcctttaggttctttaaattccgtgggtggtgtagctaccgagatcaatgcagtcaattatgtctctcctagaagttggttagctacctctcattttgttctaggattcttcttctttgtaggtcatttgtggcacgcaggaagggctcgtgcagctgcagcaggatttgaaaaaggaattgatcgcgactttgaacctgttctttccatgacccctcttaattgatatgagacaggagatccaatgcttgaatgaagtacaaattactttgattcaatcatacatcttggaatcagcttaagtattccttttttcttttttttttttcaactcatttattttatctaatttatatctaatctatttttctggcttggctaggtgggatagccgagccattcccttttctttcggatagcagattgggcaaaaccactaaataaaaaaatctattcaattagcaaaaaaggagagagagggattcgaaccctcgatagttctttgttcaaaactataccggttttcaagaccggggctatcaaccactcagccatctctccgaaagactatttttattttattcctccgaatagaacatggctataggggtggatacccccactatctgtagaaagatctcaggtgcgaatccgccgatcgatctatctatccgtatatagatatatgatctagcatgtccatttgtgaaataaaaaagaaaattccatttccccccaccccactccatgtacgaataaagtgcgaaagggggagtagtaataagtcatatagaatcaatggattcatgataaagtaaaatccctcgatgacatattttatcacaattaatattttttggctgatagagggatcaaatggtatatagttcatttgttggtagcttggaggattaaaagcatgactcttgctttccaattggctgtttttgcattaattgctacttcattaatcttattgattagcgtacccgttgtatttgcttctcctgatggctggtcaagtaacaaaaatgttgtattttctggtacctccttatggattggattagtctttctggtgggtatccttaattctctcatctcttgaacctattcgtcgcagacccaaaaccaaaatgacccccctaatttttctcggttgtgagacacattaaatttgaatctaagtccccaaagaaaatgcaaatcaaataaagaaaacaaaaaaattagaggggggtcaaacttcttgaataaaaagaatataattaacaaaattattggaatcgttccgaagagaatatgtgtcccggcactgcacaaataagatccggttatatatcatatatgtgggtacatattgtgtatcaagaacaaaaaaatgcggatatggtcgaatggtaaaatttctctttgccaaggagaagatgcgggttcgattcccgctatccgcccaagatccaagataaagtaatttttttactatttctttttattattgaatttcataaatagcattaaatatatccttacattaaggagttggtatagttggccgtgatagtgtagtgattctatccctcccctacgttttcttttgccttccacccccaaaaagcgaaaggcgggaattaattactagttaccagaataagatgttgcggagacaggatttgaacccgtgacctcaaggttatgagccttgcg

SEQ ID NO: 4192 - DNA, 3854 bp, Malus domestica
aatatatgatacttatgatactgtagtagtttaatacacatagaaatttgaagaatacataaaaatatttataaatttcccctcttcaacgggattcaagactaagattagttgatgaaacgagaagaatatgtccgggatttatcggtatggagaaaagggatcacttgtttcttgaacaattctaaaattcatctatctgattgatgagtcagaagacaattcatggttcggacagttattaagaataggaagggataagataaccgggttgagttcatggattaaactaggtcgggttacagattaataaatgatttttctattcgaaacccattcaaaagtcaaaagaaggggcagtgtacgagaaatcaaatcatacagaaatgatagaagcctcgaacgttcagaaaatgctatgaggtgttcgaaaatggttgaagtagttgaataggaggatcactatgactatagcccttggtaaatttaccaaagacgaaaatgatttatttgatattatggatgactggttacggagggaccgcttcgtttttgtaggttggtctggcctattactctttccttgtgcctatttcgctttagggggttggttcacaggtacaacctttgtaacttcatggtatacccatggattagcaagttcctatttggaaggctgtaacttcttaaccgcggcagtttccactccggctaatagtttagcgcactcgttgttgttactatggggtcctgaagcacaaggagattttactcgttggtgtcaattaggcggtctatggacttttgttgctctacatggcgctttcggactaataggttttatgttacgtcaatttgagcttgctcgatctgttcaattgcgaccttataatgcaatcgcattctccggtccaattgctgtttttgtttctgtattcctaatttatccgttaggtcagtctggttggttctttgcgcccagttttggtgtagcagctatatttcgattcatcctctttttccaggggtttcataattggacattgaacccatttcatatgatgggagttgctggggtgttgggcgctgctctgttatgcgctattcatggtgctaccgtagaaaatactttatttgaagatggtgatggtgcaaatacattccgtgcttttaacccaactcaagctgaagaaacttattcaatggtcaccgctaaccgtttttggtcccaaatctttggggttgctttttccaataaacgttggttacatttctttatgttatttgtaccagtaaccggtttatggatgagtgctcttggagtagtaggtctggccctgaacctacgtgcctatgacttcgtttctcaggaaatccgtgcagcggaagatcctgaatttgagactttctacaccaaaaatattctcttaaacgaaggtattcgtgcttggatggcggctcaagatcagcctcatgaaaaccttatattccctgaggaggttctaccccgtggaaacgctctttaatggaactttagctttagccggtcgtgaccaagaaaccaccggtttcgcctggtgggccgggaatgcccgacttatcaatttatccggtaaactactgggggctcatgtagcccatgccggattaatcgtattctgggccggagcaatgaacctatttgaagtggctcatttcgtaccagagaagcctatgtatgaacaaggattaattttacttcctcacctagctactctaggttggggggtaggtccgggtggggaagttctagacacctttccatactttgtgtctggagtacttcacttaatttcctctgcagtattgggctttggcggtatttatcatgcacttctgggacccgagactcttgaagaatcttttccattcttcggttatgtatggaaagatagaaataaaatgactacaattttgggtattcacttaatcttgttaggtataggtgcttttcttctagtattcaaggctctttattttgggggtgtatatgatacctgggctccgggcgggggagatgtaagaaaaattaccaacttgacccttagcccaagtattgtatttggttatttactaaaatccccctttggcggagaagggtggatcgttagtgtagacgatttggaagatataattggtgggcatgtatggttaggttccatttgtatacttggtggaatctggcatatcttaaccaaaccctttgcatgggctcgccgtgcacttgtatggtctggagaggcttacttgtcttatagtttaggtgctttatccgtttttggttttattgcttgttgctttgtttggttcaataataccgcctatcctagtgagttttatggacccactggaccagaagcttctcaagctcaagcatttacttttttggttagagaccaacgtcttggggctaacgtaggatccgctcaaggacctaccggtttaggtaaatatctaatgcgttcgccgaccggggaagttatttttggaggagaaactatgcgtttctgggatctgcgtgctccctggttagaacccttaaggggtcctaatggtttggacttgagtaggttgaaaaaagacatacagccttggcaagaacgacgttctgcggaatatatgactcatgctcctttaggttctttaaattccgtgggtggcgtagctaccgagatcaacgcagtcaattatgtttctcctagaagttggttagctacttctcattttgttctaggattcttcctattcgtaggtcatttatggcacgcgggaagggctcgtgcagctgcagcaggatttgaaaaaggaattgatcgtgattttgaacctgttctttccatgactcctcttaactgagacagagatccaatgcttgaagtaggaatcaaattgattccaccaaacttaatatgtatggtggtcatattttaaaagcattctttcttttcaactcatttatatcttctaatcttttttttctggctcggctatcccacttagccgagccatttccttttatgctaccgatttcttttatgctacgctactgagccgggcaaaaccaataaaataaagaaaagcaacaaatctattcaccgagtataaaggagagagagggattcgaaccctcgatagttctttgtttcgaactataccggttttcaagaccggagctatcaaccactcggccatctctccgaaagataatttctatttcatttttatcccatattttatttttattccaccccatagaacacggacatatgagttgataccattactatctatagaaagatatcgggtgtgaatctataggtctatctattctgtatatatataatatagatgcatgatccagcaagcatgcccctttggaaagtaaaaaaaaaaaaaaaaatggattcatggtaaaatccttacatgatgcattttttttttttttttacaattttttggctgataaagggatcaaatggtataattcttttgttggtagattggaggattagaaacatgactattgctttccaattggctgtttttgcattaattgctacttcattaatcttactgattagtgtacctgttgtatttgcttctcctgagggttggtcgggtaacaaaaatgttctattttccggcacatcattatggattggattagtctttctggtgggtatccttaattctctcatctcttgaacctattcgttctatatccaaaaatgaaatgacccccctcccaattccttcaggttgtgagacacattaaaattcaatataagtcccaaaaattcaaataaagaaaaaaa

SEQ ID NO: 4193 - DNA, 4280 bp, Amsonia hubrichtii
ggacttatattaattaatgtgtctcacaaccgagaaaaattcgggggtcttttcggttttggatctgggacgaataggttcaagagatgagagaattaagaataccgactagaaagactaacccaatccataatgaggtaccggaaaatataacatttttgttactcgaccaaccatcaggagaagcaaatacaacgggcacgctaatcaataagattgatgaagtagcaattaatgcaaaaacagccaattggaaagcaagagtcatgcttttaatcctccaagctaccaacaaatgaatttctaccatctgatccctctattagccaaaaattgtaataaaatacagcaggggattttactttaccatgaatccattgattctatatgacttattactaacccttttaccgtacgtggggtcgagggaaatgaatttttttctttcacaaatgggcgtgctcatatatacggataggtagatccattggtagattcccacccgaggtctttccgtctttctacagatagtggtggtatccacccctctggtcatgttctatggtcatgttctattcggaggaataaaataaaaattgtctttcggagagatggctgagtggttgatagccccggtcttgaaaaccggtatagttgtgaacaaagaactatcgagggttcgaatccctctctctccttttttgttcattgaataggtttatttctttattagtttttcccggactggtatcgtaaaggggaatggctcggctatcccaccgagccaggccgaaaaatggattatgattctataaattaaatgagttagaaaaaaaaaaaaaaaaaaaaagattttaagtatgacccgatcccaagacgtatgatggaattattcctatttcaagcattggatctcctcgtttatctcaattatcaattaagagggttcatggaaagaacaggttcaaaatcacgatcaattcctttttcaaatcctgctgcagctgcacgagcccttcccgcgtgccacaaatgacctacgaagaagaagaatcctagaacaaaatgagaggtagctaaccaacttctaggagagacataattgactgcattgatctcggtagctacgccacccacggaatttaaagaacctaaaggggcatgagtcatatattctgcggaacgccgttcttgccaaggttgtatgtcttttttcaacctactcaagtccaacccatttggaccccttagaggttctaaccaaggagcacgcagatcccaaaaacgcatcgtttctcctccaaaaatgacttctccggttggggaacgcattagatatttacctaaacctgtaggcccttgagcggatcccacgttagccccaagacgttggtctctaactagaaaagtaaacgcttgggcttgagaagcttctggcccggtgggtccgtaaaactcactaggataagcggtattgttgaaccagacaaaacaacacgcaatgaaaccaaagacggataaagcccctaaactataagataagtaagcctctccagaccatacaagtgcgcgtcgagcccacgcgaagggtttagttaagatatgccagattccaccaagtatacaaatggaacctaaccatacatgtcctccgattatatcttctaaatcgtccacactaacaatccatccttcccctccaaagggcgattttagtaaataaccaaatatgatactcgggctaagagtcaagttggtaatttttcttacatctccccctcccggagcccaagtatcatacacgcccccaaaatatagagccttgaatactagaagaaaagcacctagacctaacaagattaagtgaatacctaaaattgtggtcattttatttctatctttccatacataaccgaagaatggaaaagattcttcaagcgtctcaggaccaagaagcgcatgataaataccgccaaagcccaaaaccgcagaggaaattaaatgaagtactccagatacaaagtacggaaaggtgtctataacttccccccccggacctaccccccaacctagagtagctagatggggaagtaaaattaacccttgttcatacatgggcttctctggtacgaaatgagccacttcaaataggttcattgctccggcccagaatacgattaatccagcgtgggctacatgagcccctagtagtttaccggataaattgataagtcgggcatttccggcccaccaagcgaaaccggtggtttcttggtcacgaccagctaaagctaaagttccattaaagagcgtttccacgtggtagaacctcctcagggaatataaggttttcatgaggctgatcttgagccgccatccaagcacgaataccttcgtttaagagaatatttttggtgtagaaagtctcaaattccggatcttccgctgctcgaatttcctgagaaacaaagtcataggcacgtaggttcagggccagaccaactactccaagagcactcatccataaaccggttactggtacaaataacataaagaaatgtaaccaacgtttattggaaaagcaaccccaaagatttgggaccaaaagcggttagcggtgaccattgaataagtttcttcagcctgagttgggttaaaagcacggaatgtatttgcaccatcaccatcttcaaataaagtattttctacggtagcaccatgaatagcgcacagcaaagcagcgcccaatacaccggcaactcccatcatatgaaaggggttcaacgtccaattatgaaacccttgaaaaaagaggatgaatcgaaatatagctgctacgccaaaactaggcgcaaagaaccaaccagattgacctagtggataaatcaagaatacagaaacaaaaacagcaattggaccagagaatgcgattgcattataaggtcgcaattgaacagatcgagcaagctcgaattgacgtaacatgaaacctattaatccgaaagcgccatgaagagcaacaaaagtccacagaccgcctaattgacaccaacgagtaaaatctccttgtgcttcaggaccccatagtaacaacaaagagtgtgctaaactattagcaggagtagaaactgcggcagttaagaaattgcagccttccaaataggaactggccaatccatgggtataccatgaagttacaaaggttgtacctgtgaaccaaccccctaaagcgaaataggcacaaggaaagagcaatagaccggaccagcctacaaaaacgaaacggtccctacgtaaccagtcatccataatatcaaataaatcattttcgtctttggtaaatttaccaagggctatagtcatagcgattctcctattcaactacttcgaccatttccgagcacctcatagcattttcggggcgttcgaagattcgatcatttatgtatgatttctcttgcactgccccactccaatgggtttcgaagataaaaatcccttattggtccatacattggcctagataaatccatgaactcaatttgattattccttcttactaagtatctgaacctgtcttcttatgactcatcaatcaatcagatagatgaatatcttttgaaagacctgttcaaggaacaatcaaccccctctctcattcccaatcgatttcagacctaaccccctctgttccattaattaatgttattattagatctttttcgggagattgagaaaaagaaagatatttatagagtcttcgaatttctatgtatactaaattacattactactttctttttttattttctttagtatctactttattagtatcttctttattagttctatctccctttccttcagataaataaatcgaaaactcctgtgaaaaagagagaatttattcttaaattaaaaagaaaaaagaaataggagactggaaatgaaagtctctttttttttttttttgcatccattctctatcgcactgtcacaacaaaaatataggatgcaaaatatttggtacatgaagccatgatctcctagatatacatctaaatatacttctatagatagaaagtaatcttcatctgtaatcaaagagagatggtggaaatgactcttatgttgtgacagtgcgataaacccttctccgtggagtaacagaataacaatttattcctatatatagaatatagaatagaaaatctaggaacaagaagatttaatcggaaatatcgacaaattcttgcggagtcaaagaaatgaaataaaaa

SEQ ID NO: 4194 - DNA, 3258 bp, Cicer arietinum
tttttttgtttagattagctcagttttttggggctcggctaagtggtgatatagcggagccccaaaaaatattagatataaatgaattgaaaaaaaatactttttcaatatgatctcctcgattcaacccaatatgtatactaaaatcaaagtgattcctacgtcaagcataggatttcatgtctcaattaagaggagtcatggaaagaacaggctcaaaatctcgatcaattcctttttcaaatcctgcagcagctgcgcgagctcttcccgcgtgccataaatgacctacgaataggaagaatcctagaacaaaatgagaagtagctaaccaacttctaggagagacataattgactgcattaatctctgtagctacgccaccaacggaatttaaagaacctaaaggagcatgagtcatatattccgcggaacgacgttcttgccaaggctgtatgtctttttcagtctactcaagtccaaaccattaggaccccttaaaggttctaaccagggagcacgcagatacccaaaaacgcatagtttcctaccccaaaaataacttccccagtcggggaacgcattagatatttacccaaaccggtaggtccttgagccgatcctacattagctccaagacgttggtctctaactagaaaagtaaatgcttgagcctgagaagcttctggtccagtcggaccataaaactcactaggataagcagtattattaaaccagacaaagcaacaagctataaaaccaaaaacggctaaagcacctaaactataagacaagtaagcttctccagaccatactagtgcacggcgagcccacgcaaagggcttggttaatatatgccagattccaccaagtatacaaatggaacccaaccatacatgccctccaattatgtcttccaaatcatccacactaacaatccatccttctcccccaaaaggagattttagtaaataaccgaatataatacttggactaagggttaagtttgtaatttttcttacatctccccctcctggagcccaggtatcatatatacctccaaaataagaagccttaaatactagaagaaaagcccctatacctaacaatattaagtgaatacctaaaatagtagtcattttatttctgtctttccatacataaccaaagaatggaaaagattcttcaagagtttcaggtcccagaagtgcatgataaataccgccaaagcccaatactgcggaggaaattaagtgaagtactccagacacaaagtatggaaaggtatctattacttcccctccaggacctaccccccaacctagagtagctagatggggaagtaaaattaagccttgttcatacatgggcttctcaggtacgaaatgagcgacttcaaataggttcattgctccggcccagaatactattaatccggcatgggctacatgggcccccagtagtttaccagataaattgataagtcgggcattcccggcccaccaagcaaaaccggtagtttcttggtcacgaccagttaaagctaaagttccattaaagagcgtttccacgtggtagaacctcctcagggaatataaggttttcatgaggctgatcttgagccgccatccacgcacgaataccttcgtttaaaagaatatttttggtgtagaaagtctcaaattcaggatcttccgctgcgcggatttcttgagaaacaaagtcataggcacgtaggttcagggccagaccgactactccaagagcactcatccataaaccagttactggtacaaataacataaagaaatgtaaccaacgtttattggaaaaagcaaccccaaaaatttgggaccaaaagcggttagcggtgaccattgaataagtttcttccgcttgcgttgggttaaaagcacggaatgtatttgcgccatcaccatcttcaaataaagtattttctacggtagcaccatgaatagcgcatagtagggcagcacccaatacaccagcaacgcccatcatatgaaatgggttcaatgtccaattatgaaacccttggaaaaagagaatgaatcgaaatatagctgctacaccaaaactaggtgcaaagaaccaaccagactgacccagtggataaataaggaatacagaaacaaaaacagcaattggaccggagaatgcgattgcattataaggccgcaattgaacagatcgagcaagttcaaattgacgtaacataaaacctattaatccgaaagcaccgtggagagcaacaaaagtccacagaccacctaattgacaccaacgggtaaaatctccttgtgcttcaggaccccaaagtaacaacaaagagtgtgctaaactattagcaggagtagagactgcagcagttaagaagttacaaccttccaaataggaacttgccaatccatgagtataccatgaagttacaaaggtggtacctgtgaaccaacccccacgcgaataggcgcaaggaaaaagcaatagaccagaccaacccacaaaaacgaaacggtccctccgtaaccagtcatccataatatcaaataaatcattttgatctttggtaaatttaccaagagcgatagtcatagtcatcctcctattcaactacttcaaccatttccgaacacctcctagcattttcagggatggaatcttcgagtcttttttcattttacatatgatatgatttctcgtagactgccccttcttttctactgggtttcgaatagaaaaatccctttttttgtcgattgatacctaatctatgtaaaatccctgaacttcatttggttattcctttctattctttttcaaattccctaaatcatgaattgggaattgacttctgactcgtaaatcctataaataaattatttaaagaactgttccagaaacaaatgatcgcttttatcactctcgttcccagcggatccccagatatactactctccttttatcaaataatcttatcttattcttgaatgttgttcgtgaaataaaaaaaaaggggttttttatattgtgtatgtctaggaaacaactagaggatcatattttttctttctatttgacatttatttcttttattgtcttctttgttctttttttgtttcgttcatattaaaaaaatcccaaagtatacttttttgcagatccaggtaagaaattcgaatattttttctatttatttttttatctatctgtcaaatttttaaatattgtatcgaattt

SEQ ID NO: 4195 - DNA, 3168 bp, Cicer arietinum
tctcctcgattcaacccaatatgtatactaaaatcaaagtgattcctacgtcaagcataggatttcatgtctcaattaagaggagtcatggaaagaacaggctcaaaatctcgatcaattcctttttcaaatcctgcagcagctgcgcgagctcttcccgcgtgccataaatgacctacgaataggaagaatcctagaacaaaatgagaagtagctaaccaacttctaggagagacataattgactgcattaatctctgtagctacgccaccaacggaatttaaagaacctaaaggagcatgagtcatatattccgcggaacgacgttcttgccaaggctgtatgtcttttttcagtctactcaagtccaaaccattaggaccccttaaaggttctaaccagggagcacgcagatcccaaaaacgcatagtttctcccccaaaaataacttccccagtcggggaacgcattagatatttacccaaaccggtaggtccttgagccgatcctacattagctccaagacgttggtctctaactagaaaagtaaatgcttgagcctgagaagcttctggtccagtcggaccataaaactcactaggataagcagtattattaaaccagacaaagcaacaagctataaaaccaaaacggctaaagcacctaaactataagacaagtaagcttctccagaccatactagtgcacggcgagcccacgcaaagggcttggttaatatatgccagattccaccaagtatacaaatggaacccaaccatacatgccctccaattatgtcttccaaatcatccacactaacaatccatccttctcccccaaaaaggagattttagtaaataaccgaatataatacttggactaagggttaagtttgtaatttttcttacatctccccctcctggagcccaggtatcatatatacctccaaaataagaagccttaaatactagaagaaaagcccctatacctaacaatattaagtgaatacctaaaatagtagtcattttatttctgtctttccatacataaccaaagaatggaaaagattcttcaagagtttcaggtcccagaagtgcatgataaataccgccaaagcccaatactgcggaggaaattaagtgaagtactccagacacaaagtatggaaaggtatctattacttcccctccaggacctacccccaacctagagtagctagatggggaagtaaaattaagccttgttcatacatgggcttctcaggtacgaaatgagcgacttcaaataggttcattgctccggcccagaatactattaatccggcatgggctacatgggcccccagtagtttaccagataaattgataagtcgggcattcccggccaccaagcaaaaccggtagtttcttggtcacgaccagttaaagctaaagttccattaaagagcgtttccacgtggtagaacctcctcagggaatataaggttttcatgaggctgatcttgagccgccatccacgcacgaataccttcgttaaaagaatatttttggtgtagaaagtctcaaattcaggatcttccgctgcgcggatttcttgagaaacaaagtcataggcacgtaggttcagggccagaccgactactccaagagcactcatccataaaccagttactggtacaaataacataaagaaatgtaaccaacgtttattggaaaaagcaaccccaaaaatttgggaccaaaagcggttagcggtgaccattgaataagtttcttccgcttgcgttgggttaaaagcacggaatgtatttgcgccatcaccatcttcaaataaagtattttctacggtagcaccatgaatagcgcatagtagggcagcacccaatacaccagcaacgcccatcatatgaaatgggttcaatgtccaattatgaaacccttggaaaaagagaatgaatcgaaatatagctgctacaccaaaactaggtgcaaagaaccaaccagactgacccagtggataaataaggaatacagaaacaaaaacagcaattggaccggagaatgcgattgcattataaggccgcaattgaacagatcgagcaagttcaaattgacgtaacataaaacctattaatccgaaagcaccgtggagagcaacaaaagtccacagaccacctaattgacaccaacgggtaaaatctccttgtgcttcaggaccccaaagtaacaacaaagagtgtgctaaactattagcaggagtagagactgcagcagttaagaagttacaaccttccaaataggaacttgccaatccatgagtataccatgaagttacaaaggtggtacctgtgaaccaaccccccacggcgaaataggcgcaaggaaaaagcaatagaccagaccaacccacaaaaacgaaacggtccctccgtaaccagtcatccataatatcaaataaatcattttgatctttggtaaatttaccaagagcgatagtcatagtcatcctcctattcaactacttcaaccatttccgaacacctcctagcattttcagggatggaatcttcgagtcttttttcatttactatatgatatgatttcttcgtagactgcccttccttttctactgggtttcgaatagaaaaatccctttttttgtcgattgatacctaatctatgtaaaatccctgaacttcatttggttattcctttctattctttttcaaattccctaaatcatgaattgggaattgacttctgactcgtaaatcctataaataaattatttaaagaactgttccagaaacaaatgatcgcttttatcactctcgttcccagcggatccccagatatactactctccttttatacaaataatcttatcttattcttgaatgttgttcgtagaaaattaaaaaaaaggggtttttatattgtgtatgtctaggaaacaactagaggatcattatttttctttctatttgacatttatttcttttattgtcttctttgtttcttttttgtttcgttcatattaaaaaaatcccaaagtatactttttgcagatccaggtaagaaattcgaatatttttctatttattttttatctatctgtcaaatttagtcgtggggagcaaggcacgacaggggtataggcccccccccc

SEQ ID NO: 4196 - DNA, 2804 bp, Cicer arietinum
cgaaaaatcaattcgaatatattaacctatataataggaatattgtatttttgtattttgttatcttctttttacttttactatagatatatatatctattaagtataagatataagaggtttttaatagaagaagtttgacccctccctataataataataatgttttcgttttctttatttgtggggtcttatatattccattttaatgtgcctcacaacccgaaattattcggggggaggggtcatttcgttttttgatctagaatgaatagtttcaagagatgagagaattaagaatacccactagaaatactaatccaatccataatgatgtaccggaaaatacaacatttttgttacttgaccaaccatcaggagaagcaaatacaacaggtacactaatcaataaaatgaatgaagtagcaattaatgcaaaaacggctaattgaaaagcaatagtcatgtttctaatcctccaatttaccaacaaaagaactataccatttgatcccccaaccccttgaccccttaaaaaatttctaataatgtaataaaaaatgaatgcattatggagggttttatcatgaatccattgattttatatgacacccccttttgaggcatggatcgaggagtatttttttacttcagaaattaagggcatgctggatcatgcatatatatacggatagagaactagaccaatagattcacactgagtatctttaccatttatctatcaatagagaaaaagggtattaattcgtatggtaatgttctattgagtggaataaagataaaatagaaattagcttttggagagatggctgagtggttgatagctccggtcttgaaaaccggtatagttcgaaacaaagaactatcgagggttcgaatccccctctctcctttttcttggcgacttgtttttttgtttagattagctcagttttttggggctcggctaagtggtgatatagcggagccccaaaaaatattagatataaatgaattgaaaaaaaatactttttcaatatgatctcctcgattcaacccaatatgtatactaaaatcaaagtgattcctacgtcaagcataggatttcatgtctcaattaagaggagtcatggaaagaacaggctcaaaatctcgatcaattcctttttcaaatcctgcagcagctgcgcgagctcttcccgcgtgccataaatgacctacgaataggaagaatcctagaacaaaatgagaagtagctaaccaacttctaggagagacataattgactgcattaatctctgtagctacgccaccaacggaatttaaagaacctaaaggagcatgagtcatatattccgcggaacgacgttcttgccaaggctgtatgtcttttttcagtctactcaagtccaaaccattaggaccccttaaaggttctaaccagggagcacgcagatcccaaaaacgcatagtttctcccccaaaaataacttccccagtcggggaacgcattagatatttacccaaaccggtaggtccttgagccgatcctacattagctccaagacgttggtctctaactagaaaagtaaatgcttgagcctgagaagcttctggtccagtcggaccataaaactcactaggataagcagtattattaaaccagacaaagcaacaagctataaaaccaaaaacggctaaagcacctaaactataagacaagtaagcttctccagaccatactagtgcacggcgagcccacgcaaagggcttggttaatatatgccagattccaccaagtatacaaatggaacccaaccatacatgccctccaattatgtcttccaaatcatccacactaacaatccatccttctcccccaaaaggagattttagtaaataaccgaatataatacttggactaagggttaagtttgtaatttttctttacatctccccctcctggagcccaggtatcatatatacctccaaaataagaagccttaaatactagaagaaaagcccctatacctaacaatattaagtgaatacctaaaatagtagtcattttattctgtctttccatacataaccaaagaatggaaagattcttcaagagtttcaggtcccagaagtgcatgataaataccgccaaagcccaatactgcggaggaaattaagtgaagtactccagacacaaagtatggaaaggtatctattacttcccctccaggacctacccccaacctagagtagctagatggggaagtaaaattaagccttgttcatacatgggcttctcaggtacgaaatgagcgacttcaaataggttcattgctccggcccagaatactattaatccggcatgggctacatgggcccccagtagtttaccagataaattgataagtcgggcattcccggcccaccaagcaaaaccggtagtttcttggtcacgaccagttaaagctaaagttccattaaagagcgtttccacgtggtagaacctcctcagggaatataaggttttcatgaggctgatcttgagccgccatccacgcacgaataccttcgtttaaaagaatatttttggtgtagaaagtctcaaattcaggatcttccgctgcgcggatttcttgagaaacaaagtcataggcacgtaggttcagggccagaccgactactccaagagcactcatccataaaccagttactggtacaaataacataaagaaatgtaaccaacgtttattggaaaaagcaaccccaaaaatttggggaccaaaagcggttagcggtgacca

SEQ ID NO: 4197 - DNA, 2778 bp, Flaveria ramosissima
ttcatttttttcaacaacaagaacaggcccccctcaggccccccttctaatctcattttttattttttcttatattgattttgattttggggatttatattgaatgtgtctcacaaccaagaataattcagagggtcatttcggttttggatctaggacaataggttcaagagatgagagaattaaggatacccaccagaaagactaatccaatccataatgatgtacctgaaaatacaacatttttgttacttgaccaaccatcaggagaagcaaatacaacgggtacgctaatcaataagattaatgaagtagcaattaatgcaaaaacagccaattggaaagcaagagtcatgctttttatcctccaagctaccaacaaatgaactataccatttgatccctatatcagccaaaaattgtactaaaatacatcatacagggattttaccacgaatccattgattctatatgatttattatattactacccctttaccactttattcgtacatggagtcggggcagaatggaatttggttttttattttacatttgattttccaaatgggcatgctggatcatatatctatccatatatcgggatagatagattgaccatcacacccgagatctttgatagtggcggtatccactcatatggccatgttctattcggaggaataaaataaaattgtctttcggagagatggctgagtggttgaaagccccggtcttgaaaaccggtatagtttactatcgagggttcgaatccctctctctccttttttgcttgttgaatagatttgtttctttattggattggttttgaccggatggtttcattatcataaagaaagggaagtggctcggctatcccgcctagccaagccagaaaaaatggattaaggattaaatataaatgagttgaaaaaaaattttatgacatgatccccatatgtatgagggaaccgaagtgactcctatttcaagtctttgatctcctgtctcaattaactgtctcaattaagaggggtcatggaaagaactggttcaaaatcacgatcaattcctttttcaaatcctgctgcagctgcacgagcccttcctgcgtgccacaaatgccctacgaagaagaagaatcctagaacaaaatgagaggtagctaaccaacttctaggagacacataattgactgcattgatctcggtagctactccacccacggaatttaaagaacctaaaggagcatgagtcatatattctgcggaacgacgttcttgccaaggttgtatgtcttttttcagccgactcaagtccaacccatttggaccccttagaggttctaaccaaggagcacgcaaatcccaaaaacgcatagtttctcctccaaaaatgacttctccggtcggggaacgcattaaatatttacctaaaccggtaggcccttgagcggatcccacgttagctccaagacgttggtctctaactagaaaagtaaatgcttgagcttgagaagcttctggtccagtgggtccataaaactcactaggataagccgtattattgaaccagacaaaacaacaagcaatgaaaccaaagacagatatggccgctaaactataagataagtaagcctctccagaccatacaagtgcacgtcgagcccatgcgaagggtttggttaagatatgccaaattccaccaagtatacaaatggaacctaaccatacatggcctccaattatatcttccaaatcgtctacactaacaatccatccttcccccccaaagggcgattttagtagataaccaaatatgatacttgggctaagcgtcaagttggtgatttttcttacatctcctcctcccggagcccaagtatcatatatgcccccaaaataaagagccttgaatactagaagaaaagcacctatacctaacaagattaagtgaatacctaaaattgtggtcattttatttctatctttccatacataaccgaagaacggaaaagattcttcaagcgtctcaggtcctaaaagtgcatgataaataccgccaaagcccaatactgcagaggaaattaaatgaagtactccagatacaaagtatggaaaagtatctatcacttccccaccaggacctaccccccaacctagagtagctaggtggggaagtaaaattaatccttgttcatacataggcttttctggtacgaaatgagccacttcaaatagattcattgctccggcccagaatacgattaatccggcatgggctacatgagcccctagtagtttaccggataaattgataagccgggcattcccggcccaccaagcgaaaccggtggtttcttggtcacgaccagctaaagctaaagttccattaaagagcgtttccacggggtagaacctcctcagggaatataaggttttcatgaggctgatcttgagccgccatccaagcacgaataccttcgtttaagagaatatttttggtgtagaaagtctcaaattcaggatcttccgccgcgcgaatttcttgagaaacgaagtcataggcacgtaggttcaacgccagaccgactactccaagagcactcatccataaaccagttactggtacaaataacataaagaaatgtaaccaacgtttattggaaaagacaaccccaaatatttggaccgaaaagacgattagcagtgaccattgaataagtttcttcagcttgagtcgggttaaagcacggaatgtattgtcgccacgtcaccg

SEQ ID NO: 4198 - DNA, 4047 bp, Flaveria ramosissima
tttatattgaatgtgtctcacaaccaagaataattcagagggtcatttcggttttggatctaggacaataggttcaagagatgagagaattaaggatacccaccagaaagactaatccaatccataatgatgtacctgaaaatacaacatttttgttacttgaccaaccatcaggagaagcaaatacaacgggtacgctaatcaataagattgatgaagtagcaattaatgcaaaaacagccaattggaaagcaagagtcatgctttttatcctccaagctaccaacaaatgaactataccatttgatccctatatcagccaaaaattgtactaaaatacatcatacagggattttaccacgaatccattgattctatatgatttattatattactacccctttaccactttattcgtacatggagtcggggcagaatggaatttggttttttattttacattttattttacaaatgggcatgctggatcatatatctatccatatatcgggatagatagattgaccatcacacccgagatctttgatagtggcggtatccactcatatggccatgttctattcggaggaataaaataaaattgtctttcggagagatggctgagtggttgaaagccccggtcttgaaaaccggtatagtttactatcgagggttcgaatccctctctctccttttttgcttgttgaatagatttgtttctttattggattggttttgaccggatggtttcattatcataaagaaagggaagtggctcggctatcccgcctagccaagccagaaaaaatggattaaggattaaatataaatgagttgaaaaaaaaaaaaaaaaaaaaaattttatgacatgatccccatatgtatgagggaaccgaagtgactcctatttcaagtctttgatctcctgtctcaattaactgtctcaattaagaggggtcatggaaagaactggttcaaaatcacgatcaattcctttttcaaatcctgctgcagctgcacgagcccttcctgcgtgccacaaatgccctacgaagaagaagaatcctagaacaaaatgagaggtagctaaccaacttctaggagacacataattgactgcattgatctcggtagctactccacccacggaatttaaagaacctaaaggagcatgagtcatatattctgcggaacgacgttcttgccaaggttgtatgtcttttttcagccgactcaagtccaacccatttggaccccttagaggttctaaccaaggagcacgcaaatcccaaaaacgcatagtttctcctccaaaaatgacttctccggtcggggaacgcattaaatatttacctaaaccggtaggcccttgagcggatcccacgttagctccaagacgttggtctctaactagaaaagtaaatgcttgagcttgagaagcttctggtccagtgggtccataaaactcactaggataagccgtattattgaaccagacaaaacaacaagcaatgaaaccaaagacagatatggccgctaaactataagataagtaagcctctccagaccatacaagtgcacgtcgagcccatgcgaagggtttggttaagatatgccaaattccaccaagtatacaaatggaacctaaccatacatggcctccaattatatcttccaaatcgtctacactaacaatccatccttcccccccaaagggcgattttagtagataaccaaatatgatacttgggctaagcgtcaagttggtgatttttcttacatctcctcctcccggagcccaagtatcatatatgcccccaaaataaagagccttgaatactagaagaaaagcacctatacctaacaagattaagtgaatacctaaaattgtggtcattttatttctatctttccatacataaccgaagaacggaaaagattcttcaagcgtctcaggtcctaaaagtgcatgataaataccgccaaagcccaatactgcagaggaaattaaatgaagtactccagatacaaagtatggaaaagtatctatcacttccccaccaggacctaccccccaacctagagtagctaggtggggaagtaaaattaatccttgttcatacataggcttttctggtacgaaatgagccacttcaaatagattcattgctccggcccagaatacgattaatccggcatgggctacatgagcccctagtagtttaccggataaattgataagccgggcattcccggcccaccaagcgaaaccggtggtttcttggtcacgaccagctaaagctaaagttccattaaagagcgtttccacggggtagaacctcctcagggaatataaggttttcatgaggctgatcttgagccgccatccaagcacgaataccttcgtttaagagaatatttttggtgtagaaagtctcaaattcaggatcttccgccgcgcgaatttcttgagaaacgaagtcataggcacgtaggttcaacgccagaccgactactccaagagcactcatccataaaccagttactggtacaaataacataaagaaatgtaaccaacgtttattggaaaagacaaccccaaagatttgggaccaaaagcgattagcagtgaccattgaataagtttcttcagcttgagtcgggttaaaagcacggaatgtatttgcgccatcaccgtcttcaaataaagtattttctacggtagcaccatgaatagcgcatagcaaagcagcgcccaatacaccggcaactcccatcatatgaaatgggttcaatgtccagttatgaaatccttgaaaaaagaggataaatcgaaatatagctgctacaccaaaactaggcgcaaagaaccaaccagactgacctagtggataaatcaggaatacagaaacaaaaacggcaattggaccagagaatgcgattgcattataaggtcgcaattgaacagatcgagcaagttcgaattgacgtaacatgaaacctattagtccgaaagcgccgtggagagcaacaaaagtccacagaccgcctaattgacaccaacgagtaaaatctccttgtgcttcaggcccccatagtaataataaagaatgcgctaaactattagcaggagtagaaactgcggcagttaagaaattgcagccttccaaataggaactggccaatccatgggtataccatgaagttacaaaggttgtacccgtgaaccaaccccctacggcgaaataggcacaaggaaagagcaataggccggaccagcctacaaaaacgaaacggtccctacgtaaccagtcatccataatatcaaacaaatcattttcgtctttggtaaatttaccaagggctatagtcatcgtaatcctcctattcaactacttcgaccatttccgaacacctcatagtattttcggggcgtccaaagagtcgatcatttctgcatgatttttttctcgtgcactaccccttacgatgggtttcgaagataaaaatcctttattggcccataaattgaccacccaggtaaattcatgaattcaatttgattattccttcttattattaagcatctgaatcatgaattgtcttcttatgactcatgaatcagatatattcgttttttgaaagaactgttcaaggaaaaagcaatcccctcgcccactaccggttgatcctcagacttgtccccatctttttccatcaactaaatgggattcttagatcttgttcgtgagattaagaaaaagaactctctttctattctaatttttatgtatactaaattactaagctttttatatttctttttctttgttagaaaagagatagtttccaattttttacttcacttcaatactcaatacaataacaatattcaataaaataaataggagactggaaatgagagtatttatcccgcatccattcttcatacgattgtcggaacaaaaatattggatgcaacaaatggaaatttttggtacatcaagtcgcgatctgatagctataaatctcaatataaatatatat

SEQ ID NO: 4199 - DNA, 4361 bp, Gossypium raimondii
ttattatattattcttataatattattatatatattattatttctatttagttattatttagttattatttatatttagtctatttagaattttttattatttcatttaagttattattatttaatttaagttaaatagaaaaattaataatttaatttaagtataattaaaataaattattaatttaataatttagaatttcattttttttattatgatttcgattttattattttcttttcattcatcattcaaattctatttatttcattcaagttacattacagattacagaagtttgactgacccccccctctaatttttttttattttcattttggcaacttatacttctatattattgaatgtgtttcaaaatctgaaaaattcgtgggaggggtcatttttggatccagaatggatagattcaagaaataagagaattaaggatacccactagaaaaactaatccaatccataaagatgtaccggaaaatacaatatttttgttactcaaccaaccatcaggagaagcaaatacaacaggtacactaatcagtaagattgacgaagtagcaattaatgcaaaaacagccaattggaaagcaatagtcatgtttctaatcctccaagctaccaacaaaagaactataccatttgatccctctatgatattgaccaaaaaaaaattaataaaatgcaaggtagagggattttaccatgaatcgattgattctatatgacttatttccaaccctttgaaccgcttttattcggacatggggtcgagggtgatttttttatttcacgttcccaaataggcatgctagattatgcatttcatctatctatatatacagataaatagattgacctataggttcacacacgatatctttctatacatagtgatggtatcaactcatatggccatgttcgattcggtggaataaaaataaaatagaaattagctttcggagagatggctgagtggttgatagctccggtcttgaaaaccggtatagttcgaaacaaagaactatcgagggttcgaatccctctctctccttttgctcgatgaatagatttctttctttattgctttttcctggcttcttaattaagaatcttaatattaataaaagggaatggctcggctgggtggaatagccgagccagaaaaaaaaagtttagatagaaaatgagttgaaacgaaaggaaaacagaatactttttaaatatcacctgattccttcaatatatatagtgtaatcaatcctacgttaagcacaaattgattcctacgttaagcattggatctcctgtctcagttatctcagttaagaggagtcatggaaagaacaggctcaaaatcacgatcaattcctttttcaaatcccgctgcggctgcgcgagctcttcccgcgtgccataaatgacccacgaataggaagaatcctagaacaaaatgagaggtagctaaccaacttctcggagagacataattaactgcattgatctcggtagctacgccacctacagaatttaaagaccctaaaggagcatgcgtcatatattccgcagaacgccgttcttgccaaggttgtatgtcttttttcaacctactcaagtccaaaccattgggacctcttagaggttctaaccaaggagcacgcagatcccaaaagcgcatagtttcccctccaaaaatgacttctccggtcggggaacgcattagatatttacctaacccagtaggcccttgagcggatcccacgttagccccaagacgttggtctctaactagaaaagtaaatgcttgagcttgagaagcttctggtccagtgggcccgtaaaactcactaggataagcggtattattgaaccagacaaagcaacaagcaatgaaaccaaaaacggataaagcacctaaactataagacaagtaagcctctcccgaccatacaagtgcacggcgagcccatgcaaaaggtttggttaagatatgccagattccaccaaatatacaaatggaacctaaccatacatgtcctccaattatatcttccaaatcgtccacactaacaatccacccttcgcctccaaagggcgattttagtaaataaccaaatataacacttgggctaagagtcaagttggtaatttttcttacatctccccctcccggagcccaggtatcgtatacgcccccaaaataaagagccttgaatactagaagaaaagcacctatacctagcaaaattaagtgaatacccaaaattgtggtcattttatttctatctttccatacataaccgaaaaatggaaaagattcttcaagagtttcaggtcccagaagtgcatgataaataccgccaaagcccaatacagcagaggaaattaagtgaagtactccagatacaaagtatggaaaggtgtctataacttctccgccaggacctaccccccagcctagagtagctaggtggggaagtaaaattaatccttgttcgtacatgggtttttctgggacaaaatgagccacttcaaataggttcattgctccggcccagaatacgattaatccggcatgggctacatgagcccccaatagtttaccggataaattgataagccgggcattcccggcccaccaagcgaaaccggtggtttcttggtcacgaccggctaaagctaaagttccattaaagagcgtttccacggggtagaacctcctcagggaatataaggttttcatgaggctgatcttgagccgccatccaagcacgaataccttcgtttaaaagaatatttttggtgtagaaagtctcaaattcaggatcttctgctgcacggatttcctgggaaacgaagtcataggcacgtaggttcagagccagaccgactactccaagagcactcatccataaaccggttactggtacaaataacataaagaaatgtaaccaacgtttattggaaaaagcaaccccaaagatttgggaccaaaagcggttagcggtgaccattgaataagtttcttcggcttgagttgggttaaaagcacggaatgtatttgcaccatcaccatcttcaaataaagtattctctacggtagcaccatgaatagcgcatagcagagccgcgcccaatacaccggcaactcccatcatatgaaatgggttcaatgtccaattatgaaatccttggaaaaagaggatgaatcgaaatatagctgctacaccaaaactaggcgcaaagaaccaaccagactgacctagtggataaatcaggaatacagaaacaaaaacagcaattggaccagagaatgcgattgcgttataaggtcgcaattgaacagatcgcgcaagttcaaattgacgtaacataaaacctattagtccgaaagcgccgtggagagcaacaaatgtccacagaccacctaattgacaccaacgagtaaaatctccttgtgcttcaggaccccatagtaacaacaaagaatgtgctaaactattagcaggggtagaaactgcggcggttaagaaattgcagccttccaaataggagctggccaatccatgagtataccacgaagttacaaaggttgtacctgtaaaccaaccccctacagcgaaataggcacaaggaaagagcaataggccggaccaacctacaaaaacgaaacggtccctacgtaaccagtcatccataatatcaaataaatcattttcatctttggtaaatttaccaagggctatagtcatagcaatcctcctattcaactacttcaaccatttccgagcaccttatgttatgggggcgctgggggattcgattttttatgtatgatttgatttctcgtgcactgccccttataattaattggtttcgaatataaaaaaatattgtcttgtattggtccataacctgacttaggtaaatccatgaactcaattcgtttattcttttctatttttactagtcgtctgaaccatgaattgtcttatggctcatcaatcagatagatgaattttttgaacgaactcttcaattcaaggaagaagcgatcccttctctcgctactggttgatccccagatctacccctccccctccatcaactaatcttattcttggatcttgttcgtgaaattgataaaaatcaatattcttatgtatttttataatttctatgtgtattaaattactatagtctgatatatatttccttcattttatttcttttatttattgttttctttatcatatttccttcagatgaatataaaacaaaaaaactccagaggctagtttttcatttcacgggtcgagaaatccacttcgaatctttttctatt

SEQ ID NO: 4200 - DNA, 2282 bp, Carpinus betulus
gatgttctattcggtagaataaaaaaataaataagaaattgtctttcggagaggtggccgagtggttgatagctccggtcttgaaaaccggtatagttcaaaaaaaagaactatcgagggttcgaatccctctctctccttttttttgctcggcgaatagatttgtttttttatttttttggttttgtccggctcagtatcataaaagggaatggctcggctaggggggatagccgagccagaacagaaaaaaagaattagattgaaatgataaatgagttgaaaatgaaaagaaaggaatacttttgaaatatgacctaatccacccaacccaatcccaatatgtatgatgaaatcaaattgattccgacttcaaacattagatttcctgtcttagttaagaggagtcatggaaagaacaggttcaaaatcacgatcaattcctttttcaaatcctgctgcagccgcgcgagcccttcctgcatgccataaatgacctacaaataggaagaatcctagaacaaaatgagaggtagctaaccaacttctaggagagacataattgactgcattgatctcggtagctacgccacccacagaatttaaagaacctaaaggagcatgagtcatatattctgcagaacgccgttcttgccaaggttgtatgtctttttttagcctactcaagtccaaaccattgggaccccttaggggttctaaccagggagcacgcaaatcccaaaaacgcatagtttctcccccaaagatgacttctccagtcggcgaacgcattagatatttacctaaaccggtaggtccttgggcggatcccacgttagccccaagacgttggtctctaactagaaaagtaaatgcttgagcttgagaagcttctggtccagtgggcccgtaaaactcactaggataagcggtattattgaaccaaacaaagcaacaagcaataaaaccaaaaacagctaaagcacctaaactataagacaagtaagcctccccagaccatacaagtgcacggcgcgcccatgcaaaaggtttggttaagatatgccagattccaccaagtatacaaatggaacctaaccatacatgccctccaattatatcttccaaatcgtccacactaacaatccatccctctcctccaaaaggagattttagtaaataaccaaatataacacttgggctaagggtcaagttggtaatttttcttacatctccccctcctggagcccaggtatcatatacgcctccaaaataaagagccttgaatactagaagaaaagcacctatacctaacaaaattaagtgaatacccaaaattgtagtcattttatttctatctttccatacataaccgaagaatggaaaagattcttcaagagtctcgggtcccagaagtgcatgataaataccgccaaagcccaatactgcagaggaaattaagtgaagtaccccagacacaaagtatggaaaggtatctataacttccccaccagggcctaccccccaacctagagtagctaggtggggaagtaaaattaacccttgttcatacatgggcttttctggtacgaaatgagccacttcaaataggttcattgctccggcccagaatacgattaatccggcatgggctacatgagctcccaataatttaccggataaattgataagccgggcattcccggcccaccaagcgaaaccggtggtttcttggtcacgaccggctaaggctaaagttccattaaagagcgtttccacggggtagaacctcctcagggaatataaggttttcatgaggctgatcttgagccgccatccaagcacgaataccttcatttaaaagaatgtttttggtgtagaaagtctcaaactcaggatcttctgctgcacggatttcctgagaaacgaagtcataggcgcgtaggttcagagccagaccgactactccaagagcactcatccataaaccggttactggtacaaataacataaagaaatgtaaccaacgtttattggaaaaagcaaccccaaagatttgggaccaaaagcggttagcggtgaccattgaataagtttcttcagcttgagttgggttaaaagcacggaatgtatttgcaccatcaccatcttcaaataaagtattttctacggtagcaccatgaatagcgcatagcagagcagcgcccaatacaccggcaacccccatcatatgaaatgggttcaatgtccaattatgaaacccttggaaaaagaggatgaat

SEQ ID NO: 4201 - DNA, 3108 bp, Platanus occidentalis
acctgatcccaatatgtatgatggaatcaaattgattcctacttcaggcatttgatcttctgtctcagttaagaggggtcatggaaagaacaggctcgaaatcacgatcaattcctttttcaaatcctgctgcagctgcacgggcccttcccgcatgccacaaatgacccacgaataggaagaatcctagaacaaaatgagaggtagctaaccaacttctaggagagacataattgactgcattgatctcggtagctacgccacccacggaatttaaagaacctaaaggagcatgagtcatatattccgcggaacgccgttcttgccaaggttgtatgtcttttttcagcctactcaagtccaaaccattgggaccccttagaggttccaaccagggagcacggagatcccaaaaacgcatagtttctcctccaaaaatgacctctccggtaggggaacgcattagatatttacctaaaccagtaggtccttgagcggatcccacgttagccccaagacgttgatctctaactagaaaagtaaatgcttgagcttgagaagcttctggcccagtgggcccataaaactcactaggataagcggtattattgaaccagacaaagcaacaagcgatgaaaccaaagacagataaagcacctaaactataagacaagtaagcctctccagaccatacaagtgcgcggcgagcccatgcaaagggtttggttaagatatgccagattccaccaagtatacaaatggaacctaaccatacatgtcctccaattatatcttctaaatcgtccacactaacaatccatccttctcccccaaagggggattttagtaaataaccaaatataacacttgggctaagggtcaagttggtaatttttcttacatctccccccccgggagcccaggtatcatatacgcccccaaaataaagagccttgagtactagaagaaaagcacctatacctaacaagattaagtgaatacccaaaattgtggtcattttatttctatctttccatacataaccgaagaatggaaaagattcttccagagtctcaggcccgagaagtgcatgataaataccgccaaagcccaatactgcagaggaaattaagtgaagtactccagatacaaagtatggaaaagtgtctataacttccccaccaggacctaccccccaacctagagtagctagatggggaagtaaaattaatccttgttcatacatgggcttctctggtacgaaatgagccacttcaaataggttcattgctccggcccagaatacaattaatccggcatgggctacgtgagccccgagtagtttaccagacaagttgataagtcgggcatttccggcccaccaagcgaaaccggtggtttcttggtcacgaccagctaaagctaaagttccattaaagagcgtttccacggggtagaacctcctcagggaatataaggttttcatgaggctgatcttgagccgccatccaagcacgaataccttcgtttaagagaatgtttttggtgtagaaagtctcaaattcaggatcttccgctgcacggatttcctgggaaacgaagtcataggcacgtaggttcagagccagaccgactactccaagagcactcatccataaaccagttacgggtacaaataacataaagaaatgtaaccaacgtttattggaaaaagcaaccccaaagatttgggaccaaaagcggttagcggtgaccattgaataagtctcttcagcttgagttgggttaaaagcacggaatgtatttgcaccgtcaccatcttcgaataaagtattttctacagtagcaccatgaatagcgcatagcagagcagcacctaatacgccggcaactcccatcatatgaaatgggttcaacgtccaattatgaaacccttggaagaagaggatgaatcgaaatatagctgctacaccaaaactaggtgcaaaaaaccaaccagactgaccaagtggataaatcaggaatacagaaacaaaaacagcaattggagcagagaatgcgattgcattataaggtcgcaattgaacagatcgagcaagttcgaattgacgtaacatgaaacctattagtccgaaagcgccatgaagagcaacaaaagtccacagaccgcctaattgacaccaacgagtaaaatctccttgtgcttcaggaccccatagtagcaataaagaatgtgctaaactattagcaggagtagaaactgcggcggttaagaaattgcagccttccaaataggaactggccaatccatgggtataccatgaagttacaaaggttgtacctgtgaaccaacctcctaaagcgaaataggcacaaggaaagagcaatagaccggaccaacctacaaaaacgaaacggtccctccgtaaccagtcatccataatatcaaataaatcattttcgtctttggtaaatctaccaagggctatagtcatagtgatcctcctattcaactacttcaaccatttccgaacacctcatagcattttcaggacatacaagagttcgatcatttatgtatgatttctcgtccactgccctttccaatgcaatgggtttcgaagataaaaatgctttctttctattgggccataaactgacctaggtaaatccatgagctcgattcgattattctttcctattcctattcttaataaccatctgaaccctgaattgtcttatgactcatcaataagatgaattttttgaaagaactgttcaaggaacaagtgatcccttctttcgccaccagttgctcccctgatctacaccaccgttccatcaacaaatcttattcttgttcttggatctggttagtgatattgagaaaaggtaaggtcaataaatatctctatgaactctcctaatttctatgtatactaaactactacagtatcatatagtatcatatatatatcatattatgatatctatatcatatatataataaagtatcatatatttagaatcttatattcttaatatatatacttaatatatataattatttaatataattaattatataattatatatattatataata

SEQ ID NO: 4202 - DNA, 1425 bp, Populus trichocarpa
caactagttaagaggagtcatggaaagaacaggttcaaaatcacgatcaattcctttttcaaatcctgctgcagctgcacgagcccttcccgcgtgccataaatgacctacgaataggaagaacccgagaacaaaatgagaggtagctaaccaacttctaggagagacatagttgactgcattgatctcggtagctacgccacctacggaatttaatgaacctaaaggcgcatgggtcatatattccgcagaacgtcgttcttgccaaggttgtatgtcttttttcaacctactcaagtccaaaccatttggacctcttagaggttctaaccaaggagcgcgcagatcccaaaaacgcatagtttctcctccaaaaataacttctccggtgggcgaacgcattagatatttacctaagccggtaggtccttgagcggatcccacgttagccccaagacgttggtctctaactagaaaagtaaaagcttgagcttgagaagcttctggtccagtgggcccgtaaaactcactaggataagcggtattattgaaccagacaaagcaacaagcaatgaaaccaaaaacagctaaagcgcctaaactataagacaaataagcctccccggaccatacaagtgcacggcgagcccatgcaaagggtttggttaagatatgccagattccaccaagtatacaaatggaacctaaccatacatgccccccaattatatcttccaaatcatccacactaacaatccatccttctcctccaaaaggagattttagtaaataaccaaaaataacacttgggctaagggtcaagttggtaatttttcttacatctcccccccccggagcccaggtatcatatacgcccccaaaataaagagctttgaatactagaagaaaagcacctatacctagcaagattaagtgaatacctaaaattgttgtcattttatttctatctttccatacataaccaaaaaatggaaaagattcttcaagagtctcgggtcctagaagtgcatgataaataccgccaaagcccaatactgcagaggaaattaagtgaagtacgccagatacaaagtatggaaaggtgtctatgacttccccgccaggacccaccccccaacctagagtagctaggtggggaagtaaaattaatccttgttcatacattggcttctccggtacgaaatgggccacttcaaataggttcattgctccggcccagaatacgattaatccagcatgggctacatgagctcccagcagtttaccggataaattgataagtcgggcattcccggcccaccaagcgaaacctgtggtttcttggtcacgaccagctaaagctaaagttccattaaagagcgtttccacggggtagaacctcctcagggaatataaggttttcat

SEQ ID NO: 4203 - DNA, 2446 bp, Prunus mume
cattggatctctgtctcagttaagaggagtcatggaaagaacaggttcaaaatcacgatcaattcctttttcaaatcctgctgcagctgcacgcgcccttcccgcgtgccataaatgacctacgaataggaagaatcctagaacaaaatgagaagtagctaaccaacttctaggagagacataattgactgcattgatctcggtagctacgccacccacggaatttaaagaacctaaaggagcatgagtcatatattccgcagatcgccgttcttgccaaggctgtatgtcttttttcagcctactcaagtccaaaccattaggaccccttaaaggttctaaccagggagcacgcagatcccagaaacgcatagtttctcctccaaaaataacttccccggtcggagaacgcattagatatttacctaaaccggtaggtccttgagcagatcctacgttagccccaagacgttggtctctaaccaaaaaagtaaatgcttgagcttgagaagcttctggtccagtgggcccgtaaaactcactaggataggcggtattattgaaccaaacaaagcaacaagcaataaaaccaaaaacagataaagcagctaaactataagacaggtaagcctctccagaccatacaagtgcacggcgagcccatgcaaaaggtttggttaagatatgccagattccaccaagtatacaaatggaacctaaccatacatgccctccaattatatcttccaaatcgtccacactaacgatccacccctctccgccaaagggggattttagtaaataaccaaatacaatacttgggctaagggtcaagttggtaatttttcttacatctcccccgcccggagcccaggtatcatatacacccccaaaataaagagccttgaatactagaagaaaagcacctatacctaacaagattaagtgaatacccaaaattgtagtcattttgtttctatctttccatacataaccgaagaatggaaaagattcttcaagagtctcgggtcccagaagtgcatgataaataccgccaaagcccaatactgcagaggaaattaagtgaagtactccagacacaaagtatggaaaggtgtctagaacttccccacccggacctaccccccaacctagagtagctaggtggggaagtaaaatcaatccttgttcatacataggcttctctggtacgaaatgagccacttcaaataggttcattgctccggcccagaatacgattaatccggcatgggctacatgagcccccagtagtttaccggataaattgataagtcgggcattcccggcccaccaagcgaaaccagtggtttcttggtcacgaccggctaaagctaaagttccattaaagagcgtttccacggggtagaacctcctcagggaatataaggttttcatgaggctgatcttgagccgccatccaagcacgaataccttcgtttaagagaatatttttggtgtagaaagtctcaaattcaggatcttccgctgcacggatttcctgagaaacgaagtcataggcacgtaggttaagggccagaccgactactccaagagcactcatccacaaaccggttactggtacaaataacataaagaaatgtaaccaacgtttattggaaaaagcaaccccaaagatttgggaccaaaagcggttagcggtgaccattgaataagtttcttcagcttgagttgggttaaaagcacggaatgtatttgcaccatcaccatcttcaaataaagtattttctacggtagcaccatgaatagcgcataacagagcagcgcccaacaccccagcaactcccatcatatgaaatgggttcaatgtccaattatgaaacccttggaaaaagaggatgaatcgaaatatagctgctacaccaaaactgggcgcaaaaaaccaaccagactgacctagcggataaattaggaatacagaaacaaaaacagcaattggaccggagaatgcgattgcattataaggtcgcaattgaacagatcgagcaagttcaaattgacgtaacataaaacctattagtccgaaagcgccgtgtagagcaacaaaagtccacagaccgcctaattgacaccaacgagtaaaatctccttgtgcttcaggaccccatagtaacaacaaagagtgcgctaaactattagccggagtggaaactgcggcggttaagaagttacagccttccaaataggaacttgctaatccatgggtataccatgaagttacaaaggttgtacctgtgaaccaaccccctaaagcgaaataggcacaaggaaagagcaataggccagaccaacctacaaaaacgaagcggtccctccgtaaccagtcatccataatatcaaataaatcattttcgtctttggtaaatttaccaagggctatagtcat

SEQ ID NO: 4204 - DNA, 12102 bp, Prunus mume
tgaattagttgacgagtacggaaagagagggattcgaaccctcggtaaacaaaagtctacatagcagttccaatgctacgccttgaaccactcggccatctctcctacataatgattatggcccaaaaaccgagtgaatagtgagtcattcatattattttggataggtattatgtacattcaattttaactctaaaaatagaaaacttttcatcaaagaaaaatacttcctccgaggctggggataaagataaatccttttgggaaaaattgtaaaataaggatatatatctattcatgtttgcgaagatggtgtttccgccctttctaatatttataccggattaaatcactcaattgaaacgaatccaatgatcgatatattttttttagactgtgtttaatggatacctttaaatcatgattctatttagtttacactattattcaattttcataaaaattataaaatttctttccagttttagatttttcaacaacaactctttactccaacttcttaacccataaatttattccaaattcatgaaccgcccccggattttttttattgattcctgtcaaaaagaaacaatttgagtaaaaggtcttcctttttaatgaatccgtttttatgttatttcgtactgcacaattcctttgtttgtgggatcattttctcacgaaagggaattaaaataaattatagaatggattaatacacctatgtctagatctgggataaatgaaatttttattgataaacccttttcaattgtagccaatatcttattacgaataattccgacaacttcgggagaaaaagaggcattcacctattacagagatggtgcgatttgattatttttttattttttttatttttaccgctctcggtcttaagagaaagacaacattattcgggataggaagaaaaaaattatggaaataaatctacgcttgttgaaggtgaagtttgtaaataaaacaacgccttctgtcgtgtatccccgattaatgcagcctcagatgcttcaattgtcgattctagagtattgagcgaaaggttacacctatgggttaggtcaaccctactccactagtaccaatagggtgcataggggaagaagcactactcctaggaatcaacacacgaaaactttgttataaattatcccttttccttatcaggatcgggactaacaatggttgggacaacaaacatccatctcgttcgtattttggatacccgtataaccatcgaagactgttgaagtgactaattcctgcaaatttaagggcgttgaagacaaagaaattgttggagtaacttttttttatctaataccaacatgcttgatgttaaggaaagatcttctacaagaaggttggctagagatttcttgtaaaaacaccagccccgcttagtttataatgagaatatttcagtctttttgattccatgtattattatcattatgcacataaaggaggagccgtatgagatgaaaatctcatgtacggttctgaaacggagattctttgaatcgaatgacgaccgtaacggatgtcggctcaatccgaaggaaattatgcggaagctttacagaattattatgaagctatgcgactagaaattgatccttatgatcgaagttatatactctataacataggccttatccacacaagtaacggggaacatacgaaagctttggaatattattttcgggccctagagcgaaacccattcttaccacaagcttttaataatatggccgtgatctgtcattacgtgcgactatctccactatagaaataaaaaaaggaaagaaagaaaaaatccgttaacgttaataaatactagaaacaaagagtaggctttctacatatgtatcgttcaaaacaacgatttttatcagctgtagcaaagaaataaacttcataaaagtcgaaatatgaatatgaagaaataggtatgcctagatactttacttttattctatggataaaggatctaattgatagaggaagcgccgtaaagatcaattcgcgaggttttggtccgatacaataagaactgcttacttatgtcatgatatgagataaaagttaggaatccacttatgtaatagagtcgatcccctaaggtattgagcagcggtgtagcatcagatcccaaagatggtaagtcttttccttcttatgaaggaaggcctttttcaaagattctatataaatttatatatgaaaccgagatagttacctttcagaaaattcgaataatagtgaaaacgcttatgctttatttttctgaaggtgggagaaaagataaaactgattattaataaaaattttagtttgaaactcatgtaattaacctctttcttttggttaactcgagaaaaaaaaaatgggatatatctctgagaaatctcatttaattagtatagggtaatgaaaaaataggacaccaaaagaatttgacccctgagccgtatgaggtcggaaactctcaagtacggttctaagggaagggatttacccccctattccgaccggggagaacaggccgttcaacaagggtattccgaaattgcggaggcttggttcgatcaagccgccgagtattggaaacaagctatagcgcttactcctgaggaggactcaatgattattcgttcgccggaaccagaagttaaaattttggtagatagggatcccgtaaaaacttctttcgaggaatgggccagaccgggtcatttctcaagaacaatagctaagggacctgatactaccacttggatctggaacctacacgctgatgctcacgattttgatagccataccagtgatttggaggagatctctcgcaaagtatttagtgcccatttcggtcaactctccatcatctttctttggctgagtggtatgtatttccatggtgctcgtttttccaattatgaagcatggctaagtgatcctactcacattggacctagtgcccaggtggtttggccaatagtgggtcaagaaatattgaatggtgatgtcggcgggggtttccgaggaatacaaataacctctgggttttttcagatttggcgagcatctggaataactagtgaattacaactctattgtactgcaattggtgcattggtctttgctgccttaatgctttttgcaggttggtttcattatcacaaagctgctccgaagttggcttggttccaagatgtagaatctatgttgaatcaccatttagcagggctactaggccttggttctctttcttgggcgggacatcaagtacacgtatctttaccaattaaccaatttctaaacgctggagtagatcctaaagagattccacttcctcatgaatttatcttgaatcgggatcttttggctcaactttatcccagttttgctgagggagcaaccccatttttcaccttgaattggtcaaaatatgcggaatttcttacctttcgtggaggattagatccagtaactggaggtctatggctgaccgatattgcacaccatcatttagctattgcaattcttttcctggtagcgggtcacatgtatagaaccaactggggcattggtcatggtataaaagatattttagaggctcataaaggcccatttacgggccagggccataaaggcctatatgagatcctaacaacgtcatggcatgctcaattatctattaacctcgctatgttaggatctttaaccattgttgtagctcaccatatgtattcgatgcccccttatccatatctagctactgactatggtacacaactttcattgttcacacatcacatgtggatgggtggatttctcatagttggtgctgctgcgcatgcagccatttttatggtaagagactatgatccaactactcgatacaacgatctattagatcgtgtccttaggcatcgcgatgcaatcatatcacatctcaactgggtatgtatatttttaggctttcacagttttggtttgtatattcataatgatactatgagcgctttagggcgcccccaagatatgttttcagataccgctatacaattacaacccgtctttgctcaatggatacaaaacacccatgctttagcacccagtgcaacggcccctggtgcaacaacaagcaccagtttgacttgggggggtggtgatttagtggcagtgggcggcaaagttgctttgttacctattccattaggaaccgcagattttttggtgcatcacattcatgcgtttacaattcatgtgacggtattaatactcctgaaaggtgttctatttgctcggagttcgcgtttgataccagataaagcaaatcttggttttcgtttcccttgtgatgggccgggaagaggagggacatgccaagtatccgcttgggatcatgtcttcttagggctattctggatgtataatgcaatttcggtagtaatattccatttcagttggaaaatgcagtcagatgtttggggtagtatcagtgatcaaggagtggtaactcatatcacgggagggaactttgcgcagagttccattactattaatgggtggctccgcgatttcttatgggcacaggcatcccaggtaattcagtcttatggttcttcattatccgcatatggcctttttttcctaggtgcgcattttgtatgggcttttagtttaatgtttctattcagcgggcgtggttattggcaagaacttatcgaatccatcgtttgggctcataataaattaaaagttgctcctgctactcagcctagagccttgagtattgtccaaggacgtgctgtaggagtaacccattaccttctgggtggaattgccacaacatgggcgttcttcttagcaagaattattgcagtaggataatggctaggaggatttgaaaggcattatggcattaagatttccaaggtttagccaaggcttagctcaggaccccactactcgtcgtatttggtttgggattgctaccgcacatgacttcgagagtcatgatgatattactgaggaacgtctttatcagaatatttttgcttctcatttcgggcaattggcaataatttttctgtggacttccggaaatctgtttcatgtagcttggcaaggaaattttgaggcatgggtacaggatcctttacatgtaagacctattgctcatgcaatttgggatcctcattttggtcaaccagctgtagaagcttttactcgggggggtgctcttggcccagtgaatatcgcttattctggtgtttatcagtggtggtatacaattggtttacgtactaacgaggatctttatactggcgctctttttctattatttctttctgccatatccttaatagcgggttggttacacctacaaccgaaatggaagccgagcgtttcgtggtttaaaaatgccgaatctcgtctaaatcatcatttgtcaggactattcggagtgagttccttagcttggacaggacatttagttcatgtcgctattcccggatccaggggagaaaacgttcgatggaataatttcttagatgtattgccacatccccaaggattaggtccactttttacaggtcagtggaatctttatgctcaaaaccccgattcaagtagtcatttatttggtacctcccaaggagcaggaactgccattctaacccttctggggggatttcatccacaaacgcaaagtttatggctgactgatattgctcatcatcatttagctattgcgtttatttttctgattgctggtcatatgtatagaactaatttcgggattgggcacagtatcaaaaatcttttagaagcacatattcccccaggggggcgattgggtcgtggacataagggtctttatgacacaatcaataattcgattcattttcaattaggccttgctctagcctctttgggggttattacgtccttggtcgctcaacacatgtactctttacctgcttatgcgttcatagcacaagactttactactcaagctgcgttatatactcatcaccaatacatcgcaggattcatcatgacaggggcttttgctcatggagctatattttttattagagattacaatccggaacagaatgaggataatgtattggcaagaatgttagaccataaagaagctatcatatcccatttaagttgggccagtctctttttagggttccatactttgggactttatgttcataatgatgtcatgcttgcttttggtactccggagaaacaaatcttgatcgaacctatatttgcccaatggatacaatctgctcatggtaaaacttcatatgggttcgatgtacttttatcttcaacgaatggtccagcgttcaatgcgggtcgaagcatatggttacctggttggttaaatgctgttaatgagaatagtaattcactattcttaacaataggacccggagatttcttggttcatcatgctattgctctaggtttacatacaactacattgatcttagtaaaaggtgctttagatgcacgtggttccaagttaatgccagataaaaaagattttggttatagttttccttgcgatggtccgggacgaggcggtacttgtgatatttcggcttgggacgcattttatttggcagttttctggatgttaaatacgattggatgggttactttttattggcattggaagcacatcacattatggcagggtaacgtttcacagtttaatgagtcttccacttatttgatgggatggttaagagattatctatggttaaactcttcgcaacttattaatggatataatccttttggtatgaatagtttatccgtctgggcgtggatgttcttatttggacatcttgtttgggctactggatttatgttcttaatttcctggcgtggatattggcaggaattgattgaaactttagcatgggctcatgaacgcacacctttggctaatttgattcgatggagagataaaccggtggctctttccattgtgcaagcaagattggttggattagcccacttttctgtcgggtatatatttacttatgcggctttcttgattgcctctacatcgggtaaatttggttaattctttattttatgtggtgtatccgcaataatatcataccgtttctttcgatggagaagggatctaccttcttatatttttacatctaggatctgacttgtatcattgatactaataggaattgaacccttatggcaagaaaaagtttgattcagcgggagaagaagagacaaaaattggaaaaaaaatatcatttgattcgtcgatcctcaaaaaaagaaataagcaaagttccctcgttgagcgagaaatgggaaattcatggaaagttacaatccccaccacgtaatagtgcacctacacgccttcatcgacgttgtttttcgaccggaagaccgagagctaactatcgagactttgggttatccggacacatacttcgtgaaatggttcatgcatgtttgttgcccggggcaacaagatcaagttggtaaggattaaaatagccattcatttttctattaatttctatgatcatcgatcatagaggggcctctttaccattctgtataaatgggctattctatttgtacagatatggtagaggggcgcattcaatccttgtttgtccattaattctcagttcttctcttcatcgcggggtagagcagcgtggtagctcgcaaggctcataaccttgaggtcacgggttcaaatcccgtctccgcaacattttttttgacaaaaaaaatctaataattaattactgttttcttttgggtgggaggaaggggagagtagaaccactatactatcgtggtcaattatacttaatgctttatccattaaatatttaattaaatttcatatatttacccattatcctgggcggatagcgggaatcgaacccgcgtcttctccttggcaaagagaaattttaccattcgactatatccgcattatatataatttatttagtatttataatattttatatataaaaaaataaaatataaatttatatccttttaaaacttcttataatacttataatacaaatacacaaaagtttgacccctccctctaatttttctaatttttttcttttctttatttgcatttttgggacttatattgaattttaatgtgtctcacaacctgaaggaattcggagggaggggtcatttcatttttggatctagaacgaataggttcaagagatgagagaattaaggatacccaccagaaagactaatccaatccataatgatgtaccggaaaatacaacatttttgttacccgaccaaccctcaggagaagcaaatacaacaggtacactaatcaataagattaatgaagtagcaattaatgcaaaaacagccaattggaaagcaatagtcatgtttctaatcctccaatctaccaacaaaagaattataccatttgatccctttatcagccaaaaaattgtaaaaaaaaaatgcatcatggaaggattttaccatgaatccatcattgattctataatgacttattaccaccctttgccactgcatggaatcgagggtcgcttttttttactttacaaaacaaaggggcatgcttgctggatcatgcatctatattatatatatacagatagatagacctatagactcacacctgatatctttctatagataataatggtatcaactcatatgtccatgttctattgggtggaataaaatataaattttatttcggagagatggccgagtggttgatagctccggtcttgaaaaccggtatagttcgaaacaaagaactatcgagggttcgaatccctctctctcctttatactcggttaataaattcgttgcctttctttattttattgaaatcggtagcataaaaggaaatggctcggctaagtggaatagccgagccagaaaaaaaaatagatttagaagatataaatgagtagaaaagaaaggaatacttttaaaatatgacctgatccaccatacatattaggtttggtggaatcaattttattcctacttcaagcattggatctctgtctcagttaagaggagtcatggaaagaacaggttcaaaatcacgatcaattcctttttcaaatcctgctgcagctgcacgcgcccttcccgcgtgccataaatgacctacgaataggaagaatcctagaacaaaatgagaagtagctaaccaacttctaggagagacataattgactgcattgatctcggtagctacgccacccacggaatttaaagaacctaaaggagcatgagtcatatattccgcagaccgccgttcttgccaaggctgtatgtcttttttcagcctactcaagtccaaaccattaggaccccttaaaggttctaaccagggagcacgcagatcccagaaacgcatagtttctcctccaaaaataacttccccggtcggagaacgcattagatatttacctaaaccggtaggtccttgagcagatcctacgttagccccaagacgttggtctctaaccaaaaaagtaaatgcttgagcttgagaagcttctggtccagtgggcccgtaaaactcactaggataggcggtattattgaaccaaacaaagcaacaagcaataaaaccaaaaacagataaagcagctaaactataagacaggtaagcctctccagaccatacaagtgcacggcgagcccatgcaaaaggtttggttaagatatgccagattccaccaagtatacaaatggaacctaaccatacatgccctccaattatatcttccaaatcgtccacactaacgatccacccctctccgccaaagggggattttagtaaataaccaaatacaatacttgggctaagggtcaagttggtaatttttcttacatctcccccgcccggagcccaggtatcatatacacccccaaaataaagagccttgaatactagaagaaaagcacctatacctaacaagattaagtgaatacccaaaattgtagtcattttgtttctatctttccatacataaccaaagaatggaaaagattcttcaagagtctcgggtcccagaagtgcatgataaataccgccaaagcccaatactgcagaggaaattaagtgaagtactccagacacaaagtatggaaaggtgtctagaacttccccacccggacctaccccccaacctagagtagctaggtggggaagtaaaattaatccttgttcatacataggcttctctggtacgaaatgagccacttcaaataggttcattgctccggcccagaatacgattaatccggcatgggctacatgagcccccagtagtttaccggataaattgataagtcgggcattcccggcccaccaagcgaaaccagtggtttcttggtcacgaccggctaaagctaaagttccattaaagagcgtttccacggggtagaacctcctcagggaatataaggttttcatgaggctgatcttgagccgccatccaagcacgaataccttcgtttaagagaatatttttggtgtagaaagtctcaaattcaggatcttccgctgcacggatttcctgagaaacgaagtcataggcacgtaggttcagggccagaccgactactccaagagcactcatccacaaaccggttactggtacaaataacataaagaaatgtaaccaacgtttattggaaaaagcaaccccaaagatttgggaccaaaagcggttagcggtgaccattgaataagtttcttcagcttgagttgggttaaaagcacggaatgtatttgcaccatcaccatcttcaaataaagtattttctacggtagcaccatgaatagcgcataacagagcagcgcccaacaccccagcaactcccatcatatgaaatgggttcaatgtccaattatgaaacccttggaaaaagaggatgaatcgaaatatagctgctacaccaaaactgggcgcaaaaaaccaaccagactgacctagcggataaattaggaatacagaaacaaaaacagcaattggaccggagaatgcgattgcattataaggtcgcaattgaacagatcgagcaagttcaaattgacgtaacataaaacctattagtccgaaagcgccgtgtagagcaacaaaagtccacagaccgcctaattgacaccaacgagtaaaatctccttgtgcttcaggaccccataataacaacaaagagtgtgctaaactattagccggagtggaaactgcggcggttaagaagttacagccttccaaataggaacttgctaatccatgggtataccatgaagttacaaaggttgtacctgtgaaccaaccccctaaagcgaaataggcacaaggaaagagcaataggccagaccaacctacaaaaacgaaacggtccctccgtaaccagtcatccataatatcaaataaatcattttcgtctttggtaaatttaccaagggctatagtcatagtgatcctcctattcaactacttcaaccattttcgaacacctcatagcattttccgaacgttcgaggcttctatcatttatgtattatttgatttctcgtacactgtccattcttttgaatgggtttcgaatagaaaaataatttattggtctgtaacccgacctagtttaatccatgaactcaattcggttatcccttcctattcttaataactgcccgaaccatgaattgttttatgatccatcaatcagatagatggattttagaattgttcaagaaacaagtgatcccttttctcgataccgatggatcctatacatattcctctcgttccatcaactaatcttagtcttgaatcccgttgaaggggggagattgataaatatttttatgtattcttctaataccatatattttattactttatattttactcttttattttaaaaaatttcctattattttattaatatattgtattaatattaatatattgtatttaattaaataa

SEQ ID NO: 4205 - DNA, 3183 bp, Prunus mume
gaactatcgagggttcgaatccctctctctcctttatactcggttaataaattcgttgcctttctttattttattggttttgcccggctcagtagcataaaagaaatcggtagcataaaaggaaatggctcggctaagtgggatagccgagccagaaaaaaaaaaaaaaaaaacagatttagaagatataaatgagtagaaaagaaaggaatacttttaaaatatgacctgatccaccatacatattaggtttggtggaatccattttattcctacttcaagcattggatctctgtctcagttaagaggagtcatggaaagaacaggttcaaaatcacgatcaattcctttttcaaatcctgctgcagctgcacgcgcccttcccgcgtgccataaatgacctacgaataggaagaatcctagaacaaaatgagaagtagctaaccaacttctaggagagacataattgactgcattgatctcggtagctacgccacccacggaatttaaagaacctaaaggagcatgagtcatatattccgcagatcgccgttcttgccaaggctgtatgtcttttttcagcctactcaagtccaaaccattaggaccccttaaaggttctaaccagggagcacgcagatcccagaaacgcatagtttctcctccaaaaataacttccccggtcggagaacgcattagatatttacctaaaccggtaggtccttgagcagatcctacgttagccccaagacgttggtctctaaccaaaaaagtaaatgcttgagcttgagaagcttctggtccagtgggcccgtaaaactcactaggataggcggtattattgaaccaaacaaagcaacaagcaataaaaccaaaaacagataaagcagctaaactataagacaggtaagcctctccagaccatacaagtgcacggcgagcccatgcaaaaggtttggttaagatatgccagattccaccaagtatacaaatggaacctaaccatacatgccctccaattatatcttccaaatcgtccacactaacgatccacccctctccgccaaagggggattttagtaaataaccaaatacaatacttgggctaagggtcaagttggtaatttttcttacatctcccccgcccggagcccaggtatcatatacacccccaaaataaagagccttgaatactagaagaaaagcacctatacctaacaagattaagtgaatacccaaaattgtagtcattttgtttctatctttccatacataaccgaagaatggaaaagattcttcaagagtctcgggtcccagaagtgcatgataaataccgccaaagcccaatactgcagaggaaattaagtgaagtactccagacacaaagtatggaaaggtgtctagaacttccccacccggacctaccccccaacctagagtagctaggtggggaagtaaaatcaatccttgttcatacataggcttctctggtacgaaatgagccacttcaaataggttcattgctccggcccagaatacgattaatccggcatgggctacatgagcccccagtagtttaccggataaattgataagtcgggcattcccggcccaccaagcgaaaccagtggtttcttggtcacgaccggctaaagctaaagttccattaaagagcgtttccacggggtagaacctcctcagggaatataaggttttcatgaggctgatcttgagccgccatccaagcacgaataccttcgtttaagagaatatttttggtgtagaaagtctcaaattcaggatcttccgctgcacggatttcctgagaaacgaagtcataggcacgtaggttaagggccagaccgactactccaagagcactcatccacaaaccggttactggtacaaataacataaagaaatgtaaccaacgtttattggaaaaagcaaccccaaagatttgggaccaaaagcggttagcggtgaccattgaataagtttcttcagcttgagttgggttaaaagcacggaatgtatttgcaccatcaccatcttcaaataaagtattttctacggtagcaccatgaatagcgcataacagagcagcgcccaacaccccagcaactcccatcatatgaaatgggttcaatgtccaattatgaaacccttggaaaaagaggatgaatcgaaatatagctgctacaccaaaactgggcgcaaaaaaccaaccagactgacctagcggataaattaggaatacagaaacaaaaacagcaattggaccggagaatgcgattgcattataaggtcgcaattgaacagatcgagcaagttcaaattgacgtaacataaaacctattagtccgaaagcgccgtgtagagcaacaaaagtccacagaccgcctaattgacaccaacgagtaaaatctccttgtgcttcaggaccccatagtaacaacaaagagtgcgctaaactattagccggagtggaaactgcggcggttaagaagttacagccttccaaataggaacttgctaatccatgggtataccatgaagttacaaaggttgtacctgtgaaccaaccccctaaagcgaaataggcacaaggaaagagcaataggccagaccaacctacaaaaacgaagcggtccctccgtaaccagtcatccataatatcaaataaatcattttcgtctttggtaaatttaccaagggctatagtcatagtgatcctcctattcaactacttcaaccattttcgaacacctcatagcattttccgaacgttcgaggcttctatcatttatgtattatttgatttctcgtacactgtcccttcttttgaatgggtttcgaatagaaaaataatttattggtctgtaacccgacctagtttaatccatgaactcaattcggttatcccttcctattcttaataactgcccgaaccatgaattgttttatgatccatcaatcagatagatgaattttagaattgttcaagaaacaagtgatcccttttctcgataccgatggatcctatacatattcctctcgttccatcaactaatcttagtcttgaatcccgttgaaggggggggggattgataaatatttttatgtattcttctaataccatatattttattactttatattttactcttttattttaaaaaa

SEQ ID NO: 4206 - DNA, 1866 bp, Pteridium aquilinum
tttcttttttctggcttctttattaagaatcttaatattaataaaaggtaatggctcggctgggtggaatagccgagccagaaaaaaatattttagatataaaatgagttgaaaagaaaggaaaacagaatactttttaaatatcaccggattccttcaatatgtatggtgtaatcaaatcgattcctactttaagcattggatctcctgtctcagttaagaggagtcatggaaagaacaggctcaaaatcacgatcaattcctttttcaaatcccgctgcggctgcgcgagctcttcccgcatgccataaatgacccacgaataggaagaaccctagaacaaaatgagaggtagctaaccaacttctcggagagacataattaactgcattgatctcggtagctacgccacctacagaatttaaagaacctaaaggagcatgagtcatatattccgcagaacgccgttcttgccaaggttgtatgtcttttttcaatctactcaagtccaaaccattgggaccccttagaggttctaaccaaggagcacgcagatcccaaaaacgcatagtttcccctccaaaaatgacttctccggtcggggaacgcattagatatttacctaacccagtaggcccttgagcggatcccacgttagccccaagacgttggtctctaactagaaaagtaaatgcttgagcttgagaagcttctggtccagtgggcccgtaaaactcactaggataagcggtattattgaaccagacaaagcaacaagcaatgaaaccaaaaacagataaagcacctaaactataagacaagtaagcctctcccgaccatacaagtgcacggcgagcccatgcaaaaggtttggttaagatatgccagattccaccaaatatacaaatggaacctaaccatacatgccctccaattatatcttccaaatcgtccacactaacaatccatccttcgcctccaaagggggattttagtaaataaccaaatataacacttgggctaagagtcaagttggtaatttttcttacatctccccctcccggagcccaggtatcatatacgcccccaaaataaagagccttgaatactagaagaaaagcacctatacctagcaaaattaagtgaatacccaaaattgtggtcattttatttctatctttccatacataaccgaaaaatggaaaagattcttcaagagtttcaggtcccagaagtgcatgataaataccgccaaagcccaatacagcagaggaaattaagtgaagtactccagatacaaagtatggaaaagtgtctataacttctccaccaggacctaccccccagcctagagtagctaggtggggaagtaaaattaatccttgttcgtacatgggcttttctgggacaaaatgagccacttcaaataggttcattgctccggcccagaatacgattaatccggcatgggctacatgagcccccaatagtttaccggataaattgataagtcgggcattcccagcccaccaagcgaaaccggtggtttcttggtcacgaccggctaaagctaaagttccattaaagagcgtttccacggggtagaacctcctcagggaatataaggttttcatgaggctgatcttgagccgccatccaagcacgaataccctcgtttaaaagaatatttttggtgtagaaagtctcaaattcaggatcttccgctgcacggatttcctgggaaacgaagtcataggcacgtaggttcagagccagaccgactactccaagagcactcatccataaaccggttactggtacaaataacataaaaaaatgtaaccaacgtttattggaaaaagcaac

SEQ ID NO: 4207 - DNA, 3992 bp, Vinca minor
attttcttttggggacttctattaaattttaatgtgtctcacaaccgagaaaagttcggggggtcttttcggttttggatctgggacgaataggttcaagagatgagagaattaagaataccgactagaaagactaacccaatccataatgaggtaccggaaaatataacatttttgttactcgaccaaccatcaggagaagcaaatacaacgggcacgctaatcaataagattgatgaagtagcaattaatgcaaaaacagccaattggaaagcaagagtcatgcttttaatcctccaaactaccaacaaatgaatttataccatttgatccccctattagtcaaaaaattataataaaatacatcagggggattttactttaccacgaatccattgattctatatgacttattactaacccctttgccgtacatggggtcgaggtaaatgaaatttttttatttcaaatttatttcacaaatcggcgtgctcatatatggatagatagatccatcggccgattcccacccgcgagctttctgtctttctacagatagtcagatagtggtggtatccacccctatggtcatgttctattcggaggaataaaataaaaattgtctttcggagagatggctgagtggttgatagccccggtcttgaaaaccggtatagttttgaacaaagaactatcgagggttcgaatccctctctctccttttttgttcattgaataggttatttctttattagtttttcccggacgggtatcataaagaatgggggaatggctcggctatctcaccgagccaagtcgaaaaatagattataattatataaatgataactgagttgaaaaaaaaaaagattttaaatatgacccgatcccaaggcgtatgatggaatgaatattcctatttcaagcattggatctcctatcttttctcaattaagaggggtcatggaaagaacaggttcaaaatcacgatcaattcctttttcaaatcctgctgcagctgcacgagcccttcccgcgtgccataaatgacctacgaagaagaagaatcctagaacaaaatgagaggtagctaaccaacttctaggagagacgtaattgactgcattgatctcggtagctacgccacccacggaatttaaagaacctaaaggagcatgagtcatatattctgcggaacgccgttcttgccaaggttgtatgtcttttttcaacctactcaagtccaacccatttggaccccttagaggttctaaccagggagcacgcagatcccaaaaacgcatcgtttctcctccaaaaatgacttctccggttggggaacgcattagatatttacctaaacctgtaggcccttgagcggatcccacgttagccccaagacgttggtctctaactagaaaagtaaatgcttgagcttgagaagcttctggcccagtaggtccgtaaaactcactaggataagctgtattattgaaccagacaaaacaacacgcaatgaaaccaaagacggctaaagcccctaaactataagataagtaagcctctccagaccatacaagtgcgcgtcgagcccacgcgaagggtttagttaagatatgccagattccaccaagtatacaaatggaacccaaccatacatgtcctccgattatatcttctaaatcgtccacactaacaatccacccttcccctccaaagggagattttagtaaataaccaaatatgatactcgggctaagagtcaagttagtaatttttcttacatctcccccccccggagcccaagtatcatacacgcccccaaaatatagagccttgaatactagaagaaaagcacctagacctaacaagattaagtgaatacctaaaattgtggtcattttatttctatctttccatacataaccgaagaatggaaaagattcttcaagcgtctcaggaccaagaagcgcatgataaataccgccaaagcccaaaaccgcagaggaaattaaatgaagtactccagatacaaagtacggaaaggtgtctataacttcccccccaggacctaccccccaacctagagtagctaggtggggaagtaaaattaacccttgttcatacataggtttctctggtacgaaatgagccacttcaaataggttcattgctccggcccagaatacgattaatccggcgtgggctacatgagctcctagcagtttaccggataaattgataagtcgggcatttcctgcccaccaagcgaaaccggtggtttcttggtcacgaccagctaaagctaaagttccattaaagagcgtttccacgtggtagaacctcctcagggaatataaggttttcatgaggctgatcttgagccgccatccaagcacgaataccttcgtttaagagaatatttttggtgtagaaagtctcaaattccggatcttccgctgctcgaatttcctgagaaacgaagtcataggcacgtaggttcagcgccagaccaactactccaagagcactcatccataaaccggttactggtacaaataacataaagaaatgtaaccaacgtttattggaaaaagcaaccccaaagatttgggaccaaaagcggttagcggtgaccattgaataagtttcttcagcctgggttgggttaaaagcacggaatgtatttgcaccatcaccatcttcaaataaagtattttctacggtagcaccgtgaatagcgcacagcaaggcagcgcccaatacaccggcaactcccatcatatgaaaggggttcaacgtccaattatgaaacccttgaaaaaagaggatgaatctaaatatagctgctacgccaaaactaggcgcaaagaaccaaccagattgacctagtggataaatcaggaatacagaaacaaaaacagcaattggaccagagaatgcgattgcattataaggtcgcaattgaacagatcgagcaagctcgaattgacgtaacatgaaacctattaatccgaaagcgccatgaagagcaacaaaagtccacagaccgcctaattgacaccaacgagtaaaatctccttgtgcttcaggaccccatagtaacaacaaagagtgtgctaaactattagcaggagtagaaactgcggcagttaagaaattgcagccttccaaataggaactggccaatccatgggtataccatgaagttacaaaggttgtacctgtgaaccaaccccctaaagcaaaataggcacaaggaaagagcaatagaccggaccagcctacaaaaacgaaacggtccctacgtaaccagtcatccataatatcaaataaatcagtttcgtctttggtaaatttaccaagggctatagtcatagtgatcctcctattcaactacttcgaccatttccgagcacctcatagcattttcgggccgttcgaagattcgatcatttctgtatgatttctcttgcactgccccactccaataggtttcgaagataaaaatcccttattggcccataaattcgcctagagaaattcagaaactcaatttgattcttccttcttactaagtatctgaaccgtgaattgtcttcttatgactcatcaatcaatcagatatatgaatatcttttgaaagacctgttcgaggaagaatcaaccccctctccctctctcgctcccaatcgattctcagacctaaccttttgttcttgttccattaattaatgttattattagatctttttcgggagattgagaaaaatctaaatatttaatatttatagagtcttctaatttctatgtgtactaaattacagtatttgaaattattacagtattttactactttctttttttttttattttctttagtatcttctttattagtcctatctccctttctttcagataaattagtcctatctccctttccttcagataaatcgaaaactcctgtgaaaaagaaaaagagagaatttcct

SEQ ID NO: 4208 - DNA, 2523 bp, Theobroma cacao
aattgcgaccttataatgcaatcgcattctctggtccaattgctgtttttgtttctgtattcctgatttatccactaggtcaatctggttggttctttgcgcccagttttggtgtagcagctatatttcgattcatcctctttttccaaggatttcataattggacattgaacccatttcatatgatgggagttgccggtgtattgggcgctgctctgctatgcgctattcatggtgctaccgtggaaaatactttatttgaagatggtgatggtgcaaatacattccgtgcttttaacccaactcaagccgaagaaacttattcaatggtcaccgctaaccgcttttggtcccaaatctttggggttgctttttccaataaacgttggttacatttctttatgttatttgtaccagtaaccggtttatggatgagtgctcttggagtagtcggtctggctctgaacctacgtgcctatgacttcgtttcccaggaaatccgtgcagcggaagatcctgaatttgagactttctacaccaaaaatattcttttaaacgagggtattcgtgcttggatggcggctcaagatcagcctcatgaaaaccttatattccctgaggaggttctaccccgtggaaacgctctttaatggaactttagctttagccggtcgtgaccaagaaaccaccggtttcgcttggtgggctgggaatgcccgacttatcaatttatccggtaaactattgggggctcatgtagcccatgccggattaatcgtattctgggccggagcaatgaacctatttgaagtggctcattttgtcccagaaaagcccatgtacgaacaaggattaattttacttccccacctagctactctaggctggggggtaggtcctggtggagaagttatagacacttttccatactttgtatctggagtacttcacttaatttcctctgctgtattgggctttggcggtatttatcatgcacttctgggacctgaaactcttgaagaatcttttccatttttcggttatgtatggaaagatagaaataaaatgaccacaattttgggtattcacttaattttgctaggtataggtgcttttcttctagtattcaaggctctttattttgggggcgtatatgatacctgggctccgggagggggagatgtaagaaaaattaccaacttgactcttagcccaagtgttatatttggttatttactaaaatccccctttggaggcgaaggatggattgttagtgtggacgatttggaagatataattggagggcatgtatggttaggttccatttgtatatttggtggaatctggcatatcttaaccaaaccttttgcatgggctcgccgtgcacttgtatggtcgggagaggcttacttgtcttatagtttaggtgctttatctgtttttggtttcattgcttgttgctttgtctggttcaataataccgcttatcctagtgagttttacgggcccactggaccagaagcttctcaagctcaagcatttacttttctagttagagaccaacgtcttggggctaacgtgggatccgctcaagggcctactgggttaggtaaatatctaatgcgttccccgaccggagaagtcatttttggaggggaaactatgcgtttttgggatctgcgtgctccttggttagaacctctaaggggtcccaatggtttggacttgagtagattgaaaaaagacatacaaccttggcaagaacggcgttctgcggaatatatgactcatgctcctttaggttctttaaattctgtaggtggcgtagctaccgagatcaatgcagttaattatgtctctccgagaagttggttagctacctctcattttgttctagggttcttcctattcgtgggtcatttatggcatgcgggaagagctcgcgcagccgcagcgggatttgaaaaaggaattgatcgtgattttgagcctgttctttccatgactcctcttaactgagacaggagatccaatgcttaaagtaggaatcgatttgattacaccatacatattgaaggaatccggtgatatttaaaaagtattctgttttcctttcttttcaactcattttatatctaaaatatttttttctggctcggctattccacccagccgagccattaccttttattaatattaagattcttaataaagaagccaggaaaaagcaaaaaagaaaaaagtctattcatcgagcaaaaggagagagagggattcgaaccctcgatagttctttgtttcgaactataccggttttcaagaccggagctatcaaccactcagccatctctccgaaagctaatttctattttatttttattccaccgaatcgaacatggccatatgagttgataccatcactatgtatagaaagatctcgtgtgtgaacctataggtcgatctatttctctgtatatatagatagatgaaatgcatgatctagcatgcctatttgtttgtgaa

SEQ ID NO: 4209 - DNA, 2698 bp, Gossypium raimondii
aataaacgttggttacatttctttatgttatttgtaccagtaaccggtttatggatgagtgctcttggagtagtcggtctggctctgaacctacgtgcctatgacttcgtttcccaggaaatccgtgcagcagaagatcctgaatttgagactttctacaccaaaaatattcttttaaacgaaggtattcgtgcttggatggcggctcaagatcagcctcatgaaaaccttatattccctgaggaggttctaccccgtggaaacgctctttaatggaactttagctttagccggtcgtgaccaagaaaccaccggtttcgcttggtgggccgggaatgcccggcttatcaatttatccggtaaactattgggggctcatgtagcccatgccggattaatcgtattctgggccggagcaatgaacctatttgaagtggctcattttgtcccagaaaaacccatgtacgaacaaggattaattttacttccccacctagctactctaggctggggggtaggtcctggcggagaagttatagacacctttccatactttgtatctggagtacttcacttaatttcctctgctgtattgggctttggcggtatttatcatgcacttctgggacctgaaactcttgaagaatcttttccatttttcggttatgtatggaaagatagaaataaaatgaccacaattttgggtattcacttaattttgctaggtataggtgcttttcttctagtattcaaggctctttattttgggggcgtatacgatacctgggctccgggagggggagatgtaagaaaaattaccaacttgactcttagcccaagtgttatatttggttatttactaaaatcgccctttggaggcgaagggtggattgttagtgtggacgatttggaagatataattggaggacatgtatggttaggttccatttgtatatttggtggaatctggcatatcttaaccaaaccttttgcatgggctcgccgtgcacttgtatggtcgggagaggcttacttgtcttatagtttaggtgctttatccgtttttggtttcattgcttgttgctttgtctggttcaataataccgcttatcctagtgagttttacgggcccactggaccagaagcttctcaagctcaagcatttacttttctagttagagaccaacgtcttggggctaacgtgggatccgctcaagggcctactgggttaggtaaatatctaatgcgttccccgaccggagaagtcatttttggaggggaaactatgcgtttttgggatctgcgtgctccttggttagaacctctaagaggtcccaatggtttggacttgagtaggttgaaaaaagacatacaaccttggcaagaacggcgttctgcggaatatatgacgcatgctcctttagggtctttaaattctgtaggtggcgtagctaccgagatcaatgcagttaattatgtctctccgagaagttggttagctacctctcattttgttctaggattcttcctattcgtgggtcatttatggcacgcgggaagagctcgcgcagccgcagcgggatttgaaaaaggaattgatcgtgattttgagcctgttctctccatgactcctcttaactgagataactgagacaggagatccaatgcttaaggtaggaatcaatttgattacactatatatattgaaggaatcaggtgatatttaaaaagtattctgttttcctttcgtttcaactcattttctatctaaaatttttttttctggctcggctattccacccagccgagccattaccttttattaatattaagattcttaattaagaagccaggaaaaagcaataaagaaagaaatctattcatcgagcaaaaggagagagagggattcgaaccctcgatagttctttgtttcgaactataccggttttcaagaccggagctatcaaccactcagccatctctccgaaagctaatttctattttatttttattccaccgaatcgaacatggccatatgagttgataccatcactatgtatagaaagatatcgtgtgtgaacctataggtcaatctatttatctgtatatatagatagatgaaatgcataatctagcatgcctatttgggaacgtgaaataaaaaaatcaccctcgaccccatgtccgaataaaagcggttgaaagggttggaaataagtcatatagaatcaatcgattcatggtaaaatccctctaccttgcattttattaatttttttttggtcaatatcatagagggatcaaatggtatagttcttttgttggtagcttggaggattagaaacatgactattgctttccaattggctgtttttgcattaattgctacttcgtcaatcttactgattagtgtacctgttgtatttgcttctcctgatggttggttgagtaacaaaaatattgtattttccggtacatctttatggattggattagtttttctagtgggtatccttaattctcttatttcttgaatctatccattctggatccaaaaatgacccctcccacgaatttttcagattttgagacacattcaataatatagaagtataagttgccaaaatgaaaataaaaaaaaattagaggggggggtcagtcaaacttctgtaatctgtaatgtaacttgaatgaaata

SEQ ID NO: 4210 - DNA, 2068 bp, Eucalyptus grandis
ggtcccaaatctttggggttgctttttccaataaacgttggttacatttctttatgttatttgtaccagtaaccggtttatggatgagtgctcttggagtagtcggtctggctctgaacctacgtgcctatgacttcgtttcccaggagatccgtgcagcggaagatcctgaatttgaaactttctacaccaaaaatattctcttaaacgaaggtattcgtgcttggatggcggctcaagatcagcctcatgaaaaccttatattccctgaggaggttctaccccgtggaaacgctctttaatggaactttagctttagctggtcgtgaccaagaaaccaccggtttcgcttggtgggccgggaatgcacgacttatcaatttatccggtaaactgttgggggctcatgtagcccatgccggattaatcgtattctgggccggagcaatgaacctatttgaagtggctcattttgtaccagaaaagcccatgtatgaacaaggattaattttacttccccacttagctactctaggttggggggtaggtccgggtggggaagttatagacacctttccatattttgtatctggagtacttcacttaatttcgtctgcagtattaggctttggcggtatttatcatgcacttctgggccctgagactcttgaagaatcttttccattctttggttatgtatggaaagatagaaataaaatgaccacaattttgggtattcacttaatcttgttaggtataggtgcttttcttctagtattcaaggctctttattttggaggcgtatatgatacctgggctccgggagggggagatgtaagaaaaattaccaacttgacccttagcccaagtgttatatttggttatttactaaaatctccttttggaggagaaggatggattgttagtgtggacgatttggaagatataattggagggcatgtatggttaggttccatttgtatacttggcggaatctggcatatcttaaccaaaccttttgcatgggctcgtcgagcacttgtatggtctggggaggcttacttgtcttatagtttagctgctttatctgtttttggtttcattgcttgttgctttgtctggttcaataataccgcttatcctagtgaattttacggacctactgggccagaagcttctcaagctcaggcatttacttttctagttagagaccaacgtcttggggctaacgtgggatccgctcaaggacctactggtttaggtaaatacctaatgcgttccccgactggagaagtaatttttggaggggaaactatgcgtttttgggatctgcgtgctccttggttagaacctctaaggggtccaaatggattggacttgagtaggctgaaaaaagatatacagccttggcaagaacgtcgttccgcagaatatatgactcatgctcctttaggttctttaaattctgtgggtggtgtcgctaccgagatcaatgcagtcaattatgtctctcctagaagttggttagctacttctcattttgttctaggattctttctattcgtaggtcatttatggcacgcgggaagggctcgtgcagctgcagcaggatttgaaaagggaattgatcgtgattttgaacctgttctttccatgaccccccttaattgaaacaggagtccaatgtttgaagtcagaatcaatttgattccactaccctacatattggtaggatggggtcatacttcaaataaaaagtattccttttcctttcttttgatttctatctaatctattttttttctggctcggctataccacttagccgagccatttccttttatgatactaaaaagccgggcaactcaaataaggtaaggaaagaaatattttcaccgagcaaaagaaaaggagagagagggattcgaaccctcgatagttttttgttacgaactataccggttttcaagaccggagccatcaaccactcggccatctctccgaaagacaatttctattatatttttattccaccgatagaacatggccatatgagttgataccatca

SEQ ID NO: 4211 - DNA, 2346 bp, Panax ginseng
atgaaaaccttatattccctgaggaggttctaccccgtggaaacgctctttaatggaactttagctttagctggtcgtgaccaagaaaccactggtttcgcttggtgggccgggaatgcccggcttatcaatttatccggtaaactactcggggctcatgtagcccatgccggattaattgtattctgggccggaggaatgaacctatttgaagtggctcatttcgtaccagagaagcctatgtatgaacaaggattaattttacttccccacctagctactctaggttggggggtaggtcctggtggggaagttatagacacttttccatactttgtatctggagtacttcatttaatttcctctgcagtattgggctttggtggtatttatcatgcacttctagggcctgagacgcttgaagaatcttttccattcttcggttatgtatggaaagatagaaataaaatgactacaattttaggtattcacttaatcttattaggtataggtgcttttcttctagtattcaaggctctttattttggtggcgtatatgatacctgggctccgggggggggagatgtaagaaaaattaccaacttgacccttagcccaagtattatatttggttatttactaaaatcgccctttggaggggaaggatggattgttagtgtagatgatttggaagatataatcggaggacatgtatggttaggttccatttgtatacttggtggaatctggcatatcttaaccaaacccttcgcatgggctcgacgcgcacttgtgtggtctggggaggcttacttatcttatagtttaggggctttatccgtctttggtttcattgcttgttgttttgtctggttcaataataccgcctatcctagcgagttttacggacccactggaccagaagcttcccaagctcaagcatttacttttctagttagagaccaacgccttggggctaacgtgggatccgctcaaggacctactggtttaggtaaatatttaatgcgttccccgaccggagaagtcatttttggaggagaaactatgcgtttttgggatctgcgtgccccttggttagaacctctaaggggtccaaatgggttggacttgagtaggctgaaaaaagacctacaaccttggcaagaacggcgttctgcagaatatatgacccatgctcctttaggttctttaaattctgtgggtggcgtagctaccgagatcaatgcagtcaattatgtctctcctagaagttggttagctacttctcattttgttctaggattcttcttgttcgtaggtcatttgtggcacgcgggaagggctcgtgcagctgcagcagggtttgaaaaaggaattgatcgtgattttgaacctgttctttccatgacccctcttaattgagacaggaaatccaatacttgaagtagaaatcactttgattccatcatattggaatcaggtcatacttaaaaaaagtaaattttttcaactcatttatatctaatcttttttctggcttggctaggtgggatagccgagccactaccctttcgttatgatcctgtccgggcaaaaccaataaagaaaaatctattcaacgagcaaaaaaaggagagagagggattcgaaccctcgatagttctttgttcaaaactatgccggttttcaagaccggagctatcaaccactcagccatctctccgaaagacaatttttattttattcctccgaatagaacatggctatatgagtcgatataacactactatctgtagaaagatctcgggtgtgaatctactggtcgatctatacgtatatatagatagaagtatgatccagcatgcccatttgtaaaataaaaaaattccgttttcccccgactccatgtatgaataaagtggtaatgttaataataaggggtagtaataagtcatataaaatcaatagatttatggtaaaatccctgtatgatgtaatgtattttaatacaatttttagggatcaaatggtatagttcatttgttggtagcttggaggattaaaagcatgactcttgctttccaattagctgtttttgcattaattgctacgtcattaatcttattaattggcgtacccgttgtatttgcttctcctgatggttggtcaagtaacaaaaatgttttattttccggtacatcattatggattggattagtctttctggtgggtatccttaattctctcatctcttgaacctattcgtcccagatccaaaactcaaacgaccccccccccgaatttttctcggttgtgagacacagcaaaattcaataaaagtccacg

SEQ ID NO: 4212 - DNA, 1994 bp, Gossypium raimondii
atgaaaaccttatattccctgaggaggttctaccccgtggaaacgctctttaatggaactttagctttagccggtcgtgaccaagaaaccaccggtttcgcttggtgggccgggaatgcccggcttatcaatttatccggtaaactattgggggctcatgtagcccatgccggattaatcgtattctgggccggagcaatgaacctatttgaagtggctcattttgtcccagaaaaacccatgtacgaacaaggattaattttacttccccacctagctactctaggctggggggtaggtcctggcggagaagttatagacacctttccatactttgtatctggagtacttcacttaatttcctctgctgtattgggctttggcggtatttatcatgcacttctgggacctgaaactcttgaagaatcttttccatttttcggttatgtatggaaagatagaaataaaatgaccacaattttgggtattcacttaattttgctaggtataggtgcttttcttctagtattcaaggctctttattttgggggcgtatacgatacctgggctccgggagggggagatgtaagaaaaattaccaacttgactcttagcccaagtgttatatttggttatttactaaaatcgccctttggaggcgaagggtggattgttagtgtggacgatttggaagatataattggaggacatgtatggttaggttccatttgtatatttggtggaatctggcatatcttaaccaaaccttttgcatgggctcgccgtgcacttgtatggtcgggagaggcttacttgtcttatagtttaggtgctttatccgtttttggtttcattgcttgttgctttgtctggttcaataataccgcttatcctagtgagttttacgggcccactggaccagaagcttctcaagctcaagcatttacttttctagttagagaccaacgtcttggggctaacgtgggatccgctcaagggcctactgggttaggtaaatatctaatgcgttccccgaccggagaagtcatttttggaggggaaactatgcgtttttgggatctgcgtgctccttggttagaacctctaagaggtcccaatggtttggacttgagtaggttgaaaaaagacatacaaccttggcaagaacggcgttctgcggaatatatgacgcatgctcctttagggtctttaaattctgtaggtggcgtagctaccgagatcaatgcagttaattatgtctctccgagaagttggttagctacctctcattttgttctaggattcttcctattcgtgggtcatttatggcacgcgggaagagctcgcgcagccgcagcgggatttgaaaaaggaattgatcgtgattttgagcctgttctctccatgactcctcttaactgagataactgagacaggagatccaatgcttaaggtaggaatcaatttgattacactatatatattgaaggaatcaggtgatatttaaaaagtattctgttttcctttcgtttcaactcattttctatctaaaatttttttttctggctcggctattccacccagccgagccattaccttttattaatattaagattcttaattaagaagccaggaaaaagcaataaagaaagaaatctattcatcgagcaaaaggagagagagggattcgaaccctcgatagttctttgtttcgaactataccggttttcaagaccggagctatcaaccactcagccatctctccgaaagctaatttctattttatttttattccaccgaatcgaacatggccatatgagttgataccatcactatgtatagaaagatatcgtgtgtgaacctataggtcaatctatttatctgtatatatagatagatgaaatgcataatctagcatgcctatttgggaacgtgaaataaaaaaatcaccctcgaccccatgtccgaataaaagcggttcaaagggttggaaa

SEQ ID NO: 4213 - DNA, 4911 bp, Gossypium raimondii
tcagtaattgagtcgaaccgcccttttaactcagtggtagagtaacgccatggtaaggcgtaagtcatcggttcaaatccgataaggggcttttgacttttttttcataaaactcctatgaaatggtagtattcatattgaaacataaggatgttgtttttattggtaataaaaacccaactgtatatgtataataattgaattagaaattgtataatttaactctaataagttattattctaatgagttagagtagagtaattctaaaagaaagttgaaattataatgaataatgataagccgtctcttgaagcgacaaatatatatttctattttgttttgattttgaattagattattccaatcaaatccattgtaaagaattgtaaagattagaaatcaacaaaagaaaaagtaagtggatctaacccattgaatcgtgactatatccactattctgatattaaaattcgatagagatgaaattggaacagtcgatttctttttatttcatatttatttggactccacaagaatccgtcgatatttccgattcaatcttcttgttcctaggaataaattaatattctattcgagataaagagaaacatttatttcaagttacaacctaagagcctttttcaacatcttatctttctttgattccagaacacaacaagatccatttctatctatatattctatctattctataatagatagaaacctaaatcaaatcatgtcttcacatatcaaatatttccatatcgatacatatgacacttttgttctgccaatgtgatggagagtgagtgcgaaaaagaaactttcattttgagtctcctattatttaatttaatattattaaatattgtattagattgaaaaataggaacttcgaatctttttctgatatacataaagtaaatagaaaaagattcgaagtggatttctcgacccgtgaaatgaaaaaatagcctctggagtttttttgttttatattcatctgaaggaaatatgagaaagaaaacaataaataaaagaaataaaatgaaggaaatatatcagactatagtaatttaatacacatagaaattagaaaaatacataaaaatattgatttttatcaatttcacgaacaagatccaagaataagattagttgatggagggggaggggtagatctggggatcaaccagtagcgagagaagggatcgcttcttccttgaattgaagagttcgttcaaaaaattcatctatctgattgatgagccataagacaattcatggttcagacgactagtaaaaatagaaaagaataaacgaattgagttcatggatttacctaagtcaggttatggaccaatacaagaaaatatttttttatattcgaaaccaattaattataaggggcagtgcacgagaaatcaaatcatacataaaaaatcgaatcccccagcgcccccataacataaggtgctcggaaatggttgaagtagttgaataggaggattgctatgactatagcccttggtaaatttaccaaagatgaaaatgatttatttgatattatggatgactggttacgtagggaccgtttcgtttttgtaggttggtccggcctattgctctttccttgtgcctatttcgctgtagggggttggtttacaggtacaacctttgtaacttcgtggtatactcatggattggccagctcctatttggaaggctgcaatttcttaaccgccgcagtttctacccctgctaatagtttagcacattctttgttgttactatggggtcctgaagcacaaggagattttactcgttggtgtcaattaggtggtctgtggacatttgttgctctccacggcgctttcggactaataggttttatgttacgtcaatttgaacttgcgcgatctgttcaattgcgaccttataacgcaatcgcattctctggtccaattgctgtttttgtttctgtattcctgatttatccactaggtcagtctggttggttctttgcgcctagttttggtgtagcagctatatttcgattcatcctctttttccaaggatttcataattggacattgaacccatttcatatgatgggagttgccggtgtattgggcgcggctctgctatgcgctattcatggtgctaccgtagagaatactttatttgaagatggtgatggtgcaaatacattccgtgcttttaacccaactcaagccgaagaaacttattcaatggtcaccgctaaccgcttttggtcccaaatctttggggttgctttttccaataaacgttggttacatttctttatgttatttgtaccagtaaccggtttatggatgagtgctcttggagtagtcggtctggctctgaacctacgtgcctatgacttcgtttcccaggaaatccgtgcagcagaagatcctgaatttgagactttctacaccaaaaatattcttttaaacgaaggtattcgtgcttggatggcggctcaagatcagcctcatgaaaaccttatattccctgaggaggttctaccccgtggaaacgctctttaatggaactttagctttagccggtcgtgaccaagaaaccaccggtttcgcttggtgggccgggaatgcccggcttatcaatttatccggtaaactattgggggctcatgtagcccatgccggattaatcgtattctgggccggagcaatgaacctatttgaagtggctcattttgtcccagaaaaacccatgtacgaacaaggattaattttacttccccacctagctactctaggctggggggtaggtcctggcggagaagttatagacacctttccatactttgtatctggagtacttcacttaatttcctctgctgtattgggctttggcggtatttatcatgcacttctgggacctgaaactcttgaagaatcttttccatttttcggttatgtatggaaagatagaaataaaatgaccacaattttgggtattcacttaattttgctaggtataggtgcttttcttctagtattcaaggctctttattttgggggcgtatacgatacctgggctccgggagggggagatgtaagaaaaattaccaacttgactcttagcccaagtgttatatttggttatttactaaaatcgccctttggaggcgaagggtggattgttagtgtggacgatttggaagatataattggaggacatgtatggttaggttccatttgtatatttggtggaatctggcatatcttaaccaaaccttttgcatgggctcgccgtgcacttgtatggtcgggagaggcttacttgtcttatagtttaggtgctttatccgtttttggtttcattgcttgttgctttgtctggttcaataataccgcttatcctagtgagttttacgggcccactggaccagaagcttctcaagctcaagcatttacttttctagttagagaccaacgtcttggggctaacgtgggatccgctcaagggcctactgggttaggtaaatatctaatgcgttccccgaccggagaagtcatttttggaggggaaactatgcgcttttgggatctgcgtgctccttggttagaacctctaagaggtcccaatggtttggacttgagtaggttgaaaaaagacatacaaccttggcaagaacggcgttctgcggaatatatgacgcatgctcctttagggtctttaaattctgtaggtggcgtagctaccgagatcaatgcagttaattatgtctctccgagaagttggttagctacctctcattttgttctaggattcttcctattcgtgggtcatttatggcacgcgggaagagctcgcgcagccgcagcgggatttgaaaaaggaattgatcgtgattttgagcctgttctttccatgactcctcttaactgagataactgagacaggagatccaatgcttaacgtaggaatcaatttgtgcttaacgtaggattgattacactatatatattgaaggaatcaggtgatatttaaaaagtattctgttttcctttcgtttcaactcattttctatctaaactttttttttctggctcggctattccacccagccgagccattcccttttattaatattaagattcttaattaagaagccaggaaaaagcaataaagaaagaaatctattcatcgagcaaaaggagagagagggattcgaaccctcgatagttctttgtttcgaactataccggttttcaagaccggagctatcaaccactcagccatctctccgaaagctaatttctattttatttttattccaccgaatcgaacatggccatatgagttgataccatcactatgtatagaaagatatcgtgtgtgaacctataggtcaatctatttatctgtatatatagatagatgaaatgcataatctagcatgcctatttgggaacgtgaaataaaaaaatcaccctcgaccccatgtccgaataaaagcggttcaaagggttggaaataagtcatatagaatcaatcgattcatggtaaaatccctctaccttgcattttattaatttttttttggtcaatatcatagagggatcaaatggtatagttcttttgttggtagcttggaggattagaaacatgactattgctttccaattggctgtttttgcattaattgctacttcgtcaatcttactgattagtgtacctgttgtatttgcttctcctgatggttggttgagtaacaaaaatattgtattttccggtacatctttatggattggattagtttttctagtgggtatccttaattctcttatttcttgaatctatccattctggatccaaaaatgacccctcccacgaatttttcagatttt

SEQ ID NO: 4214 - DNA, 4354 bp, Prunus mume
agagatgaaatttgatcttttttttctttggactacgcgggaatctgtcgatatatccgattaaatcctcttgttcctagatgttctataggaaaggaataaattaggaatgaataaattactattcccctcctttacagagaaacatttattacaagtcacgccgctttaaatatctttctttgattccaattccagaacacaagatcaatttttattttatttattttattagttatatcttatctatctatttatatatctagcaaataactatttcatgtactaaatatttccatccatattgatacatacgatatttttgttccgacaatgtgatggagaatggatgcgagaaggatactttcatttctagtctcctattatttatttaattaaatacaatatattaatattaatacaatatattaataaaataataggaaattttttaaaataaaagagtaaaatataaagtaataaaatatatggtattagaagaatacataaaaatatttatcaatctccccccttcaacgggattcaagactaagattagttgatggaacgagaggaatatgtataggatccatcggtatcgagaaaagggatcacttgtttcttgaacaattctaaaatccatctatctgattgatggatcataaaacaattcatggttcgggcagttattaagaataggaagggataaccgaattgagttcatggattaaactaggtcgggttacagaccaataaattatttttctattcgaaacccattcaaaagaatggacagtgtacgagaaatcaaataatacataaatgatagaagcctcgaacgttcggaaaatgctatgaggtgttcgaaaatggttgaagtagttgaataggaggatcactatgactatagcccttggtaaatttaccaaagacgaaaatgatttatttgatattatggatgactggttacggagggaccgtttcgtttttgtaggttggtctggcctattgctctttccttgtgcctatttcgctttagggggttggttcacaggtacaacctttgtaacttcatggtatacccatggattagcaagttcctatttggaaggctgtaacttcttaaccgccgcagtttccactccggctaatagtttagcacactctttgttgttattatggggtcctgaagcacaaggagattttactcgttggtgtcaattaggcggtctgtggacttttgttgctctacacggcgctttcggactaataggttttatgttacgtcaatttgaacttgctcgatctgttcaattgcgaccttataatgcaatcgcattctccggtccaattgctgtttttgtttctgtattcctaatttatccgctaggtcagtctggttggttttttgcgcccagttttggtgtagcagctatatttcgattcatcctctttttccaagggtttcataattggacattgaacccatttcatatgatgggagttgctggggtgttgggcgctgctctgttatgcgctattcatggtgctaccgtagaaaatactttatttgaagatggtgatggtgcaaatacattccgtgcttttaacccaactcaagctgaagaaacttattcaatggtcaccgctaaccgcttttggtcccaaatctttggggttgctttttccaataaacgttggttacatttctttatgttatttgtaccagtaaccggtttgtggatgagtgctcttggagtagtcggtctggccctgaacctacgtgcctatgacttcgtttctcaggaaatccgtgcagcggaagatcctgaatttgagactttctacaccaaaaatattctcttaaacgaaggtattcgtgcttggatggcggctcaagatcagcctcatgaaaaccttatattccctgaggaggttctaccccgtggaaacgctctttaatggaactttagctttagccggtcgtgaccaagaaaccactggtttcgcttggtgggccgggaatgcccgacttatcaatttatccggtaaactactgggggctcatgtagcccatgccggattaatcgtattctgggccggagcaatgaacctatttgaagtggctcatttcgtaccagagaagcctatgtatgaacaaggattaattttacttccccacctagctactctaggttggggggtaggtccgggtggggaagttctagacacctttccatactttgtgtctggagtacttcacttaatttcctctgcagtattgggctttggcggtatttatcatgcacttctgggacccgagactcttgaagaatcttttccattctttggttatgtatggaaagatagaaacaaaatgactacaattttgggtattcacttaatcttgttaggtataggtgcttttcttctagtattcaaggctctttattttgggggtgtatatgatacctgggctccgggcgggggagatgtaagaaaaattaccaacttgacccttagcccaagtattgtatttggttatttactaaaatccccctttggcggagaggggtggatcgttagtgtggacgatttggaagatataattggagggcatgtatggttaggttccatttgtatacttggtggaatctggcatatcttaaccaaaccttttgcatgggctcgccgtgcacttgtatggtctggagaggcttacctgtcttatagtttagctgctttatctgtttttggttttattgcttgttgctttgtttggttcaataataccgcctatcctagtgagttttacgggcccactggaccagaagcttctcaagctcaagcatttacttttttggttagagaccaacgtcttggggctaacgtaggatctgctcaaggacctaccggtttaggtaaatatctaatgcgttctccgaccggggaagttatttttggaggagaaactatgcgtttctgggatctgcgtgctccctggttagaacctttaaggggtcctaatggtttggacttgagtaggctgaaaaaagacatacagccttggcaagaacggcggtctgcggaatatatgactcatgctcctttaggttctttaaattccgtgggtggcgtagctaccgagatcaatgcagtcaattatgtctctcctagaagttggttagctacttctcattttgttctaggattcttcctattcgtaggtcatttatggcacgcgggaagggcgcgtgcagctgcagcaggatttgaaaaaggaattgatcgtgattttgaacctgttctttccatgactcctcttaactgagacagagatccaatgcttgaagtaggaataaaattgattccaccaaacctaatatgtatggtggatcaggtcatattttaaaagtattcctttcttttctactcatttatatcttctaaatctatttttttttctggctcggctattccacttagccgagccatttccttttatgctaccgatttcttttatgctactgagccgggcaaaaccaataaaataaagaaaggcaacgaatttattaaccgagtataaaggagagagagggattcgaaccctcgatagttctttgtttcgaactataccggttttcaagaccggagctatcaaccactcggccatctctccgaaataaaatttatattttattccacccaatagaacatggacatatgagttgataccattattatctatagaaagatatcaggtgtgagtctataggtctatctatctgtatatatataatatagatgcatgatccagcaagcatgcccctttgttttgtaaagtaaaaaaaagcgaccctcgattccatgcagtggcaaagggtggtaataagtcattatagaatcaatgatggattcatggtaaaatccttccatgatgcattttttttttacaattttttggctgataaagggatcaaatggtataattcttttgttggtagattggaggattagaaacatgactattgctttccaattggctgtttttgcattaattgctacttcattaatcttattgattagtgtacctgttgtatttgcttctcctgagggttggtcgggtaacaaaaatgttgtattttccggtacatcattatggattggattagtctttctggtgggtatccttaattctctcatctcttgaacctattcgttctagatccaaaaatgaaatgacccctccctccgaattccttcaggttgtgagacacattaaaattcaatataagtcccaaaaatgcaaataaagaaaagaaaaaaattagaaaaattagagggaggggtcaaa

SEQ ID NO: 4215 - DNA, 3797 bp, Castanea mollissima
  misc_feature (568)..(568): n is a, c, g, or t
  misc_feature (3775)..(3775): n is a, c, g, or t
gtcgtctccttgaatcgataaatatccctttccattattccaaccaaatccattctaaagattagaaaacaacaaaaaaagtaagtggacctaacctattgaatcatgactatatccactattctgatattaaaattcgataactcgataaagatgaaattgtaacagtcagtagatcctttttttatttaattttcatatttattttcttttggctctgcaagaatttgtcgatattactgattaaatattatcattcatagatgggttatagggagaaattaatatttccttcttctacgaagaaaggcttattccaagtcacaacatacgagccgttttaaattaaatttaaatatatttttaaattccagaacacaagacaggaccaatttagatctatataaatcttatatagatctaaattgatcagaacatgtattcatgtaccaaatatttccatatcgatacatgcgatatttttgttccgacaacgggataaaaaatgtatgcgagaaagctgctttcatttacaatttttattattaaattaaatacaatatcaatnattaaaaaaaaaaaaaattaggaaattcattctccttttttatgatttttctgacagataaaggtaaatagaaaaaaatcttcgaagtgcattgcttgctttgaaccacgaaaagatatacttccgagttgtatattcatatgagagaaaaagaaatataacacaataaaagaaaatgaaagagttaaagtataacgtaataaaatatatgatactatagtagtttaataagtagtttaatacacatagaaattatacggaatacataaagatatttatttttatcaatctcacaaacgagattcaagaataagattggttgatgaaacgagaggaatatgtctggggatcaaatggtagcgagaaaaggaatcacttgtttcttgaacagttctttcaaaaaattaatctatttgatcgatgagtcataagacaaggcaattcaaggttcaggtggttggttagtcagactagaaaaaaagaactgaattgaagtcatggatttacctcagtcaggttatgtaccaataaatgatttttagattcgaaacccattagaaagaaggggtagtgtacgagaaatcaaatcatatagaaatgatagacgtcttgaacgccctgaaaatgctatgaggtgttcgaaaatggttgaagtagttgaataggaggatcactatgactatagcccttgggaaatttaccaaagacgaaaatgatttatttgatattatggatgactggttacggagggaccgtttcgtttttgtaggttggtccggtctattgctctttccttgtgcttatttcgcgttaggaggttggtttacaggtacaacctttgtaacttcatggtatacacatggattggcgagttcctatttggaaggctgcaacttcttaaccgcggcagtttctactcctgctaatagtttagcacactctttgttgttactatggggtccagaagcacaaggagattttactcgttggtgtcaattaggcggtctgtggacttttgttgctctccacggcgctttcggactaataggtttcatgttacgtcaatttgaacttgctcgatctgttcaattgcgaccttataatgcaatcgcattctctgctccaattgctgtttttgtttctgtattcctgatttatccgctaggtcagtctggttggttctttgcgcccagttttggtgtcgcagctatatttcgattcatcctctttttccaagggtttcataattggacattgaacccatttcatatgatgggggttgccggtgtattgggcgctgcccttctatgcgctattcatggtgctaccgtagaaaatactttatttgaagatggtgatggcgcaaatacattccgtgcttttaacccaactcaagcggaagaaacttattcaatggtcaccgctaaccgcttttggtcccaaatctttggggttgctttttccaataaacgttggttacatttctttatgttatttgtaccagtaactggtttatggatgagtgctcttggagtagtcggcttggctctgaacctacgcgcctatgacttcgtttctcaggaaatccgtgcagcggaagatcctgaatttgagacgttctacaccaaaaatattcttttaaatgaaggcattcgtgcttggatggcggctcaagatcagcctcatgaaaaccttatattccctgaggaggttctaccccgtggaaacgctctttaatggaactttagccttagccggtcgtgaccaagaaaccacaggtttcgcttggtgggccgggaatgcccgacttatcaatttatccggtaaattactgggagctcatgtagcccatgccggattaatcgtattctgggccggagcaatgaacctatttgaagtggctcatttcgtaccagaaaagcccatgtatgaacaaggattaattttacttccccacctagctactctaggttggggggtaggtcctggtggggaagttatagatacctttccatactttgtgtctggagtacttcacttaatttcctctgcagtattgggctttggcggtatttatcacgcacttctgggacccgagactcttgaagagtcttttccattcttcggttatgtatggaaagatagaaataaaatgactacaattttgggtattcacttaattttgttaggtataggtgcttttcttctagtattcaaagctatttattttggaggcgtatatgatacctgggccccaggagggggagatgtaagaaaaattaccaacttgacccttagcccaagcgtcatatttggttatttactaaaatccccttttggaggagagggatggattgttagtgtggacgatttggaagatataattggagggcatgtatggttgggttccatttgtatacttggtggaatctggcatatcttaaccaaaccttttgcatgggcgcgccgtgcgcttgtatggtctggggaggcttacttgtcttatagtttaggtgctttagctgtttttggttttattgcttgttgctttgtttggttcaataataccgcttatcctagtgagttttacgggcccactggaccagaagcttctcaagctcaagcatttacttttctggttagagaccaacgtcttggggctaacgtggggtccgcccaaggacctaccggtttaggtaaatatctaatgcgttctccgactggagaagtaatttttgggggagaaactatgcgtttttgggatttgcgtgctccctggttagaacccctaaggggtcccaatgggttggacttgagtaggctgaaaaaagacatacaaccttggcaagaacgacgttccgcggaatatatgactcatgctcctttaggttctttaaattccgtgggtggtgtagctaccgagatcaatgcagtcaattatgtctctcctagaagttggttagctacctctcattttgttctcggattcttcctattcgtaggtcatttatggcatgcaggaagggctcgtgcagctgcagcaggatttgaaaaaggaattgatcgcgattttgaacctgttctttccatgactcctcttaactaagacaggagatctaattctaatgcttgaagtcaaaatctatttgatttcatcatacatatttgtttggttgggttaggtcatacgtattgaaaaaaaaagtnttcctttattttcattttgact

SEQ ID NO: 4216 - DNA, 3063 bp, Triphysaria pusilla
aaaaaaaataaaaaggaaggctttttaattgaagtataaccggatcccaatatggatgattgaatcacttttattcctacttcaattcaagcattggatctactgtctcacctcaattaagaggggtcatggaaagaacaggttcaaaatcgcgatcaattcctttttcaaatcctgctgcagctgcacgagcccttcccgcatgccacaaatgacctacgaataagaagaatcctagaacaaaatgagaggtagctaaccaacttctaggagaaacataattgactgcattaatctcggtagctacgccacccacagaatttaaagaacctaaaggagcgtgagtcatatattctgcggaccgccgttcttgccaaggttgtatgtcttttttcaacctactcaagtctaacccgtttggacctcttagaggttctaaccaaggagcgcgcagatcccaaaaacgcatagtttctcctccaaaaatgacttctccggtcggggaacgcattagatatttacctaagccggtaggtccttgagcggatcctacattagcccccagacgttggtctcgaacgagaaaggtaaatgcttgcgcctgagaagcttctggaccagtaggtccgtaaaactcgctaggataagcggtattattgaaccagacaaaacaacaagcaatgaaaccaaagacggctaaagccgctaaactataagataagtaagcctccccagaccatacaagggcacgtcgagcccacgcgaagggtttagttaagatatgccagattccgccaagtatacaaatggaacctaaccatacatgtcctccgattatatcttctaaatcgtccacactaacaatccacccctccccaccaaagggggattttagtaaataaccaaatataatacttgggctaagggtcaagttggtaatttttcttacatccccccctcccggagcccaagtatcatatacgcccccaaaataaagagccttgaagactagaagaaaagcacctagacccaacaaaattaaatgaatacctaaaattgtggtcattttatttctatctttccatacataaccgaagaacggaaaagattcttccagtgtctcgggtcccagaagtgcatgataaataccgccaaagcctaatacggcagaggaaattaaatgaagtactccagacacaaagtatggaaaggtatctataacttcccccccagggccgactccccaacctagagtagctagatggggaagtaaaattaatccttgttcatacataggcttctctggtacaaaatgagccacttcaaataggttcattgctccagcccagaatacgattaacccggcatgggctacatgagctcctagtagtttaccggataaattaataagccgggcatttccggcccaccaagcaaaaccggtggtttcttggtcacgaccagctacagctaaagttccattaaagagcgtttccacgtggtagaacctcctcagggaatataaggttttcatgaggctgatcttgagccgccatccaagcacgaataccttcgtttaatagaatatttttggtgtagaaagtctcaaattccggatcttccgcggcgcgaatttcctgagaaacgaagtcatatgcacgtaagttcagggccaagccgactactccaagagcactcatccataaaccggttactggtacaaataacataaagaaatgtaaccaacgtttattggaaaaagcaaccccaaagatttgggaccaaaagcggttagcggtgaccatggaataagtttcttccgcttgggttgggttaaaagcacggaatgtatttgcaccatcaccatcttcaaataaagtattttctacggtagcaccatgaatagcgcatagcaaagcagcccccaagacaccggcaactcccatcatatgaaatgggtttagtgtccaattatgaaatccttgaaaaaagaggatgaatcgaaaaatagctgctacgccaaaactcggtgcaaagaaccaaccagactgccccagtggataaatcaagaatacagaaacaaaaactgcaattggaccagagaatgctattgcattataaggtcgcaattgaacagatcgagcaagctcaaattgccgtaacatgaaacctattagtgcgaaagcaccatgcagagcaacaaaagtccacagaccgcctaattgacaccaacgggtaaaatctccttgtgcttccggaccccatagtaacaacaaagaatgtgctaaactattagcaggagtagaaactgcggccgttaagaaattgcagccttccaaataggaactagccaatccatgagtataccatgaagttacaaaagttgtacctgtgaaccaaccccctacagcaaaataggcacaaggaaagagcaataggccggaccagcctacaaaaacgaaacggtccctccgcaaccagtcatccataatatcaaataaatcattttcgtctttggtaaatttaccaagggctatagtcatagtgatcctcctattcaactacttcaaccatttccgagcacctcatagtattttcggggcgtctgaagattcgatcatttctctatgatttctcttgcactgcccctttccaacgggtttcgaagagaaaaatgctcacctagggaaatccatgaattccattttattattgtttgttactaaggatatggaccgtgaattgtcttcttatgactcatcaatcagatatatgaatcttttcaaagaacttttgaaggaacaagtagcccccttttctcactactaaccaatcctcagacctaccccttcttcttcgattaactaatgttattcttagatcttgttcgtgagattgagaaaaagaaagatagtgggaatggctcttatcttgtgacttggaggaaaggtttctctgtcgaggaagggagtaacaatttattcccatagaaaatatagaaataagaagattgaatcggaaatatcgacaaattctttcgaagtccaaggaaatgaaattcaa

SEQ ID NO: 4217 - DNA, 4047 bp, Cannabis sativa
gtattgtattgaatttgaacgtgtcttataacctgaaagaattcggggaggggtcgtttttggacctagaacgaccaggttcaagagataagagaattaaggatacctaccagaaagactaatccaatccataatgatgtaccggaaaatacaacatttttattacccgaccaaccatcaggagaagcaaatacaacgggtacactaatcagtaagattgatgaagtagcaattaatgcaaaaacagccaattggaaagcaatagtcatgtttctaatcctccaatttaccaataaaagaattatataccatttgatctctttatcagccaaaaaattgtcaaaaaaaaaatgcatcgaggacactttttttactttacaaaagggaacgctagatcatgcatctatatatatagatagctagatctatagattcatactcgatatatttctataatatactaaaggtatcaacttatatcgctatgtcttattcaatgaaaaaaaataaaatagaaattatctttcggagagatggccgagtggttgatagctccggtcttgaaaaccggtatagtccaaaacaaaggactatcgagggttcgaatccctctctctcctttttcttggtgaatagattagtttcgttatttattgatttcagtattataagtggaatggctcggctattccacttagccgagccagaaaaaaaaatagattagatataaaaagaaagaaaaaaggaagacttttaaaatattatattaccgactcgccccaacttactaacttacttaataggtagggtggaatcaaattgattcctacttcaagcattgggtctcctgtcttaattaagaggagtcatgaaaagaacaggttctaaatcacgatcaattcctttttcaaatcccgctgcagctgcacgagcccttcccgcgtgccataaatgacctacgaataggaagaaccctagaacaaaatgagaagtcgctaaccaacttctcggagagacataattgactgcattgatctcggtagctacgccacccacggaatttaaagaacctaaaggagcatgagtcatatattccgcagaacgccgttcttgccaaggctgtatgtcttttttcagcctactcaagtccaaaccgttgggaccccttagaggttctaaccagggagctcgtagatcccaaaaacgcatagtttcccctccaaaaataacttcccctgtcggtgaacgcattagatatttacctaaaccggtaggtccttgagcggatcccacgttagccccaagacgttggtctctaactagaaaagtaaatgcttgagcttgagaagcttctggaccagtgggcccgtaaaactcactaggataagcggtattattgaaccagacaaagcaacaagcaataaaaccaaaaactgataaagcacctaaactataagacaagtaagcctctccagaccatacaagtgcacgacgagcccatgcaaagggtttggttaagatatgccagattccaccaagtatacaaatggaacctaaccatacatgtcctccaattatatcttccaaatcgtccacactaacaatccacccctctccaccaaagggagatttgagtaaataaccaaatacaatacttggactaagggtcaaattggtaatttttcttacatctcctccccccggagcccaggtatcatatacacccccaaaataaagagccttaaagactagaagaaaagcacctatacctaacaaaattaagtgaatacccaaaattgtagtcattttatttctatctttccatacataaccgaagaatggaaaagattcttcaagagtttcaggtcccagaagtgcatgataaataccgccaaagcccaatactgcagaggaaattaagtgaagtactccagacacaaagtatggaaaggtatctagaacttccccgccgggccctaccccccaacctagagtagctaggtggggaagtaaaattaagccctgttcatacataggcttctctgggacgaaatgagccacttcaaataggttcattgctccggcccagaatacgattaatccggcatgagctacatgagcccccagcagtttaccggataaattgataagtcgggcattcccggcccaccaagcgaaaccggtggtttcttggtcacgaccagctaaagctaaagttccattaaagagcgtttccacggggtagaacctcctcagggaatataaggttttcatgaggctgatcttgagccgccatccaagcacgaataccctcgtttaagagaatatttttggtgtagaaagtctcaaattcaggatcttccgctgcacggatttcctgagaaacaaagtcatacgcacgtagattcaaagccagaccgactactccaagagcactcatccataaaccggttactggtacaaataacataaagaaatgtaaccaacgtttattggaaaaagcaaccccaaatatttgggaccaaaagcggttagcggtgaccattgaataagtttcttcagcttgagttgggttaaaagcacggaatgtatttgcaccatcaccatcttcaaataaagtgttttctacggtagcaccatgaatagcacatagcaaagcagcgcccaagacccctgcaactcccatcatatgaaatgggttcaatgtccaattatgaaacccttggaaaaagaggatgaatcgaaatatagctgctacaccaaaactaggcgcaaagaaccaaccagactgacctagcggataaatcaggaatacagaaacaaaaacagcaattggaccggagaatgcgattgcattataaggtcgcaattgaacagatcgagcaagttcaaattgacgtaacatgaaacctattagtgcgaaagcgccgtggagagcaacaaaagtccacagaccgcctaattgacaccaacgagtaaaatctccctgtgcttcaggaccccaaagtaacaacaaagagtgtgctaaactattagcaggagtagaaactgcggcagttaagaagttgcatccttccaaataggaacttgctaatccatgggtataccatgaagttacaaaggttgtacccgtgaaccaaccccctaaagagaaataggcacaaggaaagagcaatagaccggaccaacctacaaaaacgaaacggtccctccgtaaccagtcatccataatatcaaataaatcattttcgtctttggtaaatttaccaagagctatagtcatagtgatcctcctatttaactacttcaaccatttcagtttcgaacactcgatttcgttttcagagtggttgaggcttctattatttttgtatgatattttttttcgaatgggtttctaatataaaaaaaattattggtctgtaacccgaccaagttaactcaattcggttatcctttcctattcttaataagcatttgaaccatgaattgtcttattattcatcaattctctatctgattttttttgaaagaactgctcaaaaaagaagtgtgatcccccttctcgctaccgatagatccctgatccctagacatattcctcttgttccatcacctaatcttatttcttattcccgactcccgttgggaaatttttgaatttttatgtatttttcgaatttagatgtgtattaaagtattatatattttattactttatagtttactctttcattttcttttaaatttcaaaatttcctattattaaattcactacaatattcaatttcaatctaataaataatattaaataaaataatagtaaactataactgaaagcctctttctcacacccattttacatcacattgtctggaataaaaatagttaaaacgtctcttattagaataaacccttttctgtaaaggaggggaatagcaatttattcctcgaaaacatctaggaaaaagaatatttaatcggcaatatcgacagattcccgcgtagtccaaagaaatatgaaaaaaaaaaaagccccactgttcc

SEQ ID NO: 4218 - DNA, 10828 bp, Vitis vinifera
actaataaaagagactttcgaatgactaaatatagatacctcgatgtctcttagtaatgactaatgattgctcacgtgagagtaatagtaataccttctatgtaagacatgaagtagctctatctaagaacttctaattgagatatgaatacactaggttgcacaaaaaaatcgtttttgcgttcaaattcaaagaccggaaaaggttttataatattaaacgggtccagtaagcgcctcaaagctatgtcataatagatccgaacacttgcccggatcgacttccagatcataattgctctagtgaataactaaagaaaatagatagatgggagatataagagaagagaaagaaactaattataaatatctctcataggttcactaatttcttgactgttggcgggtctctttgtatgtgttgtccggaaagaggaggactcaatgattattcgttcgccggaaccagaagttaaaattttggtagatagggatcccataaaaacttctttcgaggaatgggccagacccggtcatttctcaagaacaatagctaagggccctgatactaccacttggatctggaacctacatgctgatgctcacgatttcgatagccataccagtgatttggaggagatctctcgaaaagtatttagtgcccatttcgggcaactctccatcatctttctttggctgagtggcatgtatttccacggtgctcgtttttccaattatgaagcatggctaagcgatcctactcacattggacctagtgcccaggtggtttggccaatagtgggccaagaaatattgaatggtgatgtgggcgggggtttccgaggaatacaaataacctctggtttttttcagatgtggcgagcatctggaataactaatgaattacaactttattgtaccgcaattggtgcattggtctttgcagccttaatgctttttgctggttggttccattatcacaaagccgctccaaaattggcttggttccaagatgtagaatctatgttgaatcaccatttagcggggctactaggacttgggtctctttcttgggcggggcatcaagtacatgtatctttaccgattaaccaatttctaaacgctggagtagatcctaaagagatcccacttcctcatgaatttatcttgaatcgggatcttttggctcaactttatcccagttttgccgagggagcaaccccatttttcaccttgaattggtcaaaatatgcagaatttcttacttttcgtggaggattagatccagtaactgggggtctatggctgaccgatattgcacaccatcatttagctattgcaattcttttcctgatagcgggtcacatgtataggaccaactggggcattggtcatgggctaaaagatattttagaggctcataaaggtccatttacaggtcagggccataaaggcctatatgaaattctaacaacgtcatggcatgctcaattatctcttaacctagctatgttaggctctttaaccattgttgtagctcaccatatgtattccatgcccccttatccatatttagctactgactatggtacacaactgtcattgttcacacatcacatgtggattggtggatttctcatagttggtgctgctgcgcatgcagccatttttatggtaagagactatgatccaactactcgatacaacgatctattagatcgtgtccttaggcatcgtgatgcaatcatatcacatctcaactgggcatgtatatttctaggctttcacagttttggtttgtatattcataatgataccatgagcgctttagggcgtccccaagatatgttttcagatactgctatacaattacaacccgtctttgctcaatggatacaaaacacccatgccctagcacctagtgcaacggctcctggtgcaacaacaagcaccagtttgacttgggggggtggtgatttagtagcagtgggtggcaaagtagctttgttgcctattccgttaggaaccgcagattttttggtacatcacattcatgcatttacgattcatgtgacggtattgatactcctgaaaggtgttctatttgctcgtagctctcgtttgataccggataaagcaaaccttggttttcgtttcccatgtgatggacctggaagagggggtacatgtcaagtatcagcttgggatcacgtcttcttagggctattctggatgtataattcaatttcggtagtaatattccatttcagttggaaaatgcagtcagatgtttgggggagtataagtgatcaaggggtgttaactcatatcacgggaggaaactttgcgcaaagttccattactattaatgggtggctccgcgatttcttatgggcacaggcatcccaggtaattcagtcttatggttcttcattatccgcatatggtctttttttcctaggtgctcattttgtatgggcttttagtttaatgtttctatttagcgggcgtggttattggcaagaacttattgaatccatcgtttgggctcataataaattaaaagttgctcctgctacccagcctagagccttgagcattgtacaaggacgtgctgtaggagtaacccattaccttctgggtggaattgccacaacatgggcgttcttcttagcaagaattattgcagtaggataatggctaggaggatttgaaaggcattatggcattaagatttccaaggtttagccaaggcttagctcaggaccccactactcgtcgtatttggtttggtattgctaccgcacatgacttcgaaagtcatgatgatattactgaggaacgtctttatcagaatatttttgcttctcattttgggcaattagcaatcatttttctgtggacttccggaaatctgtttcatgtagcttggcaaggaaattttgaatcatgggtacaagaccctttacatgtaagacctattgctcatgcaatttgggatcctcatttcggtcaaccggctgtggaagcttttactcgagggggtgctcctggaccagtgaatatcgcttattctggtgtttatcagtggtggtatacaatcggtttacgcactaatgaagatctttatactggagctctttttctattatttctttctgctatatctttaatagcgggttggttacacctacaaccgaaatggaaaccgagcgtttcgtggttcaaaaatgccgaatctcgtctcaatcatcatttgtcaggactcttcggagtaagttcattggcttggaccggacatttagtccatgtcgctattcctggatccaggggggagtacgttcgatggaataatttcttagatgtattaccgcaccctcaggggttaggcccactttttacaggtcagtggaatctttatgctcaaaaccctgattcaagtagtcatttatttggtacctctcaaggagcaggaactgccattctaacccttctcgggggattccatccacaaacgcaaagtttatggctgactgatattgctcatcatcatttagctattgcatttatttttctcgttgctggtcatatgtatagaactaacttcgggattgggcacagtatgaaagatcttttagaagcgcatattcctccgggaggacgattggggcgtggacataagggtctttatgacacaatcaataattcgattcattttcaattaggccttgctctagcctctttaggggttattacttccttggtagctcaacacatgtattctttaccggcttatgcgttcatagcacaagactttactactcaagctgcgttatatactcatcaccaatacatcgcaggattcatcatgacaggagcttttgctcatggagctatatttttcattagagattacaatccggagcagaatgaggataatgtattggcaagaatgttagaccataaagaagctatcatatcccatttaagttgggccagcctatttttggggttccataccttgggactttatgttcataatgatgtcatgcttgcgtttggtactccggagaaacaaatcttgattgaacctatatttgctcaatggatacaatctgctcacggtaaaacttcatatgggtttgatgtacttttatcttcaacaactggcccggcattcaatgcggggcgaagcatatggttgcctggctggttaaatgctgttaatgagaatagtaattcattattcttaacaataggtcctggagacttcttggttcatcatgctattgctctaggtttacatacaactacattgatcttagtaaaaggcgctttagatgcacgtggttccaagttaatgccagataaaaaggatttcggttatagttttccttgcgatggtcccggacgaggcggtacttgtgatatttcggcttgggacgcattttatttggcagttttctggatgttaaatactattggatgggttactttttattggcattggaagcacatcacattatggcagggtaacgtttcacagtttaatgaatcttccacttatttgatgggatggttaagagattatctatggttaaactcttcacaacttatcaatgggtataacccttttggtatgaatagtttatcagtctgggcgtggatgttcttatttggacatcttgtttgggctactgggtttatgttcttaatttcctggcgtggatattggcaggaattgattgaaactttagcatgggctcatgaacgcacacctttggccaatttgattcgatggagagataaaccagtggctctttccattgtgcaggcaagattagttggattagcccacttttctgtaggttatatattcacctatgcggctttcttgattgcctccacatcgggcaaatttggttaattattattattttttaatgtgctgtatccgcgataatctcatttctttcgatggagaaggggttcgccttcttatatttctacatctaggatccgacttgtatcattgatactaataggaactgaaccgttatggcaaggaaaagtttgattcagagggagaggaagagacaaaaattggaacagaaatatcatttgattcgtcgatcctcaaaaaaagaaataagcaaagttccgtcgttgagtgacaaatgggaaattcatggaaagttacaatcctcaccgcgtaatagcgcacctacccgtcttcatcgacgttgttttttgaccggaagaccgggagctaactatcgatactttgggttatctggacacatacttcgtgaaatggttcatgcatgtttgttgccaggggcaacaagatcaagttggtagggattcaaatatcctttaattttctattcgtttctatgatcgatgatcatagagcagtcattctgtacccctttaccattctgtataaatgggctattctatttgtacagatatggtagaggggcccatttaatccttgtttgtccattagttcccatctcttcagggcggggtagagcagcttggtagctcgcaaggctcataaccttgaggtcacgggttcaaatcctgtctccgcaatatttttttgtcaaaaaattatttattgttaactagtaattacttaccattctttttttggggggggaaggatataacgactacactatcatggtcaactataccgaatactttatcatagtaaatgcatttctttaccttgggcggatagcgggaatcgaacccgcatcttctccttggcaaagagaaattttaccattcgaccatatccgcattttttcgttcttgatacgaaatatgtccacacctacatatatatcatatatgtttgtatcatatttgtgcagagccgagccagatactctcttcagggtgattcccatatcatttatatatttcttttaattcaatttaaaatttgaattccattttatatttatattgtatatatttataataatataaattatatatataattatttattaattatttataataaattataaaaattataatattaattaatttaataggattaaaaaggactaaaaatttttaaattattaaaaaaatttttaaattcaaaatataaaaaaatattcaaatattaataaaataaaatattaatatatatatatatatatttaatatttattatatgcatattatattaatattctaattatataataataataatacatatttataataatatttatatattataatatatatattatattgaaatattgaatttgttaatattaacattattaacattaaaaaaaaaaaaaaatggaattttttttttcattcaagaactttgacccctcccccgaattctttctggttgtgagacacattcaaattcaatataaatcctcaacatgaaaataaagaaaacaaaaaaaattagagggaggggtcatttcatttttggatctgggacgaataggttcaagagatgagagaattaagtatacctaccagaaagactaatccaatccataatgatgtaccggaaaaaacaatatttttgttacttgaccaaccatcaggagaagcaaatacaacgggtacactaatcagtaagattgatgaagtagcaattaatgcaaaaacagccaattggaaagcaatagtcatgcttctaatcctccaagctaccaacaaaagaactataccatttgatccctcgatcagccaaaaaattgtaataaaatgcatcatggagggattttaccatgaatcattgattctgattctatatgacttattaccacttttttaccactttattcggacacggggtcggggggaattttttttacttcacaaataggcatgttggatcatgcatctatctatctatatatacagatagatcagatagatcgacctatagattcacaccttgatatatttctacaaatagtaatggtatcaactcatatggatatgaccatgttctatttgggagaataaaaataaaatataaattgtctttcggagagatggccgagtggttgatagctccggtcttgaaaaccggtatagttctgaacaaagaactatcgagggttcgaatccctctctctcctttttctcggtgaagagatttttttctttattggttttgcctggcccggtatcatatatcataaaggggaatggctcggctaggtgggatagcatagccgagccagaaaaaaaaaatagattaaatataaataaaaaataaatggagttgaaaaagaaaggaaaaaggaatgctttttaagtatgacctgacaccaatatgtatggtggaaccaaatagattcctacttcaagcattggatctcccgtctcagttaagaggggtcatagaaagaacaggttcaaaatcacgatcaattcctttttcaaatcctgctgcagctgcacgagcccttcccgcgtgccacaaatgacctacgaataggaagaatcctagaacaaaatgagaagtagctaaccaacttctaggagagacataattgactgcattgatctcggtagctacgccacccacggaatttaaagaacctaaaggagcgtgagtcatatattccgcggaacgccgttcttgccaaggttgtatgtcttttttcagcctactcaagtccaaaccattgggaccccttagaggttctaaccagggagcacgcagatcccaaaaacgcatagtttctcctccaaaaatgacttctccagtcggggaacgcattagatatttacctaaaccagtaggtccttgagcggatcccacgttagccccaagacgctggtctctaactagaaaagtaaatgcttgagcttgagacgcttcgggtccagttggcccgtaaaactcactaggataagcggtattattgaaccagacaaagcaacaagcaatgaaaccaaagacagctaaagcacctaaactataagacaagtaagcctctccagaccatacaagtgcacggcgagcccacgcaaagggtttggttaagatatgccagattccaccaaatatacaaatggaacctaaccatacatgtcctccaattatatcttccaaatcgtccacactaacaatccatccttctcctccaaagggcgattttagtaaataaccaaatataacacttgggctaagggtcaagttggtaatttttcttacatctccccctccgggagcccaggtatcatatacgccgccaaaataaagagccttgaatactagaagaaaagcacctatacctaacaagattaagtgaatacccaaaattgtggtcattttatttctatctttccatacataaccgaaaaatggaaaagattcttcaagagtctcaggtcccagaagtgcatgataaataccgccaaagcccaatactgcggaggaaattaagtgaagtactccagatacaaagtatggaaaggtgtctataacttccccaccaggacctaccccccaacctagagtagctaggtggggaagtaaaattaatccttgttcatacatgggcttctctggtacgaaatgagccacttcaaataggttcattgctccggcccagaatacgattaatccggcatgggctacatgagccccaagtagtttaccggataaattgataagtcgggcattcccggcccaccaagcgaaaccggtggtttcttggtcacgaccagctaaagctaaagttccattaaagagcgtttccacggggtagaacctcctcagggaatataaggttttcatgaggctgatcttgagccgccatccaagcacgaataccttcgtttaagagaatatttttggtgtagaaagtctcaaattcaggatcttccgctgcacggatttcctgggaaacgaagtcataggcacgtaagttcagagccagaccgactactccaagagcactcatccataaaccggttactggtacaaataacataaagaaatgtaaccaacgtttattggaaaaagcaaccccaaagatttgggaccaaaagcggttagcggtgaccattgaataagtttcttcagcttgagttggattaaaagcccggaatgtatttgcaccatcaccatcttcaaataaagtattttctacggtagcaccatgaatagcgcatagcagagcagcgcccaatacaccggcaactcccatcatatgaaatgggttcaacgtccaattatgaaacccttggaaaaagaggatgaatcgaaatatagctgctacaccaaaactaggcgcaaagaaccaaccagactgacctagtggataaattaggaatacagaaacaaaaacagcgattggagcagagaatgcgattgcattataaggtcgcaattgaacagatcgagcaagttcgaattgacgtaacatgaaacctattagtccgaaagcgccatgaagagcaacaaaagtccacagaccacctaattgacaccaacgagtaaaatctccttgtgcttcaggaccccatagtaacaataaagaatgtgctaaactattagcaggggtagaaactgcggcggttaagaaattgcaaccttccaaataggaactagccaatccatgggtataccatgaagttacaaaggttgtacctgtgaaccaaccccccaaagcgaaataggcacaaggaaagagcaatagaccggaccaacctacaaaaacgaaacggtccctccgtaaccagtcatccataatatcaaataaatcgctttcgtctttggtgaatttaccaagggctatagtcatagtgatcctcctattcaactacttcaaccatttccgaacacctcatagcgttttcagggcatccgaggattcgatcatttatgtatgatttgatttctcgtacactgccccttctaatgctaatgggtttcgaagaaaaaaatcctttattgatccataaattgacctaggtaaatccatgaactcaattggattattcctattcttaataagcacctgaaccgtgaattgtcttatgactcatcaatcagatagattcattttttgaaagaactgaactgttcaaagaacaagtgatcccttctcttgctaccagttgatctccagacttaccctcctcgttccatcaactaatcttattctcgtatcttgttcgtgagattgagaaaaataaatatctttatggattcttctaatttctatgtatattaaactaatacagtatcatatattttcttactttatactttactctttctttcattttattttattgtcggctttgttatatttccttttcctatagatgaatctaaaactccagagtatatattttcacaggtcgaagtaagaaagacactttgaatatttttctatttacttttatcggaacaaaaatatcggatgtatcgatatatagggaaatatttgatacacgaaatcacgatctcatagatatatataaatcttatatagatataaattgatcttgttcgggaatcaaagaaagatgttgaaaatggctcttatgctgtgacttggaatactcctttctctgtggaggaaaggaatagcaatttattcctatggaacacctaggaacaagaagatttaattggaaatatcgacaaattcttgcggagttcaaagaaatgaaaaaaaaaagatcaactgttccaatttcatctctatcgaatttgaatatcagaatagtggatatagtcatgattcaatgggtcaggtccacttactttttattttgttgatttctaatctataat

SEQ ID NO: 4219 - DNA, 4802 bp, Medicago truncatula
cacgaaggtttgttgcccggtgcaacaagatcgagttggtaagaataaataaaaaaaaattatcttcatttttttttatttattttgatgattagcgatcctaggacggtccctttaccattctgtataaatggtttattctatttgtacagatatggtggaggggcacattcaatctctgtttttcattaattgtcaattcttcttcttatcgcggagtagagcaacttggtagctcgcaaggctcataaccttgaggtcacgggttcaaatcccgtctccgcaacatttttgaaaaaaaaaaatggaattcaccatactctatttatatagtattttttttataatataaatatactattactttcgtattcaatacataagcaacggcggatagcgggaatcgaacccgcgtcttctccttggcaaggagaaattttaccattcaactatatccgcatttttgtttttatggtactttatactttatactttaaaattttatttgtgcagaactgtgtctgatatctattaggaataattaaaaaaaaagtaagaaatctatagatctatagatagatctatagttagaatagaatatataactattagattctataatctatatagaatctatattctatatagaatatatatactatatatctttctattctaaatagaccttatttgtatatatatctatatattggtatattgttaattttttttttttgatatattgtattgtatctataatatagatctatatattaattaaattaattaaaaaagtagaattacagatttctaaaatataaaaaataaattcgaatatattcccctagataataggaatcccatatttttctattttcttattttgacccctcccattaataataatgttttagttttctttatttgtggggtcttatatattccattttcattttaatgtgcctcacaacccgaaagaattcgggggggaggggtcatttcgttttttaatctagaatgaaaagtttcaagagatgagagaattaagaatacccactagaaatactaatccaatccataatgatgtaccggaaaatacaacatttttattacttgaccaaccatcaggagaagcaaatacaacaggtacaccaatcaataaaatggatgaagtaacaattaatgcaaaaacagctaattgaaaagcaatagtcatgtttctaatcctccaatttaccaacaaaagaactataccatttgatcccccaatcccttttgaaccccttaaaaaaagaaaaaacgcattatggagggttttatcattaatccattgattttagatgacaccccttttgaggcgtggatcgaggggtagtttttttacttcacaaaagagcatgctggatcatgcatatatatatacggagagagagaactagaccaataaagtcactttatcatacatagataaaaaggggtattaattcgtatggtcatgttctcttgagtggaataaagataaaatagaaattagcttttggagagatggctgagtggttgatagctccggtcttgaaaaccggtatagttcgaaagaactatcgagggttcgaatccccctctctcctttttcttagcgaatgtatttttgaattttattgatttaggttagctcggttttttcgggctcgactatatcaccacttagccgagcccgaaaaaagattagatattacatataaatgaattgaaaaaaaataatattttttcaatatcatctgctcgactcaacccaatatgtatactaaaatcaaagtgattcttacgtcaagcattgtatttcatgtctcaattaagaggagtcatgaaaagaacaggctccgaatctcgatcaattcctttttcaaatcctgcggcagctgcacgagctcttcccgcgtgccataaatgacctacgaataggaagaatcctagaacaaaatgagaagtagctaaccaacttctaggagagacataattgactgcattaatctctgtagctacgccacccacggaatttaaagaacctaaaggagcatgagtcatatattccgcagaacgacgttcttgccaaggctgtatgtcttttttcagtctactcaagtccaaaccattaggacctcttagaggttctaaccagggagcacgcagatcccaaaaacgcatagtttctcccccaaaaataacctctccggtcggagaacgcattaaatatttacctaaaccggtcggtccttgagcggatcctacattagctccaagacgttggtctctaactagaaaagtaaatgcttgagcttgagaagcttccggtccagtaggaccataaaactcactaggataagcagtattattaaaccagacaaagcaacaagctataaaaccaaaaagggataaagctgctaaactataagacaagtaagcttctccagaccatactagtgcacgacgagcccatgcaaagggtttagttaagatatgccagattccaccaagtatacaaatggaacccaaccatacatgccctccaattatgtcttccaaatcgtccacactaacaatccacccctctcccccaaaaggagattttagtaaataacccaatataatacttggactaagggttaagttggtaatttttcttacatccccccctcctggagcccaggtatcatatatacctccaaaataagaagccttaaatactagaagaaaagcccctatccctaacaaaattaagtgaatacctaaaatagtagtcattttatttctatctttccatacataaccaaagaaaggaaaagattcttcaagagtctcaggtcccagaagtgcatgataaataccgccaaagcccaatactgcagaagaaattaagtgaagtactccagagacaaagtatggaaaggtgtctataacttcccctccaggacctaccccccaacctagagtagctagatggggaagtaaaattaatccttgttcatacatgggcttctcgggtacgaaatgagcgacttcaaataggttcattgctccggcccagaatactattaatccggcatgggctacatgggcccccagtagtttaccggataaattgataagtcgggcattcccggcccaccaagcaaaaccggtagtttcttggtcacggcccgttaaagctaaagttccattaaagagcgtttccacgtggtagaacctcctcagggaatataaggttttcatgaggctgatcttgagccgccatccacgcacgaataccttcatttaagagaatatttttggtgtagaaagtctcaaattcaggatcttccgctgcgcggatttcttgagaaacgaagtcataggcacgtaggttcagggccagaccgactactccaagagcactcatccataaaccagttactggtacaaataacataaagaaatgtaaccaacgtttattggaaaaagcaaccccaaagatttgggaccaaaagcggttagcggtgaccattgaataagtttcttccgcttgagttgggttaaaagcacggaatgtatttgcgccatcaccatcttcaaataacgtattttctacggtagcaccatgaatagcgcatagtagggcagcgcccaatacaccagcaactcccatcatatgaaatgggtttaatgtccaattatgaaacccttggaaaaatagaatgaatcgaaatatagctgctacaccaaaactaggcgcaaagaaccaaccagactgacccagtggataaatcaggaatacagaaacaaaaacagcaattggaccggagaatgcgattgcattataagggcgcaattgaacagatcgagcaagttcaaattgacgtaacataaaacctattaatccgaaagcaccgtggagagcaacaaaagtccacagaccacccaattgacaccaacgggtaaaatctccctgtgcttcaggaccccatagtaacaacaaagagtgtgctaaactattagcaggagtagagactgccgcagttaagaagttacaaccttccaaataggaacttgccaatccatgagtataccatgaagttacaaaggtggtacctgtgaaccaaccccccacggcaaaataggcgcaaggaaagagcaatagaccggaccaacccacaaaaacaaaacggtcccttcgtaaccagtcatccataatatcaaataaatcattttcatctttggtaaatttaccaagagctatagtcatagtgatcctcctattcaactacttcaaccatttccgaacaccccctagcattttcagggatagaaccttcgaggattttttcattttatatatgatatgatttctcaaagactgtcccttcttttctactgggtttcgaatagaaaaattactttttttgtcgattgatatttaatctaggtcaaatccattaacttaattgggttattcctttctattctaaaaaattccctaagtcatgaagtcatgacgcgggaattgtcttatgattcgtaaatctgataaataaattttttaaagaactattccagaaacaaatgaaatgatcccttttatcacttttgttaccagcagatccccagacagactactctccttttatcaaataatattaaataatattattcttgaatcttgttcgtgaaataaaaaaaaagttttatatattcttctaatttgtatgtctaggaaactactatagaatcctatttttactttctattttactttaatttcttttatt

SEQ ID NO: 4220 - DNA, 2432 bp, Medicago truncatula
tcaattaagaggagtcatgaaaagaacaggctccgaatctcgatcaattcctttttcaaatcctgcggcagctgcacgagctcttcccgcgtgccataaatgacctacgaataggaagaatcctagaacaaaatgagaagtagctaaccaacttctaggagagacataattgactgcattaatctctgtagctacgccacccacggaatttaaagaacctaaaggagcatgagtcatatattccgcagaacgacgttcttgccaaggctgtatgtcttttttcagtctactcaagtccaaaccattaggacctcttagaggttctaaccagggagcacgcagatcccaaaaacgcatagtttctcccccaaaaataacctctccggtcggagaacgcattaaatatttacctaaaccggtcggtccttgagcggatcctacattagctccaagacgttggtctctaactagaaaagtaaatgcttgagcttgagaagcttccggtccagtaggaccataaaactcactaggataagcagtattattaaaccagacaaagcaacaagctataaaaccaaaaagggataaagctgctaaactataagacaagtaagcttctccagaccatactagtgcacgacgagcccatgcaaagggtttagttaagatatgccagattccaccaagtatacaaatggaacccaaccatacatgccctccaattatgtcttccaaatcgtccacactaacaatccacccctctcccccaaaaggagattttagtaaataacccaatataatacttggactaagggttaagttggtaatttttcttacatccccccctcctggagcccaggtatcatatatacctccaaaataagaagccttaaatactagaagaaaagcccctatccctaacaaaattaagtgaatacctaaaatagtagtcattttatttctatctttccatacataaccaaagaaaggaaaagattcttcaagagtctcaggtcccagaagtgcatgataaataccgccaaagcccaatactgcagaagaaattaagtgaagtactccagagacaaagtatggaaaggtgtctataacttcccctccaggacctaccccccaacctagagtagctagatggggaagtaaaattaatccttgttcatacatgggcttctcgggtacgaaatgagcgacttcaaataggttcattgctccggcccagaatactattaatccggcatgggctacatgggcccccagtagtttaccggataaattgataagtcgggcattcccggcccaccaagcaaaaccggtagtttcttggtcacggcccgttaaagctaaagttccattaaagagcgtttccacgtggtagaacctcctcagggaatataaggttttcatgaggctgatcttgagccgccatccacgcacgaataccttcatttaagagaatatttttggtgtagaaagtctcaaattcaggatcttccgctgcgcggatttcttgagaaacgaagtcataggcacgtaggttcagggccagaccgactactccaagagcactcatccataaaccagttactggtacaaataacataaagaaatgtaaccaacgtttattggaaaaagcaaccccaaagatttgggaccaaaagcggttagcggtgaccattgaataagtttcttccgcttgagttgggttaaaagcacggaatgtatttgcgccatcaccatcttcaaataacgtattttctacggtagcaccatgaatagcgcatagtagggcagcgcccaatacaccagcaactcccatcatatgaaatgggtttaatgtccaattatgaaacccttggaaaaatagaatgaatcgaaatatagctgctacaccaaaactaggcgcaaagaaccaaccagactgacccagtggataaatcaggaatacagaaacaaaaacagcaattggaccggagaatgcgattgcattataagggcgcaattgaacagatcgagcaagttcaaattgacgtaacataaaacctattaatccgaaagcaccgtggagagcaacaaaagtccacagaccacccaattgacaccaacgggtaaaatctccctgtgcttcaggaccccatagtaacaacaaagagtgtgctaaactattagcaggagtagagactgccgcagttaagaagttacaaccttccaaataggaacttgccaatccatgagtataccatgaagttacaaaggtggtacctgtgaaccaaccccccacggcaaaataggcgcaaggaaagagcaatagaccggaccaacccacaaaaacaaaacggtcccttcgtaaccagtcatccataatatcaaataaatcattttcatctttggtaaatttaccaagagctatagtcata

SEQ ID NO: 4221 - DNA, 2691 bp, Quercus alba
ggacttatatttcattttaatgtgtctcacaacctgaaaatgaaagaattaggaggggatcatttcatttttggatctaaatagaacaaataggttcaagagatgagagaattaaggatacccaccaaaaagactaatccaatccataatgatgtaccggaaaatacaacatttttgttatttgaccaaccatcaggagaagcaaatacaacaggtacactaatcagtaagattgttgaagtagcaattaatgcaaaaacagccaattggaaagcaatagtcatctttctaatcctccaatctatcaacaaaagaaactatataccatttgatccctttattggtatcggccaaaaaattgtatcagccaaaaattctaataaaacgtatcatagagggattttaccacgaatctattaatgctgtatgacttattagcaccttttaccaccttattaaatcttattaaattaaggcatgagatcaagggaaaggtattttttttttactttcattaaaagaggcccgccagatcattatctatatatatacagatcgatagctagacccataggatcgcaccggatatctttatatatataggtcgtaatggtatcaactcatatatccatgttctattcgttagaaaataaaaaaaaaataataaaatagaaataatctttcggagaggtggccgagtggttgatagctccggtcttgaaaaccggtatagttcgaaacaaagaactatcgagggttcgaatccctctctctccttttttgctcgtggaatatatatatatattttttattttattggttttgtccggctcagtattagtattctaaaagggaatggctcggctagggggatagccgagccagaacagaaaaaaaagggttcaatatataatgagtcgaaaatgaaaataaaggaatacttttttttttaatacgtatgacctaacccaaccaaacaaatatgtatgatgaaatcaaatagattttgacttcaagcattagaattagatctcctgtcttagttaagaggagtcatggaaagaacaggttcaaaatcgcgatcaattcctttttcaaatcctgctgcagctgcacgagcccttcctgcatgccataaatgacctacgaataggaagaatcctagaacaaaatgagaggtagctaaccaacttctaggagagacataattgactgcattgatctcggtagctacaccacccacggaatttaaagaacctaaaggagcatgagtcatatattccgcggaacgtcgttcttgccaaggttgtatgtcttttttcagcctactcaagtccaacccattgggaccccttaggggttctaaccagggagcacgcaaatcccaaaaacgcatagtttctcccccaaaaatgacttctccagtcggagaacgcattagatatttacctaaaccggtaggtccttgggcggaccctacgttagccccaaggcgttggtctctaaccagaaaagtaaatgcttgagcttgagaagcttctggtccagtgggcccgtaaaactcactaggataagcggtattattgaaccaaacaaagcaacaagcaataaaaccaaaaacagctaaagcacctaaactataagacaagtaagcctccccagaccatacaagcgcacggcgcgcccatgcaaaaggtttggttaagatatgccagattccaccaagtatacaaatggaacccaaccatacatgccctccaattatatcttccaaatcgtccacactaacaatccatccctctcctccaaaaggggattttagtaaataaccaaatatgacgcttgggctaagggtcaagttggtaatttttcttacatctccccctcccggggcccaggtatcatatacgcctccaaaataaatagctttgaatactagaagaaaagcacctatacctaacaaaattaagtgaatacccaaaattgtagtcattttatttctatctttccatacataaccgaagaatggaaaagactcttcaagagtctcgggtcccagaagtgcgtgataaataccgccaaagcccaatactgcagaggaaattaagtgaagtactccagacacaaagtatggaaaggtatctataacttccccaccaggacctaccccccaacctagagtagctaggtggggaagtaaaattaatccttgttcatacatgggcttttctggtacgaaatgagccacttcaaataggttcattgctccggcccagaatacgattaatccggcatgggctacatgagctcccagtaatttaccggataaattgataagtcgggcattcccggcccaccaagcgaaacctgtggtttcttggtcacgaccggctaaggctaaagttccattaaagagcgtttccacggggtagaacctcctcagggaatataaggttttcatgaggctgatcttgagccgccatccaagcacgaatgccttcatttaaaagaatatttttggtgtagaacgtctcaaattcaggatcttcctatttgtaattggagtgagatttggtttctttcttcgtcttgttgaaaattctattctaaacgtttctttctcttttttgttctctcctctctcactcacgccatgggatttggaattatccccatgtactctgcgttgat

SEQ ID NO: 4222 - DNA, 4516 bp, Quercus alba
aacctgaaaaatgaaagaattagaggggatcatttcatttttggatctaaatagaacaaataggttcaagagatgagagaattaaggatacccaccaaaaagactaatccaatccataatgatgtaccggaaaatacaacaattttgttattgaccaaccatcaggagaagcaaatacaacaggtacactaatcagtaagattgctgaagtagcaattaatgcaaaaacagccaattggaaagcaatagtcatcttctaatcctccaatctatcaacaaagaaactatataccatttgatccctttattggtatcggccaaaaaattagtatcagccaaaaattactaataaaacgtatcatagagggattttaccacgaatctattaatgctgtatgacttattagcaccttttaccaccttattaaatcttattaaattaaggcatgagatcaagggaaaggtattttttttttactttcactaaaagaggcccgccagatcattatctatatatatacagatcgatagctagacccataggatcgcaccggatatctttatatatataggtcgtaatggtatcaactcatatatccatgttctattcgttagaaaataaaaaaaaaaaataataaaatagaaataatctttcggagaggtggccgagtggttgatagctccggtcttgaaaaccggtatagttcgaaacaaagaactatcgagggttcgaatccctctctctccttttgctcgtggaatatatatatatattttttattttattggttttgtccggctcagtattagtattctaaaagggaatggctcggctagggggatagccgagccagaacagaaaaaaagggttcaatatataatgagtcgaaaatgaaaataaaggaatactttttttcaatacgtatgacctaacccaaccaaacaaatatgtatgatgaaatcaaatagattttgacttcaagcattagaattagatctcctgtcttagttaagaggagtcatggaaagaacaggttcaaaatcgcgatcaattcctttttcaaatcctgctgcagctgcacgagcccttcctgcatgccataaatgacctacgaataggaagaatcctagaacaaaatgagaggtagctaaccaacttctaggagagacataattgactgcattgatctcggtagctacaccacccacggaatttaaagaacctaaaggagcatgagtcatatattccgcggaacgtcgttcttgccaaggttgtatgtcttttttcagcctactcaagtccaacccattgggaccccttaggggttctaaccagggagcacgcaaatcccaaaaacgcatagtttctccccccaaaaaatgacttctccagtcggagaacgcattagatatttacctaaaccggtaggtccttgggcggaccctacgttagccccaaggcgttggtctctaaccagaaaagtaaaatgcttgagcttgagaagcttctggtccagtgggcccgtaaaactcactaggataagcggtattattgaaccaaacaaagcaacaagcaataaaaccaaaaacagctaaagcacctaaactataagacaagtaagcctccccagaccatacaagcgcacggcgcgcccatgcaaaaggtttggttaagatatgccagattccaccaagtatacaaatggaacccaaccatacatgccctccaattatatcttccaaatcgtccacactaacaatccatccctctcctccaaaaaggggattttagtaaataaccaaatatgacgcttgggctaagggtcaagttggtaatttttcttacatctccccctcccggggcccaggtatcatatacgcctccaaaaataaatagctttgaatactagaagaaaagcacctatacctaacaaaattaagtgaatacccaaaattgtagtcattttatttctatctttccatacataaccgaagaatggaaaagactcttcaagagtctcgggtcccagaagtgcgtgataaataccgccaaagcccaatactgcagaggaaattaagtgaagtactccagacacaaagtatggaaaggtatctataacttccccaccaggacctaccccccaacctagagtagctaggtggggaagtaaaattaatccttgttcatacatgggcttttctggtacgaaatgagccacttcaaataggttcattgctccggcccagaatacgattaatccggcatgggctacatgagctcccagtaatttaccggataaattgataagtcgggcattcccggcccaccaagcgaaacctgtggtttcttggtcacgaccggctaaggctaaagttccattaaagagcgtttccacggggtagaacctcctcagggaatataaggttttcatgaggctgatcttgagccgccatccaagcacgaatgccttcatttaaaagaatatttttggtgtagaacgtctcaaattcaggatcttccgctgcacggatttcctgagaaacgaagtcataggcgcgtaggttcagagccaagccgactactccaagagcactcatccataaaccggttactggtacaaataacataaagaaatgtaaccaacgtttattggaaaaagcaaccccaaagatttgggaccaaaagcggttagcggtgaccattgaataagtttcttccgcttgagttgggttaaaagcacggaatgtatttgcgccatcaccatcttcaaataaagtattttctacggtagcaccatgaatagcgcatagaagggcagcgcccaatacaccggcaacccccatcatatgaaatgggttcaatgtccaattatgaaacccttggaaaaagaggatgaatcgaaatatagctgcgacaccaaaactgggcgcaaagaaccaaccagactgacctagcggataaatcaggaatacagaaacaaaaacagcaattggagcagagaatgcgattgcattataaggtcgcaattgaacagatcgagcaagttcaaattgacgtaacatgaaacctattagtccgaaagcgccgtggagagcaacaaaagtccacagaccgcctaattgacaccaacgagtaaaatcccccttgtgcttctggaccccatagtaacaacaaagagtgtgctaaactattagcaggagtagaaactgccgcggttaagaagttgcagccttccaaataggaactcgccaatccatgtgtataccatgaagttacaaaggttgtacctgtaaaccaacctcctaacgcgaaataagcacaaggaaagagcaatagaccggaccaacctacaaaaacgaaacggtccctccgtaaccagtcatccataatatcaaataaatcattttcgtctttggtaaatttcccaagggctatagtcatagtgatcctcctattcaactacttcaaccattttcgaacacctcatagaattttcagggcgttcaagacgtctatcatttctatatgatttgatttctcgtacactaccccttctttctaatgggtttcgaatctaaaaatcatttattggtacataacctgactgaggtaaatccatgacttcaattcagttctttttttctagtctgactaaccaaccacctgaaccttgaattgccttgtcttatgactcatcgatcaaatagattaattttttgaaagaactgttcaagaaacaagtgattccttttctcgctaccagttgatccccagacatattcctctcgtttcatcaaccaatcttattcttgaatctcgtttgtgagattgataaaaataaatatctttatgtattccgtataatttctatgtgtattaaactacttattaaactactatagtatcatatattttattacgttatactttaactctttcattttcttttattgtgttatatttctttttctctcatatgaatatacaactcggaagtatatcttttcgcggttcaaagcaagcaatgcacttcgaagatttttttctatttacctttatctgtcagaaaaatcataaaaaaggagaattcatttcctaatttttttttttattttaatattgatattgtatttaatttaataataaaaactgtaaatgaaagcagctttctcgcatacatttttgatcccgttgtcggaacaaaaatttcgcatgtatcgatatggaaatatttggtacatgaatacatgctctgatcaatttagatctatataaatcttatatagatctaaattgatcagagcatgtattctggaattttaaaatatatttaaatttaatttaaaacggctcgtatgttgtgacttggaataagcctttcttcgtagaagaaggaaatattaatttatccctataacccatctatgaatgataatatttaatcagtaatatcgacaaattcttgcagagccaaaagaaaataaatatgaaaattaaataaaaaaaggatctacc

SEQ ID NO: 4223 - DNA, 2409 bp, Quercus alba
cttattaaattaaggcatgagatcaagggtaaaggtatttttttttttactttcattaaaagaggcccgccagatcattatctatatatatacagatcgatagctagacccataggatcgcaccggatatctttatatatataggtcgtaatggtatcaactcatatatccatgttctattcgttagaaataaaaaaaaaaataataaaatagaaataatctttcggagaggtggccgagtggttgatagctccggtcttgaaaaccggtatagttcgaaacaaagaactatcgagggttcgaatccctctctctccttttttgctcgtggaatatatatatatattttttattttattggttttgtccggctcagtattagtattctaaaagggaatggctcggctagggggatagccgagccagaacagaaaaaaagggttcaatatataatgagtcgaaaatgaaaataaaggaatactttttttttcaatacgtatgacctaacccaaccaaacaaatatgtatgatgaaatcaaatagattttgacttcaagcattagaattagatctcctgtcttagttaagaggagtcatggaaagaacaggttcaaaatcgcgatcaattcctttttcaaatcctgctgcagctgcacgagcccttcctgcatgccataaatgacctacgaataggaagaatcctagaacaaaatgagaggtagctaaccaacttctaggagagacataattgactgcattgatctcggtagctacaccacccacggaatttaaagaacctaaaggagcatgagtcatatattccgcggaacgtcgttcttgccaaggttgtatgtcttttttcagcctactcaagtccaacccattgggaccccttaggggttctaaccagggagcacgcaaatcccaaaaacgcatagtttctcccccaaaaatgacttctccagtcggagaacgcattagatatttacctaaaccggtaggtccttgggcggaccctacgttagccccaaggcgttggtctctaaccagaaaagtaaatgcttgagcttgagaagcttctggtccagtgggcccgtaaaactcactaggataagcggtattattgaaccaaacaaagcaacaagcaataaaaccaaaaacagctaaagcacctaaactataagacaagtaagcctccccagaccatacaagcgcacggcgcgcccatgcaaaaggtttggttaagatatgccagattccaccaagtatacaaatggaacccaaccatacatgccctccaattatatcttccaaatcgtccacactaacaatccatccctctcctccaaaaggggattttagtaaataaccaaatatgacgcttgggctaagggtcaagttggtaatttttcttacatctccccctcccggggcccaggtatcatatacgcctccaaaataaatagctttgaatactagaagaaaagcacctatacctaacaaaattaagtgaatacccaaaattgtagtcattttatttctatctttccatacataaccgaagaatggaaaagactcttcaagagtctcgggtcccagaagtgcgtgataaataccgccaaagcccaatactgcagaggaaattaagtgaagtactccagacacaaagtatggaaaggtatctataacttccccaccaggacctaccccccaacctagagtagctaggtggggaagtaaaattaatccttgttcatacatgggcttttctggtacgaaatgagccacttcaaataggttcattgctccggcccagaatacgattaatccggcatgggctacatgagctcccagtaatttaccggataaattgataagtcgggcattcccggcccaccaagcgaaacctgtggtttcttggtcacgaccggctaaggctaaagttccattaaagagcgtttccacggggtagaacctcctcagggaatataaggttttcatgaggctgatcttgagccgccatccaagcacgaatgccttcatttaaaagaatatttttggtgtagaacgtctcaaattcaggatcttccgctgcacggatttcctgagaaacgaagtcataggcgcgtaggttcagagccaagccgactactccaagagcactcatccataaaccggttactggtacaaataacataaagaaatgtaaccaacgtttattggaaaaagcaaccccaaagatttgggaccaaaagcggttagcggtgaccattgaataagtttcttccgcttgagttgggttaaaagcacggaatgtatttgcgccatcaccatcttcaaataaagtattttctacggtagcaccatgaatagcgcatagaagggcagcgcccaatacaccggcaaccc

SEQ ID NO: 4224 - DNA, 2668 bp, Quercus alba
gtcattttggggtacttatatttcattttaatgtgtctcacaacctgaaaatgaaagaattagaggggatcatttcatttttggatctaaatagaacaaataggttcaagagatgagagaattaaggatacccaccaaaaagactaatccaatccataatgatgtaccggaaaatacaacatttttgttatttgaccaaccatcaggagaagcaaatacaacaggtacactaatcagtaagattgttgaagtagcaattaatgcaaaaacagccaattggaaagcaatagtcatctttctaatcctccaatctatcaacaaaagaaactatataccatttgatccctttattggtatcggccaaaaaattgtatcagccaaaaattctaataaaacgtatcatagagggattttaccacgaatctattaatgctgtatgacttattagcaccttttaccaccttattaaatcttattaaattaaggcatgagatcaagggaaaggtatttttttttttttactttattaaaagaggcccgccagatcattatctatatatatacagatcgatagctagacccataggatcgcaccggatatctttatatatataggtcgtaatggtatcaactcatatatccatgttctattcgttagaaaataaaaaaaaaaataataaaatagaaataatctttcggagaggtggccgagtggttgatagctccggtcttgaaaaccggtatagttcgaaacaaagaactatcgagggttcgaatccctctctctccttttttgctcgtggaatatatatatatattttttattttattggttttgtccggctcagtattagtattctaaaagggaatggctcggctagggggatagccgagccagaacagaaaaaaaagggttcaatatataatgagtcgaaaatgaaaataaaggaatacttttttttttcaatacgtatgacctaacccaaccaaacaaatatgtatgatgaaatcaaatagattttgacttcaagcattagaattagatctcctgtcttagttaagaggagtcatggaaagaacaggttcaaaatcgcgatcaattcctttttcaaatcctgctgcagctgcacgagcccttcctgcatgccataaatgacctacgaataggaagaatcctagaacaaaatgagaggtagctaaccaacttctaggagagacataattgactgcattgatctcggtagctacaccacccacggaatttaaagaacctaaaggagcatgagtcatatattccgcggaacgtcgttcttgccaaggttgtatgtcttttttcagcctactcaagtccaacccattgggaccccttaggggttctaaccagggagcacgcaaatcccaaaaacgcatagtttctcccccaaaaatgacttctccagtcggagaacgcattagatatttacctaaaccggtaggtccttgggcggaccctacgttagccccaaggcgttggtctctaaccagaaaagtaaatgcttgagcttgagaagcttctggtccagtgggcccgtaaaactcactaggataagcggtattattgaaccaaacaaagcaacaagcaataaaaccaaaaacagctaaagcacctaaactataagacaagtaagcctccccagaccatacaagcgcacggcgcgcccatgcaaaaggtttggttaagatatgccagattccaccaagtatacaaatggaacccaaccatacatgccctccaattatatcttccaaatcgtccacactaacaatccatccctctcctccaaaaggggattttagtaaataaccaaatatgacgcttgggctaagggtcaagttggtaatttttcttacatctccccctcccggggcccaggtatcatatacgcctccaaaataaatagctttgaatactagaagaaaagcacctatacctaacaaaattaagtgaatacccaaaattgtagtcattttatttctatctttccatacataaccgaagaatggaaaagactcttcaagagtctcgggtcccagaagtgcgtgataaataccgccaaagcccaatactgcagaggaaattaagtgaagtactccagacacaaagtatggaaaggtatctataacttccccaccaggacctaccccccaacctagagtagctaggtggggaagtaaaattaatccttgttcatacatgggcttttctggtacgaaatgagccacttcaaataggttcattgctccggcccagaatacgattaatccggcatgggctacatgagctcccagtaatttaccggataaattgataagtcgggcattcccggcccaccaagcgaaacctgtggtttcttggtcacgaccggctaaggctaaagttccattaaagagcgtttccacggggtagaacctcctcagggaatataaggttttcatgaggctgatcttgagccgccatccaagcacgaatgccttcatttaaaagaatattttggtgtagaacgtctcaaattcaggatcttccgctgcacggatttcctgagaaacgaagtcataggcgcgtaggttcagagccaagccgactactccaagagcactcatccataaaccggttactggtacaaataac

SEQ ID NO: 4225 - DNA, 1531 bp, Quercus alba
ttttttttcttaatacgtatgacctaacccaaccaaacaaatatgtatgatgaaatcaaatagattttgacttcaagcattagaattagatctcctgtcttagttaagaggagtcatggaaagaacaggttcaaaatcgcgatcaattcctttttcaaatcctgctgcagctgcacgagcccttcctgcatgccataaatgacctacgaataggaagaatcctagaacaaaatgagaggtagctaaccaacttctaggagagacataattgactgcattgatctcggtagctacaccacccacggaatttaaagaacctaaaggagcatgagtcatatattccgcggaacgtcgttcttgccaaggttgtatgtcttttttcagcctactcaagtccaacccattgggaccccttaggggttctaaccagggagcacgcaaatcccaaaaacgcatagtttctcccccaaaaatgacttctccagtcggagaacgcattagatatttacctaaaccggtaggtccttgggcggaccctacgttagccccaaggcgttggtctctaaccagaaaagtaaatgcttgagcttgagaagcttctggtccagtgggcccgtaaaactcactaggataagcggtattattgaaccaaacaaagcaacaagcaataaaaccaaaaacagctaaagcacctaaactataagacaagtaagcctccccagaccatacaagcgcacggcgcgcccatgcaaaaggtttggttaagatatgccagattccaccaagtatacaaatggaacccaaccatacatgccctccaattatatcttccaaatcgtccacactaacaatccatccctctcctccaaaaggggattttagtaaataaccaaatatgacgcttgggctaagggtcaagttggtaatttttcttacatctccccctcccggggcccaggtatcatatacgcctccaaaataaatagctttgaatactagaagaaaagcacctatacctaacaaaattaagtgaatacccaaaattgtagtcattttatttctatctttccatacataaccgaagaatggaaaagactcttcaagagtctcgggtcccagaagtgcgtgataaataccgccaaagcccaatactgcagaggaaattaagtgaagtactccagacacaaagtatggaaaggtatctataacttccccaccaggacctaccccccaacctagagtagctaggtggggaagtaaaattaatccttgttcatacatgggcttttctggtacgaaatgagccacttcaaataggttcattgctccggcccagaatacgattaatccggcatgggctacatgagctcccagtaatttaccggataaattgataagtcgggcattcccggcccaccaagcgaaacctgtggtttcttggtcacgaccggctaaggctaaagttccattaaagagcgtttccacggggtagaacctcctcagggaatataaggttttcatgaggctgatc

SEQ ID NO: 4226 - DNA, 2468 bp, Quercus alba
acttatatttcattttaatgtgtctcacaacctgaaaatgaaagaattaggaggggatcatttcatttttggatctaaatagaacaaataggttcaagagatgagagaattaaggatacccaaccaaaagactaatccaatccataatgatgtaccggaaaatacaactatttttgttatttgaccaaccatcaggagaagcaaatacaacaggtacactaatcagtaagattgttgaagtagcaattaatgcaaaaacagccaattggaaagcaatagtcatctttctaatcctccaatctatcaacaaagaaactatataccatttgatccctttattggtatcggccaaaaaattgtatcagccaaaaattctaataaaacgtatcatagagggattttaccacgaatctattaatgctgtatgacttattagcaccttttaccaccttattaaatcttattaaattaaggcatgagatcaagggaaaggttatttttactttcattaaaagaggcccgccagatcattatctatatatatacagatcgatagctagacccataggatcgcaccggatatctttatatatataggtcgtaatggtatcaactcatatatccatgttctattcgttagaaaataaaaaaaaataataaaatagaaataatctttcggagaggtggccgagtggttgatagctccggtcttgaaaaccggtatagttcgaaacaaagaactatcgagggttcgaatccctctctctccttttttgctcgtggaatatatatatatattttttattttattggttttgtccggctcagtattagtattctaaaagggaatggctcggctagggggatagccgagccagaacagaaaaaaaagggttcaatatataatgagtcgaaaatgaaaataaaggaatactttttttttcaatacgtatgacctaacccaaccaaacaaatatgtatgatgaaatcaaatagattttgacttcaagcattagaattagatctcctgtcttagttaagaggagtcatggaaagaacaggttcaaaatcgcgatcaattcctttttcaaatcctgctgcagctgcacgagcccttcctgcatgccataaatgacctacgaataggaagaatcctagaacaaaatgagaggtagctaaccaacttctaggagagacataattgactgcattgatctcggtagctacaccacccacggaatttaaagaacctaaaggagcatgagtcatatattccgcggaacgtcgttcttgccaaggttgtatgtcttttttcagcctactcaagtccaacccattgggaccccttaggggttctaaccagggagcacgcaaatcccaaaaacgcatagtttctcccccaaaaatgacttctccagtcggagaacgcattagatatttacctaaaccggtaggtccttgggcggaccctacgttagccccaaggcgttggtctctaaccagaaaagtaaatgcttgagcttgagaagcttctggtccagtgggcccgtaaaactcactaggataagcggtattattgaaccaaacaaagcaacaagcaataaaaccaaaaacagctaaagcacctaaactataagacaagtaagcctccccagaccatacaagcgcacggcgcgcccatgcaaaaggtttggttaagatatgccagattccaccaagtatacaaatggaacccaaccatacatgccctccaattatatcttccaaatcgtccacactaacaatccatccctctcctccaaaaggggattttagtaaataaccaaatatgacgcttgggctaagggtcaagttggtaatttttcttacatctccccctcccggggcccaggtatcatatacgcctccaaaataaatagctttgaatactagaagaaaagcacctatacctaacaaaattaagtgaatacccaaaattgtagtcattttatttctatctttccatacataaccgaagaatggaaaagactcttcaagagtctcgggtcccagaagtgcgtgataaataccgccaaagcccaatactgcagaggaaattaagtgaagtactccagacacaaagtatggaaaggtatctataacttccccaccaggacctaccccccaacctagagtagctaggtggggaagtaaaattaatccttgttcatacatgggcttttctggtacgaaatgagccacttcaaataggttcattgctccggcccagaatacgattaatccggcatgggctacatgagctcccagtaatttaccggataaattgataagtcgggcattcccggcccaccaagcgaaacctgtggtttcttggtcacgaccggctaaggctaaagttccattaaagagcgtttccacggggtagaacctcctcagggaatataaggttttcatgaggctgatcccat

SEQ ID NO: 4227 - DNA, 3993 bp, Quercus alba
acacgacgactaatagtcatctttctaatcctccaatctatcaacaaagaactatataccatttgatccctttattggtatcggccaaaattgtatcagccaaaattactataaaacgtatcatagagggattttaccacgaatctattaatgctgtatgacttattagcaccttttaccaccttattaaatcttattaaattaaggcatgaagatcaagggaaaggtatttttttttttactttcattaaaagaggcccgccagatcattatctatatatatacagatcgatagctagacccataggatcgcaccggatatctttatatatataggtcgtaatggtatcaactcatatatccatgttctattcgttagaaataaaaaaaaaaaaaataaaatagaaataatctttcggagaggtggccgagtggttgatagctccggtcttgaaaaccggtatagttcgaaacaaagaactatcgagggttcgaatccctctctctccttttttgctcgtggaatatatatatatattttttattttattggttttgtccggctcagtattagtattctaaaagggaatggctcggctagggggatagccgagccagaacagaaaaaaaagggttcaatatataatgagtcgaaaatgaaaataaaggaatacttttttttttcaatacgtatgacctaacccaaccaaacaaatatgtatgatgaaatcaaatagattttgacttcaagcattagaattagatctcctgtcttagttaagaggagtcatggaaagaacaggttcaaaatcgcgatcaattcctttttcaaatcctgctgcagctgcacgagcccttcctgcatgccataaatgacctacgaataggaagaatcctagaacaaaatgagaggtagctaaccaacttctaggagagacataattgactgcattgatctcggtagctacaccacccacggaatttaaagaacctaaaggagcatgagtcatatattccgcggaacgtcgttcttgccaaggttgtatgtcttttttcagcctactcaagtccaacccattgggaccccttaggggttctaaccagggagcacgcaaatcccaaaaacgcatagtttctcccccaaaaatgacttctccagtcggagaacgcattagatatttacctaaaccggtaggtccttgggcggaccctacgttagccccaaggcgttggtctctaaccagaaaagtaaatgcttgagcttgagaagcttctggtccagtgggcccgtaaaactcactaggataagcggtattattgaaccaaacaaagcaacaagcaataaaaccaaaaacagctaaagcacctaaactataagacaagtaagcctccccagaccatacaagcgcacggcgcgcccatgcaaaaggtttggttaagatatgccagattccaccaagtatacaaatggaacccaaccatacatgccctccaattatatcttccaaatcgtccacactaacaatccatccctctcctccaaaaggggattttagtaaataaccaaatatgacgcttgggctaagggtcaagttggtaatttttcttacatctccccctcccggggcccaggtatcatatacgcctccaaaataaatagctttgaatactagaagaaaagcacctatacctaacaaaattaagtgaatacccaaaattgtagtcattttatttctatctttccatacataaccgaagaatggaaaagactcttcaagagtctcgggtcccagaagtgcgtgataaataccgccaaagcccaatactgcagaggaaattaagtgaagtactccagacacaaagtatggaaaggtatctataacttccccaccaggacctaccccccaacctagagtagctaggtggggaagtaaaattaatccttgttcatacatgggcttttctggtacgaaatgagccacttcaaataggttcattgctccggcccagaatacgattaatccggcatgggctacatgagctcccagtaatttaccggataaattgataagtcgggcattcccggcccaccaagcgaaacctgtggtttcttggtcacgaccggctaaggctaaagttccattaaagagcgtttccacggggtagaacctcctcagggaatataaggttttcatgaggctgatcttgagccgccatccaagcacgaatgccttcatttaaaagaatattttttggtgtagaacgtctcaaattcaggatcttccgctgcacggatttcctgagaaacgaagtcataggcgcgtaggttcagagccaagccgactactccaagagcactcatccataaaccggttactggtacaaataacataaagaaatgtaaccaacgtttattggaaaaagcaaccccaaagatttgggaccaaaagcggttagcggtgaccattgaataagtttcttccgcttgagttgggttaaaagcacggaatgtatttgcgccatcaccatcttcaaataaagtattttctacggtagcaccatgaatagcgcatagaagggcagcgcccaatacaccggcaacccccatcatatgaaatgggttcaatgtccaattatgaaacccttggaaaaagaggatgaatcgaaatatagctgcgacaccaaaactgggcgcaaagaaccaaccagactgacctagcggataaatcaggaatacagaaacaaaaacagcaattggagcagagaatgcgattgcattataaggtcgcaattgaacagatcgagcaagttcaaattgacgtaacatgaaacctattagtccgaaagcgccgtggagagcaacaaaagtccacagaccgcctaattgacaccaacgagtaaaatccccttgtgcttctggaccccatagtaacaacaaagagtgtgctaaactattagcaggagtagaaactgccgcggttaagaagttgcagccttccaaataggaactcgccaatccatgtgtataccatgaagttacaaaggttgtacctgtaaaccaacctcctaacgcgaaataagcacaaggaaagagcaatagaccggaccaacctacaaaaacgaaacggtccctccgtaaccagtcatccataatatcaaataaatcattttcgtctttggtaaatttcccaagggctatagtcatagtgatcctcctattcaactacttcaaccattttcgaacacctcatagaattttcagggcgttcaagacgtctatcatttctatatgatttgatttctcgtacactaccccttctttctaatgggtttcgaatctaaaaatcatttattggtacataacctgactgaggtaaatccatgacttcaattcagttctttttttctagtctgactaaccaaccacctgaaccttgaattgccttgtcttatgactcatcgatcaaatagattaattttttgaaagaactgttcaagaaacaagtgattccttttctcgctaccagttgatccccagacatattcctctcgtttcatcaaccaatcttattcttgaatctcgtttgtgagattgataaaaataaatatctttatgtattccgtataatttctatgtgtattaaactacttattaaactactatagtatcatatattttattacgttatactttaactctttcattttcttttattgtgttatatttctttttctctcatatgaatatacaactcggaagtatatcttttcgcggttcaaagcaagcaatgcacttcgaagattttttctatttacctttatctgtcagaaaaatcataaaaaggagaattcatttccttaatttttattttaatattgatattgtatttaatttaataataaaaactgtaaatgaaagcagctttctcgcatacattttgatcccgttgtcggaacaaaatttcgcatgtatcgatatggaaatattcccat

SEQ ID NO: 4228 - DNA, 3048 bp, Quercus alba
aatacgtatgactaaccaaccaacaaatatgtatgatgaaatcaaatagattttgacttcaagcattagaattagatctcctgtcttagttaagaggagtcatggaaagaacaggttcaaaatcgcgatcaattcctttttcaaatcctgctgcagctgcacgagcccttcctgcatgccataaatgacctacgaataggaagaatcctagaacaaaatgagaggtagctaaccaacttctaggagagacataattgactgcattgatctcggtagctacaccacccacggaatttaaagaacctaaaggagcatgagtcatatattccgcggaacgtcgttcttgccaaggttgtatgtcttttttcagcctactcaagtccaacccattgggaccccttaggggttctaaccagggagcacgcaaatcccaaaaacgcatagtttctcccccaaaaatgacttctccagtcggagaacgcattagatatttacctaaaccggtaggtccttgggcggaccctacgttagccccaaggcgttggtctctaaccagaaaagtaaatgcttgagcttgagaagcttctggtccagtgggcccgtaaaactcactaggataagcggtattattgaaccaaacaaagcaacaagcaataaaaccaaaaacagctaaagcacctaaactataagacaagtaagcctccccagaccatacaagcgcacggcgcgcccatgcaaaaggtttggttaagatatgccagattccaccaagtatacaaatggaacccaaccatacatgccctccaattatatcttccaaatcgtccacactaacaatccatccctctcctccaaaaggggattttagtaaataaccaaatatgacgcttgggctaagggtcaagttggtaatttttcttacatctccccctcccggggcccaggtatcatatacgcctccaaaataaatagctttgaatactagaagaaaagcacctatacctaacaaaattaagtgaatacccaaaattgtagtcattttatttctatctttccatacataaccgaagaatggaaaagactcttcaagagtctcgggtcccagaagtgcgtgataaataccgccaaagcccaatactgcagaggaaattaagtgaagtactccagacacaaagtatggaaaggtatctataacttccccaccaggacctaccccccaacctagagtagctaggtggggaagtaaaattaatccttgttcatacatgggcttttctggtacgaaatgagccacttcaaataggttcattgctccggcccagaatacgattaatccggcatgggctacatgagctcccagtaatttaccggataaattgataagtcgggcattcccggcccaccaagcgaaacctgtggtttcttggtcacgaccggctaaggctaaagttccattaaagagcgtttccacggggtagaacctcctcagggaatataaggttttcatgaggctgatcttgagccgccatccaagcacgaatgccttcatttaaaagaatatttttggtgtagaacgtctcaaattcaggatcttccgctgcacggatttcctgagaaacgaagtcataggcgcgtaggttcagagccaagccgactactccaagagcactcatccataaaccggttactggtacaaataacataaagaaatgtaaccaacgtttattggaaaaagcaaccccaaagatttgggaccaaaagcggttagcggtgaccattgaataagtttcttccgcttgagttgggttaaaagcacggaatgtatttgcgccatcaccatcttcaaataaagtattttctacggtagcaccatgaatagcgcatagaagggcagcgcccaatacaccggcaacccccatcatatgaaatgggttcaatgtccaattatgaaacccttggaaaaagaggatgaatcgaaatatagctgcgacaccaaaactgggcgcaaagaaccaaccagactgacctagcggataaatcaggaatacagaaacaaaaacagcaattggagcagagaatgcgattgcattataaggtcgcaattgaacagatcgagcaagttcaaattgacgtaacatgaaacctattagtccgaaagcgccgtggagagcaacaaaagtccacagaccgcctaattgacaccaacgagtaaaatccccttgtgcttctggaccccatagtaacaacaaagagtgtgctaaactattagcaggagtagaaactgccgcggttaagaagttgcagccttccaaataggaactcgccaatccatgtgtataccatgaagttacaaaggttgtacctgtaaaccaacctcctaacgcgaaataagcacaaggaaagagcaatagaccggaccaacctacaaaaacgaaacggtccctccgtaaccagtcatccataatatcaaataaatcattttcgtctttggtaaatttcccaagggctatagtcatagtgatcctcctattcaactacttcaaccattttcgaacacctcatagaattttcagggcgttcaagacgtctatcatttctatatgatttgatttctcgtacactaccccttctttctaatgggtttcgaatctaaaaatcatttattggtacataacctgactgaggtaaatccatggcttcaattcagttctttttttctagtctgactaaccaaccacctgaaccttgaattgccttgtcttatgactcatcgatcaaatagattaattttttgaaagaactgttcaagaaacaagtgattccttttctcgctaccagttgatccccagacatattcctctcgtttcatcaaccaatcttattcttgaatctcgtttgtgagattgataaaaataaatatctttatgtattccgtataatttctatgtgtattaaactacttattaaactactatagtatcatatattttattacgttatactttaactctttcattttcttttattgtgttatatttctttttctct

SEQ ID NO: 4229 - DNA, 2667 bp, Quercus alba
gtaccctcctttctatttttttctttatttgtcatttgggtacttatatttctatttaatgtgtctacacaacctagaaaatagaaagaattaggaggggatcatttcattttggatctaaacagaacaaataggttcaagagatgagagaattaaggataacccaccaaaaagactaatccaatccataatgatgtaccggaaaatacaacatttttgttatttgaccaaccatcaggagaagcaaatacaacaggtacactaatcagtaagattgttgaagtagcaattaatgcaaaaaacagccaattggaaagcaatagtcatctttctaatcctccaatctatcaacaaaagaaactatataccatttgatccctttattggtatcggccaaaaaattgtatcagccaaaaattctaataaaacgtatcatagagggattttaccacgaatctattaatgctgtatgacttattagcaccttttaccaccttattaaatcttattaaattaaggcatgagatcaagggaaaggtatttttttttacttcattaaaagaggcccgccagatcattatctatatatatacagatcgatagctagacccataggatcgcaccggatatctttatatatataggtcgtaatggtatcaactcatatatccatgttctattcgttagaaaataaaaaaaaataataaaatagaaataatctttcggagaggtggccgagtggttgatagctccggtcttgaaaaccggtatagttcgaaacaaagaactatcgagggttcgaatccctctctctccttttttgctcgtggaatatatatatatattttattttattggttttgtccggctcagtattagtattctaaaagggaatggctcggctagggggatagccgagccagaacagaaaaaaagggttcaatatataatgagtcgaaaatgaaaataaaggaatactttttttttctaatacgtatgacctaacccaaccaaacaaatatgtatgatgaaatcaaatagattttgacttcaagcattagaattagatctcctgtcttagttaagaggagtcatggaaagaacaggttcaaaatcgcgatcaattccttttttcaaatcctgctgcagctgcacgagcccttcctgcatgccataaatgacctacgaataggaagaatcctagaacaaaatgagaggtagctaaccaacttctaggagagacataattgactgcattgatctcggtagctacaccacccacggaatttaaagaacctaaaggagcatgagtcatatattccgcggaacgtcgttcttgccaaggttgtatgtcttttttcagcctactcaagtccaacccattgggaccccttaggggttctaaccagggagcacgcaaatcccaaaaacgcatagtttctcccccaaaaatgacttctccagtcggagaacgcattagatatttacctaaaccggtaggtccttgggcggaccctacgttagccccaaggcgttggtctctaaccagaaaagtaaatgcttgagcttgagaagcttctggtccagtgggcccgtaaaactcactaggataagcggtattattgaaccaaacaaagcaacaagcaataaaaccaaaaacagctaaagcacctaaactataagacaagtaagcctccccagaccatacaagcgcacggcgcgcccatgcaaaaggtttggttaagatatgccagattccaccaagtatacaaatggaacccaaccatacatgccctccaattatatcttccaaatcgtccacactaacaatccatccctctcctccaaaaggggattttagtaaataaccaaatatgacgcttgggctaagggtcaagttggtaatttttcttacatctccccctcccggggcccaggtatcatatacgcctccaaaataaatagctttgaatactagaagaaaagcacctatacctaacaaaattaagtgaatacccaaaattgtagtcattttatttctatctttccatacataaccgaagaatggaaaagactcttcaagagtctcgggtcccagaagtgcgtgataaataccgccaaagcccaatactgcagaggaaattaagtgaagtactccagacacaaagtatggaaaggtatctataacttccccaccaggacctaccccccaacctagagtagctaggtggggaagtaaaattaatccttgttcatacatgggcttttctggtacgaaatgagccacttcaaataggttcattgctccggcccagaatacgattaatccggcatgggctacatgagctcccagtaatttaccggataaattgataagtcgggcattcccggcccaccaagcgaaacctgtggtttcttggtcacgaccggctaaggctaaagttccattaaagagcgtttccacggggtagaacctcctcagggaatataaggttttcatgaggctgatcttgagccgccatccaagcacgaatgccttcatttaaaagaatattttggtgtagaacgtctcaaattcaggatcttccgctgcacggatttcctgagaaacgaagtcataggcgcgtaggttcagagccaagccgactactccaagagcactcatcc

SEQ ID NO: 4230 - DNA, 3593 bp, Quercus alba
aattagggggggatctttttctttttttggatctaaattagacaaataggttcaagagatgagagaattaaggatacccaccaaaagactaatccaatccataatgatgtaccggaaatacaacattttttgttattttgaccaaccatcaggagaagcaaatacaacaggtacactaatcagtaagattgttgaagtagcaattaatgcaaaaacagccaattggaaagcaatagtcatcttttctaatcctccaatctatcaacaaaagaaactatataccatttgatccctttattggtatcggccaaaaaattgtatcagccaaaaattctaataaaacgtatcatagagggatttttaccacgaatctattaatgctgtatgacttattagcaccttttaccaccttattaaatcttattaaattaaggcatgagatcaagggaaaggtttttttttttttttacttcattaaaagaggcccgccagatcattatctatatatatacagatcgatagctagacccataggatcgcaccggatatctttatatatataggtcgtaatggtatcaactcatatatccatgttctattcgttagaaaataaaaaaataaataaaatagaaataatctttcggagaggtggccgagtggttgatagctccggtcttgaaaaccggtatagttcgaaacaaagaactatcgagggttcgaatccctctctctccttttttgctcgtggaatatatatatatattttttattttattggttttgtccggctcagtattagtattctaaaagggaatggctcggctagggggatagccgagccagaacagaaaaaaaagggttcaatatataatgagtcgaaaatgaaaataaaggaatacttttttttttcaatacgtatgacctaacccaaccaaacaaatatgtatgatgaaatcaaatagattttgacttcaagcattagaattagatctcctgtcttagttaagaggagtcatggaaagaacaggttcaaaatcgcgatcaattcctttttcaaatcctgctgcagctgcacgagcccttcctgcatgccataaatgacctacgaataggaagaatcctagaacaaaatgagaggtagctaaccaacttctaggagagacataattgactgcattgatctcggtagctacaccacccacggaatttaaagaacctaaaggagcatgagtcatatattccgcggaacgtcgttcttgccaaggttgtatgtcttttttcagcctactcaagtccaacccattgggaccccttaggggttctaaccagggagcacgcaaatcccaaaaacgcatagtttctcccccaaaaatgacttctccagtcggagaacgcattagatatttacctaaaccggtaggtccttgggcggaccctacgttagccccaaggcgttggtctctaaccagaaaagtaaatgcttgagcttgagaagcttctggtccagtgggcccgtaaaactcactaggataagcggtattattgaaccaaacaaagcaacaagcaataaaaccaaaaacagctaaagcacctaaactataagacaagtaagcctccccagaccatacaagcgcacggcgcgcccatgcaaaaggtttggttaagatatgccagattccaccaagtatacaaatggaacccaaccatacatgccctccaattatatcttccaaatcgtccacactaacaatccatccctctcctccaaaaggggattttagtaaataaccaaatatgacgcttgggctaagggtcaagttggtaatttttcttacatctccccctcccggggcccaggtatcatatacgcctccaaaataaatagctttgaatactagaagaaaagcacctatacctaacaaaattaagtgaatacccaaaattgtagtcattttatttctatctttccatacataaccgaagaatggaaaagactcttcaagagtctcgggtcccagaagtgcgtgataaataccgccaaagcccaatactgcagaggaaattaagtgaagtactccagacacaaagtatggaaaggtatctataacttccccaccaggacctaccccccaacctagagtagctaggtggggaagtaaaattaatccttgttcatacatgggcttttctggtacgaaatgagccacttcaaataggttcattgctccggcccagaatacgattaatccggcatgggctacatgagctcccagtaatttaccggataaattgataagtcgggcattcccggcccaccaagcgaaacctgtggtttcttggtcacgaccggctaaggctaaagttccattaaagagcgtttccacggggtagaacctcctcagggaatataaggttttcatgaggctgatcttgagccgccatccaagcacgaatgccttcatttaaaagaatatttttggtgtagaacgtctcaaattcaggatcttccgctgcacggatttcctgagaaacgaagtcataggcgcgtaggttcagagccaagccgactactccaagagcactcatccataaaccggttactggtacaaataacataaagaaatgtaaccaacgtttattggaaaaagcaaccccaaagatttgggaccaaaagcggttagcggtgaccattgaataagtttcttccgcttgagttgggttaaaagcacggaatgtatttgcgccatcaccatcttcaaataaagtattttctacggtagcaccatgaatagcgcatagaagggcagcgcccaatacaccggcaaccccccatcatatgaaatgggttcaatgtccaattatgaaacccttggaaaaagaggatgaatcgaaatatagctgcgacaccaaaactgggcgcaaagaaccaaccagactgacctagcggataaatcaggaatacagaaacaaaaacagcaattggagcagagaatgcgattgcattataaggtcgcaattgaacagatcgagcaagttcaaattgacgtaacatgaaacctattagtccgaaagcgccgtggagagcaacaaaagtccacagaccgcctaattgacaccaacgagtaaaatccccttgtgcttctggaccccatagtaacaacaaagagtgtgctaaactattagcaggagtagaaactgccgcggttaagaagttgcagccttccaaataggaactcgccaatccatgtgtataccatgaagttacaaaggttgtacctgtaaaccaacctcctaacgcgaaataagcacaaggaaagagcaatagaccggaccaacctacaaaaacgaaacggtccctccgtaaccagtcatccataatatcaaataaatcattttcgtctttggtaaatttcccaagggctatagtcatagtgatcctcctattcaactacttcaaccattttcgaacacctcatagaattttcagggcgttcaagacgtctatcatttctatatgatttgatttctcgtacactaccccttctttctaatgggtttcgaatctaaaaatcatttattggtacataacctga

SEQ ID NO: 4231 - DNA, 2922 bp, Quercus alba
agtaagattattgaagtagcaattaatgcaaaaacaagccaattggaaagcaatagtcatctttctaatcctccaatctatcaacaaaagaaactatataccatttgatccctttatttggtatcggccaaaaaaattgtatcagccaaaaattctaataaaacgtatcatagagggattttaccacgaatctattaatgctgtatgacttattagcaccttttaccaccttattaaatcttattaaattaaggcatgagatcaagggaaaggtattttttttttttactttcattaaaagaggcccgccagatcattatctatatatatacagatcgatagctagacccataggatcgcaccggatatctttatatatataggtcgtaatggtatcaactcatatatccatgttctattcgttagaaaaaaaaaaaaaaaaaataataaaatagaaataatctttcggagaggtggccgagtggttgatagctccggtcttgaaaaccggtatagttcgaaacaaagaactatcgagggttcgaatccctctctctccttttttgctcgtggaatatatatatatattttttattttattggttttgtccggctcagtattagtattctaaaagggaatggctcggctagggggatagccgagccagaacagaaaaaaaaagggttacaatatataatgagtcgaaaatgaaaataaaggaatacttttttttttctaatacgtatgacctaacccaaccaaacaaatatgtatgatgaaatcaaatagattttgacttcaagcattagaattagatctcctgtcttagttaagaggagtcatggaaagaacaggttcaaaatcgcgatcaattcctttttcaaatcctgctgcagctgcacgagcccttcctgcatgccataaatgacctacgaataggaagaatcctagaacaaaatgagaggtagctaaccaacttctaggagagacataattgactgcattgatctcggtagctacaccacccacggaatttaaagaacctaaaggagcatgagtcatatattccgcggaacgtcgttcttgccaaggttgtatgtcttttttcagcctactcaagtccaacccattgggaccccttaggggttctaaccagggagcacgcaaatcccaaaaacgcatagtttctcccccaaaaatgacttctccagtcggagaacgcattagatatttacctaaaccggtaggtccttgggcggaccctacgttagccccaaggcgttggtctctaaccagaaaagtaaatgcttgagcttgagaagcttctggtccagtgggcccgtaaaactcactaggataagcggtattattgaaccaaacaaagcaacaagcaataaaaccaaaaacagctaaagcacctaaactataagacaagtaagcctccccagaccatacaagcgcacggcgcgcccatgcaaaaggtttggttaagatatgccagattccaccaagtatacaaatggaacccaaccatacatgccctccaattatatcttccaaatcgtccacactaacaatccatccctctcctccaaaaggggattttagtaaataaccaaatatgacgcttgggctaagggtcaagttggtaatttttcttacatctccccctcccggggcccaggtatcatatacgcctccaaaataaatagctttgaatactagaagaaaagcacctatacctaacaaaattaagtgaatacccaaaattgtagtcattttatttctatctttccatacataaccgaagaatggaaaagactcttcaagagtctcgggtcccagaagtgcgtgataaataccgccaaagcccaatactgcagaggaaattaagtgaagtactccagacacaaagtatggaaaggtatctataacttccccaccaggacctaccccccaacctagagtagctaggtggggaagtaaaattaatccttgttcatacatgggcttttctggtacgaaatgagccacttcaaataggttcattgctccggcccagaatacgattaatccggcatgggctacatgagctcccagtaatttaccggataaattgataagtcgggcattcccggcccaccaagcgaaacctgtggtttcttggtcacgaccggctaaggctaaagttccattaaagagcgtttccacggggtagaacctcctcaggggaatataaggttttcatgaggctgatcttgagccgccatccaagcacgaatgccttcatttaaaagaatatttttggtgtagaacgtctcaaattcaggatcttccgctgcacggatttcctgagaaacgaagtcataggcgcgtaggttcagagccaagccgactactccaagagcactcatccataaaccggttactggtacaaataacataaagaaatgtaaccaacgtttattggaaaaaagcaaccccaaagatttgggaccaaaagcggttagcggtgaccattgaataagtttcttccgcttgagttgggttaaaagcacggaatgtatttgcgccatcaccatcttcaaataaagtattttctacggtagcaccatgaatagcgcatagaagggcagcgcccaatacaccggcaaccccccatcatatgaaatgggttcaatgtccaattatgaaacccttggaaaaagaggatgaatcgaaatatagctgcgacaccaaaactgggcgcaaagaaccaaccagactgacctagcggataaatcaggaatacagaaacaaaaacagcaattggagcagagaatgcgattgcattataaggtcgcaattgaacagatcgagcaagttcaaattgacgtaacatgaaacctattagtccgaaagcgccgtggaagtctactcgt

SEQ ID NO: 4232 - DNA, 1422 bp, Parthenium argentatum
tcaattaagcggggtcatggaaagaacaggttcaaaatcacgatcaattcctttttcaaatcctgctgcagctgcacgagctcttcctgcgtgccacaaatgccctacgaagaagaagaatcctagaacaaaatgagaagtagctaaccaacttctaggagacacataattgactgcattgatctcggtagctactccacccacggaatttaaagaacctaaaggagcatgagtcatatattctgcggaacgacgttcttgccaaggttgtatgtcttttttcagccgactcaagtccaacccatttggaccccttagaggttctaaccaaggagcacgcaaatcccaaaaacgcatagtttctcctccaaaaatgacttctccggtcggggaacgcattaaatatttacctaaaccggtaggcccttgagcggatcctacgttagctccaagacgttggtctctaactagaaaagtaaatgcttgagcttgagaagcttctggtccagtgggtccataaaactcactaggataagccgtattattgaaccagacaaaacaacaagcaatgaaaccaaagacagatatagctgctaaactataagataagtaagcctctccagaccatacaagtgcacgtcgagcccatgcgaagggtttggttaagatatgccaaattccaccaagtatacaaatggaacctaaccatacatggcctccgattatatcttccaaatcgtctacactaacaatccatccttcccccccaaagggcgattttagtaaataaccaaatatgatacttgggctaagcgtcaagttggtgatttttcttacatctcctcctcccggagcccaagtatcatatacgcccccaaaataaagagccttgaatactagaagaaaagcacctatacctaacaagattaagtgaatacctaaaattgtggtcattttatttctatctttccatacataaccgaagaatggaaaagattcttcaagcgtctcaggtcctaaaagtgcatgataaataccgccaaagcccaatactgcagaggaaattaaatgaagtactccagatacaaagtatggaaaagtatctataacttccccaccaggacctaccccccaacctagagtagctaggtggggaagtaaaattaatccttgttcatacataggcttttctggtacgaaatgagccacttcaaatagattcattgctccggcccagaatacgattaatccggcatgggctacatgagcccctagtagtttaccggataaattgataagccgggcattcccggcccaccaagcgaaaccggtggtttcttggtcacgaccagctaaagctaaagttccattaaagagcgtttccacggggtagaacctcctcagggaatataaggttttcat

SEQ ID NO: 4233 - DNA, 3943 bp, Sesamum indicum
cggggggtcgttccggttttggatctgggacgaataggttcaagagatgagagaattaaggatacccaccagaaagactaacccaatccataatgatgtaccagaaaatacaacatttttgttacttgaccaaccatcaggagaagcaaatacgacgggtacgctaatcaataagattaatgaagtagcaattaatgcaaaaacagccaattggaaaacaagagtcatgcttttaatcctccaagatatcaacaaataaactataccatttgatccctctatcagccaaaaaattgtaagaaaatacatcatcaagggattttagtttaccacgaatcgattggacttattactacccctttgaccactctattcgtacatggagtcaggggaaattgaattttcttttttattttatttcacaaatgggcatgctggattctatatacggatagatagatcgatcagtagattcacacctgagatctttctacagatagtagtgatatccaccccctatggccatgttctattcggaggaataaaataaaaattgtctttcggagagatggctgagtggttgatagccccggtcttgaaaaccggtatagttttgaacaaagaactatcgagggttcgaatccctctctctcctttttttgctcattgaatagatttctttctattggttttgttttgcccggattggtagcataaagaaaggagaatggctcggctatcccacctagccaagccagaaaaaatagaaaaatcgattagatagaaatgagttgaaaaaaaaagaaaaaggaagactttttaagtataacctgatcccaatatgtatgatggaatcaaagtgattcctacttcaattgaagcattggatctcctgtctcatctcaattaagaggggtcatggaaagagcaggttcaaaatcacgatcaattcctttttcaaatcctgctgcagctgcacgagcccttcccgcgtgccacaaatgacctacgaagaagaagaatcctagaacaaaatgagaggtagctaaccaacttctaggagagacataattgactgcattaatctcggtagctacgccacccacagaatttaaagaacctaaaggagcatgagtcatatattctgcggaacgccgttcttgccaaggttgtatgtcttttttcaacctactcaagtccaagccatttggacctcttaaaggttctaaccaaggagcacgcagatcccaaaaacgcatagtttctcctccaaaaatgacttctccggtcggggaacgcattagatatttacctaaaccggtgggtccttgggcggatcctacattagccccaagacgttggtctctaactagaaaagtaaatgcttgggcctgagaagcttctggtccagtaggtccgtaaaactcgctaggataagcggtattattgaaccagacaaaacaacaagcaatgaaaccaaagacggataaagcccctaaactataagataagtaagcctctccagaccatacaagggcgcgtcgagcccacgcgaagggtttagttaagatatgccagattccaccaagtatacaaatggaacccaaccatacatgtcctccaattatatcttctaaatcgtccacactaacaatccacccttcccctccaaagggggattttagtaaataaccaaatataatacttgggctaagggtcaagttggtaatttttcttacatctccccctcccggagcccaagtatcatatacgcccccaaaataaagagccttgaagactagaagaaaagcacctagacccaacaagattaagtgaatacctaaaattgtggtcattttatttctatctttccatacataaccgaagaatggaaaagattcttccagtgtttcgggtcccagaagtgcatggtaaataccgccaaagcccaatacggcagaggaaattaaatgaagtactccagatacaaagtatggaaaggtatctataacttcccccccaggacctaccccccaacctagagtagctagatggggaagtaaaattaatccttgttcatacataggcttctctggtacgaaatgagccacttcaaataggttcattgctccggcccagaatacgattaatccggcatgagctacatgagcccctagtagtttaccggataaattaataagtcgggcatttccggcccaccaagcaaaaccggtggtttcttggtcacgaccagctacagctaaagttccattaaagagcgtttccacgtggtagaacctcctcagggaatataaggttttcatgaggctgatcttgagccgccatccaagcacgaataccttcgtttaatagaatatttttggtgtagaaagtctcaaattccggatcttccgctgcgcgaatttcctgagaaacgaagtcataggcacgtaggttcagggccaaaccgactactccaagagcactcatccataaaccggttactggtacaaataacataaagaaatgtaaccaacgtttattggaaaaagcaaccccaaagatttgggaccaaaagcggttagcggtgaccattgaataagtttcttcagcttgagttgggttaaaagcacggaatgtatttgcaccatcaccatcttcaaataaagtattttctacggtagcaccatgaatagcgcatagcaaagcagcccccaatacaccggcaactcccatcatatgaaatgggttcagcgtccaattatgaaatccttgaaaaaagaggatgaatcgaaatatagctgctacaccaaaactaggtgcaaagaaccaaccagactgccctagtggataaatcaagaatacagaaacaaaaacagcaattggaccagagaatgcgattgcattataaggtcgcaattgaacagatcgagcaagctcaaattgacgtaacatgaaacctattagtgcgaaagcgccatgcagagcaacaaaagtccacagaccgcctaattgacaccaacgagtaaaatctccttgtgcttcaggaccccatagtaacaataaagaatgcgctaaactattagcaggagtagaaactgcggccgttaagaaattacagccttccaaataggaactggccaatccatgggtataccatgaagttacaaaggttgtacctgtgaaccaaccccctaaagcgaaataggcacaaggaaagagcaataggccggaccagcctacaaaaacgaaacggtccctccgtaaccagtcatccataatatcaaataaatcattttcgtctttggtaaatttaccaagggctatagtcatagtgatcctcctattcaactacttcgaccatttccgagcacctcatagtattttcggggcgtttgaagattcgatcatttctctatgatttctcttgcactgccccttctaacgggtttcgaagataaaaatcctttattggcccataaactgacctagggaaatccatgaaatcaatttgattattctttgttactaagcatatgaaccatgaattgtcttcttatgactcatagatgaatcttttccaagaacttttcaaggaacaagcgaccccctccctcactactaactgatcctcagatttaccccctcttcttcgattaactaatgttattcttagatcttgttcgtgagattgagaaaaagaaagatatttctagattgttctaatttctatgtatactaaactattccaattcgatatacataattttcttaatttcttttttcattctctttgagtgtcttctttgttatatctccttttacttcagataaatcgaaaactccagagtatatcctcccacgggtgaaagcaaaaaagacactttgaatatttttctattgagtcttatctcttagaaagagagagaatttcctatttttt

SEQ ID NO: 4234 - DNA, 1836 bp, Silene vulgaris
aaataaagggaatggctcggccatctcgcctagccgagccataaaattaaaactaaataaaagaaatctataaatgaaaaaaaaaaaaaagactttttatgtatgatcggattccaatctgtatgatgtaataaaacgtattcctactttggaaacattaaagaaaacattaaaaacattgaatttattgtctcaattaagaggggtcatcgaaagaacaggttcaaaatcacgatcaattcctttttcaaatcctgctgcagctgcacgagcccttcccgcatgccacaaatgtcctacaaataggaagaatcctaaaacaaaatgcgaagtggctaaccaacttctaggagagacatagttgaccgcattgatctcggtagctacaccacccacagaatttaaagaacctaaaggagcgtgagtcatatattcagctgaacgtcgttcttgccaaggttgtatgtcttttttcagccgactcaagtccaaaccatttggacccctaaggggttctaaccaaggagcgcgcaaatcccaaaaacgcatagtttctcccccaaaaataacttctccagtcggagaacgcattagatacttacctaaaccagttggtccttgagcggatcccacgttagcgccaagacgttggtctctaactaaaaaagtaaatgcttgggcttgagaagcttctggtccagtgggtccgtaaaactcactaggataagcagtattattgaaccagacaaagcaacaagcaatgaaaccaaagacggataaagcacctaaactataagacaaataagcttctcccgaccaaacaagtgcgcgacgagcccatgcaaaaggtttagttaagatatgccaaattccaccaagtatacaaatggaacctatccatacgtgccccccgattatatcttccagatcgtctacactaacaatccacccttctcccccaaaaggtgattttagtaaataacccaatataatacttggactaagggttatgttggtaatttttcttacatccccccctcccggagcccaagtatcatatacgcccccaaaataaagagctttgaatactagaagaaaagcgcctatacctaacaagattaagtgaatgcccaaaattgtggtcattttatttctatctttccatacataaccaaagaatggaaaagattcttcaagagtttcagggcccagaagtgcatgataaataccaccaaagcccaatactgccgaagaaattaagtgaagtactccagatacaaagtatggaaaggtgtctataacttccccgccggggcctaccccccatcctagagtagctaggtggggaagtaaaattaatccttgttcatacattggcttctctggtacgaaatgagccacttcaaagagattcattgctccggcccagaatacgattaatccggcatgggctacatgagctccaagtagtttaccggataaattgataagtcgagcgttcccggcccaccaagcgaaaccggtggtttcctggtcacgaccggctaaagctaaagttccattaaagagcgtttccacggggtagaacctcctcagggaatataaggttttcatgaggctgatcttgagccgccatccaagcacgaataccttcgtttaagagaatatttttggtgtagaaagtctcaaattcaggatcttcggctgcacggatttcctgggaaacgaagtcataggcacgtaggttcaaagccagaccgactaccccaagagcactcatccataaaccggttactggtacaaataacataaagaaatgtaaccaacgtttattgg

SEQ ID NO: 4235 - DNA, 3836 bp, Tabernaemontana elegans
aaaaagttcggggggtcctttcggttttgaatcggggacgaataggttcaagagatgagagaattaagaataccgactagaaagactaacccaatccataatgaggtaccggaaaatataacatttttgttactcgaccaaccatcaggagaagcaaatacaacaggcacactaatcaataagattgatgaagtagcaattaatgcaaaaacagccaattggaaagcaagagtcatgcttttaatcctccaagctaccaacaaatgaatttataccatttgatccctctattagccaaaaattgtaataaaatacatcagggggattttactttacaatgaatccattgattctagatgacttattactaacccttttaccatacatggggtcgagggaaatggaattttttatttcacaaatgggcgtgctcatatatacggatagatagatccatcggtagattcccacccgaggtctttttgtctttctccagatagtgggggtatccacccctatggtcatgttctactcggaggaataaaatcaaaattgtctttcggagagatggctgagtggttgatagccccggtcttgaaaaccggtatagttttgaacaaagaactatcgagggttcgaatccctctctctcctttttgtccattgaataggtttgtttctttattagtttttcccggactggtatcataaagaagggggaatggcccggcgatcccaccgagccaagccgaaaaatagattatgattatataaatgagttgaaaaaaaaagaaaaaagattttaagtatgacccgatcccaaaagaatgaaagggattattcctatttcaagcattggatctcctgtcttatctcaattaagaggggtcatggaaagaacaggttcaaaatcacgatcaattcctttttcaaatcctgctgcagctgcacgagcccttcctgcgtgccacaaatgacctacgaagaagaagaatcctagaacaaaatgagaggtagctaaccaacttctaggagagacataattgactgcgttgatctcggtagctacgccacccacggaatttaaagaacctaaaggagcatgagtcatatattctgcggaacgccgctcttgccaaggttgtatgtcttttttcaacctactcaagtccaacccgtttggaccccttagaggttctaaccagggagcacgcagatcccaaaaacgcatcgtttcccccccaaaaatgacttctccggttggggaacgcattagatatttacctaaaccagtaggcccttgagcggatcccacgttagccccaagacgttggtctctaactagaaaagtaaatgcttgagcttgagaagcttctggcccagtgggtccgtaaaactcactaggataagccgtattattgaaccagacaaaacaacacgcagtgaaaccaaagatggataaagcccctaaactataagataagtaagcctccccggaccatacaagtgcacgtcgagcccacgcgaagggcttagttaagatatgccagattccaccaagtatacaaatggaacctaaccatacatgtcctccgattatatcttctaaatcgtccacactaacaatccatccttcccctccaaagggcgattttagtaaataaccaaatatgatactcgggctaagagtcaagttggtaatttttcttacatctccccctcccggagcccaagtatcatacacgcccccaaaatatagagccttgaatactagaagaaaggcacctagacctaacaagattaagtgaatacctaaaattgtggtcattttatttctatctttccatacataaccgaagaatggaaaagattcttcaagcgtctcaggaccaagaagtgcatgataaataccgccaaagcccaaaaccgcggaggaaattaaatgaagtactccagatacaaagtacggaaaggtgtctataacttcccccccaggacctaccccccaacctagagtagctaggtggggaagtaaaattaacccttgttcatacataggtttctctggtacgaaatgagccacttcaaataggttcattgctccggcccagaatacgattaatccagcgtgggctacatgagctcccagtagtttaccggataaattgataagtcgggcatttccggcccaccaagcgaaaccggtggtttcttggtcacgaccggctaaagctaaagttccattaaagagcgtttccacgtggtagaacctcctcagggaatataaggttttcatgaggctgatcttgagctgccatccaagcacgaataccttcgtttaagagaatatttttggtgtagaaagtctcaaattccggatcttccgctgctcgaatttcctgagaaacgaagtcataggcacgtaggttcagggccagaccaactactccaagagcactcatccataaaccggttactggtacaaataacataaagaaatgtaaccaacgtttattggaaaagcaaccccaaagatttgggaccaaaagcggttagcggtgaccattgaataagtttcttcagcctgagttgggttaaaagcacggaatgtatttgcaccatcaccatcttcaaataaagtattttcgacggtagcaccatgaatagcgcacagcaaagcagcgcccaatacaccggcaacccccatcatatgaaaggggtttaacgtccaattatgaaacccttgaaaaaagaggatgaatcgaaatatagctgctacgccaaaactaggtgcaaagaaccaaccagattgacccagtggataaatcaggaatacagaaacaaaaacagcaattggaccagagaatgcgattgcattataaggtcgcaattgaacagatcgagcaagctcgaattgacgtaacatgaaacctattaatccgaaagcgccatgaagagcaacaaaagtccacaggccgcctaattgacaccaacgagtaaaatctccttgtgcttcaggaccccatagtaacaacaaagagtgtgctaaactattagcaggagtagaaactgcggcagttaagaaattgcagccttccaaataggaactggccaatccatgggtataccatgaagttacaaaggttgtacctgtgaaccaaccccctaaagcgaaataggcacaaggaaagagcaataggccggaccagcctacaaaaacgaaacggtccctacgtaaccagtcatccataatatcaaataaatcattttcgtctttggtaaatttaccaagggctatagtcatagtgatcctcctattcaactacttcgaccatttccgagcacctcatagcattttcggggcgttcgaagattcgatcatttctgtatgatttctcttgcactgccccaccccaatgggtttcgaagataaaaatcccttattggtccataaattcgcctagataaatccacgaactcaatttgattattccttcttactaagtatctgaaccatgaattgtcttcttagggctcatcaatcaatcaaatagatgaatatcttttgaaagacctgtttaaggaacaatcaatcccctctctcactcccaaccgattaaccccccttgttcccttaattaatgttattattagatctttttcgggagattgagaaaaataaagatatttatagagtcttctaatttctatgtatactaaattaaagtattttactactttctttttattttctttagtatcttctttattagttctattccccctttccttcagataaatcgaaaactcgtgtgaaaaagaaaaagagagaattt

SEQ ID NO: 4236 - DNA, 2401 bp, Vitis vinifera
atgggagttgccggtgtattgggcgctgctctgctatgcgctattcatggtgctaccgtagaaaatactttatttgaagatggtgatggtgcaaatacattccgggcttttaatccaactcaagctgaagaaacttattcaatggtcaccgctaaccgcttttggtcccaaatctttggggttgctttttccaataaacgttggttacatttctttatgttatttgtaccagtaaccggtttatggatgagtgctcttggagtagtcggtctggctctgaacttacgtgcctatgacttcgtttcccaggaaatccgtgcagcggaagatcctgaatttgagactttctacaccaaaaatattctcttaaacgaaggtattcgtgcttggatggcggctcaagatcagcctcatgaaaaccttatattccctgaggaggttctaccccgtggaaacgctctttaatggaactttagctttagctggtcgtgaccaagaaaccaccggtttcgcttggtgggccgggaatgcccgacttatcaatttatccggtaaactacttggggctcatgtagcccatgccggattaatcgtattctgggccggagcaatgaacctatttgaagtggctcatttcgtaccagagaagcccatgtatgaacaaggattaattttacttccccacctagctactctaggttggggggtaggtcctggtggggaagttatagacacctttccatactttgtatctggagtacttcacttaatttcctccgcagtattgggctttggcggtatttatcatgcacttctgggacctgagactcttgaagaatcttttccatttttcggttatgtatggaaagatagaaataaaatgaccacaattttgggtattcacttaatcttgttaggtataggtgcttttcttctagtattcaaggctctttattttggcggcgtatatgatacctgggctcccggagggggagatgtaagaaaaattaccaacttgacccttagcccaagtgttatatttggttatttactaaaatcgccctttggaggagaaggatggattgttagtgtggacgatttggaagatataattggaggacatgtatggttaggttccatttgtatatttggtggaatctggcatatcttaaccaaaccctttgcgtgggctcgccgtgcacttgtatggtctggagaggcttacttgtcttatagtttaggtgctttagctgtctttggtttcattgcttgttgctttgtctggttcaataataccgcttatcctagtgagttttacgggccaactggacccgaagcgtctcaagctcaagcatttacttttctagttagagaccagcgtcttggggctaacgtgggatccgctcaaggacctactggtttaggtaaatatctaatgcgttccccgactggagaagtcatttttggaggagaaactatgcgtttttgggatctgcgtgctccctggttagaacctctaaggggtcccaatggtttggacttgagtaggctgaaaaaagacatacaaccttggcaagaacggcgttccgcggaatatatgactcacgctcctttaggttctttaaattccgtgggtggcgtagctaccgagatcaatgcagtcaattatgtctctcctagaagttggttagctacttctcattttgttctaggattcttcctattcgtaggtcatttgtggcacgcgggaagggctcgtgcagctgcagcaggatttgaaaaaggaattgatcgtgattttgaacctgttctttctatgacccctcttaactgagacgggagatccaatgcttgaagtaggaatctatttggttccaccatacatattggtgtcaggtcatacttaaaaagcattcctttttcctttctttttcaactccatttattttttatttatatttaatctattttttttttctggctcggctatgctatcccacctagccgagccattcccctttatgatatatgataccgggccaggcaaaaccaataaagaaaaaaatctcttcaccgagaaaaaggagagagagggattcgaaccctcgatagttctttgttcagaactataccggttttcaagaccggagctatcaaccactcggccatctctccgaaagacaatttatattttatttttattctcccaaatagaacatggtcatatccatatgagttgataccattactatttgtagaaatatatcaaggtgtgaatctataggtcgatctatctgatctatctgtatatatagatagatagatgcatgatccaacatgcctatttgtgaagtaaaaaaaattccccccgaccccgtgtccgaataaagtggtaaaaaag

SEQ ID NO: 4237 - DNA, 3916 bp, Cannabis sativa
gggtttattctaataagagacgttttaactatttttattccagacaatgtgatgtaaaatgggtgtgagaaagaggctttcagttatagtttactattattttatttaatattatttattagattgaaattgaatattgtagtgaatttaataataggaaattttgaaatttaaaagaaaatgaaagagtaaactataaagtaataaaatatataatactttaatacacatctaaattcgaaaaatacataaaaattcaaaaatttcccaacgggagtcgggaataagaaataagattaggtgatggaacaagaggaatatgtctagggatcagggatctatcggtagcgagaagggggatcacacttcttttttgagcagttctttcaaaaaaaatcagatagagaattgatgaataataagacaattcatggttcaaatgcttattaagaataggaaaggataaccgaattgagttaacttggtcgggttacagaccaataattttttttatattagaaacccattcgaaaaaaaatatcatacaaaaataatagaagcctcaaccactctgaaaacgaaatcgagtgttcgaaactgaaatggttgaagtagttaaataggaggatcactatgactatagctcttggtaaatttaccaaagacgaaaatgatttatttgatattatggatgactggttacggagggaccgtttcgtttttgtaggttggtccggtctattgctctttccttgtgcctatttctctttagggggttggttcacgggtacaacctttgtaacttcatggtatacccatggattagcaagttcctatttggaaggatgcaacttcttaactgccgcagtttctactcctgctaatagtttagcacactctttgttgttactttggggtcctgaagcacagggagattttactcgttggtgtcaattaggcggtctgtggacttttgttgctctccacggcgctttcgcactaataggtttcatgttacgtcaatttgaacttgctcgatctgttcaattgcgaccttataatgcaatcgcattctccggtccaattgctgtttttgtttctgtattcctgatttatccgctaggtcagtctggttggttctttgcgcctagttttggtgtagcagctatatttcgattcatcctctttttccaagggtttcataattggacattgaacccatttcatatgatgggagttgcaggggtcttgggcgctgctttgctatgtgctattcatggtgctaccgtagaaaacactttatttgaagatggtgatggtgcaaatacattccgtgcttttaacccaactcaagctgaagaaacttattcaatggtcaccgctaaccgcttttggtcccaaatatttggggttgctttttccaataaacgttggttacatttctttatgttatttgtaccagtaaccggtttatggatgagtgctcttggagtagtcggtctggctttgaatctacgtgcgtatgactttgtttctcaggaaatccgtgcagcggaagatcctgaatttgagactttctacaccaaaaatattctcttaaacgagggtattcgtgcttggatggcggctcaagatcagcctcatgaaaaccttatattccctgaggaggttctaccccgtggaaacgctctttaatggaactttagctttagctggtcgtgaccaagaaaccaccggtttcgcttggtgggccgggaatgcccgacttatcaatttatccggtaaactgctgggggctcatgtagctcatgccggattaatcgtattctgggccggagcaatgaacctatttgaagtggctcatttcgtcccagagaagcctatgtatgaacagggcttaattttacttccccacctagctactctaggttggggggtagggcccggcggggaagttctagatacctttccatactttgtgtctggagtacttcacttaatttcctctgcagtattgggctttggcggtatttatcatgcacttctgggacctgaaactcttgaagaatcttttccattcttcggttatgtatggaaagatagaaataaaatgactacaattttgggtattcacttaattttgttaggtataggtgcttttcttctagtctttaaggctctttattttgggggtgtatatgatacctgggctccggggggaggagatgtaagaaaaattaccaatttgacccttagtccaagtattgtatttggttatttactcaaatctccctttggtggagaggggtggattgttagtgtggacgatttggaagatataattggaggacatgtatggttaggttccatttgtatacttggtggaatctggcatatcttaaccaaaccctttgcatgggctcgtcgtgcacttgtatggtctggagaggcttacttgtcttatagtttaggtgctttatcagtttttggttttattgcttgttgctttgtctggttcaataataccgcttatcctagtgagttttacgggcccactggtccagaagcttctcaagctcaagcatttacttttctagttagagaccaacgtcttggggctaacgtgggatccgctcaaggacctaccggtttaggtaaatatctaatgcgttcaccgacaggggaagttatttttggaggggaaactatgcgtttttgggatctacgagctccctggttagaacctctaaggggtcccaacggtttggacttgagtaggctgaaaaaagacatacagccttggcaagaacggcgttctgcggaatatatgactcatgctcctttaggttctttaaattccgtgggtggcgtagctaccgagatcaatgcagtcaattatgtctctccgagaagttggttagcgacttctcattttgttctagggttcttcctattcgtaggtcatttatggcacgcgggaagggctcgtgcagctgcagcgggatttgaaaaaggaattgatcgtgatttagaacctgttcttttcatgactcctcttaattaagacaggagacccaatgcttgaagtaggaatcaatttgattccaccctacctattaagtaagttagtaagttggggcgagtcggtaatataatattttaaaagtcttccttttttctttctttttatatctaatctatttttttttctggctcggctaagtggaatagccgagccattccacttataatactgaaatcaataaaataacgaaactaatctattcaccaagaaaaaggagagagagggattcgaaccctcgatatcctttgttttggactataccggttttcaagaccggagctatcaaccactcggccatctctccgaaagataatttctattttattttttttcattgaataagacatagcgatataagttgatacctttagtatattatagaaatatatcgagtatgaatctatagatctagctatctatatatatagatgcatgatctagcgttcccttttgtaaagtaaaaaaagtgtcctcgatgcattttttttttgacaattttttggctgataaagagatcaaatggtatataattcttttattggtaaattggaggattagaaacatgactattgctttccaattggctgtttttgcattaattgctacttcatcaatcttactgattagtgtacccgttgtatttgcttctcctgatggttggtcgggtaataaaaatgttgtattttccggtacatcattatggattggattagtctttctggtaggtatccttaattctcttatctcttgaacctggtcgttctaggtccaaaaacgacccctccccgaattctttcaggttataagacacgttcaaattcaatacaatac

SEQ ID NO: 4238 - DNA, 4556 bp, Vitis vinifera
gtaataaaaaaaaaaataaccaactgtatagtataattataagaagttatcattataatgagttatagtataataattatagttataaagttgaagagttgtttaaaatttataatgaataatgataagtcgtctcttgaatcgccaaatattcttattttccattattccaatcaaatccattatagattagaaatcaacaaaataaaaagtaagtggacctgacccattgaatcatgactatatccactattctgatattcaaattcgatagagatgaaattggaacagttgatcttttttttttcatttctttgaactccgcaagaatttgtcgatatttccaattaaatcttcttgttcctaggtgttccataggaataaattgctattcctttcctccacagagaaaggagtattccaagtcacagcataagagccattttcaacatctttctttgattcccgaacaagatcaatttatatctatataagatttatatatatctatgagatcgtgatttcgtgtatcaaatatttccctatatatcgatacatccgatatttttgttccgataaaagtaaatagaaaaatattcaaagtgtctttcttacttcgacctgtgaaaatatatactctggagttttagattcatctataggaaaaggaaatataacaaagccgacaataaaataaaatgaaagaaagagtaaagtataaagtaagaaaatatatgatactgtattagtttaatatacatagaaattagaagaatccataaagatatttatttttctcaatctcacgaacaagatacgagaataagattagttgatggaacgaggagggtaagtctggagatcaactggtagcaagagaagggatcacttgttctttgaacagttcagttctttcaaaaaatgaatctatctgattgatgagtcataagacaattcacggttcaggtgcttattaagaataggaataatccaattgagttcatggatttacctaggtcaatttatggatcaataaaggatttttttcttcgaaacccattagcattagaaggggcagtgtacgagaaatcaaatcatacataaatgatcgaatcctcggatgccctgaaaacgctatgaggtgttcggaaatggttgaagtagttgaataggaggatcactatgactatagcccttggtaaattcaccaaagacgaaagcgatttatttgatattatggatgactggttacggagggaccgtttcgtttttgtaggttggtccggtctattgctctttccttgtgcctatttcgctttggggggttggttcacaggtacaacctttgtaacttcatggtatacccatggattggctagttcctatttggaaggttgcaatttcttaaccgccgcagtttctacccctgctaatagtttagcacattctttattgttactatggggtcctgaagcacaaggagattttactcgttggtgtcaattaggtggtctgtggacttttgttgctcttcatggcgctttcggactaataggtttcatgttacgtcaattcgaacttgctcgatctgttcaattgcgaccttataatgcaatcgcattctctgctccaatcgctgtttttgtttctgtattcctaatttatccactaggtcagtctggttggttctttgcgcctagttttggtgtagcagctatatttcgattcatcctctttttccaagggtttcataattggacgttgaacccatttcatatgatgggagttgccggtgtattgggcgctgctctgctatgcgctattcatggtgctaccgtagaaaatactttatttgaagatggtgatggtgcaaatacattccgggcttttaatccaactcaagctgaagaaacttattcaatggtcaccgctaaccgcttttggtcccaaatctttggggttgctttttccaataaacgttggttacatttctttatgttatttgtaccagtaaccggtttatggatgagtgctcttggagtagtcggtctggctctgaacttacgtgcctatgacttcgtttcccaggaaatccgtgcagcggaagatcctgaatttgagactttctacaccaaaaatattctcttaaacgaaggtattcgtgcttggatggcggctcaagatcagcctcatgaaaaccttatattccctgaggaggttctaccccgtggaaacgctctttaatggaactttagctttagctggtcgtgaccaagaaaccaccggtttcgcttggtgggccgggaatgcccgacttatcaatttatccggtaaactacttggggctcatgtagcccatgccggattaatcgtattctgggccggagcaatgaacctatttgaagtggctcatttcgtaccagagaagcccatgtatgaacaaggattaattttacttccccacctagctactctaggttggggggtaggtcctggtggggaagttatagacacctttccatactttgtatctggagtacttcacttaatttcctccgcagtattgggctttggcggtatttatcatgcacttctgggacctgagactcttgaagaatcttttccatttttcggttatgtatggaaagatagaaataaaatgaccacaattttgggtattcacttaatcttgttaggtataggtgcttttcttctagtattcaaggctctttattttggcggcgtatatgatacctgggctcccggagggggagatgtaagaaaaattaccaacttgacccttagcccaagtgttatatttggttatttactaaaatcgccctttggaggagaaggatggattgttagtgtggacgatttggaagatataattggaggacatgtatggttaggttccatttgtatatttggtggaatctggcatatcttaaccaaaccctttgcgtgggctcgccgtgcacttgtatggtctggagaggcttacttgtcttatagtttaggtgctttagctgtctttggtttcattgcttgttgctttgtctggttcaataataccgcttatcctagtgagttttacgggccaactggacccgaagcgtctcaagctcaagcatttacttttctagttagagaccagcgtcttggggctaacgtgggatccgctcaaggacctactggtttaggtaaatatctaatgcgttccccgactggagaagtcatttttggaggagaaactatgcgtttttgggatctgcgtgctccctggttagaacctctaaggggtcccaatggtttggacttgagtaggctgaaaaaagacatacaaccttggcaagaacggcgttccgcggaatatatgactcacgctcctttaggttctttaaattccgtgggtggcgtagctaccgagatcaatgcagtcaattatgtctctcctagaagttggttagctacttctcattttgttctaggattcttcctattcgtaggtcatttgtggcacgcgggaagggctcgtgcagctgcagcaggatttgaaaaaggaattgatcgtgattttgaacctgttctttctatgacccctcttaactgagacgggagatccaatgcttgaagtaggaatctatttggttccaccatacatattggtgtcaggtcatacttaaaaagcattcctttttcctttctttttcaactccatttattttttatttatatttaatctattttttttttctggctcggctatgctatcccacctagccgagccattcccctttatgatatatgataccgggccaggcaaaaccaataaagaaaaaaatctcttcaccgagaaaaaggagagagagggattcgaaccctcgatagttctttgttcagaactataccggttttcaagaccggagctatcaaccactcggccatctctccgaaagacaatttatattttatttttattctcccaaatagaacatggtcatatccatatgagttgataccattactatttgtagaaatatatcaaggtgtgaatctataggtcgatctatctgatctatctgtatatatagatagatagatgcatgatccaacatgcctatttgtgaagtaaaaaaaattccccccgaccccgtgtccgaataaagtggtaaaaaagtggtaataagtcatatagaatcagaatcaatgattcatggtaaaatccctccatgatgcattttattacaattttttggctgatcgagggatcaaatggtatagttcttttgttggtagcttggaggattagaagcatgactattgctttccaattggctgtttttgcattaattgctacttcatcaatcttactgattagtgtacccgttgtatttgcttctcctgatggttggtcaagtaacaaaaatattgttttttccggtacatcattatggattggattagtctttctggtaggtatacttaattctctcatctcttgaacctattcgtcccagatccaaaaatgaaatgacccctccctctaatttttt

SEQ ID NO: 4239 - DNA, 2133 bp, Vitis vinifera
agtaaccggtttatggatgagtgctcttggagtagtcggtctggctctgaacttacgtgcctatgacttcgtttcccaggaaatccgtgcagcggaagatcctgaatttgagactttctacaccaaaaatattctcttaaacgaaggtattcgtgcttggatggcggctcaagatcagcctcatgaaaaccttatattccctgaggaggttctaccccgtggaaacgctctttaatggaactttagctttagctggtcgtgaccaagaaaccaccggtttcgcttggtgggccgggaatgcccgacttatcaatttatccggtaaactacttggggctcatgtagcccatgccggattaatcgtattctgggccggagcaatgaacctatttgaagtggctcatttcgtaccagagaagcccatgtatgaacaaggattaattttacttccccacctagctactctaggttggggggtaggtcctggtggggaagttatagacacctttccatactttgtatctggagtacttcacttaatttcctccgcagtattgggctttggcggtatttatcatgcacttctgggacctgagactcttgaagaatcttttccatttttcggttatgtatggaaagatagaaataaaatgaccacaattttgggtattcacttaatcttgttaggtataggtgcttttcttctagtattcaaggctctttattttggcggcgtatatgatacctgggctcccggagggggagatgtaagaaaaattaccaacttgacccttagcccaagtgttatatttggttatttactaaaatcgccctttggaggagaaggatggattgttagtgtggacgatttggaagatataattggaggacatgtatggttaggttccatttgtatatttggtggaatctggcatatcttaaccaaaccctttgcgtgggctcgccgtgcacttgtatggtctggagaggcttacttgtcttatagtttaggtgctttagctgtctttggtttcattgcttgttgctttgtctggttcaataataccgcttatcctagtgagttttacgggccaactggacccgaagcgtctcaagctcaagcatttacttttctagttagagaccagcgtcttggggctaacgtgggatccgctcaaggacctactggtttaggtaaatatctaatgcgttccccgactggagaagtcatttttggaggagaaactatgcgtttttgggatctgcgtgctccctggttagaacctctaaggggtcccaatggtttggacttgagtaggctgaaaaaagacatacaaccttggcaagaacggcgttccgcggaatatatgactcacgctcctttaggttctttaaattccgtgggtggcgtagctaccgagatcaatgcagtcaattatgtctctcctagaagttggttagctacttctcattttgttctaggattcttcctattcgtaggtcatttgtggcacgcgggaagggctcgtgcagctgcagcaggatttgaaaaaggaattgatcgtgattttgaacctgttctttctatgacccctcttaactgagacgggagatccaatgcttgaagtaggaatctatttggttccaccatacatattggtgtcaggtcatacttaaaaagcattcctttttcctttctttttcaactccatttattttttatttatatttaatctatttttttttttctggctcggctatgctatcccacctagccgagccattcccctttatgatatatgataccgggccaggcaaaaccaataaagaaaaaaatctcttcaccgagaaaaaggagagagagggattcgaaccctcgatagttctttgttcagaactataccggttttcaagaccggagctatcaaccactcggccatctctccgaaagacaatttatattttatttttattctcccaaatagaacatggtcatatccatatgagttgataccattactatttgtagaaatatatcaaggtgtgaatctataggtcgatctatctgatctatctgtatatatagatagatagatgcatgatccaacatgcctatttgtgaagtaaaaaaaa

SEQ ID NO: 4240 - DNA, 3633 bp, Lactuca sativa
ttggcctagtgaatatcgcctattctggtggacgccccgaaaatactatgaggtgttcggaaatggtcgaagtagttgaataggaggattacgatgactatagcccttggtaaagttaccaaagacgaaaatgatttgtttgatattatggatgactggttacggagggaccgtttcgtttttgtaggctggtccggcctattgctctttccttgtgcctatttcgctgtagggggttggttcacaggtacaacctttgtaacttcatggtatacccatggattggccagttcctatttggaaggctgcaatttcttaactgccgcagtttctactcctgcgaatagtttagcacattctttgttattactatggggtcctgaagcacaaggagattttactcgttggtgtcaattaggcggtctgtggacttttgttgctctccacggcgctttcggactaataggtttcatgttgcgtcaattcgaacttgcgcgatctgttcaattgcgaccttataatgcaatcgcattctctggtccaattgccgtttttgtttctgtattcctgatttatccactaggtcagtctggttggttctttgcgcctagttttggtgtagcagctatatttcgatttatcctcttttttcaaggatttcataactggacattgaacccatttcatatgatgggagttgcaggtgtattgggcgctgctttgctatgcgctattcatggtgctaccgtagaaaatactttatttgaagatggtgatggggcaaatacattccgtgcttttaacccaactcaagctgaagaaacttattcaatggtcactgctaatcgtttttggtcccaaatctttggggttgctttttccaataaacgttggttacatttctttatgttatttgtaccagtaactggtttatggatgagtgctcttggagtagtcggtctggccttgaacctacgtgcctatgacttcgtttctcaggaaattcgcgcggcggaagatcctgaatttgaaactttctacaccaaaaatattctcttaaacgaaggtattcgtgcttggatggcggctcaagatcagcctcatgaaaaccttatattccctgaggaggttctaccccgtggaaacgctctttaatggaactttagctttagctggtcgtgaccaagaaaccactggtttcgcttggtgggccgggaatgcccggcttatcaatttatctggtaaactactaggggctcatgtagcccatgccggattaatcgtattttgggccggagcaatgaatctatttgaagtggctcatttcgtaccagagaagcctatgtatgaacaaggattaattttacttccccacctagctactctaggttggggggtgggtcctggtggggaagttatagatacttttccatactttgtatccggagtacttcatttaatttcctctgcagtattgggctttggcggtatttatcatgcacttttagggcctgagacgcttgaagaatcttttccattcttcggttatgtatggaaagatagaaataaaatgaccacaattttaggtattcacttaatcttgttaggtataggtgcttttcttctagtattcaaggctctttattttgggggcgtatatgatacttgggctccgggaggaggagatgtaagaaaaataaccaacttgacgcttagcccaagtatcatatttggttatttactaaaatcgccctttgggggagaaggatggattgttagtgtagacgatttggaagatataatcggaggccatgtatggttaggttccatttgtatacttggtggaatttggcatatcttaaccaaacccttcgcatgggctcgacgagcacttgtatggtctggagaggcttacttatcttatagtttagcggctatatctgtctttggtttcattgcttgttgttttgtctggttcaataataccgcttatcctagtgagttttacggacccactggaccagaagcttctcaagctcaagcatttacttttctagttagagaccaacgtcttggagctaacgttggatctgctcaaggtcctaccggtttaggtaaatatttaatgcgttccccgactggagaagtcatttttggaggagaaactatgcgtttttgggatctgcgtgctccttggttagaacccctaaggggtccaaatgggttggacttaagtcggctgaaaaaagacatacaaccttggcaagaacgtcgttccgcagaatatatgacccatgctcctttaggttctttaaattccgtgggtggcgtagctaccgagatcaatgcagtcaattatgtctctcctagaagttggttagctacttctcattttgttctaggattcttcttcttcgtagggcatttgtggcacgcaggaagagctcgtgcagctgcagcaggatttgaaaaaggaattgatcgtgattttgaacctgttctttccatgacccctcttaattgagacaggagatcaaagacttgaactaggagtcacttcggttccttcatacatatagggatcatgtcataaaaaaatattcttttttttttttcaactcatttatatttaatttaatccatttttctggcttggctaggcgggatagccgagccactcccctttctttatgataatgaaaccatccggtcaaaaccaatccaataaagaaacaaatttatttaacaagcaaaaaaggagagagagggattcgaaccctcgatagtaaactataccggttttcaagaccggggctttcaaccactcagccatctctccgaaagacaattttattttattcctcctaatagaacatggccatatgagtggataccgccactatcaaagatctcgggtgtgatggtcaatctatctatcccgatatatggatagatatatgatccagcatgcccatttgtaaaataaaaaaagtatgatgtattttagtacaatttttggctgatatagggatcaaatggtatagttcatttgttggtagcttggaggattaaaagcatgactcttgctttccaattggctgtttttgcattaattgctacttcatcaatcttattgattagcgtacccgttgtatttgcttctcctgatggttggtcaagtaacaaaaatgttgtattttcaggtacatcattatggattggattagtctttctggtgggtatccttaattctctcatctcttgaacctattgttctagatccaaaaccaaaatgaccccctgaattattcttggttgtgagacgcattcaatataagtccccaaaatccaaataaatataagaaaaaaatgaaaaattagaagggggtcaaacttcttgttcttgaatgaaaaaaaaggaatataaaattcaaattaataaaaaatttgggctcaatctgaagagagtctccggcccagcactgcacaaatatgctccagacatatatatcatatatgtgtggacatattgtgtattatggacatattgtgtatcaagaacgaaacaaaaagcggatatagtcgaatggtaaaatttctctttgccaaggagaagacgcgggttcgattccc

SEQ ID NO: 4241 - DNA, 1623 bp, Medicago truncatula
atgaaaaccttatattccctgaggaggttctaccacgtggaaacgctctttaatggaactttagctttaactggccgtgaccaagaaactaccggttttgcttggtgggccgggaatgcccgacttatcaatttatccggtaaactactgggggcccatgtagcccatgccggattaatagtattctgggccggagcaatgaacctatttgaagtcgctcatttcgtacccgagaagcccatgtatgaacaaggattaattttacttccccatctagctactctaggttggggggtaggtcctggaggggaagttatagacacctttccatactttgtctctggagtacttcacttaatttcttctgcagtattgggctttggcggtatttatcatgcacttctgggacctgagactcttgaagaatcttttccattctttggttatgtatggaaagatagaaataaaatgactactattttaggtattcacttaattttgttagggataggggcttttcttctagtatttaaggcttcttattttggaggtatatatgatacctgggctccaggagggggggatgtaagaaaaattaccaacttaacccttagtccaagtattatattgggttatttactaaaatctccttttgggggagaggggtggattgttagtgtggacgatttggaagacataattggagggcatgtatggttgggttccatttgtatacttggtggaatctggcatatcttaactaaaccctttgcatgggctcgtcgtgcactagtatggtctggagaagcttacttgtcttatagtttagcagctttatccctttttggttttatagcttgttgctttgtctggtttaataatactgcttatcctagtgagttttatggtcctactggaccggaagcttctcaagctcaagcatttacttttctagttagagaccaacgtcttggagctaatgtaggatccgctcaaggaccgaccggtttaggtaaatatttaatgcgttctccgaccggagaggttatttttgggggagaaactatgcgtttttgggatctgcgtgctccctggttagaacctctaagaggtcctaatggtttggacttgagtagactgaaaaaagacatacagccttggcaagaacgtcgttctgcggaatatatgactcatgctcctttaggttctttaaattccgtgggtggcgtagctacagagattaatgcagtcaattatgtctctcctagaagttggttagctacttctcattttgttctaggattcttcctattcgtaggtcatttatggcacgcgggaagagctcgtgcagctgccgcaggatttgaaaaaggaattgatcgagattcggagcctgttcttttcatgactcctcttaattgagacatgaaatacaatgcttgacgtaagaatcactttgattttagtatacatattgggttgagtcgagcagatgatattgaaaaaatatatttttttttcaattcatttatatgtaatatctaatcttttttcgggctcggctaagtggtgatatagtcgagcccgaaaaaaccgagctaacctaaatcaataaaattcaaa

SEQ ID NO: 4242 - DNA, 3550 bp, Medicago truncatula
gatcactatgactatagctcttggtaaatttaccaaagatgaaaatgatttatttgatattatggatgactggttacgaagggaccgttttgtttttgtgggttggtccggtctattgctctttccttgcgcctattttgccgtggggggttggttcacaggtaccacctttgtaacttcatggtatactcatggattggcaagttcctatttggaaggttgtaacttcttaactgcggcagtctctactcctgctaatagtttagcacactctttgttgttactatggggtcctgaagcacagggagattttacccgttggtgtcaattgggtggtctgtggacttttgttgctctccacggtgctttcggattaataggttttatgttacgtcaatttgaacttgctcgatctgttcaattgcgcccttataatgcaatcgcattctccggtccaattgctgtttttgtttctgtattcctgatttatccactgggtcagtctggttggttctttgcgcctagttttggtgtagcagctatatttcgattcattctatttttccaagggtttcataattggacattaaacccatttcatatgatgggagttgctggtgtattgggcgctgccctactatgcgctattcatggtgctaccgtagaaaatacgttatttgaagatggtgatggcgcaaatacattccgtgcttttaacccaactcaagcggaagaaacttattcaatggtcaccgctaaccgcttttggtcccaaatctttggggttgctttttccaataaacgttggttacatttctttatgttatttgtaccagtaactggtttatggatgagtgctcttggagtagtcggtctggccctgaacctacgtgcctatgacttcgtttctcaagaaatccgcgcagcggaagatcctgaatttgagactttctacaccaaaaatattctcttaaatgaaggtattcgtgcgtggatggcggctcaagatcagcctcatgaaaaccttatattccctgaggaggttctaccacgtggaaacgctctttaatggaactttagctttaacgggccgtgaccaagaaactaccggttttgcttggtgggccgggaatgcccgacttatcaatttatccggtaaactactgggggcccatgtagcccatgccggattaatagtattctgggccggagcaatgaacctatttgaagtcgctcatttcgtacccgagaagcccatgtatgaacaaggattaattttacttccccatctagctactctaggttggggggtaggtcctggaggggaagttatagacacctttccatactttgtctctggagtacttcacttaatttcttctgcagtattgggctttggcggtatttatcatgcacttctgggacctgagactcttgaagaatcttttcctttctttggttatgtatggaaagatagaaataaaatgactactattttaggtattcacttaattttgttagggataggggcttttcttctagtatttaaggcttcttattttggaggtatatatgatacctgggctccaggagggggggatgtaagaaaaattaccaacttaacccttagtccaagtattatattgggttatttactaaaatctccttttgggggagaggggtggattgttagtgtggacgatttggaagacataattggagggcatgtatggttgggttccatttgtatacttggtggaatctggcatatcttaactaaaccctttgcatgggctcgtcgtgcactagtatggtctggagaagcttacttgtcttatagtttagcagctttatccctttttggttttatagcttgttgctttgtctggtttaataatactgcttatcctagtgagttttatggtcctactggaccggaagcttctcaagctcaagcatttacttttctagttagagaccaacgtcttggagctaatgtaggatccgctcaaggaccgaccggtttaggtaaatatttaatgcgttctccgaccggagaggttatttttgggggagaaactatgcgtttttgggatctgcgtgctccctggttagaacctctaagaggtcctaatggtttggacttgagtagactgaaaaaagacatacagccttggcaagaacgtcgttctgcggaatatatgactcatgctcctttaggttctttaaattccgtgggtggcgtagctacagagattaatgcagtcaattatgtctctcctagaagttggttagctacttctcattttgttctaggattcttcctattcgtaggtcatttatggcacgcgggaagagctcgtgcagctgccgcaggatttgaaaaaggaattgatcgagattcggagcctgttcttttcatgactcctcttaattgagacatgaaatacaatgcttgacgtaagaatcactttgattttagtatacatattgggttgagtcgagcagatgatattgaaaaaatatatttttttttcaattcatttatatgtaatatctaatcttttttcgggctcggctaagtggtgatatagtcgagcccgaaaaaaccgagctaacctaaatcaataaaattcaaaaatacattcgctaagaaaaaggagagagggggattcgaaccctcgatagttctttcgaactataccggttttcaagaccggagctatcaaccactcagccatctctccaaaagctaatttctattttatctttattccactcaagagaacatgaccatacgaattaatacccctttttatctatgtatgataaagtgactttattggtctagttctctctctccgtatatatatatgcatgatccagcatgctcttttgtgaagtaaaaaaaactacccctcgatccacgcctcaaaaggggtgtcatctaaaatcaatggattaatgataaaaccctccataatgcgttttttctttttttaaggggtcaaaagggattgggggatcaaatggtatagttcttttgttggtaaattggaggattagaaacatgactattgcttttcaattagctgtttttgcattaattgttacttcatccattttattgattggtgtacctgttgtatttgcttctcctgatggttggtcaagtaataaaaatgttgtattttccggtacatcattatggattggattagtatttctagtgggtattcttaattctctcatctcttgaaacttttcattctagattaaaaaacgaaatgacccctcccccccgaattctttcgggttgtgaggcacattaaaatgaaaatggaatatataagaccccacaaataaagaaaactaaaacattattattaatgggaggggtcaaaataagaaaatagaaaaatatgggattcctattatctaggggaatatattcgaatttattttttatattttagaaatctgtaattctacttttttaattaatttaattaatatatagatctatattatagatacaatacaatatatc

SEQ ID NO: 4243 - DNA, 3251 bp, Coffea canephora
tttcccgagattgtctatattatatataagaataaattcttattctgttcctccacagagaagggtttctttcaagttacaagataagagccttttccactctctctttgattacatactttctagctatataagtatgtatattgggatgtatatttatcagatcgtggcttcatgtaccaaatgttttgcatccgatatttttgtgtgatggatgcgagaaatagactttcatttccagtctactatttatattatatttattttattgaattaacaaaaaatataaattatttctttttctttttcaaaggagttttagatttatctgaaggaaaaagagatagaactaacaaagaaaatactaaagaaaatgaaaaaagaaattaataaaaaactttaatttaaagaatctctaaatttctttatttttctcaatatcacgaacaagatctaataataacattaattattaatggaacaaacgaggggttaggtaagagggtcgattgggggtgagagagggggttggttgttccttgaacagttctttgaaaagatattcattatctgattgatgagtcataataagacaattcacggttcatatacttactaagtaggaatctactaatctaggaataaaaaaatggagttatctaggcgagtttatgggccaataaataaaggatttttatcttcgaaacccattgcattggggtggggcagtgcaagagaaatcatacagaagagatcgaatgccccgaaaatgctatgaggtgctcggaaatggtcgaagtagttgaataggaggatcgctatgactatagcccttggtaaatttaccaaagacgaaaatgatttatttgatattatggatgactggttacgtagggaccgtttcgtttttgtaggctggtccggcctattgctctttccttgtgcctatttcgctttagggggttggttcacaggtacaacctttgtaacttcatggtatacccacgggttagccagttcctatttggaaggctgcaatttcttaactgccgcagtttctactcctgctaatagtttagcacattctttgttgttactatggggccctgaagcacaaggagattttactcgttggtgccaattaggcggtctgtggacttttgttgctctccacggcgcttttggattaataggtttcatgttacgtcaattcgaacttgctcgatctgttcaattgcgaccttataatgcaatcgcattctctgccccaattgccgtttttgtttctgtattcctcatttatccactaggtcagtctggttggttctttgcgcctagttttggtgtagcagctatatttcgattcatcctcttttttcaagggtttcataattggacattgaacccatttcatatgatgggagttgccggtgtattgggcgctgctttgctatgcgctattcatggtgctactgtagaaaatactttatttgaagatggtgatggtgcaaatacattccgtgcttttaacccaacgcaagccgaagaaacttattcaatggtcaccgctaaccgcttttggtcccaaatctttggggttgctttttccaataaacgttggttacatttctttatgttatttgtaccagtaaccggtttatggatgagtgctcttggagtagtcggtttggccctgaatctacgtgcctatgatttcgtttctcaggaaattcgcgcagcggaagatccggaatttgaaactttctacaccaaaaatattctcttaaatgagggtattcgtgcttggatggcagctcaagatcagcctcatgaaaaccttatattccctgaggaggttctaccacgtggaaacgctctttaatggaactttagctttagctggtcgtgaccaagaaaccaccggtttcgcttggtgggcgggaaatgcccgacttatcaatttatccggtaaactactaggagctcatgtagcccatgctgggttaatcgtattctgggccggagcaatgaacctatttgaagtggctcatttcgtaccagagaagcctatgtatgaacaagggttaatcttacttccccacctagctactctaggttggggggtaggccctgggggggaagttatagacacctttccatactttgtatctggagtacttcatttaatttcctctgcggttttgggctttggaggtatttaccacgcacttctgggtcctgagacgcttgaagaatcttttccattcttcggttatgtatggaaagatagaaataaaatgaccacaattttaggtattcacttaatcttgttaggtataggtgcttttcttctagtattcaaggctctatattttgggggcgtgtatgatacctgggctccgggagggggagatgtaagaaaaattaccaatttgacccttagcccaggtatcatttttggttatttactaaaatccccttttggaggggagggttggattgttagtgtggacgatttagaagatataatcggcggacatgtatggttaggttcgatttgtatacttggtggaatctggcatatcttaaccaaacccttcgcgtgggctcggcgcgcacttgtatggtctggagaggcttacttatcttatagtttaggggctttatccatctttggtttcactgcttgttgttttgtctggttcaataataccgtctatcctagtgagttttacggacctactgggccagaagcttctcaagcccaagcatttacttttttagttagagaccaacgtcttggggctaatgtgggatccgcccaagggcctactggtttaggtaaatatctaatgcgttcgccaaccggagaagtcatttttggaggagaaaccatgcgtttttgggacctgcgcgctccctggttagaacctttaagaggtccaaatgggttggacttgagtaggttgaaaaaagacatacaaccttggcaagaacggcgttccgcagaatatatgactcatgcccctttaggttctttaaattccgtgggtggcgtagctaccgagatcaatgcagtcaattatgtctctcctagaagttggttagctacctctcattttgttctaggattcttcttcttcgtgggtcatttatggcatgcgggaagggctcgtgcagctgcagcaggatttgaaaagggaattgatcgtgattttgaacctgtcctttcaatgaccccgcttaattga

SEQ ID NO: 4244 - DNA, 2656 bp, Juglans hindsii x Juglans regia
  misc_feature (778)..(778): n is a, c, g, or t
  misc_feature (831)..(831): n is a, c, g, or t
ttctttatgttatttgtaccagtaaccggtttatggatgagtgctcttggagtagtcggtctggctctgaacctacgcgcctatgacttcgtttctcaggaaatccgtgcagcagaagatcctgaatttgagactttctacacaaaaaatattcttttaaatgaaggtattcgtgcttggatggcggctcaagatcagcctcatgaaaaccttatattccctgaggaggttctaccccgtggaaacgctctttaatggaactttagccttatccggtcgtgaccaagaaaccactggtttcgcttggtgggccgggaatgcccggcttatcaatttatccggtaaattactgggagctcatgtagcccatgccggattaatagtattctgggccggagcaatgaacctgtttgaagtggctcatttcgtaccagaaaagcccatgtatgaacaaggattaattttacttccccacctagctactctaggctggggggtaggtcctggtggggaagttatagatacctttccatactttgtgtctggagtacttcacttaatttcctctgcagtattgggctttggcggtatttatcatgcacttctgggacccgagactcttgaagaatcttttccattcttcggttatgtatggaaagatagaaataaaatgactacaattttgggtattcacttaattttgttaggtataggtgcttttcttctagtattcaaggctctttattttggaggtgtatatgatacctgggctccaggngggggagatgaagaaaattaccaacttgacccttagcccaagtattatatttngttatttactaaaatctccctttggaggagagggatggattgttagtgtggacgatttggaagatataattggagggcatgtatggttaggttccatttgtatacttggtggaatctggcatatcttaaccaaaccttttgcatgggcgcgccgtgcacttgtatggtctggagaggcttacttgtcttatagtttaggtgctttagctgtttttggttttattgcttgttgctttgtttggttcaataataccgcttatcctagtgagttttacgggcccactggaccagaagcttctcaagctcaagcatttacttttctagttagagaccaacgtcttggggctaacgtgggatccgcccaaggacctaccggtttaggtaaatatctaatgcgttcgccgactggagaagtcatctttgggggagaaactatgcgtttttgggatttgcgtgctccttggttagaacccctaaggggtcccaatggtttggacttgagtcggctaaaaaaagacatacaaccttggcaagaacggcgttccgcagaatatatgactcatgctcctttaggttctttaaattccgtgggtggcgtagctaccgagatcaatgcagtaaattatgtctctccgagaagttggttagctacctctcattttgttctaggattcttcctattcgtaggtcatttatggcatgcaggaagagctcgtgcggctgcagcaggatttgaaaaaggaattgatcgtgattttgaacctgttctttccatgactcctcttaactaagacaggagatctgatgcttgaagtcggaatcaatttgatttcattatacatattgggattaggttgggtggattaggtcatatttaaaaagtattcctttcttttcattttcaactcatttatatctaatcttttttttctgttctggctcggctatctcccctagccgagccattctcttttatgatactgagccggataaaaccaataaaaaaaaacaaatctattcgccgagcaaaaaaaggagagagagggattcgaaccctcgatagttctttgttttgaactataccggttttcaagaccggagctatcaaccactcggccacctctccgtaaagtaaagacaatttatattttattttttattctagcgaatagaatatggtcatatgagttaataccattactacctatagaaagatatctggtaggtgtgaatttatgggtctatctatttatctgtatatatctatctgtatatatagatacatgatccagcgggccctttttgtttgtgaagtaaaaaaaaatacccttgatctcatgccttaattgaataaagtggtaaaagtcaaaggtggtaataagtcatatagcatcaatagattcatggtaaaaatccctctatgatacattttattacaatttttggctgatacaatcttttggtcgataacgataaagggatcaaatggtatatagttcttttgttgataaattggaggattagaaacatgactattgctttccaattggctgtttttgcgttaattgctacttcattaatcttactgattagtgtacccgttgtatttgcttctcctgatggttggtcgagtaacaaaaatgttgtattttccggtacatcattatggattggattagtctttctggtgggtatccttaattctctcatttcttgaacctactcgttccatttagatccaaaaatgaaatgaccccctcctaattctttcatttcaggttgtgagacacattaaaattaaataaaatataagtcccaaaaatgc

SEQ ID NO: 4245 - DNA, 2590 bp, Centaurea maculosa
cttatatttatttggattttggggacttatattgaatgtgaatgtgtctcacaaccaagaataattcagggggtcatttcggttttggatctagggcaataggttcaagagatgagagaattaaggatacccaccagaaagactaatccaatccataatgatgtacctgaaaatacaacatttttgttacttgaccaaccatcaggagaagcaaatacaacgggtacgctaatcaataagattaatgaagtagcaattaatgcaaaaacagccaattggaaagcaagagtcatgcttttaatcctccaagctaccaacaaatgaactataccatttgatccctatatcagccaaaaattgtactaaaatacatcatacagggattttaccatgaatccattgattctatatgatttattatattactaccccgttaccactttattcgtacatggagtcgggggagaatggaatttggtttttttattttacaaatgggcatgctggatcatacatctatccatatatcgggatagataaattgaccatcacacccgagatctttgatagtggcggtatccactcatatggccatgttctattcggaggaataaaataaaattgtctttcggagagatggctgagtggttgaaagccccggtcttgaaaaccggtatagtttactatcgagggttcgaatccctctctctccttttttgcttgttgaatagatttgtttctttattggattggttttgaccggagggtttcattctcataaagaaagggaagtggctcggctattccgcctagccaagccagaaaaaatggattcaaattaaatataaatgagttgaaaaaaaaagattctttttttttatgacatgatccctatatgtatgagggaaccgaagtgactcctacttcaagtcttggatctcctgtctcaattaagaggggtcatggaaagaacaggttcaaaatcacgatcaattcctttttcaaatcctgctgcagctgcacgagcccttcctgcgtgccacaaatgccctacgaagaagaagaaccctagaacaaaatgagaagtagctaaccaacttctaggagagacataattgactgcattgatctcggtagctacgccacccacggaatttaaagaacctaaaggagcatgagtcatatattctgcggaacgacgttcttgccaaggttgtatgtcttttttcagtcgactcaagtccaacccatttggaccccttagaggttctaaccaaggagcacgcagatcccaaaaacgcatagtttcccctccaaaaatgacttctccggtcggggaacgcattaaatatttacctaaaccggtaggcccttgagcggatcccacgttagctccaagacgttggtctctaactagaaaagtaaatgcttgagcttgagaagcttctggtccagtgggtccgtaaaactcactaggataagcggtattgttgaaccagacaaaacaacaagcaatgaaaccaaagacagatatagccgctaaactataagataagtaagcctctccagaccatacaagtgcgcgtcgagcccatgcgaagggtttggttaagatatgccaaattccaccaagtatacaaatggaacctaaccatacatggccgccgattatatcttccaaatcgtctacactaacaatccatccttcccccccaaagggcgattttagtaaataaccaaatatgatacttgggctaagggtcaagttggtgatttttcttacatctcctcctcccggagcccaagtatcatatacgcccccaaaataaagagccttgaatactagaagaaaagcacctagacctaacaagattaagtgaatacctaaaattgtggtcattttatttctatctttccatacataaccgaagaacggaaaagattcttcaagcgtctcaggtcctaaaagtgcatgataaataccgccaaagcccaatactgcagaggaaattaaatgaagtactccggatacaaagtatggaaaagtatctataacttccccaccaggacctaccccccaacctagagtagctaggtggggaagtaaaattaatccttgttcatacataggcttctctggtacgaaatgagccacttcaaatagattcattgctccggcccagaatacgattaatccggcatgggctacatgagcccctagtagtttaccggataaattgataagccgggcattcccggcccaccaagcgaaaccggtggtttcttggtcacgaccagctaaagctaaagttccattaaagagcgtttccacggggtagaacctcctcagggaatataaggttttcatgaggctgatcttgagccgccatccaagcacgaataccttcgtttaatagaatatttttggtgtagaaagtctcaaattcaggatcttccgccgcgcgaatttcctgagaaacgaagtcataggcacgcaggttcaaggccagaccgactactccaagagcactcatccataaaccagttactggtacaaataacataaagaaatgtaaccaacgtttattgg

SEQ ID NO: 4246 - DNA, 36555 bp, Aristolochia fimbriata
ctaagtcccagtggtttccagaaatcctaggcactacttctgttatgtgagcccgcttagctcaggggttagagcatcgcatttgtaatgcgatggtcatcggttcgattccgatagccggcttttccatttattctatttttttccatgattgataatgtcttcttgagatcaagagaaattgaaaagacagaaattgaaaagactcttccattttctccaaatgtcgggtcaacatagtatgttatgggaactcccaactatgaataaaaaagaataaaaaaaggattcaagcccttagatctctacagaacaagaaggggatacttaacttcctatatataactctataaaataatccggttattgagacaatttttcccattcttctttatagtacttcagcgagtttagcttcgtttatcgtttagttcagtctaaatttttttattctgtgaaatagaatttcaataaaattaaggagtctttatgtctcgttaccgagggcctcgtttcaaaaaaatacgccgtctgggggctttaccgggactcactagtaaaagacctagatccgtaagggatcttagaaaccaaccgcgttccgcgaaaagatctcaatatcgtattcgtctagaagaaaaacaaaaattgcgttttcattatggtctgacagagcggcaattacttagatatgttcgtatcgctgggaaagccaaagggtcaacaggtcaagttttactacaactacttgaaatgcgtttggataacatcctttttcgattgggtatggcttcgaccattcctggagctagacaattagttaaccatagacatattttagttaatggtcatatagtagatatcccaagttatcggtgtaaaccccgagatattattactacgagggatgaacaaagatcaagagctctgattcaaaattatgtggatttatccccccacgaggaattgccaaaacatttgactcttgacccattacactataaaggaatagtaaatcaaataatagatagtaaatggatcggcttaaaaatcaatgaattactagtcgtggaatattattcccgtcagacttaaacttaattaaaataattaagctttggacaattttgtccacccggtttcaccaaacaaagtaaatagaactaagctaagggatttaatctggattttccccatttgtatatcgcaagtggatccgcggttagattctcattccttgtctaccctttccgatattttatctaccacagtaattggcaatagagaatcactagaaaagaaaggccctactcttggggtatccattgttatttgatacattgtggttggtaacgttggtgaatttggtgtaagtcaaggtacggaaagagagggattcgaaccctcggtaagcaaaagcctacatagcagttccagtgctacgccttgaaccactcggccacctttcctgcggaatcttaggattattgcccggaaacccagtgaatagcgagtcattcatattattgaattgtattattgcaataacaataaaggtacgaccgatcgattataaatcgaaaactttccgtcaaagatcttccttggaggctcgagggataaaacacatttttttttattgaatattaacttaatattatattaaaaaaatgatctattcatctttatctattcatctttgtcaagacgatggtcctctccatcttattcggatatttataccggattaaacaaccaatgaattgggacgaatccactaactctatagtattttatactatggttatatttagaggtcggtaggaattacaaaatgcatttctagtttattcagatttatcaacagcaactcttctcatgagccaccccatggatccattataaaaaaattcacggtcgccctatgatttttatattatatttccattgtattgtttgtgtatacgcgctattcaccaaaaatggatgggttggttattctattttcatcatggaatgattatttgattctttttactctttggatcataatataataaaataaaaaaataaataaataaaataaaaactcctcgagttagatcagaatctgtaggaaaaattctttgattccttaacttcgctaaaatgaggagtaagagttctgttcattggcataaataccacattgggctgaaatccaatctgattccaatatttcctatctatccctgtcttaacttaaaagggacaatttttggggtcttttttttttttacaattactccgtttttatgtgatttcgtactgtacaattcctttgtttatgggagcattttccctcaagggagaggataatgagaagaattatggaatgggttgtaaactatgcctagatctcggataagtggaaattttattgataagacctcctcaattgtagccaatatcttattacgaataattccgacaacttcaggagaaaaagaggcatttacctattacagagatggtgtgatttgatttgattcgttttttttttatttatattaatattaattaaatattagattcgatttgtttggcctctttcagtcttatgagaaggggacatggttcaggacacaaaaaaaaaaaaaaaaaaattcttgaaataaacttccgcttggtgaaggtgaagtttgggttagtagagatcgaacaattccttctgtcgtgtatccccgattgatgcaacctcagatgcttcaattattgattttagcattgagcgaaaggttacacctataggttctgtattgcaggttaatcctactccaccagtaccaataggcggcgcatagggaaagaagcactacacctaggaatcaacaacacgaaaactttgttatatattatactattataccccttttccttattgggatcgggactaacaagaatggttgggacaacaaacatccatctcgtttgtgcttttggatacccgtataaccatcgaagatcgttgaagtgactaattcctgcaaagcaaatagagggcgttgaggacaaagaaattgttggagtgagcatttctatctagcatcaacacgtttggtgttaagaaaaagacctcttacaggaaggttggctagagatttcttgtaaaaacactagcccccatcagttcataatgagaatatttcaatcttttttgattccacggattattccctttattactatgcacagaagggaggagccgtatgagatgaaagtctcacgtacggttctgaaacggagattctttgaatataatgaacgaccgtaacggatgtcagctcaatccgaaggaaattatgcggaagctttacaaaattattatgaagctacgcgactagaaattgatccctatgatcgaagttatatactctataacataggccttatccacacaagcaatggggaacatacgaaggctttggaatattatttccgggcactagagcgaaacccattcttaccacaagcttttaataatatggccgtgatctgtcattacgtgcgactatctccactatagaaagaaggaaagaaagatcaaatacgctagtcaatactagaaaaaaaatgggctttctacatatgcatcgtccaaagcaacgatttttatcagctgtagcaaagaaagacttcatggaggccaaaatatgaagaaatgggtatggcctatatactagattccatggataaaggatctaatttaattgatagggtaagcgccgtaaagatcaattagagaggtattagagaggttttggggccgatagaataagaactgcttacataacatatcttttgatatgagataaaataaaagttaggaatcaacttatgtaatagagtcgatctactaaggtattgagcagcggtgtagcatcagatcccaaagatagtaagtcctttctttcttatggaggaaagtctttttcaaagattctatatcaatttctatatgaaaccgagatagttacctttcagaggattctaatgatatagggggtacggtacctatgctttattcttctgaaggtgggagaaaagataaaacgaattattgatcaaaataagagtttgaaacttatgtaattaacctcttctggttaacccgggatagatttacgagaaatctcattcaattatggatatggtagattaagatgggacaccaaaagaattggcggcggagccgtatgaggtaggaaactctcaagtacggttctaagggaaggaagtggcccacctattccgaccggggagaacaggccattcgacagggggattctgaaattgcggaggcttggtctgatcaagctgctgaatattggaaacaagcaatatcgcttactccaggtaattatattgaagcccataattggttgaaaatcacagggcggtaagaacactctttttttttttttttaattcaattatcatgttatgttggatccattaatcaaataaaatggatcgttcctctgggaagagccaatcaagtaatttcattatatcccttctaagatcgttctattttgtctggtacttccgaagtataaaccatacagatactgtacagaatacattacttttttctatgctaataaagctatatactcgaatgactaaatatggatatcgggatgtctctttttaatgactaatgactaattctttgatttggaatagagtaataaatacgttccatgtgagatatatgtaagatctaaactgaagtagattcatctaggcatttatccattgagatatgaatacattggattgcactaaaaaataaaaggtttttgcaccatgccatgcgaggaaggacctttagtattagataaaggtccgttgagcgccaaaaaaatatgtcataatagattcgaacacttgcccggattgacttccatatcataattgttctagtaaataactaaagaaaataactagatgggggataggaactaattctaaatagaaatatccatctctcagaggttcactaattactgacagttggcgggtctctttgtatgtgttgtccggaaagaggaggactcaatgattattcgttcgccggaaccagaagtgaagattatggtagacagggatcccgtaaaaacttctttcgaggaatgggccaaacccggtcatttctcaagaacaatagctaaaggccctgatactaccacttggatctggaatctacatgctgatgctcacgacttcgatagccataccagtgatttggaggagatctctcgaaaagtctttagtgctcatttcggtcaactctccatcatctttctttggctgagtggcatgtatttccacggtgcccgtttttccaattatgaagcatggctaagcgatcctactcacattggacccagcgcccaggtggtttggccaatagtgggtgaagaaatattgaatggtgatgtgggtggaggtttcccaggaatacaaataacctccaaattttttcagatttggagagcgtctggaataactagcgaatttacaactctattgtaccgcaattggtgcattagtatttgcagcgttaatgctttttgccggtggttccattatcacaaagctgctcctaaattggcttggttccaagatgtggaatccatgttaaatcaccacttagcggggttactaggactggggtttctttcttgggcgggacaccaagtacatgtatctttgccgattaaccaatttctagatgctggggtagatcctaatgagatcccgcttcctcatgaatttatcttgaatcgggattttttggcttaactttatccaagttttgctgagggagcaaccccttttttcaccttgaattggtcaaaatacgcggaatttcttacttttcggggaggattagacccagtaacagggggtctatggctgaccgatattgcacaccatcatttagctattgcaattcttttcctgatagctggtcacatgtataggactaactggggcattggtcacagtctgaaagatattttagaggctcataaaggtccatttacaggtcaggggcataaaggtctctatgagatcctaacaacgtcatggcatgctcaattatctcttaacttagctatgttaggctcttcaaccattgttgtagctcaccatatgtattccatgcccccatatccatacttagctactgactatggtacacaactttcgttgttcacacatcacatgtggattggtggatttctcatagttggtgctgctgcacacgcagccatttttatggtaagagactatgatccaactactcgatacaacgatctattagatcgtgtacttaggcatcgcgacgcaatcatatcacatctcaactgggcatgtatatttctaggctttcacagttttggtttgtatattcacaatgataccatgagtgctttagggcgtccccaagatatgttttcagataccgctatacaattacaacccatctttgctcaatgggtacaaaacacccatgctttagcacctagtgcaacagctcctggtgcaacaacaagcaccagcttgacttgggggggtagtgatttagtggctgtagggggcaaagtcgctttgttacctattccattaggaaccgcagattttttggtacatcacattcatgcatttacgatccatgtgactgtattgatattactgaaaggtgttctctttgctcgtagctcacgattgatacctgataaagcaaatcttgggtttcgtttcccttgtgacggccctggaagagggggaacatgccaagtatccgcctgggatcatgtcttcttaggcctattctggatgtacaattctatttcggtagtgatattccacttcagttggaaaatgcagtcagatgtttggggcagtataagtgatcaaggggtggtaactcatatcacgggggggaactttgcgcagagttccactactattaatgggtggctccgcgatttcttatgggcacaagcatctcaggtaattcagtcttatggttcctcattatccgcatacggcctttttttcctaggtgctcattttgtctgggcgtttagtttaatgtttctattcagcggccgcggttattggcaagaactcattgaatccatcgtttgggctcataacaaattaaaagttgctcctgctattcagcctagagccttgagcattgtacaaggacgcgctgtaggagtaacccattaccttctgggtggaattgccacaacatgggcattcttcttagcaagaattatttcactaggataatggctaggaggatttgaaaggcattatggcattaagatttccaaggtttagccaaggcttagctcaggaccctactactcgtcgtatttggtttggtattgctaccgcacatgatttcgagagtcatgatgatattactgaggaacgtctttatcagaacatttttgcttctcacttcgggcagttagcaataatctttctgtggacttccggaaatctgtttcatgtagcttggcaaggaaattttgagtcatgggtacaggaccctttacatgtaagaccaattgctcatgcaatttgggatcctcattttggtcaaccggcggtagaagcttttactcgagggggtgctctcggcccagtgaatatcgcttattccggtgtttatcagtggtggtatacaatcggcttacgtaccaatgaggatctttatactggagctctttttctattatttctttctgctatatccttaatagcgggttggttacatctacagcctaagtggaaaccaagtgtttcgtggtttaaaagtgctgaatctcgtctcaatcatcatttgtcaggactattcggagtaagttccttggcttggacagggcatttagttcatgtcgctattcccggatcaagggggcagtacgtcagatggaataatttcttagatgtattaccgtatccccaggggttgggccctctttttacaggtcagtggaatctttatgcccagaaccccgattccagtagtcatttattcggcacctccgaaggggcgggaacttccattctaacccttcttggggggttccatccacaaacacaaagtttatggttgaccgacattgcccatcatcatttagctattgcatttatttttctcgttgctggccatatgtatagaactaacttcggtattgggcatagtatgaaagatcttttagaagcacatattcctccgggaggtagattggggcgtgggcataagggtctttatgacacaatcaataattcgcttcatttccaattgggtcttgccctagcctctttaggggttattacctccttggtagctcaacacatgtactctttacccgcttacgcattcatagcacaagactttactactcaagctgcgttatatactcatcaccaatacatcgcagggttcatcatgacaggagcctttgctcatggagctatattcttcattcgagattacaatccagaacagaatgaggataatgtattggcaagaatgttagaccataaagaagctatcatatctcatttaagttgggccagcctgtttctggggtttcatactttaggactctatgttcataacgacgtcatgctcgcttttggtactccggagaaacaaatcttgatcgagcctatatttgcccaatgggtacaatctgctcacggtaagacttcatatgggttcgacgtactcttatcgtcaacgaatggcccagcatttaatgctggtcgaagcatatggttacctggctggttgaatgccgttaatgagaatagtaattccctatttttaacaataggtcctggagacttcttggttcatcatgcgattgctctaggtttgcatacaactacattgattttagtaaaaggtgctttagacgcgcgcggttccaagttaatgccagataaaaaggatttcggttatagtttcccttgtgatggcccgggacgaggtggtacttgtgatatttcggcttgggacgcattttatttggcagttttctggatgttaaataccataggatgggttactttttattggcattggaagcacatcacgttatggcaaggtaacgtttcccaatttaacgaatcctccacttatttgatgggatggttaagagattatctatggttaaactcttcacaacttatcaatggatataacccttttggtacgaatagtttatccgtctgggcatggatgttcctatttggacatcttgtttgggcgactggatttatgttcttaatttcctggcgtggatattggcaggaattgattgaaactttagcatgggctcatgaacgcacacctttggctaatttgattcgatggagggataaaccagtggctctttccattgtgcaagcaagattggttggattagcccacttttctgtaggttatatattcacttatgcagccttcttgattgcctccacatcagggaaatttggttaattcatttttcttgtaatgtgctccatcggcgacaatctcatttgattcggtggagaagggggactaccactaccctcttatatttctacatctaggatccgacccgtatcattgataataaaataggaactgaacaattatggcaaggaaaagtttgattcaaagggaaagtaaaaggcagaaattaaaagagaaatatcatttgattcgccgatccccaaaaaaagaaataagcaaagtttcgtcgttgagtgacaaatgggaaattcatggaaaattgcaatccccgccacgtaatagtgcacctatacgtcttcatcgacgttgcttttcgaccggaaggcccagaggtaactatcgggactttgggctatccgggcacatacttcgcgaaagggttcatgcatgtttgttgccgggggcaacgagatcaagttggtaagggtaaaaatactccttcttcatatttctatgggtctctatgatctatgatcatagaggggcccctttaccattctgtagaaatgggctagtctatttattatggtagaggggcaacccaatacttcttgttccacaagttcccgggtatttcgtgcggggtagagcagtttggtagctcgcaaggctcataaccttgaggtcacgggttcaaatcctgtctccgctacatttttgtttgtcagaaattctgttttaggctaggcattaggtgtaactccgttaatgttaattgttttgggatagtaggagagaaggagagtgggagagaagagggaagatagaaccactacattatcgtggtcaactagaccgaatcatttatcatattaatattagattattttaccctgggcggatagcgggaatcgaacccgcgtcttctccttggcaaagagaaattttaccattcgaccatatccgcatttcttcgttctgatatgaacatcatcatgttcacacatatatgatatatcatatatatatatatatgtgtgtctggatcatatttgtacaaggccatataatataatggattcctattattttattttaacattagattattcatttttttttttcattcaagaagtgacccctctccctccaacttttttctttatttatttatttatttattttcgcgactcatattgaattttaatgtgtctcacagtcggaattccttcgggggaggggtcacttttttgattctgtacgaggagattttctgtacgaggaggttcaagagattagagaattaaggatagcgactagaaagaccaatccaatccataatgatgtacccgaaaatacaacatttttgttacttgaccaaccatcaggagaagcaaatacaacgggtacactaattactaaaattgatgaagtagcaattaatgcaaaaacagccaattggaaagcaatagtcatgcttgtaatcctccaagctaccaacaaatgaacttgaactataccatttgatccccctctcagtccaaattgtactaaaatctatcgtgggggatttgcccatgaatatattgatcctttcgaacttattccgaattaaatctttaatttagtatttttttttatttgttacatggcggagccgagaggccatttttatttacttcacaaacgggcatactggctcatgcatatatctatataaacagatagatactatactagaactagacagatagatacagcaaaatatagctggatgcttttagagatagttatggtatcaactcatatggccatgttccattttggggaataaaatagagattgtctctcggagagatggccgagtggttgatagctccggtcttgaaaaccggtatagttctgaacaaagaactatcgagggttcgaatccctctctctccttttactcgttgaatagatttgtttctttattaatttggcctgacctgtgttataaagaggcacggctcggctaggtgggatagccgagccagaaaaaagaagtaaatataaataaataaataaaattaaatattttatttgaatttttaattttatttagaataaatctttatatatagaaatataaagaaaagaaatataaagaaatggataaatagatataatctaatctatgaatcaaaaaaaaaaaaagaaaaggaaaaataaatactttttaaaatttgagtatgccccgatcctaatatgtataatggaatcaaatggattcctacttcatgcatttgatctcctgtctcaattaaggggggtcatggaaagaacaggttcaaaatcgcgatcgattcctttttcaaatcccgctgcagctgcgcgagcccttcccgcatgccacaaatgccccacgaatagaaagaatcctagaacaaaatgagaggtagctaaccaacttctaggagagacataattgactgcattgatctcggtagctacgccacccacggaatttaaagaacctaaaggggcatgagtcatatactctgcagaacgtcgttcttgccaaggttgtatgtcttttttcagtctactcaagtccaacccattcggaccccttagaggttccaaccaaggagcacggagatcccaaaaacgcatagtttctcctccaaaaataacctctccagttggagaacgcattagatatttacctaaaccggtgggtccttgagcggatcccacgttagccccaagacgttggtctctaaccagaaaagtaaatgcttgagcttgagaagcttctggaccagtgggaccgtaaaactcactaggataagcggtattattgaaccagacgaaacaacaagcgatgaatccaaaaacggataaagcacctaaactataagacaagtaagcctccccagaccatacaagcgctcggcgagcccatgcaaagggtttggttaagatatgccagattccgccaagtatacaaatggaacctaaccacacatgtcctccaattatatcttctaaatcgtccacactaacaatccatccttctcctccaaagggggattttagtaaataaccaaatataacacttgggctaagggtcaagttggtaatttttcttacatctccacccccgggggcccaggtatcatatacgcccccaaaataaagagccttgagtactagaagaaaagcacctacacctaacaagattaagtgaatacccaaaattgtggtcattttatttctatctttccatacataaccgaagaatggaaaggattcttcaagagtctcagggccgataagtgcatgataaataccgccaaagcctaggactgcggaggaaattaagtgaagtactccggatacaaagtatggaaaggtgtctataacttccccacccggacctactccccaacctagagtagctaaatggggaagtaaaatcaatccttgttcatacatgggtttctctggtacgaaatgagccacttcaaataggttcattgctccggcccagaatacgattaatccggcatgggctacgtgagctccaagtagtttaccggacaaattgataagtcgggcattcccggcccaccaagcaaaaccggtggtttcttggtcacgaccagctaaagctaaagttccattaaagagcgtttccacggggtagaacctcctcagggaatataaggttttcatgaggctgatcctgagccgccatccaagcgcgaataccttcgtttaagagaatatttttggtgtaaaaagtctcaaattcaggatcttccgctgcacggatttcctgggaaacgaagtcataggcacgtaggttcagagccaggccgactactccaagagcgctcatccataaaccggttactggtacaaataacataaagaaatgtaaccaacgtttattggaaaaagcaaccccaaaaatttgggaccaaaagcggttagcagtgaccatcgaataagtctcttcagcttgagttggattaaaagcgcggaatgtatttgcaccgtcaccatcttcgaataaagtattttccacggtagcaccatgaatagcgcatagcagagcagcccccaatactccggcaactcccatcatatgaaatgggttcaacgtccaattatgaaacccttggaagaagaggatgaatcgaaatatagctgctacgccaaaactaggcgcaaagaaccaaccagactgacctagtggataaatcaagaatacagaaacaaaaacagcaattggaccggagaatgcgattgcattataaggtcgcaattgaacagatcgagcaagttcgaattgacgtaacatgaaacctattagtccaaaagcgccatggagagcaacaaaagtccacagaccgcctaattgacaccaacgagtaaaatccccctgtgcttcagggccccatagtagcaacaaagaatgtgctaaactattagcaggagtagaaaccgcagcggttaagaaattgcaaccttccaaataggaactagccaatccatgggtataccatgaagttacaaaggttgtacctgtgaaccaacctcctaaagcgaaataagcacaagggaagagcaatagaccagaccatcctacaaaaacgaaacggtccctacgtaaccagtcatccataatatcaaataagtcactttcttctttggtaactctaccaagggctatagtcatagtaatcctcctatttaactacttcaaccatttccgaacaccccatcgcattctcagggcatacgacggttcgattatctacggacgacgaatcatctactgactctttccaatgggtttcgaagatacaaacaaacaaatctttccttcctattggaaggctacaaccgaaccataagtaaatctatgagctcgcttcgattattatttcctatttttaataaacatatgaactcctaattttcttctgactcatcaatcagataatatttgatgagataactgtcaaggagcaggggatcctttctttcgctaccagttcttctactcatctatctctccgttccatcaacgaatcttattcttggatttcattcgtgatatgatattgagaaaagatcaataaatatctctatggattctcctaatttcatttagggtatactaaacggctacgatatcatatattacggtatcatatatatataatgaaactccatttttttcctttatttgattgttttttgtttcttattgttttctttagcttagttatatttccttcggatgaatctaaaataccagactatacctttcccatttcgcgggtagaagaaaaaaaaaggggggggggggagtattcccaatatcttttgtccctgcccttttaaaatcgaaattaaataggaagtggggactggaaatgaaaatcccgttctcgcattcgttctccattacattggtggaacaaaaatatctgatgcatccatatggaaatatttgatacatgaagtcatgtgacccaatatccatatctaagtcctatatggatataaaccaatctttttctggaaccaaaaaaagatattcaaaaaaagattgttcttgtgactcggaataaacatttctttgtggaggaaagggatgggcgatttattcctatgggtcatctaggaacaagaggattcaatcggaaatatcgacaaattcttgcgtggtccaaggaaataaaaaaggcccggcttccacaatttcatctctattgaaattgaatattttttaatatcagaatagccgatatagtcaccattcaatgggtcaggtccacttactttttcttttattgattttcaaatttgccgatcgggtttattggaacaatggagaagtaggaatgttttggtttgctgattcataatctgaattggatatataaaatagatatgatatgtaccaggaccagaaaaaataggaataatgaaaaatgaggcgaagtatatcctgtaatgacaacatagcagtcctcctaataagattagtgcaattacttatcatcataatgaacaaatgtttaactttgtacctataactcattctctaattttattagaataataactcattatgtgggcagttacctattacaaataactctaaaaaatctctcttttctctgctgaataatcaacactaagactgcaagctggagcttcatggaaaaagccccttatcggatttgaaccgatgacttacgccttaccatggcgttactctaccactgagttaaaagggcccgctttattcaattcaggaagaagccactcgctgctatgagtctactacatgatctatacatttagtatatgtacatatatatatgtatccatagggattcactgaggaacaaaaaatgggatttacctatacctatgagattctataggaaaaaaaaaatgattatttctatttcttttgttttgtatatttgaaaaatagcaatggtaatgcaatgaattctttcagggtcgggcctatactaatagctttgcttttattaacccgtccagacgagattcacttgattgatacatgtaccaatctgacatcgatccagaatataatatttcatcaaatcccttcccagatttaccaattctacatcatctttctgaatcgatcaaaaaaaagcattctatcgtttttaaatttcctggcttagtattagtgtgagataaagataggttatatcccatcttaatgttatatcccatcttaatgatgggtgagtcgatgagtaaaaatggaagaagggtttgacttaccttttctgtctgtcgaccaaatcatttcctgaagggattccatacttcgttatatatatatataggatataggacgggacggttcatgaatgataggatataggacgggatggttcatgaatgaaaatccaaaattctatggaatcatagaagcaggaaagatttttcggatctagtcatcccattatacattacattatattgacaattccaaaaaactgctcatactatgagcatagtatgatggcgatcgggcaggtatgcccctatcgtctagtggttcaggacatctctctttcaaggaggcagcggggattcgacttcccctgggggtagggtactacgaaaggaagttgatcatggattatcaataagcctagaatttattcttcctgggtcgatgcccgagcggttaatggggacggactgtaaattcgttggcgatatgtctacgctggttcaaatccagctcggcccactaattcgccgatccatgataaccaaatttgtcctccagaaatgcccattatttataatgccccatatattctaagtattctaaggatatacgggaataaaataaagtatatagggctaaagggaaagggtccattttttctacaatacccccttggtttctttcctatttctcacatcttctgatctgtctaaagatctagattaccaatttgttgcaaaggtaaggtagtaaagaaaaaaagaaaaagagtcatttttccattgaaaaatggattatcaatatattggcaggattaccagtaatccgtgtcattcggactcgagtccgtatccatgtggatatcagtatatcagtcgtgtttctgttacaacacaataatatttctcgtaaatagaaacgaaacgaatgaaagcataagaatacatatatgcatgctgtatacctcacccccgggattgtagttcaattggtcagagcaccgccctgtcaaggcggaagctgcgggttcgagccccgtcagtcccgacctcggatccggatgaatccatcaattcatctccccattttctgtgaggagagggaccccggacaggattgaatttcctgtggggatccttaatttacttttatttcgtttttcgtttcgaatttctcatcggacaaagacgggaatttctattatttgaacgagtactgattgctgggagagaggcatatgtagtcggaggtatcgccatactgggattccaagagagacctactggtttgactttttcaattgtttctgatccatgaaatggaatagggtacagagtaccaatatgtttccaaggagtacatatacaaattgtactcgtttattctacgatacacagttaactaacttagtgacatagttacccgggcagcagagtactattaaacctactcccttttgttttcgagatacgattttgtgcaacctcaattagtaaagtaattaaaaacaatatatcttattcaaattgcatgctgaatttcgctttctgtctcagtcccaatccaaggaaaaagagggtccttactttttattttaataataataataataagtcaaacaatgatccgccccttttgtttcttttctacggaggggatgaatcagtttttttttctttatctttatatatatattttagggtttcatcgaagaaggagaaaaatcaataaagaaagaatttgtcggaatattagatcttttttttttttatttatatcgggaccttcctttatctcatttctctgtcttccaggaagattagatcattacgcaaatttcgcttcgagcttaactccttcccttttccatttcactcctactgtttaggtctgttaccaatggaagggcggcaacggaacacaggtcagatgataccccgtcggatgattcttataaggaagatgataggttttataaactaaagaatgaaaaaaaaaagatgagaaattcaatgggattcttgattggatcaggaatcctatttttgattcggtatggataaaagatcttcctatgttatactattcaattctcgacgatgaatcgatttaatagatcagatattgttattcataatattgatccgattcagtatcaaccatcaggatgcaatccatcccattgaatttacaggatcaatagttttttttttttttttttctatgggattagatcccgagttattgcgaagcaaaaaaaacgatgagattatggaagtcaatattctcgcatttattgctactgcgctgttcattttagttcctactgcttttttacttatcatctacgtaaaaacagtcagtcaaaatgattagaattaaacttgacttattagctcttatcaatgattgacgaaataaaagggattgcaattccaagtcttaaatgaaatgagagaactggaatcaacagtataatagatggtgtagtagaaaggttcatatagttctttctaccacactatctattattatattgattgtataaatattctattgtataaagtgtataaagtagtattgtataaattaataaaatggatgggtttgatatagactagatacaatatctatccacataaatgaagtaattgattgagtcgttaacagataccccacggagttttatagtcacttcttcggatttgaaaaagaagtagtaaacctcacccatttttcatgcttgagccatgacatggggtgagtgaataaagcataaataagattactagaagtataaaacttaagtgaacacacacggatcacccaacgcaagatcttattatgcgtagtacgtagtacctctttgaacaaccacagcgcctatggcatctccagtagaaagtacgtatccacgtaatagtagcagtacttcctctttgaacagtcaagaaggaaaaacaaataaaaaataaaaaaataggggttggttgctcctcattgtaatgtaatatccataattatggtaagagcgggttcatcaaaatcaaatattctatttaggaaaggaataggaagagttcgtctggaaaaatttcctatcatgcgtattcctttgagtttcgaaatacgaacaacatcagaatcaaatcattgaaatatttgtttgatcgaaagatcattgttcatatattactggattaccctagaattttttgaaatggattatcttaaaacgcttcgcggaacggtctattaaacataaaccattgatccaatttgattactcaacttaattagtagtacccctagagcccacttcttccccatactacgagtgaaagggaaaacgtaaagaccaccattaaagcagcccaagcgagacttactatatccatgtaaattatctccctgatctctatgaatatgaaggaattattccattattaatcactaataatagtggaatcaatggtgcagagtcaaaatggcatttttctctaacgctattgatgaaccaacccaatgaatacaagagttcctatactctaactatactataagtatctctggtcgaatcggaaagcagtaagcaaaagcaagatatacagctacccttgggtatcttaaaggaatgttactaatgaaagatgtaggataggaatagtaaggcccattgtttgttttgttagctttcataagcataagcaaaaaaaaacggaaataaaataaaatagaaaatatatataccatcaagatggaaaagatcactatcttaactacctatcacatacctctatcttcccgcccatctaagtcttactgtctctgtttctttctgtgaaagaatcgggggacaccccattctgttcttagcagggtgttacaaaaaggggagaagttcttttttttttacttttattagaaaatgagattctctatatatattatagaatatggatataagatatagaatagttagttattgttagttattgtataactataatagttatagttaagagtcaattactcatccacatccaatctaatattgattggatacccgagtaagtactcagggactctcacgagtctcgatataaaataaaaactagccctttctgcaactcctaatttgattccccgccaacctacccaatctaattaaagactcagtcagtgggcatcaccctagtaaggtagggtaattaggaagtattgatagtatttcctataatctccctcagatcctagaatagaagcaaggattgggttttcatttaggaaccccctttcctttggctacctcaattttaggtatctgactttcgtagttatgaatctcacaattgaagttttactatcgattcgattgaaaaataaaatacaaataaatgaaatagcccgaacccatcggtaatcagtaataaataataaatgaggtttttttcatattgatacccgattttgaccataaccaaatggaaaaaattcaagtctttttttttttttattagagcctctatattcttaaatattcttaaagtattcttaaaatacagtatcgacaaccctagttatgctgccatcaggcaagaattttgtgagttctatttagcatagagggataaggtattccgaagcttttcttttgttgatcaggcgacacccggatttgaactggggagaaagggatttgcagtcccgcgccttaccactcggccatgccgccaaaataacccaaaatagacctaactctttcttttttgttttcgttttttttttgttttggggggggttactcaacctttttttggtttgtgttggattttgaaaacgggtttctttatccctttccaaaggggattcccgggtccagggttctcttgattgtagagtctttcaaaacatacagatcttttttttttatttttgatattgaaacataaaaaaaaaatcgatttctagacacagagtcaaaaattcagggtaaattagaactattaattattccctgtgaattcatgaatagttcttggatttggatctaacgttttctttccttaacttaataattaaattaataacataagaaaacaaaaaagttgatacacgactaatcagtatcaattgttttcaatttcaattataacaacatatatgtgtatatgtaaaccctcgagtagaaattgttacacggatacctagtcctatccaccttattttatagggaattgtcgtgcttgaattttgcattgaatatttttctattgaataagttgaatctaaattgcaaattctcatatagcaacatcgaaaagatgggatatgcagataactagatagctatatctgtatatacttatacaacgccctttacgcgtttcaatcgtattctactaattctactaacactaacaagggctccctattctctgggaatccttttttgaataatggtggaatcaatgaaatgagttaagtgtaaaaaccaactcgatactgttccagattattctgtctttatctcattcatagagaatggatcaaatcatgaatctatttatggtacccaatcttattgtaatatcataataacaataacaggtagaaattggatccatttgtatattctatacaagactccatcagtctaagctaagggacagaattttgtttcaaagaatgttttattaatccatctccatttggattaatccatctccatttggatccgtctaaaattctctctcttttttcctccgtctatgccaatttcattggtatatggaattggataaaatttcatgtgattcagtaaaaagaatatacattccatcattgctcgatccatctatatggttcgataaagagttaaccaataatgggattttatcaataaaagggaaactaaattaagatgctccgggatgaaaatgagggaatgtctacaatacctggatttagtcagatacaatttgaaggattttgtagattcattgatcaaggtttgaccgaagaacttcataagtttccaaaaattgaagatacggatcaagaaatcgaatttcaattatttgtggaaacatatcaattggtggaacccttgataaaagagagagatgctgtgtatgaatcactcacgtattcttctgaattatatgtacccgcggggttaatttggaaacccggtagagatatgcaagagcaaaccctatttattggaaatattcctctaatgaattccctgggaacttttatagtaaatggaatatacaggattgtgatcaatcaaatattgcaaagccctggtatttattaccgttcagaattggaccataacggaattgctgtctataccggaacaataatatcagattgggggggaaggtcagaattagagattgatagaaaagcaagaatatgggcccgcgtgagtaggaaacaaaaaatatctattctagttttactatcagctatgggttcgaatctaagagaaattctagataatgtttgctaccctgaaattttcttgtctttcctgaatgaaaaggaaaaaaaaagatcgggtcaagggaaaatgccattttggagttttatcaacaatttgcgtgtgtaggtggggatccggtattttcggagtccttatgtaaggaattacaaaagaaattttttcaacaaagatgtgaattaggaaggattggtcgacgaaacatgaaccggagacttaatcttgatatacctcagaacaatatatttttgttaccacgagatatattggctgctgccgatcatttgatcggaatgaaatttggaatgggcacacttgacgatatgaatcacttgaaaaataaacgtattcgttctgtagcggatctgttacaggatcaattgggattggctctggttcgtttagaaaatgtggttcgaggaactatatgtggagcaatcaggcataaattgataccgactcctcaaaatttggtaacttcaactccattaacaactacttatgaatcctttttcggactacaccctttatctcaagttttggatcgaacgaatccattgacacaaatagttcatgggcgaaaattgagttatttaggtcctggaggattaacaggtcgaactgctagttttcggatacgggatatccaccctagtcattatggacgtatttgtccaattgacacgtccgaagggatcaatgttggacttattgggtccttagctattcatgcgaggattggtcattggggtctatagagagtcctttttatgagatatctcagagatctaaagaagcacaggtgttttatttagcaccaagtatagatgaatactatatggtagcgacaggaaattctttggccttgaaccgggatattcaggaagaacaggttgttccagctcgataccgtcaagaattcctgactattgcatgggaacagattcatcttcgaagcatttttcccttccaatatttttctattggagcttccctcattccttttattgagcataatgatgcgaatcgggctttaatgagttctaatatgcagcgccaggcggttccgctttctcggtccgagaagtgcattgttggaactgggttggaacgccaagcggctcttgattcgggagtttccgctatagccgaatgcgagggaaagattgtttataccgatactgacaagatagttttatcaggtaatggagacactataagcattccattagttatgtatcaacgttccaacaaaaacacttgtatgcatcaaaaacctcaggctccgcggggtaaatgcattaaaaagggacaaattttagcgggtggtgcggctactgttggcggtgaactcgctttgggaaaaaatgtattagtagcttatatgccgtgggaaggctacaattttgaagacgcggtactcattagcgagcgtttggcatatgccgatatttatacttcttttcacatccggaaatatgaaattcagactcatgtgacaagccaaggtcctgaaagaatcactaaggaaataccccatttagaagctcatttactccgcaatttagacagaaacggaattgtgatgctgggatcttgggtagaaacaggtgatattttagtaggtaaattaacgcctcaggcggcgaaagaatcatcgtatgccccagaagatagattattacgagccatactcggcattcaggtatccactgcaaaggaaacttgtctaaaattacctatagggggaaggggccgggttattgatgtgagatggatccagaaaaaaaaagggtccagttataatccagaaatgattcgtgtatatatttcacagaaacgtgaaatcaaagtaggtgataaagtagctggaaggcatggaaataagggtatcatttcaaaaattttgcctagacaagatatgccttatttgcaagatggaacaccagtggatatggtcttcaacccattaggagtaccctcgcgaatgaatgtgggacagatatttgaatgctctctcgggttagcggggaacttgctgggcagacattatagaatagcaccctttgatgaaagatatgagcaagaagcttcgagaaaactcgtgttttctgaattatatgaagccagcaagcaaacagcaaatccatgggtctttgaacccgagtatccaggaaaaagcagaatatttgatggaagaacaggagatccttttgagcaacctgttataataggaaaaccctatatcctgaaattaattcatcaagttgatgataaaatccatgggcgctccagtggacattatgcacttgttacacaacaaccccttagagggagggccaagcaagggggacaacgagtaggagaaatggaagtttgggctctagagggatttggtgttgcgcatattttacaagagatgcttacttataaatccgatcatattagagctcgccaggaagtacttgggactatgattattggaggaacaatacctaacacggaggatgctcccgaatcttttcgattactcgttcgagaactacggtctttggctctggaactgaatcatttccttgtatctgagaagaacttacagattcatagggaggaagcttgatcggaatgaatccgaatttttcttctatgatcgatcggtataaacatcaacaacttcgaattggatcggtttctcctcaacaaataagtacgtgggccaccaaaatcctacctaatggagaaatagttggagaggtgacaaaaccctatacttttcattacaaaaccaataaaccggaaaaagatggattgttttgcgaaagaatctttggacctattaaaagtggaatttgtgcttgtggaaattttcgagtgatcggagatgaaacagaagacgcgaaattttgtgaacaatgcggagtcgaatttgttgattctcgggtacgaagatatcaaatgggatacatcaaactggcatgcccagtgactcacgtgtggtatttgaaacgtcttcccagttatatcgcgaatcttttagataaaccccttaaggaattagaaggcctagtatactgcgatgtgtgatttgatcgaaatcttgattttacagattcggaatgagaaactgtcatcccattcaatccgattgggatgcccccgactctgacatgtctctttagaggaggaacatgaagctcagaattatgggtgtattaaatacttccaaatagaaaggggaattgatccatggtcgattccgtaatagaaaaatgggaattgctagttatacctcgtgaaaaaaaaaaaaaaaaaaaacttctttcgtggaattagccattccatttcttttttgaaagagattccattcaagtaaacataaacaaatatgacatggttacaggagtttatccatcgcatatatgcttcaaaggatattatagcataaccatcgaggtgaagtagggacctaaaagatcgaatggaacgatacatagacaagtaaatcccttaccttatgagatgagtgagttcgaagatattcgaattttaattttaataattaaaattaaaggaatttctcattcgaagggaagtagactactcaataatttctcatttcctttatgtcataattgagttgaataactaattcataaagtaaaagtaagaatgaatcaatgagatattggttggtcctcgctgtgaacttgagtaaggagtaaatctttatggggcttctagaacaaaattggaattgtaaaataagaacccctttctttatttgatgtaactacttgagccggatgagaggaaaccttcacgtccgatttttaaggggggaattcataggaacctatcctaatttttcttttgctaggcccattgctaaaaaacccactttcttacgattacgaggttcattcgaatatgaaatccaatctcggaaatacagcatcccacttttttttactacccaaggcttcgatacatttcgaaatagagaaatctctacaggagcgagtgctatcagagaacaattagccgatctggatttgcgaattattatagatcattcattggcagaatggaaggaattaggggaagaagggcccaccgggaatgaatgggaagatagaaaaattggaagaagaaaggattttttggttagacgcatagaattagctaagcattttatccgaacaaacgtagaaccagagtggatggttttgtgcttattaccagttcttcctcccgagttgagacccattattcagatagatgggggtaaactaatgagttcggatattaatgaactctatcgaagagttatctatcggaacaatactcttactgatccattaacaacaagtagatccacaccaggggaattagtaatgtgccaggagaaattggtacaagaagccgtggatacacttcttgataatgggatccgcggacaaccaatgagggacggtcataataaagtttacaagtcgttttcggatgtaattgaaggcaaagagggaagatttcgcgagactttacttggtaaacgagtcgattattcggggcgctccgtcattgttgtgggcccttcgctttcattacatcaatgtggattgcctcgagaaatagcaatagagcttttccagacatttttaattcgtggtttaatcagacaacatcttgcttccaacatagggattgctaaaagtaaaattcgggaaaacaaacctattgtatgggaaatacttcaagaagttatgcaggggcatcccgtattgctgaatagagcaccaaccctgcatagattaggcatacaggcgttccaacccattttagtggaaggacgtgctatttgtttacatccattagttcgtaagggattcaatgcagactttgatggggatcaaatggctgttcatgtacctttatcttttgaagctcaagcagaggctcatttacttatgttttctcatatgaatctcttgtctccagctattggggatcccatttccgtaccaacgcaagatatgcttatgggactctatatattaacaattgggaatcgtcgaggtatttgtgcaaataggtataatccatggaatcgcggaaactatgaaaataaaataggtggtgataataactataagtatacgaaagagaaagaaccttatttttgtagttcctatgatgcacttggagcttatcgtcagaaacgaatcaatttagatagccctttgtggctccggtggcgactagatcaacgtgtcattgcctcaagagaacttcctatagaagttcaatatgaatcctcgggaacctatcatgagatttatgggcactttttaatagtgaaaagtgtcaaaaaagaaatcctttgtatatacattcgaaccacagttggtcatatttctttttatcgagaaatagaagaagccatacaagggttttggcgggcctactcatacggtgcctaagctaagtaattatgtgatatgatatccgggcgagcctccttggttcaaccggtatcctaattcctgaatttctacgtgaatcaagatcgaggaaaggaagtcttagaatcactgactcaaccccattgtcgaatcccactcagacgaatatggaggtacttatggcagaacgacccgatctagtctttcacaataaagtgatagatggaactgccatgaaacgacttattagcagattaatagatcacttcgggatggcatatacatcacatatactggatcaagtaaagactctgggtttccggcaagccactgctacatccatttcattaggaattgatgatcttttaacaataccttctaaaggatggctagtccaagatgctgaacaacaaagtttgattttggaaaagcaccatcattatgggaatgtacacgcggtagaaaaattacgtcaatctattgagatatggtatgctacaagtgaatatttgagacaagaaatgcatcttaattttaggatgactgatccttctaatccagtccatataatgtccttttcaggagctagaggaaatgcatctcaggtacatcaattagtaggtatgagaggattaatgtcggatccccaaggacaaatgattgatttacccattcaaagcaatttacgtgaaggactttctttaacggaatatatcatttcctgctacggggcccgcaaaggggttgtggatactgctgtacgaacatcagatgctggatacctcacgcgtagacttgttgaagtagttcaacacattgttgtacgtagaacggattgtggcactatccgaggtatttccgtgagtccccaaaacgggatgacggaaaaaatgttgatccaaacattaattggtcgtgtattagcagacgatgtatatatgggtctaaggtgtattgccgctcgaaatcaagatatcgggattggacttgtcaatcgcttcataacttttcaggcacaaccgatatatattcgaacccccttcacttgccgtagtacatcttggatctgtcgattatgttatggtcgaagtcccactcatggtgacctggttgaattaggggaagcagtgggtatcattgcgggtcaatcaattggggaaccggggactcaactaacattaagaacttttcatactggtggagtattcacaggtggtactgcagaacaggtacgagctccttttaatggaaaaattcaatttaatgaggatttagttcatccaacacgtacacgtcatgggcatcctgcttttctatgttatatagacctgtatgtaactattgagagtcagggcattatccatagtgtgaatattccaccaaaaagttttcttttagttcaaaatggtcaatatgtagaatcagaacaagtgatcgctgagattcgcgctggaacatctactttgaattttaaagaaagagttcgaaaacatatttattctgactcagagggagaaatgcactggagtaccgacgtgtaccatgcacctgaatatacatatgggaatgttcatctcttaccaaaaacaagccatttatggatattatcgggggacccgtgcagatctaatagagtgcccttttccctccacggggatcaagatcaaatgaatgttcattctctttctgtcgaacagagatatatttctggcctctcagtgactaatgatcgagtgagacacaaattgtttagttcggatcctttcggtaaaaaagtagataggagttttgataattcaagatcagatcgaatcatatccaacggccattggaatttcatatactccgccattctctacgagaattctgatttattggggaagaggcgaagaaatagattcatcctcccattccaatatgatcaagaacgagagaaagaactaatgtcctgttctggtatctcaattgaaatacccataactggtattttacgtaaaaattgtattcttgcttattttgacgatccccaatacagaagaagcaattcaggaattactaaatatggtaccgtagaggtggatttcatcctaaaaaaagaagatttgattgaatatcgaggagcaaaagaatttaggccgaaataccaaacgaaagtagatcgcttttttttcattcccgaagaagtgcatattttacccagatcttcgtccataaaggtacgtaacaatagtatcattggagtaggtacacgaatagctttaaatacaagaagccgagtaggtggattggtccgagtggagagaaaaaagaaaaagattgaattgaaaatattttctggagatatacattttcccggagagacagataaaatctctcggcatagcggcatcttgataccaccaggaacgggagaaaaaaattctaaggactcaaaaaaattgaaaaattggatctatgtccaacggattacacccatcaagaaaaagtattttgttttggttcggcctgtagtcacatatgaaatagccgatggcataaatttagcaacgcttttcccccaggatctgttgcaggaaagagataatgtgcaactacaagttgtcaattatatcctttatggaaacggcaaacccattcgaggaatctcccacacaaatattcaattagttcgaacttgtttagtattgaattgggaccaaggacaaaatagttctatagaagaagtccatgcttcctttgttgaagtaaggacaaatgatctgattcgaaatttcataagaattgacttagttaagtcccctatttcgtgtaccggaaaaagggatgataggggagattcgggattgaatctcgataatggatcagatcgcaccaatattaatcctttttaccccaaggcgaagattcaatcacttacccaacagcaagggactatccatttgttgctgaataaaaataagcaatgccaatcttttctaattttgtcatcatctaattgttctcgaattggtccattcaatggttccaaatctctcagtgtgagaaaaaaatcaattaaagaagattccacgattgctattgctattagcaatttgttgggccccctgggtactgtatttaaaattgcgaatttttattcatcttgttgcttaataacttataatcagatcttgttaaataaatatttgcgacttgaaaatttaaaacagactttccgagccattcaatattatttaatagatgaaaatgggggaatttacaattgcgatccttttagtaacatcatttttaatccattcgatttaaattggcgctttctccatctcaattattgtgagaagacatccacaacaattagccttgggcagtttatttgtgaaaatgtatgtatatccaaatatggaccgcgcataaaatccggtcaagttataattgttcatgttgactccttagtaataagattggctaagcctcatttggccactccgggagcaaccgttcatggccattatggagaaattctttatgaaggagatacattagttacatttatatatgaaaaatcgagatcgggtgatataacgcagggtcttccaaaagtggaacaagtgttagaagtgcgctcaattcattcaatatcgatgaacttagagaagagagttgaaggttggaacaaacatataacaaaaattattggaaatccctggggatttttaattggagctgagctaaccatagcgcaaagtcgtatttctttggttaataagatccaaaaggtttatcgatcccagggggtgcagatccataataggcacatagagattattgtacgtcaaataacatcaaaagtgttagtttcagaagatggaatgtctaatgttttttcacccggagaactaatcggattgttgcgagcggaacgggcagggcgcgctttagaagaagcaatctgttaccgagccattttattgggaataacgaaggcatctctgaatactcaaagtttcatatccgaagcgagttttcaagaaaccgctcgagttttggcaaaagctgctctacgaggtcgtattgattggttgaaaggcctgaaagagaatgttgttctggggggtatgatacctgttggtaccggatttaaaggattagtgcatcgttctaggcaacacaacaacattcctttggaaatcaaaaagaagaatctattcgaggggaaaataagagatatttttttccaccacagagaattatttggtttttgcacacaaaatactttccatgatacaacagaacaatcatttacaggatttaatgattcctaataagagcatattcattcttttcttttaacttttaactatatagggtatggtatgtatggtccggtcatttgatttgttaataaagataataacgaatagaaagtaattaacgacttggaccgtgtatcaatggccaatccccggcagaaggttccgtcggaacaattatttatttcaaggtaccttgtttcttaaaacaaaaaataaaagataaagtgtggggggaaatgacaagaagatactggaacatcaatttagaagagatgatggaagcgggagtgcatttcggtcatggtactaggaaatggaatcctagaatggcaccttacatctctgcaaagcgtaaaggtattcatattacaaatcttactagaactgctcgttttttgtcagcagcttgtgatttagtttttgatgcagcaagtaggggaaagaactttttaatagttggtaccaaaagtaaagctgcggattcagtagcagcagctgcaataaaggttcggtgtcattatgttaataaaaaatggctcgggggtatgttaacaaattggtctactacagaaacgagacttcataagttcagggacttgagagtagaggcggggaaactcaaacgtctcccgaaaagagacgctgcaatgttgaagagacaattatctcacttgcaaacatatctaggtgggatcaaatatatgacggagttacccgatattgtcatcatcgttgatcagcaagaagaatatacggctcttcgagaatgtatcactttgggtattccgacgatttgtttaatcgatacaaattgcgacccggatctcgcagatatttcgattccagccaacgatgacgctatagcttcaatccgattgattcttaacaaattagtatccgcaatttgtgagggtcgttctagctatataagaaatcgttgattaataataagattaagataagtcaataactttgggaactccatagattgattgaatcggttaccattcctgaatctcaaaaaagagatcaaaattgatggggatattctgtgattccttggcacctgaaacatacgattaaagtcaaagtaggcgagtcgagaaagagatggttgaatctgaatcaaaataattactttttaagttgtatttctgtcagagggtaatatgaattttctaccatgttccataagcacactaagggatatatacgatatatctggtgtggaagtaggccaacatttctattggcaaatagggggtttccaagtccatgcccaagtacttatcacttcttgggtcgtaattgctatcttattaggttcagctgctatagctgttcggaatccacaaaccgttccaaccgacggtcagaattttttcgaatatatccttgaattcattcgagatttgagcaaaactcagattggagaagattatggcccctgggttccctttattggaactatgtttctatttatttttgtttctaactggtcgggtgctcttttaccttggaaaatcatacagttacctcatggagagttagcagcacctacgaatgatataaatactactgttgctttagctttacccacatcagtggcatatttctacgcgggtcttaccaaaagagggttgggttatttcggtaaatacattcaaccaactccaatacttttaccaattaacatcctagaagatttcacaaaacctttatcacttagttttcgacttttcgggaatatattggctgatgaattagtagttgttgttcttgtttctttagtaccttcagtagttcctatacctgtcatgttccttggattattcacaagtgggattcaagctcttatttttgcaaccttagccgcggcttatataggtgaatccatggagggtcatcattgactagctttcaaaaaaaaaaaagcttatcccaattccaactctcgagtgtctcaagataatctactgggggaacacaatatatccaaaaagtgcatgtatggtctagagtaggaacaaaaaagatgtacgatattggggaattgtaaaaaaaaaagggaagagatctaaaagatctttttcctaagatttacttttggtccatttatgttacgtctctctaatcaatattctataattctataatataatcgtatttgttcagtcaattactatattttaaaaatttaactaagaattgttatcttatctgtctctgacatgcgcctaaaacaactaaaataaaaagagtatgttctatagaaacaatcattccgtttttatttgatttgattcaatttgattcaacgattgatcaaagttgtcattaattgcaatcaaatctttatacagaatgattcgggctaacgatcccgtctatttatattcatgcaggagtcgcgataatgtaaaaggaagagaagagtttacaagcaaataagattcataaaaaagtggattaggggctcgtgctgagctaggtatggatatatatatatatatatatataatggctataagccaattcctgtgtatgtttcgaagcatgattcaattcttcggctagaatccaattcaacagcataaagaatggtttacgttatggaagaaacacttgtatatgtgatattagatattcattaattgtctatatatggattatacatacaaataatatatatggattatacatacaaataaaataaatatataaatataaaaatagaatctattatttatttattattatttattttatatatatttattcttttaccataccatcctactgaattaaatgaattcaaattcaataggagttcttccgttttatctgtgaccggggattgaatgaataaacagatgaagtcaagcatatagagaagaacgtgccaagaataaaaagagtggcttagaacaaagaaattgaataactagaatcttttggatttacaaagactacacggtagaaattataaaggagatattgaagtcgttcggctaattcaggaatattattacctcaattcacttttctgttcttatcttagttacttcgcccgaatgggtctttgaaataataagtaataattcattggttgattgtatcattaaccatttctttattttggtgtgaggagcttactatgaatccactgatttccgccgcttctgttattgctgctgggttggccgtagggcttgcttctattggacctggggttggtcaaggtactgctgcgggccaagccgtagaaggtatcgcgagacaaccggaagcagagggtaaatacgaggtactttattacttagtctggctttatggaagctttaacaatttatgggctagtcgtggcattagcgcttttatttgcgaatccttttgtttaatcccataaatattttaaatacgtactcattttcttatttttttgttgtgtacttgcctcttgcttcttagaattagatcaacacttcacccctatcatctaatcacttgttgatctaatcacttgttcgttgaaacaataccccggggaaggactaatttgaggatgaggaatttgcgaatccactcgctttcttccttcccgcccttaatggaaaggaaacccccctttttttttttttagttttacttttttttattagattaggatggagcaaacgcaattgacatgaggcctggggcctaggcctaataagtgtcttattgagaacttccataattcataattctaataataataaaaaaaaaaaagaatagatttcatttctttatttcattttttttttcttaatttctaaaaaaaaaagagctcaatcaaacaaaacacaaaggatgaggtgatacaaaaagaactctgtttgattttcttagtcctatctatatctataagaggagatcatatgaaaaatgta

SEQ ID NO: 4247 - DNA, 1782 bp, Arnica chamissonis
tgtttttttttttttatgacatgatccctatatgtatgagggaaccgaagtgactcctatttcaagtctttgatctcctgtctcaattaactgtctcaattaagaggggtcatggaaagaacaggttcaaaatcacgatcaattcctttttcaaatcctgctgcagctgcacgagcccttcctgcgtgccacaaatgccctacgaagaagaagaatcctagaacaaaatgagaagtagctaaccaacttctaggagacacataattgactgcattgatctcggtagctactccacccacggaatttaaagaacctaaaggagcatgagtcatatattctgcggaacgacgttcttgccaaggttgtatgtcttttttcagccgactcaagtccaacccatttggaccccttagaggttctaaccaaggagcacgcaaatcccaaaaacgcatagtttctcctccaaaaatgacttctccggtcggggaacgcattaaatatttacctaaaccggtaggcccttgagcggatcccacgttagctccaagacgttggtctctaactagaaaagtaaatgcttgagcttgagaagcttctggtccagtgggtccataaaactcactaggataagccgtattattgaaccagacaaaacaacaagcaatgaaaccaaagacagatatagccgctaaactataagataagtaagcctctccagaccatacaagtgcacgtcgagcccatgcgaagggtttggttaagatatgccaaattccaccaaatatacaaatggaacctaaccatacatggcctccgattatatcttccaaatcgtctacactaacaatccatccttcccccccaaagggcgattttagtaaataaccaaatatgatacttgggctaagcgtcaagttggttatttttcttacatctcctcctcccggagcccaagtatcatatacgcccccaaaataaagagccttgaatactaaaagaaaagcacctatacctaacaagattaagtgaatacctaaaattgtggtcattttatttctatctttccatacataaccgaagaatggaaaagattcttcaagcgtctcaggtcctaaaagtgcatgataaataccgccaaagcccaatactgcagaggaaattaaatgaagtactccagatacaaagtatggaaaagtatctataacttccccaccaggacctaccccccaacctagagtagctaggtggggaagtaaaattaatccttgttcatacataggcttttctggtacgaaatgagccacttcaaatagattcattgctccggcccagaatacgattaatccggcatgggctacatgagcccctagtagtttaccggataaattgataagccgggcattcccggcccaccaagcgaaaccggtggtttcttggtcacgaccagctaaagctaaagttccattaaagagcgtttccacggggtagaacctcctcagggaatataaggttttcatgaggctgatcttgagccgccatccaagcacgaataccttcgtttaagagaatatttttggtgtagaaagtctcaaattcaggatcttccgccgcgcgaatttcttgagaaacgaagtcataggcacgtaggttcaaggccagaccgactactccaagagcactcatccataaaccagttactggtacaaataacataaagaaatgtaaccaacgtttataggaaaagcaacccaaagatttagggaccaaagcgattagcagtga

SEQ ID NO: 4248 - DNA, 2142 bp, Cirsium arvense
ctttattcgtacatggagtcgggggagaatggaattttttttttttttttacaaatgggcatgctggatcatacatctatccatatatcgggatagatagattgaccatcacacccgagatctttgatagtggcggtatccactcatatggccatgttctattcggaggaataaaataaaattgtctttcggagagatggctgagtggttgaaagccccggtcttgaaaaccggtatagtttactatcgagggttcgaatccctctctctccttttttgcttgttgaatagatttgtttctttattggattggttttgaccggagggtttcattatcataaagaaagggaagtggctcggctattccgcctagccaagccagaaaaaatggattcaaattaaatataaatgagttgaaaaaaaaaagattcttttttttatgacatgatccctatatgtatgagggaaccgaagtgactcctacttcaagtcttggatctcctatctcaattaagaggggtcatggaaagaacaggttcaaaatcacgatcaattcctttttcaaatcctgctgcagctgcacgagcccttcctgcgtgccacaaatgccctacgaagaagaagaatcctagaacaaaatgagaagtagctaaccaacttctaggagagacataattgactgcattgatctcggtagctacgccacccacggaatttaaagaacctaaaggagcatgagtcatatattctgcggaacgacgttcttgccaaggttgtatgtcttttttcagtcgactcaagtccaacccatttggaccccttagaggttctaaccaaggagcacgcagatcccaaaaacgcatagtttctcctccaaaaatgacttctccggtcggggaacgcattaaatatttacctaaaccggtaggcccttgagcggatcccacgttagctccaagacgttggtctctaactagaaaagtaaatgcttgagcttgagaagcttctggtccagtgggtccgtaaaactcactaggataagcggtattgttgaaccagacaaaacaacaagcaatgaaaccaaagacagatatagccgctaaactataagataagtaagcctctccagaccatacaagtgcgcgtcgagcccatgcgaagggtttggttaagatatgccaaattccaccaagtatacaaatggaacctaaccatacatggccgccgattatatcttccaaatcgtctacactaacaatccatccttcccccccaaagggcgattttagtaaataaccaaatatgatacttgggctaagggtcaagttggtgatttttcttacatctcctcctcccggagcccaagtatcatatacgcccccaaaataaagagccttgaatactagaagaaaagcacctagacctaacaagattaagtgaatacctaaaattgtggtcattttatttctatctttccatacataaccgaagaacggaaaagattcttcaagcgtctcaggtcctaaaagtgcatgataaataccgccaaagcccaatactgcagaggaaattaaatgaagtactccggatacaaagtatggaaaagtatctataacttccccaccaggacctaccccccaacctagagtagctaggtggggaagtaaaattaatccttgttcatacataggcttctctggtacgaaatgagccacttcaaatagattcattgctccggcccagaatacgattaatccggcatgggctacatgagcccctagtagtttaccggataaattgataagccgggcattcccggcccaccaagcgaaaccggtggtttcttggtcacgaccagctaaagctaaagttccattaaagagcgtttccacggggtagaacctcctcagggaatataaggttttcatgaggctgatcttgagccgccatccaagcacgaataccttcgtttaagagaatatttttggtgtagaaagtctcaaattcaggatcttccgccgcgcgaatttcctgagaaacgaagtcataggcacgtaggttcaaggccagaccgactactccaagagcactcatccataaaccagttactggtacaaataacataaagaaatgtaaccaacg

SEQ ID NO: 4249 - DNA, 3600 bp, Euphorbia peplus
cacagttaattacatttacaaattgcaaaaagtttgacccctccctcgaatttttgttttctttaatttgtattttgcattttaggaacttagacttattgaatttgaatatctttcgcaacccgaaagagttcaggggaggggtcattttcatttcatttttgtatctagaacaaatacgttcaagagatgagagaattaaggatacctaccagaaagactaatccaatccataatgatgtaccggaaaatacaacatttttgttactcgaccacccatcaggagaagaaaaaacaacgggtacactaatcagtaagattgatgaagtagcaattaatgcaaaaacagccaattggaaagcaatagtcatgtttctaatcctccaagctaccaacaaaagaactataccatttgatccctctattaaccaaaaaaattgtaaaaaaaaaaatagcatcatggggggattgtgccatgaattcattgattctatatgacttattactaccctttcccattctgtttatttgaacatggagtcgagagtcgttttttacttcacaaataaaatagtcatactagatcctgcatccgtctatatattatagatatataaatagacttatcgactcataccaaattgattttttttatagtacagtgatggtatcaactcctatgaccctttctattcggcgaaaaaaaataaaatagtaaaatagaaattacctttcggagagatggccgagtggttgatagctccggtcttgaaaaccggtatagttcgcaaagaactatcgagggttcgaatccctctctctccttttctcgatgaataaatttatgtgtttaatggaaatggctcggctatgtcacctagccgagccagaaaaaaaaagagattagatctaaatgagttgaaaagaaaggaaaaagtaatactttttatttaagtatgagtatgacttaatccacccaatccatatgtattattgaatcaaatagattcccactttaagtattggatctcttgtctcagttaattaagaggagtcatggagagaacgggttcaaaatcacgatcaattcctttttcaaatcctgctgcagctgcacgagcccttcccgcgtgccataaatgacctacgaataggaagaaacctagaacaaaatgagaggtagctaaccaacttcgaggagagacataattgactgcattgatttcggtagctacgccacctacagaatttaatgaacctaaaggcgcatgggtcatatattccgcggaacggcgttcttgccaaggttgtatgtcttttttcaacctactcaagtccaaaccattcggacctcttagaggttctaaccaaggagcacgcagatcccaaaaacgcatagtttctcctccaaaaataacttctccggtaggcgaacgcattaaatatttacctaacccagtaggtccttgagcggatcccacgttagccccaagacgttggtctctaactagaaaagtaaaagcttgagcttgagaagcttctgggccagtaggcccgtagaactcactaggataagcggtattattgaaccagacaaagcaacaagcaatgaaaccaaaaacggataaagcggctaaactataagataagtaagcctctccagaccatacaagtgcacggcgagcccatgcaaagggtttggttaagatatgccagattccaccaagtatacaaatagaacctaaccacacatgccccccaattatatcttccaaatcgtccacactaacaatccatccttctccgccaaagggggattttagtaaataaccaaaaataacacttgggctaagggtcaagttggtaatttttcttacatccccgccccccggagcccaggtatcatatacgcccccaaaataaagagccttgaatactagaagaaaagaacctatacctagcaagattaagtgaatacctaaaattgttgtcattttatttctatctttccatacataaccaaaaaaaggaaaagattcttcaagagtctcaggacccagaagtgcatgataaatgccgccaaagcccaatactgcagaggaaattaagtgaagtacacccgatacaaagtatggaaaggtgtctagaacttccccaccaggacctaccccccaacctagagtagctaggtggggaagtaaaattaatccttgttcatacattggtttctccggtacaaaatgagccacttcaaataggttcattgctccggcccagaatacgattaatccagcatgagctacatgagctcccagaagtttaccggataaattgataagtcgagcattcccggcccaccaagcgaaacccgtggtttcttggtcacgaccggctaaagataaagttccattaaagagcgtttccacgtggtagaacctcctcagggaatataaggttttcatgaggctgatcttgagccgccatccaagcacgaataccttcgtttaagagaatatttttagtgtagaaagtctcaaattcaggatcttccgctgcacggatttcctgagaaacgaagtcataggcacgtagattcagagccagaccgactactccaagagcgctcatccataaaccagttactggtacaaataacataaagaaatgtaaccaacgtttattggaaaaagcaaccccaaagatttgagaccaaaagcggttagcggtgaccattgaataagtttcttcagcttgagttgggttaaaagcacggaatgtattggcaccatcaccatcttcaaataaagtattttccacagtagcgccatgaatagcgcataacagggcagcgcccaatacgccagcaactcccatcatatgaaatggattcagcgtccagttatgaaacccttggaaaaagaggatgaatcgaaatatagctgctacaccaaaactaggtgcaaaaaaccaaccagactgccctagtggataaatcaggaatacagaaacaaaaacagcaattggaccagagaatgcgattgcattataaggtcgcaattgcacggatcgagcaagttcaaattgacgtaacataaaacctattagcccgaaagcaccgtggagagcaacaaaagtccacaaaccgcctaattgacaccaacgagtaaaatctccttgggcttccggaccccatagtaataacaaagaatgtgctaaactattagcaggagtagaaactgcggcggttaagaagttgcagccttccaaataagaactggccaatccatgggtataccatgaggttacaaaggttgtacctgtgaaccaaccccctaaggcgaaataggcacaaggaaagagcaatagaccggaccaacctacaaaaacgaaacggtccctccgtaaccagtcatccataatatcaaataaatcattttcgtctttagtaaatttaccaagggctatagtcattgtgagcctcctattcaactacttcaaccatttccgagcacctcatagcatttttagggcttttgaagcttctatcattcaggtatgatttgatttttcgtacactgcccttcgaatttccaaggggtt

SEQ ID NO: 4250 - DNA, 3002 bp, Guizotia abyssinica
tcaattaagaggggtcatggaaagaacaggttcaaaatcacgatcaattcctttttcaaatcctgctgcagctgcacgagcccttcctgcgtgccacaaatgccctacgaagaagaagaatcctagaacaaaatgagaagtagctaaccaacttctaggagacacataattgactgcattgatctcggtagctactccacccacggaatttaaagaacctaaaggagcatgagtcatatattctgcggaacgacgttcttgccaaggttgtatgtcttttttcagccgactcaagtccaacccatttggaccccttagaggttctaaccaaggagcacgcaaatcccaaaagcgcatagtttctcctccaaaaatgacttctccggttggggaacgcattaaatatttacctaaaccggtaggcccttgagcggatcccacgttagctccaagacgttggtctctaactagaaaagtaaatgcttgggcttgagaagcttctggtccagtgggtccataaaactcactaggataagccgtattattgaaccagacaaaacaacaagcaatgaaaccaaagacagatatggccgctaaactataagataagtaagcctctccagaccatacaagtgcacgtcgagcccatgcgaagggtttggttaagatatgccaaattccaccaagtatacaaatggaacctaaccatacatggcctccgattatatcttccaaatcgtctacactaacaatccatccttcccccccaaagggcgattttagtaaataaccaaatatgatactcgggctaagcgtcaagttggtgatttttcttacatctcctcctcccggagcccaagtatcatatacgcccccaaaataaagagccttgaatactagaagaaaagcacctatacctaacaagattaagtgaatacctaaaattgtagtcattttatttctatctttccatacataaccgaagaatggaaaagattcttcaagcgtctcaggtcctaaaagtgcatgataaataccgccaaagcccaatactgccgaggaaattaaatgaagtactccagatacaaagtatggaaaagtatctataacttccccaccaggacctaccccccaacctagagtagctaggtggggaagtaaaattaatccttgttcatacataggcttttctggtacgaaatgagctacttcaaatagattcattgctccggccaagaatacgattaatccggcatgggctacatgagcccctagtagtttaccggataaattgataagccgggcattcccggcccaccaagcgaaaccggtggtttcttggtcacgaccagctaaagctaaagttccattaaagagcgtttccacggggtagaacctcctcagggaatataaggttttcatgaggctgatcttgagccgccatccaagcacgaataccttcgtttaagagaatatttttggtgtagaaagtctcaaattcaggatcttccgccgcgcgaatttcttgagaaacgaagtcataggcacgtaggttcaaggccagaccgactactccaagagcactcatccataaaccagttactggtacaaataaaataaagaaatgtaaccaacgtttattggaaaaagcaaccccaaagatttgggaccaaaagcgattagcagtgaccattgaataagtttcttcagcttgagttgggttaaaagcacggaatgtgtttgcgccatcaccatcttcaaataaagtattttctacggtagcaccatgaatagcgcatagcaaagcagcgcccaatacaccggcaactcccatcatatgaaatgggttcaatgtccagttatgaaatccttgaaaaaagaggataaatcgaaatatagctgctacaccaaaactaggcgcaaagaaccaaccagactgacctagtggataaattaggaatacagaaacaaaaacggcaattggaccagagaatgcgattgcattataaggtcgcaattgaacagatcgagcaagttcgaattgacgtaacatgaaacctattagtccgaaagcgccgtggagagcaacaaaagtccacagaccgcctaatgacaccaacgagtaaaatctctttgtgcttcaggaccccatagtaataacaaagaatgtgctaaactataagcaggagtagaaactgcggcagttaagaaattgcagccttccaaataggaactggccaatccatgggtataccatgaagttacaaaggttgtacccgtgaaccaaccccctacggcgaaataggcacaaggaaagagcaataggccggaccagcctacaaaaacgaaacggtccctacgtaaccagtcatccataatatcaaacaaatctttttcgtctttggtaaatttaccaagggctatagtcatcgtaatcctcctattcaactacttcgaccatttccgaacacctcatagtattttcggggcgtccaaagagtcgatcatttcgcatgatttttttctcgtgcactaccccttacaatgggtttcgaagataaaaatcctttattggcccataaattgaccacccaggtcaattcatgaattcaatttgattattccttgttattattaagcatctgaattataaattgtcttcttatgactcattaatcagatatattcgttttttgaaagaactgttcaaggaaaaagcaatcccctcgcccactaccggttgatcctcagacctgcccccatcttcttccatcaactaaatggattcttagatattgttcaggagattaagaaaaagaactctctttctattctcatttttatgtatactaaattactaagctttttatatttctttttctttgttagaaaagagatagtttccaattttttacttcacttcaatacttaacttaatacaatattcaataaaataaataggagactggaaatgagagtatttatcccgcatccattccccg

SEQ ID NO: 4251 - DNA, 2473 bp, Quercus alba
ttatattttcatttttaatgtgtctcacaacctgaaaatgaaagaattaggaggggatcatttcatttttggatctaaatagaacaaataggttcaagagatgagagaattaaggatacccaccaaaaagactaatccaatccataatgatgtaccggaaaatacaacatttttgttatttgaccaaccatcaggagaagcaaatacaacaggtacactaatcagtaagattgttgaagtagcaattaatgcaaaaacagccaattggaaagcaatagtcatctttctaatcctccaatctatcaacaaaagaaactatataccatttgatccctttattggtatcggccaaaaaattgtatcagccaaaaattctaataaaacgtatcatagagggattttaccacgaatctattaatgctgtatgacttattagcaccttttaccaccttattaaatcttattaaattaaggcatgagatcaagggaaaggtattttttttttacttcattaaaagaggcccgccagatcattatctatatatatacagatcgatagctagacccataggatcgcaccggatatctttatatatataggtcgtaatggtatcaactcatatatccatgttctattcgttagaaaataaaaaaaaaaataataaaaatagaaataatctttcggagaggtggccgagtggttgatagctccggtcttgaaaaccggtatagttcgaaacaaagaactatcgagggttcgaatccctctctctccttttttgctcgtggaatatatatatatattttttattttattggttttgtccggctcagtattagtattctaaaagggaatggctcggctagggggatagccgagccagaacagaaaaaaaagggttcaatatataatgagtcgaaaatgaaaataaaggaatactttttttttcaatacgtatgacctaacccaaccaaacaaatatgtatgatgaaatcaaatagattttgacttcaagcattagaattagatctcctgtcttagttaagaggagtcatggaaagaacaggttcaaaatcgcgatcaattcctttttcaaatcctgctgcagctgcacgagcccttcctgcatgccataaatgacctacgaataggaagaatcctagaacaaaatgagaggtagctaaccaacttctaggagagacataattgactgcattgatctcggtagctacaccacccacggaatttaaagaacctaaaggagcatgagtcatatattccgcggaacgtcgttcttgccaaggttgtatgtcttttttcagcctactcaagtccaacccattgggaccccttaggggttctaaccagggagcacgcaaatcccaaaaacgcatagtttctcccccaaaaatgacttctccagtcggagaacgcattagatatttacctaaaccggtaggtccttgggcggaccctacgttagccccaaggcgttggtctctaaccagaaaagtaaatgcttgagcttgagaagcttctggtccagtgggcccgtaaaactcactaggataagcggtattattgaaccaaacaaagcaacaagcaataaaaccaaaaacagctaaagcacctaaactataagacaagtaagcctccccagaccatacaagcgcacggcgcgcccatgcaaaaggtttggttaagatatgccagattccaccaagtatacaaatggaacccaaccatacatgccctccaattatatcttccaaatcgtccacactaacaatccatccctctcctccaaaaggggattttagtaaataaccaaatatgacgcttgggctaagggtcaagttggtaatttttcttacatctccccctcccggggcccaggtatcatatacgcctccaaaataaatagctttgaatactagaagaaaagcacctatacctaacaaaattaagtgaatacccaaaattgtagtcattttatttctatctttccatacataaccgaagaatggaaaagactcttcaagagtctcgggtcccagaagtgcgtgataaataccgccaaagcccaatactgcagaggaaattaagtgaagtactccagacacaaagtatggaaaggtatctataacttccccaccaggacctaccccccaacctagagtagctaggtggggaagtaaaattaatccttgttcatacatgggcttttctggtacgaaatgagccacttcaaataggttcattgctccggcccagaatacgattaatccggcatgggctacatgagctcccagtaatttaccggataaattgataagtcgggcattcccggcccaccaagcgaaacctgtggtttcttggtcacgaccggctaaggctaaagttccattaaagagcgttccacggggtagaacctcctcagggaatataaggttttcatgaggctgatcccat

SEQ ID NO: 4252 - DNA, 2451 bp, Quercus alba
attttaatgtgtctcacaacctgaaaatgaaagaattaggaggggatcatttcatttttggatctaaatagaacaaataggttcaagagatgagagaattaaggatacccaccaaaagactaatccaatccataatgatgtaccggaaaatacaacatttttgttatttgaccaaccatcaggagaagcaaatacaacaggtacactaatcagtaagattgttgaagtagcaattaatgcaaaaacagccaattggaaagcaatagtcatctttctaatcctccaatctatcaacaaaagaaactatataccatttgatccctttattggtatcggccaaaaaattgtatcagccaaaaattctaataaaacgtatcatagagggattttaccacgaatctattaatgctgtatgacttattagcaccttttaccaccttattaaatcttattaaattaaggcatgagatcaagggaaaggtatttttttttttactttcattaaaagaggcccgccagatcattatctatatatatacagatcgatagctagacccataggatcgcaccggatatctttatatatataggtcgtaatggtatcaactcatatatccatgttctattcgttagaataaaaaaaaaaaataaataaaatagaaataatctttcggagaggtggccgagtggttgatagctccggtcttgaaaaccggtatagttcgaaacaaagaactatcgagggttcgaatccctctctctcctttttgctcgtggaatatatatatatatttttattttattggttttgtccggctcagtattagtattctaaaagggaatggctcggctagggggatagccgagccagaacagaaaaaagggttcaatatataatgagtcgaaaatgaaaataaaggaatactttttttttcaatacgtatgacctaaccaaccaaacaaatatgtatgatgaaatcaaatagattttgacttcaagcattagaattagatctcctgtcttagttaagaggagtcatggaaagaacaggttcaaaatcgcgatcaatcctttttcaaatcctgctgcagctgcacgagcccttcctgcatgccataaatgacctacgaataggaagaatcctagaacaaaatgagaggtagctaaccaacttctaggagagacataattgactgcattgatctcggtagctacaccacccacggaatttaaagaacctaaaggagcatgagtcatatattccgcggaacgtcgttcttgccaaggttgtatgtcttttttcagcctactcaagtccaacccattgggaccccttaggggttctaaccagggagcacgcaaatcccaaaaacgcatagtttctcccccaaaaatgacttctccagtcggagaacgcattagatatttacctaaaccggtaggtccttgggcggaccctacgttagccccaaggcgttggtctctaaccagaaaagtaaatgcttgagcttgagaagcttctggtccagtgggcccgtaaaactcactaggataagcggtattattgaaccaaacaaagcaacaagcaataaaaccaaaaacagctaaagcacctaaactataagacaagtaagcctccccagaccatacaagcgcacggcgcgcccatgcaaaaggtttggttaagatatgccagattccaccaagtatacaaatggaacccaaccatacatgccctccaattatatcttccaaatcgtccacactaacaatccatccctctcctccaaaaggggattttagtaaataaccaaatatgacgcttgggctaagggtcaagttggtaatttttcttacatctccccctcccggggcccaggtatcatatacgcctccaaaataaatagctttgaatactagaagaaaagcacctatacctaacaaaattaagtgaatacccaaaattgtagtcattttatttctatctttccatacataaccgaagaatggaaaagactcttcaagagtctcgggtcccagaagtgcgtgataaataccgccaaagcccaatactgcagaggaaattaagtgaagtactccagacacaaagtatggaaaggtatctataacttccccaccaggacctaccccccaacctagagtagctaggtggggaagtaaaattaatccttgttcatacatgggcttttctggtacgaaatgagccacttcaaataggttcattgctccggcccagaatacgattaatccggcatgggctacatgagctcccagtaatttaccggataaattgataagtcgggcattcccggcccaccaagcgaaacctgtggtttcttggtcacgaccggctaaggctaaagttccattaaagagcgtttccacggggtagaacctcctcagggaatataaggttttcatgaggctga

SEQ ID NO: 4253 - DNA, 3765 bp, Quercus alba
atttcatttttaatgtgtctcacaacctgaaaatgaaagaattaggaggggatcatttcatttttggatctaaatagaacaaataggttcaagagatgagagaattaaggatacccaccaaaaagactaatccaatccataatgatgtaccggaaaatacaacatttttgttatttgaccaaccatcaggagaagcaaatacaacaggtacactaatcagtaagattgttgaagtagcaattaatgcaaaaacagccaattggaaagcaatagtcatctttctaatcctccaatctatcaacaaaagaaactatataccatttgatccctttattggtatcggccaaaaaattgtatcagccaaaaattctaataaaacgtatcatagagggattttaccacgaatctattaatgctgtatgacttattagcaccttttaccaccttattaaatcttattaaattaaggcatgagatcaagggaaaggttttttttttttactttcattaaaagaggcccgccagatcattatctatatatatacagatcgatagctagacccataggatcgcaccggatatctttatatatataggtcgtaatggtatcaactcatatatccatgttctattcgttagaaaataaaaaaaaaataataaaatagaaataatctttcggagaggtggccgagtggttgatagctccggtcttgaaaaccggtatagttcgaaacaaagaactatcgagggttcgaatccctctctctccttttttgctcgtggaatatatatatatattttttattttattggttttgtccggctcagtattagtattctaaaagggaatggctcggctagggggatagccgagccagaacagaaaaaaaagggttcaatatataatgagtcgaaaatgaaaataaaggaatacttttttttttcaatacgtatgacctaacccaaccaaacaaatatgtatgatgaaatcaaatagattttgacttcaagcattagaattagatctcctgtcttagttaagaggagtcatggaaagaacaggttcaaaatcgcgatcaattcctttttcaaatcctgctgcagctgcacgagcccttcctgcatgccataaatgacctacgaataggaagaatcctagaacaaaatgagaggtagctaaccaacttctaggagagacataattgactgcattgatctcggtagctacaccacccacggaatttaaagaacctaaaggagcatgagtcatatattccgcggaacgtcgttcttgccaaggttgtatgtcttttttcagcctactcaagtccaacccattgggaccccttaggggttctaaccagggagcacgcaaatcccaaaaacgcatagtttctccccccaaaaatgacttctccagtcggagaacgcattagatatttacctaaaccggtaggtccttgggcggaccctacgttagccccaaggcgttggtctctaaccagaaaagtaaatgcttgagcttgagaagcttctggtccagtgggcccgtaaaactcactaggataagcggtattattgaaccaaacaaagcaacaagcaataaaaccaaaaacagctaaagcacctaaactataagacaagtaagcctccccagaccatacaagcgcacggcgcgcccatgcaaaaggtttggttaagatatgccagattccaccaagtatacaaatggaacccaaccatacatgccctccaattatatcttccaaatcgtccacactaacaatccatccctctcctccaaaaggggattttagtaaataaccaaatatgacgcttgggctaagggtcaagttggtaatttttcttacatctccccctcccggggcccaggtatcatatacgcctccaaaataatagctttgaatactagaagaaaagcacctatacctaacaaaattaagtgaatacccaaaattgtagtcattttattctatctttccatacataaccgaagaatggaaaagactcttcaagagtctcgggtcccagaagtgcgtgataaataccgccaaagcccaatactgcagaggaaattaagtgaagtactccagacacaaagtatggaaaggtatctataacttccccaccaggacctaccccccaacctagagtagctaggtggggaagtaaaattaatccttgttcatacatgggcttttctggtacgaaatgagccacttcaaataggttcattgctccggcccagaatacgattaatccggcatgggctacatgagctcccagtaatttaccggataaattgataagtcgggcattcccggcccaccaagcgaaacctgtggtttcttggtcacgaccggctaaggctaaagttccattaaagagcgtttccacggggtagaacctcctcagggaatataaggttttcatgaggctgatcttgagccgccatccaagcacgaatgccttcatttaaaagaatatttttggtgtagaacgtctcaaattcaggatcttccgctgcacggatttcctgagaaacgaagtcataggcgcgtaggttcagagccaagccgactactccaagagcactcatccataaaccggttactggtacaaataacataaagaaatgtaaccaacgtttattggaaaaagcaaccccaaagatttgggaccaaaagcggttagcggtgaccattgaataagtttcttccgcttgagttgggttaaaagcacggaatgtatttgcgccatcaccatcttcaaataaagtattttctacggtagcaccatgaatagcgcatagaagggcagcgcccaatacaccggcaaccccccatcatatgaaatgggttcaatgtccaattatgaaacccttggaaaaagaggatgaatcgaaatatagctgcgacaccaaaactgggcgcaaagaaccaaccagactgacctagcggataaatcaggaatacagaaacaaaaacagcaattggagcagagaatgcgattgcattataaggtcgcaattgaacagatcgagcaagttcaaattgacgtaacatgaaacctattagtccgaaagcgccgtggagagcaacaaaagtccacagaccgcctaattgacaccaacgagtaaaaatccccttgtgcttctggaccccatagtaacaacaaagagtgtgctaaactattagcaggagtagaaactgccgcggttaagaagttgcagccttccaaataggaactcgccaatccatgtgtataccatgaagttacaaaggttgtacctgtaaaccaacctcctaacgcgaaataagcacaaggaaagagcaatagaccggaccaacctacaaaaacgaaacggtccctccgtaaccagtcatccataatatcaaataatcatttcgtctttggtaatttcccaagggctatagtcatagtgatcctcctattcaactacttcaaccatttttcgaacacctcatagaattttcagggcgttcaagacgtctatcatttctatatgatttgatttctcgtacactaccccttctttctaatgggttttcgaatctaaaaatcatttattggtacataacctgactgaggtaaatccatgacttcaattcagttctttttttctagtctgactaaccaaccacctgaaccttgaattgccttgtcttatgactcatcgatcaaatagattaattttttgaaaagaactgttatacgtgtcgt

SEQ ID NO: 4254 - DNA, 3447 bp, Quercus alba
tccggctcagtattagtattctaaaagggaatggctcggctagggggatagccgagccagaacagaaaaaaaagggttcaatatataatgagtcgaaaatgaaaataaaggaatactttttttttcaatacgtatgacctaacccaaccaaacaaatatgtatgatgaaatcaaatagattttgacttcaagcattagaattagatctcctgtcttagttaagaggagtcatggaaagaacaggttcaaaatcgcgatcaattcctttttcaaatcctgctgcagctgcacgagcccttcctgcatgccataaatgacctacgaataggaagaatcctagaacaaaatgagaggtagctaaccaacttctaggagagacataattgactgcattgatctcggtagctacaccacccacggaatttaaagaacctaaaggagcatgagtcatatattccgcggaacgtcgttcttgccaaggttgtatgtcttttttcagcctactcaagtccaacccattgggaccccttaggggttctaaccagggagcacgcaaatcccaaaaacgcatagtttctcccccaaaaatgacttctccagtcggagaacgcattagatatttacctaaaccggtaggtccttgggcggaccctacgttagccccaaggcgttggtctctaaccagaaaagtaaatgcttgagcttgagaagcttctggtccagtgggcccgtaaaactcactaggataagcggtattattgaaccaaacaaagcaacaagcaataaaaccaaaaacagctaaagcacctaaactataagacaagtaagcctccccagaccatacaagcgcacggcgcgcccatgcaaaaggtttggttaagatatgccagattccaccaagtatacaaatggaacccaaccatacatgccctccaattatatcttccaaatcgtccacactaacaatccatccctctcctccaaaaggggattttagtaaataaccaaatatgacgcttgggctaagggtcaagttggtaatttttcttacatctccccctccggggcccaggtatcatatacgcctccaaaataaatagctttgaatactagaagaaaagcacctatacctaacaaaattaagtgaatacccaaaattgtagtcattttatttctatctttccatacataaccgaagaatggaaaagactcttcaagagtctcgggtcccagaagtgcgtgataaataccgccaaagcccaatactgcagaggaaattaagtgaagtactccagacacaaagtatggaaaggtatctataacttccccaccaggacctaccccccaacctagagtagctaggtggggaagtaaaattaatccttgttcatacatgggcttttctggtacgaaatgagccacttcaaataggttcattgctccggcccagaatacgattaatccggcatgggctacatgagctcccagtaatttaccggataaattgataagtcgggcattcccggcccaccaagcgaaacctgtggtttcttggtcacgaccggctaaggctaaagttccattaaagagcgtttccacggggtagaacctcctcagggaatataaggttttcatgaggctgatcttgagccgccatccaagcacgaatgccttcatttaaaagaatatttttggtgtagaacgtctcaaattcaggatcttccgctgcacggatttcctgagaaacgaagtcataggcgcgtaggttcagagccaagccgactactccaagagcactcatccataaaccggttactggtacaaataacataaagaaatgtaaccaacgtttattggaaaaagcaaccccaaagatttgggaccaaaagcggttagcggtgaccattgaataagtttcttccgcttgagttgggttaaaagcacggaatgtatttgcgccatcaccatcttcaaataaagtattttctacggtagcaccatgaatagcgcatagaagggcagcgcccaatacaccggcaaccccccatcatatgaaatgggttcaatgtccaattatgaaacccttggaaaaagaggatgaatcgaaatatagctgcgacaccaaaaactgggcgcaaagaaccaaccagactgacctagcggataaatcaggaatacagaaacaaaaacagcaattggagcagagaatgcgattgcattataaggtcgcaattgaacagatcgagcaagttcaaattgacgtaacatgaaacctattagtccgaaagcgccgtggagagcaacaaaagtccacagaccgcctaattgacaccaacgagtaaaatccccttgtgcttctggaccccatagtaacaacaaagagtgtgctaaactattagcaggagtagaaactgccgcggttaagaagttgcagccttccaaataggaactcgccaatccatgtgtataccatgaagttacaaaggttgtacctgtaaaccaacctcctaacgcgaaataagcacaaggaaagagcaatagaccggaccaacctacaaaaacgaaacggtccctccgtaaccagtcatccataatatcaaataaatcattttcgtctttggtaaatttcccaagggctatagtcatagtgatcctcctattcaactacttcaaccattttcgaacacctcatagaattttcagggcgttcaagacgtctatcatttctatatgatttgatttctcgtacactaccccttctttctaatgggtttcgaatctaaaaatcatttattggtacataacctgactgaggtaaatccatgacttcaattcagttctttttttctagtctgactaaccaaccacctgaaccttgaattgccttgtcttatgactcatcgatcaaatagattaattttttgaaagaactgttcaagaaacaagtgattccttttctcgctaccagttgatccccagacatattcctctcgtttcatcaaccaatcttattcttgaatctcgtttgtgagattgataaaaataaatatctttatgtattccgtataatttctatgtgtattaaactacttattaaactactatagtatcatatattttattacgttatactttaactctttcattttcttttattgtgttatatttctttttctctcatatgaatatacaactcggaagtatatcttttcgcggttcaaagcaagcaatgcacttcgaagtatttttttctatttacctttatctgtcagaaaaatcataaaaaggagaattcatttcctttaatttttattttaatattgatattgtatttaatttaataataaaaactgtaaatgaaagcagctttctcgcatacattttgatcccgttgtcggaacaaaatttcgcatgtatcgatatggaaatatttggtacatgaataca

SEQ ID NO: 4255 - DNA, 2031 bp, Quercus alba
acacgtagtatgtcgtaatggtatcaactcatatatccatgttctattcgttagaaataaaataataaaatagaaataatctttcggagaggtggccgagtggttgatagctccggtcttgaaaaccggtatagttcgaaacgaagaactatcgagggttcgaatccctctctctccttttgtctcgtggaatatatatatatatttttattttattggtttgtccggctcagtattagtattctaaaagggaatggctcggctagggggatagccgagccagaacagaaaaaaaagggttcaatatataatgagtcgaaaatgaaaataaaggaatacttttttttttctaatacgtatgacctaacccaacccaaacaaatatgtatgatgaaatcaaatagattttgacttcaagcattagaattagatctcctgtcttagttaagaggagtcatggaaagaacaggttcaaaatcgcgatcaatcctttttcaaatcctgctgcagctgcacgagcccttcctgcatgccataaatgacctacgaataggaagaatcctagaacaaaatgagaggtagctaaccaacttctaggagagacataattgactgcattgatctcggtagctacaccacccacggaatttaaagaacctaaaggagcatgagtcatatattccgcggaacgtcgttcttgccaaggttgtatgtcttttttcagcctactcaagtccaacccattgggaccccttaggggttctaaccagggagcacgcaaatcccaaaaacgcatagtttctcccccaaaaatgacttctccagtcggagaacgcattagatatttacctaaaccggtaggtccttgggcggaccctacgttagccccaaggcgttggtctctaaccagaaaagtaaatgcttgagcttgagaagcttctggtccagtgggcccgtaaaactcactaggataagcggtattattgaaccaaacaaagcaacaagcaataaaaccaaaaacagctaaagcacctaaactataagacaagtaagcctccccagaccatacaagcgcacggcgcgcccatgcaaaaggtttggttaagatatgccagattccaccaagtatacaaatggaacccaaccatacatgccctccaattatatcttccaaatcgtccacactaacaatccatccctctcctccaaaaggggattttagtaaataaccaaatatgacgcttgggctaagggtcaagttggtaatttttcttacatctccccctcccggggcccaggtatcatatacgcctccaaaataaatagctttgaatactagaagaaaagcacctatacctaacaaaattaagtgaatacccaaaaattgtagtcatttttatttctatctttccatacataaccgaagaatggaaaaagactcttcaagagtctcgggtcccagaagtgcgtgataaataccgccaaagcccaatactgcagaggaaattaagtgaagtactccagacacaaagtatggaaaggtatctataacttccccaccaggacctaccccccaacctagagtagctaggtggggaagtaaaattaatccttgttcatacatgggcttttctggtacgaaatgagccacttcaaataggttcattgctccggcccagaatacgattaatccggcatgggctacatgagctcccagtaatttaccggataaattgataagtcgggcattcccggcccaccaagcgaaacctgtggtttcttggtcacgaccggctaaggctaaagttccattaaagagcgtttccacggggtagaacctcctcagggaatataaggttttcatgaggctgatcttgagccgccatccaagcacgaatgccttcatttaaaagatatttttggtgtagaacgtctcaaattcaggatcttccgctgcacggatttcctgagaaacgagtcataggcgcgtaggtcagagccaagccgactactccaagagcactcatccat

SEQ ID NO: 4256 - DNA, 1729 bp, Olea europaea
aagtataacccgatcccaatatgtatgatagaatcaaagtgattcttacttcaatccaagcattggatctcctgtctcatctcaattaagaggggtcatggaaagaacaggttcaaaatcacgatcaattcctttttcaaatcctgctgcagctgcacgagcccttcccgcgtgccacaaatgacctacgaagaaaaagaatcctagaacaaaatgagaggtagctaaccaacttctaggagagacataattaactgcattaatctcggtagctacgccacccacagaatttaaagaacctaaaggagcatgagtcatatattctgcggaacgccgttcttgccaaggttgtatgtcttttttcaacctactcaagtccaatccatttggacctcttagaggttctaaccagggagcacgcagatcccaaaaacgcatagtttctcctccaaaaatgacttctccggttggggaacgcattagatatttacctaaacctgtaggtccttgcgcagatcctacattagccccaagacgttggtctctaactagaaaagtaaatgcttgagcttgagaagcttctggtccagtaggtccgtaaaactcgctaggataagcggtattattgaaccagacaaaacaacaagcagtgaaaccaaagatggataaagcccctaaactataagataagtaagcctccccagaccatacaagagcgcgtcgagcccatgcgaagggtttggttaagatatgccagattccaccaagtatacaaatggaacctaaccatacatgtcctccgattatatcttctaaatcgtccacactaacaatccatccttcccctccaaagggcgattttagtaaataaccaaatataatacttgggctaagggtcaagttggtaatttttcttacatctccccctcccggagcccaagtatcatatacgcccccaaaataaagagccttgaatactagaagaaaagcacctagacctaacaagattaagtgaatacctaaaattgtggtcattttatttctatctttccatacataaccgaagaatggaaaagattcctcaagtgtctcaggtcccagaagtgcatgataaataccgccaaagcccaatactgcagaggaaattaaatgaagtactccagatacaaagtagggaaaggtgtctataacttccccccaggacctaccccccaacctagagtagctagatggggaagtaaaattaatccttgttcatacataggcttctctggtacgaaatgagccacttcaaataggttcattgctccggcccagaatacgattaatccggcgtgggctacatgagctcctagtagtttaccggacaaattaataagtcgagcattcccggcccaccaagcaaaaccggtggtttcttggtcacgaccagttacagctaaagttccattaaagagcgtttccacgtggtagaacctcctcagggaatataaggttttcatgaggctgatcttgagctgccatccaagcacgaataccttcgtttaatagaatatttttggtgtagaaagtttcaaattcaggatcttccgctgcgcgaatttcctgagaaacgaagtcataggcgcgtaggttcagggccagaccgactactccaagagcactcatccataaaccggttactggtacaaataacataaagaaatgtaaccaacgtttattggaaaaa

SEQ ID NO: 4257 - DNA, 3771 bp, Helianthus annuus
ggggacttatattgaatgtgaatgtgtaagaataattcagagggccatttcggttttggatctaggacaataggttcaagagatgagagaattaaggatacccaccagaaagactaatccaatccataatgatgtacctgaaaatacaacatttttgttacttgaccaaccatcaggagaagcaaatacaacgggtacgccaatcaataagattgatgaagtagcaattaatgcaaaaacagccaattggaaagcaagagtcatgcttttaatcctccaagctaccaacaaatgaactataccatttgatccctatatcggccaaaaattgtactaaaatacatcatacagggattttaccacgaatccattgattctatatgatttattatattactacccctttaccactttattcgtacatggagtcgggggagaatggaattttgtttttttttttttttttacaaatgggcatgctggatcatatatctatccatatatcgggatagatagattgaccatcacacccgagatctttgatagtggcggtatccactcatatggcgatgttctattcggaggaataaaataaaattgtctttcggagagatggctgagtggttgaaagccccggtcttgaaaaccggtatagtttactatcgagggttcgaatccctctctctccttttttgcttgttgaatagatttgtttctttattggattggttttgaccggacggtttcattatcataaagaaagggaagtggctcggctatcccgcctagccaagccagaaaaatggattaaatataaatgagttgaaaaaagattctttttttttatgacatgatcctatatgtatgagggaaccgaagtgactcctatttcaagtctttgatctcctgtctcaattaactgcctcaataaactgtctcaattaagaggggtcatggaaagaacaggttcaaaatcacgatcaattcctttttcaaatcctgctgcagctgcacgagctcttcctgcgtgccacaaatgtcctacgaagaagaagaatcctagaacaaaatgagaagtagctaaccaacttctaggagacacataattgactgcattgatctcggtagctactccacccacggaatttaaagaacctaaaggagcatgagtcatatattctgcggaacgacgttcttgccaaggttgtatgtcttttttcagccgactcaagtccaacccatttggaccccttagaggttctaaccaaggagcgcgcaaatcccaaaaacgcatagtttctcctccaaaaatgacttctccggtcggggaacgcattaaatatttacctaaaccggtaggcccttgagcggatcctacgttagctccaagacgttggtctctaactagaaaagtaaatgcttgagcttgagaagcttctggtccagtgggtccataaaactcactaggataagccgtattattgaaccagacaaaacaacaagcaatgaaaccaaagacagatatagccgctaaactataagataagtaagcctctccagaccatacaagtgcacgtcgagcccatgcgaagggtttggttaagatatgccaaattccaccaagtatacaaatggaacctaaccatacatggcctcctattatatcttccaaatcgtctacactaacaatccatccttcccccccaaagggcgattttagtaaataaccaaatatgatacttgggctaagcgtcaagttggtgatttttcttacatctcctcctcccggagcccaagtatcatatacgcccccaaaataaagagccttgaatactagaagaaaagcacctagacctaacaagattaaatgaatacctaaaattgtggtcattttatttctatctttccatacataaccgaagaatggaaaagattcttcaagcgtctcaggtcctaaaagtgcatgataaataccgccaaagcccaatactgcagaggaaattaaatgaagtactccagatacaaagtatggaaaagtatctataacttccccaccaggacctaccccccaacctagagtagctaggtgaggaagtaaaattaatccttgttcatacataggcttttctggtacgaaatgagccacttcaaatagattcattgctccggcccagaatacgattaatccggcatgggctacatgagcccctagtagtttaccggataaattgataagccgggcattcccggcccaccaagcgaaaccggtggtttcttggtcacgaccagctaaagctaaagttccattaaagagcgtttccacggggtagaacctcctcagggaatataaggttttcatgaggctgatcttgagccgccatccaagcacgaataccttcgtttaagagaatatttttggtgtagaaagtctcaaattcaggatcttccgccgcgcgaatttcttgagaaacgaagtcataggcacgtaggttcaaggccagaccgactactccaagagcactcatccataaaccagttactggtacaaataacataaagaaatgtaaccaacgtttattggaaaaagcaaccccaaagatttgggaccaaaagcgattagcagtgaccattgaataagtttcttcagcttgagttgggttaaaagcacggaatgtatttgcgccatcaccatcttcaaataaagtattttctacggtagcaccatgaatagcgcatagcaaagcagcgcccaatacaccggcaactcccatcatatgaaatgggttcaatgtccagttatgaaatccttgaaaaaagaggataaatcgaaatatagctgctacaccaaaactaggcgcaaagaaccaaccagactgacctagtggataaatcaggaatacagaaacaaaaacggcaattggaccagagaatgcgattgcattataaggtcgcaattgaacagatcgagcaagttcgaattgacgtaacatgaaacctattagtccgaaagcgccgtggagagcaacaaaagtccacagaccgcctaattgacaccaacgagtaaaatctccttgtgcttcaggaccccatagtaataacaaagaatgtgctaaactattagcaggagtagaaactgcggcagttaagaaattgcagccttccaaataggaactggccaatccatgggtataccatgaagttacaaaggttgtacccgtgaaccaaccccctacggcgaaataggcacaaggaaagagcaataggccggaccagcctacaaaaacgaaacggtccctacgtaaccagtcatccataatatcaaacaaatcattttcgtctttggtaaatttaccaagggctatagtcatcgtaatcctcctattcaactacttcgaccatttccgaacacctcatagtattttcggggcgtccaaagagtcgatcatttctgcatgatttttttctcgtgcactaccccttacaatacaatgggtttcgaagataaaaatcctttattggattggcccataaattgaccacccaggtaaattcatgaattcaaattgattattccttacttattattaagcatctgaatcatgaattgtcttgttatgactcatgaatcagatctattcgttttttgaaagaactgttcaaggaaaaagcaatcccctcgcccactaccggttgatcctcagacctgcccccatccttttccatcaactaaatagattcttagatcttgttcatgagattaagaaaaagaac

SEQ ID NO: 4258 - DNA, 1904 bp, Arabidopsis lyrata
gtgcttggatggcggctcaagatcagcctcatgaaaaccttatattccctgaggaggttctaccacgtggaaacgctctttaatggaactttagctttagctggtcgtgaccaagaaaccaccggtttcgcttggtgggccgggaatgcccgacttatcaatttatctggtaaactattgggagctcatgtagcccatgccggattaatcgtattctgggccggagcaatgaacttatttgaagtggcccattttgtacccgaaaagcccatgtatgaacaaggattaattttacttccccacctagccactttaggatggggggtaggtcctgggggagaagttatagacacctttccgtactttgtatctggagtacttcacttaatttcttctgcagttttgggctttggcggtatttatcatgcacttctgggacccgaaactcttgaagaatcttttccctttttcggttatgtatggaaagatagaaataaaatgaccaccattttgggtattcacttaattttgttaggtgtaggtgcctttcttctagtattcaaggctctctattttgggggcgtatatgatacctgggctccgggagggggggatgtaagaaaaattacaaacttgactcttagcccaagtgttatatttggttatttactaaaatctccctttgggggagaaggatggattgttagtgtggacgatttggaagatataattggagggcatgtatggttaggttccatttgtatatttggtggaatctggcatatcttaaccaagccttttgcatgggctcgccgcgcacttgtatggtctggggaggcttacttgtcttatagtttagctgctttatctgtttgtggtttcattgcttgttgttttgtctggtttaataataccgcttaccctagtgagttttacggacctacggggccagaagcttctcaagctcaagcatttacttttctagttagagaccaacgtcttggagctaacgtggggtctgctcaaggacctacaggtttaggtaaatacttaatgcgttctccgactggagaagttatttttggaggagaaacaatgcgcttttgggatctgcgtgctccctggttagaacctttaaggggtcctaacggtttggacttgagtaggttgaaaaaagacatacaaccttggcaagaacgacgttcggcagaatatatgactcatgctcctttaggttccttaaattctgtagggggcgtagctactgagatcaatgcagtcaattatgtctccccgagaagttggttatctacctctcattttgttctaggatttttcctattcgtgggtcatttatggcacgcgggaagggctcgggcagcggcagcgggatttgaaaaaggaattgatcgtgattttgaacctgttctttccatgactcctcttaactaaagtagtaggtaaaacaggaaagtaaaactcggttcatatttaaaagtcttctttgtttctttcaattcaatctaaatttttctggctcggctatactatccagccgagccattctcctttatttatcatgctaagaagtaaaaaaagccaataaagataaaaatagattcatccaacaaaaggagagagagagggattcgaaccctcgatagttatttttatgaactataccggttttcaagaccggagccatcaaccgctcggccatctctccgaaagataatttctattttatttttttttcgccaaatagaacatagccctatgagttaatacggtcactatgtagagaaagatatagggtgtgactttctttaataggtctataaatctggctatataaataaatgagatacgcgatccagtatacccatttgtgaagtcaaaaagaa

SEQ ID NO: 4259 - DNA, 7385 bp, Arabidopsis thaliana
ttgaagtagatgaataggaggatcgctatgactatagcccttggtaaatttaccaaagacgaaaaagatttatttgatattatggatgactggttacggagggaccgcttcgtttttgtaggttggtctggtctattgctctttccttgtgcctatttcgctttagggggttggttcacaggtacaacctttgtaacttcatggtatactcatggattggccagttcctatttagaaggttgcaattttttaaccgctgcagtttctactcctgctaatagtttagcgcattctttgttgttactgtggggtcctgaagcacaaggagattttactcgttggtgtcaattaggtggtctatgggcttttgttgctctccacggcgctttcgcattaataggttttatgttacgtcaatttgaacttgctcgatctgttcaattgcgaccttataatgcaatcgcattctctggtcccattgctgtttttgtttctgtcttcctaatttatccactaggtcaatctggttggttctttgcgcctagttttggtgtagcggctatatttcgattcatcctctttttccaagggtttcataattggacattgaacccatttcatatgatgggagtcgccggtgtactgggcgcggctctgctatgcgctattcatggtgctactgtagaaaatactttatttgaagatggtgatggtgcaaatacattccgtgcttttaacccaactcaagccgaagaaacttattcaatggtcaccgctaaccgcttttggtcacaaatctttggggttgctttttccaataaacgttggttacatttctttatgttatttgtaccggtaactggtttatggatgagtgctcttggagtagtcggtttagctttgaacctacgtgcctatgacttcgtttcccaggaaatccgtgcagcggaagatccagaatttgagactttctatactaaaaatattcttttaaacgaaggtattcgtgcttggatggcggctcaagatcagcctcatgaaaaccttatattccctgaggaggttctaccacgtggaaacgctctttaatggaactttagctttagctggtcgtgaccaagaaaccaccggtttcgcttggtgggccgggaatgcccgacttatcaatttatctggtaaacttttgggagctcatgtagcccatgccggattaatcgtattctgggccggagcaatgaacttatttgaagtggcccattttgtacctgaaaagcccatgtatgaacaaggattaattttacttccccacctagccactttaggatggggggtaggtcctgggggagaagttatagacacctttccgtactttgtatctggagtacttcacttaatttcttctgcagttttgggctttggcggtatttatcatgcacttctgggacccgaaactcttgaagaatcttttccctttttcggttatgtatggaaagatagaaataaaatgaccaccattttgggtattcacttaattttgttaggtgtaggtgcctttcttctagtattcaaggctctctattttgggggcgtatatgatacctgggctccgggagggggggatgtaagaaaaattacaaacttgactcttagcccaagtgttatatttggttatttactaaaatctccctttgggggagaaggatggattgttagtgtggacgatttggaagatataattggaggacatgtatggttaggttccatttgtatatttggtggaatctggcatatcttaaccaagccttttgcatgggctcgccgcgcacttgtatggtctggggaggcttacttgtcttatagtttagctgctttatctgtttgtggtttcattgcttgttgttttgtctggtttaataataccgcttaccctagtgagttttacggacctacggggccagaagcttctcaagctcaagcatttacttttctagttagagaccaacgtcttggagctaacgtggggtctgctcaaggacctacaggtttaggtaaatacttaatgcgttctccgactggagaagttatttttggaggagaaacaatgcgtttttgggatctgcgtgctccctggttagaacctttaaggggtcctaacggtttggacttgagtaggttgaaaaaagacatacaaccttggcaagaacgacgttcggcagaatatatgactcatgctcctttaggttcgttaaattctgtagggggcgtagctactgagatcaatgcagtcaattatgtctctccgagaagttggttatctacctctcattttgttctaggatttttcctattcgtgggtcatttatggcacgcgggaagggctcgggcagcggcagcgggatttgaaaaaggaattgatcgtgattttgaacctgttctttccatgactcctcttaactaaagtagtaggtaaaacaaataggttcatattaaaaagtcttctttgtttctttcaattcaatctaaatttttctggctcggctatactatccagccgagccagaaaaatttatttatcatgctaagaagtaaaaaaagccaataaagagaaaaatagattcatccaacaaaaggagagagagggattcgaaccctcgatagttatttttatgaactataccggttttcaagaccggagccatcaaccactcggccatctctccgaaagataatttctattttatttttttttcgccaaatagaacatagccctatgagttaatacgatcactatgtagagaaagatatagggtgtgactttctttaataggtctataaatctggctatataaataaatgagatacgcgatccagtatacccgtttgtgaagtaaaaaagaacctttaacttcatgtccgaatagactaaaagtggtaaaaagaaattggaactaagtcatctcgaatcaacggattcatgataaaatccctttatttattaaaaatttttagtgggtaagaggattaaatggtgtatattcttttgttaatagcttggaggattaaaaacatgactattgctttccaattggcagtttttgcattaattattacttcatcaatcttactgattagtgtacccgttgtatttgcgtctcctgatggttggtcgagtaacaaaaatgttgtattttctggtacatctttatggattggattagtcttcttggtgggtatccttaattctcttatctcttgaattcattcgttgcagatccaaaaatgagatgaccccctcccattccttgaattacacattcaaattcaatataagtccataaaatgcaaataaagaaaaaattagagggggggtcgaacttatggaacttgaatgaaatatgaataaaagattaataaatagttactaaatatgaaatagttcctaaatatgaaatagtaataaaaaaaaataaataaaaaaaacgaataaaaaattgagatctgatatcaagtcaatatagaatataatattttatggaaatataagaataatatattcttgaatctggaattcaatattaaattaaattaatattcaagaattaatattaatatattaatatatagaataaatataatatatattattaatatatatatttataatatatatatatatattaatagaattgttaattgaatttatttggtggtagaattttatgaaatgaccccaaaccaaagagtgtatctcgtctagctttgaacaaatattatccataaatttcttataaagaagggcaaaaaatgcggatatagtcgaatggtaaaatttctccttgccaaggagaagacgcgggttcgattcccgctatccgcccaaatataaatggattcaaaaagagaaaatattcggtatagttgaccgggaaatattgtaattttttcctcgcgtcccaaaagacacgtattaatttatgacttgttagtagaatcaaacttacatttcttgaaaaaaaaaagttgcggagacaggatttgaacccgtgacctcaaggttatgagccttgcgagctaccaaactgctctaccccgcgctgaaacaaaaaaacttggactaaactctaataaacaaagaataattgaaggagcccctcttccatatctgtacaaatagaatagcctatttagacagaatggtaaaggggcctcatcgatcatagaaaaaaatagaaaaattaagggatacttaaatccttaccagcttgatcttgttgcccctggcaacaaacatgcctgaaccatttcccgaaggatgtgtccagatagtccaaagtctcgatagttagctctcggtcttccggtcgaaaagcaacgtcgatgaagacgtgtaggtgcactattacgcggtggggattgtaattttccatgaattttccatttctcacttagcgacggaatcttacttatttccttttttaaggatcgacgaatcaaatgatattttttttccaatttttgcctcttcttctccctataaatcaaacttttctttgccataatgcttcagttcctgttattatcaatgataatgatacaaatcggatcctagatgtagaaataaatataagagtgcatacctatattttttttattaaaaaaaatatatgattgcggatagaatacataaataattaaccgaatttgcccgatgtggaggcaatcaagaaagccgcataagtgaatatataacctacagaaaagtgagctaatccaaccaatcttgcttgcacgattgaaagagctactggtttatctttccagcgaatcaaatttgccaaaggtgtgcgttcatgagcccacgctaaagtttcaatcaattcctgccaataaccacgccaggaaattaagaacataaatcctgtagcccaaacaagatgcccaaataagaacatccatgcccagactgataaactattcataccaaacgggttatatccattgataagttgtgaagagtttaaccatagataatctcttaaccatcccatcaaataagtggaagattcattaaactgtgaaacgttaccctgccataatgtgatgtgtttccaatgccaataaaaagtaacccatccaatagtatttaacatccagaaaactgccaaataaaatgcgtcccaagccgaaatatcacaagtaccacctcgtcccggaccatcgcaaggaaaactatacccgaaatcctttttatctggcattaacttggaaccacgtgcatctaaagcaccttttactaagatcaatgtagttgtatgtaaacctaaagcaatagcatgatgaaccaagaaatctccaggacctattgttaagaataatgaattactattctcattaatagcatttaaccagccaggcaaccatatgctgcgacccgcattaaatgctgggccacttgtcgaagataaaagtacatcaaatccatatgaagttttcccatgagcagattgtatccattgggcaaatataggttcgatcaagatttgtttttcgggagtaccaaaagcaagcatgacgtcgttatgaacataaagtcccaaagtatggaaccctagaaagaggctggcccaacttaaatgggatatgatagcttctttatggtctaacattcttgctaatacgttatcctcattctgttctggattgtaatctctaataaaaaagatagctccatgagcaaaagctcctgtcatgatgaatcctgcaatatattggtgatgggtatataacgcagcttgagtcgtaaaatcttgcgctatgaacgcataagcaggtaaagagtacatgtgttgagctaccaaggaagtaataactcctaaggaggctagagcaaggcctaattgaaaatgaatcgaattattgattgtgtcataaagacccttatgcccacgccccaatcgtcctcccggaggaatatgtgcttctaaaagatcttttatactgtgtccgattccaaagttcgttctatacatatgacccgcaatgaggaaaagaattgcgatagctaaatgatgatgtgccatatcggttagccataaactttgcgtttgtggatggaatcccccaagaagggttagaatggcagttccggatccttgggaggtaccaaataaatgactactcgagtcggggttttgagcataaagattccactgacccgtaaaaagtgggcctaacccttggggatgcggtaatacatttaagaaattattccatcgaacatattcccccctggatgcaggaatagcgacatggactaaatgacctgtccaagccaatgagcttaccccgaatagtcctgacaaatgatgattcagacgagattcagcatttttgaaccacgaaactcttggtttccattttggttgtaggtgtaaccaaccccctattaaggatagggcagaaagaaataatagaaaaagagctccagtataaagatcttcattagtacgtaaaccgattgtataccaccactgataaacaccagaataagctatattcaccgggccaagagcacctcctcgagtaaacgcttccacagccggttgaccaaaatgaggatcccaaatagcatgagcaatcggtcttacatgtaaagggtcttgtacccatgtctcaaaatttccttgccaagctacatgaaacaaatttccggaagtccacagaaaaattattgctaattgcccgaaatgagaagcaaaaatattctgataaagacgttcttcagtaatatcatcatgactctcgaagtcatgtgcggtagcaataccaaaccaaatacgacgagtagtggggtcctgagctaagccttggctaaaccttggaaatcttaatgccataatgcctttcaaatcctcctagccattatcctactgcaataattcttgctaagaagaacgcccatgttgtggcaattccacccattaatagtaatggaactctgtgcaaagtttcctccagtaatatgagttaccaccccttgatcacttatactaccccaaacatctgactgcattttccaactgaaatggaatattactacggaaatagcattgtacatccagaatagtcctaagaagacatgatcccaagcagatacttgacatgttcctcctcttcccggcccatcacaagggaaacgaaaaccaagatttgctttatctggtattaaacgcgagctacgagcaaatagaacacctttcaacagtatcaataccgtcacatgaattgtaaatgcatgaatatgatgtaccaaaaaatctgccgttcctaatggaataggtaacaaagctactttgccacccactgctactaactcaccgcccccc

SEQ ID NO: 4260 - DNA, 1831 bp, Amborella trichopoda
atgaaaaccttatattccctgaggaggttctaccccgtggaaacgctctttaatggaactttagctttagctggtcgtgaccaagaaaccacaggttttgcttggtgggccgggaatgcccgacttatcaatttgtctggtaaattactcggggctcacgtggcccatgccggattaatcgtattctgggcgggagcaatgaatctatttgaagtggctcattttgtaccagagaaacctatgtatgaacaaggattaattttacttccccatctagctactctaggttggggggtaggtcctgggggggaagttatagacacctttccatactttgtatctggagtacttcatttaatttcctctgcagtcctaggctttggtggtatttatcatgcacttcttggacctgagactcttgaagaatcctttccattcttcggttatgtatggaaagatagaaataaaatgaccactattttgggtattcacttaattttattaggtgtaggcgcttttctcctagtgttcaaggctctttattttggaggcgtatatgatacctgggcccccggtggcggagatgtaagaaaaataaccaacctgacacttagcccaagtgttatatttggttatttgctaaaatctccttttgggggagaaggatggattgttagtgtggatgatttagaagatataattggaggacacgtatggttaggtttcatttgtatacttggtggaatatggcatatcttaaccaaaccttttgcgtgggctcgccgcgcatttgtatggtctggagaagcttacttgtcttatagtttgggggctttatctatctttggtttcattgcttgctgtttcgtctggttcaataatacggcttatcctagtgagttttacggtcctaccggcccagaagcttctcaagctcaagcgtttacttttctagttagagaccaacgtcttggggctaacgtaggatctgctcaaggacccaccggtttaggtaaatatctaatgcgttctccaactggggaggtcatttttggaggagaaactatgcgcttctgggatctccgtgctccctggttggaaccactaaggggtcccaacggtttggacttgagtaggctgaaaaaagacatacagccctggcaagaacgacgttcggcggaatatatgactcatgctcctttaggttctttaaattccgtgggcggcgtagctacagagatcaatgcagtcaattatgtctctcccagaagttggttagctacctctcattttgttctaggatttttcctattcgtgggtcatttgtggcatgcaggaagggcccgtgcagctgcagcaggatttgaaaaaggaatcgatcgtgattttgaacctgttctttccatgactcctcttaactgagacggtagatcaaatagatgaagtaggaatcaatttggattccacggtacatatttggatcaggtcatacttaaaaaaaaaggggggaatcttttttttttttcaactcatttctatttgtggctcggctattccccttagtcgagccttctcctttatgcacatactggcccagcccaaaccaaaaaccaataaagaaatattcaacgagcaaaaggagagagagggattcgaacccacgagagttctttgttcggaactataccggttttcaagaccggagctatcaaccactcagccatctctcccagagacaatctccatcttattcccacggataggacccggcttcggcatagagttgataccataactatctgtagaaactcccatgtacggtatttcaatt

SEQ ID NO: 4261 - DNA, 5003 bp, Arabidopsis lyrata
agaaaatgattgttcagaggataatccgtatctcttcatcacatgtcaagataaaatatcttgggtgtatgtcaacttgctgagtacatgtataaatcaaatgaatttcgttcgatttcgatgcggtaggcaatttcaaaaaaaaatgcattgcatggatatttatcaaatccaatattaaaaaagcaaaaaataccccgttaagtaattttgaagtaaattcaaattctcatttctagttccgaaatgagctactaaccactatgcgtctattgtatatatatttaatatatatatagatagattttatttacctacccactcagtcgggaattaaaccaagacggcccttttaactcagtggtagagtaacgccatggtaaggcgtaagtcatcggttcaaatccgataaggggcttttacgttctttactttctaatagtcaaaatttcattcgaaagtgtataatttaatttctaattttgttaatttcattctaataaatttcattctaataataactaataataaagttagcgagtaatttcaaaaatcaaattgaacatttttatattataatacaatgaataatgataagtcgtctcttgaatcgccaaatatatattctttttttttttttgatttgtcgatagattagaaatcgacaaatcaaaaagaaaaagtaagtggacctaacccatcgaatcatgactatatccactattctgatattcaaattcgatagagattaaattgaaacagtaggttttttttatttcatatttttgtattaggaaatccgtcgatatctcttattgaatcttcttgtttctatatatttcataggaaatatattgcgttcctgcctagagaaagaaagtcttatttcaaagtaataactaaaagggcatttcaatattttttttgattcgagaacataacaagatcctacattctctttgtataagaatcaaattgtattaaaaataaacaaaaatcgaatcataatcatggcttcagatatcaattaaatatttccatattgatgcatacgagatgacaatgtaatgtgatcgaaagtgtatgtgagaaagaaactctcatttacagtttcctataattttatttaaatattgaattaaatataaataagaaattttcccctttttttacagatacataagggtataaaaaaaaaaaaaaaagatttctttatctgaataatgaatcatccgacaattcatgatttagattcaactacttatacttattaataaactaatagcaaggaagaaacaaattgagttgatgcgtttacctaagtaaggaccaataaaatcaaatattttgatcttcgaaaccaattaaattaaattctaagggttccattttatggggcagtgcgcgagaaatcaaatcataaacaaatgatagaatttcgagcgccctgaaaatgccataatatataacatcaaaatatataacattaaggtgttcggaaatggttgaagtagatgaataggaggatcgctatgactatagcccttggtaaatttaccaaagacgaaaaagatttatttgatattatggatgactggttacggagggaccgcttcgtttttgtaggttggtctggtctattgctctttccttgtgcctatttcgctttagggggttggttcacaggtacaacctttgtaacttcatggtatactcatggattggccagttcctatttagaaggttgcaattttttaaccgctgcagtttctactcctgctaatagtttagcgcattctttgttgttactgtggggtcctgaagcacaaggagattttactcgttggtgtcaattaggtggtctatgggcttttgttgctctccacggcgctttcgcattaataggttttatgttacgtcaatttgaacttgctcgatctgttcaattgcgaccttataatgcaatcgcattctctggtcccattgctgtttttgtttctgtcttcctaatttatccactaggtcaatctggttggttctttgcgcctagttttggtgtagcggctatatttcgattcatcctctttttccaagggtttcataattggacattgaacccatttcatatgatgggagtcgccggtgtactgggcgcggctctgctatgcgctattcatggtgctactgtagaaaatactttatttgaagatggtgatggtgcaaatacattccgtgcttttaacccaactcaagccgaagaaacttattcaatggtcaccgctaaccgcttttggtcacaaatctttggggttgctttttccaataaacgttggttacatttctttatgttatttgtaccggtaactggtttatggatgagtgctcttggagtagtcggtctagctttgaacctacgtgcctatgacttcgtttcccaggaaatccgtgcagcggaagatccagaatttgagactttctatactaaaaatattcttttaaacgaaggtattcgtgcttggatggcggctcaagatcagcctcatgaaaaccttatattccctgaggaggttctaccacgtggaaacgctctttaatggaactttagctttagctggtcgtgaccaagaaaccaccggtttcgcttggtgggccgggaatgcccgacttatcaatttatctggtaaactattgggagctcatgtagcccatgccggattaatcgtattctgggccggagcaatgaacttatttgaagtggcccattttgtacccgaaaagcccatgtatgaacaaggattaattttacttccccacctagccactttaggatggggggtaggtcctgggggagaagttatagacacctttccgtactttgtatctggagtacttcacttaatttcttctgcagttttgggctttggcggtatttatcatgcacttctgggacccgaaactcttgaagaatcttttccctttttcggttatgtatggaaagatagaaataaaatgaccaccattttgggtattcacttaattttgttaggtgtaggtgcctttcttctagtattcaaggctctctattttgggggcgtatatgatacctgggctccgggagggggggatgtaagaaaaattacaaacttgactcttagcccaagtgttatatttggttatttactaaaatctccctttgggggagaaggatggattgttagtgtggacgatttggaagatataattggagggcatgtatggttaggttccatttgtatatttggtggaatctggcatatcttaaccaagccttttgcatgggctcgccgcgcacttgtatggtctggggaggcttacttgtcttatagtttagctgctttatctgtttgtggtttcattgcttgttgttttgtctggtttaataataccgcttaccctagtgagttttacggacctacggggccagaagcttctcaagctcaagcatttacttttctagttagagaccaacgtcttggagctaacgtggggtctgctcaaggacctacaggtttaggtaaatacttaatgcgttctccgactggagaagttatttttggaggagaaacaatgcgcttttgggatctgcgtgctccctggttagaacctttaaggggtcctaacggtttggacttgagtaggttgaaaaaagacatacaaccttggcaagaacgacgttcggcagaatatatgactcatgctcctttaggttccttaaattctgtagggggcgtagctactgagatcaatgcagtcaattatgtctccccgagaagttggttatctacctctcattttgttctaggatttttcctattcgtgggtcatttatggcacgcgggaagggctcgggcagcggcagcgggatttgaaaaaggaattgatcgtgattttgaacctgttctttccatgactcctcttaactaaagtagtaggtaaaacaggaaagtaaaactcggttcatatttaaaagtcttctttgtttctttcaattcaatctaaatttttctggctcggctatactatccagccgagccattctcctttatttatcatgctaagaagtaaaaaaagccaataaagataaaaatagattcatccaacaaaaggagagagagggattcgaaccctcgatagttatttttatgaactataccggttttcaagaccggagccatcaaccgctcggccatctctccgaaagataatttctattttatttttttttcgccaaatagaacatagccctatgagttaatacgatcactatgtagagaaagatatagggtgtgactttctttaataggtctataaatctggctatataaataaatgagatacgcgatccagtatacccatttgtgaagtcaaaaagaacctttaacttcatgtccgaatagaataaaagtggtaaaaataaattggaactaagtcatctcgaatcaacggattcatgataaaatccctttatctattaaaattttttagtgggtaagaggattaaatggtgtatattcttttgttaatagcttggaggattaaaaacatgactattgctttccaattggctgtttttgcattaattattacttcatcaatcttactgattagtgtacccgttgtatttgcgtctcctgatggttggtcgagtaacaaaaatgttgttttttctggtacatctttatggattggattagtcttcttggtgggtatccttaattctcttatctcttgaattcattcgttgcagatccaaaaatgagatgaccccctcccattccatgaattacacattcaaattcaatataagtccataaaatgcaaataaagaaaaatttagagggggggtcgaacttctggaacttgaattaaatatgaataaaagattaataaatagcaatttactaaatataactatgaaatagtaataactaattaaataaaaaaaaaacgcgatctagaactag

SEQ ID NO: 4262 - DNA, 5186 bp, Arabidopsis thaliana
aaaaaaaaaagaaaaaaagagggttaagtttcgttttttttttactttccttgatagattgcctcatctcattgttaagaaatagtagtatccctgtctaacactaatccaagaaagtcagccagaatccatcttctaattagggaaaaaggtggatttataagttaagttatcaaaaatttgctttttttttttttagaaaattattgttcagaggataatccgtatctcttcatcacatgtcaagataaaatatcttgggtgtatgtcaacttgctgagtacatgtataaatcaaattaatttcgttcgatgcgctaggctattaaaaaaaaattcattgcatggatatttatcaaatccaatattaaaaaagcaaaaaataccccgttaagtaaatttgaagtcaattcaaattctcatttctagttcccaaatgagctactaaccactatgcgtctattgtatatatatttaatatatatatatatatagattttatttactaccggctcagtcaggaattaaaccaagacggcccttttaactcagtggtagagtaacgccatggtaaggcgtaagtcatcggttcaaatccgataaggggcttttacgttctttactttctaatagtcaaaatttcatttgaaagtctataatttaatttcaaattttgttaatttcattctaataaatttcattctaataatataataactaataataaagttagcgagtaatttaaaaaataaaaatgaacatttgtatattataatacaattacaatgaataatgataagtcgtctcttgaatcgccaaatatatattctttttttttcgatttttcgatagattagaaatcgacaaatccaaaagaaaaagtaagtggacctaacccatcgaatcatgactatatccactattctgatattcaaattcgatagagattaaattgaaacagtagattttttttatttcatatttttgtattaggaaatccgtcgatatctcttattgaatcttcttgtttctatatatttcataggaaatatattgcgttcctgcctagagaaagagagtctttttgcaaagtaataactaaaagggcgtttcaatattttttttgattcgagaacataacaagatcctacattctctttgtattaagaatcaatttgtattaaaaataaacaaaaatcgaatcataatcatggcttcagatatcaattaaatatttccatattgatgcatccgagatgacaatgtaatgtgatcgaaggtgtatgtgagaaagaaactctcatttacagtttcctataattttatttaaatattgaattaaatataaataagaaattttccccttttttgacagatacataagggcatgtacatatagatatcaaagaaaatagaaaaaaatattaaaagttccctttttgcttcaacccgtcaactaaaaaaagggtataaaaggaaaataacaatagttgatactatagtatttaatagacaagtatttaatacacgcaaaaaagaaaaaaaaaagttctttattctttatctgaataatgagtcatccgacaattcatgatttagattcaactacttatacttattaataaactaatagcaaggaagaaacaaattgagttgatccgtttacctaagtaaggaccaataaaatcaaaaattttgatcttcgaaaccaattaaatgaaattctaagggttccattttatggggcagtgcgcgagaaattaaatcataaacaaatgatagaatttgagcgccctgaaaatgccataatatataacatcaaaatctataacattaaggtgttcggaaatggttgaagtagatgaataggaggatcgctatgactatagcccttggtaaatttaccaaagacgaaaaagatttatttgatattatggatgactggttacggagggaccgcttcgtttttgtaggttggtctggtctattgctctttccttgtgcctatttcgctttagggggttggttcacaggtacaacctttgtaacttcatggtatactcatggattggccagttcctatttagaaggttgcaattttttaaccgctgcagtttctactcctgctaatagtttagcgcattctttgttgttactgtggggtcctgaagcacaaggagattttactcgttggtgtcaattaggtggtctatgggcttttgttgctctccacggcgctttcgcattaataggttttatgttacgtcaatttgaacttgctcgatctgttcaattgcgaccttataatgcaatcgcattctctggtcccattgctgtttttgtttctgtcttcctaatttatccactaggtcaatctggttggttctttgcgcctagttttggtgtagcggctatatttcgattcatcctctttttccaagggtttcataattggacattgaacccatttcatatgatgggagtcgccggtgtactgggcgcggctctgctatgcgctattcatggtgctactgtagaaaatactttatttgaagatggtgatggtgcaaatacattccgtgcttttaacccaactcaagccgaagaaacttattcaatggtcaccgctaaccgcttttggtcacaaatctttggggttgctttttccaataaacgttggttacatttctttatgttatttgtaccggtaactggtttatggatgagtgctcttggagtagtcggtttagctttgaacctacgtgcctatgacttcgtttcccaggaaatccgtgcagcggaagatccagaatttgagactttctatactaaaaatattcttttaaacgaaggtattcgtgcttggatggcggctcaagatcagcctcatgaaaaccttatattccctgaggaggttctaccacgtggaaacgctctttaatggaactttagctttagctggtcgtgaccaagaaaccaccggtttcgcttggtgggccgggaatgcccgacttatcaatttatctggtaaacttttgggagctcatgtagcccatgccggattaatcgtattctgggccggagcaatgaacttatttgaagtggcccattttgtacctgaaaagcccatgtatgaacaaggattaattttacttccccacctagccactttaggatggggggtaggtcctgggggagaagttatagacacctttccgtactttgtatctggagtacttcacttaatttcttctgcagttttgggctttggcggtatttatcatgcacttctgggacccgaaactcttgaagaatcttttccctttttcggttatgtatggaaagatagaaataaaatgaccaccattttgggtattcacttaattttgttaggtgtaggtgcctttcttctagtattcaaggctctctattttgggggcgtatatgatacctgggctccgggagggggggatgtaagaaaaattacaaacttgactcttagcccaagtgttatatttggttatttactaaaatctccctttgggggagaaggatggattgttagtgtggacgatttggaagatataattggaggacatgtatggttaggttccatttgtatatttggtggaatctggcatatcttaaccaagccttttgcatgggctcgccgcgcacttgtatggtctggggaggcttacttgtcttatagtttagctgctttatctgtttgtggtttcattgcttgttgttttgtctggtttaataataccgcttaccctagtgagttttacggacctacggggccagaagcttctcaagctcaagcatttacttttctagttagagaccaacgtcttggagctaacgtggggtctgctcaaggacctacaggtttaggtaaatacttaatgcgttctccgactggagaagttatttttggaggagaaacaatgcgtttttgggatctgcgtgctccctggttagaacctttaaggggtcctaacggtttggacttgagtaggttgaaaaaagacatacaaccttggcaagaacgacgttcggcagaatatatgactcatgctcctttaggttcgttaaattctgtagggggcgtagctactgagatcaatgcagtcaattatgtctctccgagaagttggttatctacctctcattttgttctaggatttttcctattcgtgggtcatttatggcacgcgggaagggctcgggcagcggcagcgggatttgaaaaaggaattgatcgtgattttgaacctgttctttccatgactcctcttaactaaagtagtaggtaaaacaaataggttcatattaaaaagtcttctttgtttctttcaattcaatctaaatttttctggctcggctatactatccagccgagccagaaaaatttatttatcatgctaagaagtaaaaaaagccaataaagagaaaaatagattcatccaacaaaaggagagagagggattcgaaccctcgatagttatttttatgaactataccggttttcaagaccggagccatcaaccactcggccatctctccgaaagataatttctattttatttttttttcgccaaatagaacatagccctatgagttaatacgatcactatgtagagaaagatatagggtgtgactttctttaataggtctataaatctggctatataaataaatgagatacgcgatccagtatacccgtttgtgaagtaaaaaagaacctttaacttcatgtccgaatagactaaaagtggtaaaaagaaattggaactaagtcatctcgaatcaacggattcatgataaaatccctttatttattaaaaatttttagtgggtaagaggattaaatggtgtatattcttttgttaatagcttggaggattaaaaacatgactattgctttccaattggcagtttttgcattaattattacttcattaatcttactgattagtgtacccgttgtatttgcgtctcctgatggttggtcgagtaacaaaaatgttgtattttctggtacatctttatggattggattagtcttcttggtgggtatccttaattctcttatctcttgaattcattcgttgcagatccaaaaatgagatgaccccctcccattccttgaattacacattcaaattcaatataagtcca

SEQ ID NO: 4263 - DNA, 4376 bp, Brassica rapa
cttttgaatcgccaaatagatattcgttgtttccctttttcgatagattagaaatcaacaaatccaaaagaaaaagtaagtggacctaacccgtcgaatcatgactatatccactattctgatattcaaattcgatagagataaaattgaaacagtagatttggtttatttcatatttttttattcggaaatctgtcgatatctcttatttaatcttcttgtttctatatttcataggaaatatattgcgttcctgcctagagaaagaaagtcttattccaaattttttaatacctaaagggtatttcaatatcttgttttgattccagaacataacaagagcctaaattctagttgtataagaatcaaattgtattaagaatcaaaaaatcgaatcataaagaatggcttcagatatcaatcaaatatttccatattgatgcttacaagatgacaatgtaatgggattgaaggtgtatgtgagaaagaaactctcatttacagtttgctattattttatttaaatattgtattgaattagatataaataataaattttccctttttttaccggcatggacatgtagatatcaaataaaatagaaaaaaagatttctttatctgagtaatgagtcatctgacaattcatgatttagattcaactacttattaagaaactaatagcaaggaagaaacaatttgagttgatgcgtttacctaagtaaggaccaataaaatcaaatattttgatcttcgaaaccaattaaatgaaattctaaaggttaaattttatggggcagtgcgcgagaaatcaaatcataaataaatgatagaattttgagcgtcctgaacataatatataacattaagatatataaaggtgttcggaaatggttgaagtagatgaataggaggatcgctatgactatagcccttggtaaatttaccaaagacgaaaaagatttatttgatattatggatgactggttacggagggaccgcttcgtttttgtaggttggtctggtctattgctctttccttgtgcctatttcgctttggggggttggttcacaggtacaacctttgtaacttcatggtatactcatggattggctagttcctatttagaaggttgcaattttttaaccgctgcagtttctactcctgctaatagtttagcgcattctttgttgttactgtggggtcctgaagcacaaggagattttactcgttggtgtcaattaggcggtctgtgggcttttgttgctctccacggtgctttcgcattaataggttttatgttacgtcaatttgaacttgctcgatctgttcaattgcgaccttataatgcaatcgcattctctggtccaattgctgtttttgtttctgtctttctaatttatccactaggtcaatctggttggttctttgcgcctagttttggtgtagcggctatatttcgattcatcctctttttccaagggtttcataattggacattgaacccatttcatatgatgggagtcgctggtgtactgggcgcggctctgttatgcgctattcatggtgctactgtagaaaatactttatttgaagatggtgatggtgcaaatacattccgtgcttttaacccaactcaagccgaagaaacttattcaatggtcaccgctaaccgcttttggtcacaaatctttggggttgctttttccaataaacgttggttacatttctttatgttatttgtaccagtaactggtttatggatgagtgctcttggagtagtcggtctagctttgaacctacgtgcctatgacttcgtttcccaggaaatccgtgcagcggaagatccggaatttgagactttctatactaaaaatattcttttaaacgaaggtattcgcgcttggatggcggctcaagatcagcctcatgaaaaccttatattccctgaggaggttctaccacgtggaaacgctctttaatggaactttagctttagctggtcgtgaccaagaaaccactggtttcgcttggtgggccgggaatgcccgacttatcaatttatctggtaaactattgggagctcatgtagcccatgccggattaatcgtattctgggccggagcaatgaacttatttgaagtggctcattttgtacctgaaaagcccatgtatgaacaaggattgattttacttccccacctagccactttaggctggggggtaggtcctgggggagaagttatagacacctttccatactttgtatctggagtacttcacttaatttcttctgcagttttgggctttggcggtatttatcatgcacttctgggacccgaaactcttgaagaatcttttccatttttcggttatgtatggaaagatagaaataaaatgaccaccattttgggtattcacttaattttgttaggtgtaggtgcttttcttctagtattcaaggctctctattttgggggcgtatatgatacctgggctccaggagggggggatgtaagaaaaattacaaacttgactcttagcccaagtgttatatttggttatttactaaaatctccctttgggggagaaggatggattgttagtgtggacgatttggaagatataattggagggcatgtatggttaggttccatttgtatatttggtggaatctggcatatcttaaccaaaccttttgcatgggctcgccgcgcacttgtatggtctggggaggcttacttgtcttatagtttagctgctttatctgtttgtggtttcattgcttgttgttttgtctggtttaataatactgcttaccctagtgagttttacggacctacagggccagaagcttctcaagctcaagcatttacttttctagttagagaccaacgtcttggagctaacgtggggtctgctcaaggacctacaggtttaggtaaatacttaatgcgttccccgactggagaagttatttttggaggagaaacaatgcgtttttgggatctgcgtgctccctggttagaacctttaaggggtcctaatggtttggacttaagtaggttgaaaaaagacatacaaccttggcaagaacgacgttctgcagaatatatgactcatgctcctttaggttccttaaattctgtagggggcgtagctactgagatcaatgcagtcaattacgtctctccgagaagttggttatctacctctcattttgttctaggattcttcctattcgtgggtcatttatggcacgcgggaagagctcgggcagcggcagcaggatttgaaaaaggaattgatcgtgattttgaacctgttctttctatgactcctcttaactaaagtagtagttaaaataggaaagtaaaaatcgggtcatattaaaaagtcttctttctttctttcaattcaatctcgttttttctggctcggctggatagtatagccgagccattctccttttttatgatgctaagaagtaaaaaaagccaataaagaaaaaaatctattcatccaacaaaaggagagagagggattcgaaccctcgatagttattttttatgaactataccggttttcaagaccggagccatcaaccactcggccatctctccaaaagataatttctattttatctttttttttcgccaaatagaacatagctcgatgagttaatacgatcactatgtagaaaaagatatagggtgtgactttctttataagtctatcaattgtatctatataaatgagatacatgatccagtctacccatttgtgaagtaaaaaagaacctttaacttcatgtccgaatagaataaaagtggtaaaaagaagttggaaataaggcatctcgaataaacggattcatgataaaatccctttatttattaaaattttttagtgggtaagaggattaaatggtgtatattgttaatagcttggaggattaaaaacatgactattgcttttcaattggctgtttttgcattaattattacttcattaatcttactgattagtgtacccgttgtatttgcgtctcctgatgggtggtcgagtaacaaaaatgttgtattttctggtacatctttatggattggattagtcttcttggtgggtatccttaattctcttatctcttgaattcattcgttgcagatcaaaaaatgagatgacccctcccattccacgaattacacattcaaattcaatataagtccataaaatgcaaataaagaaaacaaaaaaattagagggggggtcgaacttctgtaacttgagtgaaatatgaatcaaatattaataaatagcaatttactaaatataactatgaaatagtaataactaattaaataaaaaaaaaacg

SEQ ID NO: 4264 - DNA, 4822 bp, Arabidopsis lyrata
gtaatttcaaaaatcaaattgaacatttttatattataatacaatgaataatgataagtcgtctcttgaatcgccaaatatatattctttttttttttttgatttgtcgatagattagaaatcgacaaatcaaaaagaaaaagtaagtggacctaacccatcgaatcatgactatatccactattctgatattcaaattcgatagagattaaattgaaacagtaggttttttttatttcatatttttgtattaggaaatccgtcgatatctcttattgaatcttcttgtttctatatatttcataggaaatatattgcgttcctgcctagagaaagaaagtcttatttcaaagtaataactaaaagggcatttcaatattttttttgattcgagaacataacaagatcctacattctctttgtataagaatcaaattgtattaaaaataaacaaaaatcgaatcataatcatggcttcagatatcaattaaatatttccatattgatgcatacgagatgacaatgtaatgtgatcgaaagtgtatgtgagaaagaaactctcatttacagtttcctataattttatttaaatattgaattaaatataaataagaaattttcccctttttttacagatacataagggtatgtacatatagatataaaagaaaatagaaaaaaatagtcaaagttcccgttttgcttcaacccgtcaactaaaaaaagggtataaaaggaaaataacaatagttgatacttgatactatagtatttaatagacaagtatttaatacccgcaaaaaagaaaaaaaaaaaaaaaagatttctttatctgaataatgaatcatccgacaattcatgatttagattcaactacttatacttattaataaactaatagcaaggaagaaacaaattgagttgatgcgtttacctaagtaaggaccaataaaatcaaatattttgatcttcgaaaccaattaaattaaattctaagggttccattttatggggcagtgcgcgagaaatcaaatcataaacaaatgatagaatttcgagcgccctgaaaatgccataatatataacatcaaaatatataacattaaggtgttcggaaatggttgaagtagatgaataggaggatcgctatgactatagcccttggtaaatttaccaaagacgaaaaagatttatttgatattatggatgactggttacggagggaccgcttcgtttttgtaggttggtctggtctattgctctttccttgtgcctatttcgctttagggggttggttcacaggtacaacctttgtaacttcatggtatactcatggattggccagttcctatttagaaggttgcaattttttaaccgctgcagtttctactcctgctaatagtttagcgcattctttgttgttactgtggggtcctgaagcacaaggagattttactcgttggtgtcaattaggtggtctatgggcttttgttgctctccacggcgctttcgcattaataggttttatgttacgtcaatttgaacttgctcgatctgttcaattgcgaccttataatgcaatcgcattctctggtcccattgctgtttttgtttctgtcttcctaatttatccactaggtcaatctggttggttctttgcgcctagttttggtgtagcggctatatttcgattcatcctctttttccaagggtttcataattggacattgaacccatttcatatgatgggagtcgccggtgtactgggcgcggctctgctatgcgctattcatggtgctactgtagaaaatactttatttgaagatggtgatggtgcaaatacattccgtgcttttaacccaactcaagccgaagaaacttattcaatggtcaccgctaaccgcttttggtcacaaatctttggggttgctttttccaataaacgttggttacatttctttatgttatttgtaccggtaactggtttatggatgagtgctcttggagtagtcggtctagctttgaacctacgtgcctatgacttcgtttcccaggaaatccgtgcagcggaagatccagaatttgagactttctatactaaaaatattcttttaaacgaaggtattcgtgcttggatggcggctcaagatcagcctcatgaaaaccttatattccctgaggaggttctaccacgtggaaacgctctttaatggaactttagctttagctggtcgtgaccaagaaaccaccggtttcgcttggtgggccgggaatgcccgacttatcaatttatctggtaaactattgggagctcatgtagcccatgccggattaatcgtattctgggccggagcaatgaacttatttgaagtggcccattttgtacccgaaaagcccatgtatgaacaaggattaattttacttccccacctagccactttaggatggggggtaggtcctgggggagaagttatagacacctttccgtactttgtatctggagtacttcacttaatttcttctgcagttttgggctttggcggtatttatcatgcacttctgggacccgaaactcttgaagaatcttttccctttttcggttatgtatggaaagatagaaataaaatgaccaccattttgggtattcacttaattttgttaggtgtaggtgcctttcttctagtattcaaggctctctattttgggggcgtatatgatacctgggctccgggagggggggatgtaagaaaaattacaaacttgactcttagcccaagtgttatatttggttatttactaaaatctccctttgggggagaaggatggattgttagtgtggacgatttggaagatataattggagggcatgtatggttaggttccatttgtatatttggtggaatctggcatatcttaaccaagccttttgcatgggctcgccgcgcacttgtatggtctggggaggcttacttgtcttatagtttagctgctttatctgtttgtggtttcattgcttgttgttttgtctggtttaataataccgcttaccctagtgagttttacggacctacggggccagaagcttctcaagctcaagcatttacttttctagttagagaccaacgtcttggagctaacgtggggtctgctcaaggacctacaggtttaggtaaatacttaatgcgttctccgactggagaagttatttttggaggagaaacaatgcgcttttgggatctgcgtgctccctggttagaacctttaaggggtcctaacggtttggacttgagtaggttgaaaaaagacatacaaccttggcaagaacgacgttcggcagaatatatgactcatgctcctttaggttccttaaattctgtagggggcgtagctactgagatcaatgcagtcaattatgtctccccgagaagttggttatctacctctcattttgttctaggatttttcctattcgtgggtcatttatggcacgcgggaagggctcgggcagcggcagcgggatttgaaaaaggaattgatcgtgattttgaacctgttctttccatgactcctcttaactaaagtagtaggtaaaacaggaaagtaaaactcggttcatatttaaaagtcttctttgtttctttcaattcaatctaaatttttctggctcggctatactatccagccgagccattctcctttatttatcatgctaagaagtaaaaaaagccaataaagataaaaatagattcatccaacaaaaggagagagagggattcgaaccctcgatagttatttttatgaactataccggttttcaagaccggagccatcaaccgctcggccatctctccgaaagataatttctattttatttttttttcgccaaatagaacatagccctatgagttaatacgatcactatgtagagaaagatatagggtgtgactttctttaataggtctataaatctggctatataaataaatgagatacgcgatccagtatacccatttgtgaagtcaaaaagaacctttaacttcatgtccgaatagaataaaagtggtaaaaataaattggaactaagtcatctcgaatcaacggattcatgataaaatccctttatctattaaaattttttagtgggtaagaggattaaatggtgtatattcttttgttaatagcttggaggattaaaaacatgactattgctttccaattggctgtttttgcattaattattacttcatcaatcttactgattagtgtacccgttgtatttgcgtctcctgatggttggtcgagtaacaaaaatgttgttttttctggtacatctttatggattggattagtcttcttggtgggtatccttaattctcttatctcttgaattcattcgttgcagatccaaaaatgagatgaccccctcccattccatgaattacacattcaaattcaatataagtccataaaatgcaaataaagaaaaatttagagggggggtcgaacttctggaacttgaattaaatatgaataaaagattaataaatagttactaaatatgaaatagtaataaaaaaaataaataaaaaaacgaataaaaaattgagatctgatatcaatatagaatataatattttatggaaatagaagaatcatatattcttgaacttgaatatggaattcaatattaaatataaatatatagaataaatataatattaatatataatattaatatatatatttatatatattaatagaattgttaattgaatttatttgctggtaaaattttatgaaatgaccccaaaccaaagagtgt

SEQ ID NO: 4265 - DNA, 5040 bp, Arabidopsis thaliana
ttttttttttcaagaaatgtaagtttgattctactaacaagtcataaattaatacgtgtcttttgggacgcgaggaaaaaattacaatatttcccggtcaactataccgaatattttctctttttgaatccatttatatttgggcggatagcgggaatcgaacccgcgtcttctccttggcaaggagaaattttaccattcgactatatccgcattttttgcccttctttataagaaatttatggataatatttgttcaaagctagacgagatacactctttggtttggggtcatttcataaaattctaccaccaaataaattcaattaacaattctattaatatatatatatatattataaatatatatattaataatatatattatatttattctatatattaatatattaatattaattcttgaatattaatttaatttaatattgaattccagattcaagaatatattattcttatatttccataaaatattatattctatattgacttgatatcagatctcaattttttattcgttttttttatttatttttttttattactatttcatatttaggaactatttcatatttagtaactatttattaatcttttattcatatttcattcaagttccataagttcgaccccccctctaattttttctttatttgcattttatggacttatattgaatttgaatgtgtaattcaaggaatgggagggggtcatctcatttttggatctgcaacgaatgaattcaagagataagagaattaaggatacccaccaagaagactaatccaatccataaagatgtaccagaaaatacaacatttttgttactcgaccaaccatcaggagacgcaaatacaacgggtacactaatcagtaagattgatgaagtaataattaatgcaaaaactgccaattggaaagcaatagtcatgtttttaatcctccaagctattaacaaaagaatatacaccatttaatcctcttacccactaaaaatttttaataaataaagggattttatcatgaatccgttgattcgagatgacttagttccaatttctttttaccacttttagtctattcggacatgaagttaaaggttcttttttacttcacaaacgggtatactggatcgcgtatctcatttatttatatagccagatttatagacctattaaagaaagtcacaccctatatctttctctacatagtgatcgtattaactcatagggctatgttctatttggcgaaaaaaaaataaaatagaaattatctttcggagagatggccgagtggttgatggctccggtcttgaaaaccggtatagttcataaaaataactatcgagggttcgaatccctctctctccttttgttggatgaatctatttttctctttattggctttttttacttcttagcatgataaataaatttttctggctcggctggatagtatagccgagccagaaaaatttagattgaattgaaagaaacaaagaagactttttaatatgaacctatttgttttacctactactttagttaagaggagtcatggaaagaacaggttcaaaatcacgatcaattcctttttcaaatcccgctgccgctgcccgagcccttcccgcgtgccataaatgacccacgaataggaaaaatcctagaacaaaatgagaggtagataaccaacttctcggagagacataattgactgcattgatctcagtagctacgccccctacagaatttaacgaacctaaaggagcatgagtcatatattctgccgaacgtcgttcttgccaaggttgtatgtcttttttcaacctactcaagtccaaaccgttaggaccccttaaaggttctaaccagggagcacgcagatcccaaaaacgcattgtttctcctccaaaaataacttctccagtcggagaacgcattaagtatttacctaaacctgtaggtccttgagcagaccccacgttagctccaagacgttggtctctaactagaaaagtaaatgcttgagcttgagaagcttctggccccgtaggtccgtaaaactcactagggtaagcggtattattaaaccagacaaaacaacaagcaatgaaaccacaaacagataaagcagctaaactataagacaagtaagcctccccagaccatacaagtgcgcggcgagcccatgcaaaaggcttggttaagatatgccagattccaccaaatatacaaatggaacctaaccatacatgtcctccaattatatcttccaaatcgtccacactaacaatccatccttctcccccaaagggagattttagtaaataaccaaatataacacttgggctaagagtcaagtttgtaatttttcttacatccccccctcccggagcccaggtatcatatacgcccccaaaatagagagccttgaatactagaagaaaggcacctacacctaacaaaattaagtgaatacccaaaatggtggtcattttatttctatctttccatacataaccgaaaaagggaaaagattcttcaagagtttcgggtcccagaagtgcatgataaataccgccaaagcccaaaactgcagaagaaattaagtgaagtactccagatacaaagtacggaaaggtgtctataacttctcccccaggacctaccccccatcctaaagtggctaggtggggaagtaaaattaatccttgttcatacatgggcttttcaggtacaaaatgggccacttcaaataagttcattgctccggcccagaatacgattaatccggcatgggctacatgagctcccaaaagtttaccagataaattgataagtcgggcattcccggcccaccaagcgaaaccggtggtttcttggtcacgaccagctaaagctaaagttccattaaagagcgtttccacgtggtagaacctcctcagggaatataaggttttcatgaggctgatcttgagccgccatccaagcacgaataccttcgtttaaaagaatatttttagtatagaaagtctcaaattctggatcttccgctgcacggatttcctgggaaacgaagtcataggcacgtaggttcaaagctaaaccgactactccaagagcactcatccataaaccagttaccggtacaaataacataaagaaatgtaaccaacgtttattggaaaaagcaaccccaaagatttgtgaccaaaagcggttagcggtgaccattgaataagtttcttcggcttgagttgggttaaaagcacggaatgtatttgcaccatcaccatcttcaaataaagtattttctacagtagcaccatgaatagcgcatagcagagccgcgcccagtacaccggcgactcccatcatatgaaatgggttcaatgtccaattatgaaacccttggaaaaagaggatgaatcgaaatatagccgctacaccaaaactaggcgcaaagaaccaaccagattgacctagtggataaattaggaagacagaaacaaaaacagcaatgggaccagagaatgcgattgcattataaggtcgcaattgaacagatcgagcaagttcaaattgacgtaacataaaacctattaatgcgaaagcgccgtggagagcaacaaaagcccatagaccacctaattgacaccaacgagtaaaatctccttgtgcttcaggaccccacagtaacaacaaagaatgcgctaaactattagcaggagtagaaactgcagcggttgtacctgtgaaccaaccccctaaagcgaaataggcacaaggaaagagcaatagaccagaccaacctacaaaaacgaagcggtccctccgtaaccagtcatccataatatcaaataaatctttttcgtctttggtaaatttaccaagggctatagtcatagcgatcctcctattcatctacttcaaccatttccgaacaccttaatgttatagattttgatgttatatattatggcattttcagggcgctcaaattctatcatttgtttatgatttaatttctcgcgcactgccccataaaatggaacccttagaatttcatttaattggtttcgaagatcaaaatttttgattttattggtccttacttaggtaaacggatcaactcaatttgtttcttccttgctattagtttattaataagtataagtagttgaatctaaatcatgaattgtcggatgactcattattcagataaagaataaagaacttttttttttcttttttgcgtgtattaaatacttgtctattaaatactatagtatcaactattgttattttccttttataccctttttttagttgacgggttgaagcaaaaagggaacttttaatatttttttctattttctttgatatctatatgtacatgcccttatgtatctgtcaaaaaaggggaaaatttcttatttatatttaattcaatatttaaataaaattataggaaactgtaaatgagagtttctttctcacatacaccttcgatcacattacattgtcatctcggatgcatcaatatggaaatatttaattgatatctgaagccatgattatgattcgatttttgtttatttttaatacaaattgattcttaatacaaagagaatgtaggatcttgttatgttctcgaatcaaaaaaaatattgaaacgcccttttagttattactttgcaaaaagactctctttctctaggcaggaacgcaatatatttcctatgaaatatatagaaacaagaagattcaataagagatatcgacggatttcctaatacaaaaatatgaaataaaaaaaatctactgtttcaatttaatctctatcgaatttgaatatcagaatagtggatatagtcatgattcgatgggttaggtccacttactttttcttttggatttgtcgatttctaatctatcgaaaaatcgaaaaaaaaagaatatatatttggcgattcaagagacgacttatcattattcattgtaattgtattataatata

SEQ ID NO: 4266 - DNA, 4611 bp, Amborella trichopoda
tgatccgggaaaggctcaagagatgagagaattaaggatagctaccaaaaagactaatccaatccataatgatgtacccgaaaatacaatatttttgttacttgaccaaccatcagaagaagcaaatacaacgggtacactaatcagtaagattgatgaagtagcaattaatgcaaaaacagccaattggaaagcaatagtcatggttgtaatcctccaagctatcaacaaatgaactataccatttgatccccatcggtcgaaattgtaataaaatggattggatcatgaggggatttaaccatgaatccgctgatcttttagaactcattactaccttattccaacattgaattgaggggaaactcttctttactgcacaactgggcatgcatggatcatgtattatatatacagataacagatagataaattcaaattgaaataccgtacatggggagtttctacagatagttatggtatcaactctatgccgaagccgggtcctatctgtgggaataagatggagattgtctctgggagagatggctgagtggttgatagctccggtcttgaaaaccggtatagttccgaacaaagaactatcgagggttcgaatccctctctctccttttgctcgttgaatatttctttattggtttttggtttgggctgggccagtatgtgcataaaggagaaggctcgactaaggggaatagccgagccacaaatagaaatgagttgaaaaaaaaaaaagattccccccctttttttttaagtatgacctgatccaaatatgtaccgtggaatccaaattgattcctacttcatctatttgatctaccgtctcagttaagaggagtcatggaaagaacaggttcaaaatcacgatcgattcctttttcaaatcctgctgcagctgcacgggcccttcctgcatgccacaaatgacccacgaataggaaaaatcctagaacaaaatgagaggtagctaaccaacttctgggagagacataattgactgcattgatctctgtagctacgccgcccacggaatttaaagaacctaaaggagcatgagtcatatattccgccgaacgtcgttcttgccagggctgtatgtcttttttcagcctactcaagtccaaaccgttgggaccccttagtggttccaaccagggagcacggagatcccagaagcgcatagtttctcctccaaaaatgacctccccagttggagaacgcattagatatttacctaaaccggtgggtccttgagcagatcctacgttagccccaagacgttggtctctaactagaaaagtaaacgcttgagcttgagaagcttctgggccggtaggaccgtaaaactcactaggataagccgtattattgaaccagacgaaacagcaagcaatgaaaccaaagatagataaagcccccaaactataagacaagtaagcttctccagaccatacaaatgcgcggcgagcccacgcaaaaggtttggttaagatatgccatattccaccaagtatacaaatgaaacctaaccatacgtgtcctccaattatatcttctaaatcatccacactaacaatccatccttctcccccaaaaggagattttagcaaataaccaaatataacacttgggctaagtgtcaggttggttatttttcttacatctccgccaccgggggcccaggtatcatatacgcctccaaaataaagagccttgaacactaggagaaaagcgcctacacctaataaaattaagtgaatacccaaaatagtggtcattttatttctatctttccatacataaccgaagaatggaaaggattcttcaagagtctcaggtccaagaagtgcatgataaataccaccaaagcctaggactgcagaggaaattaaatgaagtactccagatacaaagtatggaaaggtgtctataacttcccccccaggacctaccccccaacctagagtagctagatggggaagtaaaattaatccttgttcatacataggtttctctggtacaaaatgagccacttcaaatagattcattgctcccgcccagaatacgattaatccggcatgggccacgtgagccccgagtaatttaccagacaaattgataagtcgggcattcccggcccaccaagcaaaacctgtggtttcttggtcacgaccagctaaagctaaagttccattaaagagcgtttccacggggtagaacctcctcagggaatataaggttttcatggggctgatcctgagccgccatccaagcacgaataccttcgtttaagagaatatttttggtatagaaagtctcaaattcaggatcttccgctgcacggatttcttgggaaacgaagtcataggcacgtaggttcaaagccagaccgactactccaagagcactcatccataaaccggttactggtacaaataacataaagaaatgtaaccaacgtttattggaaaaagcaaccccaaagatttgggaccaaaagcggttagcagtgaccatcgaataagtctcttcagcttgagttgggttaaaagcacggaatgtatttgcaccatcaccatcttcaaataaagtattttctacggtagcaccatgaatagcgcatagcagagcagcacccaatactccagcaactcccatcatatgaaatggattcaacgtccaattatgaaatccttggaagaagagaatgaatcgaaatatagctgctacaccgaaactcggtgcaaagaaccaaccagactgacctagtggataaatcaggaatacagaaacaaaaacagcaattggagcggagaatgcgattgcgttataaggtcgcaattgaacagatcgagcaagttcgaattgacgcaacatgaaacctattagtccgaaagcaccatggagagcaacaaaagtccacagaccccccaattgacaccaacgagtaaaatctccttgtgcttcaggaccccacagtaacaacaaagaatgtgctaaactattagcaggagtagaaactgcagcggttaaaaaattgcatccttccaaataggagctagctaatccatgggtgtaccatgaagttacaaaggttgtacctgtgaaccaccctcctaaagcaaaataggcacaaggaaaaagcaatagaccagaccaacctacaaaaacgaagcggtccctccgtagccagtcatccataatatcaaataaatcattttcctctttggaaaacctaccaagggctatagtcatagtgatcctcctattcaactactgcaaccattttcgaacacctcatatcattatgattaaagaaagagtatatgatggttcgatcatttatgtatggacgattactcgcccactgtcccttccaaaatatcgggtttcgaagatatagatcccacaggacaaaccaaatgcatgctatcccgatttaattattgcttcctacatctgatccatgaattgtcttatgcctcatcaatcagatgaaatttattaaaaaactgtcaaggagcccttctctcgctaccagtttcttctcagatcctatctccctgttccatcaaacgaatgattcttggattttattcgtgatattgagaaaagaaaagatcaataaatatctctattgatcctcccaattgtatactagacttagactctagacttagactactataataaaaaagaaaaatagaataaaaaataaaaaaagaaagaatatgaattttcattgtatcgtatgtatcatttcttactttttttttttttttttttttttttttgtcttgtcatattttcattcgtatgaatctcaaattccagagtttttcttgtcatgggccaaagaaacttcgaatcttttcccttttacttaccttacccgacagaaaaaaagggagataattctccattttttgtccctgtacccatttgtctttgtacccatacctatcctatatacaataggggacttgaaatgtaagctcctttcatgattcgaattcattctccaccggtggatcccttttttattcggaatgaacctttctcagggtaggaaaatttatttctatggagcattcaagaaacaagaagattcaatcggaaatctcgacgaatttttgcggggccaaggaaatcaacctcttccacaacttcatctatctcgaatcttactatcagaatagctggtatagtcacgattcaatgggtcaggtccacttaatttctttctttttattgatttctcattttttccgatgaatctcattggaacaatggagaagtaggaatactttggctttgtcgattcataattaggtatctagaatatacatgtcccgggatcaaaaaaatatgaataatgaaacatgaggaagagtctattctgtagtgacatagtggtcctactaaaataagaagtttgacgtcttatcaatgaagaaatgatgaattttataattcattacaactcattattgaatttatgttatgacagttcagttggttccttttttttatcacaaatatcaacaaacctctctctatcgtccgctaaaaaaatgaagaccggag

SEQ ID NO: 4267 - DNA, 2409 bp, Amorphophallus konjac
ttcaagagatgagagaattaaggatagctaccagaaagactaatccaatccataatgatgtaccagaaaatacaacatttttgttacttgaccaaccatcggaagaagcaaatacaacaggtacactaatcagtaagattaatgaagtcgcaattaatgcaaaaaacagccaattggaaagcaatagtcatgcttgtaatcctccaatccaagctaccaacaaataaactataccatttgatcccccgcttagtcaaaattttgataaaatgcatcatcatcatggcgggatttgaccatgaatctattgattctttaaaacttattaccactttattattttatttagtatttatttacaaacaaacagatatactagatcctgcatatatctatatccacagtatacaaatagatacatacagatggatacatatatagatcgcatctgagatgtaactataaatggttagtgtatcaacttatatggccatgttctatttgtaggaataaaatagaaattgtcttttggagagatggccgagtggttgatagctccggtcttgaaaaccggcatagttctgaacaaagaactatcgagggttcgaatccctctctctcctttttcttgcttgttgaatctttccttattggacggatatgctgtcataaaaggtatggctcggccaggtgggataggatagccgagccagaacagaaaaaatagaaaaaaataggaatagatataaatacaaaaatctcagctaagaggggtcatggaaagaacaggttccaaatcacgatcgattcccttttcaaatcctgctgcagctgcacgggcccttcccgcatgccacaaatgacccacaaaaaagaagaatcctagaacaaaatgagaggtagctaaccaacttctaggagatacataattgactgcattgatctcggtagctacgccacccacggaatttaaagaacctagaggagcgtgagtcatatattccgcggaacggcgttcttgccacggttgtatgtcttttttcagcctactcaagtccaacccatttggacctcttagaggttccaaccaaggagcacggagatcccaaaaacgcatagtttcccctccaaaaatgatctctccggtcggggaacgcattagatatttacctaaaccagtaggtccttgagcggatcccacattagccccaaggcgttggtctctaactagaaaagtaaaagcttgagcttgagaagcttctggtccggttggcccataaaattcactagggtaagcagtattattgaaccagacgaaacaacaagctataaaaccaaagacggataaagcacctaaactataagacaagtaagcctctccagaccagacaaatgcgcggcgagcccatgcaaagggcttggttaagatatgccaaattccaccaagtatacaaatggaacctaaccatacatgtcctccaattatatcttctaaatcgtccacactaacaatccatccttctcccccaaaaggagattttagtaaataaccaaatataacacttgggctaagggtcaagttggtaatttttcttacatctccccctccgggagcccaggtatcatatacaccaccaaaataaagagctttgaatactagaagaaaagcacctatgcctaacaaaattaagtgaatacctaaaattgtggtcattttatttctatctttccatacataaccaaagaatggaaaggattcttcaagagtctcaggcccaagaagcgcatgataaatgccgccaaagcctaagactgcagaggaaattaagtgaagtactccagacacaaagtatggaaaagtgtctataacttcccctcccggacctaccccccaacctagagtagctagatgtggaagtaaaatcaatccttgttcatacatgggcttttccggtacgaagtgagccacctcaaataggttcattgctccggcccagaatacaattaatccggcgtgggctacgtgagccccaagtagtttaccggacaaattgataagtctggcattcccagcccaccaagcaaaaccggtggtttcttggtcacgaccagctaaagctaaagttccattaaagagcgtttccacgtggtagaacctcctcagggaatataaggttttcatgaggctgatcctgagccgccatccaagcacgaataccttcgtttaagagtaatatttttggtgtagaaagtctcaaattcaggatcttctgctgcacggatttcttgggaaacgaagtcataggcacgtaggttcagagccagaccgactactccaagagcactcatccataaaccagttactggtacaaataacataaagaaatgtaaccaacgtttataggaaaa

SEQ ID NO: 4268 - DNA, 2779 bp, Fagopyrum esculentum
tttaagtatgacccgatcccaatccaatatgtatgatggaatcaaaatggttcctactttaagcattggatctcttgtctcaattaagaggggtcatcgaaagaacaggttcaaaatcacgatcaattcctttttcaaatcctgctgcagccgcacgagcccttcccgcgtgccacaaatgacctacgaataggaagaagcctagaacaaaatgagaagtagctaaccaacttctaggagagacataattgactgcattgatctcggtagctacgccacccacagaatttaaggaccctaaaggggcatgagtcatatattccgcggaacgccgttcttgccacggttgtatgtcttttttcagccgactcaagtccaaaccgttaggaccccttaggggttctaaccaaggagcacgcaaatcccaaaaacgcatagtttctcctccaaaaatgacttctccagttggggaacgcattagatacttacctaacccagtaggtccttgcgcggatcccacgttagccccaaggcgttggtctcgaactagaaaagtaaatgcttgagcttgagaagcttctggccctgttggaccgtaaaactcactaggataagcggtattattgaaccagacaaagcaacaagcaatgaaaccgaagacagataaagcacctaaactataagacaaataagcctctccagaccatacaagtgcgcggcgagcccacgcaaaaggtttggttaatatatgccagattccgccaagtatacaaatggaacctaaccatacatgtcctccgatgatatcttccaaatcgtccacactaacaatccatccttctcccccaaaaggagattttagtaaataaccaaatataatacttgggctaagggtcaagttggtaatttttctgacatccccccctcctggagcccaggtatcgtatatgcccccaaaaaaaagagccttgaatactagaagaaaagcccctagacctaacaagattaagtgaatgcccaaaattgtggtcattttatttcgatctttccatacataaccgaagaatggaaaagattcctcaagagtctcagggcccagaagtgcatgataaatccccccaaagcccaacactgccgaggaaattaagtgaagtactcccgatacaaaatatggaaaagtgtctataacttcccaccagggcctactcccaacctagagtagcgaggtgggaagtaaattaatccttgttcatacattggcttttctggtacgaaatgagccacttcaaataggttcattgctccggcccagaatactattaatccggcatgggctacgtgagctccgagtagtttacccgataaattgataagtcgggcattcccggcccaccaagcgaaaccggtggtttcttggtcacgactggttaaagctaaagttccattaaagagcgtttccacgtggtagaacctcctcagggaatataaggttttcatgaggctggtcttgagccgccatccaagcgcgaataccctcgtttaagagaatattttttgtgtagaaagtctcaaattcaggatcttctgcggcacggatttcctgggaaacgaagtcataggcgcgtaggttcaaagccagaccgactaccccaagagcactcatccataaaccggttactggtacaaataacataaagaaatgtaaccaacgtttattggaaaagcaaccccaaagatttgggaccaaaagcggttagcagtgaccattgaataagtttcttcggcttgggttgggttaaaagcccggaatgtatttgcaccatcaccatcttcaaataaagtattttctacggtagcaccatgaatagcgcatagcagagcggcgcccaatacaccggccactcccatcatatgaaatggattcaatgtccaattatgaaacccttgaaaaaagaggatgaatcgaaatatagctgctacaccaaaactaggcgcaaagaaccaaccagactgacctagtggataaattagaaacaccgaaacaaaaacggcaattgggccagagaatgcgattgcattataaggtcgcaattgaacagatcgagcaagttcgaattgacgtaacataaaacctattagtccgaaaagcgccatggagagcaacaaaagtccacaggccgcctaattgacaccaacgagtaaaatctccttgagcttcagggccccatagtaacaataaagagtgtgctaaactattagcaggagtcgaaactgctgcggttaagaaattgcagccttccaaataggaactggccaaaccatgagtataccaggaagttacaaaggttgtacccgtaaaccaacctcctacagcgaaatacgcacacggaaagagcaatagaccggaccaaccgacaaaaacgaaacggtccctccgtaaccagtcatccataatatcaaataaatcattttcatctttggtaactttaccaagggctatagtcatagtaatcctcctattcaactatttcaaccatttccgaacacctcatagcgtggagtccgagactcttccaacgggtttcgaagatatactttattggttcataaatttactttgaaaggtaaaatacctcaattcgattattctttaactagtctgaataagcccctgacccatgaattgtcttatgtctcattaaccaaatctatatatttttgaaagaactgttcaaggaacaagcaatattctttctcgttaccagttgattacgagact

SEQ ID NO: 4269 - DNA, 4077 bp, Quercus alba
atagtcatctttctaatcctccaatctatcaacaaaagaaactatataccatttgtatccctttattggtatcggccaaaaaattagtatcagccaaaaattactaataaaacgtatcatagagggatttttaccacgaatctattaatgctgtatgacttattagcaccttttaccaccttattaaatcttattaaattaaggcatgagatcaagggaaaggtatttttttttttactttcattaaaagaggcccgccagatcattatctatatatatacagatcgatagctagacccataggatcgcaccggatatctttatatatatataggtcgtaatggtatcaactcatatatccatgttctattcgttagaaaataaaaaaaaaataaataaaaatagaaataatctttcggagaggtggccgagtggttgatagctccggtcttgaaaaccggtatagttcgaaacaaagaactatcgagggttcgaatccctctctctccttttttgctcgtggaatatatatatatatattttttattttattggttttgtccggctcagtattagtattctaaaagggaatggctcggctagggggatagccgagccagaacagaaaaaaagggttcaatatataatgagtcgaaaatgaaaataaaggaattactttttttcaatacgtatgacctaacccaaccaacaaatatgtatgatgaaatcaaatagattttgacttcaagcattagaattagatctcctgtcttagttaagaggagtcatggaaagaacaggttcaaaatcgcgatcaattcctttttcaaatcctgctgcagctgcacgagcccttcctgcatgccataaatgacctacgaataggaagaatcctagaacaaaatgagaggtagctaaccaacttctaggagagacataattgactgcattgatctcggtagctacaccacccacggaatttaaagaacctaaaggagcatgagtcatatattccgcggaacgtcgttcttgccaaggttgtatgtcttttttcagcctactcaagtccaacccattgggaccccttaggggttctaaccagggagcacgcaaatcccaaaaacgcatagtttctcccccaaaaatgacttctccagtcggagaacgcattagatatttacctaaaccggtaggtccttgggcggaccctacgttagccccaaggcgttggtctctaaccagaaaagtaaatgcttgagcttgagaagcttctggtccagtgggcccgtaaaactcactaggataagcggtattattgaaccaaacaaagcaacaagcaataaaaccaaaaacagctaaagcacctaaactataagacaagtaagcctccccagaccatacaagcgcacggcgcgcccatgcaaaaggtttggttaagatatgccagattccaccaagtatacaaatggaacccaaccatacatgccctccaattatatcttccaaatcgtccacactaacaatccatccctctcctccaaaaggggattttagtaaataaccaaatatgacgcttgggctaagggtcaagttggtaatttttcttacatctccccctcccggggcccaggtatcatatacgcctccaaaataaatagctttgaatactagaagaaaagcacctatacctaacaaaattaagtgaatacccaaaaattgtagtcattttattctatctttccatacataaccgaagaatggaaaaagactcttcaagagtctcgggtcccagaagtgcgtgataaataccgccaaaagcccaatactgcagaggaaattaagtgaagtactccagacacaaagtatggaaaggtatctataacttccccaccaggacctaccccccaactagagtagctaggtggggaagtaaaattaatccttgttcatacatgggcttttctggtacgaaatgagccacttcaaataggttcattgctccggcccagaatacgattaatccggcatgggctacatgagctcccagtaatttaccggataaattgataagtcgggcattcccggcccaccaagcgaaacctgtggtttcttggtcacgaccggctaaggctaaagttccattaaagagcgtttccacggggtagaacctcctcagggaatataaggttttcatgaggctgatcttgagccgccatccaagcacgaatgccttcatttaaaagaatattttggtgtagaacgtctcaaattcaggatcttccgctgcacggatttcctgagaaacgaagtcataggcgcgtaggttcagagccaagccgactactccaagagcactcatccataaaccggttactggtacaaataacataagaaatgtaaccaacgtttattggaaaaagcaaccccaaagatttgggaccagaagcggttagcggtgaccattgaataagtttcttccgcttgaagttcgggttaaaaagcacggtaatgtatttgcgtccatcaccatcttccaaataaagtattttctacggtagctaccatagaatagcgcatagaagggcagacgcccaatacaccggcaacccccatcatatgaaatgggttcaatgtccaattatgaaacccttggaaaaagaggatgaatcgaaatatagctgcgacaccaaaaactgggcgcaaagaaccaaccagactgacctagcggataaatcaggaatacagaaacaaaaacagcaattggagcagagaatgcgattgcattataaggtcgcaattgaacagatcgagcaagttcaaattgacgtaacatgaaacctattagtccgaaagcgccgtggagagcaacaaaagtccacagaccgcctaattgacaccaacgagtaaaaatccccttgtgcttctggaccccatagtaacaacaaagagtgtgctaaactattagcaggagtagaaactgccgcggttaagaagttgcagccttccaaataggaactcgccaatccatgtgtataccatgaagttacaaaggttgtacctgtaaaccaacctcctaacgcgaaataagcacaaggaaagagcaatagaccggaccaacctacaaaacgaaacggtccctccgtaaccagtcatccataatatcaataaatcattttcgtctttggtaaatttcccaagggctatagtcatagtgatcctcctattcaactacttcaaccattttcgaacacctcatagaattttcagggcgttcaagacgtctatcatttctatatgatttgatttctcgtacactaccccttctttctaatgggtttcgaatctaaaaatcatttattggtacataacctgactgaggtaaatccatgacttcaattcagttctttttttctagtctgactaaccaaccacctgaaccttgaattgccttgtcttatgactcatcgatcaaatagattaattttttgaaagaactgttcaagaaacaagtgattccttttctcgctaccagttgatccccagacatattcctctcgtttcatcaaccaatcttattcttgaatctcgtttgtgagattgataaaataaatatctttatgtattccgtataatttctatgtgtattaaactacttattaaactactatagtatcatatattttattacgttatactttaactctttcattttcttttattgtgttatatttctttttctctcatatgaatatacaactcggaagtatatcttttcgcggttcaaagcaagcaatgcacttcgaagatttttttctatttacctttatctgtcagaaaaatcataaaaaggagaattcatttccttaatttttttattttaatattgatattgtatttaatttaataataaaaactgtaaatgaaagcagctttctcgcatacatttttgatcccgttgtcggaacaaaaatttcgcatgtatcgatatggaaatatttggtacatgaatacatgctctgatcaatttagatctatataaatcttatatagatctaaattgatcagagcatgtattct

SEQ ID NO: 4270 - DNA, 2669 bp, Quercus alba
acttatatttcatttttaatgtgtctcacaacctgaaaatgaaagaattaggaggggatcatttcatttttggatctaaatagaacaaataggttcaagagatgagagaattaaggatacccaccaaaaagactaatccaatccataatgatgtaccggaaaatacaacatttttgttatttgaccaaccatcaggagaagcaaatacaacaggtacactaatcagtaagattgttgaagtagcaattaatgcaaaaacagccaattggaaagcaatagtcatctttctaatcctccaatctatcaacaaaagaaactatataccatttgatccctttattggtatcggccaaaaaattgtatcagccaaaaattctaataaaacgtatcatagagggattttaccacgaatctattaatgctgtatgacttattagcaccttttaccaccttattaaatcttattaaattaaggcatgagatcaagggaaaggttattttttttttacttcattaaaagaggcccgccagatcattatctatatatatacagatcgatagctagacccataggatcgcaccggatatctttatatatataggtcgtaatggtatcaactcatatatccatgttctattcgttaagaaataaaaaaaaaaaaaataaaatagaaataatctttcggagaggtggccgagtggttgatagctccggtcttgaaaaccggtatagttcgaaacaaagaactatcgagggttcgaatccctctctctccttttttgctcgtggaatatatatatatatttttattttattggttttgtccggctcagtattagtattctaaaagggaatggctcggctagggggatagccgagccagaacagaaaaaaaagggttcaatatataatgagtcgaaaatgaaaataaaggaatacttttttttcaatacgtatgacctaacccaaccaaacaaatatgtatgatgaaatcaaatagattttgacttcaagcattagaattagatctcctgtcttagttaagaggagtcatggaaagaacaggttcaaaatcgcgatcaattcctttttcaaatcctgctgcagctgcacgagcccttcctgcatgccataaatgacctacgaataggaagaatcctagaacaaaatgagaggtagctaaccaacttctaggagagacataattgactgcattgatctcggtagctacaccacccacggaatttaaagaacctaaaggagcatgagtcatatattccgcggaacgtcgttcttgccaaggttgtatgtcctttttcagcctactcaagtccaacccattgggaccccttaggggttctaaccagggagcacgcaaatcccaaaacgcatagtttctccccaaaaatgacttctccagtcggagaacgcattagatatttacctaaaccggtaggtccttgggcggaccctacgttagccccaaggcgttggtctctaaccagaaaagtaaatgcttgagcttgagaagcttctggtccagtgggcccgtaaaactcactaggataagcggtattattgaaccaaacaaagcaacaagcaataaaaccaaaaacagctaaagcacctaaactataagacaagtaagcctccccagaccatacaagcgcacggcgcgcccatgcaaaaggtttggttaagatatgccagattccaccaagtatacaaatggaacccaaccatacatgccctccaattatatcttccaaatcgtccacactaacaatccatccctctcctccaaaaggggattttagtaaataaccaaatatgacgcttgggctaagggtcaagttggtaatttttcttacatctccccctcccggggcccaggtatcatatacgcctccaaaataaatagctttgaatactagaagaaaagcacctatacctaacaaaattaagtgaatacccaaaattgtagtcattttatttctatctttccatacataaccgaagaatggaaaagactcttcaagagtctcgggtcccagaagtgcgtgataaataccgccaaagcccaatactgcagaggaaattaagtgaagtactccagacacaaagtatggaaaggtatctataacttccccaccaggacctaccccccaacctagagtagctaggtggggaagtaaaattaatccttgttcatacatgggcttttctggtacgaaatgagccacttcaaataggttcattgctccggcccagaatacgattaatccggcatgggctacatgagctcccagtaatttaccggataaattgataagtcgggcattcccggcccaccaagcgaaacctgtggtttcttggtcacgaccggctaaggctaaagttccattaaagagcgtttccacggggtagaacctcctcagggaatataaggttttcatgaggctgatcttgagccgccatccaagcacgaatgccttcatttaaaagaatatttttggtgtagaacgtctcaaattcaggatcttccgctgcacggattcctgagaaacgaagtcataggcgcgtaggttcagagccaagccgactactccaagagcactcatccataaaccggttactggtacaaataacataagaaatgtaaccccat

SEQ ID NO: 4271 - DNA, 4198 bp, Quercus alba
actttcattaaaagaggcccgccagatcattatctatatatatacagatcgatagctagacccataggatcgcaccggatatctttatatatataggtcgtaatggtatcaactcatatatccatgttctattcgttagaaaataaaaaaaaaataaataaaatagaaataatctttcggagaggtggccgagtggttgatagctccggtcttgaaaaccggtatagttcgaaacaaagaactatcgagggttcgaatccctctctctccttttttgctcgtggaatatatatatatattttttattttattggttttgtccggctcagtattagtattctaaaagggaatggctcggctaggggggatagccgagccagaacagaaaaaaaagggttcaatatataatgagtcgaaaatgaaaataaaggaatacttttttttttcaatacgtatgacctaacccaaccaaacaaatatgtatgatgaaatcaaatagattttgacttcaagcattagaattagatctcctgtcttagttaagaggagtcatggaaagaacaggttcaaaatcgcgatcaattcctttttcaaatcctgctgcagctgcacgagcccttcctgcatgccataaatgacctacgaataggaagaatcctagaacaaaatgagaggtagctaaccaacttctaggagagacataattgactgcattgatctcggtagctacaccacccacggaatttaaagaacctaaaggagcatgagtcatatattccgcggaacgtcgttcttgccaaggttgtatgtctttttcagcctactcaagtccaacccattgggaccccttaggggttctaaccagggagcacgcaaatcccaaaaacgcatagtttctccccaaaaatgacttctccagtcggagaacgcattagatatttacctaaaccggtaggtccttgggcggaccctacgttagccccaaggcgttggtctctaaccagaaaagtaaatgcttgagcttgagaagcttctggtccagtgggcccgtaaaactcactaggataagcggtattattgaaccaaacaaagcaacaagcaataaaaccaaaaacagctaaagcacctaaactataagacaagtaagcctccccagaccatacaagcgcacggcgcgcccatgcaaaaggtttggttaagatatgccagattccaccaagtatacaaatggaacccaaccatacatgccctccaattatatcttccaaatcgtccacactaacaatccatccctctcctccaaaaggggattttagtaaataaccaaatatgacgcttgggctaagggtcaagttggtaatttttcttacatctccccctcccggggcccaggtatcatatacgcctccaaaataaatagctttgaatactagaagaaaagcacctatacctaacaaaattaagtgaatacccaaaattgtagtcattttatttctatctttccatacataaccgaagaatggaaaagactcttcaagagtctcgggtcccagaagtgcgtgataaataccgccaaagcccaatactgcagaggaaattaagtgaagtactccagacacaaagtatggaaaggtatctataacttccccaccaggacctaccccccaacctagagtagctaggtggggaagtaaaattaatccttgttcatacatgggcttttctggtacgaaatgagccacttcaaataggttcattgctccggcccagaatacgattaatccggcatgggctacatgagctcccagtaatttaccggataaattgataagtcgggcattcccggcccaccaagcgaaacctgtggtttcttggtcacgaccggctaaggctaaagttccattaaagagcgtttccacggggtagaacctcctcagggaatataaggttttcatgaggctgatcttgagccgccatccaagcacgaatgccttcatttaaaagaatatttttggtgtagaacgtctcaaattcaggatcttccgctgcacggatttcctgagaaacgaagtcataggcgcgtaggttcagagccaagccgactactccaagagcactcatccataaaccggttactggtacaaataacataaagaaatgtaaccaacgtttattggaaaaagcaaccccaaagatttgggaccaaaagcggttagcggtgaccattgaataagtttcttccgcttgagttgggttaaaagcacggaatgtatttgcgccatcaccatcttcaaataaagtattttctacggtagcaccatgaatagcgcatagaagggcagcgcccaatacaccggcaacccccatcatatgaaatgggttcaatgtccaattatgaaacccttggaaaaagaggatgaatcgaaatatagctgcgacaccaaaactgggcgcaaagaaccaaccagactgacctagcggataaatcaggaatacagaaacaaaaacaagcaattggagcagagaatgcgattgcattataaggtcgcaattgaacagatcgagcaagttcaaattgacgtaacatgaaacctattagtccgaaagcgccgtggagagcaacaaaagtccacagaccgcctaattgacaccaacgagtaaaatccccttgtgcttctggaccccatagtaacaacaaagagtgtgctaaactattagcaggagtagaaactgccgcggttaagaagttgcagccttccaaataggaactcgccaatccatgtgtataccatgaagttacaaaggttgtacctgtaaaccaacctcctaacgcgaaataagcacaaggaaagagcaatagaccggaccaacctacaaaaacgaaacggtccctccgtaaccagtcatccataatatcaaataaatcattttcgtctttggtaaatttcccaagggctatagtcatagtgatcctcctattcaactacttcaaccattttcgaacacctcatagaattttcagggcgttcaagacgtctatcatttctatatgatttgatttctcgtacactaccccttctttctaatgggtttcgaatctaaaaatcatttattggtacataacctgactgaggtaaatccatgacttcaattcagttctttttttctagtctgactaaccaaccacctgaaccttgaattgccttgtcttatgactcatcgatcaaatagattaattttttgaaagaactgttcaagaaacaagtgattccttttctcgctaccagttgatccccagacatattcctctcgtttcatcaaccaatcttattcttgaatctcgtttgtgagattgataaaaataaatatctttatgtattccgtataatttctatgtgtattaaactacttattaaactactatagtatcatatattttattacgttatactttaactctttcattttcttttattgtgttatatttctttttctctcatatgaatatacaactcggaagtatatcttttcgcggttcaaagcaagcaatgcacttcgaagatttttttctatttacctttatctgtcagaaaaatcataaaaaaggagaattcatttccttaatttttttttattttaatattgatattgtatttaatttaataataaaaactgtaaatgaaagcagctttctcgcatacatttttgatcccgttgtcggaacaaaaatttcgcatgtatcgatatggaaatatttggtacatgaatacatgctcgtatgttgtgacttggaataagcctttcttcgtagaagaaggaaatattaatttatccctataacccatctatgaatgataatatttaatcagtaatatcgacaaattcttgcagagccaaaagaaaataaatatgaaaattaaataaaaaaaggatctaccgactgttacaatttcatctttatcgagttatcgaattttaatatcagaatagtggatatagtcatgattcaataggttaggtccacttactttttttgttgttttctaatctttagaatggatttggttggaataatggaaagggatatttatcgattcaaggagacgactcttcattattcaatagaatattacattaaatataatataatattattcattataattataataataaataataatttcgaatagctaat

SEQ ID NO: 4272 - DNA, 2463 bp, Quercus alba
atttcattttaatgtgtctcacaacctgaaaatgaaagaattaggaggggatcatttcatttttggatctaaatagaacaaataggttcaagagatgagagaattaaggatacccaccaaaaagactaatccaatccataatgatgtaccggaaaatacaacatttttgttatttgaccaaccatcaggagaagcaaatacaacaggtacactaatcagtaagattgttgaagtagcaattaatgcaaaaaacagccaattggaaagcaatagtcatctttctaatcctccaatctatcaacaaaagaaactatataccatttgatccctttattggtatcggccaaaaaattgtatcagccaaaaattctaataaaacgtatcatagagggattttaccacgaatctattaatgctgtatgacttattagcaccttttaccaccttattaaatcttattaaattaaggcatgagatcaagggaaaggtattttttactttcattaaaagaggcccgccagatcattatctatatatatacagatcgatagctagacccataggatcgcaccggatatctttatatatataggtcgtaatggtatcaactcatatatccatgttctattcgttagaaataaaaaaaaaataataaaatagaaataatctttcggagaggtggccgagtggttgatagctccggtcttgaaaaccggtatagttcgaaacaaagaactatcgagggttcgaatccctctctctccttttttgctcgtggaatatatatatatattttttattttattggttttgtccggctcagtattagtattctaaaagggaatggctcggctagggggatagccgagccagaacagaaaaaaaagggttcaatatataatgagtcgaaaatgaaaataaaggaatactttttttttctaatacgtatgacctaacccaaccaacaaatatgtatgatgaaatcaaatagattttgacttcaagcattagaattagatctcctgtcttagttaagaggagtcatggaaagaacaggttcaaaatcgcgatcaattcctttttcaaatcctgctgcagctgcacgagcccttcctgcatgccataaatgacctacgaataggaagaatcctagaacaaaatgagaggtagctaaccaacttctaggagagacataattgactgcattgatctcggtagctacaccacccacggaatttaaagaacctaaaggagcatgagtcatatattccgcggaacgtcgttcttgccaaggttgtatgtcttttttcagcctactcaagtccaacccattgggaccccttaggggttctaaccagggagcacgcaaatcccaaaaacgcatagtttctcccccaaaaaatgacttctccagtcggagaacgcattagatatttacctaaaccggtaggtccttgggcggaccctacgttagccccaaggcgttggtctctaaccagaaaagtaaatgcttgagcttgagaagcttctggtccagtgggcccgtaaaactcactaggataagcggtattattgaaccaaacaaagcaacaagcaataaaaccaaaaacagctaaagcacctaaactataagacaagtaagcctccccagaccatacaagcgcacggcgcgcccatgcaaaaggtttggttaagatatgccagattccaccaagtatacaaatggaacccaaccatacatgccctccaattatatcttccaaatcgtccacactaacaatccatccctctcctccaaaaggggattttagtaaataaccaaatatgacgcttgggctaagggtcaagttggtaatttttcttacatctccccctcccggggcccaggtatcatatacgcctccaaaataaatagctttgaatactagaagaaaagcacctatacctaacaaaattaagtgaatacccaaaattgtagtcattttatttctatctttccatacataaccgaagaatggaaaagactcttcaagagtctcgggtcccagaagtgcgtgataaataccgccaaagcccaatactgcagaggaaattaagtgaagtactccagacacaaagtatggaaaggtatctataacttccccaccaggacctaccccccaacctagagtagctaggtggggaagtaaaattaatccttgttcatacatgggcttttctggtacgaaatgagccacttcaaataggttcattgctccggcccagaatacgattaatccggcatgggctacatgagctcccagtaatttaccggataaattgataagtcgggcattcccggcccaccaagcgaaacctgtggtttcttggtcacgaccggctaaggctaaagttccattaaagagcgtttccacggggtagaacctcctcagggaatataaggtttcatgaggctgatcccat

SEQ ID NO: 4273 - DNA, 2499 bp, Quercus alba
ctcacaacctgaaaatgaaagaattagaggggatcatttcatttttggatctaaatagaacaaataggttcaagagatgagagaattaaggataacccaccaaaaaagactaatccaatccataatgatgtaccggaaaatacaacatttttgttattttgaccaaccatcaggagaagcaaatacaacaggtacactaatcagtaagattgttgaagtagcaattaatgcaaaaacagccaattggaaagcaatagtcatctttctaatcctccaatctatcaacaaaagaaactatataccatttgatccctttattggtatcggccaaaaaattgtatcagccaaaaattctaataaaacgtatcatagagggattttaccacgaatctattaatgctgtatgacttattagcaccttttaccaccttattaaatcttattaaattaaggcatgagatcaagggaaaggtatttttttttttttttacttcattaaaagaggcccgccagatcattatctatatatatacagatcgatagctagacccataggatcgcaccggatatctttatatatataggtcgtaatggtatcaactcatatatccatgttctattcgttagaaataaaaaaaaaaaataataaaatagaaataatctttcggagaggtggccgagtggttgatagctccggtcttgaaaaccggtatagttcgaaacaaagaactatcgagggttcgaatccctctctctccttttttgctcgtggaatatatatatatattttttattttattggttttgtccggctcagtattagtattctaaaagggaatggctcggctagggggatagccgagccagaacagaaaaaaaagggttcaatatataatgagtcgaaaatgaaaataaaggaatactttttttttcaatacgtatgacctaacccaaccaaacaaatatgtatgatgaaatcaaatagattttgacttcaagcattagaattagatctcctgtcttagttaagaggagtcatggaaagaacaggttcaaaatcgcgatcaatcctttttcaaatcctgctgcagctgcacgagcccttcctgcatgccataaatgacctacgaataggaagaatcctagaacaaaatgagaggtagctaaccaacttctaggagagacataattgactgcattgatctcggtagctacaccacccacggaatttaaagaacctaaaggagcatgagtcatatattccgcggaacgtcgttcttgccaaggttgtatgtcttttttcagcctactcaagtccaacccattgggaccccttaggggttctaaccagggagcacgcaaatcccaaaaacgcatagtttctcccccaaaaatgacttctccagtcggagaacgcattagatatttacctaaaccggtaggtccttgggcggaccctacgttagccccaaggcgttggtctctaaccagaaaagtaaatgcttgagcttgagaagcttctggtccagtgggcccgtaaaactcactaggataagcggtattattgaaccaaacaaagcaacaagcaataaaaccaaaaacagctaaaagcacctaaactataagacaagtaagcctccccagaccatacaagcgcacggcgcgcccatgcaaaaggtttggttaagatatgccagattccaccaagtatacaaatggaacccaaccatacatgccctccaattatatcttccaaatcgtccacactaacaatccatccctctcctccaaaagggggattttagtaaataaccaaatatgacgcttgggctaagggtcaagttggtaatttttcttacatctccccctcccggggcccaggtatcatatacgcctccaaaaataaatagctttgaatactagaagaaaagcacctatacctaacaaaattaagtgaatacccaaaattgtagtcattttatttctatctttccatacataaccgaagaatggaaaagactcttcaagagtctcgggtcccagaagtgcgtgataaataccgccaaagcccaatactgcagaggaaattaagtgaagtactccagacacaaagtatggaaaggtatctataacttccccaccaggacctacccccccaacctagagtagctaggtggggaagtaaaattaatccttgttcatacatgggcttttctggtacgaaatgagccacttcaaataggttcattgctccggcccagaatacgattaatccggcatgggctacatgagctcccagtaatttaccggataaattgataagtcgggcattcccggcccaccaagcgaaacctgtggttcttggtcacgaccggctaaggctaaagttccattaaagagcgtttccacgggtagaacctcctcagggaatataaggttttcatgaggctgatcttgagccgccatccaagcacgaatgccttcatttaaaaaatattt

SEQ ID NO: 4274 - DNA, 3800 bp, Phalaenopsis aphrodite
cttcggatcggggaaataccaaaaaagttcaagagattagagaattaaggatagctaccagaaagactaatccaatccataatgatgtaccagaaaatacaatatttttgttacttgaccaaccatcagaagaagcaaatacaacgggtacactaatcagtaagattaatgaagttgcaattaatgcaaaaacagctaattggaaagcaatagtcatgtttgtaatcctccaaactaccaacaaatgaactgtaccatttgatccctcgcttcgtcaaaattgtcaaaaaagcatcatgaagggatttgacatgaatgaattgattcattagaacttattaccgctttcttttttttttattcggacatggagtggagcagatagttaatgtatcatttcataggatcatgttcttcataggatcttgttctattcgtaggaataaaatagagattctattttggagagatggctgagtggttgatagccccggtcttgaaaaccggtatagttcttaacaaggaactatcgagggttcgaatccccctctctccttttgcttgcttaagcaattacttcttgactcgtttggactggccccttttttcagaaagggaatggctcggctatctcgcctagccgagccagaatctaaaaaaaaaaaaaaaaatagacaatagatatatagatataaataaaaaaataagaaaatatcagctaatcagctaagaggggtcatggaaagaacaggttccaaatcacgatcgattcctttttcaaaccccgctgcagctgcacgtgcccttcccgcatgccacaaatgtcccacaaataggaaaaatcctagaacaaaatgagaggtagctaaccaacttctaggagagacataattgactgcattgatctcggtagctacgccacccacggaatttaaagaacccaaaggagcatgagtcatatattctgccgaacgtcgttcttgccaaggttgtatgtcttttttcagcctactcaagtccaagccattgggacctcttagaggttctaaccagggagcacgaagatcccaaaaacgcatagtttctcccccaaaaataacctctccggtcggagaacgcattagatatttacctaacccagtgggtccttgggcggatcccacgttagccccaagacgttggtctctcactagaaaagtaaatgcttgagcttgagaagcttccggcccagtaggtccgtaaaactcactaggataagcggtattattgaaccagacaaaacaacaagcgatgaaaccaaagacagatagagcacctaaactatacgacaaataagcttctccagaccatacaaatgcacggcgagcccatgcaaaaggtttggttaagatatgccaaattccaccaagtatacaaatggaacctaaccaaacatgtcctccaattatatcttctaaatcgtccacactaacaatccatccttctcccccaaaaggagattttagtaaataaccaaaaataacgcttgggctaagggtcaagttggtaatttttcttacatctccccctccgggtgcccaggtatcatatacgcctccaaaatacagagccttaagtactagaagaaaagcacctatacctaataaaattaagtgaatacccaaaattgtagtcattttatttctatctttccatacataaccgaagaatggaaaggattcttcaagagtttcaggtcctagaagtgcatgataaataccgccaaagcctaagactgcagaggaaattaagtggagtactccagatacaaagtatggaaaggtgtcgataacttctccccccggacctactccccaccctagagtagctaagtgtggaagtaaaatcaatccttgttcatacatgggcttctctggtacgaaatgagccacttcaaataggttcattgctccggcccagaatacaattaatccggcatgagctacgtgagccccaagcagtttaccggacaaattgataagtctcgcattcccggcccaccaagcgaaaccggtggtttcttggtcacgaccgactaaggctaaagttccattaaagagcgtttccacggggtagaacctcctcagggaatataaggttttcatgaggctgatcctgagccgccatccaagcacgaataccttcgtttaagagaatatttttggtgtagaaagtttcaaattcaggatcttccgctgcacgaatttcttgggaaacaaagtcataggcacgtaggttcagagcgagaccaactaccccaatagcactcatccataaaccggttactggcacaaatagcataaagaaatgtaaccaacgtttattggaaaagcaaccccaaagatttgggaccaaaacggttagcagtgaccattgaataagtctcttcagcttgagttgggttaaaagcacggaatgtatttgcaccatcgccatcttcgaataaggtattttctacggtggcgccatgaatagcacatagcagagcagcgcctaagactccagcaactcccatcatatgaaatgggttcaacgtccaattatgaaacccttggaagaaaagaatgaatcgaaatatagctgctacaccaaaactgggtgcaaaaaaccaaccagattgacccagtggataaatcagaaatacagaaacaaaaacagcaattggagcagaaaatgcaattgcattataaggtcgcaattgaacagaacgagcaagttcaaattgacgtaacatgaaacctattagaccaaaagcaccgtggagagcgacaaaagtccacagaccgcctaattgacaccagcgagtaaaatctccttgtgcttcaggaccccatagtagcaacaaagaatgtgctaaactatttgcaggagtagaaaccgcagccgttaagaaattacaaccttccaaataggaactagccaatccatgggtataccatgaagttacaaaagttgtacctgtgaaccaaccccctaaagcgaaataagcacaaggaaagagcaataggccggaccaacctacaaaaacgaaacggtccctccgtaaccaatcatccataatatcaaataaatcattttcttctttgataaatctaccaaaggctatagtcatagtgatcctcctattcaactacttcaaccatttccgaacacttcatctcatttccagggcatgtgttagttcgattatctatggacgattcttcgttcaatgcccttttccaatgggttcgaagatcaaaattagtttattcttttctctttttatatagtaatagtataatagataataaagtagactaaatatagactaaataagaaagtagactaatcgagtcgaactcataaactaggccggtttggtttgcggtccaatataaaataaaaagaatataaccattagaatccttaattatccacagattcccgatttttccctgtccttaaattgaataattgaatagtagactagaaatgaaaaccccttattctcgattctcgcatttattctctattccatcggatcggtgtaacaacaaaacaatatctgattctgaaatcaaggaaagatattcaaaatccatatttgaaagagatttttcttttctatgtagcggaaaggaaaagaatagcgatttagttctatggagcatccagtaacaagaatatgaaatcaaaaacaaatttttgacttgtgtggtccaatggtataaggaaagaaaaaaattcacttctacaattgaatctatatcgaatttatt

SEQ ID NO: 4275 - DNA, 2769 bp, Plantago ovata
gggtgatatttgtgcattattgagccagagattcccttccaagtgattccaattatccaagaagtttgtaagaagtttgaccccccctcttatttttggacttactattcaattcaattgcaacctgtctcacaaccgagacgtttttttttggggggggtcatttctcttttggatatgggacaaataggttcaagagatgagagaattaaggatacccaccagaaagactaacccaatccataatgatgtaccggaaaatacaacatttttgttacttgaccaaccatccggagaagcaaatacgacaggtacgctaattaataagattaatgaagtagcaattaatgcaaaaacagccagttggaaaacaagagtcattcttttaatcctccagataagataccaataaacaaattatcctatttcatccctctatcagccaaaaaacggtaataaaatacatcatcatgggatttttgtttaccataaatcaattagacttattattactacctctttgactactctattcgtacatggagcaggggaaatgggatttggtttttttcacaatttcacaaataggcatgctggattctatatacggatagatatatggatagataaattagtagattcacacctacgatctttctacagatcctacaggtaggggtgagatccaccccctatggtcatgttctattcggaggaataaaataaaaaatagtctttcggagagatggctgagtggttgatagccccggtcttgaaaaccggtatagttttgaacaaagaactatcgagggttcgaatccctctctctcctttttttgctcattgaatagattttttctattggttttacctcagttgctattctaaaaataaaggggaatggctaggctatcccacctagccaagccagaaaaaatacaaaattgaattagatagattatatagaaatgagttgaaaaaaaaattatattaatttaagtaagtataacctgattccaatataaaaatataaaatatatccaaatattatatatattctaataataatatagaagggatcaaagtaattcctactttaattcaaacagtggatctcctgtcttatctcaattaagaggggtcatggaaagaacaggttcaaaatcacgatcaattcctttttcaaatcctgctgcagccgcacgagcccttcctgcgtgccacaaatgacctacgaataagaagaatcctagaacaaaatgagaagtagctagccaacttctcggagagacataattaactgcattaatctcggtagctacgccacccacagaatttaaagaacctaaaggggcatgagtcatatattctgcggaacgccgttcttgccaaggttgtatgtcttttttcaacctactcaaatccaacccatttggacctcttagaggttctaaccaaggagcacgcagatcccaaaaacgcatagtttctcctccaaaaattacttctccggttggggaacgcattagatatttccctaaaccagtaggtccttgggcagatcctacattagccccaaggcgttggtctcgaactagaaaagtaaatgcttgagcttgagaagcttctgggccagtaggcccgtaaaactcgctaggataagcggtattattgaaccaaacaaaacaacaagcaatgaaaccaaagacggataaagctgctaaactataagataagtaagcctctccagaccatacaagggcacgtcgagcccacgcgaatggtttagttaagatatgccagattccaccaagtatacaaatggcacctaaccatacatgtcctccgattagatcttctaaatcgtccacactaacaatccatccttcccctccaaaaggggattttagtaaataaccaaatagaatactgggactgagagtcaaattggtaattttccttacatcgccccctcccggtgcccaagtatcatatacgcccccaaaataaagagccttgaagactagaagaaaagcacctagacctaacaagattaagtgaatacctaaaatggtggtcattttatttctatctttccatacataaccgaagaatggaaaagattcttccagtgtctcgggtcccaaaagtgcatgataaataccgccaaatcccaatactgccgaggaaattaaatgaagtactccagatacaaagtatggaaaagtatctataacttcccccccaggacctaccccccaacctagagtagctaggtggggaagtaaaatgaatccttgttcatacataggcttctctggtacgaaatgggccacttcaaataggttcattgcgccggcccagaatacaattaatccggcatgggctacatgagcacctaataatttaccggataaattaataagtcgagcatttccggcccaccaagcaaaaccagtggtttcttggtcacgacccactacagttaaagttccattaaagagcgtttccacgtggtagaacctcctcagggaatataaggttttcatgaggctgatcttgagccgccatccaagcacgaatcccttcgtttaatagaatatttttggtgtagaaagtctcaaattcaggatcttccgctgcgcgaatttcctgagaaacgaagtcataggcacgtaggttcaaggccaaaccgactaccccaagagcactcatccacaaaccggttactggtacaaataacataaagaaatgtaaccaacgtttatt

SEQ ID NO: 4276 - DNA, 4505 bp, Papaver somniferum
aacaatatacaccattaatcctcttacccactaaaaatttaataaataaagggatttatcatgaatccgttgattcgagatgatttatttccaacttctttttaccacgtttattctattcggacatgaagttaaaggttctttttgacttcacaaatgggtatactggatcgtgtatctcatttatttatatagaccgattgatagacttataaaaaaagtcataccctatatctttttctacatagtgatcgtattaactcatcgagctatgttctatttggcgaaaaaaagataaaatagaaattatctttcggagagatggccgagtggttgatggctccggtcttgaaaaccggtatagttcataaaataactatcgagggttcgaatccctctctctccttttgttggatgaatagatttttttctttattggctttttttacttcttagcatcataaaaaggagaatggctcggctggatagtatagccgagccagaaaaaatgagattgaattgaaagaaacaaagaagactttttaatatgacccgattttactttactatttaactactactttagttaagaggagtcatagaaagaacaggttcaaaatcacgatcaattcctttttcaaatcctgctgccgctgcccgagctcttcccgcgtgccataaatgacctacgaataggaagaatcctagaacaaaatgagaggtagataaccaacttctcggagatacataattgactgcattgatctcagtagctacgccccctacagaatttaaggaacctaaaggagcatgagtcatatattctgcagaacgtcgttcttgccaaggttgtatgtcttttttcaacctactcaagtccaaaccattaggaccccttaaaggttctaaccaaggagcacgcagatcccaaaaacgcattgtttctcctccaaaaataacttctccagtcggggaacgcattaagtatttacctaaacctgtaggtccttgagcagaccccacattagctccaagacgttggtctctaactagaaaagtaaatgcttgggcttgagaggcttctggccctgtaggtccgtaaaactcactagggtaagcggtattattaaaccagacaaaacaacaagcaatgaaaccacaaacagataaagcagctaaactataagacaagtaagcctccccagaccatacaagtgcgcggcgagcccatgcaaaaggtttggttaagatatgccagattccaccaaatatacaaatggaacctaaccatacatgccctccaattatatcttccaaatcgtccacactaacaatccatccttctcccccaaagggagattttagtaaataaccaaatataacacttgggctaagagtcaagtttgtaatttttcttacatccccccctcctggagcccaggtatcatatacgcccccaaaatagagagccttgaatactagaagaaaagcacctacacctaacaaaattaagtgaatacccaaaatggtggtcattttatttctatctttccatacataaccgaaaaatggaaaagattcttcaagagtttcgggtcccagaagtgcatgataaataccgccaaagcccaaaactgcagaagaaattaagtgaagtactccagatacaaagtatggaaaggtgtctataacttctcccccaggacctaccccccagcctaaagtggctaggtggggaagtaaaatcaatccttgttcatacatgggcttttcaggtacaaaatgagccacttcaaataagttcattgctccggcccagaatacgattaatccggcatgggctacatgagctcccaatagtttaccagataaattgataagtcgggcattcccggcccaccaagcgaaaccagtggtttcttggtcacgaccagctaaagctaaagttccattaaagagcgtttccacgtggtagaacctcctcagggaatataaggttttcatgaggctgatcttgagccgccatccaagcgcgaataccttcgtttaaaagaatattttagtatagaaagtttcaaattccggatcttccgctgcacggattcctgggaaacgaagtcataggcacgtaggttcaaagctagaccgactactccaagagcactcatccataaaccagttactggtacaaataacataaagaaatgtaaccaacgtttattggaaaaagcaaccccaagatttgtgaccaaaagcggttagcggtgaccattgaataagtttcttcggcttgagttgggttaaaagcacggaatgtatttgcaccatcaccatcttcaaataaagtattttctacagtagcaccatgaatagcgcataacagagccgcgcccagtacaccggcgactcccatcatatgaaatgggttcaatgtccaattatgaaacccttggaaaaagaggatgaatcgaaatatagccgctacaccaaaactaggcgcaaagaaccaaccagattgacctagtggataaattaaaaagacagaaacaaaaacagcaattggaccagagaatgcgattgcattataaggtcgcaattgaacagatcgagcaagttcaaattgacgtaacataaaacctattaatgcgaaagcaccgtggagagcaacaaaagcccacagaccacctaattgacaccaacgagtaaaatctccttgtgcttcaggaccccacagtaacaacaaagaatgcgctaaactattagcaggagtagaaactgcagcggttaaaaaattgcaaccttctaaataggaactagccaatccatgagtataccatgaagttacaaaggttgtacctgtgaaccaaccccccaaagcgaaataggcacaaggaaagagcaatagaccagaccaacctacaaaaacgaagcggtccctccgtaaccagtcatccataatatcaaataaatctttttcatctttggtaaatttaccaagggctatagtcatagcgatcctcctattcatctacttcaaccatttccgaacacctttatatatcttaatgttatatattatggcattttcagggcgctcaaaattctatcatttgtttatgatttgatttctcgcgcactgccccataaaattgaacccttagaatttcatttaattggtttcgaagatcaaaatatttgattttattggtccttacttaggtaaacgcatcaactcaaattgtttcttccttgctattagttgattaataagtagttgaatctaaatcatgaattgtcggatgacttattactcagataaagaaatctttttttctattttctttgatatctacatgtccatgcctgtaaaaaaagggaaatttcttatttatatctaattcaatacaatatttaaataaaataatagcaaactgtaaatgagagtttctttctcacatacaccttcaatcacattacattgtcatcttgtatgcatcaatatggaaatatttgattgatatctgaaaccattatttatgattcgattttttgattcttaatacaatttgattcttatacaaataaaatttaggatcttgttatgttctggaatcaaaacaagatattgaaatgcccttttaggtattaattaatttggaataagactttctttctctaggcaggaacgcaatatatatttcctatgaaatatagaaacaagaagattaaataagagatatcgacagatttccgaataaaaaatatgaaataaaaaaaatctactgtttcaattttatctctatcgaatttgaatatcagaatagtggatctagtcatgattcgacgggttaggtccacttactttttcttttggatttgttgatttctaatctattgaaaaagggaaacaaagaatatatatttggcgattcaagagacgccttattattattcattgtattataatataaaaatgttcaattttattttctaaattactctctcactttattattagttattattaaaatgaaattcattagaatgaaatgaaaaaattagaattatacactttcgaatgaatttttactatatagaaagttaaagaaagtaaaagccccttatcggatttgaaccgatgacttacgccttaccatggcgttactctaccactgagttaaaagggccgtcttgatttaattcctgactgagtcgataggtaaagcaaatctatatatatatatattaaatatatatacaatagacgcatagtggttagtagctcatttcgtaactagaagcgagaatcgataacttaacttatcaatccatcttctaattagggaagaagattctgtcttactttcttgggttagtgttagatagggacactgctatttcttaacaatgagatgaggcaatctatgaaggaagtaaaaaacgaacttaacctttttactgtcagaccaatcactctttaaagatttatactagactatttttga

SEQ ID NO: 4277 - DNA, 1797 bp, Chenopodium quinoa
aacgttgaatttcttgtctcaattaaggggggtcattgaaagaacaggttcaaaatcacgatcaattcctttttcaaatcctgctgcagctgcacgagcccttcccgcatgccacaaatgacctacgaataggaaaaatcctaaaacaaaatgagaagtagctaaccaacttctaggagagacataattgactgcattgatctcggtagccaccccacccacagaatttaaagaacctaaaggagcatgggtcatatattctgcggaacggcgttcttgccaaggttgtatgtcttttttcagccgactcaagtccaaaccatttggacctcttaggggttctaaccagggagcgcgcaaatcccaaaaccgcatagtttctcccccaaaaataacttctccagtcggagaacgcattagatacttacctaaaccagtaggtccttgagcggatcccacgttagccccaagacgttggtctctaactaaaaaagtaaatgcttgagcttgagaagcttctggtccagtaggtccgtaaaactcactaggataagcagtattattgaaccagacaaagcaacaagcaatgaaaccaaagacagataaagcagccaaactataagacaaataagcctctccagaccagacaagtgcgcggcgagcccatgcaaaaggtttagttaagatatgccagattccaccaagtatacaaatgaaacctatccatacatgccccccgattatatcttccaaatcgtccacactaacaatccacccttctcctccaaaaggcgattttagtaaataaccaaagataatactcggactaagggtgacgttggtaatttttcttacatctccgcctcctggagcccaggtatcatatacgcccccaaaataaagagccttgaacactagaagaaaggcgcctatacctaacaagattaagtgaatgcccaaaattgtggtcattttatttctatctttccacacataaccgaagaatggaaaagattcttcaagagtttcagggcccagaagtgcatgataaatacccccaaagcccaatacggccgacgaaattaagtgaaggactcctgatacaaagtatggaaaagtgtctataacttccccgccggggcctaccccccaacctagagtagctaggtggggaagtaaaattaatccttgttcatacatcggcttctctggtacgaaatgagccacttcaaacaggttcattgctccggcccagaatacgattaatccggcatgggctacatgagctccaagtagtttaccagataaattgataagtcgagcattcccggcccaccaagcgaaaccggtggtttcttggtcacgtccggctatagttaaagttccattaaagagcgtttccacggggtagaacctcctcagggaatataaggttttcatgaggctgatcttgagccgccatccaagcacgaataccttcgtttaagagaatatttttggtgtagaaagtttcaaattcaggatcttccgctgcacggatttcctgggaaacgaagtcataggcacgtaggttcaaagccagaccgactactccaagagcactcatccataaaccggttactggtacaaataacataaagaaatgtaaccaacgtttattggaaaaagcaaccccaaaaatttgggaccaaaagcggttagcggtgaccattgaataagtttcttcggcttgggttgggttaaaagcccggaatgtatttgccccatcaccgtcttcaaataaagtattttctacgg

SEQ ID NO: 4278 - DNA, 1720 bp, Chelidonium majus
gtatgacctgatcccaatcccaatatgtataatggaatcaaattgattcccacttcaggcatttgatctcctatctcagttaagaggggtcatgaaaaggacaggttccaaatcacgatcaattcctttttcaaatcctgctgcagctgcgcgggcccttcccgcatgccacaaatgacccacgaataggaagaatcctagaacaaaatgagaggtagctaaccaacttctaggagaaacataattgactgcattgatctcggtagctacgccacccacggaatttaaagaacctaatggagcatgagtcatatattccgcagaacgccgttcttgccaaggttggatgtcttttttcagcctactcaagtccaaaccattgggaccccttagaggttccaaccagggagcacggagatcccaaaaacgcatagtttctcctccaaaaataacttccccagttggggaacgcattagatatttacctaaaccggtaggtccttgagcggatcccacgttagccccaagacgttggtctctaactagaaaggtgaatgcttgcgcttgagaagcttctggcccagtgggcccgtaaaattcactaggataggcagtattattgaaccagacaaaacaacaagcgatgaaaccaaagacagataaagcagctaaactataagacaagtaagcctccccagaccatacaagtgcgcggcgagcccatgcaaagggtttggttaagatatgccagattccaccaagtatacaaatggaacctaaccatacatgtcctccaattatatcttctaaatcatccacactaacaatccagccttctcccccaaagggagattttagtaaataaccaaatataacacttgggctaagggtcaagttggtaatttttcttacatcgccccccccctggagcccaagtatcatatacgcccccaaaataaagagccttgagtactagaagaaaagcacctatacctaacaagattaggtgaatacccaaaattgtggtcattttatttctatctttccatacgtaaccgaagaatggaaaggattcttcaagagtctcgggcccgagaagtgaatgataaataccgccaaagcccaatactgcagaggaaattaagtgaagtactccagatacaaagtatggaaaggtgtctataacttccccaccaggacctaccccccaacctagagtagctagatggggaagtaaaatcaatccttgttcatacatgggcttctctggtacgaaatgagccacttcaaataagttcattgctccagcccagaatacgattaatccggcgtgggctacgtgagccccgagtagtttaccggacaaattgataagtcgggcattcccggcccaccaagcgaaaccggtggtttcttggtcacgaccagctaaagctaaagttccattaaagagcgtttccacggggtagaacctcctcagggaatataaggttttcatgaggctgatcctgagccgccatccaagcacgaataccttcgtttaaaagaatatttttggtgtagaaagtctcaaattcaggatcttccgctgcacggatttcctgggaaacgaagtcataggcacgcagattcagagccagaccgactactccaagagcactcatccataaaccggttactggtacaaataacataaagaaatgtaaccaacgtttattgg

SEQ ID NO: 4279 - DNA, 4398 bp, Euonymus alatus
attttttttgtatttgcttgcatttcaagagttatgcattttgaagaattatatcgaactttaatgtgtctcgcacaaccgaaagaatacggagggggggttatctggaatgaatagggtcaagagatgagagaattaaggatacctaccagaaagactaatccaatccataaagatgtccccgaaaatacaacatttttgttactcgaccaaccctcaggagaagcaaatacaacgggtacactaatcagtaagattaatgacgtagcaattaatgcaaaaacagccaattggaaagcaatagtcatctttctaatcctccaagttaccaacaaaagaactataccatttgatccctctcttattcaaaaaacaaatctaattataagaaaatgtatcatagagggattttccattttaccatgaatccattaattctatatgccttattaacaccccgttaacactttattcgggcatggggtcaggagtagttttctttttttttttttttacttcacaaatggtcgtgctagatgatgcatctctaaatagatagtcttttcaatttactccagattctttttctatagatagtcatagtatccgttcctatgctctggtcatgttctattcggtagactcaattttaaaactttttaaaagaatttagaaattcattctcttttggagagatggccgagtggttgatagctctggtcttgaaaaccggtatagttcagaacaaagaactatcgagggttcgaatccctctctctccttttgcttggcgaatatatatatatatatatttttttattggttttgcctggttcagtagcataaaggtgaatggctcggctatgctacctagccgagccaaaaaaagaggttagatataactgaaatgggttcaaaagaaaggaaaaggatgcttttttttttagtatgacccaatctacccaactagatcaaatatgtattagccatggtggaagtaaattaaatactacttctaaatactacttcaagtagtggatctcttgcctcagttaagaggagtcatggaaagaacaggctcaaaatcgcgatcaattcctttttcaaatcccgcagcagccgctcgagcccttcccgcgtgccataaatgacctacgaaaaggaagaatcctagaacaaaatgagaggtagctaaccaacttctaggagaaacataattgaccgcattgatctcggtagctacgccacccacagaatttaaagagcccaacggggcatgggtcatatattccgcggaacgtcgttcttgccagggttgtatgtcttttttcagcctactcaagtccaaaccattgggaccccttagaggttctaaccagggagcacgcaaatcccaaaaacgcatagtttcacctccaaaaataacttctccggtcggggaacgcattagatatttacctaaaccagtaggtccttgagcagatcccacgttagccccaagacgttggtctctaactagaaaagtaaatgcttgggcttgagaagcttctgggccggtaggcccgtaaaactcactaggataagcggtattattgaaccagacaaagcaacaagcaatgaaaccaaaaacagataaagcagctaaactataagacaggtaagcctctccagaccatacaagcgcacggcgagcccatgcaaaaggtttggttaagatatgccagattccaccaagtatacaaatggaacctatccatacatgtcctccaattatatcttcgaaatcgtccacactaacaatccatccttctcctccaaagggggattttagtaaatacccaaatataacacttggactaagagtcaagttggtaatttttcttacatctcccccccccggagcccaggtatcatatacgcccccaaaataaagagctttaaatactaacagaaaggcacctagacctaacaagattaagtgaatacccaaaattgttgtcattttatttctatctttccatacataaccaaagaatggaaaagattcttcaagggtctcaggtcccagaagtgcatgataaataccgccaaagcctaatactgcggaggaaattaagtgaagcactccagatacaaagtatggaaaggtatctataacttctcccccaggacctaccccccaacctagagtagctaggtggggaagtaaaattaatccttgttcatacatcggtttctccggtacgaaatgagccacttcaaataagttcattgcgccggcccagaatacgattaatccggcatgtgctacatgagcccccagcagtttaccagataaattgataagtcgggcattcccggcccaccaagcgaacccggtgctttcttggtcacgaccagctaaagctaaagttccattaaagagcgtttccacggggtagaacctcctcagggaatataaggttttcatgaggctgatcttgagccgccatccaagcacgaataccttcgtttaaaagaatatttttggtgtagaaagtctcaaattcgggatcttccgctgcacggatttcctgagaaacgaagtcataggcacgtaggttcagagctagaccaactactccaagagcgctcatccataaaccggttactggtacaaataacataaagaaatgtaaccaacgtttattggaaaaagcaaccccaaagatttgagaccaaaagcggttggcagtaaccattgaataagtttcttcagcttgagttgggttaaaagcgcggaatgtatttgcaccatcaccatcttcaaataaagtattttcgacggtagccccatgaatagcacatagcagagcagcgcccaatacaccagcaacccccatcatatgaaatgggttcaatgtccaattatgaaatccttggaaaaagaggatgaatcgaaatatagctgctacaccaaaactaggtgcaaaaaaccaaccagactgacctagtggataaatcaagaataccgaaacaaaaacagcgattggagcagagaatgaaattgcattataaggtcgcaattgaacagatcgagcaagttcaaattgacgtaacatgaaaccgattagtccaaaagcgccgtggagagcaacaaaagtccacagaccacccaattgacaccagcgggtaaaatccccttgtgcctcgggaccccatagtaacaacaaagaatgcgctaaactattagcaggagtagaaactgcagcggttaagaagttgcagccttccaaataggaactggctaatccatgggtgtaccatgaagttacaaaggttgtacctgtgaaccaacctcctaaggcgaaataggcacaaggaaagagcaatagaccggaccaacctacaaaaacgaaacggtccctccttaaccagtcatccataatatcaaataaatccttttcttctttggtaaatttaccaagggctatagtcatagcgatcctcctattcaactacttcaaccatttccgaacaccccccgtagcatgtttagggctttggaagttttgatcattatatctacaatttgatttttcgtacattgccctctgccctttgaatgtgtttcgaagatcagaagatcaaaatcctttattggtccatcttgttccatcctgtcctaggtaaattcatgaattcaattcagttattccttacctatttaaccccatgaaccatgaattgtcttatgactcatcaatcagatagattcatcttttgaaagaaccgctcaaagaacaaaggatccttctctcgctactagttgattcgcagatctacttctctcctttcatcaactaatcttattcttggattttgttcgtgaggttgataaaatcaaaattcttccgtattcctctaatttctatgtccattaaactactacagtatcctgtattttattactttattttctttattctttcatgttttttattgtcttctttctgattctatttccttttccttcagaagaaaatcaaacttcagaaaatcaaacttcagagtctattttttcaggggctgaaagaagaaatacacatcaatttttttccatttcgttttatctgttagaaaggaaaaaagaatgcattttcctagaattaaatatatagaagactttaaattaaagtctttttatcacatttattctacattacattgtcagaacacaaatctcgtatgtaccaatagggaaatttttgatacatgaagccatgatctaatagatatatagaaatcttattctatctaattctacctaatattctatatcgattctctacagtatcgaaatttagaatctaaaaagagaatggataaaaaacaaacaaggagagatggagatataaa

SEQ ID NO: 4280 - DNA, 2638 bp, Quercus alba
gtgtctcacaacctgaaaatgaaagaattaggagggatcatttcatttttggatctaaatagaacaaataggttcaagagatgagagaattaaggatacccaccaaaaagactaatccaatccataatgatgtaccggaaaatacaacattttttgttatttgaccaaccatcaggagaagcaaatacaacaggtacactaatcagtaagattgttgaagtagcaattaatgcaaaaaacagccaattggaaagcaatagtcatctttctaatcctccaatctatcaacaaaagaaactatataccatttgatccctttattggtatcggccaaaaaaattgtatcagccaaaaaattctaataaaaacgtatcatagagggattttaccacgaatctattaatgctgtatgacttattagcaccttttaccaccttattaaatcttattaaattaaggcatgagatcaagggaaaggtttttttttttttacttcattaaaagaggcccgccagatcattatctatatatatacagatcgatagctagacccataggatcgcaccggatatctttatatatataggtcgtaatggtatcaactcatatatccatgttctattcgttaagaaaatataaaaaaaaaataataaaatagaaataatctttcggagaggtggccgagtggttgatagctccggtcttgaaaaccggtatagttcgaaacaaagaactatcgagggttcgaatccctctctctcctttttgctcgtggaatatatatatatattttattttattggttttgtccggctcagtattagtattctaaaagggaatggctcggctagggggatagccgagccagaacaggaaaaaaaagggttcaatatataatgagtcgaaaatgaaaataaaggaatacttttttttcaatacgtatgacctaacccaaccaaacaaatatgtatgatgaaatcaaatagattttgacttcaagcattagaattagatctcctgtcttagttaagaggagtcatggaaagaacaggttcaaaatcgcgatcaatcctttttcaaatcctgctgcagctgcacgagcccttcctgcatgccataaatgacctacgaataggaagaatcctagaacaaaatgagaggtagctaaccaacttctaggagagacataattgactgcattgatctcggtagctacaccacccacggaatttaaagaacctaaaggagcatgagtcatatattccgcggaacgtcgttcttgccaaggttgtatgtcttttttcagcctactcaagtccaacccattgggaccccttaggggttctaaccagggagcacgcaaatcccaaaaacgcatagtttctcccccaaaaatgacttctccagtcggagaacgcattagatatttacctaaaccggtaggtccttgggcggaccctacgttagccccaaggcgttggtctctaaccagaaaagtaaatgcttgagcttgagaagcttctggtccagtgggcccgtaaaactcactaggataagcggtattattgaaccaaacaaagcaacaagcaataaaaccaaaaacagctaaagcacctaaactataagacaagtaagcctccccagaccatacaagcgcacggcgcgcccatgcaaaaggtttggttaagatatgccagattccaccaagtatacaaatggaacccaaccatacatgccctccaattatatcttccaaatcgtccacactaacaatccatccctctcctccaaaaggggattttagtaaataaccaaatatgacgcttgggctaagggtcaagttggtaatttttcttacatctccccctcccggggcccaggtatcatatacgcctccaaaataaatagctttgaatactagaagaaaagcacctatacctaacaaaattaagtgaatacccaaaattgtagtcattttattctatctttccatacataaccgaagaatggaaaagactcttcaagagtctcgggtcccagaagtgcgtgataaataccgccaaagcccaatactgcagaggaaattaagtgaagtactccagacacaaagtatggaaaggtatctataacttccccaccaggacctacccccaacctagagtagctaggtggggaagtaaaattaatccttgttcatacatgggcttttctggtacgaaatgagccacttcaaataggttcattgctccggccccagaatacgattaatccggcatgggctaacatgagctcccagtaatttaccggataaaattgataagtcgggcattcccggcccaccaagcgaaacctgtggtttcttggtcacgaccggctaaggctaaagttccattaaagagcgtttccacggggtagaacctcctcagggaatataaggttttcatgaggctgatcttgagccgccatccaagcacgaatgccttcatttaaaagaatatttttggtgtagaacgtctcaaattcaggatcttccgctgcacggatttcctgagaaacgaagtcataggcgcgtaggttcagagccaagccgactactccaagagcactcatccataaaccggttactggtacaaataac

SEQ ID NO: 4281 - DNA, 3371 bp, Quercus alba
actttatatttcatttttaatgtgtctcacaacctgaaaatgaaagaattagaggggatcatttcatttttggatctaaatagaacaaataggttcaagagatgagagaattaaggatacccaccaaaagactaatccaatccataatgatgtaccggaaaatacaacatttttgttatttgaccaaccatcaggagaagcaaatacaacaggtacactaatcagtaagattgttgaagtagcaattaatgcaaaaacagccaattggaaagcaatagtcatctttctaatcctccaatctatcaacaaaagaaactatataccatttgatccctttattggtatcggccaaaaaattgtatcagccaaaaattctaataaaacgtatcatagagggattttaccacgaatctattaatgctgtatgacttattagcaccttttaccaccttattaaatcttattaaattaaggcatgagatcaagggaaaggtatttttttttttacttcattaaaagaggcccgccagatcattatctatatatatacagatcgatagctagacccataggatcgcaccggatatctttatatatataggtcgtaatggtatcaactcatatatccatgttctattcgttagaaaaataaaaaaaaaataataaaatagaaataatctttcggagaggtggccgagtggttgatagctccggtcttgaaaaccggtatagttcgaaacaaagaactatcgagggttcgaatccctctctctccttttttgctcgtggaatatatatatattatttttattttattggttttgtccggctcagtattagtattctaaaagggaatggctcggctagggggatagccgagccagaacagaaaaaagggttcaatatataatgagtcgaaaatgaaaataaaggaatacttttttttttcaatacgtatgacctaacccaaccaaacaaatatgtatgatgaaatcaaatagattttgacttcaagcattagaattagatctcctgtcttagttaagaggagtcatggaaagaacaggttcaaaatcgcgatcaatcctttttcaaatcctgctgcagctgcacgagcccttcctgcatgccataaatgacctacgaataggaagaatcctagaacaaaatgagaggtagctaaccaacttctaggagagacataattgactgcattgatctcggtagctacaccacccacggaatttaaagaacctaaaggagcatgagtcatatattccgcggaacgtcgttcttgccaaggttgtatgtctttttttcagcctactcaagtccaacccattgggaccccttaggggttctaaccagggagcacgcaaatcccaaaaacgcatagtttctcccccaaaaaatgacttctccagtcggagaacgcattagatatttacctaaaccggtaggtccttgggcggaccctacgttagccccaaggcgttggtctctaaccagaaaagtaaatgcttgagcttgagaagcttctggtccagtgggcccgtaaaactcactaggataagcggtattattgaaccaaacaaagcaacaagcaataaaaccaaaaacagctaaagcacctaaactataagacaagtaagcctccccagaccatacaagcgcacggcgcgcccatgcaaaaggtttggttaagatatgccagattccaccaagtatacaaatggaacccaaccatacatgccctccaattatatcttccaaatcgtccacactaacaatccatccctctcctccaaaaggggattttagtaaataaccaaatatgacgcttgggctaagggtcaagttggtaatttttcttacatctccccctccggggcccaggtatcatatacgcctccaaaataaatagctttgaatactagaagaaaagcacctatacctaacaaaattaagtgaatacccaaaattgtagtcattttatttctatctttccatacataaccgaagaatggaaaagactcttcaagagtctcgggtcccagaagtgcgtgataaataccgccaaagcccaatactgcagaggaaattaagtgaagtactccagacacaaagtatggaaaggtatctataacttccccaccaggacctaccccccaacctagagtagctaggtggggaagtaaaattaatccttgttcatacatgggcttttctggtacgaaatgagccacttcaaataggttcattgctccggcccagaatacgattaatccggcatgggctacatgagctcccagtaatttaccggataaattgataagtcgggcattccccggcccaccaagcgaaacctgtggtttcttggtcacgaccggctaaggctaaagttccattaaagagcgtttccacggggtagaaccccctcagggaatataaggttttcatgaggctgatcttgagccgccatccaagcacgaatgccttcatttaaagaatatttggtgtagaacgtctcaaattcaggatcttccgctgcacggatttcctgagaaacgaagtcataggcgcgtaggttcagagccaagccgactactccaagagcactcatccataaaccggttactggtacaaataacataaagaaatgtaaccaacgtttattggaaaaagcaaccccaaagatttgggaccaaaagcggttagcggtgaccattgaataagtttcttccgcttgagttgggttaaaagcacggaatgtatttgcgccatcaccatcttcaaataaagtattttctacggtagcaccatgaatagcgcatagaagggcagcgcccaatacaccggcaacccccatcatatgaaatgggttcaatgtccaattatgaaacccttggaaaagaggatgaatcgaaatatagctgcgacaccaaaactgggcgcaaagaaccaaccagactgacctagcggataaatcaggaatacagaaacaaaaacagcaattggagcagagaatgcgattgcattataaggtcgcaattgaacagatcgagcaagttcaaattgacgtaacatgaaacctattagtccgaaagcgccgtggagagcaacaaaagtccacagaccgcctaattgacaccaacgagtaaaaatccccttgtgcttctcggaccccatagtaacaacaaagagtgtgctaaactattagcaggagtagaaactgccgcggttaagaagttgcagccttccaaataggaactcgccaatccatgtgtataccatgaagttacaaaggttgtacctgtaaaccaacctcctaacgcgaaataagcacaaggaaagagcaatatactacgtgt

SEQ ID NO: 4282 - DNA, 2541 bp, Allium cepa
ttaactaagtggggtcataaaaagaacaggttccaaatcgcgatcgattcctttttcaaatcctgctgcagctgcacgggcccttcccgcatgccacaaatgacccacaaatagaaaaaatcctagaacaaaatgagaggtagctaaccaacttctaggagagacataattaactgcatttatctcggtagctacgccacctacagaatttaaagaacctaaaggagcatgagtcatatattctgccgaacgtcgttcttgccaaggttgtatatcttttttcagcctactcaagtccaaaccattgggaccccgtagaggttctaaccagggagcacggagatcccaaaaaacgcatagtttctcctccaaaaataacctctcccgtaggggaacgcattagatatttacctaaaccagtgggtccttgggcagatccaacgttggccccaagacgttggtctctaactagaaaagtaaatgcttgagcttgagaagcttctggtccggtgggcccgtaaaactcactaggataagcggtattattgaaccaaacgaaacaacaagcgatgaaaccaaagacagataaagcagctaaactataagacaagtaagcctctccagaccatacaagtgcacggcgagcccacgcaaagggtttggttaagatatgccaaattccaccaagtatacaaatggaacctaaccatacatgtcctccaattatatcttctaaatcgtccacactaacaatccatccttctcctccaaaaggggattttagtaaataaccaaatataacacttgggctaagtgtcaaattggtaatttttcttacatctcccccccccggtgcccaggtatcatatacgcctccaaaataaagagccttgaatactaaaagaaaagcacctatacctaataaaattaagtgaatacccaaaattgtcgtcattttatttctatctttccatacataaccaaagaatggaaaggattcctcaagagtctcaggtccaagaagcgcgtgataaatacccccaaagcccaagactgcagaggaaattaagtgaagtactccagatacaaagtatggaaaggtgtctataacttctccccccggacctatcccccaacctagagtagctaggtgtggaagtaaaatcaatccttgttcatacatgggtttctctggtacgaaatgagccacttcaaataggttcattgctccggcccagaatacgattaatccggcatgggctacgtgagccccaagtagtttaccagataaattgataagtctggcattcccggcccaccaagcgaaaccggtggtttcttggtcacgaccagctaaagctaaagttccattaaagagcgtttccacggggtagaacctcctcagggaatataaggttttcatgaggctgatcctgagctgccatccaagcacgaataccttcgtttaataaaatatttttggtgtagaaagtctcaaattcaggatcctccgctgcgcggatttcttgggaaacaaagtcataggcacgtaggttcaaagccagaccaactaccccaagagcactcatccataaaccggttactggcacaaataacataaagaaatgtaaccaacgtttattggaaaaagcaaccccaaagatttgggaccaaaagcggttagcagtgaccattgaataagtctcttcagcttgagttgggttaaaagcacggaatgtatttgcgccgtcaccatcttcgaataaagtattttctacggtagcaccatgaatagcgcatagcaaagcagcgcctaatactccggcaactcccatcatatgaaatgggtttaatgtccaattatgaaacccttggaagaagagaatgaatcgaaatatagctgctacaccaaaactgggtgcaaagaaccaaccagattgacccaatggataaataaggaatacagaaacaaaaacagcaattggaccagagaatgcgattgcattatatggtcgcagttgaacagatcgagcaagttcaaattggcgtaacataaaacctattagtccgaaagcaccatggagggcaacaaaagtccacagccctcctaattgacaccaacgagtaaaatccccttgtgcttcaggtccccatagtagtaataaagaatgtgctaaactatttgcaggggtagaaaccgcagcagttaagaaattacaaccttccaaataggaactggccaatccatgagtataccatgaagttacaaaagttgtacctgtgaaccaaccccctaaagcgaaataagcacaaggaaagagcaataggccggaccagcctacaaaaacaaaacggtccctccgtaaccagtcatccataatatcaaataaatcattttcttctttggtaattttaccaagagctatagtcatagtgatcctcctattcaactacttcaaccattccgaacacgtcatctcattttcagggcatgcgatagttcaattatgtatggacgattcgttgttccatgccctcccc

SEQ ID NO: 4283 - DNA, 2116 bp, Utricularia gibba
aatcgattggacttattaaaaccctttaaccactctattcgtaccataaggataaaataaatggaattttttgatttcacaacacaaaagtgcatgctggattatatgtgcgaatagatagatcgatcgctagattcacacctgagatctttttaccaatagtcgtggtatccattccttatggccttgttctattcagaagaataaaatagaaattgtctttcggagagatggctgagtggttgatagccccggtcttgaaaaccggtatagttttgaataaagaactatcgagggttcgaatccctctctctcctttttttgctcattgaatcaacttttttctagtgggtttgaacagattggtattataaagaaaaggggaatggctcggctatcggacttagccaagccagaaaaaaagaatacttttactttttattaagtacaatcttatcccaacatctaccatgtaatcaaagggattcctacttcaaggatctcctggattatcttaattaagaggagtcatggaaagaacaggttcaaaatcacgatcaattcctttttcaaatcctgctgcagctgcacgagcccttcccgcgtgccacaaatgacctacaaaaaagaagaatcctaaaacaaaatgagaggtagctaaccaacttctaggagagacataattcactgcattaatctcggtcgctacgccacccacagaatttaaagaacctaaaggagcatgggtcatatattctgcggaacgccgttcttgccaaggttgtatgtcctttttcaacctactcaagtccaatccatttgggcctcttaaaggttctaaccaaggagcacgaagatcccaaaaacgcatagtttcccctccaaaaattacttctccggtaggggaacgcattagatatttacctaaaccagtaggtccttgagcggatcctacattagccccaagacgttggtctcgaactagaaaagtaaacgcttgagcctgagaagcttctggtccagtaggtccgtaaaactcgctaggataagccgtattattgaaccagacaaaacaacaagcaatgaaaccaaagacagctaaagcccctaaactataagataaataagcctccccagaccatacaagggcacgtcgagcccacgcgaagggtttagttaaaatatgccagattccaccaattatacaaatggaacctaaccatacatgtcccccgattatatcttctaaatcgtcgacactaacaatccaccctccccccaaaagggggattttaataaataaccaaatatgatacttgggctaagggttaagttggtaatttttcttacatctccccctcctggcgcccaagtatcatatacacccccaaaataaagagccttgaagactagaagaaaagcacctagacccaacaagattaagtgaatccctaaaattgtggtcattttatttctatctttccatacataaccgaagaatggaaaagattcttccagcgtttcaggccccagaagtgcatgataaataccgccaaagcccaatacagcagaagaaattaaatgaagtactccagatacaaagtaaggaaaggtatctataacctctcccccaggacctaccccccaacctagagtagctagatgcggaagtaagattaatccttgttcatacataggtttctctggtacgaaatgagccacttcaaataggttcattgctccggcccagaatacgattaatccggcatgggctacatgagctcctagtagtttaccggataaattaataagtcgtgcatttccggcccaccaagcaaaaccggtggtttcttggtcacgaccagctatagctaaagttccattaaagagcgtttccacgtggtagaacctcctcagggaatataaggttttcatgaggctgatcttgagccgccatccaagcacgaataccctcgtttaatagaatatttttggtgtagaaagtctcaaattctggatcttccgctgcgcgaatttcctgagaaacaaagtcataggcacgtaggtttagggccaagccaactactccaagagcactcatccataaaccggttac

SEQ ID NO: 4284 - DNA, 1423 bp, Solanum phureja
atgaaaaccttatattcccggaggaggttctaccacgtggaaacgctctttaatggaactttagccttagctggtcgtgaccaagaaaccacaggtttcgcttggtgggccgggaatgcccgacttatcaatctatccggtaaactactaggggctcatgtagcccatgctggattaatcgtattctgggccggagcaatgaacctatttgaagtggcccatttcgtacccgagaagcctcattgtatgaacaaggattgattttacttccccacctagctactctaggttgggggtaggtcctaggggagaagttatagacacctttccatactttgtatctggagtacttcatttaatttcttctgtagtattgggctttggcggcatttatcatgcacttctgggacctgagacacttgaagaatcttttcccttctttggttatgtctggaaagatcgaaataaaatgaccacaattttaggtattcacttaatcttgttaggtataggtacttttcttctagtattcaaggctctttattttgggggcgtatatgatacctgggctccgggagggggagatgtaagaaaaattaccaacttgacccttagcccgagtatcatatttggttatttactaaaatccccttttggaggagaagggtggattgttagtgtggacgatttagaagatataatcggaggacatgtatggttaggttccatttgtatacttggtggaatctggcatatcttaaccaaacccttcgcatgggctcgacgcgcacttgtatggtctggagaggcttacttatcttatagtttaggggctttagccgtctttggtttcattgcttgttgttttgtctggttcaataataccgcttatcctagtgaattttacgggcctactggaccagaagcttctcaagctcaagcatttacttttctagttagagaccaacgtcttggggctaacgtgggatccgctcaaggacctactggtttaggtaaatatctaatgcgttccccaaccggagaagtcatttttggaggagaaactatgcgtttttgggatctgcgtgctccatggttagagcctctaaggggtccaaatgggttagacttgagtaggttgaaaaaagacatacaaccttggcaggaacggcgttccgcggaatatatgactcatgctcctttaggttctttaaattccgtgggtggtgtagctaccgagatcaatgcagtcaattatgtctctcctagaagttggttagctacctctcattttgttctaggattcttcttctttgtaggtcatttgtggcacgcaggaagggctcgtgcagctgcagcaggatttgaaaaaggaattgatcgtgactttgaacctgttctttccatgacccctcttaattga

SEQ ID NO: 4285 - DNA, 3224 bp, Chenopodium quinoa
aaaaacaagaaaaaggaatactttttacgtatgacctgatccccatatgtaatatgtatgatggaagccaattgatttataccttaaaacgttgaatttcttgtctcaattaaggggggtcattgaaagaacaggttcaaaatcacgatcaattcctttttcaaatcctgctgcagctgcacgagcccttcccgcatgccacaaatgacctacgaataggaaaaatcctaaaacaaaatgagaagtagctaaccaacttctaggagagacataattgactgcattgatctcggtagccaccccacccacagaatttaaagaacctaaaggagcatgggtcatatattctgcggaacggcgttcttgccaaggttgtatgtcttttttcagccgactcaagtccaaaccatttggacctcttaggggttctaaccagggagcgcgcaaatcccaaaaccgcatagtttctcccccaaaaataacttctccagtcggagaacgcattagatacttacctaaaccagtaggtccttgagcggatcccacgttagccccaagacgttggtctctaactaaaaaagtaaatgcttgagcttgagaagcttctggtccagtaggtccgtaaaactcactaggataagcagtattattgaaccagacaaagcaacaagcaatgaaaccaaagacagataaagcagccaaactataagacaaataagcctctccagaccagacaagtgcgcggcgagcccatgcaaaaggtttagttaagatatgccagattccaccaagtatacaaatgaaacctatccatacatgccccccgattatatcttccaaatcgtccacactaacaatccacccttctcctccaaaaggcgattttagtaaataaccaaagataatactcggactaagggtgacgttggtaatttttcttacatctccgcctcctggagcccaggtatcatatacgcccccaaaataaagagccttgaacactagaagaaaggcgcctatacctaacaagattaagtgaatgcccaaaattgtggtcattttatttctatctttccacacataaccgaagaatggaaaagattcttcaagagtttcagggcccagaagtgcatgataaatacccccaaagcccaatacggccgacgaaattaagtgaaggactcctgatacaaagtatggaaaagtgtctataacttccccgccggggcctacccccaacctagagtagctaggtggggaagtaaaattaatccttgttcatacatcggcttctctggtacgaaatgagccacttcaaacaggttcattgctccggcccagaatacgattaatccggcatgggctacatgagctccaagtagtttaccagataaattgataagtcgagcattcccggcccaccaagcgaaaccggtggtttcttggtcacgtccggctatagttaaagttccattaaagagcgtttccacggggtagaacctcctcagggaatataaggttttcatgaggctgatcttgagccgccatccaagcacgaataccttcgtttaagagaatatttttggtgtagaaagtttcaaattcaggatcttccgctgcacggatttcctgggaaacgaagtcataggcacgtaggttcaaagccagaccgactactccaagagcactcatccataaaccggttactggtacaaataacataaagaaatgtaaccaacgtttattggaaaaagcaaccccaaaaatttgggaccaaaagcggttagcggtgaccattgaataagtttcttcggcttgggttgggttaaaagcccggaatgtatttgccccatcaccgtcttcaaataaagtattttctacggtagcgccatgaatagcgcatagtagagcggcgcccaatacaccggcaactcccatcatatgaaatggattcagtgtccaattatgaaacccttgaaaaaagagaatgaatcgaaatatagctgctacaccaaaactaggtgcaaagaaccaaccagactgacctagtggataaattaggaatacagaaacaaaaacagcaattggaccagagaatgcgattgcattataagggcgcaattgaacggatcgagcaagctcgaattgacgtaacataaaacctattagtgcgaaagcaccatgaagagcaacaaaagtccacaggccgcctaattgacaccaacgagtaaagtctccttgtgcttcaggaccccacagtaacaataaagagtgggctaaactattagcaggagtagaaactgccgcggttaagaaattgcaaccttccaaataagaactggccaatccatgggtataccatgaagttacaaaggttgtacctgtaaaccaacctcctaaggcgaaataagcacaaggaaagagcaatagcccagaccaacctacaaaaacgaaacggtccctccgtaaccagtcatccatactatcaaataaatctttttcgtctttagtaaatttaccaacggctatagtcatagtgatcctcctattcaactacttcaaccatttccgagcaccccatagcattttttggaatccgagaattcgatcatttaatttatggatgatttgatttctcgtataatattagctataaggtttcgaaaaaaaattataattaaaataaattccgaaattcaattattccttaatttgaacttattagactcaactattaatcttttgaaagagctcgtcaaggaacaaccaatctactcgctcgttaccgactgatcctcaaatcgaccttttctttctatcaacgaattcaattaagcttattgttgcatcttgttcataaaacggagcaaaagaaataaatatctttcgagattattctctaataaatatatgtttcgtttttgtctatttatagttagtttttccttccgatcaatcggaaatgtcagaatatatcgtttcattttcacggatcgaagaaagatacagagaattttcgattttttacttaatttgaattccatatgatattcacaataaaatactaggaaacttaaaatgagagcttctttcacgcatgcattctctatcccattgtcggaacaaaaatatgggatgcatggatatagaaatagttggtacaggaaaccacactatcatcgcaatcttatttgatagataagatcgaaatgcaattccgtttt

SEQ ID NO: 4286 - DNA, 2867 bp, Quercus alba
acttatatttcatttttaatgtgtctcacaacctgaaaaatgaaagaattaggaggggatcatttcatttttggatctaaatagaacaaataggttcaagagatgagagaattaaggatacccaccaaaaagactaatccaatccataatgatgtaccggaaaatacaacattttgttatttgaccaaccatcaggagaagcaaatacaacaggtacactaatcagtaagattgttgaagtagcaattaatgcaaaaacagccaattggaaagcaatagtcatctttctaatcctccaatctatcaacaaaagaaactatataccatttgatccctttattggtatcggccaaaaaattgtatcagccaaaaattctaataaaacgtatcatagagggattttaccacgaatctattaatgctgtatgacttattagcaccttttaccaccttattaaatcttattaaattaaggcatgagatcaagggaaaggtatttttttacttcattaaaagaggcccgccagatcattatctatatatatacagatcgatagctagacccataggatcgcaccggatatctttatatatataggtcgtaatggtatcaactcatatatccatgttctattcgttagaaaataaaaaaataataaaatagaaataatctttcggagaggtggccgagtggttgatagctccggtcttgaaaaccggtatagttcgaaacaaagaactatcgagggttcgaatccctctctctccctttttgctcgtggaatatatatatatatttttattttattggttttgtccggctcagtattagtattctaaaagggaatggctcggctagggggatagccgagccagaacagaaaaaagggttcaatatataatgagtcgaaaatgaaaataaaggaatactttttttttctaatacgtatgacctaacccaaccaaacaaatatgtatgatgaaatcaaatagattttgacttcaagcattagaattagatctcctgtcttagttaagaggagtcatggaaagaacaggttcaaaatcgcgatcaattcctttttcaaatcctgctgcagctgcacgagcccttcctgcatgccataaatgacctacgaataggaagaatcctagaacaaaatgagaggtagctaaccaacttctaggagagacataattgactgcattgatctcggtagctacaccacccacggaatttaaagaacctaaaggagcatgagtcatatattccgcggaacgtcgttcttgccaaggttgtatgtcttttttcagcctactcaagtccaacccattgggacccccttaggggttctaaccagggagcacgcaaatcccaaaaaacgcatagtttctcccccaaaaatgacttctccagtcggagaacgcattagatatttacctaaaccggtaggtccttgggcggaccctacgttagccccaaggcgttggtctctaaccagaaaagtaaatgcttgagcttgagaagcttctggtccagtgggcccgtaaaactcactaggataagcggtattattgaaccaaacaaagcaacaagcaataaaaccaaaacagctaaagcacctaaactataagacaagtaagcctccccagaccatacaagcgcacggcgcgcccatgcaaaaggtttggttaagatatgccagattccaccaagtatacaaatggaacccaaccatacatgccctccaattatatcttccaaatcgtccacactaacaatccatccctctcctccaaaaggggattttagtaaataaccaaatatgacgcttgggctaagggtcaagttggtaatttttcttacatctccccctcccggggcccaggtatcatatacgcctccaaaataaatagctttgaatactagaagaaaagcacctatacctaacaaaattaagtgaatacccaaaattgtagtcattttatttctatctttccatacataaccgaagaatggaaaagactcttcaagagtctcggggtcccagaagtgcgtgataaataccgccaaagcccaatactgcagaggaaattaagtgaagtactccagacacaaagtatggaaaggtatctataacttccccacaggacctaccccccaactagagtagctaggtggggaataaaattaatccttgttcatacatgggcttttctggtacgaaatgagccacttcaaataggttcattgctccggcccagaatacgattaatccggcatgggctacatgagctcccagtaatttaccggataaattgataagtcgggcattcccggcccaccaagcgaaacctgtggtttcttggtcacgaccggctaaggctaaagttccattaaagagcgtttccacggggtagaacctcctcagggaatataaggttttcatgaggctgatcttgagccgccatccaagcacgaatgccttcatttaaaagaatatttttggtgtagaacgtctcaaattcaggatcttccgctgcacggatttcctgagaaacgaagtcataggcgcgtaggttcagagccaagccgactactccaagagcactcatccataaaccggttactggtacaaataacataaagaaatgtaaccaacgtttattggaaaaaagcaaccccaaagatttgggaccaaaagcggttagcggtgaccattgaataagtttcttccgcttgagttgggttaaaaagcacggaatgtatttgcgccatcaccatcttcaaataaagtattttctacggtagcaccatgaattagtcgtctatagaagggcagcgcccaatacaccatacgtgtcgt

SEQ ID NO: 4287 - DNA, 3497 bp, Elaeis guineensis
aaataccaaataagttcaagagatgagagaattaaggatagctaccagaaagactaatccaatccataatgatgtaccggaaaatacaacatttttgttacttgaccaaccatcagaagaagcaaatacaacgggtacactaatcagtaagattaatgaagtcgcaattaatgcaaaaacagctaattggaaagcaatagtcatgtttgtaatcctccaagctaccaacaaatgaactataccatttgatccctcgcttagtcaaaattgtatgtaataaaatgcatcatggagggatttgacatgaatcaattgattcggtaaaatttattaccactctattcggacatggagtcgagggaagtttagtattttcttcacaaacaaacatactggatcatgcatatatactatgcatatagtatacagatagatacatcgaaatatggattcgcatctgggatgtttctacggatagttagtgtatcatctcatatggtcatgttctattcgtaggaataaaatagagattacctctgggagagatggccgagtggttgatagctccggtcttgaaaaccggtatagttctgaacaacgaactatcgagggttcgaatccctctctctccttttgtttgttaaataaatttgtttctttattcgtttggcctggccccttttatttcataaaaggggatggctcggctaggtgggatagccgagccagaacagaaaaaaacaatagaatagatataaataagaaaatctcagctaaggggggtcgatggaaagaacaggttccaaatcacgatcgattcctttttcaaaccctgctgcagctgcacgggcccttcccgcatgccacaaatgccccacaaataggaagaatcctagaacaaaatgagaggtcgctaaccagcttctaggagagacataattgactgcattgatctcggtagctacgccacccactgaatttaaagaacctaaaggagcatgagtcatatattctgccgaacgtcgttcttgccaaggttgtatgtcttttttcagcctactcaagtccaaaccattgggaccccttaggggttctaaccagggagcacgaagatcccaaaaacgcatagtttctcctccaaaaataacctccccggtcggggaacgcattagatatttacctaaaccagtaggtccttgggcggaccccacgttagctccaagacgttggtctctaactagaaaggtaaatgcttgagcttgagaagcttctggcccggtgggtccgtaaaactcactaggataagcggtattattgaaccatacgaaacaacaagcgatgaaaccaaaaacagataaagcacctaagctataagacaagtaagcctctccagaccatacaaatgcacggcgagcccatgcaaagggtttggttaagatatgccaaattccaccaagtatacaaatggaacctaaccatacatgtcctccaattatatcttctaaatcgtccacactaacaatccatccttctcccccaaaaggagattttagtaaataaccaaatataacacttgggctaagtgttaagttggttatttttcttacatctccccccccaggggcccaggtatcatatacgcccccaaaataaagagccttgagtactagaagaaaagcacctatacctaacaaaattaagtgaatacccaaaattgtagtcattttatttctatctttccatacataaccgaaaaatggaaaagattcttcaagagtctcaggtccaagaagcgcatgataaataccgccaaagcctaagactgcagaggaaattaagtgaagtactccagatacaaagtatggaaaggtgtctataacttccccccccggactaccccccaacctagagtagctaggtgtggaagtaaaatcaatccttgttcatacatgggtttctctggtacaaaatgagccacttcaaataggttcattgctccggcccagaatacgattaatccggcatgggctacgtgagctccaagtagtttaccggacaaattgataagtctggcattcccggcccaccaagcgaaaccagtggtttcttggtcacgaccagctaaagctaaagttccattaaagagcgtttccacggggtagaacctcctcagggaatataaggttttcatgaggctgatcctgagccgccatccaagcacgaataccttcgtttaagaggatatttttggtgtagaaagtctcaaattcaggatcttccgctgcacggatttcttgggaaacgaagtcataggcacggaggttcagagccaggccgactaccccaagagcactcatccataaaccggttactggtacaaatagcataaagaaatgtaaccaacgtttattggaaaaagacaaccaaagatttgggaccaaaagcggttagcagtgaccattgaataagtctcttcggcttgagttgggttaaaagcacggaatgtatttgcaccgtcaccatcttcgaataaagtattttctacggtagcaccatgaatagcgcatagcagagcagcgcctaatactccggcaactcccatcatatgaaatgggttcaacgtccaattatgaaacccttggaagaagaggatgaatcgaaatatagctgctacgccaaaactgggcgcaaagaaccaaccagattgacccagtggataaatcaggaatacagaaacaaaaacagcaattggagcagagaatgcgattgcattataaggtcgcaattgcacagatcgagcaagttcgaattgacgtaacataaaacctattagtccgaaaacaccatggagagcaacaaaagtccacagaccgcctaattgacaccaacgagtaaaatccccttgtgcctcagggccccatagtagcaacaaggaatgtgctaaactattcgcaggagtggaaactgcagcggtcaagaaattgcaaccttccaaataggaactggccaatccatgggtataccatgaagttacaaaagttgtacctgtaaaccaacctcctaaagcgaaataagcacaaggaaagagcaataggccagaccagcctacaaaaacgaaacggtccctccgtaaccaatcatccataatatcaaataaatcattttcttctttggtaaatctaccaagggctatagtcatagtgatcctcctattcaactacttcaaccatttccgaacacctcatatcatttccaaggcatacgatagttcgattatctatggacgatttctcgcccaatgccccttaaaatgggtttcgaagatacaaatgcgtcttttttttctattgtattgggccacaaattaacctaggtaaatcgatgagctcgattcgattagtccttatactatatataaccatttgaaccctgaattgttctatgactcatattccagagtatatcttttaattccagagtatatcttttaacgtaac

SEQ ID NO: 4288 - DNA, 4547 bp, Tripterygium wilfordii
gcttgcatttcaagagttatgcgttttgaagaattatattgcattttaatgtatctcgcacaaccgaaagaattcggagggggggggattatctggaatgaatagggtcaagagatgagagaattaaggatacctaccagaaagactaatccaatccataaggatgtccccgaaaatacaacatttttgttactcgaccaaccctcaggagaagcaaatacaacgggtacactaatcagtaagattaatgacgtagcaattaatgcaaaaacagccaattggaaagcaatagtcatctttctaatcctccaagttaccaacaaaagaactataccatttgatccctctcttattcaaaaaacaaatctaattgtaagaaaatgtatcatagagggattttacttttaccatgaatccattaattctatatgacttattaacatcccgttaacactttattcgggcatggggtcaggagtagtttctttttttttttacttcacaaaaggtcgtgctagatgatgcatctctaaatagtatagagataaaaattcttttcaatttaaatttactacagatctttttctatagatagtcatggtatccgttcctatgctctggtcatgttctattcggtagactgaatttttaaaattgaaaaaagaatttataaattctcttttggagagatggccgagtggttgatagctccggtcttgaaaaccggtatagttcagaacaaagaactatcgagggttcgaatccctctctctccttttgcttggcgaatatgtatatttttttggttttgcctgtttcagtagcataaaggtgaatggcccggctatcctacctagccgagccaaaaaaagatgttagatataaatgaaatgggttgaaaagaaagtaaaaaggaatactttttttttgaagtatgacccaatctacccaactagatcaaatatgtattagccatggtggaagtaaattaaatactacttcaagtagtagatctcttgcctcagttaagaggagtcatggaaagaacaggctcaaaatcgcgatcaattcctttttcaaatcccgcagcagccgctcgagccctccccgcgtgccataaatgacctacgaaaaggaagaatcctagaacaaaatgagaggtagctaaccaacttctaggagaaacataattgaccgcattgatctcggtagctacgccacccacagaatttaaagagcccagcggggcatgggtcatatattccgcggaacgtcgttcttgccaaggttgtatgtcttttttcagcctactcaagtccaaaccattgggaccccttagaggttctaaccagggagcacgcaaatcccaaaaacgcatagtttcgcctccaaaaataacttctccggtcggggaacgcattagatatttacctaaaccagtaggcccttgagcagatcccacgttagccccaagacgttggtctctaactaggaaagtaaatgcttgggcttgagaagcttctgggccggtaggcccgtaaaactcactaggataagcggtattattgaaccagacaaagcaacaagcaatgaaaccaaaaacagataaagcagctaaactataagacaagtaagcctctccagaccatacaagcgcacggcgagcccatgcaaaaggtttggttaagatatgccagattccaccaagtatacaaatggaacctatccatacatgtcctccaattatatcttcgaaatcgtccacactaacaatccatccttctcctccaaagggggattttagtaaatacccaaatataacatttggactaagagtcaagttggtaatttttcttacatctcccccccccggagcccaggtatcatatacgcccccaaaataaagagccttaaatactaacagaaaagcgcctagacctaacaagattaagtgaatacccaaaattgttgtcattttatttctatctttccatacataaccaaagaatggaaaagattcttcaagggtctcaggtcccagaagtgcatgataaataccgccaaagcctaatactgcggaggaaattaagtgaagcactccagatacaaagtatggaaaggtatctataacttctccaccaggacctaccccccaacctagagtagctaggtggggaagtaaaattaatccttgttcatacattggtttctccggtacgaaatgagccacttcaaataagttcattgcgccggcccagaatacgattaatccggcatgtgctacatgagcccccagcagtttaccagataaattgataagtcgggcattcccggcccaccaagcgaacccggtgctttcttggtcacgaccagctaaagctaaagttccattaaagagcgtttccacggggtagaacctcctcagggaatataaggttttcatgaggctgatcttgagccgccatccaagcacgaataccttcgtttaaaagaatatttttggtgtagaaagtctcaaattcgggatcttccgctgcacggatttcttgagaaacgaagtcataggcacgtaggttcagagctagaccaactactccaagagcgctcatccataaaccggttactggtacaaataacataaagaaatgtaaccaacgtttattagaaaaagcaaccccaaagatttgagaccaaaagcggttggcagtaaccattgaataagtttcttcagcttgagttgggttaaaagcgcggaatgtatttgcaccatcaccatcttcaaataaagtattttcgacggtagcaccatgaatagcacatagcagagcagcgcccaatacaccagcaacccccatcatatgaaatgggttcaatgtccaattatgaaatccttggaaaaagaggatgaatcgaaatatagctgctacaccaaaactaggtgcaaaaaaccaaccagactgacctagtggataaatcaagaataccgaaacaaaaacagcgattggagcagagaatgaaattgcattataaggtcgcaattgaacagagcgagcaagttcaaattgacgtaacatgaaaccgattagtccgaaagcgccgtggagagcaacaaaaatccatagaccccccaattgacaccagcgggtaaaatccccttgtgcttcgggaccccatagtaacaacaaagaatgcgctaaactattagcaggagtagaaactgcagcggttaagaagttgcagccttccaaataggaactggctaatccatgggtataccatgaagttacaaaggttgtacctgtgaaccaacctcctaaggcgaaataggcacaaggaaagagcaatagaccggaccaacctacaaaaacgaaacggtccctccgtaaccagtcatccataatatcaaataaatccttttcttctttggtaaatttaccaagggctatagtcatagtgatcctcctattcaactacttcaaccatttccgaacaccctctagcatgtttagggctttggaagttttgatcattatatctacaatttgatttttcgtacattgccctctgccctttgaatgggtttcgaagatcaaaatcctctattgatattggtccatcctggcctaggtaaattcatgaattcagttattccttacttatttaaccccatgaaccatgaattgtcttatgactcatcaatcagatagattcatcttttgaaagaaccgctcaaagaacaaaggatccttctcttgctactagttgattcgcagatctacttctctcctttcatcaactaatcttattcttggattttgttcgtgagattgataaaatcaaaattcttccgtattcctctaatttctatgtacattaaactactacagtatcctgcattttattactttattttctttattctttcatcttcttttattgtcttctttcttattctatttctatttccttcagaagaaaataaagcttcagagtctattttttcaggggctgaaagaagaaatacacatcaatttttttttacatttcgttttatctgttagaaaggaaaaaagaataaattttcctagaattcaattcaatacaatattcaatgtatagaagactgtaaatgaaagtctctttctcacatttattgtacattacattgtccgaacacaaatctcgtctgtacaatagggaaatttttgatacatgaagccatgatctaatagatatatagaaatcttattctatctaattctacctaatattctatattgattctctatagtatctaaattcgaaatatataatctaaaaaaaaagataaagaaataaggagaaatggagataaaaaaaaaagctatcctgtgttctggaatcaaagaaggatatagaaaaggtctttgctatgtctcttatgttatgaaactttttttatgggaaagaaaggaatagttatttattcctatagagcatctaggagtaaaaagatttaatcggaaatatcgacggatttccgcagagacccaaagaaatatgaaaat

SEQ ID NO: 4289 - DNA, 2467 bp, Zostera marina
aaggatagctaccagaaagactaatccaatccataatgatgtaccggaaaatacaaaatttttgttactcgaccaaccatcagaggaagcaaatacaaccggtacactaatcaataaaattgatgaggttgcaattaatgcaaaaacagccaattggaaagcaatagtcatgcttataatcctccaaactaccaataaattaactataccatttaatcccttgctttcgcaaaattttgcgaaaatgaatcatggagagatttgatcatgaatacatggattctttataacttattaccactttttatatttaaatattatattgaatgggctggtggaatttcatctttctttactaaaaaaggggtatactgtaatctggatatagcgtacagattacagtatacagattgatacattgaaatatagattcgcatctacatttaagtgtatctacagataattagtatatcaatccatatggctatgtactatttgtcgaataaaatataaatagtcttttggagagatggctgagtggttgatagctccggtcttgaaaaccggtatagttctttgttcagaattatcgagggttcgaatccctctctctccttttacttgacttgttgaaaggttctttatgggcagagtttattgacataaaaaggaaaggctcggctaggtaggatagccgagccagaacaaaaaacgggtaaaaaatatcaactaagaggggtcatggaaagaacaggttctaaatcacgatcgattcctttttcaaatcctgctgcagctgcacgagctcttcctgcatgccataaatgacccacaaataggaagaaccctagaacaaaatgagaagtagctaaccaacttctaggagagacataattgactgcattgatctcagtagctacgccacccacagaatttaaagaacctaaaggagcatgagtcatatattccgccgaacgtcgttcttgccaaggttgtatgtcttttttcaacctactcaagtccaaaccattgggacctcttaaaggttccaaccaaggagcacggagatcccaaaaacgcatagtttcccctccaaaaatgacctctccagtgggagaacgcattaaatatttacctaaaccagtagggccttgagcggatcctatgttagccccaagacgttggtctctaactagaaaagtaaatgcttgagcttgagaagcctcaggtccggtgggcccataaaattcactaggataagcagtattgttgaaccagacaaaacaacaagcgatgaaaccaaagacagctaaagcagctaaactataagataagtaagcttctccagaccagacaagggcacggcgagcccatgcaaagggcttggttaagatatgccaaattccaccaaatatacaaatggaacccaaccatacatggcctccaattatatcttctaaatcgtctacactaacaatccagccctctcccccaaagggagattttaataaataaccaaatataacacttggactcagagttaagtttgtaatttttcttacatctcctcccccaggagcccaggtatcatatacaccaccaaaataaagagctttaaatactaaaagaaaagcgcctatacctaacaaaattaagtgaatacctaaaattagtggtcattttatttctatctttccatacatagccaaagaaaggaaaagattcttcaagagtctcaggtccaagaagtgcatgataaatacccccaaaacctaagactgcagaggaaattaagtgaagtaccccagatacaaagtaaggaaaggtgtctataacttccccacctggacctactccccaacctagagtagctagatgcggaagtaaaatcaacccttgttcatacatgggcttctcgggtacaaaatgggccacttcaaagaggttcattgctccggcccaaaatacaattaatccggcgtgggccacgtgggccccgagtagtttaccggacaaattgataagtctggcattcccggcccaccaggcgaaacctgtggtttcttggtcacggccagctaaagctaaagttccattaaagagcgtttccacggggtagaacctcctcagggaatataaggttttcatgaggctgatcttgagccgccatccaagcacgaataccttcgtttaagagaatatttttggtatagaaagtttcaaattcaggatcctccgctgcacggatttcctgagaaacgaaatcataggcacgcaggttgagagccagaccgactactccaagagcactcatccataaaccggttactggtacaaataacataaagaaatgtaaccaacgtttattggaaaaagcaaccccgaagatttgtgaccaaaagcggttagcagtgaccattgaataagtctcttccgcttgagttggattaaaagcacggaatgtatt

SEQ ID NO: 4290 - DNA, 3036 bp, Zostera marina
catggagagatttgatcatgaatacatggattctttataacttattaccacttttatatttaaatattatattgaatgggctggtggaatttcatccttctttactaaaaaaggggtatactgtaatctggatatagcgtacagattacagtatacagattgatacattgaaatatagattcgcatctacatttaagtgtatctacagataattagtatatcaatccatatggctatgtactatttgtcgaataaaatataaatagtcttttggagagatggctgagtggttgatagctccggtcttgaaaaccggtatagttctttgttcagaattatcgagggttcgaatccctctctctccttttacttgacttgttgaaaggttctttatgggcagagtttattgacataaaaaggaaaggctcggctaggtaggatagccgagccagaacaaaaacgggtaaaaaataatcaactaagaggggtcatggaaagaacaggttctaaatcacgatcgattcctttttcaaatcctgctgcagctgcacgagctcttcctgcatgccataaatgacccacaaataggaagaaccctagaacaaaatgagaagtagctaaccaacttctaggagagacataattgactgcattgatctcagtagctacgccacccacagaatttaaagaacctaaaggagcatgagtcatatattccgccgaacgtcgttcttgccaaggttgtatgtcttttttcaacctactcaagtccaaaccattgggacctcttaaaggttccaaccaaggagcacggagatcccaaaaacgcatagtttcccctccaaaaatgacctctccagtgggagaacgcattaaatatttacctaaaccagtagggccttgagcggatcctatgttagccccaagacgttggtctctaactagaaaagtaaatgcttgagcttgagaagcctcaggtccggtgggcccataaaattcactaggataagcagtattgttgaaccagacaaaacaacaagcgatgaaaccaaagacagctaaagcagctaaactataagataagtaagcttctccagaccagacaagggcacggcgagcccatgcaaagggcttggttaagatatgccaaattccaccaaatatacaaatggaacccaaccatacatggcctccaattatatcttctaaatcgtctacactaacaatccagccctctcccccaaagggagattttaataaataaccaaatataacacttggactcagagttaagtttgtaatttttcttacatctcctcccccaggagcccaggtatcatatacaccaccaaaataaagagctttaaatactaaaagaaaagcgcctatacctaacaaaattaagtgaatacctaaaattgtggtcattttatttctatctttccatacatagccaaagaaaggaaaagattcttcaagagtctcaggtccaagaagtgcatgataaatacccccaaaacctaagactgcagaggaaattaagtgaagtaccccagatacaaagtaaggaaaggtgtctataacttccccacctggacctactccccaacctagagtagctagatgcggaagtaaaatcaacccttgttcatacatgggcttctcgggtacaaaatgggccacttcaaagaggttcattgctccggcccaaaatacaattaatccggcgtgggccacgtgggccccgagtagtttaccggacaaattgataagtctggcattcccggcccaccaggcgaaacctgtggtttcttggtcacggccagctaaagctaaagttccattaaagagcgtttccacggggtagaacctcctcagggaatataaggttttcatgaggctgatcttgagccgccatccaagcacgaataccttcgtttaagagaatatttttggtatagaaagtttcaaattcaggatcctccgctgcacggatttcctgagaaacgaaatcataggcacgcaggttgagagccagaccgactactccaagagcactcatccataaaccggttactggtacaaataacataaagaaatgtaaccaacgtttattggaaaaagcaaccccgaagatttgtgaccaaaagcggttagcagtgaccattgaataagtctcttccgcttgagttggattaaaagcacgaaatgtatttgcaccgtcaccgtcttcaaataaagtattttctacagtagcaccatgaatagcgcacaatagagcagcacctagtactccagcaactcccatcatatgaaatgggttcaatgtccaattatgaaatccttggaagaaaaggatgaatcgaaatatagctgctacaccaaaactaggtgcaaaaaaccaaccggactggcccagtggataaattaagaatacagaaacaaaaacagcaattggaccggaaaatgcaattgcattataaggcctcaattgcacagatcgagcaagttcaaattggcgtaacataaagcctattagtccgaaagcaccatgaagagcaacaaaagtccacaaaccacctaattgacaccaacgagtgaaatctccttgtgcttcagggccccatagtaacaacaaagaatgtgctaaactattggcaggagttgaaattgcggcagttaagaaattgcagccttccaaataggagctggccaatccatgggtataccatgaagttacaaaagtagtacctgtgaaccaaccccctaaagcgaaataagcacaaggaaagagcaataaaccggaccaacccacaaaaacgaagcggtctcttcgtaaccaatcatccatactatcaaataaatctttttcttcttcgttaaatctaccaagggctacagtcatagttatcctcctattcaactacttcaaccatttccgaacacctgatagaatttctggggcatacaacagttcgattatctatagatgaggaatcgtccaataccccttccgacgggtttcgaagatacaaa

SEQ ID NO: 4291 - DNA, 1604 bp, Ricinus communis
atgaaaaccttatattccccgaggaggttctaccacgtggaaacgctctttaatggaactttatctttagccggtcgtgaccaagaaaccaccggtttcacttggtgggctaggaatgcccgacttattaatttatccggtaaactactgggagcccatgtagcccatgctggattaatcgtattctgggccggagcaatgaacctattcgaagtggctcatttcgtactagagaagccaatgtatgaacaaggattaattttacttccccacctagctactctgggttggggtgtaggccctggtggggaagttatagacacctttccatactttgtatctggcgtacttcacttaatttcctccgcagtattgggctttggcggtatttatcatgcacttctgggtcctgagactcttgaagaatcttttccattttttggttatgtatggaaagatagaaataaaatgacaacaattttaggtattcacttaatcttgctaggtataggtgcttttcttctagtattcaaggctctttattttgggggcgtatatgatacctgggctccgggggggggagatgtaagaaaaattactaacttaacccttagcccaagtgttattttcggttatttactaaaatccccttttggaggagaaggatggattgttagtgtggacgatttggaagatataattggagggcatgtatggttaggttccatttgtatactgggtggaatctggcatatcttaaccaaaccctttgcatgggctcgccgtgcacttgtatggtctggagaggcttacttgtcttatagtttaggtgtctactgtttttggtttcattgcttgttgctttgtctggttcaataataccgcttaccctagtgagttttacgggcctactggaccagaagcttctcaagctcaagcttttacttttctagttcgagatcaacgtcttggggctaacgtgggatctgctcaaggacctaccgggttaggtaaatatttaatgcgttcgcctaccggagaagttatttttggaggcgaaactatgcgtttttgggatctgcgtgctccttggttagaacctctaagaggtccaaatggtttggacttgagtaggttgaaaaaagacatacaaccttggcaagaacgccgttccgcagaatatatgacccacgcgcctttaggttcgttaaattctgtaggtggcgtagctaccgaaatcaatgcagtcaattatgtctctcctagaagttggttagctacctctcattttgttctagggttcttcctattcgtaggtcatttatggcacgcgggaagggctcgtgcagctgcagcaggatttgaaaagggaattgatcgtgattttgaacccgttctttccatgactcctcttaactaactgagacaagagatccaatagttaaatcgatcttaaaaagtattcctttttcctttcttttcaattcatttagatctaatctatttttttctggctcggctatcccatctagccgagccatttacatttatgatactgggccggtcaaaaccaataaagacataaatctattcatacgaagaaa

SEQ ID NO: 4292 - DNA, 1455 bp, Chenopodium quinoa
tgtctcaattaaggggggtcattgaaagaacaggttcaaaatcacgatcaattcctttttcaaatcctgctgcagctgcacgagcccttcccgcatgccacaaatgacctacgaataggaaaaatcctaaaacaaaatgagaagtagctaaccaacttctaggagagacataattgactgcattgatctcggtagccaccccacccacagaatttaaagaacctaaaggagcatgggtcatatattctgcggaacggcgttcttgccaaggttgtatgtctttttcagccgactcaagtccaaaccatttggacctcttaggggttctaaccagggagcgcgcaaatcccaaaaccgcatagtttcctcccccaaaaataacttctccagtcggagaacgcattagatacttacctaaaccagtaggtccttgagcggatcccacgttagccccaagacgttaggtctctaactaaaaaagtaaatagcttgagcttgagaagcttctggtccagtaggtccgtaaaactcactaggataagcagtattattgaaccagacaaagcaacaagcaatgaaaccaaagacagataaagcagccaaactataagacaaataagcctctccagaccagacaagtgcgcggcgagcccatgcaaaaggtttagttaagatatgccagattccaccaagtatacaaatgaaacctatccatacatgccccccgattatatcttccaaatcgtccacactaacaatccacccttctcctccaaaaggcgattttagtaaataaccaaagataatactcggactaagggtgacgttggtaatttttcttacatctccgcctcctggagcccaggtatcatatacgcccccaaaataaagagccttgaacactagaagaaaggcgcctatacctaacaagattaagtgaatgcccaaaattgtggtcattttatttctatctttccacacataaccgaagaatggaaaagattcttcaagagtttcagggcccagaagtgcatgataaatacccccaaagcccaatacggccgacgaaattaagtgaaggactcctgatacaaagtatggaaaagtgtctataacttccccgccggggcctaccccccaacctagagtagctaggtggggaagtaaaattaatccttgttcatacatcggcttctctggtacgaaatgagccacttcaaacaggttcattgctccggcccagaatacgattaatccggcatgggctacatgagctccaagtagtttaccagataaattgataagtcgagcattcccggcccaccaagcgaaaccggtggtttcttggtcacgtccggctatagttaaagttccattaaagagcgtttccacggggtagaacctcctcagggaatataaggttttcatgaggctgatcttgagccgccatccaag

SEQ ID NO: 4293 - DNA, 1792 bp, Papaver somniferum
cttaacctggtatcataaggtgaaatggctcggctatcccacctagccgagccagaaaaaagaaagtaaaaaggaacactttttaagtatgacctaatccaaatgatggaatcaaattgattcctacttcaggcatttgatctcctgtctcagttaagaggggtcatgaaaagaacaggttccaaatcacgatcaattcctttttcaaatcctgctgcagctgcacgagctcttcccgcatgccataaatgacccacgaataggaagaatcctagaacaaaatgagaggtagctaaccaacttcgaggagaaacataattgactgcattgatttcagtagctacgccacccacggaatttaaggaacctaaaggagcatgggtcatatattccgcagaacgccgttcttgccaaggttggatgtcttttttcagcctgctcaagtccaagccatttggaccccttagaggttccaaccagggagcgcggaggtcccaaaaacgcatagtttctcctccaaaaatgacctcccctgttggggaacgcattagatatttacctaaaccggtaggtccttgagcggatcccacgttagccccaagacgttggtctcgaactagaaaggtgaatgcttgcgcttgagaagcttctggcccagtgggcccgtaaaattcactaggataagcagtattattgaaccagacaaaacaacaagcgatgaaaccaaagacagataaagcagctaaactataagacaagtaagcctccccagaccatacaagggcgcgacgggcccatgcaaagggtttggttaagatatgccagattccaccaaatatacaaatggaacctaaccatacatgccctccaattatatcttctaagtcgtctacactaacaatccatccttctcccccaaaaggagattttagtaaataaccaaatataacacttgggctaagggtcaggttagtaatttttcttacatcgccccccccaggagcccaagtatcatatacgcccccaaaataaagagccttgagtactagaagaaaagcacctatacctaataagattaagtgaatacccaaaattgtggtcattttatttctatctttccatacataaccgaagaatggaaaagattcttcaagagtctcaggtccgagaagtgaatgataaataccgccaaagcccaatactgcagaggaaattaagtgaagtactccagatacaaagtatggaaaggtgtctataacttccccaccaggacctaccccccaacctagagtagcaagatggggaagtaaaatcaatccttgttcatacatgggtttttctggtacgaaatgggccacttcaaataagttcattcctccagcccagaatacaattaatccggcgtgagctacgtgagccccaagtagtttaccggacaaatttataagtcgggcattcccggcccaccaagcgaaaccggtggtttcttggtcacgaccagctaaagctaaagttccattaaagagcgtttccacggggtagaacctcctcagggaatataaggttttcatgaggctgatcctgagccgccatccaagcacgaataccctcgtttaaaagaatatttttagtgtagaaagtctcaaattcaggatcttccgctgcgcgtatttcctgggaaacgaagtcataggcacgcaggttcagagccaggccgactactccaagagcactcatccataaaccggttactggtacaaataacataaagaaatgtaaccaacgtttattg

SEQ ID NO: 4294 - DNA, 2543 bp, Quercus alba
ttactttgtttgtcatttgggacttatattcatttaatgtgtctcacaacctgaaatgaaagaattaggagggatcattcatttggatctaatagaacaataggttcaagagatgagagaattaaggatacccaccaaaagactaatccaatccataatgatgtaccggaaatacaacattttgttatttgaccaaccatcaggagaagcaaatacaacaggtacactaatcagtaagattgttgaagtagcaattaatgcaaaaaacagccaattggaaagcaatagtcatctttctaatcctccaatctatcaacaaaagaaactatataccatttgatccctttattggtatcggccaaaaaattgtatcagccaaaaattctaataaaacgtatcatagagggatttttaccacgaatctattaatgctgtatgacttattagcaccttttaccaccttattaaatcttattaaattaaggcatgagatcaagggaaaggtatttttttttttactttcattaaaagaggcccgccagatcattatctatatatatacagatcgatagctagacccataggatcgcaccggatatctttatatatataggtcgtaatggtatcaactcatatatccatgttctattcgttagaaaataaaaaaaaaataataaaatagaaataatctttcggagaggtggccgagtggttgatagctccggtcttgaaaaccggtatagttcgaaacaaagaactatcgagggttcgaatccctctctctccttttttgctcgtggaatatatatatatatttttattttattggttttgtccggctcagtattagtattctaaaagggaatggctcggctagggggatagccgagccagaacagaaaaaagggttcaatatataatgagtcgaaaatgaaaataaaggaatacttttttcaatacgtatgacctaacccaaccaaacaaatatgtatgatgaaatcaaatagattttgacttcaagcattagaattagatctcctgtcttagttaagaggagtcatggaaagaacaggttcaaaatcgcgatcaattcctttttcaaatcctgctgcagctgcacgagcccttcctgcatgccataaatgacctacgaataggaagaatcctagaacaaaatgagaggtagctaaccaacttctaggagagacataattgactgcattgatctcggtagctacaccacccacggaatttaaagaacctaaaggagcatgagtcatatattccgcggaacgtcgttcttgccaaggttgtatgtcttttttcagcctactcaagtccaacccattgggaccccttaggggttctaaccagggagcacgcaaatcccaaaaaacgcatagtttctcccccaaaaaatgacttctccagtcggagaacgcattagatatttacctaaaccggtaggtccttgggcggaccctacgttagccccaaggcgttggtctctaaccagaaaagtaaaatgcttgagcttgagaagcttctggtccagtgggcccgtaaaactcactaggataagcggtattattgaaccaaacaaaagcaacaagcaataaaaccaaaaaacagctaaagcacctaaactataagacaagtaagcctccccagaccatacaagcgcacggcgcgcccatgcaaaaggtttggttaagatatgccagattccaccaagtatacaaatggaacccaaccatacatgccctccaattatatcttccaaatcgtccacactaacaatccatccctctcctccaaaaagggggattttagtaaataaccaaatatgacgcttgggctaagggtcaagttggtaatttttcttacatctccccctcccggggcccaggtatcatatacgcctccaaaataaatagctttgaatactagaagaaaagcacctatacctaacaaaattaagtgaatacccaaaattgtagtcattttatttctatctttccatacataaccgaagaatggaaaagactcttcaagagtctcgggtcccagaagtgcgtgataaataccgccaaagcccaatactgcagaggaaattaagtgaagtactccagacacaaagtatggaaaggtatctataacttccccaccaggacctaccccccaacctagagtagctaggtgggaagtaaaattaatccttgttcatacatgggcttttctggtacgaaatgagccacttcaaataggttcattgctccggcccagaatacgattaatccggcatgggctacatgagctcccagtaatttaccggataaattgataagtcgggcattacccggcccacctaagcgaaaacctgtggtttcttggtcacgaccggctaaggctaaagttccattaaagagcgtttccacgggggtagaacctcctcagggaatataaggttttcatgaggctgatcttgagccgccatccaagcacgaatgccttcatttaaaagaatatttttggtgtcccat

SEQ ID NO: 4295 - DNA, 1483 bp, Chenopodium quinoa
tatgtaatatgtatgatggaagccaattgatttataccttaaaacgttgaatttcttgtctcaattaaggggggtcattgaaagaacaggttcaaaatcacgatcaattcctttttcaaatcctgctgcagctgcacgagcccttcccgcatgccacaaatgacctacgaataggaaaaatcctaaaacaaaatgagaagtagctaaccaacttctaggagagacataattgactgcattgatctcggtagccaccccacccacagaatttaaagaacctaaaggagcatgggtcatatattctgcggaacggcgttcttgccaaggttgtatgtcttttttcagccgactcaagtccaaaccatttggacctcttaggggttctaaccagggagcgcgcaaatcccaaaaccgcatagtttctcccccaaaaataacttctccagtcggagaacgcattagatacttacctaaaccagtaggtccttgagcggatcccacgttagccccaagacgttggtctctaactaaaaaagtaaatgcttgagcttgagaagcttctggtccagtaggtccgtaaaactcactaggataagcagtattattgaaccagacaaagcaacaagcaatgaaaccaaagacagataaagcagccaaactataagacaaataagcctctccagaccagacaagtgcgcggcgagcccatgcaaaaggtttagttaagatatgccagattccaccaagtatacaaatgaaacctatccatacatgcccccgacttatatcttccaaatacgtccacactaacaatccacccttctcctccaaaaggcgattttagtaaataaccaaagataatactcggactaagggtgacgttggtaatttttctttacatctccgcctcctggagcccaggtatcatatacgcccccaaaataaagagccttgaacactagaagaaaggcgcctatacctaacaagattaagtgaatgcccaaaattgtggtcattttatttctatctttccacacataaccgaagaatggaaaagattcttcaagagtttcagggcccagaagtgcatgataaatacccccaaagcccaatacggccgacgaaattaagtgaaggactcctgatacaaagtatggaaaagtgtctataacttccccgccggggcctaccccccaacctagagtagctaggtggggaagtaaaattaatccttgttcatacatcggcttctctggtacgaaatgagccacttcaaacaggttcattgctccggcccagaatacgattaatccggcatgggctacatgagctccaagtagtttaccagataaattgataagtcgagcattcccggcccaccaagcgaaaccggtggtttcttggtcacgtccggctatagttaaagttccattaaagagcgtttccacggggtagaacctcctcagggaatataaggttttca

SEQ ID NO: 4296 - DNA, 2991 bp, Chenopodium quinoa
aaaacgttgaatttcttgtctcaattaaggggggtcattgaaagaacaggttcaaaatcacgatcaattcctttttcaaatcctgctgcagctgcacgagcccttcccgcatgccacaaatgacctacgaataggaaaaatcctaaaacaaaatgagaagtagctaaccaacttctaggagagacataattgactgcattgatctcggtagccaccccacccacagaatttaaagaacctaaaggagcatgggtcatatattctgcggaacggcgttcttgccaaggttgtatgtcttttttcagccgactcaagtccaaaccatttggacctcttaggggttctaaccagggagcgcgcaaatcccaaaaccgcatagttctcccccaaaaataacttctccagtcggagaacgcattagatacttacctaaaccagtaggtccttgagcggatcccacgttagccccaagacgttggtctctaactaaaaagtaaatgcttgagcttgagaagcttctggtccagtaggtccgtaaaactcactaggataagcagtattattgaaccagacaaagcaacaagcaatgaaaccaaagacagataaagcagccaaactataagacaaataagcctctccagaccagacaagtgcgcggcgagcccatgcaaaaggtttagttaagatatgccagattccaccaagtatacaaatgaaacctatccatacatgccccccgattatatcttccaaatcgtccacactaacaatccacccttctcctccaaaaggcgattttagtaaataaccaaagataatactcggactaagggtgacgttggtaatttttcttacatctccgcctcctggagcccaggtatcatatacgcccccaaaataaagagccttgaacactagaagaaaggcgcctatacctaacaagattaagtgaatgcccaaaattgtggtcattttatttctatctttccacacataaccgaagaatggaaaagattcttcaagagtttcagggcccagaagtgcatgataaatacccccaacccaatacggccgacgaaattaagtgaaggactcctgatacaaagtatggaaaagtgtctataacttccccgccggggcctacccccaacctagagtagctaggtggggaagtaaaattaatccttgttcatacatcggcttctctggtacgaaatgagccacttcaaacaggttcattgctccggcccagaatacgattaatccggcatgggctacatgagctccaagtagtttaccagataaattgataagtcgagcattcccggcccaccaagcgaaaccggtggtttcttggtcacgtccggctatagttaaagttccattaaagagcgtttccacggggtagaacctcctcagggaatataaggttttcatgaggctgatcttgagccgccatccaagcacgaataccttcgtttaagagaatatttttggtgtagaaagtttcaaattcaggatcttccgctgcacggatttcctgggaaacgaagtcataggcacgtaggttcaaagccagaccgactactccaagagcactcatccataaaccggttactggtacaaataacataaagaaatgtaaccaacgtttattggaaaaagcaaccccaaaaatttgggaccaaaagcggttagcggtgaccattgaataagtttcttcggcttgggttgggttaaaagcccggaatgtatttgccccatcaccgtcttcaaataaagtattttctacggtagcgccatgaatagcgcatagtagagcggcgcccaatacaccggcaactcccatcatatgaaatggattcagtgtccaattatgaaacccttgaaaaaagagaatgaatcgaaatatagctgctacaccaaaactaggtgcaaagaaccaaccagactgacctagtggataaattaggaatacagaaacaaaaacagcaattggaccagagaatgcgattgcattataagggcgcaattgaacggatcgagcaagctcgaattgacgtaacataaaacctattagtgcgaaagcaccatgaagagcaacaaaagtccacaggccgcctaattgacaccaacgagtaaagtctccttgtgcttcaggaccccacagtaacaataaagagtagggctaaactattagcaggagtagaaactgccgcggttaagaaattgcaaccttccaaataagaactggccaatccatgggtataccatgaagttacaaaggttgtacctgtaaaccaacctcctaaggcgaaataagcacaaggaaagagcaatagcccagaccaacctacaaaaacgaaacggtccctccgtaaccagtcatccatactatcaaataaatctttttcgtctttagtaaatttaccaacggctatagtcatagtgatcctcctattcaactacttcaaccatttccgagcaccccatagcattttttggaatccgagaattcgatcatttaatttatggatgatttgatttctcgtataatattagctataaggtttcgaaaaaaattataattaaaataaattccgaaattcaattattccttaatttgaacttattagactcaactattaatcttttgaaagagctcgtcaaggaacaaccaatctactcgctcgttaccgactgatcctcaaatcgaccttttctttctatcaacgaattcaattaagcttattgttgcatcttgttcataaaacggagcaaaagaaataaatatctttcgagattattctctaataaatatatgtttcgtttttgtctatttatagttagttttttccttccgatcaatcggaaatgtcagaatatatcgtttcattttcacggatcgaagaaagatacagagaattttcgattttttacttaatttgaattccatatgatattcacaataaaatactaggaaacttaaaa

SEQ ID NO: 4297 - DNA, 1479 bp, Chenopodium quinoa
atttataccttaaaacgttgaatttcttgtctcaattaaggggggtcattgaaagaacaggttcaaaatcacgatcaattcctttttcaaatcctgctgcagctgcacgagcccttcccgcatgccacaaatgacctacgaataggaaaaatcctaaaacaaaatgagaagtagctaaccaacttctaggagagacataattgactgcattgatctcggtagccaccccacccacagaatttaaagaacctaaaggagcatgggtcatatattctgcggaacggcgttcttgccaaggttgtatgtcttttttcagccgactcaagtccaaaccatttggacctcttaggggttctaaccagggagcgcgcaaatcccaaaaccgcatagtttcctacccccaaaaataacttctccagtcggagaacgcattagatacttacctaaaccagtaggtccttgagcggatcccacgttacgccccaagacgttggtctactaaactaaaaaagtaaatgcttgagcttgagaagcttctggtccagtaggtccgtaaaactcactaggataagcagtattattgaaccagacaaagcaacaagcaatgaaaccaaagacagataaagcagccaaactataagacaaataagcctctccagaccagacaagtgcgcggcgagcccatgcaaaaggtttagttaagatatgccagattccaccaagtatacaaatgaaacctatccatacactgccccccgacttatatcttccaaatcgtccacactaacaatccacccttctcctccaaaagacgattttagtaaataaccaaagataatactcggactaagggtgacgttggtaatttttcttacatctccgcctcctggagcccaggtatcatatacgcccccaaaataaagagccttgaacactagaagaaaggcgcctatacctaacaagattaagtgaatgcccaaaattgtggtcattttatttctatctttccacacataaccgaagaatggaaaagattcttcaagagtttcagggcccagaagtgcatgataaatacccccaaagcccaatacggccgacgaaattaagtgaaggactcctgatacaaagtatggaaaagtgtctataacttccccgccggggcctaccccccaacctagagtagctaggtggggaagtaaaattaatccttgttcatacatcggcttctctggtacgaaatgagccacttcaaacaggttcattgctccggcccagaatacgattaatccggcatgggctacatgagctccaagtagtttaccagataaattgataagtcgagcattcccggcccaccaagcgaaaccggtggtttcttggtcacgtccggctatagttaaagttccattaaagagcgtttccacggggtagaacctcctcagggaatataaggttttcatgaggctgatcttgagccgc

SEQ ID NO: 4298 - DNA, 1479 bp, Chenopodium quinoa
caattgatttataccttaaaacgttgaatttcttgtctcaattaaggggggtcattgaaagaacaggttcaaaatcacgatcaattcctttttcaaatcctgctgcagctgcacgagcccttcccgcatgccacaaatgacctacgaataggaaaaatcctaaaacaaaatgagaagtagctaaccaacttctaggagagacataattgactgcattgatctcggtagccaccccacccacagaatttaaagaacctaaaggagcatgggtcatatattctgcggaacggcgttcttgccaaggttgtatgtcttttttcagccgactcaagtccaaaccatttggacctcttaggggttctaaccagggagcgcgcaaatcccaaaaccgcatagtttctcccccaaaaataacttctccagtcggagaacgcattagatacttacctaaaccagtaggtccttgagcggatcccacgttagccccaagacgttggtctctaactaaaaaagtaaatgcttgagcttgagaagcttctggtccagtaggtccgtaaaactcactaggataagcagtattattgaaccagacaaagcaacaagcaatgaaaccaaagacagataaagcagccaaactataagacaaataagcctctccagaccagacaagtgcgcggcgagcccatgcaaaaggtttagttaagatatgccagattccaccaagtatacaaatgaaacctatccatacatgccccccgattatatcttccaaatcgtccacactaacaatccacccttctcctccaaaaggcgattttagtaaataaccaaagataatactcggactaagggtgacgttggtaatttttcttacatctccgcctcctggagcccaggtatcatatacgccccccaaataaagagccttgaacactagaagaaaggcgcctatacctaacaagattaagtgaatgcccaaaattgtggtcatttatttcttatctttccacacataaccgaagaatggaaaagattcttcaagagtttcagggcccagaagtgcatgataaatacccccaaagcccaatacggccgacgaaattaagtgaaggactcctgatacaaagtatggaaaagtgtctataacttccccgccggggcctaccccccaacctagagtagctaggtggggaagtaaaattaatccttgttcatacatcggcttctctggtacgaaatgagccacttcaaacaggttcattgctccggcccagaatacgattaatccggcatgggctacatgagctccaagtagtttaccagataaattgataagtcgagcattcccggcccaccaagcgaaaccggtggtttcttggtcacgtccggctatagttaaagttccattaaagagcgtttccacggggtagaacctcctcagggaatataaggttttcatgaggctgatcttgagccgcc

SEQ ID NO: 4299 - DNA, 1711 bp, Linum usitatissimum
agtctaacccgatcgaagcaatcaaattgagttttgcttcaagtattgtatctgttgtctcagttcagttagttaagaggagtcatcgaaagaacaggttcaaaatcacgatcaattcctttttcaaatcctgctgcagccgcgcgagctcttcccgcgtgccataaatgacccacgaataggaagaacccaagaacaaaatgagaggtagctaaccaacttcttggagagacataattcactgcattgatctcggtagctacaccacccacggaatttaacgagcctagaggcgcatgagtcatatattccgcagaacgccgttcttgccaaggttggatgtctttttttaatctactcaagtccaaaccatttgggccccttaaaggttctaaccaaggagcacgcagatcccaaaaacgcatggtttcccctccaaaaataacttctccggtaggtgaacgcattagatatttacccaaacccgtaggtccttgagctgatcccacattagccccaagacgttggtctctaactagaaaagtaaaagcttgagcttgagaggcttcaggtccggtgggtccgtaaaactcactcggataagccgtattattgaaccagacaaagcaacaagcaatgaaaccaaaaagggataaagcagctaaactataagacaggtaagcttctcccgaccagacaagtgcacggcgagcccatgcaaagggtttggttaagatatgccagattccaccaaataaacaaatggaacctaaccataaatggcctccaattagatcttccaaatcgtccacactaacaatccacccttctcccccaaaaggggattttagtaaataaccaaaaataacgcttggggtaagggtcaagttggtaatttttcttacatccccgcctcctggagcccaggtatcgtacacgccccaaaaaaaagagccttgaatactagaagaaaagcacctatacctagcaaaattaagtgaatacctaaaattgttgtcattttatttctatctttccatacataaccaaaaaaaggaaaagattcttcaagagtctcgggtcctagaagtgcatgataaataccaccaaaccccaatactgcagaggaaattaagtgaagtacgccagagacaaagtatggaaaggtatctataacttctccgccgggccctaccccccaacccagagtagctaggtggggaagtaaaattaatccttgttcatacattggcttctccggtacgaaatgagccacttcaaataggttcattgctccagcccagaatacgatcaatccagcatgagctacatgagctcccaggagtttaccggataaattgataagtcgggcattcccggcccaccaagcgaaaccggtggtttcttggtcacgaccagctaaagctaaagttccattaaagagcgtttccacggggtagaacctcctcagggaatataaggttttcatgaggctgatcttgagccgccatccaagcacgaataccttcgtttaagagaatatttttggtgtagaaagtctcaaattcaggatcttccgctgcacgtatttcctgagaaacaaagtcataggcacgtaggttcagagccagaccgactactccaagagcactcatccataaaccggttactggtacaaataacataaagaaatgtaaccagcgtttattcg

SEQ ID NO: 4300 - DNA, 2592 bp, Quercus alba
aatataaataaatagtataataaaattatttaattaatatatatatattttttaatttcatttttaaatagttaaatataagaagtttgtttgacccctccctttcattttttttctttatttgcattttggggacttatatttcattttaatgtgtctcacaacctgaaaatgaaagaattaggaggggatcatttcatttttggatctaaatagaacaaataggttcaagagatgagagaattaaggatacccaccaaaaagactaatccaatccataatgatgtaccggaaaatacaacatttttgttatttgaccaaccatcaggagaagcaaatacaacaggtacactaatcagtaagattgttgaagtagcaattaatgcaaaaaacagccaattggaaagcaatagtcatctttctaatcctccaatctatcaacaaaagaaactatataccatttgatccctttattggtatcggccaaaaaattgtatcagccaaaaattctaataaaacgtatcatagagggattttaccacgaatctattaatgctgtatgacttattagcaccttttaccaccttattaaatcttattaaattaaggcatgagatcaagggaaaggtattttttttttttttcattaaaagaggcccgccagatcattatctatatatatacagatcgatagctagacccataggatcgcaccggatatctttatatatataggtcgtaatggtatcaactcatatatccatgttctattcgttagaaaataaaaataaaaaaaaaataataaaatagaaataatctttcggagaggtggccgagtggttgatagctccggtcttgaaaaccggtatagttcgaaacaaagaactatcgagggttcgaatccctctctctcctttttgctcgtggaatatatatatattatttttattttattggttttgtccggctcagtattagtattctaaaagggaatggctcggctagggggatagccgagccagaacagaaaaaaaagggttcaatatataatgagtcgaaaatgaaaataaaggaatactttttttttctaatacgtatgacctaacccaaccaaacaaatatgtatgatgaaatcaaatagattttgacttcaagcattagaattagatctcctgtcttagttaagaggagtcatggaaagaacaggttcaaaatcgcgatcaattcctttttcaaatcctgctgcagctgcacgagcccttcctgcatgccataaatgacctacgaataggaagaatcctagaacaaaatgagaggtagctaaccaacttctaggagagacataattgactgcattgatctcggtagctacaccacccacggaatttaaagaacctaaaggagcatgagtcatatattccgcggaacgtcgttcttgccaaggttgtatgtcttttttcagcctactcaagtccaacccattgggaccccttaggggttctaaccagggagcacgcaaatcccaaaaacgcatagtttctcccccaaaaatgacttctccagtcggagaacgcattagatatttacctaaaccggtaggtccttgggcggaccctacgttagccccaaggcgttggtctctaaccagaaaagtaaatgcttgagcttgagaagcttctggtccagtgggcccgtaaaactcactaggataagcggtattattgaaccaaacaaagcaacaagcaataaaccaaacagctaaagcacctaaactataagacaagtaagcctcccagaccatacaagcgcacggcgcgcccatgcaaaaggtttggttaagatatgccagattccaccaagtatacaaatggaacccaaccatacatgccctccaattatatcttccaaatcgtccacactaacaatccatccctctcctccaaaaggggattttagtaaataaccaaatatgacgcttgggctaagggtcaagttggtaatttttcttacatctccccctccggggcccaggtatcatatacgcctccaaaataatagctttgaatactagaagaaaagcacctatacctaacaaaattaagtgaatacccaaaattgtagtcattttatttctatctttccatacataaccgaagaatggaaaagactcttcaagagtctcgggtcccagaagtgcgtgataaataccgccaaagccccaatactgcagaggaaattaagtgaagtactccagacacaaagtatggaaaggtatctataacttccccaccaggacctaccccccaacctagagtagctaggtggggaagtaaaattaatccttgttcatacatgggcttttctggtacgaaatgagccacttcaaaataggttcattgctccggcccagaatacgattaatccggcatgggctacatgagctcccagtaatttaccggataaattgataagtcgggcattcccggcccaccaagcgaaacctgtggttcttggtcacgaccggctaaggctaaagttccattaaagagcgtttccacggggtagaacctcctcagggaatataagggtttt

SEQ ID NO: 4301 - DNA, 4310 bp, Quercus alba
ttatatttctattttaatgtgtctcacaacctgaaaatgaaagaattaggaggggatcatttctatttttggatctaaatagaacaaataggttcaagagatgagagaattaaggatacccaaccaaaaagactaatccaatccataatgatgtaccggaaaatacaactatttttgttatttgaccaaccatcaggagaagcaaatacaacaggtacactaatcagtaagattgttgaagtagcaattaatgcaaaaacagccaattggaaagcaatagtcatctttctaatcctccaatctatcaacaaaagaaactatataccatttgatccctttattggtatcggccaaaaaattagtatcagccaaaaattactaataaaacgtatcatagagggattttaccacgaatctattaatgctgtatgacttattagcaccttttaccaccttattaaatcttattaaattaaggcatgagatcaagggaaaggttatttttttactttcattaaaagaggcccgccagatcattatctatatatatacagatcgatagctagacccataggatcgcaccggatatctttatatatataggtcgtaatggtatcaactcatatatccatgttctattcgttagaaataaaaaaaaaataataaaatagaaataatctttcggagaggtggccgagtggttgatagctccggtcttgaaaaccggtatagttcgaaacaaagaactatcgagggttcgaatccctctctctcctttttttgctcgtggaatatatatatatatttttttattttattggttttgtccggctcagtattagtattctaaaagggaatggctcggctagggggatagccgagccagaacagaaaaaaaaagggttcaatatataatgagtcgaaaatgaaaataaaggaatactttttttttttcaatacgtatgacctaacccaaccaaacaaatatgtatgatgaaatcaaatagattttgacttcaagcattagaattagatctcctgtcttagttaagaggagtcatggaaagaacaggttcaaaatcgcgatcaatcctttttcaaatcctgctgcagctgcacgagcccttcctgcatgccataaatgacctacgaataggaagaatcctagaacaaaatgagaggtagctaaccaacttctaggagagacataattgactgcattgatctcggtagctacaccacccacggaatttaaagaacctaaaggagcatgagtcatatattccgcggaacgtcgttcttgccaaggttgtatgtcttttttcagcctactcaagtccaacccattgggaccccttaggggttctaaccagggagcacgcaaatcccaaaaacgcatagtttctcccccaaaaatgacttctccagtcggagaacgcattagatatttacctaaaccggtaggtccttgggcggaccctacgttagccccaaggcgttggtctctaaccagaaaagtaaatgcttgagcttgagaagcttctggtccagtgggcccgtaaaactcactaggataagcggtattattgaaccaaacaaagcaacaagcaataaaaccaaaaacagctaaagcacctaaactataagacaagtaagcctccccagaccatacaagcgcacggcgcgcccatgcaaaaggtttggttaagatatgccagattccaccaagtatacaaatggaacccaaccatacatgccctccaattatatcttccaaatcgtccacactaacaatccatccctctcctccaaaaggggattttagtaaataaccaaatatgacgcttgggctaagggtcaagttggtaatttttctacatctccccctccggggcccaggtatcatatacgcctccaaaataatagctttgaatactagaagaaaagcacctatacctaacaaaattaagtgaatacccaaaattgtagtcattttatttctatctttccatacataaccgaagaatggaaaagactcttcaagagtctcgggtcccagaagtgcgtgataaataccgccaaagcccaatactgcagaggaaattaagtgaagtactccagacacaaagtatggaaaggtatctataacttccccaccaggactacccccaacctagagtagctaggtggggagtaaattaatccttgttcatacatgggcttttctggtacgaaatgagccacttcaaataggttcattgctccggcccagaatacgattaatccggcatgggctacatgagctcccagtaatttaccggataaattgataagtcgggcattcccggcccaccaagcgaaacctgtggtttcttggtcacgaccggctaaggctaaagttccattaaagagcgtttccacggggtagaacctcctcagggaatataaggttttcatgaggctgatcttgagccgccatccaagcacgaatgccttcatttaaaagaatatttttggtgtagaacgtctcaaattcaggatcttccgctgcacggatttcctgagaaacgaagtcataggcgcgtaggttcagagccaagccgactactccaagagcactcatccataaaccggttactggtacaaataacataaagaaatgtaaccaacgtttattggaaaaaacaaccccaaagatttgggaccaaaagcggttagcggtgaccattgaataagtttcttccgcttgagttgggttaaagcacggaatgtatttgcgccatcaccatcttcaaataaagtattttctacggtagcaccatgaatagcgcatagaagggcagcgcccaatacaccggcaaccccatcatatgaaatgggttcaatgtccaattatgaaacccttggaaaaagaggatgaatcgaaatatagctgcgacaccaaaactgggcgcaaaagaaccaaccagactgacctagcggataaatcaggaatacagaaacaaaaacagcaattggagcagagaatgcgattgcattataaggtcgcaattgaacagatcgagcaagttcaaattgacgtaacatgaaacctattagtccgaaagcgccgtggagagcaacaaaagtccacagaccgcctaattgacaccaacgagtaaaatccccttgtgcttctggacccccatagtaacaacaaagagtgtgctaaactattagcaggagtagaaactgccgcggttaagagttgcagccttccaaataggaactcgccaatccatgtgtataccatgaagttacaaaaggttgtacctgtaaaccaacctcctaacgcgaaataagcacaaggaaagagcaatagaccggaccaacctacaaaaacgaaacggtccctccgtaaccagtcatccataatatcaaataaatcattttcgtctttggtaaatttcccaagggctatagtcatagtgatcctcctattcaactacttcaaccattttcgaacacctcatagaattttcaagggcgttcaagacgtctatcatttctatatgatttgatttctcgtacactacccctctttctaatgggtttcgaatctaaaaatcatttattggtacataacctgactgaggtaaatccatgacttcaattcagtctttttttctagtctgactaaccaaccacctgaaccttgaattgccttgtcttatgactcatcgatcaaatagattaattttttgtaaagaactgttcaagaaacaagtgattccttttctcgctaccagttgatccccagacatattcctctcgtttcatcaaccaatcttattcttgaatctcgtttgtgagattgataaaaataaatatctttatgtattccgtataatttctatgtgtattaaactacttattaaactactatagtatcatatattttattacgttatactttaactctttcatttttcttttattgtgttatatttctttttctctcatatgaatatacaactcggaagtatatcttttcgcggttcaaagcaagcaatgcacttcgaagtatttttctatttacctttatctgtcagaaaatcataaaaggagaattcatttcctttaatttttattttaatattgatattgtatttaatttaataataaaactgtaaatgaaagcagctttctcgcatacattttgatcccgttgtcggaacaaaatttcgcatgtatcgatatggaaatatttggtacatgaatacatgctctgatcaatttagatctatataaatcttatatatacgtgtcgt

SEQ ID NO: 4302 - DNA, 2542 bp, Chenopodium quinoa
aaattttactgtgtctcacaacccgaaagaattcaaattcgggggaggggtcatttttggatctggaacaaataggttcaagagattagagaattaaggatacccaccagaaagactaatccaatccataatgatgtaccggaaaatacaaaatttttgttacttgaccaaccgtcgggagaagcaaatacaacgggtacgctaattaataagattaatgaagtagcaattaatgcaaaaacagccaattgaaaagctatagtcatacgtataatcctccaagctatcaacaaacaaactatataccatttgatccctttatcagtcattgtactataaagtaataaatgtatcacggagggattttagactattaccatggaattcattgattctatataatatcatttattaccgctttattccaagatggaactgctgggaaattagtaattaataattaaattaaatacttaaatgggcatgatagatcatttatatataatatacagataaatggatcaccctatcaacttacacctaaaattttttgacaatttcggatggtatcagctcatagaaccatgttctattcgggggaataagaataaaatagaaattgacttatgttggagagatggctgagtggttgatagctccggtcttgaaaaccggcatagttctttgttcagaactatcgagggttcgaatccctctctctccttttgttcgttcaatagaactgtttccttcttttattagttttgcttggtctgttaaaaaaaagagaatggctcggctaggtgagatagccgagccagaaaaaaagaattaaattacatagaaataagttagaaaaaaaacaagaaaaaaggaatacttttacgtatgacctgatccccatatgtaatatgtatgatggaagccaattgatttataccttaaaacgttgaatttcttgtctcaattaaggggggtcattgaaagaacaggttcaaaatcacgatcaattccttttcaaatcctgctgcagctgcacgagcccttcccgcatgccacaaatagacctacgaataggaaaaatactaaacaaaatagagaagtagctaaccaacttctaggagagacataattgactgcattgatctcggtagccaccccacccacagaatttaaagaacctaaaggagcatgggtcatatattctgcggaacggcgttcttgccaaggttgtatgtcttttttcagccgactcaagtccaaaccatttggacctcttaggggttctaaccagggagcgcgcaaatcccaaaaccgcatagtttctcccccaaaaataacttctccagtcggagaacgcattagatacttacctaaaccagtaggtccttgagcggatcccacgttagccccaagacgttggtctctaactaaaaaagtaaatgcttgagcttgagaagcttctggtccagtaggtccgtaaaactcactaggataagcagtattattgaaccagacaaagcaacaagcaatgaaaccaaagacagataaagcagccaaactataagacaaataagcctctccagaccagacaagtgcgcggcgagcccatgcaaaaggtttagttaagatatgccagattccaccaagtatacaaatgaaacctatccatacatgccccccgattatatcttccaaatcgtccacactaacaatccacccttctcctccaaaaggcgattttagtaaataaccaaagataatactcggactaagggtgacgttggtaatttttcttacatctccgcctcctggagcccaggtatcatatacgcccccaaaataaagagccttgaacactagaagaaaggcgcctatacctaacaagattaagtgaatgcccaaaattgtggtcattttatttctatctttccacacataaccgaagaatggaaaagattcttcaagagtttcagggcccagaagtgcatgataaatacccccaaagcccaatacggccgacgaaattaagtgaaggactcctgatacaaagtatggaaaagtgtctataacttccccgccggggcctaccccccaacctagagtagctaggtggggaagtaaaattaatccttgttcatacatcggcttctctggtacgaaatgagccacttcaaacaggttcattgctccggcccagaatacgattaatccggcatgggctacatgagctccaagtagtttaccagataaattgataagtcgagcattcccggcccaccaagcgaaaccggtggtttcttggtcacgtccggctatagttaaagttccattaaagagcgtttccacggggtagaacctcctcagggaatataaggttttcatgaggctgatcttgagccgccatccaagcacgaataccttcgtttaagagaatatttttggtgtagaaagtttcaaattcaggatcttccgctgcacggatttcctgggaaacgaagtcataggcacgtaggttcaaagccagaccgactactccaag

SEQ ID NO: 4303 - DNA, 2662 bp, Triticum aestivum
tttgaaaaaaaaaaaagaaaaaggaagactttttaagtataacctgatcccaatatgtatgatagaatcaaagtgattcttacttcaatccaagcattggatctcctgtctcatctcaattaagaggggtcatggaaagaacaggttcaaaatcacgatcaattcctttttcaaatcctgctgcagctgcacgagcccttcccgcgtgccacaaatgacctacgaagaaaaagaatcctagaacaaaatgagaggtagctaaccaacttctaggagagacataattgactgcattaatctcggtagctacgccacccacagaatttaaagaacctaaaggagcatgagtcatatattctgcggaacgccgttcttgccaaggttgtatgtcttttttcaacctactcaagtccaatccatttggacctcttagaggttctaaccagggagcacgcagatcccaaaaacgcatagtttctcctccaaaaatgacttctccggtcggggaacgcattagatatttacctaaacctgtaggtccttgcgcagatcctacattagccccaagacgttggtctctaactagaaaagtaaatgcttgagcttgagaagcttctggtccagtaggtccgtaaaactcgctaggataagcggtattattgaaccagacaaaacaacaagcagtgaaaccaaagatggataaagccgctaaactataagataagtaagcctccccagaccatacaagagcgcgtcgagcccatgcgaagggtttggttaagatatgccagattccaccaagtatacaaatggaacctaaccatacatgtcctccgattatatcttctaaatcgtccacactaacaatccacccttcccctccaaagggggattttagtaaataaccaaatagaatactggggctaagggtcaagttggtaatttttcttacatctccccctcccggagcccaagtatcatatacgccccaaaataaagagccttgaatactagaagaaaagcacctagacctaacaagataaaattgtggtcattttatttctatctttccatacataaccgaagaatggaaaagattcctcaagtgtctcaggtcccagaagtgcatgataaataccgccaaagcccaatactgcagaggaaattaaatgaagtactccagatacaaagtatggaaaggtgtctataacttcccccccaggacctaccccccaacctagagtagctagatggggaagtcaaattaagccttgttcatacataggcttctctggtacgaaatgagccacttcaaataggttcattgctccggcccagaatacgattaatccggcatgggctacatgagctcctagtagtttaccggataaattaataagtcgagcattcccggcccaccaagcaaaaccggtggtttcttggtcacgaccagttacaactaaagttccattaaagagcgtttccacgtggtagaacctcctcagggaatataaggttttcatgaggctgatcttgagctgccatccaagcacgaataccttcgtttaatagaatatttttggtgtagaaagtctcaaattcaggatcttccgctgcgcgaatttcctgagaaacgaagtcataggcgcgtaggttcagggccagaccgactactccaagagcactcatccataaaccggttactggtacaaataacataaagaaatgtaaccaacgtttattggaaaaagcaaccccaaagatttgggaccaaaagcggttagcggtgaccattgaataagtttcttcagcttgagttgggttaaaagcgcggaatgtatttgcaccatcaccatcttcaaataaagtattttctacggtagcaccatgaatagcgcatagcaaagcagcacccaatacaccggcaactcccatcatatgaaatgggtttagcgtccaattatgaaatccttgaaaaaagaggataatcgaaatatagctgctacaccaaaactaggtgcaaagaaccaaccagactgacctagtggataaatcaggaatacagaaacaaaaacagcaattggaccagagaatgcgattgcattataaggtcgcaattgaacagatcgagcaagctcgaattgacgtaacatgaaacctattagtccgaaagcgccatggagagcaacaaaagtccacagaccgcctaattgacaccaacgagtaaaatctccttgtgcttcaggaccccacagtaacaataaagaatgcgctaaactattagcaggagtagaaactgcggccgttaagaaattacagccttccaaataggaactagccaatccatgggtataccatgaagttacaaaggttgtacctgtgaaccaacctcctacagcgaaataggcacaaggaaagagtaatagaccggaccagcctacaaaaacgaaacggtccctccgtaaccagtcatccataatatcaaataaatcattttcgtctttggtaaatttaccaagggctatagtcatagtgatcctcctattcaactacttcgaccatttccgagcacctcatagtatttttggggcgtccgaagattcgatcatttctctatgatttctcttgcactgccccttccaatgggtttcgaagataaaaa

SEQ ID NO: 4304 - DNA, 3107 bp, Chenopodium quinoa
aaaaaagagaatggctcggctaggtgagatagccgagccagaaaaaaagaaattaaattacatagaaataagttgaaaaaaacaagaaaaaggaatactttttacgtatgacctgatccccatatgtaatatgtatgatggaagccaattgatttataccttaaaacgttgaatttcttgtctcaattaaggggggtcattgaaagaacaggttcaaaatcacgatcaattcctttttcaaatcctgctgcagctgcacgagcccttcccgcatgccacaaatgacctacgaataggaaaaatcctaaaacaaaatgagaagtagctaaccaacttctaggagagacataattgactgcattgatctcggtagccaccccacccacagaatttaaagaacctaaaggagcatgggtcatatattctgcggaacggcgttcttgccaaggttgtatgtcttttttcagccgactcaagtccaaaccatttggacctcttaggggttctaaccagggagcgcgcaaatcccaaaaccgcatagtttctacccccaaaataacttctccagtcggagaacgcattagatacttacctaaacaagtaggtccttgagcggatcccacgttagccccaagacgttggtctactaactaaaaagtaaatgcttgagcttgagaagcttctggtccagtaggtccgtaaaactcactaggataagcagtattattgaaccagacaaagcaacaagcaatgaaaccaaagacagataaagcagccaaactataagacaaataagcctctccagaccagacaagtgcgcggcgagcccatgcaaaaggtttagttaagatatgccagattccaccaagtatacaaatgaaacctatccatacatgccccccgattatatcttccaaatcgtccacactaacaatccacccttctcctccaaaaggcgattttagtaaataaccaaagataatactcggactaagggtgacgttggtaatttttcttacatctccgcctcctggagcccaggtatcatatacgcccccaaaataaagagccttgaacactagaagaaaggcgcctatacctaacaagattaagtgaatgcccaaaattgtggtcattttatttctatctttccacacataaccgaagaatggaaaagattcttcaagagtttcagggcccagaagtgcatgataaatacccccaaagcccaatacggccgacgaaattaagtgaaggactcctgatacaaagtatggaaaagtgtctataacttccccgccggggcctaccccccaacctagagtagctaggtggggaagtaaaattaatccttgttcatacatcggcttctctggtacgaaatgagccacttcaaacaggttcattgctccggcccagaatacgattaatccggcatgggctacatgagctccaagtagtttaccagataaattgataagtcgagcattcccggcccaccaagcgaaaccggtggtttcttggtcacgtccggctatagttaaagttccattaaagagcgtttccacggggtagaacctcctcagggaatataaggttttcatgaggctgatcttgagccgccatccaagcacgaataccttcgtttaagagaatatttttggtgtagaaagtttcaaattcaggatcttccgctgcacggatttcctgggaaacgaagtcataggcacgtaggttcaaagccagaccgactactccaagagcactcatccataaaccggttactggtacaaataacataaagaaatgtaaccaacgtttattggaaaaagcaaccccaaaaatttgggaccaaaagcggttagcggtgaccattgaataagtttcttcggcttgggttgggttaaaagcccggaatgtatttgccccatcaccgtcttcaaataaagtattttctacggtagcgccatgaatagcgcatagtagagcggcgcccaatacaccggcaactcccatcatatgaaatggattcagtgtccaattatgaaacccttgaaaaaagagaatgaatcgaaatatagctgctacaccaaaactaggtgcaaagaaccaaccagactgacctagtggataaattaggaatacagaaacaaaacagcaattggaccagagaatgcgattgcattataagggcgcaattgaacggatcgagcaagctcgaattgacgtaacataaaacctattagtgcgaaagcaccatgaagagcaacaaaagtccacaggccgcctaattgacaccaacgagtaaagtctccttgtgcttcaggaccccacagtaacaataaagagtgggctaaactattagcaggagtagaaactgccgcggttaagaaattgcaaccttccaaataagaactggccaatccatgggtataccatgaagttacaaaggttgtacctgtaaaccaacctcctaaggcgaaataagcacaaggaaagagcaatagcccagaccaacctacaaaaacgaaacggtccctccgtaaccagtcatccatactatcaaataaatctttttcgtctttagtaaatttaccaacggctatagtcatagtgatcctcctattcaactacttcaaccatttccgagcaccccatagcattttttggaatccgagaattcgatcatttaatttatggatgatttgatttctcgtataatattagctataaggtttcgaaaaaaattataattaaaataaattccgaaattcaattattccttaatttgaacttattagactcaactattaatcttttgaaagagctcgtcaaggaacaaccaatctactcgctcgttaccgactgatcctcaaatcgaccttttctttctatcaacgaattcaattaagcttattgttgcatcttgttcataaaacggagcaaaagaaataaatatctttcgagattattctctaataaatatatgtttcgtttttgtctatttatagttagttttttccttccgtatcaatcggaaatgtcagaatatatcgtttcattttcacggtatcgaagaaagatacagagaattttcgtattttttt

SEQ ID NO: 4305 - DNA, 4075 bp, Oryza sativa
ttaagctggcgagcggcgggaatcgaacccgtatcttctccttggcaaggagatgttttaccattgaactacgctcgctacgtcctatattttatagggtatatccgcctgggtcgaccgtctatgtctgggtcgaccgtttcattttctatttgagttttctttttattaatttaattgtctgtcaatcaattcggggcgcaaattgcattttaatgcgtctcacaatccgaataaacggcccttttttattttgtatcgggctactaaatactaaacacatttaagaaatgagagaatttagaatagctaccagaaagaccagtccaatccataatgatgtaccggaaaatacaacgtttttattgtttgaccaaccatcaggagaagcaaatacaaggggtacactaatgactaagactgaggaagtcacaattaatgcaaaaacagctaattggaaagcaatagtcatatttctaatcctccaagttaccatcaaataaagttgactacatattatatttgatccctcacttaatcaaaattgtaataaaatacaagaagtaggaggggtttaatcatgaatccattgattcttctctttaaaacttattactcaccactttttttatttggatatggggttgagggggttttatgctttatttcacaagcggatatagcggatcctgtatacatggatacagtatacagaaatatatcgaaaagggatttgtatttgagatgtttctagaggttagtgagtcatttcgtatggctatgttctatttgtaggaataaaataaggattaggctgtggagagatggctgagtggttgatagctccggtcttgaaaaccggtatagttctaggaactatcgagggttcgaatccctctctctccttttgctttcctctctcttttcttttgcgtattgaatacgtttgtttctttatttgttttttttgttctgtccccttatctttctttcatagaaaggaatgaatggctcggctagatagaataaccgagccagaacagaaaaaaacagtagaacaggtataaataagaaaatcttagttaagaggggtcatgtaaagaacaggctccaaatcacgatcgattcccttttcaaatcctgctgcagcagcccgggctcttcctgcatgccacaaatggcccacaaaaaagaagaatcctagaacaaaatgggaagtcgctaaccaacttctaggagaaacataattaactgcattgatctcggtagctacgccacccacagaatttaaagagcctaaaggagcatgggtcatatattctgccgaacgtcgttcttgccaaggttgtatgtcttttttcaacctactcaagtccaaaccgttggggccccttagaggttctaaccatggagcacgaaggtcccaaaaacgcatagtttcccctccaaaaataacctctcccgttggggaacgcattagatatttacctaaacctgtgggtccttgggcagatcccacattagctccaagacgctgatctctaactagaaaagtaaatgcttgagcttgagaagcttctggcccagtaggtccataaaactcactcggataagctgtattattgaaccagacaaaacaacaagcgataaaaccaaagacagataaagcgcctaaactataagacaagtaagcttctccagaccatacaaatgcacggcgagcccatgcgaagggtttggttaagatatgccaaattccgccaaatacacaaatgaaacccaaccatacatgtcccccaattatatcttctaaatcatccacactaacaatccaaccctctcccccaaaaggggattttagtaaataaccaaatataacaccggggctaagggtcaaattggtaatttttcttacatctcctcccccaggagcccaggtatcatatataccgccaaaataaagagctttgagtactagaagaaaagcacctatacctaacaaaattaggtgaatacccaaaattgtagtcattttatttctatctttccacacataaccaaagaatggaaaagattcttcaagagtctccggtcccagaagcgcgtgataaatgccaccgaagcctaagactgcggaggaaattagatgaagtactccagatacaaagtacggaaaagtatctagaacttctcccccgggccctactccccaacctagagtagctaagtgcggaagtaaaatcaacccttgttcatacatgggtttttctggtacgaaatgggccacttcaaataggttcattgctccggcccagaatacgattaatcctgcatgggctacgtgagctccaagtagtttacccgacaaattgataagtctggcattcccggcccaccaagcaaaaccggtggtttcttggtcacgaccagctaaaacaaaagttccattaaagagcgtttccacgtggtagaacctcctcagggaatataagattttcatgaggctgatcctgagctgccatccacgcacgaataccctcgtttaaaagaatatttttggtgtagaaagtctcaaattcaggatcttccgctgcacggatttcctgggaaacgaagtcataggcacgtaggttcagagccaggccgactacgccaatagcactcatccataaaccggtgaccggtacaaatagcataaagaaatgtaaccaacgtttattggaaaaagcaacaccaaagatttgggaccaaaagcgattagcggtgaccattgaataagtttcttcagcttgagttgggttaaaagcgcggaaggtatttgcaccatcaccgtcctcaaatagagtgttttccacggttgccccatgaatagcgcatagcagagccgcgcctaatactccggcaactcccatcatatgaaatgggttcaacgtccaattatgaaatccttggaagaagaggatgaatcgaaatatcgctgctacgccaaaactcggcgcaaagaaccaaccggattgccccagtggataaatcaggaatacggaaacaaaaacagcgattgggccagagaatgaaattgcattataaggccgcaattgaacagaccgagcaagttcaaattgacgtaacatgaaacctattagtgcaaaagccccatggagagcaacaaaagtccacagaccacctaattgacaccaacgagtaaaatccccttgtgcttccgggccccatagtagcaacaaagagtgtgctaaactattggcaggggtggaaactgctgcggttaagaaattgcaaccttccaaataggaactcgccaatccatgggtataccaagaagttacaaaagttgtccctgtaaaccaacctcctaaagcgaaataagcacaaggaaaaagcaataggccagaccatcctacaaaaacaaaacggtcccttcgtaaccagtcgtccataatatcaaataaatcattttcttctttagtaactctaccaagggctatagtcatagtgatcctcctattcaattacttcaaccatttccgagcaccttatatcacttccaaggcatacgatagattatctgtggacgattttttctcgttcaatgccttttttcaatggtctcgaagatagaaattttgcatttttatctatggggtcacagccgaggtcgtggtaaatccatgaatttgattcaattagtttttcttatactatagaaataaacattggaattcagattattccatgattcctatttccaagaaagcctattttttaaggaaaaaatgaaaaaaagtaacctcccttttcccactcgctctctattgcatgggtataagaacaaaaataggattctgaaaaaaagtaaagatattgaaaagaaaaattgactttcgaaatccatttttatgtgtagcggaaaggggttgcgatttcttcttattcctatagaacatctagtaacaagaatatgaaatagtaaatagcgagaaattcttgccttgcgtggtctaagtctaaggaaatacaaaaaaatccacttatacaatttcatctacatcgaatttat

SEQ ID NO: 4306 - DNA, 5075 bp, Oryza sativa
gaaccttctctgtttcattaactaagagggaattagcatctttctcgaatcgctacccttgacaaagggtagcgttggtatcagaatttacatgtagcgggtatagtttagtggtaaaagtgtgattcgttctattaataactgaatttgaaatgatatacttaaggcgtccttaaggttttttatattccgatgaaaactttagttcttagaaaggatttactcctttttctctcaatagcatattgaggaagaatatgcattttcgcgatttgtacccaaagactaattgaaattgcatccaaaaaacaaataggatttggattatgagtacagagtcgcgaagcataattttgcattggattaaggattccaatttttaaaatatgagtaaaggatctatggatgaagatacaaaaaaatttatttccaatcgtaactaaatcttcttttgttaaaaaaggaaatggaagccaaatagctaaaaaacggtagttttggtttactagaaccatcagcatattgtttcagctcggtggaaacccaattcttttcctcaggatctcttaaatgaaattagggaacgaagtaattagattagatagatttaggcaaatttctatctcctactctttagggatcatctagaaagcagagagccttggttccattcagacaaaaaagctgacttagatgttaagtggtgagaatacccataaaggagccgaatgaaatcaaaatttcatgttcggttttgaattagagacgttaataataatcaaccaacgtcgactataacccctagccttccaagctaacgatgcgggttcgattcccgctacccgctccattctgtataaaataactattctatttgtctagacatggtagaggcctgtattcaacctttttcgtccaccggtttccagcgctccagagcggagtagagcagtttggtagctcacgaggctcataaccttgaggtcacgggttcgattcccgtctccgcacttagcagtctgtataaaaggactattctatttgtctagatatggtagagggctgggtggttgggcggtatccaaccctttttattcattaaaaagaaaaaataaatgaaagaaaggcacagtctatctcccttccctttaaaagctgtttgctggttgtttgtttcggtgaatccccggtttagggaaccctgttgccgagttcgattcccgccgctgtagtgctctttttttgagtggggtgcaaagggggctaagatagtaaaggggtacggtactagactaacacctattactttaataaaagtagactaaattttttctcatagtaccttactaaattaagctggcgagcggcgggaatcgaacccgtatcttctccttggcaaggagatgttttaccattgaactacgctcgctacgtcctatattttatagggtatatccgcctgggtcgaccgtctatgtctgggtcgaccgtttcattttctatttgagttttctttttattaatttaattgtctgtcaatcaattcggggcgcaaattgcattttaatgcgtctcacaatccgaataaacggcccttttttattttgtatcgggctactaaatactaaacacatttaagaaatgagagaatttagaatagctaccagaaagaccagtccaatccataatgatgtaccggaaaatacaacgtttttattgtttgaccaaccatcaggagaagcaaatacaaggggtacactaatgactaagactgaggaagtcacaattaatgcaaaaacagctaattggaaagcaatagtcatatttctaatcctccaagttaccatcaaataaagttgactacatattatatttgatccctcacttaatcaaaattgtaataaaatacaagaagtaggaggggtttaatcatgaatccattgattcttctctttaaaacttattactcaccacaccactttttttatttggatatggggttgagggggttttatgctttatttcacaagcggatatagcggatcctgtatacatggatacagtatacagaaatatatcgaaaagggatttgtatttgagatgtttctagaggttagtgagtcatttcgtatggctatgttctatttgtaggaataaaataaggattaggctgtggagagatggctgagtggttgatagctccggtcttgaaaaccggtatagttctaggaactatcgagggttcgaatccctctctctccttttgctttcctctctcttttcttttgcgtattgaatacgtttgtttctttatttgttttttttgttctgtccccttatctttctttcatagaaaggaatgaatggctcggctagatagaataaccgagccagaacagaaaaaaacagtagaacaggtataaataagaaaatcttagttaagaggggtcatgtaaagaacaggctccaaatcacgatcgattcccttttcaaatcctgctgcagcagcccgggctcttcctgcatgccacaaatggcccacaaaaaagaagaatcctagaacaaaatgggaagtcgctaaccaacttctaggagaaacataattaactgcattgatctcggtagctacgccacccacagaatttaaagagcctaaaggagcatgggtcatatattctgccgaacgtcgttcttgccaaggttgtatgtcttttttcaacctactcaagtccaaaccgttggggccccttagaggttctaaccatggagcacgaaggtcccaaaaacgcatagtttcccctccaaaaataacctctcccgttggggaacgcattagatatttacctaaacctgtgggtccttgggcagatcccacattagctccaagacgctgatctctaactagaaaagtaaatgcttgagcttgagaagcttctggcccagtaggtccataaaactcactcggataagctgtattattgaaccagacaaaacaacaagcgataaaaccaaagacagataaagcgcctaaactataagacaagtaagcttctccagaccatacaaatgcacggcgagcccatgcgaagggtttggttaagatatgccaaattccgccaaatacacaaatgaaacccaaccatacatgtcccccaattatatcttctaaatcatccacactaacaatccaaccctctcccccaaaaggggattttagtaaataaccaaatataacaccggggctaagggtcaaattggtaatttttcttacatctcctcccccaggagcccaggtatcatatataccgccaaaataaagagctttgagtactagaagaaaagcacctatacctaacaaaattaggtgaatacccaaaattgtagtcattttatttctatctttccacacataaccaaagaatggaaaagattcttcaagagtctccggtcccagaagcgcgtgataaatgccaccgaagcctaagactgcggaggaaattagatgaagtactccagatacaaagtacggaaaagtatctagaacttctcccccgggccctactccccaacctagagtagctaagtgcggaagtaaaatcaacccttgttcatacatgggtttttctggtacgaaatgggccacttcaaataggttcattgctccggcccagaatacgattaatcctgcatgggctacgtgagctccaagtagtttacccgacaaattgataagtctggcattcccggcccaccaagcaaaaccggtggtttcttggtcacgaccagctaaaacaaaagttccattaaagagcgtttccacgtgtgtagaacctcctcagggaatataagattttcatgaggctgatcctgagctgccatccacgcacgaataccctcgtttaaaagaatatttttggtgtagaaagtctcaaattcaggatcttccgctgcacggatttcctgggaaacgaagtcataggcacgtaggttcagagccaggccgactacgccaatagcactcatccataaaccggtgaccggtacaaatagcataaagaaatgtaaccaacgtttattggaaaaagcaacaccaaagatttgggaccaaaagcgattagcggtgaccattgaataagtttcttcagcttgagttgggttaaaagcgcggaaggtatttgcaccatcaccgtcctcaaatagagtgttttccacggttgccccatgaatagcgcatagcagagccgcgcctaatactccggcaactcccatcatatgaaatgggttcaacgtccaattatgaaatccttggaagaagaggatgaatcgaaatatcgctgctacgccaaaactcggcgcaaagaaccaaccggattgccccagtggataaatcaggaatacggaaacaaaaacagcgattgggccagagaatgaaattgcattataaggccgcaattgaacagaccgagcaagttcaaattgacgtaacatgaaacctattagtgcaaaagccccatggagagcaacaaaagtccacagaccacctaattgacaccaacgagtaaaatccccttgtgcttccgggccccatagtagcaacaaagagtgtgctaaactattggcaggggtggaaactgctgcggttaagaaattgcaaccttccaaataggaactcgccaatccatgggtataccaagaagttacaaaagttgtccctgtaaaccaacctcctaaagcgaaataagcacaaggaaaaagcaataggccagaccatcctacaaaaacaaaacggtcccttcgtaaccagtcgtccataatatcaaataaatcattttcttctttagtaactctaccaagggctatagtcatagtgatcctcctattcaattacttcaaccatttccgagcaccttatatcacttccaaggcatacgatagattatctgtggacgattttttctcgttcaatgccttttttcaatggtctcgaagatagaaattttgcatttttatctatggggtcacagccgaggtcgtggtaaatccatgaatttgattcaattagtttttcttatact

SEQ ID NO: 4307 - DNA, 3433 bp, Sorghum bicolor
gaggggaggggatttagccttaattccacaaacggatatagcggattctgtatccgtgtatacagtatacagagatatattgaaagtggacttgcatctgagatgagttagtagatcatttcatatagctatgttctatttgtaggaataaaatagggattgggctgtggagagatggctgagtggttgatagctccggtcttgaaaaccggtatagttctaggaactatcgagggttcgaatccctctctctccttttgtatattgaatacatttgtttctttctatctatgtttttctttgttcagcccccttatatcattctttcataaaaaagcatgaatggctcggctagatggaataaccgagccagaacagaaaaaaactagaacaggtataaataaaaaatcttagttaagaggggtcatgtaaagaacaggttccaaatcacgatcaattcccttttcaaagcctgctgcagcagctcgggctcttcctgcatgccacaaatggcccacaaaaaagaagaatcctagaacaaaatgggaggtcgctaaccaacttctaggagagacataattaactgcattgatctcggtagctacgccacccacggaatttaaagagcctaaaggagcatgggtcatatattctgctgaacgtcgttcttgccaaggttggatatcttttttcaacctactcaagtccaaaccgttggggccccttagaggttctaaccacggagcacgaagatcccaaaaacgcatagtttcccctccaaaaataacctctcccgttggggaacgcattagatatttacctaaacccgtcggtccttgggcagaccctacattagctccaagacgctggtctctaactagaaaagtaaatgcttgagcttgagaagcttctggtccagtgggcccgtaaaactcacttggataagccgtattattgaaccagacaaaacaacaagcgataaaaccaaaaacagataaagcacctaaactataagacaagtaagcttcgccagaccatacaaatgcacggcgagcccatgcaaagggtttggttaagatatgccaaattccgccaagtacacaaatggaacccaaccatacatgccccccaattatatcttctaaatcatccacactaacaatccatccttctcccccaaaaggggattttagtaaataaccaaatataacaccggggctaagggtcaaattggtaatttttcttacatccccccccccgggggcccaggtatcatatacgccgccaaaataaagagccttgagtactagaagaaaagcacctagacctaacaaaattaagtgaatacccaaaattgtagtcattttatttctatctttccatacataaccaaagaatggaaaagattcttcaagagtctcgggtcccagaagcgcgtgataaatgccaccgaagcctaagactgcggaggaaattaagtgaagtactccggatacaaagtaaggaaaagtatctagaacttctccccccggccctactccccaacctagagtagctaagtgcggaagtaaaatcaacccttgttcatacatgggcttttctggtacgaaatgggccacttcaaataggttcattgctccggcccagaatacgattaatccggcatgggctacatgagctccaagtagtttaccggacaaattgataagtctggcattcccagcccaccaagcaaagccggtggtttcttggtcacgaccagctaaaacgaaagttccattaaagagcgtttccacgtggtagaacctcctcagggaatataagattttcatgaggctgatcctgagctgccatccacgcacgaataccctcatttaaaagaatatttttggtgtagaaagtctcaaattcaggatcttccgctgcacggatttcctgggaaacgaagtcataggcacgtaggttcagagccagaccaactacgccaatagcactcatccataaaccggtgacgggtacaaatagcataaagaaatgtaaccaacgtttattggaaaaagcaacaccaaagatttgggaccaaaagcggttagcagtgaccattgaataagtttcttcagcttgagttgggttaaaagcacggaaggtatttgcaccatcgccatcttcgaatagagtgttttctacggtagccccgtggatagcgcatagcagagctgcgcctaatactccggcaactcccatcatatgaaatgggttcaacgtccaattatgaaatccttggaagaaaaggatgaaccgaaatatagctgctacgccaaaactcggcgcaaagaaccaaccagattgtcccagtggataaataaggaatacggaaacaaaaacagcgattggaccagagaatgaaattgcattataaggccgcaattgaacagaccgagcaagttcaaattgacgtagcataaaacctattagtgcaaaagctccatggagagcgacaaaagtccaaagaccacctaattgacaccaacgagtaaaatccccctgtgcttccggtccccatagtagcaacaaagagtgtgctaaactattggcaggtgtggaaaccgccgcggttaagaaattgcaaccttccaaataggaactagccaatccatgggtataccaagaagttacaaaagtagtccctgtaaaccaaccccctaaagcgaaataagcacaaggaaagagcaataagccggaccatcctacaaaaacaaaacggtcccttcgtaaccagtcgtccataatatcaaatagatcgttttcttctttagtaactctaccaacggctatagtcatagtgatcctcctattcaattacttcaaccattttcgagcacctcatattacttccagggcatacgatagtttgattatctgtggacgatttctttctcgttcaatgccctttttcagtcgtctcgaagatagaaattttgcatttttatctatggggtcacaaccaaggtcgtgctaaatccacgaatttcatttaattcatttttcttatactatagaaaagaaataaaagaaaagaaataaagaaataaacatttgaattcagcattattccatgatttctatttcaaagcctattttttaagggaaaacccctcttttctcattcgctctctattgcatgggtggaagaacaaaaatagaataggattctgaaaaaaaaagaaagatattgaaaagaaaaattgacttttgaaaccctttattcattatgtgtaacggaaaagagttgcgatttcttcttattcctatagaacgtctagtaacaagaatatgaaatcgtaaatagcgaaaaattcttgccttgcgcgatctaagtctaaggaaataaaaaaatgcgcttatacaccaatttcatccacatcgaatttat

SEQ ID NO: 4308 - DNA, 2212 bp, Sorghum bicolor
aagaagtaggaggggttaaatcaggaatccattgattcttcttgttattaaactttttccttaccgcttttatttggatatggagttgaggggaggggatttagcctttatttcacaaacggatatagcggattctgtatccgtgtatacagtatacagagatatattgaaagtggacttgcatctgagatgagttagtagatcatttcatatagctatgttctatttgtaggaataaaatagggattgggctgtggagagatggctgagtggttgatagctccggtcttgaaaaccggtatagttctaggaactatcgagggttcgaatccctctctctccttttgtatattgaatacatttgtttctttctatctatgtttttctttgttcagcccccttatatcattctttcataaaaaagcatgaatggctcggctagatggaataaccgagccagaacagaaaaaaactagaacaggtataaataaaaaatcttagttaagaggggtcatgtaaagaacaggttccaaatcacgatcaattcccttttcaaagcctgctgcagcagctcgggctcttcctgcatgccacaaatggcccacaaaaaagaagaatcctagaacaaaatgggaggtcgctaaccaacttctaggagagacataattaactgcattgatctcggtagctacgccacccacggaatttaaagagcctaaaggagcatgggtcatatattctgctgaacgtcgttcttgccaaggttggatatcttttttcaacctactcaagtccaaaccgttggggccccttagaggttctaaccacggagcacgaagatcccaaaaacgcatagtttcccctccaaaaataacctctcccgttggggaacgcattagatatttacctaaacccgtcggtccttgggcagaccctacattagctccaagacgctggtctctaactagaaaagtaaatgcttgagcttgagaagcttctggtccagtgggcccgtaaaactcacttggataagccgtattattgaaccagacaaaacaacaagcgataaaaccaaaaacagataaagcacctaaactataagacaagtaagcttcgccagaccatacaaatgcacggcgagcccatgcaaagggtttggttaagatatgccaaattccgccaagtacacaaatggaacccaaccatacatgccccccaattatatcttctaaatcatccacactaacaatccatccttctcccccaaaaggggattttagtaaataaccaaatataacaccggggctaagggtcaaattggtaatttttcttacatccccccccccgggggcccaggtatcatatacgccgccaaaataaagagccttgagtactagaagaaaagcacctagacctaacaaaattaagtgaatacccaaaattgtagtcattttatttctatctttccatacataaccaaagaatggaaaagattcttcaagagtctcgggtcccagaagcgcgtgataaatgccaccgaagcctaagactgcggaggaaattaagtgaagtactccggatacaaagtaaggaaaagtatctagaacttctccccccggccctactccccaacctagagtagctaagtgcggaagtaaaatcaacccttgttcatacatgggcttttctggtacgaaatgggccacttcaaataggttcattgctccggcccagaatacgattaatccggcatgggctacatgagctccaagtagtttaccggacaaattgataagtctggcattcccagcccaccaagcaaagccggtggtttcttggtcacgaccagctaaaacgaaagttccattaaagagcgtttccacgtggtagaacctcctcagggaatataagattttcatgaggctgatcctgagctgccatccacgcacgaataccctcatttaaaagaatatttttggtgtagaaagtctcaaattcaggatcttccgctgcacggatttcctgggaaacgaagtcataggcacgtaggttcagagccagaccaactacgccaatagcactcatccataaaccggtgacgggtacaaatagcataaagaaatgtaaccaacgtttattggaaaaagcaacaccaaagatttgggaccaaaagcggttagcagtgaccattgaataagtttcttcagcttga

SEQ ID NO: 4309 - DNA, 2729 bp, Sorghum bicolor
tttagcctttatttcacaaacggatatagcggattctgtatccgtgtatacagtatacagagatatattgaaagtggacttgcatctgagatgagttagtagatcatttcatatagctatgttctatttgtaggaataaaatagggattgggctgtggagagatggctgagtggttgatagctccggtcttgaaaaccggtatagttctaggaactatcgagggttcgaatccctctctctccttttgtatattgaatacatttgtttctttctatctatgtttttctttgttcagcccccttatatcattctttcataaaaaagcatgaatggctcggctagatggaataaccgagccagaacagaaaaaaactagaacaggtataaataaaaaatcttagttaagaggggtcatgtaaagaacaggttccaaatcacgatcaattcccttttcaaagcctgctgcagcagctcgggctcttcctgcatgccacaaatggcccacaaaaaagaagaatcctagaacaaaatgggaggtcgctaaccaacttctaggagagacataattaactgcattgatctcggtagctacgccacccacggaatttaaagagcctaaaggagcatgggtcatatattctgctgaacgtcgttcttgccaaggttggatatcttttttcaacctactcaagtccaaaccgttggggccccttagaggttctaaccacggagcacgaagatcccaaaaacgcatagtttcccctccaaaaataacctctcccgttggggaacgcattagatatttacctaaacccgtcggtccttgggcagaccctacattagctccaagacgctggtctctaactagaaaagtaaatgcttgagcttgagaagcttctggtccagtgggcccgtaaaactcacttggataagccgtattattgaaccagacaaaacaacaagcgataaaaccaaaaacagataaagcacctaaactataagacaagtaagcttcgccagaccatacaaatgcacggcgagcccatgcaaagggtttggttaagatatgccaaattccgccaagtacacaaatggaacccaaccatacatgccccccaattatatcttctaaatcatccacactaacaatccatccttctcccccaaaaggggattttagtaaataaccaaatataacaccggggctaagggtcaaattggtaatttttcttacatccccccccccgggggcccaggtatcatatacgccgccaaaataaagagccttgagtactagaagaaaagcacctagacctaacaaaattaagtgaatacccaaaattgtagtcattttatttctatctttccatacataaccaaagaatggaaaagattcttcaagagtctcgggtcccagaagcgcgtgataaatgccaccgaagcctaagactgcggaggaaattaagtgaagtactccggatacaaagtaaggaaaagtatctagaacttctccccccggccctactccccaacctagagtagctaagtgcggaagtaaaatcaacccttgttcatacatgggcttttctggtacgaaatgggccacttcaaataggttcattgctccggcccagaatacgattaatccggcatgggctacatgagctccaagtagtttaccggacaaattgataagtctggcattcccagcccaccaagcaaagccggtggtttcttggtcacgaccagctaaaacgaaagttccattaaagagcgtttccacgtggtagaacctcctcagggaatataagattttcatgaggctgatcctgagctgccatccacgcacgaataccctcatttaaaagaatatttttggtgtagaaagtctcaaattcaggatcttccgctgcacggatttcctgggaaacgaagtcataggcacgtaggttcagagccagaccaactacgccaatagcactcatccataaaccggtgacgggtacaaatagcataaagaaatgtaaccaacgtttattggaaaaagcaacaccaaagatttgggaccaaaagcggttagcagtgaccattgaataagtttcttcagcttgagttgggttaaaagcacggaaggtatttgcaccatcgccatcttcgaatagagtgttttctacggtagccccgtggatagcgcatagcagagctgcgcctaatactccggcaactcccatcatatgaaatgggttcaacgtccaattatgaaatccttggaagaaaaggatgaaccgaaatatagctgctacgccaaaactcggcgcaaagaaccaaccagattgtcccagtggataaataaggaatacggaaacaaaaacagcgattggaccagagaatgaaattgcattataaggccgcaattgaacagaccgagcaagttcaaatgacgtagcataaacctatagtgcaaaagctccatgggagagcgacaaaagtccaaaagacccacctaattgacaccaacgagtaaaatccccctgggctttccggtccccatagttagcaaacaaagagtgtggctaaactattgggcagttgtggaaaccccccgcggttaaagaaattgcaacctttcctagccaatccatggggtataccaagaagttacaagagtagtccctgtaaccaacccccctaaagcgaataagcacagggaagagcataagccggacca

SEQ ID NO: 4310 - DNA, 13165 bp, Panicum virgatum
ctctataagttggggcacgagagtaactaggtctggcgatactggatttttagaatccataccatagttctatcctcaaactaggttttgttttgtcggcagtggcccaaacggctaccaatagggatgaggtagcgtttccttattcttttattaatttaaattgattcgatttgggaatttaaaactacgagactaagatgtcagaaatcttcgtatccaaaggttcctaaggagcagtcttttttcaatctaagattgaagaagggacttcgcgaagaaatatcaagacttcctaattatcatacattttttttatggtacatcttactacatacacttcgtacatcttatgctacccacatacactaaagtaaaggctactgattctgtcgagaattagattgaataggctgatcaaaaaacaatttcggggttgtggatagggcctcctcactctttcatagaaagatagaaagcggggcagtagggtttaggtaaaaaataaatatgggtaaggtaggtatccaataaatatttatctatcctaattttatggtatattcttatgccctttgcttataaaaggggaacaaacggacgaaaaaatctctctattcccgcgtcttctattcaggacatccccctactcttttttagggaaagggctatgtatcatatttatacttaatgctctccaattctaccagaaatcatataagaatttgttaggagtaaattcctttaacggattaatccatagtcttagggcagaatagaatgaccttttgactctgtacccttgattccactatgattatttatcaatagtagaagaattccttcatagaaataggagacataatttgcatggatatagtaagtctcgcttgggctgctttaatggtagtctttacattttctctttcgctagtagtatgggggaggagtggactctagggatactaccaattgattgagtagtcgaattgtagtatcaactcttttctttaattgatcgttttgcattaataagtttggcaaacttttttttttctctctttctttagttttgttttactcttgtaagaaactcttttaagaaagtaagaaagagtcgttctattctactatgttctattccagtataatagaatagaaagggcgattatagtaattcagaatttctattctactagaagtggcgaataaaaagaaagttctatacaaaagaaaatgaaactttcttttcttacacgaagctattcacaacatatcgcacattttccagttatactattttcttattcttagaaaattttttatgttcttttttttgaaggatctcgattgaagcatctcgcgccatttttaagcatgaaagattcgtaggttttttccttttactttttttcttttactatattctattcgcgtattatttttctccccctccgtggatgcggtgaaaaaagcagttgaattagactactatttcaatctactaatcgattctatgtagattcaagataatataatagaaagaatctaaagtgtggtagaaagaactacatgtagttctttctaccacactttatgattccaaccggatcctttcatttaagacttggatttttattttctttaatccctttttcatttcttcaataattaattggaattccaattaatcattttggctggctgtttttacataaataataagtaaaaaggcagtaggaactagaatgaacaatgcagtagcaataaatgcgagaatattgacttccataatctctttattttttttcacaataactcgggatgtaatcccatagagaggaaaaaggggtatcctgtaaatttaaggggaggacttgcattctgataatactgaatcaattcaatattatgaatattggatctatcaaatcaatttatggttgatagtgggataatataacataggaggatcccttatccatactaagaccaaaataggttttttgattggattcgaaactccctctattctatttttcattcttttcgacttttgcttttccatatgtataacccaaaatccttcttatcttatccaatttcccttcttttttcttatagttatagttatacatacaattatgtatgtatgtattatatgacctactttctatgggtcacatagacatccaaataagcagtagaagtagaaatgagatggagaaaaggggatcttaaataaaaaggatccaatatttaaacttaggaaaaagagcgtttacttggtttttattttattaggttactatcaatatctgctttttggggtttaaaaatgagagcagatctataaaaaaaaggagtcgcaaatggagtgagaataaggtagattctttccaattattcattgaacatacacaaacaaagttggaactagaaaatggaaggggtgtgcctccaaaaaggaactaattagatgaaattcattctctaacaataaacgaatatggtttatgtatggattccggtaaaataccggtactctattccataagagtcgaataggaagttaagatgaggatagtatcatcataaaaatagagtaatatcctaaattatactaatccacgtatgatggcctttccttatcaaccagaagtagtgaaaaaaattcctatactgctctttttttactgagaaatgtgaaataaaaaaagtgaagtaagggtaccccatagatatttgatgttgcctcctgcccccccccttttttcatcaaaaatttccatgaaaaaaaggaaagatgaatttttctattcattgaaccctagttcgggactgacggggctcgaacccgcagcttccgccttgacagggcggtgctctgaccaattgaactacaatccccgcggggtgtatggcatacttattcttaaatagaaccataattcttaaataaaaccataagaagattcgattcctctgtcgtgctttaagaaatagacgaatcatatactacatacccacataggatatgtgggtatagtgagagtggcatgactagtatgtcacgattttttatccctaaaaataaacgataatctgcctttccataagaaaaactctataaaaaataagagagatatgaattagaaatatctttccccatttatctttatcctttatttctagggatcagacattttttttcttccatacaaaataatggatttagttcatattcacgaagccctagatttttgggccgagctggatttgaaccagcgtagacatatcgtcaacgaatttacagtccgtccccattaaccgctcgggcatcgacccaggaagaattttttctaggctttttaataatctatgattaacctctttttataatactccctacccctaggggaagtcgaatccccgctgcctccttgaaagagagatgtcctgaaccactagacgataggggcatcactagacgatagcgccatatacaaccactcgtcattatattataatgatagtatgagcagttttttggaattgtcaatatactcgaagagtataactagatcaaaggaaagagtctttactctttttctgttatgctttcataggatttcttttagttgagggttaggttaattcgcggatcatcccctactttttagggaaattcgtttaaagggtatagaataagaatagattaataaaaaggagtctagattagttcagtacaggtattgatttgattgttctaacaggaaaaacagtccaatttcatttcttttttgcaatttaaactctgtgcttcgtttagtgttcagaccaaaaatgcctgcatctcgcactaaactaagtcataaaattcacgaaaaaatggagacattaaaaaaaaaaaaatgaatggattttgtagaaaagtactttctcggattcgaaccgatgacttctgtcttaccaaagcattactctacccctaagtgaaaagccctttatcggatttgaaccgatgacttatgccttaccatggcattactctaccactgagttaaaagggctttttattcaaaaattagccactttcatttactatactattataggtctactgcataatgtacatgtacatattatatgtatatattaatgtacataatatatgtatatatagagatatatgtagagatttacatatatcgaggttcaaaatcttgataaaatcaagaaaaataagaaaatctttcatattctctcttatcacttgcacaaagtggaggtattttattattatatatataaatatgtataacgtataataaaatacgtgaacggagagttgacacactcaaaacttattatatatatcggatacacttgaagaaggtgggtcagttcttaggtatgtaaacacgatctcggccaactcaccaaagcccggaagttccatttttttttagaggagaataaatatgtatcaattgttgaatcggatacaacaatgggccgaaaatgccaaaggagcaataagaactgctgttaaaaaaatgatagactttttttttatctttaggctattcacttttcacgtgctcagaatgttcggcagaattagggacttttttcttctattgtccgatcttataatatgatgagaactttctccatttatgttttatttcccctaattctaattgggtggagtataaaggaatttgtgctcttcatatacccatatggttgggtattaattttcagtgatatacttcttatctgttttggtgagagattgaaacaatttttaacaggcatctttttcttttggaaaaactttcgagtccaaaactttttaagaataattaaaaaagttttggacggatttgttgaaactgttttcaacaggtatcccttggaaatggggtacttgactattctacaaggattctagtggatttggaacaaattatgttggagttaattttattctaaaaagttggcaatcgaatttctactggagagtagaaaaattatactactgcctgcccaacaaaaaataaaaaccatatcctacatacctaactcctcctggttcaaggttttctgtttccgaacactagaaaaaggaggattttgggtttctgatcctagggtgaaaaggaagggaacagatacccaatatgattcttaggaggaacgtttggtaatggccttggtcctctatgctcttttttatgtgttcttagttctattcatcttctttgattcttttaaacaagaatttaataaactagaattgagtggaaaagaagagaggaaattagtaaatggggaggatccactaaccagagactttccggatcctctttatgaagagtttgaggagtcctcatcagagtcctctgatgtaaattttcatcagttaaatctgtcgattcctatctgcttttctttttattttaagttattactctttgtttgttgtttctctcaagtaatagaggaagtccatgatgaattttttaaagtcatctgactccttacctatggctcggatttcatgataagtggaggaagaaaacatctttcccaatttttttgttcaattctgaacaaaaaaaggaagaaagagatttatggggactgtactgccccctatatctcttagtgtatattgtagtcataaccgtagaatagatcctaatcgaaatgcatacatttggttcatacacaattggcatggtaagaagagatgtattttacagactagagaggggctatctaaatcctaaagtaaaggctcgcggttgaagtaccaaccgcccactgccatgaactttcaccgtttgatttgataaggttgaattagcccccttctcgaatggctacccttgacaaagggtagcgttggtatcataatctacatgtagcgggtatagtttagtggtaaaagtgtgattcgttctattaataactgaatttgaaatgatatacttaaggcatccttaagtttttttatattcatattccgatgaaaactttagttcttataaagggtttaatccttttcctctcaatagcatattgaggaaaaatatacattctcgcgattagtatccaaagactaatttaatttgcacccaaaatacaaatttgattatgagtacagaatcgcgaagcataattttgcatttaagtattccgattgaataaatatgagtaaaggatctatggatgaagatacaaaaaagtttatttccaatcgtaactaaatcttcttttgttttgtttaaaaaggaaatggaagcccaatagctaaaaaaccatggttttggtttactagaaccgtcagtatattgtttcagctcggtggaaacccaactcttttcctcaggatctcttgaatgaaattagggaacgaagtaagtagattagatagatatttaggataatttctatctcctattctatagggatcatctagaaagcagagagctttggttccattcagacagaaaagctgacatagatgttaagtggtgagaatatccataaaggagccgaatgaaatcaaaatttcatgttcggttttgaattagagacgttaaaaaaataaaccaacgtcgactataacccctagccttccaagctaacgatgcgggttcgattcccgctacccgctccattttgtagaaaaagactattctatttgtttgtctagacatggtagagacttgtattcaacctttttcgtccacctgttttcggccctacagagcggagtagagcagtttggtagctcacgaggctcataaccttgaggtcacgggttcgattcccgtctccgcacttagcagtccgtataaacggactaccatatttgtatagatatggtagagggctatatccaactcttttttttattcagcaggcaggcagcaaaaaaaaaatgaaagaaaagcatagcctatcccctttaaaaaccgtttgtctcttgtttgtctcggtgaatccccgccccggtttagggaactttcttggaaagttggattttcgcccccgaagcactcttttttttttgagtcgggtgcaaaggaagcataagataggaaggggtacagtactagactaacaactacttaatttaatagaagtacttaagtaatagaagtagttaagtagtcaactagatttaattttttatcatagtaccttactaaattaagctggcgagcgacggggatcgaacccgtatcttctccttggcaaggagatgttttaccactgaactacgctcgctacattgaactacgctcgctacggcctatattttatagggtatatccacctgggtcgaccgtctatgtctgggtcgaccgtttcattttctattagagttttctttttattaattgtctgtcaatcaatattctaatggcaatagaatttcataataatgaaggagaagaagtaatataataattcggaacgaaaatagcattttaatgtgtatcaaagaaatttttcgaaaaaaaggcctttctttttatttattttatatcgggctactaaatactaaacaaattcaagaaatgagagaattcagaatagctaccagaaagactaatccaatccataatgatgtaccggaaaatacaacgtttttattatttgaccaaccatcaggagaagcaaatacaaggggtacactaattactaagattgaggaagtcgcaattaatgcaaaaacagctaattggaaagcaatagtcatatttcaaatcctccaaactaccttcaaataaagttgactacatatttctatttgatccctcacttaatcaaaattgtacgaaaatacaagaagtaggaggggtttaatcatgaatccattgattcttctctttaaaactttttccttaccgcttttatttggatatagagttgaggggatttagcgtttatttcacaaacggatatagcggattctgtatccgtgtatacagtatacagagatatatcgaaagtggacttgcatctgagatgtttctaggagttagtagatcatttcatatagctatgttctatttgtaggaataaaatagggattgggctgtggagagatggctgagtggttgatagccccggtcttgaaaaccggtatagttctaggaactatcgagggttcgaatccctctctctccttttgtttattgaatacatttgtttctttctatgtttttctttgttctgcccccttatatcattctttcataaaaaagcatgaatggctcggctagatggaataaccgagccagaacagaaaaaaagtggaacaggtagaaataaaaaaatcttagttaagaggggtcatgtaaagaacaggttccaaatcacgatcaattcccttttcaaagcctgctgcagcagctcgggctcttcctgcatgccacaaatggcccacaaaaaagaagaatcctagaacaaaatgggaagtcgctaaccaacttctaggagagacataattaactgcattgatctcggtagctacgccacccacagaatttaaagagcctaaaggagcatgggtcatatattctgccgaacgtcgttcttgccaaggttggatgtcttttttcaacctactcaagtccaaaccgttggggccccttagaggttctaaccacggagcacgaaggtcccaaaaacgcatagtttcccctccaaaaatgacctctcccgttggggaacgcattagatatttacctaaacctgtcggtccttgggcagaccctacattagctccaagacgctggtctctaactagaaaagtaaatgcttgagcttgagaagcttctggcccagtgggtccgtaaaactcacttggataagcggtattattgaaccagacaaaacaacaagcgataaaaccaaaaacagataaagcacctaaactataagacaagtaagcttcgccagaccatacaaacgcacggcgagcccatgcaaagggcttggttaagatatgccaaattccgccaagtacacaaatggaacccaaccatacatgtcccccaattatatcttctaaatcatccacactaacaatccatccttctcccccaaaaggggattttagtaaataaccaaatataacaccggggctaagggtcaaattagtaatttttcttacatcccctcccccgggggcccaggtatcatatacgccgccaaaataaagagccttgagtactagaagaaaagcacctagacctaacaaaattaagtgaatacccaaaattgtagtcattttatttctatctttccatacataaccaaagaatggaaaagattcttcaagagtctcgggtcccagaagcgcgtgataaatgccaccgaagcctaagactgcggaggaaattaggtgaagtactccggatacaaagtaaggaaaagtatctagaacttctccccccggccctactccccaacccagagtagctaagtgcggaagtaaaatcaacccttgttcatacatgggcttttctggtacgaaatgggccacttcaaataggttcattgctccggcccagaatacgattaatccggcatgggctacatgagctccaagtagtttaccggacaaattgataagtctggcattcccagcccaccaagcaaagccggtggtttcttggtcacgaccagctaaaacgaaagttccattaaagagcgtttccacgtggtagaacctcctcagggaatataagattttcatgaggctgatcctgagctgccatccacgcacgaataccctcgtttaaaagaatatttttggtgtagaaagtctcaaattcaggatcttccgctgcacggatttcctgggaaacgaagtcataggcacgtaggttcagagccaggccaactacgccaatagcactcatccataaaccggtgacgggtacaaatagcataaagaaatgtaaccaacgtttattggaaaaagcaacaccaaagatttgggaccaaaagcggttagcagtgaccattgaatacgtttcttcagcttgagttgggttaaaagcgcggaaggtatttgcaccatcaccatcttcgaatagagtgttttctacggtagccccatggatagcgcatagcaaagctgcgcctaatactccggcaactcccatcatatgaaatgggttcaacgtccaattatgaaatccttggaagaaaaggataaatcgaaatatagctgctacgccaaaactcggcgcaaagaaccaaccagattgtcccagtggataaataaggaatacggaaacaaaaactgcgattggaccagagaatgaaattgcattataaggccgcaattgaacagaccgagcaagttcaaattgacgtaacatgaaacctattagtgcaaaagccccatggagagcgacaaaagtccacagaccacctaattgacaccaacgagtaaaatccccctgtgcttccgggccccatagtagcaacaaagagtgtgctaaactattggcaggagtggaaaccgccgcggttaagaaattgcaaccttccaaataggaactagccaatccatgggtataccaagaagttacaaaagtagtccctgtaaaccaaccccctaaagcgaaataagcacaaggaaagagcaataggccggaccatcctacaaaaacgaaacggtcccttcgtaaccagtcgtccataatatcaaatagatcattttcttctttagtaactctaccaagggctatagtcatagtgatcctcctattcaattacttcaaccatttccgagcacctcatattacttccagggcatacgatagtttgattatctgtggacgatttctttctcgttcaatgccctttttcaatggtctcgaagatagaaattttgcatttttatctatggggtcacaaccaaggtcgtggtaaatccacgaatttcattcaatttatttttcttttcttatactatagaaataaaaaaataaacatttgaattcagcattattccatgattcctatttcaaagcctatcttttaagggaaaaaaaacccttcttttctcattcgctctctattgcatgggtggaagaacaaaaataggattctgaaaaaaagaaagatattgaaaagaaaaattgacttttgaaaccctttttatgtgtaacggaaaagagttgcgatttcttcttattcctatagaacgtatagtaacaagaatatgaaatcgtaaagagcgaaaaattattgccttgcccgatctaagtctaaggaaatacaaaaaatccgcttatacaccaatttcatccacatcgaatttatatatcagaatagcggatagaggcattattcaaggggtcaggtctacttactttatctttctttctaattttattgtgggtttcataagaaccttttttgctttgtggataaataatcgaaaaaaaagagttttttttataacctacttgttttattctaacaaatcctatatggaactgcccgctgaagagaaaatttatctgattgtctctcatctcagcccagcctatatcgaattttggaaagaaaaaacaagaattttcttcttttttttattaacattaagataagaaaaaagaatataattaaaatggaattggcaatataatttttatgcacttttgaaatgaaagaaaaaggaaggatttttgcaatcgttatttcttgcctctgtcatatcacgaaaacctttcgatttggaacggggagagatggctgagtggactaaagcggcggattgctaatccgttgtacaatttttttgtaccgagggttcgaatccctctctttccgccccttcggattatttggaactttcgaattgtaaggaattctgacccccggattttctcatagataaatgtacgaaataaatccaatttgtaagaaaaaattcccaaaaattttggatttttactcctcacgcccaggattacgtcctgggtcattagataagaatccaaagataaagagggaaacaaagaatatcactactgtataaacaaaaagtttgagagtaagcattacataatctccaagattttttttgttaaggaatagattacccatttttctttaccacacagatccactaggatggtttttttttattttgacacctaaaaatgtaaaaatcaattcttaaaaaaaattgcaagaattgctttataaaaagcactcttatcaatatcaaaaatttgtttaggtattgtgtgggtacctaaaggtacctgctcaacgtagccgcaggggatagaaaggcggatccaaatttattgctgcagctatacattcaatgtagaagaatttcaattttagaatcgaaggttcataatataagacttcttggctcttatccatttttttttggaatgaatacattggcagacagagatagtaaagatttcatcgaaaacttacagcggcttgccaaacaaacgctaatagaaaaaagagtacaggtatgacaggcataacatccacgattgggttgaaaatggcataagcttcgggtaatttggcgaagaaaaagctagtcggacaaagaacagaattaaaacagatacaggttaaactaagtatattaggcataccaagcatttcgttcttgtagagtagataattggattttgattgagttatttttctaagggaaaaaagcaaaagaaagggtggattcaaaatccttttttcttcggactttcccaaacacaaaatacctccttgtattcgcattctcaaatgagaatggaagaaattcgactttcatataatatcttaatagaattccatgtaatgatcaatgcattttttggattctatattatccgcatgtctagaatcctagcaagaaaatatccctcattttttaggtaattgaagtgggattgacgaataatatataaaaataatactgtttattagtgtcggataaaacgaaatggggcgtggccaagtggtaaggcagcgggttttggtcccgttactcggaggttcgaatccttccgtcccagattttttctgatgaagcgaaagatagaatcgtattgtgctctgcacgacacaaaaaaagtttatt

SEQ ID NO: 4311 - DNA, 5921 bp, Panicum virgatum
ttaagctggcgagcgacggggatcgaacccgtatcttctccttggcaaggagatgttttaccactgaactacgctcgctacattgaactacgctcgctacggcctatattttatagggtatatccacctgggtcgaccgtctatgtctgggtcgaccgtttcattttctattagagttttctttttattaattgtctgtcaatcaatattctaatggcaatagaatttcataataatgaaggagaagaagtaatataataattcggaacgaaaatagcattttaatgtgtatcaaagaaatttttcgaaaaaaaggcctttctttttatttattttatatcgggctactaaatactaaacaaattcaagaaatgagagaattcagaatagctaccagaaagactaatccaatccataatgatgtaccggaaaatacaacgtttttattatttgaccaaccatcaggagaagcaaatacaaggggtacactaattactaagattgaggaagtcgcaattaatgcaaaaacagctaattggaaagcaatagtcatatttcaaatcctccaaactaccttcaaataaagttgactacatatttctatttgatccctcacttaatcaaaattgtacgaaaatacaagaagtaggaggggtttaatcatgaatccattgattcttctctttaaaactttttccttaccgcttttatttggatatagagttgaggggatttagcgtttatttcacaaacggatatagcggattctgtatccgtgtatacagtatacagagatatatcgaaagtggacttgcatctgagatgtttctaggagttagtagatcatttcatatagctatgttctatttgtaggaataaaatagggattgggctgtggagagatggctgagtggttgatagccccggtcttgaaaaccggtatagttctaggaactatcgagggttcgaatccctctctctccttttgtttattgaatacatttgtttctttctatgtttttctttgttctgcccccttatatcattctttcataaaaaagcatgaatggctcggctagatggaataaccgagccagaacagaaaaaaagtggaacaggtagaaataaaaaaatcttagttaagaggggtcatgtaaagaacaggttccaaatcacgatcaattcccttttcaaagcctgctgcagcagctcgggctcttcctgcatgccacaaatggcccacaaaaaagaagaatcctagaacaaaatgggaagtcgctaaccaacttctaggagagacataattaactgcattgatctcggtagctacgccacccacagaatttaaagagcctaaaggagcatgggtcatatattctgccgaacgtcgttcttgccaaggttggatgtcttttttcaacctactcaagtccaaaccgttggggccccttagaggttctaaccacggagcacgaaggtcccaaaaacgcatagtttcccctccaaaaatgacctctcccgttggggaacgcattagatatttacctaaacctgtcggtccttgggcagaccctacattagctccaagacgctggtctctaactagaaaagtaaatgcttgagcttgagaagcttctggcccagtgggtccgtaaaactcacttggataagcggtattattgaaccagacaaaacaacaagcgataaaaccaaaaacagataaagcacctaaactataagacaagtaagcttcgccagaccatacaaacgcacggcgagcccatgcaaagggcttggttaagatatgccaaattccgccaagtacacaaatggaacccaaccatacatgtcccccaattatatcttctaaatcatccacactaacaatccatccttctcccccaaaaggggattttagtaaataaccaaatataacaccggggctaagggtcaaattagtaatttttcttacatcccctcccccgggggcccaggtatcatatacgccgccaaaataaagagccttgagtactagaagaaaagcacctagacctaacaaaattaagtgaatacccaaaattgtagtcattttatttctatctttccatacataaccaaagaatggaaaagattcttcaagagtctcgggtcccagaagcgcgtgataaatgccaccgaagcctaagactgcggaggaaattaggtgaagtactccggatacaaagtaaggaaaagtatctagaacttctccccccggccctactccccaacccagagtagctaagtgcggaagtaaaatcaacccttgttcatacatgggcttttctggtacgaaatgggccacttcaaataggttcattgctccggcccagaatacgattaatccggcatgggctacatgagctccaagtagtttaccggacaaattgataagtctggcattcccagcccaccaagcaaagccggtggtttcttggtcacgaccagctaaaacgaaagttccattaaagagcgtttccacgtggtagaacctcctcagggaatataagattttcatgaggctgatcctgagctgccatccacgcacgaataccctcgtttaaaagaatatttttggtgtagaaagtctcaaattcaggatcttccgctgcacggatttcctgggaaacgaagtcataggcacgtaggttcagagccaggccaactacgccaatagcactcatccataaaccggtgacgggtacaaatagcataaagaaatgtaaccaacgtttattggaaaaagcaacaccaaagatttgggaccaaaagcggttagcagtgaccattgaatacgtttcttcagcttgagttgggttaaaagcgcggaaggtatttgcaccatcaccatcttcgaatagagtgttttctacggtagccccatggatagcgcatagcaaagctgcgcctaatactccggcaactcccatcatatgaaatgggttcaacgtccaattatgaaatccttggaagaaaaggataaatcgaaatatagctgctacgccaaaactcggcgcaaagaaccaaccagattgtcccagtggataaataaggaatacggaaacaaaaactgcgattggaccagagaatgaaattgcattataaggccgcaattgaacagaccgagcaagttcaaattgacgtaacatgaaacctattagtgcaaaagccccatggagagcgacaaaagtccacagaccacctaattgacaccaacgagtaaaatccccctgtgcttccgggccccatagtagcaacaaagagtgtgctaaactattggcaggagtggaaaccgccgcggttaagaaattgcaaccttccaaataggaactagccaatccatgggtataccaagaagttacaaaagtagtccctgtaaaccaaccccctaaagcgaaataagcacaaggaaagagcaataggccggaccatcctacaaaaacgaaacggtcccttcgtaaccagtcgtccataatatcaaatagatcattttcttctttagtaactctaccaagggctatagtcatagtgatcctcctattcaattacttcaaccatttccgagcacctcatattacttccagggcatacgatagtttgattatctgtggacgatttctttctcgttcaatgccctttttcaatggtctcgaagatagaaattttgcatttttatctatggggtcacaaccaaggtcgtggtaaatccacgaatttcattcaatttatttttcttttcttatactatagaaataaaaaaataaacatttgaattcagcattattccatgattcctatttcaaagcctatcttttaagggaaaaataacccttcttttctcattcgctctctattgcatgggtggaagaacaaaaataggattctgaaaaaaagaaagatattgaaaagaaaaattgacttttgaaaccctttttatgtgtaacggaaaagagttgcgatttcttcttattcctatagaacgtatagtaacaagaatatgaaatcgtaaagagcgaaaaattattgccttgcccgatctaagtctaaggaaatacaaaaaatccgcttatacaccaatttcatccacatcgaatttatatatcagaatagcggatagaggcattattcaaggggtcaggtctacttactttatctttctttctaattttattgtgggtttcataagaaccttttttgctttgtggataaataatcgaaaaaaaagagttttttttataacctacttgttttattctaacaaatcctatatggaactgcccgctgaagagaaaatttatctgattgtctctcatctcagcccagcctatatcgaattttggaaagaaaaaacaagaattttcttcttttttttattaacattaagataagaaaaaagaatataattaaaatggaattggcaatataatttttatgcacttttgaaatgaaagaaaaaggaaggatttttgcaatcgttatttcttgcctctgtcatatcacgaaaacctttcgatttggaacggggagagatggctgagtggactaaagcggcggattgctaatccgttgtacaatttttttgtaccgagggttcgaatccctctctttccgccccttcggattatttggaactttcgaattgtaaggaattctgacccccggattttctcatagataaatgtacgaaataaatccaatttgtaagaaaaaattcccaaaaattttggatttttactcctcacgcccaggattacgtcctgggtcattagataagaatccaaagataaagagggaaacaaagaatatcactactgtataaacaaaaagtttgagagtaagcattacataatctccaagattttttttgttaaggaatagattacccatttttctttaccacacagatccactaggatggtttttttttattttgacacctaaaaatgtaaaaatcaattcttaaaaaaaattgcaagaattgctttataaaaagcactcttatcaatatcaaaaatttgtttaggtattgtgtgggtacctaaaggtacctgctcaacgtagccgcaggggatagaaaggcggatccaaatttattgctgcagctatacattcaatgtagaagaatttcaattttagaatcgaaggttcataatataagacttcttggctcttatccatttttttttggaatgaatacattggcagacagagatagtaaagatttcatcgaaaacttacagcggcttgccaaacaaacgctaatagaaaaaagagtacaggtatgacaggcataacatccacgattgggttgaaaatggcataagcttcgggtaatttggcgaagaaaaagctagtcggacaaagaacagaattaaaacagatacaggttaaactaagtatattaggcataccaagcatttcgttcttgtagagtagataattggattttgattgagttatttttctaagggaaaaaagcaaaagaaagggtggattcaaaatccttttttcttcggactttcccaaacacaaaatacctccttgtattcgcattctcaaatgagaatggaagaaattcgactttcatataatatcttaatagaattccatgtaatgatcaatgcattttttggattctatattatccgcatgtctagaatcctagcaagaaaatatccctcattttttaggtaattgaagtgggattgacgaataatatataaaaataatactgtttattagtgtcggataaaacgaaatggggcgtggccaagtggtaaggcagcgggttttggtcccgttactcggaggttcgaatccttccgtcccagattttttctgatgaagcgaaagatagaatcgtattgtgctctgcacgacac

SEQ ID NO: 4312 - DNA, 1579 bp, Physcomitrella patens
ttacgagcttatgattttgtttctcaggaaattcgtgcagctgaagaccctgaatttgaaactttttacactaaaaatattcttctaaatgaaggtattcgtgcttggatggcagctcaagatcagcctcatgaaaatcttgtattcccagaggaggttctaccacgtggaaacgctctttaatggaaccttggctttaagtggtcgtgatcaagaaaccactggttttgcttggtgggctggtaatgctagacttattaatttatctggtaagttattaggtgctcacgtagctcatgctggattaattgtattctgggctggagcaatgaatctttttgaagtagctcactttgtaccagagaagcctatgtacgaacaaggattaattctacttcctcacctagctactttaggttggggagtaggtcctggtggagaagttatagatacttttccatattttgtatctggagtacttcacctaatttcttctgcggttttaggttttggtggtatttatcacgcattaattgggccagaaactttagaagaatctttcccattttttggttatgtatggaaagataaaaataaaatgactactattttaggtattcatttaattttattaggtgctggcgctttccttttagtatttaaagccttatattttggcggaatatatgatacttgggctcctggaggaggtgacgtaagaaaaattacaaatcttactcttagtcctggtgttatatttggttatttacttaaatcaccttttggtggcgaaggatggattgttagtgtagataatttagaagatattattggaggccatgtttggttaggttctatctgtatttttggtggaatctggcatattttaacaaaaccatttgcttgggctcgtcgagctcttgtttggtctggcgaagcttatttatcttatagtttaggagctattgccgtttttggttttattgcttgttgttttgtttggtttaataacacagcttatccaagtgaattttatggtcctactggaccagaagcttctcaagcacaagcttttactttcctagttagagaccaacgacttggtgctaacgtaggttctgctcaaggacctactggtttaggtaaatatctaatgcgttctcctactggagaaatcatttttggtggagaaactatgcgtttttgggaccttcgtgctccatggttagaacctttacgaggacctaatggtttggacttaagtaagttgaaaaaagatattcaaccttggcaagaaagacgttctgcagaatatatgactcatgctccgttaggttctttaaattctgtaggtggtgtagctactgaaattaatgcagtaaattatgtgtctccacgtagttggttagctacttctcactttgtattaggatttttcttctttgtaggtcatttatggcatgcaggaagagcacgtgcagctgcagctggatttgaaaaaggaattgatcgtgattttgagcctgttctttctatgacacctcttaattaataattaaaattaagaaataaattagtt

SEQ ID NO: 4313 - DNA, 1425 bp, Oryza sativa
atgaaaatcttatattccctgaggaggttctaccacgtggaaacgctctttaatggaacttttgttttagctggtcgtgaccaagaaaccaccggttttgcttggtgggccgggaatgccagacttatcaatttgtcgggtaaactacttggagctcacgtagcccatgcaggattaatcgtattctgggccggagcaatgaacctatttgaagtggcccatttcgtaccagaaaaacccatgtatgaacaagggttgattttacttccgcacttagctactctaggttggggagtagggcccgggggagaagttctagatacttttccgtactttgtatctggagtacttcatctaatttcctccgcagtcttaggcttcggtggcatttatcacgcgcttctgggaccggagactcttgaagaatcttttccattctttggttatgtgtggaaagatagaaataaaatgactacaattttgggtattcacctaattttgttaggtataggtgcttttcttctagtactcaaagctctttattttggcggtatatatgatacctgggctcctgggggaggagatgtaagaaaaattaccaatttgacccttagccccggtgttatatttggttatttactaaaatccccttttgggggagagggttggattgttagtgtggatgatttagaagatataattgggggacatgtatggttgggtttcatttgtgtatttggcggaatttggcatatcttaaccaaacccttcgcatgggctcgccgtgcatttgtatggtctggagaagcttacttgtcttatagtttaggcgctttatctgtctttggttttatcgcttgttgttttgtctggttcaataatacagcttatccgagtgagttttatggacctactgggccagaagcttctcaagctcaagcatttacttttctagttagagatcagcgtcttggagctaatgtgggatctgcccaaggacccacaggtttaggtaaatatctaatgcgttccccaacgggagaggttatttttggaggggaaactatgcgtttttgggaccttcgtgctccatggttagaacctctaaggggccccaacggtttggacttgagtaggttgaaaaaagacatacaaccttggcaagaacgacgttcggcagaatatatgacccatgctcctttaggctctttaaattctgtgggtggcgtagctaccgagatcaatgcagttaattatgtttctcctagaagttggttagcgacttcccattttgttctaggattcttcttttttgtgggccatttgtggcatgcaggaagagcccgggctgctgcagcaggatttgaaaagggaatcgatcgtgatttggagcctgttctttacatgacccctcttaactaagat

SEQ ID NO: 4314 - DNA, 1446 bp, Citrus sinensis
cctcatgaaaaccttatattccctgaggaggttctaccccgtggaaacgctctttaatggaactttagctgtagcaggtcgtgaccaagaaaccaccggtttcgcttggtgggccgggaatgcccgacttatcaatttatccggtaaactgctgggcgctcatgtagcccatgctggattaatcgtattctgggccggagcaatgaacctatttgaagtggctcatttcgtaccagaaaagcccatgtatgaacaaggattaattttacttccccacctagctactctaggctggggggtaggtcctggtggggaagttatagacacctttccatactttgtatctggagtacttcacttaatttcctctgcagtattgggctttggcggtatttatcatgcacttctgggacctgagactcttgaagaatcttttccattcttcggttatgtatggaaagatagaaataaaatgaccacaattttgggtattcacctaatcttgttaggtataggtgcttttcttctagtattcaaggctctttattttgggggcgtgtatgatacctgggctccgggggggggggagatgttaagaaaaattaccaacttgacccttagcccaagtgttatttttggttatttactaaaatccttctttggaggagaggggtggattgttagtgtggatgatttggaagatataattggaggtcatgtatggttaggttccatttgtatatttggtggaatctggcatatcttaaccaagccttttgcatgggctcgccgtgcacttgtatggtctggggaggcttacttgtcttatagtttaggtgctttagctgtttttggtttcattgcttgttgctttgtctggttcaataataccgcttatcctagtgagttttatggtcccactgggccagaagcttctcaagctcaagcatttacttttctggttagagaccaacgtcttggggctaatgtgggatccgctcaagggcctactggtttaggtaaatatctaatgcgttcccctactggagaagtcatttttgggggagaaactatgcgtttttgggatctgcgtgctccatggttagaacctctaaggggtcccaacggtttagacttgagtaggttgaaaaaggacatacaaccttggcaagaacgacgttctgcggaatatatgactcatgctcctttaggttctttaaattctgtgggtggagtagctaccgagatcaatgcagttaattatgtctctccgagaacttggttatctacttctcattttgttctaggcttcttcttcttcgtaggtcacttatggcacgcgggaagagctcgtgcagctgcagcagggtttgaaaaaggaattgatcgtgattttgaacctgttctttcgatgactcctattaactgagacaggggatccaaggc

SEQ ID NO: 4315 - DNA, 1841 bp, Oryza sativa
atgaaaatcttatattccctgaggaggttctaccacgtggaaacgctctttaatggaacttttgttttagctggtcgtgaccaagaaaccaccggttttgcttggtgggccgggaatgccagacttatcaatttgtcgggtaaactacttggagctcacgtagcccatgcaggattaatcgtattctgggccggagcaatgaacctatttgaagtggcccatttcgtaccagaaaaacccatgtatgaacaagggttgattttacttccgcacttagctactctaggttggggagtagggcccgggggagaagttctagatacttttccgtactttgtatctggagtacttcatctaatttcctccgcagtcttaggcttcggtggcatttatcacgcgcttctgggaccggagactcttgaagaatcttttccattctttggttatgtgtggaaagatagaaataaaatgactacaattttgggtattcacctaattttgttaggtataggtgcttttcttctagtactcaaagctctttattttggcggtatatatgatacctgggctcctgggggaggagatgtaagaaaaattaccaatttgacccttagccccggtgttatatttggttatttactaaaatccccttttgggggagagggttggattgttagtgtggatgatttagaagatataattgggggacatgtatggttgggtttcatttgtgtatttggcggaatttggcatatcttaaccaaacccttcgcatgggctcgccgtgcatttgtatggtctggagaagcttacttgtcttatagtttaggcgctttatctgtctttggttttatcgcttgttgttttgtctggttcaataatacagcttatccgagtgagttttatggacctactgggccagaagcttctcaagctcaagcatttacttttctagttagagatcagcgtcttggagctaatgtgggatctgcccaaggacccacaggtttaggtaaatatctaatgcgttccccaacgggagaggttatttttggaggggaaactatgcgtttttgggaccttcgtgctccatggttagaacctctaaggggccccaacggtttggacttgagtaggttgaaaaaagacatacaaccttggcaagaacgacgttcggcagaatatatgacccatgctcctttaggctctttaaattctgtgggtggcgtagctaccgagatcaatgcagttaattatgtttctcctagaagttggttagcgacttcccattttgttctaggattcttcttttttgtgggccatttgtggcatgcaggaagagcccgggctgctgcagcaggatttgaaaagggaatcgatcgtgatttggagcctgttctttacatgacccctcttaactaagattttcttatttatacctgttctactgtttttttctgttctggctcggttattctatctagccgagccattcattcctttctatgaaagaaagataaggggacagaacaaaaaaaacaaataaagaaacaaacgtattcaatacgcaaaaaaaaaaagaaaaaaaaaggagagagagggattcgaaccctcgatagttcctagaactataccggttttcaagaccggagctatcaaccactcagctatctctccacagcctaatccttattttattcctacaaatagaacatagccatacgaaatgactcactaacctctagaaacatctcaaatacaaatcccttttcgatatatttctgtatactgtatccatgtatacaggatccgctatatccgcttgtgaaataaagcataaa

SEQ ID NO: 4316 - DNA, 1925 bp, Sorghum bicolor
atgaaaatcttatattccctgaggaggttctaccacgtggaaacgctctttaatggaactttcgttttagctggtcgtgaccaagaaaccaccggctttgcttggtgggctgggaatgccagacttatcaatttgtccggtaaactacttggagctcatgtagcccatgccggattaatcgtattctgggccggagcaatgaacctatttgaagtggcccatttcgtaccagaaaagcccatgtatgaacaagggttgattttacttccgcacttagctactctaggttggggagtagggccggggggagaagttctagatacttttccttactttgtatccggagtacttcacttaatttcctccgcagtcttaggcttcggtggcatttatcacgcgcttctgggacccgagactcttgaagaatcttttccattctttggttatgtatggaaagatagaaataaaatgactacaattttgggtattcacttaattttgttaggtctaggtgcttttcttctagtactcaaggctctttattttggcggcgtatatgatacctgggcccccggggggggggatgtaagaaaaattaccaatttgacccttagccccggtgttatatttggttatttactaaaatccccttttgggggagaaggatggattgttagtgtggatgatttagaagatataattggggggcatgtatggttgggttccatttgtgtacttggcggaatttggcatatcttaaccaaaccctttgcatgggctcgccgtgcatttgtatggtctggcgaagcttacttgtcttatagtttaggtgctttatctgtttttggttttatcgcttgttgttttgtctggttcaataatacggcttatccaagtgagttttacgggcccactggaccagaagcttctcaagctcaagcatttacttttctagttagagaccagcgtcttggagctaatgtagggtctgcccaaggaccgacgggtttaggtaaatatctaatgcgttccccaacgggagaggttatttttggaggggaaactatgcgtttttgggatcttcgtgctccgtggttagaacctctaaggggccccaacggtttggacttgagtaggttgaaaaaagatatccaaccttggcaagaacgacgttcagcagaatatatgacccatgctcctttaggctctttaaattccgtgggtggcgtagctaccgagatcaatgcagttaattatgtctctcctagaagttggttagcgacctcccattttgttctaggattcttcttttttgtgggccatttgtggcatgcaggaagagcccgagctgctgcagcaggctttgaaaagggaattgatcgtgatttggaacctgttctttacatgacccctcttaactaagattttttatttatacctgttctagtttttttctgttctggctcggttattccatctagccgagccattcatgcttttttatgaaagaatgatataagggggctgaacaaagaaaaacatagatagaaagaaacaaatgtattcaatatacaaaaggagagagagggattcgaaccctcgatagttcctagaactataccggttttcaagaccggagctatcaaccactcagccatctctccacagcccaatccctattttattcctacaaatagaacatagctatatgaaatgatctactaactcatctcagatgcaagtccactttcaatatatctctgtatactgtatacacggatacagaatccgctatatccgtttgtgaaataaaggctaaatcccctcccctcaactccatatccaaataaaagcggtaaggaaaaagttttaataaaaagaagaatcaatggattcatgattaaacccctcctacttcttgtatt

SEQ ID NO: 4317 - DNA, 2055 bp, Panicum virgatum
atgaaaatcttatattccctgaggaggttctaccacgtggaaacgctctttaatggaactttcgttttagctggtcgtgaccaagaaaccaccggctttgcttggtgggctgggaatgccagacttatcaatttgtccggtaaactacttggagctcatgtagcccatgccggattaatcgtattctgggccggagcaatgaacctatttgaagtggcccatttcgtaccagaaaagcccatgtatgaacaagggttgattttacttccgcacttagctactctgggttggggagtagggccggggggagaagttctagatacttttccttactttgtatccggagtacttcacctaatttcctccgcagtcttaggcttcggtggcatttatcacgcgcttctgggacccgagactcttgaagaatcttttccattctttggttatgtatggaaagatagaaataaaatgactacaattttgggtattcacttaattttgttaggtctaggtgcttttcttctagtactcaaggctctttattttggcggcgtatatgatacctgggcccccgggggaggggatgtaagaaaaattactaatttgacccttagccccggtgttatatttggttatttactaaaatccccttttgggggagaaggatggattgttagtgtggatgatttagaagatataattgggggacatgtatggttgggttccatttgtgtacttggcggaatttggcatatcttaaccaagccctttgcatgggctcgccgtgcgtttgtatggtctggcgaagcttacttgtcttatagtttaggtgctttatctgtttttggttttatcgcttgttgttttgtctggttcaataataccgcttatccaagtgagttttacggacccactgggccagaagcttctcaagctcaagcatttacttttctagttagagaccagcgtcttggagctaatgtagggtctgcccaaggaccgacaggtttaggtaaatatctaatgcgttccccaacgggagaggtcatttttggaggggaaactatgcgtttttgggaccttcgtgctccgtggttagaacctctaaggggccccaacggtttggacttgagtaggttgaaaaaagacatccaaccttggcaagaacgacgttcggcagaatatatgacccatgctcctttaggctctttaaattctgtgggtggcgtagctaccgagatcaatgcagttaattatgtctctcctagaagttggttagcgacttcccattttgttctaggattcttcttttttgtgggccatttgtggcatgcaggaagagcccgagctgctgcagcaggctttgaaaagggaattgatcgtgatttggaacctgttctttacatgacccctcttaactaagatttttttatttctacctgttccactttttttctgttctggctcggttattccatctagccgagccattcatgcttttttatgaaagaatgatataagggggcagaacaaagaaaaacatagaaagaaacaaatgtattcaataaacaaaaggagagagagggattcgaaccctcgatagttcctagaactataccggttttcaagaccggggctatcaaccactcagccatctctccacagcccaatccctattttattcctacaaatagaacatagctatatgaaatgatctactaactcctagaaacatctcagatgcaagtccactttcgatatatctctgtatactgtatacacggatacagaatccgctatatccgtttgtgaaataaacgctaaatcccctcaactctatatccaaataaaagcggtaaggaaaaagttttaaagaaaagaatcaatggattcatgattaaacccctcctacttcttgtattttcgtacatatttttgattaagtgaggggatcaaatagaaaacatgcagcccaacttttttttgaaatgtttttttggagtatttggaattttgactatggcgcccccacctcacctggtatttgttttaatt

SEQ ID NO: 4318 - DNA, 2640 bp, Saccharum officinarum
atgactatagccgttggtagagttactaaagaagaaaacgatctatttgatattatggacgactggttacgaagggaccgtttcgtttttgtaggatggtccggcttattgctctttccttgtgcttatttcgctttagggggttggtttacagggactacttttgtaacttcttggtatacccatggattggctagttcctatttggaaggttgcaatttcttaaccgcggcggtttccacacctgccaatagtttagcacactctttgttgctactatggggaccggaagcacagggggattttactcgttggtgtcaattaggtggtctttggacttttgtcgctctccatggagcttttgcactaataggtttcatgctacgtcaatttgaacttgctcggtctgttcaattgcggccttataatgcaatttcattctctggtccaatcgctgtttttgtttccgtattccttatttatccactgggacaatctggttggttctttgcgccgagttttggcgtagcagctatatttcggttcatccttttcttccaaggatttcataattggacgttgaacccatttcatatgatgggagttgccggagtattaggcgcagctctgctatgcgctatccacggggctaccgtagaaaacactctattcgaagatggcgatggtgcaaataccttccgtgcttttaacccaactcaagctgaagaaacttattcaatggtcactgctaaccgcttttggtcccaaatctttggtgttgctttttccaataaacgttggttacatttctttatgctatttgtacccgtcaccggtttatggatgagtgctattggcgtagttggtctggctctgaacctacgtgcctatgacttcgtttcccaggaaatccgtgcagcggaagatcctgaatttgagactttctacaccaaaaatattcttttaaatgagggtattcgtgcgtggatggcagctcaggatcagcctcatgaaaatcttatattccctgaggaggttctaccacgtggaaacgctctttaatggaactttcgttttagctggtcgtgaccaagaaaccaccggctttgcttggtgggctgggaatgccagacttatcaatttgtccggtaaactacttggagctcatgtagcccatgccggattaatcgtattctgggccggagcaatgaacctatttgaagtggcccatttcgtaccagaaaagcccatgtatgaacaagggttgattttacttccgcacttagctactctaggttggggagtagggccggggggagaagttctagatacttttccttactttgtatccggagtacttcacttaatttcctccgcagtcttaggcttcggtggcatttatcacgcgcttctgggacccgagactcttgaagaatcttttccattctttggttatgtatggaaagatagaaataaaatgactacaattttgggtattcacttaattttgttaggtctaggtgcttttcttctagtactcaaggctctttattttggcggcgtatatgatacctgggcccccggggggggggatgtaagaaaaattaccaatttgacccttagccccggtgttatatttggttatttactaaaatccccttttgggggagaaggatggattgttagtgtggatgatttagaagatataattgggggacatgtatggttgggttccatttgtgtacttggcggaatttggcatatcttaaccaaaccctttgcatgggctcgccgtgcatttgtatggtctggcgaagcttacttgtcttatagtttagctgctttatctgtttttggttttatcgcttgttgttttgtctggttcaataatacggcttatccaagtgagttttacgggcccactggaccagaagcttctcaagctcaagcatttacttttctagttagagaccagcgtcttggagctaatgtagggtctgcccaaggaccgacgggtttaggtaaatatctaatgcgttccccaacgggagaggttatttttggaggggaaactatgcgtttttgggatcttcgtgctccgtggttagaacctctaaggggccccaacggtttggacttgagtaggttgaaaaaagacatccaaccttggcaagaacgacgttcagcagaatatatgacccatgctcctttaggctctttaaattccgtgggtggcgtagctaccgagatcaatgcagttaattatgtctctcctagaagttggttagcgacctcccattttgttctaggattcttcttttttgtgggccatttgtggcatgcaggaagagcccgagctgctgcagcaggctttgaaaagggaattgatcgtgatttggaacctgttctttacatgacccctcttaactaagattttttatttatacctgttctagtttttttctgttctggctcggttattccatctagccgagccattcatgcttttttatgaaagaatgatataagggggctgaacacagaaaaacataggtggaaagaaacaaatgtcttcaatatacaaaaggagagagagggattccaaccctcgatagttcctagaactataccgggtgtcaa

SEQ ID NO: 4319 - DNA, 13722 bp, Oryza sativa
cagtcctgcacttctgctatcatacctttttcgtgtatacgaaatagtggatttgattaacccaattcttaggaaatcgcgaatcagaccatttgctcttatctcaacaagggaagcacgagcctcctctttttcttcttgttcccaattcaatactaagcaagttcgaacgaattgactattcgtatgataaattctttgagttaacttgctattttcatgagaaataaaattgacaagtcgaagttggagattaccctcttcctgcaagagatcctgtgggaaaagtgttgctaaatttttactataataaaccgaggtaaaaagatacaaattcttcctgttcccggtaagaaatatagtgaaatcgtctttcccattctttcccccgaccctgctatgaagaaagacgttcatttcttaaaatatcccatatatgtggggggaaaccgaggaaggggacagatctatcctgatggtagcaagagtaacaatacggtctataatgcaacgtcaacaggtgtagtaagaaaaatactgcgtaaagaaaaggggggatatgaaatatccatagtcgatgcatcggatggacgccaagtgattgatcttatacctcccggtccagaacttcttgtttcagagggggaatcgatcaagcttgatcaaccattaacaagtaatcctaatgtgggagggtttggtcagggggatgcagaaatagtgcttcaggatccattacgcgttcaaggccttttgttcttcttcgcatccgttattttggcacaagtttttttggttctcaaaaagaaacagtttgaaaaggttcaattgtacgaaatgaatttctaggtcccgggatttcttaccatcaagttggtaaaaagccgcgatttattggcgattgctagaattctctatgatccattttggaaatcttttttttgtttagactattttttgtttgcgagatgtcttgtctgcaattccttatttctatcatctcatgcaaaacgaggagaatgcaaggcaagggcgagaacaataaaaggaacaaatccttttaggagggattgctggtcttcttaatcctctattgggcacaagaaaaaggcttttttgcctttttcttgtgtcgattcttcttgtattgtatcgaaatatgaatcttttttcttcctattcggcaaagattactatttcttctttatttgggtctgtctcttgaacctcttttgcttaggttcaggcgatgtagtggacaaaaagagggaaagaaaatatggcgggggacaaattttttgtgaccaaatagaattgcttgacttgttcaattaagttcaatttagaacttacagaaattttgcaaaaaaaacggatactcttccattgaaggctgttttttatttttaggctagttgagtagttttaattaaggttttattagtttattactctaaattaaatcaatgatttacaagagacttcctccggggaataaaatattggatcctcgattgatcctttctttctcctcgcttcataaaagtgaattaatttcattggcgagggggttataaatcaactgatggattacttcactaacattattaacaaacaaaattaacaaacaaaacgaataaatagagggattctgaccatcagagcaaaggctttctctttgttatttttacaaatcaaaataggaaacccgtttgtaggttatggaatagattaaaaaagtcgggttataagagtaagaattccgcgggtcctttccgctctaatcagataaaagggggtaaggacccgctaagttcctattttttcatgtttacaacctggtccctccaattactatagagatgaacccaatccagaatatgaaccgtaaaagaaaacacctattaaaccaatcacagcaataccggttacagtacctatcagccaaagaggaattcttccagtagtatcggccatttcccctactttcctccacattttatcaagtggtcatgctagagacaaaaacagtcatggatagttataaggatggtatccttccaaatggggataagagaattcttactactctctttctttctctcaattgaagaagtaattggaaaataaaacagcaagtacaaaaatgagtaataaaccccagtatagactggtacgattcaattcaacattttgttcattcgggtttgattgtgtcatagttctatagttggaatttggtttatcgttggatgaactgcattgctgatattgattctaagaaaaaaacagtaggtacagctagtccgtgaacagccagccatcgcactgtaaaaataggataggttcgatctatggtcattgagggcctcctaaaaggatctactaaattcatcgagttgttctaaagaatcaaaacggtcggttattaacggaattccttgtcggctttctgtgaaatactcgtttggccgaggacttccaaacacgtcataagctaaacccgtactgacaaataaccaacccggaagagcgtttcagcacttttagctccggttcgtgaaggaccagagaagctttctagttatgaatcgggtatagaacccatggggggggcttggttacaattccgaatacgctattacatgtttgcgctagtttttgttgtttttgatgtggaaacggtctttctctacccttgggcaatgagtttcgacgtattgggtatatccgtttttatcgaagctttcattttcgtgcttatcctagttgttggtttagtttatgcatggcgaaaaggagccttggaatggtcttaactgaatattcagacaaaaaaaaaagaaggaaaagattccattaagacagttatgagtttgattgagtttcccctacttgaccaaacaagttccaattccgttatttcaactacactaaaagatctttcgaattggtcaagactctctagtttatggccccttctatatggtaccagttgttgtttcattgaatttgcttcattaataggctcacgattcgactttgatcgttatggattggtaccaagatcaagtcctaggcaagcggacctaattttaacagccggtacagtaacaatgaaaatggctccctctttagtgagattatatgagcaaatgcctgaaccaaaatacgtcattgctatgggagcttgtactattactggtggaatgttcagtacggattcctatagtactgttcggggagttgataagttaattcctgtggacgtctacttgccgggttgcccacctaaaccagaggctgttatagatgccctaacaaaacttcgtaagaagatatcgcgagaaatagttgaggatcgaactctatctcaaaagaaaaatcgatgttttactaccagccacaagctttatgttcggcgcagtactaatactggaacttatgagcaagaattgctctatcaatcaccatctactttagacatatcttctgaaacttttttcaaatccaaaagtccagtatcttcctacaaattagtgaattaggaggagctctttgtgccgaaaaagaaagagcagggcaatatttcaaacttgcattcgaactgcgaaatatttatacaaaggaggagagatcaagataatgcagcagggttggttatctaattggctagtcaaacatgaggtggttcatagatctttgggcttcgatcatcgaggaatagagactttgcaaataaaagcagaggattgggattccattgctgtcattttatatgtatatggttacaattatttacgttcccaatgtgcttatgacgttgcacccggtggatctttagctagcgtgtatcatcttacgagaatacagtatggtatagataacccagaagaagtatgcataaaagtctttgcccaaaaggataatcctagaatcccatctgtcttctggatttggagaagttccgattttcaagaacgcgaatcttttgatatggtgggaatctcttatgataatcatccacgccttaaacgtatcctaatgcctgaaagttggataggctggcccttacgtaaggactatataacccccaatttctatgaaatacaagatgctcattgaatgataagaaattcatgctcacttatacaacacaactccagattttatgcaagtcaaggaatatttttacgctctgttcctagatgaaacagaatacctattacattctaattaattccaattatacaaaaggttcagatagactaagcaaaaaagggcttcatttcgttggaaaatcacatattcatttccttcgtatgaacagaaaaatatgatgactcaaagaagttccctaccacgaactttgtaccgcgtgcattacttagaacaactaggaaagtaagataagataagcaagaataaaaaaatatttgtcggaatagcggaatagaaaattaagaaatgcaaaaatgcagaaaaagaagtgcctctatttagagatttatctacttagatgaaaaaatcatactctatctatattattaacgaatatgtatcccaacccatctcgaggtatttgtatcaatacctattcggaagatcccttttttctgtgccaggaaccagatttgaactggtgacacgaggattttcagtcctctgctctaccaactgagctatcctgaccttttcttgtgcatcatcctagtagagtatttgtatctatgtcaatatccaaaatttggaaatggggagggggcagtcctatgcattgtacaaagaaagcctatttaataatatttaaatatcgagttaataatcgacattccttgccgatactataataaaaaagaaatgtattccattgaatcttaaacctattaataaaaaaaacaggataaatactagagttagggaataaaagagggtttggggatagagggacttgaaccctcacgacttagaaagtcgacggattttccttttactagaaatttcattgttgtcagtattgacatgtagaatgggactctctctttatcctcgtccgattaatccgcttttaaaaagatttcgaaaactatgaattgaaggatttgattactcaatattcgattggaatggattcacaacaattctaaaaaaattatgaattttctatttcataatcattcctattttcattttaaaaaagaattaaagaacctatattatgatatgagttctgtgattaatcgtttgctatgccagtatctatacgtgtgtattagatttcgaaagcccttctttccctaatttagaagggagttccgctagcaacacaacgtaattaactcgattcgttagaacagcttccattgagtctctgcacctatccttttcctttgggttctagttcgagaaccgcttgttttctcaaaacatggatttggctcaggattgccccttttttaattccagggtttctctgaatttggaagttgccacttagcaggtttccataccaaggctcaatacaatcaagtccgtagcgtctaccgatttcgccatatccccattttctttttctttgagaccaggattccttgtgcaatttcctccatctgttagttttttttgaatcgttgaattcattactctatgtagtctagcggttcgtctctagttgagagactccgcttattgcaattcagcattgaattgattctatcgttgatgtatttgcaattcaatgcgaatcaatatatcccaaggtttttctctcccccacctaccgcgttccttttttagagtattcaaaatcatactataacgcttgatattcattctttttttttgctaatcagaattagcaatttcatttgctatgattctatgttctccttagtgaaatattaatcattaaattattagcaaataacaaaaaaaacaaaatatctcaaaaaatgtctataatgatggactgaaaatacaagaaattcgcatgttctctttattatgttttcgtatatatattatttattcttttccatgtattagattattcgtccgagccatatcaaattaaaaatatctaaaatcaaattcaatatagaaattggaatagattctattagaaaaatagatttgcgaattagagaaaaaagaaagttcaaaaaaatctatctaactttattttatgaagttctagtatttttttctaagtagaacttccaatttcgaactagttaatagctaagattaataattaagatctgacattttacggatttcctatactatacatatttctatttgttacactatttctgttatgtaagcccacttagctcagaggttagagcatcgcatttgtaatgcgagggtcatcggttcaaatccgatagtcggcttttttctctatcaatgttccatgaacaaaaatacctctttttctccgaattaaatggagaagccaggatctattatgtcgttctaccctacaattttgctagatacaaaacaataaaataaataatatatatacaaattttttgtggtacttttagtagattttactctgtttatcctttactttaattcagttttaatttcgatgtattctgtaatgtaaatacaatgaaattaattgtgtaaaatgaaatttcaataaaaaaaggagtcttcatgtcccgttatcgaggacctcgttttaaaaaaatacgccgtctgggagctttaccaggactcactagaaaaacacctaaatccggaagtaatctgaaaaagcttaacatggtggttaaccgtattatgaaagacggaaaaaaaatcattggcttatcaaattctctatcgagccgtgaaaaagattcaacaaaagacagaaacaaatccactattggttttacgtcaagcaatacgtagagtaactcccaatataggagtaaaaacaagacgtaataaaaaaggatcgacgcggaaagttccgattgaaataggatctaaacaaggaagagcacttgccattcgttggttattagaagcatcccaaaagcgtccgggtcgaaatatggctttcaaattaagttccgaattagtagatgctgccaaagggggtgggggtgccatacgcaaaaaggaagcgactcatagaatggcagaggcaaatagagctcttgcacattttcgttaatccatgaacagaatctaggtatgtagacacatggatccatacatctcgatcggaaaagaatcaatagaaggagaatcggacgatatctttctcgaaacaaacaaaaaggaaaagaaagagaaaacagaaatcatgatcaactaagccctctcgggggcttgcttaagaataagaaagaggaatcttatggaaatagcatggaataaggtttgatcctattcatggggattccgtaaatatcccattccaaaaatcgaaacaatcgggacttttcggagattggatgcagttactaattcatgatctggcatgtacagaatgaaaacttcattctcgattctacgagaatttttatgaaagcgtttcatttgcttctcttccagggaagtttcattttcccagaatgtatcctaatttttggcctaattcttcttctgatgatcgatttaacctctgatcaaaaagatagaccttggttctatttcatctcttcaacaagtttagtaataagcataacggccctattgttccgatggagagaagaacctataattagcttttcgggaaatttccaaacgaacaatttcaacgaaatctttcaatttcttattttattatgttcaactttatgtattcctctatccgtagagtacattgaatgtacagaaatggctataacagagtttctgttattcgtattaacagctactctagggggaatgtttttatgtggtgctaacgatttaataactatctttgtagctctagaatgtttcagtttatgttcctacctattgtctggatataccaagagagatctacggtctaatgaggctactatgaaatatttactcatgggtggggcaagctcttctattctggtttatggtttctcttggctatatggtttatctgggggggagatcgagcttcaagaaattgtgaacggtcttatcaatacacaaatgtataactccctaggaatttcaattgcgcttatatccatcactgtaggacttgggttcaagctttccccagccccttttcatcaatggactcctgacgtctacgaaggagtgtggttcgttcgacaaattcctacctctatatctatctctgaggtgtttgggttttgcaaaactccatagatatgcagaagagaaatgctatccccactccgaccaagacagaacttttaccaaaagtttattgtgatctttttgttcaaataacaattaaggtgaagcagggtcaggaacaacgaatctctttatgataaacagatccattttgcaagctcgttattacgggtagttcctacaaagaatcggactaatgacatatacaatgcttgaattatcgacgtagatgctacatagtgggttctcatccttcagagactacgagtgtaataggagcatccgttgacaaaaggatcaccctaagatgatcatctcatggctattgggaacgaatcaaatcagatggttctatttctcaacctttctgacttgctcctacggaaccaaggtcgaaaggattgaaaaagtcagtcattcacaaccactgatgaaggattcctcgaaaagttaaggattagtagttctttttcgaaatcgatttcgaaaaagaatggattcggtcttatacatacgcgaggaaggtaatcaaaaaagaaagaagacaagttcttctttcttttatcacttaggagccgtgcgagatgaaagtctcatgcacggttttgcatgagagaaagaagcgaggaatcctcttttcgactctgactcccccactccagtcgttgcttttctttctgttacttcgaaagttgctgcttcagcttcagccacgcgaattctcgatattcctttttatttctcatcaaacgaatggcatcttcttctggaaatcctagctattcttagcatgatattggggaatctccttgctattactcaaacaagcatgaaacgtatgcttgcatattcgtccatagggcaaatcggatagcattaatagttgagtctgaaatgaattttctcaatgtatttcatttacacaaaattacttaacattaaagacactgttttacctactccagctcccccaaatagtccgatttttcctccacgccgataaggagctaaaagatcgaccaccttaataccagtttcaaagatggataatttcgtatctaactcgataaaggcgggcgcggatctatgaatagggaatgttgcactagtatctacaggacccaaattgtcaacaggctccccaagaacgttgaaaattcgtccaagagtagctccaccgacaggaacactgagaggagctcccgtgtcaatcacttccattcctctcatcaacccatctgtagcactcatagctacagctctaactcgattatttcctaattggatattggctaaaagacaatcagatagattttctcttcagcaggcatttccatataggacttgttataataaaacaagcaggttatagaaaaaaactcttttttttattatttatcaacaaagcaaaaaggggtcttatcaaaccaacccaccccataaaattggaaagaaagataaagtaagtggacctgactccttgaatgaggcctctatccgctattctgatatataaattcgatgtagatgaaattgtataagtggatttttttgtatttccttagacttagaccacgcaaggcaagaatttctcgctatttactatttcatattcttgttactagatgttctataggaataagaagaaatcgcaacccctttccgctacacataaaaatggatttcgaaagtcaatttttcttttcaatatctttagtttttttcagaatcctatttttgttcttatacccatgcaatagagagcgagtgggaaaagggaggttactttttttcatttttcccttaaaaaataggctttcttggaaataggaatcatggaataatcctgaattccaatgtttatttctatagtataagaaaaactaattgaatcaaattcatggatttaccacgacctcggctgtgaccccatagataaaaatgcaaaatttctatcttcgagaccattgaaaaaaggcattgaacgagaaaaaatcgtccacagataatctatcgtatgccttggaagtgatataaggtgctcggaaatggttgaagtaattgaataggaggatcactatgactatagcccttggtagagttactaaagaagaaaatgatttatttgatattatggacgactggttacgaagggaccgttttgtttttgtaggatggtctggcctattgctttttccttgtgcttatttcgctttaggaggttggtttacagggacaacttttgtaacttcttggtatacccatggattggcgagttcctatttggaaggttgcaatttcttaaccgcagcagtttccacccctgccaatagtttagcacactctttgttgctactatggggcccggaagcacaaggggattttactcgttggtgtcaattaggtggtctgtggacttttgttgctctccatggggcttttgcactaataggtttcatgttacgtcaatttgaacttgctcggtctgttcaattgcggccttataatgcaatttcattctctggcccaatcgctgtttttgtttccgtattcctgatttatccactggggcaatccggttggttctttgcgccgagttttggcgtagcagcgatatttcgattcatcctcttcttccaaggatttcataattggacgttgaacccatttcatatgatgggagttgccggagtattaggcgcggctctgctatgcgctattcatggggcaaccgtggaaaacactctatttgaggacggtgatggtgcaaataccttccgcgcttttaacccaactcaagctgaagaaacttattcaatggtcaccgctaatcgcttttggtcccaaatctttggtgttgctttttccaataaacgttggttacatttctttatgctatttgtaccggtcaccggtttatggatgagtgctattggcgtagtcggcctggctctgaacctacgtgcctatgacttcgtttcccaggaaatccgtgcagcggaagatcctgaatttgagactttctacaccaaaaatattcttttaaacgagggtattcgtgcgtggatggcagctcaggatcagcctcatgaaaatcttatattccctgaggaggttctaccacgtggaaacgctctttaatggaacttttgttttagctggtcgtgaccaagaaaccaccggttttgcttggtgggccgggaatgccagacttatcaatttgtcgggtaaactacttggagctcacgtagcccatgcaggattaatcgtattctgggccggagcaatgaacctatttgaagtggcccatttcgtaccagaaaaacccatgtatgaacaagggttgattttacttccgcacttagctactctaggttggggagtagggcccgggggagaagttctagatacttttccgtactttgtatctggagtacttcatctaatttcctccgcagtcttaggcttcggtggcatttatcacgcgcttctgggaccggagactcttgaagaatcttttccattctttggttatgtgtggaaagatagaaataaaatgactacaattttgggtattcacctaattttgttaggtataggtgcttttcttctagtactcaaagctctttattttggcggtatatatgatacctgggctcctgggggaggagatgtaagaaaaattaccaatttgacccttagccccggtgttatatttggttatttactaaaatccccttttgggggagagggttggattgttagtgtggatgatttagaagatataattgggggacatgtatggttgggtttcatttgtgtatttggcggaatttggcatatcttaaccaaacccttcgcatgggctcgccgtgcatttgtatggtctggagaagcttacttgtcttatagtttaggcgctttatctgtctttggttttatcgcttgttgttttgtctggttcaataatacagcttatccgagtgagtgagttttatggacctactgggccagaagcttctcaagctcaagcatttacttttctagttagagatcagcgtcttggagctaatgtgggatctgcccaaggacccacaggtttaggtaaatatctaatgcgttccccaacgggagaggttatttttggaggggaaactatgcgtttttgggaccttcgtgctccatggttagaacctctaaggggccccaacggtttggacttgagtaggttgaaaaaagacatacaaccttggcaagaacgacgttcggcagaatatatgacccatgctcctttaggctctttaaattctgtgggtggcgtagctaccgagatcaatgcagttaattatgtttctcctagaagttggttagcgacttcccattttgttctaggattcttcttttttgtgggccatttgtggcatgcaggaagagcccgggctgctgcagcaggatttgaaaagggaatcgatcgtgatttggagcctgttctttacatgacccctcttaactaagattttcttatttatacctgttctactgtttttttctgttctggctcggttattctatctagccgagccattcattcctttctatgaaagaaagataaggggacagaacaaaaaaaacaaataaagaaacaaacgtattcaatacgcaaaagaaaagagagaggaaagcaaaaggagagagagggattcgaaccctcgatagttcctagaactataccggttttcaagaccggagctatcaaccactcagccatctctccacagcctaatccttattttattcctacaaatagaacatagccatacgaaatgactcactaacctctagaaacatctcaaatacaaatcccttttcgatatatttctgtatactgtatccatgtatacaggatccgctatatccgcttgtgaaataaagcataaaaccccctcaaccccatatccaaataaaaaaagtggtgagtaataagttttaaagagaagaatcaatggattcatgattaaacccctcctacttcttgtattttattacaattttgattaagtgagggatcaaatataatatgtagtcaactttatttgatggtaacttggaggattagaaatatgactattgctttccaattagctgtttttgcattaattgtgacttcctcagtcttagtcattagtgtaccccttgtatttgcttctcctgatggttggtcaaacaataaaaacgttgtattttccggtacatcattatggattggactggtctttctggtagctattctaaattctctcatttcttaaatgtgtttagtatttagtagcccgatacaaaataaaaaagggccgtttattcggattgtgagacgcattaaaatgcaatttgcgccccgaattg

SEQ ID NO: 4320 - DNA, 1434 bp, Chenopodium quinoa
tgaaagaacaggttcaaaatcacgatcaattcctttttcaaatcctgctgcagctgcacgagcccttcccgcatgccacaaatgacctacgaattggaaaaatcctaaaacaaaatgagaagtagctaaccaacttctaggagagacataattgactgcattgatctcggtagccaccccacccacagaatttaaagaacctaaaggagcatgggtcatatattctgcggaacggcgttcttgccaaggttgtatgtcttttttcagccgactcaagtccaaaccatttggacctcttaggggttctaaccagggagcgcgcaaatcccaaaaccgcatagtttctcccccaaaaataacttctccagtcggagaacgcattagatacttacctaaaccagtaggtccttgagcggatcccacgttagccccaagacgttggtctctaactaaaaaagtaaatgcttgagcttgagaagcttctggtccagtaggtccgtaaaactcactaggataagcagtattattgaaccagacaaagcaacaagcaatgaaaccaaagacagataaagcagccaaactataagacaaataagcctctccagaccagacaagtgcgcggcgagcccatgcaaaaggtttagttaagatatgccagattccaccaagtatacaaatgaaacctatccatacatgccccccgattatatcttccaaatcgtccacactaacaatccacccttctcctccaaaaggcgattttagtaaataaccaaagataatactcggactaagggtgacgttggtaatttttctttacatctccgcctcctggagcccaggtatcatatacgcccccaaactaaagagccttgaacactagaagaaaggcgcctatacctaacaagattaagtgaatgcccaaaattgtggtcattttatttctatctttccacacataaccgaagaatggaaaagattcttcaagagtttcagggcccagaagtgcatgataaatacccccaaagcccaatacggccgacgaaattaagtgaaggactcctgatacaaagtatggaaaagtgtctataacttccccgccggggcctaccccccaacctagagtagctaggtggggaagtaaaattaatccttgttcatacatcggcttctctggtacgaaatgagccacttcaaacaggttcattgctccggcccagaatacgattaatccggcatgggctacatgagctccaagtagtttaccagataaattgataagtcgagcattcccggcccaccaagcgaaaccggtggtttcttggtcacgtccggctatagttaaagttccattaaagagcgtttccacggggtagaacctcctcagggaatataaggttttcatgaggctgatcttgagccgccatccaagca

SEQ ID NO: 4321 - DNA, 2412 bp, Chenopodium quinoa
caattgatttataccttaaaacgttgaatttcttgtctcaattaaggggggtcattgaaagaacaggttcaaaatcacgatcaattcctttttcaaatcctgctgcagctgcacgagcccttcccgcatgccacaaatgacctacgaataggaaaaatcctaaaacaaaatgagaagtagctaaccaacttctaggagagacataattgactgcattgatctcggtagccaccccacccacagaatttaaagaacctaaaggagcatgggtcatatattctgcggaacggcgttcttgccaaggttgtatgtcttttttcagccgactcaagtccaaaccatttggacctcttaggggttctaaccagggagcgcgcaaatcccaaaaccgcatagtttctcccccaaaaataacttctccagtcggagaacgcattagatacttacctaaaccagtaggtccttgagcggatcccacgttacgccccaagacgttggtctactaaactaaaaagtaatgacttgagcttgagaagcttctggtccagtaaggtaccgtaaaactcactaggataagcagtattattgaaccagacaaagcaacaagcaatgaaaccaaagacagataaagcagccaaactataagacaaataagcctctccagaccagacaagtgcgcggcgagcccatgcaaaaggtttagttaagatatgccagattccaccaagtatacaaatgaaacctatccatacatgccccccgattatatcttccaaatcgtccacactaacaatccacccttctcctccaaaaggcgattttagtaaataaccaaagataatactcggactaagggtgacgttggtaatttttcttacatctccgcctcctggagcccaggtatcatatacgcccccaaaataaagagccttgaacactagaagaaaggcgcctatacctaacaagattaagtgaatgcccaaaattgtggtcattttatttctatctttccacacataaccgaagaatggaaaagattcttcaagagtttcagggcccagaagtgcatgataaatacccccaaagcccaatacggccgacgaaattaagtgaaggactcctgatacaaagtatggaaaagtgtactataacttccccgccggggcctacccccaacctagagtagctaggtggggaagtaaaattaatccttgttcatacatcggcttctctggtacgaaatgagccacttcaaacaggttcattgctccggcccagaatacgattaatccggcatgggctacatgagctccaagtagtttaccagataaattgataagtcgagcattcccggcccaccaagcgaaaccggtggtttcttggtcacgtccggctatagttaaagttccattaaagagcgtttccacggggtagaacctcctcagggaatataaggttttcatgaggctgatcttgagccgccatccaagcacgaataccttcgtttaagagaatatttttggtgtagaaagtttcaaattcaggatcttccgctgcacggatttcctgggaacgaagtcataggcacgtaggttcaaagccagaccgactactccaagagcactcatacataacggtactgtacaataacataagaatgtaaccaacgttattggaaaaagcaacccaaaatttgggaccaaagcggttagcggtgaccattgaataagtttcttcggcttgggttgggttaaaagcccggaatgtatttgccccatcaccgtcttcaaataaagtattttctacggtagcgccatgaatagcgcatagtagagcggcgcccaatacaccggcaactcccatcatatgaaatggattcagtgtccaattatgaaacccttgaaaaaagagaatgaatcgaaatatagctgctacaccaaaactaggtgcaaagaaccaaccagactgacctagtggataaattaggaatacagaaacaaaaacaagcaattggaccagagaatgcgattgcattataagggcgcaattgaacggatcgagcaagctcgaattgacgtaacataaaacctattagtgcgaaagcaccatgaagagcaacaaaagtccacaggccgcctaattgacaccaacgagtaaagtctccttgtgcttcaggaccccacagtaacaataaagagtgggctaaactattagcaggagtagaaactgccgcggttaagaaattgcaaccttccaaataagaactggccaatccatgggtataccatgaagttacaaaggttgtacctgtaaaccaacctcctaaggcgaaataagcacaaggaaagagcaatagcccagaccaacctacaaaaacgaaacggtccctccgtaaccagtcatccatactat

SEQ ID NO: 4322 - DNA, 3955 bp, Oryza sativa
tatatccgcctgggtcgaccgtctatgtctgggtcgaccgtttcattttctatttgagttttctttttattaatttaattgtctgtcaatcaattcggggcacaaattgcattttaatgcgtctcacaatccgaataaacggcccttttttattttgtatcgggctactaaatactaaacacatttaagaaatgagagaatttagaatagctaccagaaagaccagtccaatccataatgatgtaccggaaaatacaacgtttttattgtttgaccaaccatcaggagaagcaaatacaaggggtacactaatgactaagactgaggaagtcacaattaatgcaaaaacagctaattggaaagcaatagtcatatttctaatcctccaagttaccatcaaataaagttgactacatattatatttgatccctcacttaatcaaaattgtaataaaatacaagaagtaggaggggtttaatcatgaatccattgattcttctctttaaaacttattactcaccactttttttatttggatatggggttgagggggttttatgctttatttcacaagcggatatagcggatcctgtatacatggatacagtatacagaaatatatcgaaaagggatttgtatttgagatgtttctagaggttagtgagtcatttcgtatggctatgttctatttgtaggaataaaataaggattaggctgtggagagatggctgagtggttgatagctccggtcttgaaaaccggtatagttctaggaactatcgagggttcgaatccctctctctccttttgctttcctctctcttttcttttgcgtattgaatacgtttgtttctttatttgtttttttttgttctgtccccttatctttctttcatagaaaggaatgaatggctcggctagatagaataaccgagccagaacagaaaaaaacagtagaacaggtataaataagaaaatcttagttaagaggggtcatgtaaagaacaggctccaaatcacgatcgattcccttttcaaatcctgctgcagcagcccgggctcttcctgcatgccacaaatggcccacaaaaaagaagaatcctagaacaaaatgggaagtcgctaaccaacttctaggagaaacataattaactgcattgatctcggtagctacgccacccacagaatttaaagagcctaaaggagcatgggtcatatattctgccgaacgtcgttcttgccaaggttgtatgtcttttttcaacctactcaagtccaaaccgttggggccccttagaggttctaaccatggagcacgaaggtcccaaaaatgcatagtttcccctccaaaaataacctctcccgttggggaacgcattagatatttacctaaacctgtgggtccttgggcagatcccacattagctccaagacgctgatctctaactagaaaagtaaatgcttgagcttgagaagcttctggcccagtaggtccataaaactcactcggataagctgtattattgaaccagacaaaacaacaagcgataaaaccaaagacagataaagcgcctaaactataagacaagtaagcttctccagaccatacaaatgcacggcgagcccatgcgaagggtttggttaagatatgccaaattccgccaaatacacaaatgaaacccaaccatacatgtcccccaattatatcttctaaatcatccacactaacaatccaaccctctcccccaaaaggggattttagtaaataaccaaatataacaccggggctaagggtcaaattggtaatttttcttacatctcctcccccaggagcccaggtatcatatataccgccaaaataaagagctttgagtactagaagaaaagcacctatacctaacaaaattaggtgaatacccaaaattgtagtcattttatttctatctttccacacataaccaaagaatggaaaagattcttcaagagtctccggtcccagaagcgcgtgataaatgccaccgaagcctaagactgcggaggaaattagatgaagtactccagatacaaagtacggaaaagtatctagaacttctcccccgggccctactccccaacctagagtagctaagtgcggaagtaaaatcaacccttgttcatacatgggtttttctggtacgaaatgggccacttcaaataggttcattgctccggcccagaatacgattaatcctgcatgggctacgtgagctccaagtagtttacccgacaaattgataagtctggcattcccggcccaccaagcaaaaccggtggtttcttggtcacgaccagctaaaacaaaagttccattaaagagcgtttccacgtggtagaacctcctcagggaatataagattttcatgaggctgatcctgagctgccatccacgcacgaataccctcgtttaaaagaatatttttggtgtagaaagtctcaaattcaggatcttccgctgcacggatttcctgggaaacgaagtcataggcacgtaggttcagagccaggccgactacgccaatagcactcatccataaaccggtgaccggtacaaatagcataaagaaatgtaaccaacgtttattggaaaaagcaacaccaaagatttgggaccaaaagcgattagcggtgaccattgaataagtttcttcagcttgagttgggttaaaagcacggaaggtatttgcaccatcaccgtcctcaaatagagtgttttccacggttgccccaagaatagcgcatagcagagccgcgcctaatactccggcaactcccatcatatgaaatgggttcaacgtccaattatgaaatccttggaagaagaggatgaatcgaaatatcgctgctacgccaaaactcggcgcaaagaaccaaccggattgccccagtggataaatcaggaatacggaaacaaaaacagcgattgggccagagaatgaaattgcattataaggccgaaattgaatagaccgagcaagttcaaattgacgtaacatgaaacctattagtgcaaaagccccatggagagcaacaaaagtccacagaccacctaattgacaccaacgagtaaaatccccttgtgcttccgggccccatagtagcaacaaagagtgtgctaaactattggcaggggtggaaactgctgcggttaagaaattgcaaccttccaaataggaactcgccaatccatgggtataccaagaagttacaaaagttgtccctgtaaaccaacctcctaaagcgaaataagcacaaggaaaaagcaataggccagaccatcctacaaaaacaaaacggtcccttcgtaaccagtcgtccataatatcaaataaatcattttcttctttagtaactctaccaagggctatagtcatagtgatcctcctattcaattacttcaaccatttccgagcaccttatatcacttccaaggcatacgatagattatctgtggacgattttttctcgttcaatgccttttttcaatggtctcgaagatagaaattttgcatttttatctatggggtcacagccgaggtcgtggtaaatccatgaatttgattcaattagtttttcttatactatagaaataaacattggaattcaggattattccatgattcctatttccaagaaagcctattttttaagggaaaaatgaaaaaaagtaacctctcttttcccactcgctctctattgcatgggtataagaacaaaaataggattctgaaaaaaagtaaagatattgaaaagaaaaattgactttcgaaatccatttttatgtgtagcggaaaggggttgcgatttcttcttattcctatagaacatctagtaacaagaatatgaaatagtaaatagcgagaaattcttgccttgcgtggtctaagtctaaggaaatacaaaaaaatccacttatac

SEQ ID NO: 4323 - DNA, 3897 bp, Oryza sativa
tatatccgcctgggtcgaccgtctatgtctgggtcgaccgtttcattttctatttgagttttctttttattaatttaattgtctgtcaatcaattcggggcgcaaattgcattttaatgcgtctcacaatccgaataaacggcccttttttattttgtatcgggctactaaatactaaacacatttaagaaatgagagaatttagaatagctaccagaaagaccagtccaatccataatgatgtaccggaaaatacaacgtttttattgtttgaccaaccatcaggagaagcaaatacaaggggtacactaatgactaagactgaggaagtcacaattaatgcaaaaacagctaattggaaagcaatagtcatatttctaatcctccaagttaccatcaaataaagttgactacatattatatttgatccctcacttaatcaaaattgtaataaaatacaagaagtaggaggggtttaatcatgaatccattgattcttctctttaaaacttattactcaccactttttttatttggatatggggttgagggggttttatgctttatttcacaagcggatatagcggatcctgtatacatggatacagtatacagaaatatatcgaaaagggatttgtatttgagatgtttctagaggttagtgagtcatttcgtatggctatgttctatttgtaggaataaaataaggattaggctgtggagagatggctgagtggttgatagctccggtcttgaaaaccggtatagttctaggaactatcgagggttcgaatccctctctctccttttgctttcctctctcttttcttttgcgtattgaatacgtttgtttctttatttgttttttttgttctgtccccttatctttctttcatagaaaggaatgaatggctcggctagatagaataaccgagccagaacagaaaaaaacagtagaacaggtataaataagaaaatcttagttaagaggggtcatgtaaagaacaggctccaaatcacgatcgattcccttttcaaatcctgctgcagcagcccgggctcttcctgcatgccacaaatggcccacaaaaaagaagaatcctagaacaaaatgggaagtcgctaaccaacttctaggagaaacataattaactgcattgatctcggtagctacgccacccacagaatttaaagagcctaaaggagcatgggtcatatattctgccgaacgtcgttcttgccaaggttgtatgtcttttttcaacctactcaagtccaaaccgttggggccccttagaggttctaaccatggagcacgaaggtcccaaaaacgcatagtttcccctccaaaaataacctctcccgttggggaacgcattagatatttacctaaacctgtgggtccttgggcagatcccacattagctccaagacgctgatctctaactagaaaagtaaatgcttgagcttgagaagcttctggcccagtaggtccataaaactcactcactcggataagctgtattattgaaccagacaaaacaacaagcgataaaaccaaagacagataaagcgcctaaactataagacaagtaagcttctccagaccatacaaatgcacggcgagcccatgcgaagggtttggttaagatatgccaaattccgccaaatacacaaatgaaacccaaccatacatgtcccccaattatatcttctaaatcatccacactaacaatccaaccctctcccccaaaaggggattttagtaaataaccaaatataacaccggggctaagggtcaaattggtaatttttcttacatctcctcccccaggagcccaggtatcatatataccgccaaaataaagagctttgagtactagaagaaaagcacctatacctaacaaaattaggtgaatacccaaaattgtagtcattttatttctatctttccacacataaccaaagaatggaaaagattcttcaagagtctccggtcccagaagcgcgtgataaatgccaccgaagcctaagactgcggaggaaattagatgaagtactccagatacaaagtacggaaaagtatctagaacttctcccccgggccctactccccaacctagagtagctaagtgcggaagtaaaatcaacccttgttcatacatgggtttttctggtacgaaatgggccacttcaaataggttcattgctccggcccagaatacgattaatcctgcatgggctacgtgagctccaagtagtttacccgacaaattgataagtctggcattcccggcccaccaagcaaaaccggtggtttcttggtcacgaccagctaaaacaaaagttccattaaagagcgtttccacgtggtagaacctcctcagggaatataagattttcatgaggctgatcctgagctgccatccacgcacgaataccctcgtttaaaagaatatttttggtgtagaaagtctcaaattcaggatcttccgctgcacggatttcctgggaaacgaagtcataggcacgtaggttcagagccaggccgactacgccaatagcactcatccataaaccggtgaccggtacaaatagcataaagaaatgtaaccaacgtttattggaaaaagcaacaccaaagatttgggaccaaaagcgattagcggtgaccattgaataagtttcttcagcttgagttgggttaaaagcgcggaaggtatttgcaccatcaccgtcctcaaatagagtgttttccacggttgccccatgaatagcgcatagcagagccgcgcctaatactccggcaactcccatcatatgaaatgggttcaacgtccaattatgaaatccttggaagaagaggatgaatcgaaatatcgctgctacgccaaaactcggcgcaaagaaccaaccggattgccccagtggataaatcaggaatacggaaacaaaaacagcgattgggccagagaatgaaattgcattataaggccgcaattgaacagaccgagcaagttcaaattgacgtaacatgaaacctattagtgcaaaagccccatggagagcaacaaaagtccacagaccacctaattgacaccaacgagtaaaatccccttgtgcttccgggccccatagtagcaacaaagagtgtgctaaactattggcaggggtggaaactgctgcggttaagaaattgcaaccttccaaataggaactcgccaatccatgggtataccaagaagttacaaaagttgtccctgtaaaccaacctcctaaagcgaaataagcacaaggaaaaagcaataggccagaccatcctacaaaaacaaaacggtcccttcgtaaccagtcgtccataatatcaaataaatcattttcttctttagtaactctaccaagggctatagtcatagtgatcctcctattcaattacttcaaccatttccgagcaccttatatcacttccaaggcatacgatagattatctgtggacgattttttctcgttcaatgccttttttcaatggtctcgaagatagaaattttgcatttttatctatggggtcacagccgaggtcgtggtaaatccatgaatttgattcaattagtttttcttatactatagaaataaacattggaattcaggattattccatgattcctatttccaagaaagcctattttttaagggaaaaatgaaaaaaagtaaagatattgaaaagaaaaattgactttcgaaatccatttttatgtgtagcggaaaggggttgcgatttcttcttattcctatagaacatctagtaacaagaatatgaaatagtaaatagcgagaaattcttgccttgcgtggtctaagtctaaggaaatacaaaaaaatccacttatacaatttcat

SEQ ID NO: 4324 - DNA, 1690 bp, Oryza sativa
ataaataagaaaatcttagttaagaggggtcatgtaaagaacaggctccaaatcacgatcgattcccttttcaaatcctgctgcagcagcccgggctcttcctgcatgccacaaatggcccacaaaaaagaagaatcctagaacaaaatgggaagtcgctaaccaacttctaggagaaacataattaactgcattgatctcggtagctacgccacccacagaatttaaagagcctaaaggagcatgggtcatatattctgccgaacgtcgttcttgccaaggttgtatgtcttttttcaacctactcaagtccaaaccgttggggccccttagaggttctaaccatggagcacgaaggtcccaaaaatgcatagtttcccctccaaaaataacctctcccgttggggaacgcattagatatttacctaaacctgtgggtccttgggcagatcccacattagctccaagacgctgatctctaactagaaaagtaaatgcttgagcttgagaagcttctggcccagtaggtccataaaactcactcggataagctgtattattgaaccagacaaaacaacaagcgataaaaccaaagacagataaagcgcctaaactataagacaagtaagcttctccagaccatacaaatgcacggcgagcccatgcgaagggtttggttaagatatgccaaattccgccaaatacacaaatgaaacccaaccatacatgtcccccaattatatcttctaaatcatccacactaacaatccaaccctctcccccaaaaggggattttagtaaataaccaaatataacaccggggctaagggtcaaattggtaatttttcttacatctcctcccccaggagcccaggtatcatatataccgccaaaataaagagctttgagtactagaagaaaagcacctatacctaacaaaattaggtgaatacccaaaattgtagtcattttatttctatctttccacacataaccaaagaatggaaaagattcttcaagagtctccggtcccagaagcgcgtgataaatgccaccgaagcctaagactgcggaggaaattagatgaagtactccagatacaaagtacggaaaagtatctagaacttctcccccgggccctactccccaacctagagtagctaagtgcggaagtaaaatcaacccttgttcatacatgggtttttctggtacgaaatgggccacttcaaataggttcattgctccggcccagaatacgattaatcctgcatgggctacgtgagctccaagtagtttacccgacaaattgataagtctggcattcccggcccaccaagcaaaaccggtggtttcttggtcacgaccagctaaaacaaaagttccattaaagagcgtttccacgtggtagaacctcctcagggaatataagattttcatgaggctgatcctgagctgccatccacgcacgaataccctcgtttaaaagaatatttttggtgtagaaagtctcaaattcaggatcttccgctgcacggatttcctgggaaacgaagtcataggcacgtaggttcagagccaggccgactacgccaatagcactcatccataaaccggtgaccggtacaaatagcataaagaaatgtaaccaacgtttattggaaaaagcaacaccaaagatttgggaccaaaa

SEQ ID NO: 4325 - DNA, 1587 bp, Oryza sativa
atgaaaatcttatattccctgaggaggttctaccacgtggaaacgctctttaatggaacttttgttttagctggtcgtgaccaagaaaccaccggttttgcttggtgggccgggaatgccagacttatcaatttgtcgggtaaactacttggagctcacgtagcccatgcaggattaatcgtattctgggccggagcaatgaacctatttgaagtggcccatttcgtaccagaaaaacccatgtatgaacaagggttgattttacttccgcacttagctactctaggttggggagtagggcccgggggagaagttctagatacttttccgtactttgtatctggagtacttcatctaatttcctccgcagtcttaggcttcggtggcatttatcacgcgcttctgggaccggagactcttgaagaatcttttccattctttggttatgtgtggaaagatagaaataaaatgactacaattttgggtattcacctaattttgttaggtataggtgcttttcttctagtactcaaagctctttattttggcggtatatatgatacctgggctcctgggggaggagatgtaagaaaaattaccaatttgacccttagccccggtgttatatttggttatttactaaaatccccttttgggggagagggttggattgttagtgtggatgatttagaagatataattgggggacatgtatggttgggtttcatttgtgtatttggcggaatttggcatatcttaaccaaacccttcgcatgggctcgccgtgcatttgtatggtctggagaagcttacttgtcttatagtttaggcgctttatctgtctttggttttatcgcttgttgttttgtctggttcaataatacagcttatccgagtgagttttatggacctactgggccagaagcttctcaagctcaagcatttacttttctagttagagatcagcgtcttggagctaatgtgggatctgcccaaggacccacaggtttaggtaaatatctaatgcgttccccaacgggagaggttatttttggaggggaaactatgcatttttgggaccttcgtgctccatggttagaacctctaaggggccccaacggtttggacttgagtaggttgaaaaaagacatacaaccttggcaagaacgacgttcggcagaatatatgacccatgctcctttaggctctttaaattctgtgggtggcgtagctaccgagatcaatgcagttaattatgtttctcctagaagttggttagcgacttcccattttgttctaggattcttcttttttgtgggccatttgtggcatgcaggaagagcccgggctgctgcagcaggatttgaaaagggaatcgatcgtgatttggagcctgttctttacatgacccctcttaactaagattttcttatttatacctgttctactgtttttttctgttctggctcggttattctatctagccgagccattcattcctttctatgaaagaaagataaggggacagaacaaaaaaaaacaaataaagaaacaaacgtattcaatacgcaaaagaaaagagagagg

SEQ ID NO: 4326 - DNA, 3691 bp, Raphanus sativus
ttttttttaccggcatggacatgtagatatcaaataaaatagaaaaaaagatttctttatctgagtaatgagtcatctgacaattcatgatttagattcaactacttattaataaactaatagcaaggaagaaacaatttgagttgatgcgtttacctaagtaaggaccaataaaataaaatattttgatcttcgaaaccaattaaatgaaattctaaaggttcaattttatggggcagtgcgcgagaaatcaaattataaataaatgatagaattttgagcgccctgaaaatgccataatatataacattaagatatataaaggtgttcggaaatggttgaagtagatgaataggaggatcgctatgactatagcccttggtaaatttaccaaagacgaaaaagatttatttgatattatggatgactggttacggagggaccgcttcgtttttgtaggttggtctggtctattgctctttccttgtgcctatttcgctttggggggttggttcacaggtacaacctttgtaacttcatggtatactcatggattggctagttcctatttagaaggttgcaattttttaaccgctgcagtttctactcctgctaatagtttagcgcattctttgttgttactgtggggtcctgaagcacaaggagattttactcgttggtgtcaattaggcggtctgtgggcttttgttgctctccacggtgctttcgcattaataggttttatgttacgtcaatttgaacttgctcgatctgttcaattgcgaccttataatgcaatcgcattctctggtccaattgctgtttttgtttctgtctttctaatttatccactaggtcaatcgggttggttctttgcgcctagttttggtgtagcggctatatttcgattcatcctctttttccaagggtttcataattggacattgaacccatttcatatgatgggagtcgctggtgtactgggcgcggctctgttatgcgctattcatggtgctactgtagaaaatactttatttgaagatggtgatggtgcaaatacattccgtgcttttaacccaactcaagccgaagaaacttattcaatggtcaccgctaaccgcttttggtcacaaatctttggggttgctttttccaataaacgttggttacatttctttatgttatttgtaccagtaactggtttatggatgagtgctcttggagtagtcggtctagctttgaacctacgtgcctatgacttcgtttcccaggaaatccgtgcagcggaagatccggaatttgagactttctatactaaaaatattcttttaaacgaagtattcgcgcttggatggcggctcaagatcagcctcatgaaaccttatattccctgaggaggttctaccacgtggaaacgctctttaatggaactttagctttagctggtcgtgaccaagaaaccactggtttcgcttggtgggccgggaatgcccgacttatcaatttatctggtaaactattgggagctcatgtagcccatgccggattaatcgtattctgggccggagcaatgaacttatttgaagtggctcattttgtacctgaaaagcccatgtatgaacaaggattgattttacttccccacctagccactttaggctggggggtaggtcctgggggagaagttatagacacctttccatactttgtatctggagtacttcacttaatttcttctgcagttttgggctttggcggtatttatcatgcacttctgggacccgaaactcttgaagaatcttttccatttttcggttatgtatggaaagatagaaataaaatgaccaccattttgggtattcacttaattttgttaggtgtaggtgcttttcttctagtattcaaggctctctattttgggggcgtatatgatacctgggctccaggagggggggatgtaagaaaaattacaaacttgactcttagcccaagtgttatatttggttatttactaaaatctccctttgggggagaaggatggattgttagtgtggacgatttggaagatataattggagggcatgtatggttaggttccatttgtatatttggtggaatctggcatatcttaaccaaaccttttgcatgggctcgccgcgcacttgtatggtctggggaggcttacttgtcttatagtttagctgctttatctgtttgtggtttcattgcttgttgttttgtctggtttaataataccgcttaccctagtgagttttacggacctacagggccagaagcttctcaagctcaagcatttacttttctagttagagaccaacgtcttggagctaacgtggggtctgctcaaggacctacaggtttaggtaaatacttaatgcgttccccgactggagaagttatttttggaggagaaacaatgcgtttttgggatctgcgtgctccctggttagaacctttaaggggtcctaatggtttggacttaagtaggttgaaaaaagacatacaaccttggcaagaacgacgttctgcagaatatatgactcatgctcctttaggttccttaaattctgtagggggcgtagctactgagatcaatgcagtcaattacgtctctccgagaagttggttatctacctctcattttgttctaggattcttcctattcgtgggtcatttatggcacgcgggaagagctcgggcagcggcagcaggatttgaaaaaggaattgatcgtgattttgaacctgttctttctatgactcctcttaactaaagtagtagttaaaataggaaagtaaaaatcgggtcatagtaaaaagtcttctttctttctttcaattcaatctccttttttctggctcggctatactatccagccgagccattctccttttttatgatgctaagaagtaaaaaagccaataaataaaaaaatctattcatccaacaaaaggagagagagggattcgaaccctcgatagttattttttatgaactataccggttttcaagaccggagccatcaaccactcggccatctctccgaaagataatttctattttatcttttttttcgccaaatagaacatagctcgatgagttaatacgatcactatgtagaaaaagatatagggtgtgactttctttataagtctatcaattggtctatataaataaatgagatacatgatccagtctacccatttgtgaagtcaaaaagaacctttaacttcatgtccgaatagaataaaagtggtaaaaagaagttggaaataaggcatctcgaataaacggattcatgataaaatccctttatttattaaaattttttagtgggtaagaggattaaatggtgtatattgttaatagcttggaggattaaaaacatgactattgcttttcaattggctgtttttgcattaattattacttcattaatcttactgattagtgtacccgttgtatttgcgtctcctgatgggtggtcgagtaacaaaaatgttgtattttctggtacatctttatggattggattagtcttcttggtgggtatccttaattctcttatctcttgaattcattcgttgcagatcaaaaaatgagatgacccctcccattccatgaattacacattcaaattcaatataagtccataaaatgcaaataaaga

SEQ ID NO: 4327 - DNA, 1551 bp, Chenopodium quinoa
aaagaacaggttcaaaatcacgatcaattccttttcaaatcctgctgcagctgcacgagcccttcccgcatgccacaaatgacctacgaataggaaaaatcctaaaacaaaatgagaagtagctaaccaacttctaggagagacataattgactgcattgatctcggtagccaccccacccacagaatttaaagaacctaaaggagcatgggtcatatattctgcggaacggcgttcttgccaaggttgtatgtctttttcagccgactcaagtccaaaccatttggacctcttaggggttctaaccagggagcgcgcaaatcccaaaaccgcatagtttctcccccaaaaataacttctccagtcggagaacgcattagatacttacctaaaccagtaggtccttgagcggatcccacgttagccccaagacgttggtctctaactaaaaaagtaaatgcttgagcttgagaagcttctggtccagtaggtccgtaaaactcactaggataagcagtattattgaaccagacaaagcaacaagcaatgaaaccaaagacagataaagcagccaaactataagacaaataagcctctccagaccagacaagtgcgcggcgagcccatgcaaaaggtttagttaagatatgccagattccaccaagtatacaaatgaaacctatccatacatgccccccgattatatcttccaaatcgtccacactaacaatccacccttctcctccaaaaggcgattttagtaaataaccaaagataatactcggactaagggtgacgttggtaatttttcttacatctccgcctcctggagcccaggtatcatatacgcccccaaaataaagagccttgaacactagaagaaaggcgcctatacctaacaagattaagtgaatgcccaaaattgtggtcattttatttctatctttccacacataaccgaagaatggaaaagattcttcaagagtttcagggcccagaagtgcatgataaatacccccaaagcccaatacggccgacgaaattaagtgaaggactcctgatacaaagtatggaaaagtgtctataacttccccgccggggcctaccccccaacctagagtagctaggtggggaagtaaaattaatccttgttcatacatcggcttctctggtacgaaatgagccacttcaaacaggttcattgctccggcccagaatacgattaatccggcatgggctacatgagctccaagtagtttaccagataaattgataagtcgagcattcccggcccaccaagcgaaaccggtggtttcttggtcacgtccggctatagttaaagttccattaaagagcgtttccacggggtagaacctcctcagggaatataaggttttcatgaggctgatcttgagccgccatccaagcacgaataccttcgtttaagagaatatttttggtgtagaaagtttcaaattcaggatcttccgctgcacggatttcctgggaaacgaagtcataggcacgtaggttcaaagccagaccgactac

SEQ ID NO: 4328 - DNA, 12633 bp, Zea mays
tagattagatagatatttaggagaatttctatctcctattctatagggatcatctagaaagcggagagctttggttccattcagacagaaaagctgacatagatgttaagtggtgagaatatccataaaggagccgaatgaaatcaaaatttcatgttcggttttgaattagagacgtcaaaaataatcaaccaacgtcgactataacccctagccttccaagctaacgatgcgggttcgattcccgctacccgctccattctgtataaaaagactattccatttgtttgtctagacatggtagagacttgtattccacctttttctttcgtccaccagttttcggccctacagagcggagtagagcagtttggtagctcacgaggctcataaccttgaggtcacgggttcgattcccgtctccgcacttagcagtccgtataaatggactattctatttgtatatatatgatagagggctatatccaaccctttttttttatttagcaggcagaaaaaaaaaaaaaaaaaatgaaagaaaagcatagcctatccccctttcaaaaccgtttgtctcttgtttgtctcggcgaatccccggtttagggaactttcttagaaagttggatttgcaccctcgaagcactctttttttttgagtcgggtgcaaaggaaggataagataggaaggggtacagtactagactaacaactacttaatttaatattcatttaatattaaatagtaatttaatagaagtagttaagtagtcatttactataataatttactatattaaaaataaatatatataatttactataatataaactataatattaaatataaactataatattaagtagttaagtagtcaactagactgaattttttatcatagcaccttactaaattaagctggcgagcgacgggaatcgaacccgtatcttctccttggcaaggagatgttttaccactgaactacgctcgctacattgaactacgcttgctacgtcctatattttatagggtatatccacctgggtcgaccgtctatgtctgggtcgaccgtctatgtctgggtcgaccgtttcattttctattagagttttctttttattaactgtctatcaatcaatattctaatggcaatagaatttcataataatgaaagagaagaggtaataattcggaacgaaaatagcattttaatgtgtataaaaatcctaattttttcgaaaaagggcctttctttttatttattttgtatcgggttactaaatactaaacaaattcaagaaataagagaattcagaatagctaccagaaagactaatccaatccataatgatgtaccggaaaatacaacgtttttattatttgaccaaccatcaggagaagcaaatacaaggtgtcctctaattactaaaactgaggaagtcgcaattaatgcaaaaacagctaattggaaagcaatattcatatttataatcctccaaactaccttcaaataaagttgactacatatttctatttgatccctcacttaatcaaaattgtatgaaaatacaagaagtaggaggggtttaatcatgaatccattgattcttctttttattaaaactttttccttaccgctttatacagagatatattgaaagtggacttgcatctgagatgagttagtagatcatttcatatagctatgttctatttgtaggaataaaatagggattgggctgtggagagatggctgagtggttgatagctccggtcttgaaaaccggtatagttctaggaactatcgagggttcgaatccctctctctccttttgtatattgaatacatttgcttctttctatctatgtttttctttgtgcagccccccttatatcattctttcataaaaaagcatgaatggctcggctagatggaataaccgagccagaacagaaaaaaactagaacaggtataaataaaaaatcttagttaagaggggtcatgtaaagaacaggttccaaatcgcgatcaattcccttttcaaagcctgctgcagcagctcgggctcttcctgcatgccacaaatggcccacaaaaaagaagaatcctagaacaaaatgggaggtcgctaaccaacttctaggggagacataattaacagcattgatctcggtagctacgccacccacggaatttaaagagcctaaaggagcatgggtcatatattctgctgaacgtcgttcttgccaaggttggatgtcttttttcaacctactcaagtccaaaccgttggggccccttagaggttctaaccacggagcacgaaggtcccaaaaacgcatagtttcccctccaaaaataacctctcccgttggggaacgcattagatatttacctaaacccgtcggtccttgggcagaccctacattagctccaagacgctggtctctaactagaaaagtaaatgcttgagcttgagaagcttctggtccagtgggcccgtaaaactcacttggataagccgtattattgaaccagacaaaacaacaagcgataaaaccaaaaacagataaagcacctaaactataagacaagtaagcttcgccagaccatacaaatgcacggcgagcccatgcaaagggtttggttaagatatgccaaattccgccaagtacacaaatggaacccaaccatacatgtcccccaattatatcttctaaatcatccacactaacaatccatccttctcccccaaaaggggattttagtaaataaccaaatataacaccggggctaagggtcaaattggtaatttttcttacatcccccccccccggggcccaggtatcatatacgccgccaaaataaagagccttgagtactagaagaaaagcacctagacctaacaaaattaagtgaatacccaaaagtgtagtcattttatttctatcttgccatacataaccaaagaatggaaaagattcttcaagagtctcgggtcccagaagcgcgtgataaatgccaccgaagcctaagactgcggaggaaattaagtgaagtactccggatacaaagtaaggaaaagtatctagaacttctccccccggccctactccccaacctagagtagctaagtgcggaagtaaaatcaacccttgttcatacatgggcttttctggtacgaaatgggccacttcaaataggttcattgctccggcccagaatacgattaatccggcatgggctacatgagctccaagtagtttaccggacaaattgataagtctggcattcccagcccaccaagcaaagccggtggtttcttggtcacgaccagctaaaacgaaagttccattaaagagcgtttccacgtggtagaacctcctcagggaatataagattttcatgaggctgatcctgagctgccatccacgcacgaataccctcgtttaaaagaatatttttggtgtagaaagtctcaaattcaggatcttccgctgcacggatttcctgggaaacgaagtcataggcacgtaggttcagagccagaccaactacgccaatagcactcatccataaaccggtgacgggtacaaatagcataaagaaatgtaaccaacgtttattggaaaaagcaacaccaaagatttgggaccaaaagcggttagcagtgaccattgaataagtttcttcagcttgagttgggttaaaagcacggaaggtatttgcaccatcgccatcttcgaatagagtgttttctacggtagccccgtggatagcgcatagcagagctgcgcctaatactccggcaactcccatcatatgaaatgggttcaacgtccaattatgaaatccttggaagaaaaggatgaaccgaaatatagctgctacgccaaaactcggcgcaaagaaccaaccagattgtcccagtggataaataaggaatacggaaacaaaaacagcgattggaccagagaatgaaattgcattataaggccgcaattgaacagaccgagcaagttcaaattgacgtagcatgaaacctattagtgcaaaagctccatggagagcgacaaaagtccaaagaccacctaattgacaccaacgagtaaaatctccctgtgcttccggtccccatagtagcaacaaagagtgtgctaaactattggcaggtgtggaaaccgccgcggttaagaaattgcaaccttccaaataggaactagccaatccatgggtataccaagaagttacaaaagtagtccctgtaaaccaaccccctaaagcgaaataagcacaaggaaagagcaataagccggaccatcctacaaaaacgaaacggtcccttcgtaaccagtcgtccataatatcaaatagatcgttttcttctttagtaactctaccaacggctatagtcatagtgatcctcctattcaattacttcaaccattttcgagcacctcatattacttccagggcatacgatagtttgattatctgtggacgatttctttctcgttcaatgccctttttcagtcgtctcgaagatagaaattttgcatttttatctatggggtcacaacccaggtcgtgctaaatccacaaatttcatttaattcatttttcttatactatagaaaagaaataaagaaataaacatttgaattcagcattattccatgatttctatttcaaagcccattttttaagggaaaacccctcttttctcattcgctctctattgcatgggtggaagaacaaaaatggaattctgaaaaaaaaagaaagatattgaaaagaaaaattgacttttgaaaccctttatttattatgtgtaacggaaaagagttgcgatttcttcttattcctatagaacgtctagtaacaagaatatgaaatcgtaaatagcgaaaaattcttgccttgcgcgatctaagtctaaggaaatacaaaaatgcgcttatacaccaatttcatccacatcgaatttatatatcagaatagcagatagaggcattattcaaggggtcaggtctacttactttatctttctttcccattttattgtgggtttgataagaaccttttttgctttgtggataaataaaaaaaaagagtttttttttttaacccgcttgttttattctaacaaattctatatggaactgcccgctgaagagaaaaaagatctgattgtctttcagcctatatcgaattttggaaagaaaaaaccagaattttcttcttttttttattaacattaagaaaaaagaatataattaaaatggaattggcaatataatttttatgcacttttgaaatgaaagaaaaaggaaggatttttgacaatcgttatttcttgcctctgccatatcatgaaaacctttcgatttggaacggggagagatggctgagtggactaaagcggcggattgctaatccgttgtacaatttttttgtaccgagggttcgaatccctctctttccgccccctcggatcatttgggactttcgaattgtaaggaattctgacccccggattttctcataaataaatgtacgaaataaatccaatttaaatttataagaaaaaattccaaaaaatttttgatttttactcctcacgcccaggattacgtcctgggtcattagataagaatccaaagataaagagggaaacaaagaatatcactactgtataaacaaaaagtttgagagtaagcattacataatctccaaaattttttttgttaaggaatagattacccatttttccttaccacacggatccactaggatgggttttctttattttgacacctaaaaatgcaaaaatcaattcttaaaaaaattgcaagaattgctttataataagcactcttatcaatatcaaaaattagtttaggtattgtgtgggtacctaaaggtacctgttcaacgtaggcgcagggggtagaaaggctgatcaaaatttattgctgcagctatacattcaatgtagaagaattttcattttagaatcgaaggttcataatataagacttctcggctcttatccatttttttttttggaatgaatacatcattcaatttggcaggcagaatagtaaagatttcatcgaaaacttacagcagcttgccaaacaaacgctaatagaaaaaagagtacaggtatgacaggcataacatccacgattgggttgaaaatggcataagcttcgggtaatttggcgaagaaaaagctagtcggacaaagaacagaattaaaacagatacaggttaaactaagtatattaggcataacaagcatttcattcttgtagagtagataattggattttgattgagttatttttataagggaaaaagcaaaagaaaaggtagattccaaatccttttttcttcggactttcccaaacacaaaatacctccttgtattcgcattctcaaatgagaatggaagaaattcgactttcatataatatcttaatagaattccatgtaatgatcaatgcattttttggattctatattatctgcatgtctagaatcctagcaagaaaatatccctcattttttaggtaattgaagtgggattgacgaataatatataaaaataatagtgtttattagtgtttcataaaacgaaatgacatggggcgtggccaagtggtaaggcagcgggttttggtcccgttactcggaggttcgaatcctttcgtcccagattttttctgatgaagcgaaagatagaatcgtattgtgccctgcacgacacaaaagtttattaaagagaataattatctcttatgaactcgtagattagatgcatttctaagcatttttttctttctcagaaaacaaaaaataaagtgtcaagtccagtcaaatttaatatctttattttcatgaaaaatttttgtctatcaggcacattcaggatatgcccctactactcattactcatatgtgttttgaatatgtgttttgaaattggaactttttggataaactttataccccgtatctatgaagtgggaattcttacaggatccatttgacacccaatatgaaagaaaagaagtaccccctatttattttcccaaaactaaagaactaaagtaagtaaaaaaaaaaaaaattaatgaggtaaaacactgtatagaaaatgagacctatccctttatgatagagatagatttttgttgtattatttgttttcttgtattattagtaaaaaagaagcgtccttcttttctttggttaagcgaaaacgatctcgatctgtgattctttaaatatccagaatgatccatttcggtaaggttaaggtaagaactgttcgttggatagaatggattcgaaaaaatcgtacttttcttattttttattttgagttctttcttttgttattcgagtcgaagaagtatgagaattttagaactactcaaaaacgaccaatcttttcattggcatagcttatttgtttatatagttaattgtttttgttacagaaaaatagattaattcattaaattaattccactttttttgaggttgatagtttatttgttgggaaagagtggatccttctcatttcaggattaatcatcttgagttctctgttgaaaatggaaattcaataataataaataagtcttaagtaaactattttattcctctttttcgaactatgtttcattcatatgatagaatatgggtttaaataaattgtatctttgcagagtgttccccgataaatacttatttcttttatccaattttctccatagatagcaggtttgaattagtatacaaaagcaatgactattcatgattccatccatattggatcaattctcgataccattttgcaatgaaattagaggaatgttatggtaaaacttcgtttaaaacgatgtggtagaaagcaacaagctatctatcgaatcgttgcaattgatgttcgatctcgaagagaaggaagagatcttcgaaaagtaggtttttatgatccgataaagaatcaaacttgtttaaatgttccagctattctctatttccttgaaaagggtgctcaacctacaagaacagtttatgatattttaaggaaggcagaattctttaaagataaagaaagaactttgagttaattgaagaactaaatgaataaaaaagtaggagagggtccttagtaccccttaattatttagacacaatttgcctctttcttagtcctattttttttttgctgcatttatgtcgtgccaatccaacaaaagtccctattttatttcctttttatatctaattacattgtatttgcattgacaaaggtctattgaacaaatagaatttgtagatagatgggtctctttattgtcactccatattaggtatttctgtctacacttcattcaaatgatagggttgcccctcttgcatgtactctcatacacatacaagattattttacttctttaaattgccaaaaaaatcacaattttgccattgtgattggggctgctttttttttttacccttagccttagtgaaatttaaccggatctgttcattttgtatttgagtgtttttaatggattagaaaatctttcttttgatgtcttgctaattcaatgtggtataatttcatcgatttttagattttgatcgtatctaagagatcctattttatccgggttgctaactcaatggtagagtactcggcttttaagtgcggctatgatcttttacacatttggatgaagcaacaaattcgtccagactcttggtagagtctagaagaccacgactgatcctcaaaggtaatgaatggaaaaaatagcatgtcgtaataaaatcaatttctttttttttttttaataaaaaaaattctgattttctgggtctagtgaataaatggatagagcctggctctaattctggtaaaataaaaaaaaagcaacgagcttaacttcttaattggttaattggaaggattccccgatctaattagacgttaaaaatagattagtgcctaatgtggggaaaggttaggttttcctatgaatggaccctttactttttttttttagaaatcctaattattcttgattatggattgaaaagagatgttatgaattgaatgtgtaaaagaaacagtatattgataaagagactgtattccaaagtcaaaagagcgattggcctgcaaaaataaaagatttgttcttgtttgttttataattagaacaaacataaactaattagatagaaaaggagtggaaaaagttctatggattagactccctttctttcctgggtttgtattatgcaacaccttgttctgaccatattgcactatgtatcatcatttgataaaccgagaaatgctttttttctctatttcaagtagaaatacaaatggaaaaattcgaagggtattcagaaaaacagaaatctcgtcaacactacttcgtctacccacttctctttcaggaatatatttatgcatttgctcatgattatggattaaatggttccgaacccgtggaaatttttggttgtaataacaagaaatttagttcactacttgtgaaacgtttaattattcgaatgtatcagcagaattttttaattaattcggttaattatcctaaccaagatcgattgttggatcaccgtaattatttttattctgagttttattctcagattctatctgaggggtttgcgatcgttgtagaaatcccactctcgctagggcaactatcttgtccggaagaaaaagaaataccaaattttcaaaatttacaatctattcattcaatatttccctttttagaagacaaatttttgcatttacattatctatcacatataaaaataccctatcctatccatttagaaatcctggttcaactccttgaataccggattcaagatgttccctctttgcatttattgcgattctttctccactattattcgaattggaatagttttattacttcaatgaaatccatttttcttttgaaaaaagaaaataaaagactatttcgattcctatataactcttatgtatcagaatatgaatttttcttgttgtttcttcataaacaatcttcttgcttacgattaacatcttctggaacctttctggaacgaatcatcttttctgggaagatggaacattttggtgtaatgtacccggggttttttcggaaaaccatatggttctttatggatcctcttatgcattatgttcgatatcaaggaaaggcaattcttgcatcaaaaggcactcttcttttgaagaagaaatggaaatcttaccttgtcaatttctcgcaatattttttctctttttggactcaaccacaaaggattcgtctaaaccaattaacaaactcttgcttcgattttctggggtacctttcaagtgtaccaataaatactttgttagtaaggaatcaaatgctggagaattcttttctaatagatactcgaatgaaaaaattcgataccacagtccttgcaactccccttgtcggatccttatcaaaagctcaattttgtactggatcggggcatcctattagtaaacccgtttggactgatttatcagattgggatattcttgatcgttttggtcggatatgtagaaatatttttcattattatagtggatcttcgaaaaaacagactttgtatcgactaaaatatatacttcgactttcatgtgctagaactttagctcgtaaacataaaagtacggtacgaacttttatgcaacgattgggttcggtatttttagaagaattttttacggaagaagagcaagttttttctttgatgttcaccaaaacaattcacttttctttccatggatcacacagtgagcgtatttggtatttggatattatccgtatcaatgacctggtgaatcctcttactcttaattaatcattagacaaaattaataaactagaaaagatcgatatcaagataaaacttgcacattttccattctgaaatgttccatagtaggtgaatcactttaactaattaaaaattctcaaaattagtggacttcctcttcggaatagaaattggctatttccacatagggaaagtcgtgtgcaatgaaaaatgcaagcacgatttggggaggggttttttctattgtaacaaggaagaattatctactccatccgactagttccgggttcgagtcccgggcaacccatatggaaaatagaaaagagcaatctgagtttttcatttttactaacttaatttcccaaatttttggatttggtaaatgaagttatacgaaaatccaatcgttggggctggcttggttgacattggtatatagactatgttatactgttaaataacaagccttctattatctattttctttctagttaatacgtgtgcttgggagtccttgcaatttgaataaaccaagatcttaccatgactgcaattttagagagacgcgaaagtacaagcctgtggggtcgcttctgcaactggataactagcaccgaaaaccgtctttacattggatggttcggtgttttgatgatccctaccttattgaccgcaacttccgtatttattatcgccttcatcgctgctcctccagtagatattgatggtattcgtgagcctgtttctggttctttactttatggaaacaatattatctctggtgctattattcctacttctgcggcgatcggattgcatttttacccaatttgggaagctgcatctgttgatgaatggttatacaatggcggtccttatgagctaattgttctacacttcttacttggtgtagcttgttatatgggtcgtgagtgggaacttagtttccgtctgggtatgcgcccttggattgctgttgcatattcagctcctgttgcagctgctactgctgttttcttgatttaccctattggtcaaggaagtttctctgatggtatgcctttaggaatatctggtactttcaactttatgattgtattccaggcagagcacaacatccttatgcatccatttcacatgttaggtgtagctggtgtattcggcggttccctattcagtgctatgcatggttccttggtaacctctagtttgatcagggaaaccactgaaaatgagtctgctaatgagggttacaaatttggtcaggaagaagagacttataatattgtggctgctcacggttattttggtcgattaatcttccaatatgctagtttcaacaattctcgttctttacacttcttcttggctgcttggcctgtagtagggatctggttcactgctttaggtattagtactatggcattcaacctaaatggtttcaatttcaaccaatctgtagttgatagccaaggtcgcgttattaatacttgggctgatatcatcaaccgtgctaatcttggtatggaggtaatgcacgaacgtaatgctcacaacttccctctagacctagctgctcttgaagttccttaccttaatggataaggtttttctcctaaacatataggaatttttgaaggaaggaaagccggaaatacccaatatcttgttccaacaggatattgggtatttc

SEQ ID NO: 4329 - DNA, 2631 bp, Zamia vazquezii
  misc_feature (29)..(29): n is a, c, g, or t
  misc_feature (2617)..(2617): n is a, c, g, or t
tttcgtttttgtgggttggtccggtctantgctctttccttgtgcctattttgccctaggtggatggttcacaggtacaacctttgtaacttcatggtatacccatggattggccagttcttatttggagggctgcaattttttgaccgccgcagtttctactcctgctaatagtttagcgcattccctgctgctattatggggtcctgaagcacaaggagattttactcgttggtgccaattaggtggcctatggactttcgttgcttttcatggtggttttggtctaataggcttcatgctacgccaattcgaacttgctcgatctgtacaattgcggccttataatgcaatcgcattctctgctccaattgctgtttttgtttccgtattcctaatctatccattgggccagtccggttggttttttgcacctagttttggtgtagcagctatctttcgatttatcctcttctttcaagggtttcataattggaccttgaacccatttcatatgatgggagttgccggagtattgggtgctgctcttctatgtgctattcatggtgctactgtggaaaatactttatttgaagatggcgatggtgcaaatacgttccgcgcttttaacccaactcaatctgaagagacctattccatggtcaccgctaaccgtttctggtctcaaatctttggggttgctttttccaataaacgttggttacatttctttatgttatttgtgccagtgaccggtttgtggatgagtgccattggagtagttggtctagctctgaacttacgtgcctatgactttgtttctcaggagatccgtgcagcagaagatcctgaatttgagaccttctacacaaaaaatatcctcttaaacgaaggtattcgtgcttggatggcggctcaagatcagcctcatgaaaaccttatattccctgaggaggttctaccccgtggaaacgctctttaatggaactctagctttagctggtcgtgaccaagaaaccaccggtttcgcttggtgggccggtaatgcccggcttatcaatttgtccggtaaattacttggggcccacgtagctcatgccggattaattgtattctgggccggagcaatgaacctatttgaagtggctcatttcgtaccagaaaagcctatgtatgaacaaggattgattttacttccccatctagctactttaggatggggagtaggccctggtggggaagtcgtggacacttttccatactttgtatctggggtacttcacttgatttcctctgcagttctaggtttcggtggtatttaccatgcacttatagggcccgaaactctcgaggaatcccttccattttttggttatgtatggaaagataggagcaaaatgaccacaattttgggtattcacctaatcttgctaggcgttggtgcttttcttctagtgctcaaggctttgtattttggaggtgtatatgatacctgggcccctggtggtggagatgtaagaaagattacgaacccaactcttagcccaagtgttatatttggttatttacttgagtccccctttgggggtgagggatggattgttagtgtggacaatctagaagatataattgggggacatgtatggttaggttccatttgtatcttcggtggtatctggcacatcttaaccaaaccttttgcatgggcccgtcgtgcgtttgtgtggtccggagaagcttacttgtcttatagtttaggagctctctctgtctttggtttcattgcttgttgcttcgtttggtttaacaatacagcttatcctagtgaattctatgggcctaccggcccagaagcctctcaagctcaagcgttcacttttctagttagagaccaacgtcttggagctaatgtggggtccgcccagggacctaccggtttaggtaaataccttatgcgctctcctactggagaaatcatctttggaggcgaaacaatgcgtttttgggatcttcgtgctccctggttggaacctctaaggggtcctaatggtttggacctaagtaggctgaaaaaagatatacagccctggcaagaacgacgttcggcggaatatatgactcatgctcctttaggttctttgaattccgtgggtggtgtagctaccgagatcaatgcggtaaattatgtatcgccccgaagttggttagctacctctcattttgttttaggatttttctttttcgtaggtcatttgtggcatgcgggaagggctcgtgcagctgcagcaggatttgagaaaggaatcgatcgtgatttcgagcctgtcctttccatgaaccctcttaactagaacaagagatcaagttgatgaaagagagatcgattcaatttcattacatccggtataagggtatcgttaaagactcccattccaacttgaccttgtagctcggctctattcagccgagctattctctttttggtatgggccagaccaataagtggaatcgttcaacaaacaaaaggagagagagggattcgaaccctcgatagtcttttgtaactataccggttttcaagaccggagccataaaccactcggccatctctcccagnggacaatttctatt

SEQ ID NO: 4330 - DNA, 2428 bp, Cycas rumphii
  misc_feature (1649)..(1649): n is a, c, g, or t
  misc_feature (2020)..(2020): n is a, c, g, or t
atgactgtagctcttggaaagtcttccaaagaagaaaaaaatttatttgatattgcggatgactggctacgtagggaccgtttcgtttttgtgggttggtctggtctattgctctttccttgtgcctattttgccctaggtggatggttcacgggtacaacctttgtaacttcatggtatactcatggattggccagttcttatttggagggctgtaattttttgaccgccgcagtttctactcctgctaatagtttagcacattccctgctgctattatggggtcctgaagcacaaggagattttactcgttggtgtcaattaggtggtctatggactttcgttgcttttcatggtggttttggtctaataggcttcatgctacgccaattcgaacttgctcgatctgtacaattgcgaccttataatgcaattgcattctctgctccaattgctgtttttgtttccgtattcctgatctatccattgggccagtctggttggttttttgcacctagttttggcgtagcagctatctttcgatttatcctcttctttcaagggtttcataattggaccttgaacccatttcatatgatgggagttgccggagtattgggtgctgctcttctatgtgctattcatggtgctactgtggaaaatactttatttgaagatggtgatggtgcaaatacgttccgtgcttttaacccaactcaagctgaagagacctattccatggtcaccgctaaccgcttctggtctcaaatctttggagttgctttttccaataaacgttggttacatttctttatgttatttgtgccagtgaccggtttatggatgagtgccattggagtagttggtctagctctaaacttacgtgcctatgactttgtttcccaggagatccgtgcagcagaagatcctgaatttgagactttctatacaaaaaatatcctcttaaacgaaggtattcgtgcttggatggcggctcaggatcagcctcatgaaaaccttatattccctgaggaggttctaccccgtggaaacgctctttaatggaactctagctttagctggtcgtgaccaagaaaccaccggtttcgcttggtgggccggtaatgctcgacttatcaatttgtctggtaaattacttggggcccacgtagcccatgccggattaattgtattctgggctggagcaatgaacttatttgaagtggctcatttcgtaccggaaaagcctatgtatgaacaaggattgattttacttccccatctagctactctaggatggggagtaggtcctggtggggaagtcgtggacacttttccatattttgtatctggggtacttcacttgatttcctctgcagttctaggtttcggtggtatttaccatgcacttataggacccgaaactctcgaggaatcccttccattttttggttatgtatggaaagatagaagcaaaatgaccacaattttaggtattcacctaatcttgctaggtgttggtgcttttcttctagtgctcaaggctttgtattttggaggtgtatatgatacctgggctcctggtggtggggatgtaagaaaaattacgaacctgactcttagcccaagtgttatatttggttatttantcgagtccccctttgggggagagggatggattgttagtgtggacaatctagaagatataattgggggacatgtatggttaggttctatttgtatcttcgggggtatctggcatatcttaaccaaaccttttgcatgggcccgtcgtgcgtttgtatggtctggagaagcttacttgtcttatagcttaggggctctctctgtctttggtttcattgcttgttgttttgtttggttcaacaatacagcttatcccagtgaattctatgggcctaccggcccagaagcctctcaagctcaagcgttcacttttctagttagagaccaacgtcttggagctaatgtggggtccgcccagggacctaccggtttnggtaaataccttatgcgttctcctaccggagagattatcttcggaggagaaacaatgcgcttttgggatcttcgtgctccctggttggaacctctaaggggtcctaatggtttggacctgagtaggctgaaaaaagacatacagccttggcaagaacgacgttcggcggaatatatgactcatgctcctttgggttctttgaattccgtgggtggtgtagctaccgagattaatgcggtaaattatgtatctccccgaagttggttggctacctctcattttgttttaggatttttctttttcgtgggccatttgtggcatgcgggaagggctcgtgcagctgcagcaggattcgagaaaggaattgatcgtgatttcgaacctgtcctttccatgaaccctcttaac

SEQ ID NO: 4331 - DNA, 1981 bp, Ceratodon purpureus
tattgagttttaagaaaatgaaaatggctcgactaaaaaaagccaagccattttcaaatattaataagtaatattgataattattttttttttcaataattattaactcttagttaagaggtgtcatagaaagaacgggctcaaaatcacgatcaattcctttttcaaatccagctgcagcagcacgcgctcttcctgcatgccataaatgacctacaaagaaaaagaatcctaacacgaaatgggaagtagctaaccaactccgtggagaaacataattaactgcattaatttcagtagctacaccacctacagaatttaaagaacctaatggagcatgtgtcatatattctgcagaacgccgttcttgccaaggttgaatatctttcttcaatttactcaaatctaatccattaggacctcgtaatggctctaaccatggagcacgaagatcccaaaagcgcattgtttctcctccaaagataatctctcctgttggagaacgcataaggtatttacccaaaccggtaggcccttgagcggaacctacattagctccaagtcgttggtctctaactaggaaagtaaaagcttgcgcttgagatgcttctggtccagtaggaccataaaattcgcttggataagctgtattattaaaccaaacaaaacagcaagcaataaaaccaaaaacagaaattgccgctaaactataagataaataagcttctccagaccaaacaagagcacgacgagcccaagcaaaaggttttgttaaaatatgccagattccaccaaaaatacagatagaacctaaccaaacatgccctccaataatatcttctaagttatctacactaacaatccatccttctccaccaaacggcgatttaagtaaataaccaaatataacattaggactaagagtaaggtttgtaatttttcttacatcgcctcctccaggagcccaagtatcgtatacacctccaaaatataaagctttaaatactaaaagaaaagcgccagcccctaataaaattaaatgaatacctaaaatagtagtcattttatttttatctttccaaacataaccaaaaaacggaaaagattcttctaaagtttctggtccaataagcgcatggtaaatacctccaaagcctaaaactgcggaagaaattaagtgaaggactccagatacaaaatatggaaaagtatctataacttctccaccaggaccaactccccaacctagagtagctaaatgaggaagtaaaattaatccttgctcatacataggtttttctggtacaaaatgagctacttcaaaaagattcattgctccagcccaaaatacaattaatccggcatgagcaacgtgagcaccaagtaatttcccagataaattaataagtctagcattaccagcccaccaagcaaaaccagtggtttcttgatcacgaccacctaaagacaaggttccattaaagagcgtttccacggggtagaacctcctcggggaatacaagattttcatgaggctgatcttgagctgccatccaagcacgaataccttcatttagaagaatatttttagtatagaaagtttcaaattcagggtcttccgctgcacgaatttcctgagaaacaaagtcataagcccgtaaatttaaagccagaccaactactccaattgcgctcatccataaaccagttactggtacgaaaagcataaaaaaatgcaaccagcgcttattagaaaatgcaacaccaaatatttgagaccaaaaacgattagctgtaaccatagaataagtttcttcagattgagttggattaaatgcacggaatgtatttgcaccgtctccatcttcaaataaagtattttctacagttgcaccatgaatagcacataaaagagcagctcctaaaactccagcaacccccatcatatgaaatgggtttaaagtccagttatgaaaacctt

SEQ ID NO: 4332 - DNA, 3551 bp, Quercus alba
ttcaagcattagaattagatctcctgtctagttaagaggagtcatggaaagaacaggttcaaaatcgcgatcaatcctttttcaaatcctgctgcagctgcacgagcccttcctgcatgccataaaatgacctacgaataggaagaatcctagaacaaaatgagaggtagctaaccaacttctaggagagacataattgactgcattgatctcggtagctacaccacccacggaatttaaagaacctaaaggagcatgagtcatatattccgcggaacgtcgttcttgccaaggttgtatgtcttttcagcctactcaagtccaacccattgggaccccttaggggttctaaccagggagcacgcaaatcccaaaacgcatagtttctccccaaaatgacttctccagtcggagaacgcattagatatttacctaaaccggtaggtccttgggcggaccctacgttagccccaaggcgttggtctctaaccagaaagtaatgcttgagcttgagaagcttctggtccagtgggcccgtaaaactcactaggataagcggtattattgaaccaaacaaagcaacaagcaataaaccaaacagctaaagcacctaaactataagacaagtaagcctccccagaccatacaagcgcacggcgcgcccatgcaaaaaggtttggttaagatatgccagattccaccaagtatacaaatggaacccaaccatacatgccctccaattatatcttccaaatcgtccacactaacaatccatccctctcctccaaaaggggatttttagtaaataaccaaatatgacgcttgggctaagggtcaagttggtaatttttcttacatctcccccctcccggggcccaggtatcatatacgcctccaaaataaatagctttgaatactagaagaaaagcacctatacctaacaaaattaagtgaatacccaaaattgtagtcattttatttctatctttccatacataaccgaagaatggaaaaagactcttcaagagtctcggggttcccagaagtgcgtgataaataccgccaaagcccaatactgcagaggaaattaagtgaagtactccagacacaaagtatggaaaggtatctataacttccccaccaggacctaccccccaacctagagtagctaggtgggggaagtaaaattaatccttgttcatacatgggcttttctggtacgaaatgagccacttcaaataggttcattgctccggcccagaatacgattaatccggcatgggctacatgagctcccagtaatttaccggataaattgataagtcgggcattcccggcccaccaagcgaaacctgtggtttcttggtcacgaccggctaaggctaaaagttccattaaagagcgtttccacggggtagaacctcctcagggaatataaggttttcatgaggctgatcttgagccgccatccaagcacgaatgccttcatttaaaagaattatttttggtgtagaacgtctcaaattcaggatcttccgctgcacggatttcctgagaaacgagtcataggcgcgtaggttcagagccaagccgactactccaagagcactcatccataaaccggttactggtacaaataacataaagaaatgtaaccaacgtttattggaaaaagcaaccccaaagatttgggaccaaaagcggttagcggtgaccattgaataagtttcttccgcttgagttgggttaaaagcacggaatgtatttgcgccatcaccatcttcaaataaagtattttctacggtagcaccatgaatagcgcatagaagggcagcgcccaatacaccggcaacccccatcatatgaaatgggttcaatgtccaattatgaaacccttggaaaaagaggatgaatcgaaatatagctgcgacaccaaaactgggcgcaaagaaccaaccagactgacctagcggataaatcaggaatacagaaacaaaaacagcaattggagcagagaatgcgattgcattataaggtcgcaattgaacagatcgagcaagttcaaattgacgtaacatgaaacctatagtccgaaagcgccgtggagagcaacaaaagtccacagaccgcctaattgacaccaacgagtaaaatctccttgtgcttctggaccccatagtaacaacaaagagtgtgctaaactattagcaggagtagaaactgccgcggttaagaagttgcagccttccaaataggaactcgccaatccatgtgtataccatgaagttacaaaggttgtacctgtaaaccaacctcctaacgcgaaataagcacaaggaaagagcaatagaccggaccaacctacaaaaacgaaacggtccctccgtaaccagtcatccataatatcaaataaatcattttcgtctttggtaaatttcccaagggctatagtcatagtgatcctcctattcaactacttcaaccattttcgaacacctcatagcattttcagggcgttcaagacgtctatcatttctatatgatttgatttctcgtacactaccccttctttctaatgggtttcgaatctaaaaatcatttattggtacataacctgactgaggtaaatccatgacttcaattcagttctttttttctagtctgactaaccaaccacctgaaccttgaattgccttgtcttatgactcatcgatcaaatagattaattttttgaaagaactgttcaagaaacaagtgattccttttctcgctaccagttgatccccagacatattcctctcgtttcatcaaccaatcttattcttgaatctcgtttgtgagattgataaaaataaatatctttatgtattccgtataatttctatgtgtattaaactacttattaaactactatagtatcatatattttattacgttatactttaactctttcattttcttttattgtgttatatttctttttctctcatatgaatatacaactcggaagtatatcttttcgcggttcaaagcaagcaatgcacttcgaagatttttttcttatttacctttatctgtcagaaaaatcataaaaaaggagaattcatttcctaatttttttatttttaatattgatattgtatttaatttaataataaaaactgtaaatgaaagcagctttctcgcatacatttttgatcccgttgtcggaacaaaaatttcgcatgtatcgatatggaaatatttggtacatgaatacatgctctgatcaatttagatctatataagatttatatagatctaaattggtcctgtcttgtgttctggaattttaaaatatatttaaatttcatttaaaacggctcgtatgttgtgacttggaataagcctttcttcgtagaagaaggaaatattaatttctccctataacccatctatgaatgataatatttaatcagtaatatcgacaaattcttgcagagccaaaagaaaataaatatgaaaattaaataaaaaaaaggatctaccgactgttacaatttcatctttat

SEQ ID NO: 4333 - DNA, 4760 bp, Secale cereale
tggaaagcaatagtcatatttataatcctccaaggtaccatcaaataaagttgactacatatttgatccctcacttaaccaaaattgtaaaaaaatacaagaagtaggaggggtttaatcatgaatccattgattcttctctttaattcaaatttattacttaaaccgcttttttatttggatatgggggtgagaagagattatttactctttatttcacaagcgggtatagcggatcctgtatccgtgtatacagtatacagagatatatcgaaaaggaacttgtatctgatatctttctagaggctaatataataaatctttttatttttatatggctatgttctatttgtaggagtaaaataaggattaggctgtggagagatggctgagtggttgatagctccggtcttgaaaaccggtatagttctaggaactatcgagggttcgaatccctctctctccttttgcttattgaatacgtttgtttctttcatttttttttttttttttttcttgtcccttatctttctttcataaaaaggaatgaatggctcggctagatggaataaccgagccagaacagaaaaaaagtagaacaggtataaataagaaaatcttagttaagagggttcatgtaaagaacaggttccaaatcacgatcgattcccttttcaaaacctgctgcagcagctcgggctcttcctgcatgccataaatggcccacaaaaaggaagaatcctagaacaaaatgagaagttgataaccaacttctaggagagacataattaactgcattgatctcggtagctacgccacccacggaatttaaagagcctaaaggagcgtgggtcatatattctgctgagcgtcgttcttgccaaggttgtatgtcttttttcaacctactcaagtccaaaccgttggggccccttagaggttctaaccatggagcacgaaggtcccaaaaacgcatagtttcccctccaaagataacttccccagttggggaacgcattagatatttacctaaacctgtgggtccttgagcggatcccacattagctccaagacgctggtctctaactagaaaagtaaatgcttgagcttgagaagcttctggcccggtgggtccataaaactcactcggataagctgtattattgaaccatacaaaacaacaagcgataaaaccaaagacagataaagcagctaaactataagacaagtaagcttctccagaccatacaaatgcacggcgagcccatgcgaagggtttggttaaaatatgccaaattccgccaaatacacaaataaaacccaaccatacatgtccaccaattatatcttctaaatcatctacactaacaatccacccttctccaccaaaaggagattttagtaaataaccaaatataacactgggactaagggtcaaattggtaatttttcttacatctccccccccaggggcccaggtatcatatacaccgccaaaataaagagccttgagtactagaagaaaagcacctagacctaacaaaattaagtgaatacccaaaattgtagtcattttatttcgatctttccagacataaccaaagaatggaaaagattcctcaagagtctcgggtcccagaagcgcgtgataaatgccaccgaagcctaagactgcggaggaaattaggtgaagtacgccagatacaaagtatggaaaagtatctagaacttccccccctggccctactccccaacctagagtagctaagtgtggaagtaaaatcaacccttgttcatacatgggcttttctggtacgaaatgggccacttcaaataggttcattgctccggcccagaatacgattaatccggcatgggctacatgagctccaagtagtttaccggacaaattgataagtctggcattcccagcccaccaagcaaagccggtggtttcttggtcacgaccagctaaaacgaaagttccattaaagagcgtttccacgtggtagaacctcctcagggaatataagattttcatgaggctgatcctgagctgccatccacgcacgaataccctcgtttaaaagaatatttttggtgtagaaagtctcaaattcaggatcttccgctgcacggatttcctgggaaacaaagtcataggcacgtaagttcagagccaagccaactacgccaatagcactcatccataaaccggtgacgggtacaaatagcataaagaaatgtaaccaacgtttattggaaaaagcaacaccaaagatttgggaccaaaagcggttagcagtgaccattgaataagtttcttcagcttgagttgggttaaaagcacggaaggtatttgcaccatcaccgtcctcaaatagagtgttttctacggtcgctccatgaatagcgcatagcagagctgcacctaatactccggcaactcccatcatatgaaatgggttcaacgtccaattatgaaatccttggaagaaaaggatgaatcgaaatatcgctgctacgccaaaactcggcgcaaagaaccaaccagattgccccagtggataaataaggaatacagaaacaaaaacagcaattggaccagagaatgagattgcattataaggccgcaattgaacagatcgagcaagttcaaattggcgtaacatgaaacctattagtgcaaaagccccgtggagagctacaaaagtccatagaccgcctaattgacaccaacgagtaaaatctccttgtgcttcgggcccccatagtagcaacaaagagtgtgctaaactattggcaggggtagaaactgctgcggttaagaaattacaaccttccaaataggaactagccaatccatgggtataccaagaagttacaaaagttgtccctgtaaaccaaccccctaaagcgaaataagcacaaggaaagagcaataggccagaccatcctacaaaaacgaaacggtcccttcgtaaccagtcatccatagtatcaaatagatcattttcttctttaggaattctaccaagggctatagtcatagtgatcctcctattcaattacttcaaccatttccgagcacctcatatcactttccaaggcatatgatagttttattatctgtggacgatttctttctcgttcaatgccctttttcaatggtctcgaagagagaaatttcctatttttatctatggagtcacaatcgaggtcgtggtaaatccatgaatttgattcgatttgtttttcttatactatttgtttttcttatactatagaaagaaatagaaataaattgtttttcttatactatagaaagaaataaacctttgaattcagcattattccaagactcctatttcaaagtctatcttttaagggaaaaatgaaaataaaagtaacccttcttttcccattccctctctattgcatgggtagaagaactaaaatagaggattctgaaaaaaaaaaatggaccttcgaaatcaaattttatgtgtagcgcaaaggagttgcgatttcttcttattcctatagaacatctagtaacaagaatatgaaatcgtaaatagcgaaaaattcttgtcttgcgcggtctaagtctaaggaaatacaaaaaattcgcttatacaatttcatctacatcgaatttatatatcagaatagcggatagaggcatcattaaaggagtcaggtctacttactttatgcttctttccaattttatggtggatttgataagaaccctttttgctttcttgataaataatcgaacaaaaaaagcgtttttttttttattttatatataatctgcttgttttattataattataacaagttataattataacaagtcctatatggaaatgcccgctaaagagaaaatctatttgattgtctctcggccaatatcgatttttagaaagaaaaaacaagaattttcttctttttttattaacattaagaaaaaagaatataactaaaatggaattggcaatataatttttatagactttggaaagaaaaaaagggggttttttgcaaccgttatttcttatttcttgcctatatcatatcacggaaacctttcgctttggaacgtggagagatggctgagtggactaaagcggcggattgctaatccgttgtacaatttttttgtaccgagggttcgaatccctctctttccgctcccttggatcatttgggactttcgaattggaaagaattctgacccccggattttctcatagataaatgtacgaaacaaatccaatttgtaagaaaaaaaaaagaatttttactcctcgcgtccaggattccgtcctgggtcattagataagaatccaaagataaagagtgaaacaaagaatatcactactgtataaacaaaaagtttgagagtaagcattacataatctccaagatttttttttaaggaatagattaccagtttttccttaccacacggatccactaggatggttttttttgatacctaaaaatgcaaaaaaaaaaaagaattcttgaaaaaaaattgcaagaattcttttataataagcactcttatcaatagaaaaaatagggttaggtggttaggtattgtgtaggtacctgctcaacctaggtgcaggggagtagaaaggctgatccaaatttattttattgctgtagctacccattcaatgtagaagaatttaaattttagaatcgaaggttcataatataaaaatataaaacttctcggcttt

SEQ ID NO: 4334 - DNA, 5386 bp, Sequoia sempervirens
agattttcagcccaaaagatcttaaaacatatcttaagatatgaaagaatttagaatacctactaaaaagactaatccaatccataatgatacgcctgaaaatagtacatttttgttacttgaccaaccattaggagaggcaagtgcgacaggtacaccaatcactagtagaattgaaattgcaattaatgcaaacacagacgattggaacgcaatagtcatggttgtgatcttaaaagtttccaacaaattcaaaaggctataccattcgatccctatccggtcaaatttgaataaaatgcactacggatttttatttgatcataaattcatcgaaattatcagattcttcttttagtataaaagagtcagggaatttatatctttttatcatcatgatatatgaatattatatatatatgtctattagccctatagacagatattatccgtcgagataaaatgagttatgctagttcgggagagatggccgagtggttgatggctctggtcttgaaaaccggtatagttcaaaaactatcgagggttcgaatccctctctctccttttgttcgtcgaacaactaaaactaacttacgaaaaagaaaatcctagaacttagttcagtaccaaaaaaatgctcggctctcggctatatataatatagccgagcaacaaggattcagttggaagaataatgacaaaggatatcgctatcccgccttccaataaaaataaattggatatttatctagttttatctctggtttaattaagaggggtcatggaaagaacaggttcaaaatcacgatcaattcctttctcaaatcctgctgcagctgcgcgagctcttcctgcatgccacaaatgacctacgaaaaagaaaaatcctagaacaaaatgagaggtggctaaccaacttcgaggtgagacataattgaccgcattaatctcggtagctacaccacccacagaatttaaagaacctaaaggagcatgagtcatatattctgctgaacgtcgttcttgccagggttgtatgtcttttttcaacttactcaggtccaaaccattaggaccccttagaggttccaaccagggagcacgaagatcccaaaaacgcatcgtttcccctccaaaaataatttctccagtaggagaacgcattagatatttacctaaaccagtaggcccttgggcagaccccacactagctccaagacgttggtctctaactagaaaagtaaatgcttgtgcttgagaggcctctgggccggtaggtccatagaattcactgggataagctgtattgttaaaccaaacaaaacaacaagcaatgaaaccaaagacagagagagccgctaaactataggataagtaagcttctccagaccatacaaacgcgcggcgagcccatgcaaaaggttttgttaagatgtgccagataccaccgaagatacaaatggaacctaaccaaacatgtcctccaattagatcttccagattgtccacgctaacaatccatccctcccctccaaaaggggatttgagtaaataaccaaatatagtacttgggttaagcgtaaggttcgtaatttttcttacatctccaccgccgggagcccaggtatcgtatataccaccaaaatacaaagccttaaacactagaagaaaagcaccaacacctagcaagattaggtgaatacctaaaattgtagtcattttgttcctatctttccatacataaccaaaaaatggaaaagattcttctaaagtttcgggtccgattagtgcgtgataaataccaccgaagcctaaaactgcagaagaaattaagtgaagtaccccggatacaaaatagggaaaagtgtccacaatttccccaccaggaccgactccccatcctagagtagctagatggggaagtagaatcaatccctgttcatacataggtttttccggtacaaaatgagccacttcaaacagattcattgctccagcccagaatacaattaatccggcatgagccacatgagccccaagtaatttgcctgacaaattaatgagtcgggcattaccggcccaccaagcgaaaccagtggtttcttggtcacgaccagctaaagttagagttccattaaagagcgtttccacggggtagaacctcctcagggaatataaggttttcatgaggctgatcctgagccgccatccaagcacgaataccttcgttcaaaagaatattttttgtataaaaagtctcaaattcaggatcttctgctgcacgaatctcctgggaaacaaaatcataagcacgtaagtttagagctaggccaactactccaatggcactcatccataaaccggtcaccggcacaaataacatgaagaaatgtaaccaacgtttattggaaaaagcaaccccaaaaatttgggaccagaaacggttcgcagtgaccatagaataagtctcttcggcttgagttgggttaaaagcacggaatgtatttgcaccatcaccgtcttcaaataaagtattttccacggtagcaccgtgaatagcacatagaagagcagcacccaatactccagcaactcccatcatatgaaatggattcaaggtccaattatgaaaaccttgaaaaaagaggataaatcggaaaatagctgctacgccaaaactaggcgcaaaaaaccaaccagactgacctaatggatagatcaagaatacggaaacaaaaacagcaatcggagcagagaacgcaattgcattataaggtcgtaattgtacagatcgagcaagttcaaattggcgtaacatgaagcctattagaccaaaagcaccatgaagagcaacgaaagtccatagaccacctaattgacaccaacgagtaaaatctccttgtgcttcaggaccccataatagcaacaaagaatgtgctaaactattagcaggcgtagaaactgcagcagttaaaaaattacaaccttccaaataggagctagccaatccgtgagtataccacgaagtcacaaaagttgtacccgtgaaccatccacctagcgcaaaataagcacaaggaaaaagcaatagaccggaccaacccacaaagacaaaacggtctctgcgtagccagtcatccataatatcaaataaagtttgttcctctttggaagactttccaagggctatagtcatagtgatcctcctatttaactattccaaccttttccgagcaccctatctgatagaatcaaagggtatacgctgatttgtatatttatggacaatttttcatccatcatccctttcaacaaatcgggttccgaagattccttattggcacagattttattctgttaaactcaactaatacaatataagtaaatgcatgataacccgaagttgtttctattcgattttttcttatcctaaaattatcttctgaatgtaataagtagaaacagaacaattgccggaaaagcaagttagcttttcttcctccctgctcttcactagagactgttcacaaaatcaattctattgaatattattacgtcttgaaccttactcatagtaatatttctaactattttatgaatctctatgcttttttactactacattatttctacgaataaataggaacaacaagaaggaaatatttctatagctcatagagctagaggaaagaactctattcgttcctttccatttttccaattcataagtaaaaaaaagcgatactatttgagtataatgaaaaatgaacagttcctttgttttccataaccctgaaattgaagactccacattatttggtaaggcgttgggagaaaccaacaagtacacatctatagctcagggatttgttacagaagatggattgcagttgcacagagcaagagttttgggaggggaaccgctttgaatgctggtttctacagcagggcgagcttggaatacattaaaaatatgagatggaatgagaggcttgtgaataagtcatatgagtgggtggaggagcagaatgctttccaaccaaagaagctttctcgttggtcttcctcttttcgaaatgcccttttggaagctggagtgctccctttcaatgggtatactgtgaatcatgtggagggcaccaagattagtgcctctacgtatgataacaataataagagacatacggctgcagatcttcttaagcaagcaaatccacaaaacatcgttgttcttctcaatgctacagtcaacagaatcctcttcaacactgaattaggaaaaccgaaggctgaaggggtcgaattcataaactcggttactggtgataaatctcatcaagtattcctgaataaagattcatgtcgcagtgaagtaattgtttcagcaggaagcataggcagtcctcaggtcctcctattgagtggaataggcccttcccaacatctcaagaaattcaatattcctgtccttgtcgatttaccctcagttgggcaaggggcccaagatagtcctcgtgcaaccatgatagtggagtcaccaataccccttgaaatctccagcatacaggtggcaggtatacttcacggttccaaactttacattgagtccgccagttctgtgtcacaggttccctcaagtaccgggggaggggcaacaaggacccaatatcttggactaatttttgccaaaatagcatttcccatgtcaaggggacagatccaactaacaagtacagatccccgaaataatccttcagttagttacaactattactctcaccctacggatatgcaaacttgcatgcagggtgtgaagaaatagccaagcttagtgaaaccccttctattcagcagtttgcatttaagaacaagtctagcggaaaaagtgagcttcgattcattgggcaggcattgcccgagactacatcggatgaagaagctgtggccaagttctgcaaagctacactaaacacaatgtggcatttccatggagggtgtcatgttggttctgtcattgaaagaaatcataaagtaaaaggggttcgtggcctcaggattgtggatggttccactttcaaggacggccctgggaccaatccacaggcaactaccatgatgcttggcaggtacatgggaatgaggatccttaaagagcgtctcaaacagaaccgtagccaagtcttagaagaaggcaaggacaagaaggcttttactgatatgaatatcattggtgccttccatgtataagataaacgtatttatggatttattaacccttattattttggctgccattggaagagtgaagtctgcactgcccatcaatatgataatggcaaataaaatgacaatatccttgtcttatcagtaatgaagatttctc

SEQ ID NO: 4335 - DNA, 1548 bp, Hordeum vulgare
atgaaaatcttatattccctgaggaggttctaccacgtggaaacgctctttaatggaactttcgttttagctggtcgtgaccaagaaaccaccggctttgcttggtgggctgggaatgccagacttatcaatttgtccggtaaactacttggagctcacgtagcccatgccggattaatcgtattctgggccggagcaatgaacctatttgaagtggcccatttcgtaccagaaaagcccatgtatgaacaagggttgattttacttccacacttagctactctaggttggggagtagggccagggggggaagttctagatacttttccatactttgtatctggcgtacttcacctaatttcctccgcagtcttaggcttcggtggcatttatcacgcgcttctgggacccgagactcttgaagaatcttttccattctttggttatgtctggaaagatagaaataaaatgactacaattttgggtattcacttaattttgttaggtctaggtgcttttcttctagtactcaaggctctttattttggcggtgtatatgatacctgggcccctggggggggagatgtaagaaaaattaccaatttgacccttagtcccagtgttatatttggttatttactaaaatctccttttgggggagaagggtggattgttagtgtagatgatttagaagatataattggtggacatgtatggttgggttttatttgtgtatttgggggaatttggcatattttaaccaaacccttcgcatgggctcgccgtgcatttgtatggtctggagaagcttacttgtcttatagtttagctgctttatctgtctttggttttatcgcttgttgttttgtatggttcaataatacagcttatccgagtgagttttatggacccaccgggccagaagcttctcaagctcaagcatttacttttctagttagagaccagcgtcttggagctaatgtgggatccgctcaaggacccacaggtttagggaaatatctaatgcgttccccaactggggaggttatctttggaggggaaactatgcgtttttgggaccttcgtgctccatggttagaacctctaaggggccccaacggtttggacttgagtaggttgaaaaaagacatacaaccttggcaagaacggcgctcagcagaatatatgacccacgctcctttaggctctttaaattccgtgggtggcgtagcgaccgagatcaatgcagttaattatgtctctcctagaagttggttatcaacttctcattttgttctaggattcttcttttttgtgggccatttatggcatgcaggaagagcccgagctgctgcagcaggttttgaaaagggaatcgatcgtgatttggaacctgttctttacatgaaccctcttaactaagattttcttatttatacctgttctactttttttctgttctggctcggttattctatctagccgagccattcattcctttttatgaaagaaagataagggacagaataaaaaaaaaaaaaaaaaaac

SEQ ID NO: 4336 - DNA, 1464 bp, Marchantia polymorpha
atgaaggtattagagcttggatggcagctcaagatcagcctcatgaaaatcttgtattcccagaggaggttctaccccgtggaaacgctctttaatggaactttagctttaggtggtcgtgatcaagaaaccacaggttttgcttggtgggcaggtaatgctagacttattaatttatctggaaagttacttggagctcatgtagctcatgctggattaattgttttttgggctggagcaatgaatttgtttgaagttgctcattttgtaccagaaaaacctatgtatgaacaaggattaatactacttcctcatttagctactttaggttggggagtaggacctggtggagaaattgttgatacttttccatattttgtgtctggagttcttcatttaatttcttctgcagttttaggttttggtggtatttatcatgcacttattggaccagaaactttagaagaatcttttccgttttttggttacgtttggaaagacaaaaacaaaatgactactattttaggtattcatttaattttgttaggtgctggtgcttttcttttagtatttaaagccttatattttggtggtatttatgatacatgggctccaggtggtggagatgtaagaaaaattacaaatttaactcttagtccaggtgtaatctttggttatttacttaaatctccatttggtggagaaggttggattgttagtgtagataatttagaagatatcattggcgggcatgtatggttaggttccatttgtatttttgggggaatctggcatattttaacaaaaccttttgcatgggctcgtcgtgctttggtatggtctggggaagcttacttatcttatagtttaggtgctattgctgtttttggttttattgcttgttgttttgtttggttcaataatacagcttatccgagtgaattttatggtcctaccggtccagaagcatctcaagctcaagcttttacttttttagttagagatcaacgtcttggagctaatgtaggttcagctcaaggacctactggattagggaaatatattatgcgttcgcccactggagaaattatttttggtggagaaacaatgcgtttttgggatcttcgtgctccatggttagaaccattacgtggaccaaacggtttagatctaagtaaattaaaaaaagatatacaaccttggcaagaacgtcgatctgcagaatacatgactcatgctccattaggatcattaaattctgtaggtggagtagcaacagaaattaatgcagtaaattatgtttctcctagaagttggttagcaacatctcatttcgttttaggtttctttttctttgtagggcacttatggcatgctggaagagcacgtgctgctgcagctggttttgaaaaaggaattgatcgtgattttgaaccagttctttctatgacacctcttaattaa

SEQ ID NO: 4337 - DNA, 1422 bp, Oryza sativa
ttagttaagtggggtcatgtaaagaacaggctccaaatcacgatcgattcccttttcaaatcctgctgcagcagcccgggctcttcctgcatgccacaaatggcccacaaaaaagaagaatcctagaacaaaatgggaagtcgctaaccaacttctaggagaaacataattaactgcattgatctcggtagctacgccacccacagaatttaaagagcctaaaggagcatgggtcatatattctgccgaatgtcgttcttgccaaggttgtatgtcttttttcaacctactcaagtccaaaccgttggggccccttagaggttctaaccatggagcacgaaggtcccaaaaacgcatagtttcccctccaaaaataacctctcccgttggggaacgcattagatatttacctaaacctgtgggtccttgggcagatcccacattagctccaagacgctgatctctaactagaaaagtaaatgcttgagcttgagaagcttctggcccagtaggtccataaaactcactcgaataagctgtattattgaaccagacaaaacaacaagcgataaaaccaaagacagataaagcgcctaaactataagacaagtaagcttctccagaccatacaaatgcacggtgagcccatgcgaagggtttggttaagatatgccaaattccgccaaatacacaaatgaaacccaaccatacatgtcccccaattatatcttctaaatcatccacactaacaatccaaccctctcccccaaaaggggattttagtaaataaccaaatataacaccggggctaagggtcaaattggtaatttttcttacatctcctcccccaggagcccaggtatcatatataccgccaaaataaagagctttgagtactagaagaaaagcacctatacctaacaaaattaggtgaatacccaaaattgtagtcattttatttctatctttccacacataaccaaagaatggaaaagattcttcaagagtctccggtcccagaagcgcgtgataaatgccaccgaagcctaagactgcggaggaaattagatgaagtactccagatacaaagtacggaaaagtatctagaacttctcccccgggccctactccccaacctagagtagctaagtgcggaagtaaaatcaacccttgttcatacatgggtttttctggtacgaaatgggccacttcaaataggttcattgctccggcccagaatacgattaatcctgcatgggctacgtgagctccaagtagtttacccgacaaattgataagtctggcattcccggcccaccaagcaaaaccggtggtttcttggtcacgaccagctaaaacaaaagttccattaaagagcatttccacgtggtagaacctcctcagggaatataagattttcat

SEQ ID NO: 4338 - DNA, 13712 bp, Hordeum vulgare
cgcgatcgaagtagaagtaccaatggctcagtgtcatgaaccttctccatctgattcaataagggggaattagcctccttgtcaaatggctatccttgacaaagggtaccatttataccataatatacaatgtagcgggtatagtttagtggtaaaagtgtgattcgttctattaataactgaatttgaaatgatatacttaaggcatccttaagtttttttttatattccgatgaaaactttagttcttataaaggattaaatccttttcctctcaatagcatattgaggaagaatatacattctggcgatttgtacccaaaaactaatttaaattgcatccaaaataaaaattggattatgatatgagtacagagtcgcgaagcataattttgcattggatttaagtattccaattttgaaaatatgagtaaaggatctatggatgaagatacaaaaaagttgatttccaatcgtaactaaatcttcttttgttaaaggataaggaagccaaatagctaaaaaacgatagttttggtttactagaaccatccgcatattgtttcagctcggtggaaacccaattcttttcctcaggatctcttgaatgaaattagggaacgaagtaagtagattagatggatttagatagaatttctatctcctactctataaggatcatctagaaagcagagagctttggttccattcaaatagaaaagctgacatagatgttaagtggtgagaatatccataaaggagccgaatgaaatcaaaatttcatgttcggttttgaattagagacgttaaaaataatcaaccaacgtcgactataacccctagccttccaagctaacgatgcgggttcgattcccgctacccgctccattctgtataaaaggagtattctatttgtctagacatgttaaaggcttgtattcaagccttttttgtccaccagtttctggtactacagagcggagtagagcagtttggtagctcacgaggctcataaccttgaggtcacgggttcgattcccgtctccgcacttagcagtctctataaaaggagtattctatttctctagatatggtagaggggcgtatccaacccttttttattcattagttccgggccctagagggcaaaattgagcaatttgcgaagccacttgccttcacaaaaagaaggcgcaaggcttctccctaccttgcagaaaataaaaatgaaatgaaagggacagtctacctctcccttccttttaaaaacagtttgcccgttgtttgtctcagttaatacccaattttggggctctgttggctagttctatttctgcctccggagcgccctctttttttgagggggatgcaaaggaagggtaaatatagtaagggatacggcactagactaatacttaattaatacttaatttaatataagtagttaaacaattaactagactaaactttttatcatagtactttgataaattaagcgggcgagcggcgggaatcgaacccgtatcttctccttggcaaggagatgttttaccattgaactacgctcgctacggtatatattttatagcgtatatccgcttgggtcgaccgtctatgtctgggtcgaccgtttcatttcattttctattctattatattagatattagagttttcctttttttattatctgtcaatgaatattctaatgggaatttcataatactgaaagagaagagctagcaattcggaacgcaaattgcgttttaatacgtctcactattcgaattttttaaatggcctttattatttcttttttatggggttactaaatattaaccaaatttaatttaagaaatgagagaattcagaatagctacgagaaagactagtccaatccataatgatgtaccggaaaatacaacatttttattatttgaccaaccatcaggagaagcaaatacaaggggtacactaattactaagactgaggaagtcgcaattaatgcaaaaacagctaattggaaagcaatagtcatatttctaatcctccaagctaccatcaaataaagttgactacatatttgatccctcacttaaccaaaattgtaaaaaaatacaagaagtaggaggggtttaatcatgaatccattgattcttctctttaattaaaatttattacttaacctcttttttatttggatatgggggtgagaggaggttatttagtctttatttcacaagcgggtatagcggatcctgtatccgtgtatacagtatacagagatatatcgaaaaggaacttgtatctgatatctttctagaggttaataaatatttttattttttatatggctatgttctatttgtaggagtaaaataaggattaggcggtggagagatggctgagtggttgatagctccggtcttgaaaaccggtatagttctaggaactatcgagggttcgaatccctctctctccttttgcttattgaatacgtttgtttctttcatttttttttattctgtcccttatctttctttcataaaaaggaatgaatggctcggctagatagaataaccgagccagaacagaaaaaaagtagaacaggtataaataagaaaatcttagttaagagggttcatgtaaagaacaggttccaaatcacgatcgattcccttttcaaaacctgctgcagcagctcgggctcttcctgcatgccataaatggcccacaaaaaagaagaatcctagaacaaaatgagaagttgataaccaacttctaggagagacataattaactgcattgatctcggtcgctacgccacccacggaatttaaagagcctaaaggagcgtgggtcatatattctgctgagcgccgttcttgccaaggttgtatgtcttttttcaacctactcaagtccaaaccgttggggccccttagaggttctaaccatggagcacgaaggtcccaaaaacgcatagtttcccctccaaagataacctccccagttggggaacgcattagatatttccctaaacctgtgggtccttgagcggatcccacattagctccaagacgctggtctctaactagaaaagtaaatgcttgagcttgagaagcttctggcccggtgggtccataaaactcactcggataagctgtattattgaaccatacaaaacaacaagcgataaaaccaaagacagataaagcagctaaactataagacaagtaagcttctccagaccatacaaatgcacggcgagcccatgcgaagggtttggttaaaatatgccaaattcccccaaatacacaaataaaacccaaccatacatgtccaccaattatatcttctaaatcatctacactaacaatccacccttctcccccaaaaggagattttagtaaataaccaaatataacactgggactaagggtcaaattggtaatttttcttacatctccccccccaggggcccaggtatcatatacaccgccaaaataaagagccttgagtactagaagaaaagcacctagacctaacaaaattaagtgaatacccaaaattgtagtcattttatttctatctttccagacataaccaaagaatggaaaagattcttcaagagtctcgggtcccagaagcgcgtgataaatgccaccgaagcctaagactgcggaggaaattaggtgaagtacgccagatacaaagtatggaaaagtatctagaacttccccccctggccctactccccaacctagagtagctaagtgtggaagtaaaatcaacccttgttcatacatgggcttttctggtacgaaatgggccacttcaaataggttcattgctccggcccagaatacgattaatccggcatgggctacgtgagctccaagtagtttaccggacaaattgataagtctggcattcccagcccaccaagcaaagccggtggtttcttggtcacgaccagctaaaacgaaagttccattaaagagcgtttccacgtggtagaacctcctcagggaatataagattttcatgaggctgatcctgagctgccatccacgcacgaataccctcgtttaaaagaatatttttggtgtagaaagtctcgaattcaggatcttccgctgcacggatttcctgggaaacaaagtcataggcacgtaagttcagagccaagccaactacgccaatagcactcatccataaaccggtgacgggtacaaatagcataaagaaatgtaaccaacgtttattggaaaaagcaacaccaaagatttgggaccaaaagcggttagcagtgaccattgaataagtttcttcagcttgagttgggttaaaagcacggaaggtatttgcaccatcaccgtcctcaaatagagtgttttctacggttgctccatgaatagcgcatagcagagccgcgcctaatactccggcaactcccatcatatgaaatgggttcaacgtccaattatgaaatccttggaagaaaaggatgaatcgaaatatcgctgctacgccaaaactcggcgcaaagaaccaaccagattgccccagtggataaataaggaataccgaaacaaaaacagcaattggaccagagaatgagattgcattataaggccgcaattgaacagaccgagcaagttcaaattggcgtaacatgaaacctattagtgcaaaagccccgtggagagctacaaaagtccatagaccgcctaattgacaccaacgagtaaaatctccttgtgcttctggcccccatagtagcaacaaagagtgtgctaaactattggcaggggtagaaactgctgcggttaagaaattacaaccttccaaataggaacttgccaatccatgggtataccaagaagttacaaaagttgtccctgtaaaccaaccccctaaagcgaaataagcacaaggaaagagcaataggccagaccatcctacaaaaacgaaacggtcccttcgtaaccagtcatccatagtatcaaatagatcattttcttctttaggaactctaccaagggctatagtcatagtgatcctcctattcaattacttcaaccatttccgagcacctcatatcactttccaaggcatatgatagttttatatctgtggacgatttctttctcgttcaatgccctttttcaatggtctcgaagagagaaattttccatttttatctatggagtcacaaccgaggtcgttgtaaatccatgaatttgattcgatttgtttttcttatcttatacttatagaaataaacctttgaattcagcattattccaagactcctatttcaaagtctatcttttaagggaaaaatgaaaataaaagtaaccccttttttcccattccctctctattgcatggggggaagaactaaaatggaggattctgaaaaaaaaaaggaccttcgaaatcaatttttatgtgtagcgcaaaggagttgcgatttcttcttattcctatagaacatctagtaacaagaatatgaaatcgtaaatagcgaaaaattcttgtcttgcgcggtctaagtctaaggaaatacgaaaaattcgcttatacaatttcatctacatcgaatttatatatcagaatagcggatagaggcatcattcaaggagtcaggtctacttactttatgcttctttccaattttatggtggatttgataagaaccctttttgctttcttgataaataatcgacaaaaaaaaaaaaagcgtttttttatatatagcttgttttattataattataacaagtcctatatggaaatgcccgctaaagagaaaatctatttgattgtctctcggtcaatatcgatttttacaaagaaaaaacaagaattttcttcttttttttattaacattaagaaaaaagaatataactaaaatggaattggcaatataatttttatagacttttgaaagaaaaaaaggggttttttgcaaccgttatttcttatttcttgcctatatcatatcacggaaacctttcgctttggaacgtggagagatggctgagtggactaaagcggcggattgctaatccgttgtacaatttttttgtaccgagggttcgaatccctctctttccgctcccttggatcatttgggactttcaaactggaaagaattctgacccccggattttctcatagataaatgtacgaaacaaatccaatttgtaagaaaaaaaaaaaattgaatttttactcctcgcgtccaggattccgtcctggatcattagataagaatccaaagataaagagtgaaacaaagaatatcactactgtataaacaaaaagtttgagagtaagcattacataatctccaagatttttttttaaggaatagattaccagtttttccttaccacacggatccactaggatggttttttttgatacctaaaaatgcaaaaatgaattctggaaaaaaattgcaagaattcatttataataagaactcttatcaatagcaaaaatagggttaggtggtattgaataggtattgtgtaggtacctaaaggtacctgctcaacctaggtgcaggggagtagaaaggctgatccaaatttattgctgtagctacccattcaatgtagaataatttcaattttagaattgagggttcataatataaaaatataaaacttctcggcttttacccattttaatttttttttttggaatgaacacatcattcaatttggcatacagagtactaaagatttcatcgaaaacttacagcagcttgccaaacaaaggctaatagaaaaaagaatagaggtataacaggcataatatccacgattggattgaaaatagcataagcttcgggcaatttggcaaagaaaaaactagtaggataaagaacagaattaaaacagatacaggttaaactaagtatattaggcataacaagcatttcattcttgtagagtaaataattggattttgattgagttatttttttaagggaaagaaggaaaaggcagattcaaaatctttttttcttcggactttcccaaacacaaaatacctccttgtattcgcactctcaaatgagagtggaataaattcgactttcatataatatcttaatagaattccatgtaatgatcaatgcatttttttgattctatattatctgcatgtgtagaatactagcaagagaatatctcttctttatttatgtaattgaaatggtattgacgaataacaaataaacataatagtgtttattagtgtcgcataaaacccgaaatggggcgtggccaagtggtaaggcagcgggttttggtcccgttactcggaggttcgaatccttccgtcccagattgtttctgatgaaacaaacggtgaaatcatatagtactccgtatgagacaaaagtttattaaagagaataatgatatcttatgttttctcagaaaacataataaagtcttaagtccagtcaaattgactacctttattttcatgaaaaaaatgggatctagcaggcacattcaggatatgcctctactatgatcacttaataatcacttaataatcacttaatcatatttttttcttccttttggtcttcgagtcgaagaagtaccaaaaacaattaactaccaaaaactttcaatctattcattggaatagtttatttagttattatagttaattgtttttggtacggaaaaaatatattactaatagaattctaattctagtaattaaatgaattaaacttttttggaggttgatagtttatttattgaggaagagtcaatccttctcttctcacttcaagattgatcatctcgagccatccgttgagggtggaaatttaataataaataagttttaagcaaacttgtttagtcgtctttttctatgtttcattcatatgatagaattcgaatatgggtttaaataaattggatcttggcggaggcttcccggataaatacttactttcttttatccatattgctccatagatagcaagttttaattttaattagtatacaaaaaacaaaaccaatgactattcatgattccatccatattggatcaattttctataccactttgcaatgaaaagaggaatgtttgttatggtaaaacttcgtttaaaacgatgtggtagaaagcaacgtgcgacttgaaggacatgatcgattgtggattttgctatccatcattttccatagtaatgaaaatgctcttggctcgacatagcctgttctattcgttccgaaccaaatttgcgcagggtttaagtaacatagtacacgatggagctcgagaggacagagtttattttttatcaagggaaagaatctagggttagtgaaaactaataaattaggccaactttgtcagtctatccttaatatagaaataaatcgaaaggttaaaatacgaagaaagtccaataaaagtatatcagaatcaatcccccttattagatttctatagaagagataaatgctttatcgaaggaaataagaaaaaagggtatgttgctactcttttgaaagaaaaaaataggaattcccgaagtaatgtctaaacccaaggatttcacaaatcaaagataaaggattccagaacaagtaaacacaattttcaattgtctcaacaacagagttggatcagaataaggaataaaagtcaattcgttcgaaatgagacaaagaaaagagtttaaagacgactcaaaaatttttgaaggattttgccttcgaagtttctcaggcagaattagccaacttgagtcatgagtataaatgaaatttgttttttctgtaaggaaattaatggacgtcatagtctaatttctattattatcgacagaaattcgaatcattttctcgagccgtatgaggagaaaacctcctatacgtttctagggggggcgttgtttatctacatctatcccaataagctgtctatcgaatcgttgcaattgatgttcgatctcgaagagaaggaagagatcttcgaaaagtaggtttttatgatccgataaagaatcaaacttgtttaaatgttccagctattctctatttccttgaaaagggtgctcaaccgacaagaactgtttatgatattttaaggaaggcggaattctttaaagaaaaagaaagaactttgagttaattgaagaactaaatgaataaaaaagtaggataggagaagattattagtattcctcgttgtctaattatttagacacaatttacctctttcttaatcctatttggatttatatcgtgccaatccaacataagcccctattttatttactttttctatctaatttgttttcttaccattgtatttccattgacaaaggtctattgaacaaatagaatttgtagatagatgggtctctttatcctcactccatatttaatttttctgcttacacttcgctcaaatgataagggtgttcctcttgcatgtattctcatacaatataatatatattttttttaataaaaatcgctaaaaaaaggagaatttggccatcgtgattagggtcgctcttttttttcactttagtggaatttaaccggacctgttcgttttgccatttgagtgtttttcatggtcgataaaatctttcttttgatgtcttgctagttcaatgttttgacagaagcgcgcggtgtaattccattgatttttggatttcgatcgtatctaagatcctttttttatctgggttgctaactcaatggtagagtactcggcttttaagtgcgactatgatcttttacacatttggatgaaacaacaaattcgtccagactcttggtagagtctagaagaccacgactgatcctcaaaggtaatgaatggaaaaaatagcatgtcgtaataaaatcaatcttttttgaatggaatccaaaattacgattttctgggtctagtgaataaatggatagagcctggctccaattctggtaaaataaaaagcaacgagcttaacttcctaattggaaggattccccgctctaattagacgttaaaaatagattagtgccggatgtggggaaaggttgggttttcctatgagtggaccctttattttttctttttttttagaaatcctaattattcttgattatggattgaataagggatgttatggattgaatgtgtaaaagaagcagtatattgataaagaggctgtattccaaagtcaaaagagcgattggcctgcaaaaataaaaaacttgttctgttcttttttgtaatttagaacaaacataaactaattcggtagaaaaggagcggaaaaagatccgtggattagactccctttctttccagggtttgtattaaaaatgcaacaccctgttctgaccatattgcactatgtatcatcattcgataaaccgagaaatgcttcttctctctgattcaagtagaaatacaaatggaaaaattcgaagggtattcagaaaaacagaaatctcgtcaacaatactttgtctacccacttctctttcaggagtatatttatgcatttgctcatgattatggattaaacggttctgaacctgtggaaatagttagttggaataacaagaaatttagttcactacttgtgaaacgtttaattattcgaatgtatcagcagaattttttggataactcggttaatcatcctaatcaagatcgattattggattacaaaatttttttttattctgagttttattctcagattctatctgaggggtttgcgattgttgtggaaatcccattctcgctacgggaattatcttgtccgaaagaaaaagaaataccaaagtttcagaatttacgctctattcattcaatatttccctttttagaagacaaatttttgcatttggattatctatcacatatagaaataccctatcctatccatttggaaatcttggttcaactccttcaataccgtatccaagatgttccatctttgcatttattgcgattctttctcaactactattcgaattggaatagttttattacttcaatgaaatccattcttttttttcaaaaagaaaataaaagactagttaaattcctatataactcttatgtatcagaatatgaatttttcttgttgtttcttcgtaaacaatcttcttgcttaccattagcatattctggaacttttctggaacgaatccacttttctaggaagatggaacattttgggataatgtaccctggtttttctcggaaaaccttatggttctttatggatcctcttatacattatgttcgatatcaaggaaaggcaattcttgcatcaaaaggcagtttttttttgaaaaagaaatggaaatgctaccttatcaatttctggcaatattatttctttttttggactcagccgcgaagaatccatataaaccaattagcaaactcttgcttcgattttatgggatacctttcaagtgtaccaaaaagtcctttgttggtaaggaatcaaatgctggagaattcatttctcatagatactcgaatgaaaaaattcgataccatagtccccgctactctcctcataggatacttatcaaaagctcaattttgtactggatcggggcatcctattagtaaacccatttggacggatttatcagattgggatattcttgatcgatttggtcggatatgtagaaatctttttcattatcatagtggatcttcgaaaaaacggactttgtatcgactaaagtatatacttcgactttcatgcgctagaactttagctcgtaaacataaaagcacggtacgaacttttatgcaacgattgggttcggcatttttagaagaattttttacggaagaagagcaagttttttctttgatgttcaccaaaacaactcttttttctttcagtggatcacacactgagcgtatttggtatttggatattataggtatcaatgacctggtcaaccctcttaattaatcattagacaaaactaataaacaggaaagggttgataaatgatcaagaaaaaactttcatatttttcattctgaaatgttccttttattataataaagagtaggtgaatcaacttactaattaaaaaattagtagaacttcctctttggaatagaatattggctatttctacatagggaaagtcgtgtgcaatgaaaaatgcaagcacgatttggggagggatttttctctattgtaacaaggaagaattatctactccatccgactagttccgggttcgagtcccgggcaacccatatagaaaagacccatcaaagtttttaacttttactcacttcatttacaaatacaaaattattggtttggttaatttatttatatggatagccaatctttgggctgacttggttgacattggtatatagtctatgttatactgttaaataacaagccttctattatctatattctagttaatacgtgtgcttgggagtccttgcaatttgaataaaccaagatcttaccatgactgcaattttagagagacgcgaaagtacaagcctgtggggtcgcttctgcaactggataactagcactgaaaatcgtctttacatcggatggttcggtgttttgatgatccctaccttattgaccgcaacttctgtatttattatcgccttcatcgctgcccctccagtagatattgatggtattcgcgagcctgtttctggttctttactttatggaaacaatattatctctggtgctattattcctacttctgcggcgatcggattgcacttttacccaatttgggaagctgcatctgttgatgagtggttatacaatggtggtccttatgagctaattgttctacacttcttacttggtgtagcttgttatatgggtcgtgagtgggaacttagtttccgtctgggtatgcgtccttggattgctgttgcatattcagctcctgttgcagctgctactgctgttttcttgatttaccctattggtcaaggaagcttttctgatggtatgcctttaggaatctctggtactttcaactttatgattgtattccaggcagagcacaacatccttatgcatccattccacatgttaggtgtagctggtgtattcggcggttccctattcagtgctatgcatggttccttggtaacctctagtttgatcagggaaactactgaaaatgaatctgctaatgagggttacaaatttggtcaagaggaagagacttataatattgtggctgctcatggttattttggccgattaatcttccaatatgctagtttcaacaactctcgttctttacacttcttcttggctgcttggcctgtagtaggaatctggttcactgctttaggtattagtactatggctttcaacctaaatggtttcaatttcaaccaatctgtagttgatagtcaaggtcgcgttattaatacttgggctgatatcatcaaccgtgctaaccttggtatggaagtaatgcacgaacgtaatgctcacaacttccctctagacttagctgctgttgaagttccagctattaatggataaggtttttctgctaacatataagaatttttgaagaaagaaaagacaaaaatacccaatatcttgttctagcaagatattgggtattttgaatcttttttttcttcttaatctttct

SEQ ID NO: 4339 - DNA, 4123 bp, Hordeum vulgare
ttaagcgggcgagcggcgggaatcgaacccgtatcttctccttggcaaggagatgttttaccattgaactacgctcgctacggtatatattttatagcgtatatccgcttgggtcgaccgtctatgtctgggtcgaccgtttcatttcattttctattctattatattagatattagagttttcctttttttattatctgtcaatgaatattctaatgggaatttcataatactgaaagagaagagctagcaattcggaacgcaaattgcgttttaatacgtctcactattcgaattttttaaatggcctttattatttcttttttatggggttactaaatattaaccaaatttaatttaagaaatgagagaattcagaatagctacgagaaagactagtccaatccataatgatgtaccggaaaatacaacatttttattatttgaccaaccatcaggagaagcaaatacaaggggtacactaattactaagactgaggaagtcgcaattaatgcaaaaacagctaattggaaagcaatagtcatatttctaatcctccaagctaccatcaaataaagttgactacatatttgatccctcacttaaccaaaattgtaaaaaaatacaagaagtaggaggggtttaatcatgaatccattgattcttctctttaattaaaatttattacttaacctcttttttatttggatatgggggtgagaggaggttatttagtctttatttcacaagcgggtatagcggatcctgtatccgtgtatacagtatacagagatatatcgaaaaggaacttgtatctgatatctttctagaggttaataaatatttttattttttatatggctatgttctatttgtaggagtaaaataaggattaggcggtggagagatggctgagtggttgatagctccggtcttgaaaaccggtatagttctaggaactatcgagggttcgaatccctctctctccttttgcttattgaatacgtttgtttctttcatttttttttattctgtcccttatctttctttcataaaaaggaatgaatggctcggctagatagaataaccgagccagaacagaaaaaaagtagaacaggtataaataagaaaatcttagttaagagggttcatgtaaagaacaggttccaaatcacgatcgattcccttttcaaaacctgctgcagcagctcgggctcttcctgcatgccataaatggcccacaaaaaagaagaatcctagaacaaaatgagaagttgataaccaacttctaggagagacataattaactgcattgatctcggtcgctacgccacccacggaatttaaagagcctaaaggagcgtgggtcatatattctgctgagcgccgttcttgccaaggttgtatgtcttttttcaacctactcaagtccaaaccgttggggccccttagaggttctaaccatggagcacgaaggtcccaaaaacgcatagtttcccctccaaagataacctccccagttggggaacgcattagatatttccctaaacctgtgggtccttgagcggatcccacattagctccaagacgctggtctctaactagaaaagtaaatgcttgagcttgagaagcttctggcccggtgggtccataaaactcactcggataagctgtattattgaaccatacaaaacaacaagcgataaaaccaaagacagataaagcagctaaactataagacaagtaagcttctccagaccatacaaatgcacggcgagcccatgcgaagggtttggttaaaatatgccaaattcccccaaatacacaaataaaacccaaccatacatgtccaccaattatatcttctaaatcatctacactaacaatccacccttctcccccaaaaggagattttagtaaataaccaaatataacactgggactaagggtcaaattggtaatttttcttacatctccccccccaggggcccaggtatcatatacaccgccaaaataaagagccttgagtactagaagaaaagcacctagacctaacaaaattaagtgaatacccaaaattgtagtcattttatttctatctttccagacataaccaaagaatggaaaagattcttcaagagtctcgggtcccagaagcgcgtgataaatgccaccgaagcctaagactgcggaggaaattaggtgaagtacgccagatacaaagtatggaaaagtatctagaacttccccccctggccctactccccaacctagagtagctaagtgtggaagtaaaatcaacccttgttcatacatgggcttttctggtacgaaatgggccacttcaaataggttcattgctccggcccagaatacgattaatccggcatgggctacgtgagctccaagtagtttaccggacaaattgataagtctggcattcccagcccaccaagcaaagccggtggtttcttggtcacgaccagctaaaacgaaagttccattaaagagcgtttccacgtggtagaacctcctcagggaatataagattttcatgaggctgatcctgagctgccatccacgcacgaataccctcgtttaaaagaatatttttggtgtagaaagtctcgaattcaggatcttccgctgcacggatttcctgggaaacaaagtcataggcacgtaagttcagagccaagccaactacgccaatagcactcatccataaaccggtgacgggtacaaatagcataaagaaatgtaaccaacgtttattggaaaaagcaacaccaaagatttgggaccaaaagcggttagcagtgaccattgaataagtttcttcagcttgagttgggttaaaagcacggaaggtatttgcaccatcaccgtcctcaaatagagtgttttctacggttgctccatgaatagcgcatagcagagccgcgcctaatactccggcaactcccatcatatgaaatgggttcaacgtccaattatgaaatccttggaagaaaaggatgaatcgaaatatcgctgctacgccaaaactcggcgcaaagaaccaaccagattgccccagtggataaataaggaataccgaaacaaaaacagcaattggaccagagaatgagattgcattataaggccgcaattgaacagaccgagcaagttcaaattggcgtaacatgaaacctattagtgcaaaagccccgtggagagctacaaaagtccatagaccgcctaattgacaccaacgagtaaaatctccttgtgcttctggcccccatagtagcaacaaagagtgtgctaaactattggcaggggtagaaactgctgcggttaagaaattacaaccttccaaataggaacttgccaatccatgggtataccaagaagttacaaaagttgtccctgtaaaccaaccccctaaagcgaaataagcacaaggaaagagcaataggccagaccatcctacaaaaacgaaacggtcccttcgtaaccagtcatccatagtatcaaatagatcattttcttctttaggaactctaccaagggctatagtcatagtgatcctcctattcaattacttcaaccatttccgagcacctcatatcactttccaaggcatatgatagttttatatctgtggacgatttctttctcgttcaatgccctttttcaatggtctcgaagagagaaattttccatttttatctatggagtcacaaccgaggtcgttgtaaatccatgaatttgattcgatttgtttttcttatcttatacttatagaaataaacctttgaattcagcattattccaagactcctatttcaaagtctatcttttaagggaaaaatgaaaataaaagtaaccccttttttcccattccctctctattgcatggggggaagaactaaaatggaggattctgaaaaaaaaaaggaccttcgaaatcaatttttatgtgtagcgcaaaggagttgcgatttcttcttattcctatagaacatctagtaacaagaatatgaaatcgtaaatagcgaaaaattcttgtcttgcgcggtctaagtctaaggaaatacgaaaaattcgcttatacaatttcatctacatcgaatttat

SEQ ID NO: 4340 - DNA, 1495 bp, Hordeum vulgare
aatggctcggctagatagaataaccgagccagaacagaaaaaaagtagaacaggtataaataagaaaatcttagttaagagggttcatgtaaagaacaggttccaaatcacgatcgattcccttttcaaaacctgctgcagcagctcgggctcttcctgcatgccataaatggcccacaaaaaagaagaatcctagaacaaaatgagaagttgataaccaacttctaggagagacataattaactgcattgatctcggtcgctacgccacccacggaatttaaagagcctaaaggagcgtgggtcatatattctgctgagcgccgttcttgccaaggttgtatgtcttttttcaacctactcaagtccaaaccgttggggccccttagaggttctaaccatggagcacgaaggtcccaaaaacgcatagtttcccctccaaagataacctccccagttggggaacgcattagatatttccctaaacctgtgggtccttgagcggatcccacattagctccaagacgctggtctctaactagaaaagtaaatgcttgagcttgagaagcttctggcccggtgggtccataaaactcactcggataagctgtattattgaaccatacaaaacaacaagcgataaaaccaaagacagataaagcagctaaactataagacaagtaagcttctccagaccatacaaatgcacggcgagcccatgcgaagggtttggttaaaatatgccaaattcccccaaatacacaaataaaacccaaccatacatgtccaccaattatatcttctaaatcatctacactaacaatccacccttctcccccaaaaggagattttagtaaataaccaaatataacactgggactaagggtcaaattggtaatttttcttacatctccccccccaggggcccaggtatcatatacaccgccaaaataaagagccttgagtactagaagaaaagcacctagacctaacaaaattaagtgaatacccaaaattgtagtcattttatttctatctttccagacataaccaaagaatggaaaagattcttcaagagtctcgggtcccagaagcgcgtgataaatgccaccgaagcctaagactgcggaggaaattaggtgaagtacgccagatacaaagtatggaaaagtatctagaacttccccccctggccctactccccaacctagagtagctaagtgtggaagtaaaatcaacccttgttcatacatgggcttttctggtacgaaatgggccacttcaaataggttcattgctccggcccagaatacgattaatccggcatgggctacgtgagctccaagtagtttaccggacaaattgataagtctggcattcccagcccaccaagcaaagccggtggtttcttggtcacgaccagctaaaacgaaagttccattaaagagcgtttccacgtggtagaacctcctcagggaatataagattttcatgag

SEQ ID NO: 4341 - DNA, 1440 bp, Oryza sativa
ataaataagaaaatcttagttaagtggggtcatgtaaagaacaggctccaaatcacgatcgattcccttttcaaatcctgctgcagcagcccgggctcttcctgcatgccacaaatggcccacaaaaaagaagaatcctagaacaaaatgggaagtcgctaaccaacttctaggagaaacataattaactgcattgatctcggtagctacgccacccacagaatttaaagagcctaaaggagcatgggtcatatattctgccgaatgtcgttcttgccaaggttgtatgtcttttttcaacctactcaagtccaaaccgttggggccccttagaggttctaaccatggagcacgaaggtcccaaaaacgcatagtttcccctccaaaaataacctctcccgttggggaacgcattagatatttacctaaacctgtgggtccttgggcagatcccacattagctccaagacgctgatctctaactagaaaagtaaatgcttgagcttgagaagcttctggcccagtaggtccataaaactcactcgaataagctgtattattgaaccagacaaaacaacaagcgataaaaccaaagacagataaagcgcctaaactataagacaagtaagcttctccagaccatacaaatgcacggtgagcccatgcgaagggtttggttaagatatgccaaattccgccaaatacacaaatgaaacccaaccatacatgtcccccaattatatcttctaaatcatccacactaacaatccaaccctctcccccaaaaggggattttagtaaataaccaaatataacaccggggctaagggtcaaattggtaatttttcttacatctcctcccccaggagcccaggtatcatatataccgccaaaataaagagctttgagtactagaagaaaagcacctatacctaacaaaattaggtgaatacccaaaattgtagtcattttatttctatctttccacacataaccaaagaatggaaaagattcttcaagagtctccggtcccagaagcgcgtgataaatgccaccgaagcctaagactgcggaggaaattagatgaagtactccagatacaaagtacggaaaagtatctagaacttctcccccgggccctactccccaacctagagtagctaagtgcggaagtaaaatcaacccttgttcatacatgggtttttctggtacgaaatgggccacttcaaataggttcattgctccggcccagaatacgattaatcctgcatgggctacgtgagctccaagtagtttacccgacaaattgataagtctggcattcccggcccaccaagcaaaaccggtggtttcttggtcacgaccagctaaaacaaaagttccattaaagagcatttccacgtggtagaacctcctcagggaatataagattttcatgag

SEQ ID NO: 4342 - DNA, 1472 bp, Brachypodium distachyon
atgaaaatcttatattccctgaggaggttctaccacgtggaaacgctctttaatggaactttcgttttagctggtcgtgaccaagaaaccaccgggtttgcttggtgggctgggaatgctagacttatcaatttgtccggtaaactacttggcgcccacgtagcccatgccggattaatcgtattctgggccggagcaatgaacctatttgaagtggcccatttcgtgccagaaaagcccatgtatgaacaagggttgattttacttccacacttagctaccctaggttggggagtcgggccagggggagaagttctcgatacttttccgtactttgtatctggagtacttcacctaatttcctccgcagtcttaggcttcggtggcatttatcacgcgcttctgggacccgagactcttgaggaatcttttccattctttggttatgtatggaaagatagaaataaaatgactacaattttgggtattcatttaattttgttaggtctaggtgcttttcttctagtactcaaggctctttattttggcggtgtatatgatacctgggcccccggggggggggatgtaagaaaaataaccaacttgacccttagccccggtgttatatttggttatttactaaaatccccttttgggggagaaggctggattgttagtgtggatgatttagaagatataattggtggacatgtatggttgggtttcatttgtgtatttggcggaatttggcatatcttaaccaaacctttcgcatgggctcgccgtgcatttgtatggtctggagaagcttacttgtcttatagtttagctgctttatctgtctttggttttatcgcttgttgttttgtctggttcaataatacggcttatccgagtgagttttatggacccaccggcccagaagcttctcaagctcaagcatttacttttctagttagagaccagcgtcttggagctaatgtgggatctgctcaaggacccacaggtttaggtaaatatctaatgcgttccccaacgggagaggttatctttggaggggaaactatgcgtttttgggacctccgtgctccatggttagaacctctaagggggcccaacggtttggacttgagtaggttgaaaaaagacatacaaccttggcaagaacgacgttcagcggaatatatgacccatgctcctttaggctctttaaattccgtgggtggcgtagctaccgagatcaatgcagttaattatgtctctcctagaagttggttatcgacttctcattttgttctaggattcttcttttttgtgggccatttgtggcatgcaggaagagcccgagctgctgcagcaggttttgaaaagggaatcgatcgtgatttagaacctgttctttacatgaaccctcttaactaagattttcttatttatacctgttctacttctactgtttttttctgctctgg

SEQ ID NO: 4343 - DNA, 1426 bp, Zea mays
cctcatgaaaatcttatattccctgaggaggttctaccacgtggaaacgctctttaatggaactttcgttttagctggtcgtgaccaagaaaccactggctttgcttggtgggctgggaatgccagacttatcaatttgtccggtaaactacttggagctcatgtagcccatgccggattaatcgtattctgggccggagcaatgaacctatttgaagtggcccatttcgtaccagaaaagcccatgtatgaacaagggttgattttacttccgcacttagctactctaggttggggagtagggccggggggagaagttctagatacttttccttactttgtatccggagtacttcacttaatttcctccgcagtcttaggcttcggtggcatttatcatgcgcttctgggacccgagactcttgaagaatcttttccattctttggttatgtatggcaagatagaaataaaatgactacacttttgggtattcacttaattttgttaggtctaggtgcttttcttctagtactcaaggctctttattttggcggcgtatatgatacctgggccccgggggggggggatgtaagaaaaattaccaatttgacccttagccccggtgttatatttggttatttactaaaatccccttttgggggagaaggatggattgttagtgtggatgatttagaagatataattgggggacatgtatggttgggttccatttgtgtacttggcggaatttggcatatcttaaccaaaccctttgcatgggctcgccgtgcatttgtatggtctggcgaagcttacttgtcttatagtttaggtgctttatctgtttttggttttatcgcttgttgttttgtctggttcaataatacggcttatccaagtgagttttacgggcccactggaccagaagcttctcaagctcaagcatttacttttctagttagagaccagcgtcttggagctaatgtagggtctgcccaaggaccgacgggtttaggtaaatatctaatgcgttccccaacgggagaggttatttttggaggggaaactatgcgtttttgggaccttcgtgctccgtggttagaacctctaaggggccccaacggtttggacttgagtaggttgaagaaagacggccaaccttggcaagaacgacgttcaggagaatatatgacccatgctcctttaggctctttaaattccgtgggtggcgtagctaccgagatcaatgctgttaattatgtctcccctagaagttggttagcgacctcccattttgttctaggattcttcttttttgtgggccatttgtggcatgcaggaagagcccgagctgctgcagcaggctttgaaaagggaattgatcgcgatttggaacctgttgtttacatgacccctcttaactaa

SEQ ID NO: 4344 - DNA, 1386 bp, Solanum tuberosum
gtggaaacgctctttaatggaactttagccttagctggtcgtgaccaagaaaccacaggtttcgcttggtgggccgggaatgcccgacttatcaatctatccggtaaactactaggggctcatgtagcccatgctggattaatcgtattctgggccggagcaatgaacctatttgaagtggcccatttcgtacccgagaagcctatgtatgaacaaggattgattttacttccccacctagctactctaggttggggggtaggtcctgggggagaagttatagacacctttccatactttgtatctggagtacttcatttaatttcttctgcagtattgggctttggcggcatttatcatgcacttctgggacctgagacacttgaagaatcttttcccttctttggttatgtctggaaagatcgaaataaaatgaccacaattttaggtattcacttaatcttgttaggtataggtgcttttcttctagtattcaaggctctttattttgggggcgtatatgataccagggctccgggagggggagatgtaagaaaaattaccaacttgacccttagcccgagtatcatatttggttatttactaaaatccccttttggaggagaagggtggattgttagtgtggacgatttagaagatataatcggaggacatgtatggttaggttccatttgtatacttggtggaatctggcatatcttaaccaaacccttcgcatgggctcgacgcgcacttgtatggtctggagaggcttacttatcttatagtttaggggctttagccgtctttggtttcattgcttgttgttttgtctggttcaataataccgcttatcctagtgaattttacgggcctactggaccagaagcttctcaagctcaagcatttacttttctagttagagaccaacgtcttggggctaacgtgggatccgctcacggacctactggtttaggtaaatatctaatgcgttccccaaccggagaagtcatttttggaggagaaactatgcgtttttgggatctgcgtgctccatggttagagcctctaaggggtccaaatgggttagacttgactaggttgaaaaaagacatacaaccttggcaggaacggcgttccgcggaatatatgactcatgctcctttaggttctttaaattccgtgggtggtgtagctaccgagatcaatgcagtcaattatgtctctcctagaagttggttagctacctctcattttgttctaggattcttcttctttgtaggtcatttgtggcacgcaggaagggctcgtgcagctgcagcaggatttgaaaaaggaattgatcgtgactttgaacctgttcttttcatgacccctcttaattga

SEQ ID NO: 4345 - DNA, 4719 bp, Brachypodium distachyon
ttgataagatccttccatttagtagcaccttaggatggcatagccataaaaaaaagaagaaaattcttcttttttattttgaaaaatagatatgggccgagaggcaatcagatagattgtagcaagcgacgaaatgcttcggggagttgaaaataagcatagatccggagattcccaaataggtcaaagaaaaaacgctttttttcgattttttatcaagaaagcaaaaagggttcttatcaaacccacaataaaataggaaacaaggataaagtaagtagacctgactccttgaattatgcctctatccgctattctgatatataaattcgatatagatgaaattgtataaacgaattttttttattttcttagacttagaccctgcaagataataatttttcgctatttacgattttatattcttgttactagatactctataggaataagaataaatcgcaactcctttccactacacataaaaattgatttcgaaagtcttttttttttaagaatcctccatttttgttcttccacccatgcaatagagagcaaatgggaaaagaggggttactttttttcatttttcccttaaaagataggctttgaaatcggagtcatggaataatggtgaattcaaatgtttagttctttagtataagaagtataagaaaaaagtataagaaaaaaatcgaatccaatttatggatttaccacgacctcggttgtgactccatagataaaaatgaaaaaatttatatcttcgagaccattgaaaaacggcattgcacgagaaagaaatcgtccacagataatcaaactatcatatgccttggaagtgatacgaggtgctcggaaatggttgaagtaattgaataggaggatcactatgactatagcccttggtagaattcctaaagaagaaaaggatctatttgatactgtggacgactggttacgaagggaccgtttcgtttttgtaggatggtccggcttattgctctttccttgtgcttatttcgctttaggagggtggtttacagggacaacttttgtaacttcttggtatacccatggattggctagttcctatttggaaggttgtaatttcttaaccgcagcagtttctacccctgccaatagtttagcacactctttgttgctactatggggcccggaagcacaaggagattttactcgttggtgtcaattaggtggcctatggacttttgtagctctccacggggcttttgcactaataggtttcatgttacgccaatttgaacttgctcggtctattcaattgcggccttataatgcaatctcattctctggtccaatcgctgtttttgtttctgtattccttatttatccactggggcaatccggttggttctttgcgccgagttttggcgtagcagcgatatttcgattcatccttttcttccaaggatttcataattggacgttgaacccgtttcatatgatgggagttgccggagtattaggcgcggctctcctatgcgctattcatggagcgaccgtagaaaacactctattcgaagacggtgatggtgcaaatacttttcgcgcttttaacccaactcaagctgaagaaacttattcaatggtcactgctaatcgcttttggtcccaaatctttggtgttgctttttccaacaaacgttggttacatttctttatgctatttgtccccgtcaccggtttatggatgagtgctattggcgtagttggcctggctctgaacttacgtgcctatgactttgtttcccaggaaatccgtgcagcggaagatcctgaatttgagactttctacaccaaaaatattcttttaaacgagggtattcgtgcgtggatggcagctcaggatcagcctcatgaaaatcttatattccctgaggaggttctaccacgtggaaacgctctttaatggaactttcgttttagctggtcgtgaccaagaaaccaccgggtttgcttggtgggctgggaatgccagacttatcaatttgtccggtaaactacttggcgcccacgtagcccatgccggattaatcgtattctgggccggagcaatgaacctatttgaagtggcccatttcgtgccagaaaagcccatgtatgaacaagggttgattttacttccacacttagctaccctaggttggggagtcgggccagggggagaagttctcgatacttttccgtactttgtatctggagtacttcacctaatttcctccgcagtcttaggcttcggtggcatttatcacgcgcttctgggacccgagactcttgaggaatcttttccattctttggttatgtatggaaagatagaaataaaatgactacaattttgggtattcatttaattttgttaggtctaggtgcttttcttctagtactcaaggctctttattttggcggtgtatatgatacctgggcccccggggggggggatgtaagaaaaataaccaacttgacccttagccccggtgttatatttggttatttactaaaatccccttttgggggagaaggctggattgttagtgtggatgatttagaagatataattggtggacatgtatggttgggtttcatttgtgtatttggcggaatttggcatatcttaaccaaacctttcgcatgggctcgccgtgcatttgtatggtctggagaagcttacttgtcttatagtttagcagctttatctgtctttggttttatcgcttgttgttttgtctggttcaataatacggcttatccgagtgagttttatggacccaccggcccagaagcttctcaagctcaagcatttacttttctagttagagaccagcgtcttggagctaatgtgggatctgctcaaggacccacaggtttaggtaaatatctaatgcgttccccaacgggagaggttatctttggaggggaaactatgcgtttttgggacctccgtgctccatggttagaacctctaagggggcccaacggtttggacttgagtaggttgaaaaaagacatacaaccttggcaagaacgacgttcagcggaatatatgacccatgctcctttaggctctttaaattccgtgggtggcgtagctaccgagatcaatgcagttaattatgtctctcctagaagttggttatcgacttctcattttgttctaggattcttcttttttgtgggccatttgtggcatgcaggaagagcccgagctgctgcagcaggttttgaaaagggaatcgatcgtgatttagaacctgttctttacatgaaccctcttaactaagattttcttatttatacctgttctacttctactgtttttttctgctctggctcggttatttcatttagccgagccattcattcctttttctgaatgaaagataaggggacagaataaagaaaaaaaaatgaaagaaacaaacgtattcaataagcaaaaggagagagagggattcgaaccctcgatagttcctagaactataccggttttcaagaccggagctatcaaccactcagccatctctccacagcttaatccctattttactcctagaaatagaacacagccatataaaaataaaaggatctactaacctctagaaacatctcagatgcaaatcctttttcgatatatttctgtatactgtatacacggatagaagatccgctatacccgcttttgaaataaagactaaatcccctaccctaatccccatatccaaataaaagcggtaagtaataagttttaattattaattaaagagaagaatcaatggattcatgattaaacccctcctacttcttgtattttttacaatttaggttaagtgagggatcaaatatgtagtcaactttatttgatgatagcttggaggattagaaatatgactattgctttccaattagctgtttttgcattaattgcgacttcctcagtcttagtaattagtgtaccccttgtatttgcttctcctgatggttggtcaaataataaaaacgttgttttttccggtacatcattatggattggtctagtctttctcgtagctattctgaattctctcatttcataaatttgtttagtattgagtaacccgatacaaaataaataaaaaggacatttcttcgaaaaaattcgaatagtgagacgcattaaaacgcaatttgcgttccgaattgctacctcttctctttcagtattatgaaattgcattgccattagaatattgattgacagacaatcaaaaaaaggaaaactctaatataatagaaaatgaaacggtcgacccagacatagacggtcgacccaagcggatatacgctataaaatatattccgtagcgagcgtagttcaatggtaaaacatctccttgccaaggagaagatacgggttcgattcccgccgctcgcccgcttactttagtcaagtactatgagaaaaaatttagtctagttgaatgtttaactacttagaataaattatatattaattaggtgttagtctagtaccctatcccttattacccttacttttcaccccactcaaaaaaaggagggctccggagagggaaatagaactctccaacaggggggtattcactgagacaaagaactggcaaactgcttttaaagggaagggaggtagactgtgcgtttctttcatttttcttttctgc

SEQ ID NO: 4346 - DNA, 1462 bp, Arabidopsis lyrata
gacggctcaagatcagcctcatgaaaaccttatattccctgaggaggttctaccacgtggaaacgctctttaatggaactttagctttagctggtcgtgaccaagaaaccaccggtttcgcttggtgggccgggaatgcccgacttattaatttatctagtaaactattgggagctcatgtagcccatgccggattaatcgtattctgggccggagcaatgaacttatttgaagtggcccattttgtacccgaaaagcccatgtatgaacaaggattaattttacttccccacctagccactttaggatggggggtaggtcctgggggagaagttatagacacctttccgtactttgtatctagagtacttcacttaatttcttctgcagttttgggctttggcggtatttatcatgcacttcttggacccaaaactcttgaagaatcttttccctttttcggttatgtatggaaagatagaaataaaatgaccaccattttgggtattcacttaattttgttaggtgtaggtgcctttcttctagtattcaaggctctctattttgggggcgtatatgatacatgggctccgggagggggggatgtaagaaaaattacaaacttgactcttagcccaagtgttatatttggttatttactaaaatctccctttgggggagaaggatggattgttagtgtggacgatttggaacatataattggagggcatgtatggttaggttccatttgtatatttggtggaatctggcatatcttaaccaagccttttgcatgagctcgccgcgcacttgtatggtttggggaggcttacttgtcttatagtttagctgctttatctgtttgtggtttcatcgcttgttgttttgtctggtttaataatactgcttaccctagtgagttttacggacctacggggccagaagcttctcaagctcaagcatttacttttctagttagagaccaacgtcttggagctaacgtggggtctgctcaaggacctacatgtttaggtaaatacttaatgcgttctccgactggagaagttatttttggaggcgaaacaatgcgcttttgggatatgcgtgctccctagttagaacctttaaggggtcctaacggtttggacttgagtaggttgaaaaaagacatacaaccttggcaagaacgacgttcggcaaaatatatgactcatgctcctttaggttccttaaattctgtggggggcgtagctactgagatcaatgcagtcaattatgtctccccgagaagttggttatctacctctcatttttttctaggacttttcctattcgtgggtcatttatggcacgcgggaagggctcgggcagcggcagcgggatttgaaaaaggaattgatcgtgattttgaacctgttctttccatgactcctcttaactaaagtagtaggtaaaacaagaa

SEQ ID NO: 4347 - DNA, 4439 bp, Artemisia annua
tagtattcatagaataacgatattattaatagtaataaaaaagtaaccaactgtataatattatcagctaatgagtttagttatagttatcacgaataatgataagtcatctgttgaatcactaaaaattcctattttcaattaggccaatgaaatccattgtaaagattagaaatcaataaaagaaaaataagtggacctgacccattgaatcatgactatatccgctattctgatattcaaattcaatagagatgaaattggaacaagttgacccccttttctatttattttcatttctttggactccgcaagaatttgtcgatatttccaattcaatcgtcttgtcttgttcctagatggtctataggaaaaaattgtcatttcgttcctccacggagaacattttattctaaattctaaatcacaggataagaaaaaaattcactatctttctttgattacaggatcaagattcatttatatctatataatatattctatagatatttctatatttagatttatagctatcagatcgcggcttgatgtaccaaaaattcccatttcgttgcatccaatatttttgttccgacaatcgtatgaagaaaggatgcaagataaatactatcatttccaatctcctatttgaatattgtattgaagtgaagtaaaaaattggaaaccctctcttttctaaaagggaaaaataaatagaaaagattagtaatttagtctacataaaaattagaatataaagagagttctttttcttaatctcatgaacaagatctaagaatccatttagttgatggaagaacaggggggcaggcctgaagatcaaccggtagtgggcgaggagattgctttttccttgaccagttctttcaaaaaacgaatcaatcggattcatgggtcataagaagataattcatgattcagatgcttaataataagaaggaataatcaaattgaattcatggatttacccggcaatttatggtccaataaaggatttttatcttcgaaacccattggaaggggtagtgcacgagaaaaaagaatcatgcagaaatgatcgactccttggatgccccaaaaatactatgaggtgttcggaaatggtcgaagtagttgaataggaggattacgatgactatagcccttggtaaatttaccaaagacgaaaaagatttgtttgatattatggatgactggttacgtagggaccgtttcgtttttgtaggctggtccggcctattgctctttccttgtgcctattttgctgtagggttggttcacgggtacaacctttgtaacttcatggtatacccatggattagccagttcctatttggaaggctgcaatttcttaactgccgcagtttctactcctgctaatagtttagcacattctttgttattactatggggtcctgaagcacaaggagattttactcgttggtgtcaattaggcggtctgtggacttttgttgctctccacggtgctttcggactaataggtttcatgttacgtcaattcgaacttgctcgatctgttcaattgcgaccttataatgcaatcgcattctctggtccaattgccgtttttgtttctgtattcctgatttatccactaggtcagtctggttggttctttgcgtgtagcagctatatttcgatttatcctcttttttcaaggatttcataactggacattgaacccatttcatatgatgggagttgccggtgtattgggcgctgctttgctatgcgctattcatggtgctactgtagaaaatactttatttgaagatggtgatggtgcaaatacattccgtgcttttaacccaactcaagctgaagaaacttattcaatggtcactgctaatcgcttttggtcacaaatctttggggttgctttttccaataaacgttggttacatttctttatgttatttgtaccagtaactggtttatggatgagtgctcttggagtagtcggtctggccttgaacctacgtgcctatgacttcgtttctcaggaaattcgcgcggcggaagatcctgaatttgattcttttaaacgaaggtattcgtgcttggatggcggctcaagatcagcctcatgaaaaccttatattccctgaggaggttctaccccgtggaaacgctctttaatggaactttagctttagctggtcgtgaccaagaaaccaccggtttcgcttggtgggccgggaatgcccggcttatcaatttatccggtaaactactaggggctcatgtagcacatgccggattaatcgtattctgggccggagcaatgaatctatttgaagtggctcattttgtaccagagaagcctatgtatgaacaaggattaattttacttcctcacctagctactctaggttggggggtaggtcctggtggggaagttatagatacgtttccatactttgtatctggagtacttcatttaatttcctccgcagtattgggctttggcggtatttatcacgcacttttagggcctgagacgcttgaagaatcttttccatttttcggttatgtatggaaagatagaaataaaatgactacaattttaggtattcacttaatcttgttaggtctaggtgcttttcttctagtattcaaggctctttattttgggggcgtatatgatacttgggctccgggaggaggagatgtaagaaaaatcaccaacttgacgcttagcccaagtatcatatttggttatttactaaaatcgccctttgggggggtgttagtgtagacgatttggaagatataatcggaggccatgtatggttaggttccatttgtatacttggtggaatttggcatatcttaaccaaacccttcgcatgggctcgacgcgcacttgtatggtctggagaggcttacttatcttatagtttagcgtggtttcattgcttgttgttttgtctggttcaataatacggcttatcctagtgagttttacggacccactggaccagaagcttctcaagcccaagcatttacttttctagttagagaccaacgtcttggagctaatgtgggatccgctcaagggcctactggtttaggtaaatatttaatgcgttctccgaccggagaagtggagaaactatgcgtttttgggatctgcgtgctccttggttagaacctttaaggggtccaaacgggttggacttgagtcggctgaaaaaagacatacaaccttggcaagaacgtcgttccgcagaatatatgacccatgctcctttgggttctttaaattccgtgggtggagtagctaccgagatcaatgcagtcaattatgtgtctcctagaagttggttagctacttctcattttgttctaggattcttctgtagggcatttgtggcacgcaggaagggctcgtgcagctgcagcaggatttgaaaaaggaattgatcgtgattttgaacctgttctttccatgacccctcttaattgagacaggagatcaaagacttgaaataggagtgacttcggttccctcatacatataggggtcatgtcataatcatttatatttaatccatttttctggcttggctaggcgggatagccgagccatttccctttctttatgataatgaaaccgtccgcaatccaataaagaaacaaatagattcaacaaggagagagagggattcgaaccctcgatagtaaactataccggttttcaagaccggggctttcaaccactcagccatctctccgaaagacatttttattttattcctccgaatagaacatggccatatgagtggataccgccactatcaaagatctcgggtgtgatggtcaatctatctatcccactatatggatagatatatgattcagcatgcccatttgtaaaataaaaaaccaaattctgttctcccccgactccatttacgaataatgtggtataaggggtaataatataataaatataataaatcatatagaatcaatggattcgtggtaaaatccctgtatgatgtattttagtacaatttttgactgatatagggatcaaatggtatagttcatttgttggtagcttggaggattaaaagcatgactcttgctttccaattggctgtttttgcattaattgctacttcattaatcttattgattggcgtacccgttgtatttgcttctcctgatggttggtcaagtaacaaaaatgttgtattttcaggtacatcgttatggcttggattagtctttctggtgggtatccttaattctctcatctcttgaacctattgtcctagatccaaaaccaaaatgaccctctgaattattcttggttgtgagacacattcacattcaatataagtcccaaaaatccaaataaatataagaattaaatataagaaaaaaaa

SEQ ID NO: 4348 - DNA, 2778 bp, Brachypodium distachyon
cccttatctttcattcagaaaaaggaatgaatggctcggctaaatgaaataaccgagccagagcagaaaaaaacagtagaagtagaacaggtataaataagaaaatcttagttaagagggttcatgtaaagaacaggttctaaatcacgatcgattcccttttcaaaacctgctgcagcagctcgggctcttcctgcatgccacaaatggcccacaaaaaagaagaatcctagaacaaaatgagaagtcgataaccaacttctaggagagacataattaactgcattgatctcggtagctacgccacccacggaatttaaagagcctaaaggagcatgggtcatatattccgctgaacgtcgttcttgccaaggttgtatgtcttttttcaacctactcaagtccaaaccgttgggcccccttagaggttctaaccatggagcacggaggtcccaaaaacgcatagtttcccctccaaagataacctctcccgttggggaacgcattagatatttacctaaacctgtgggtccttgagcagatcccacattagctccaagacgctggtctctaactagaaaagtaaatgcttgagcttgagaagcttctgggccggtgggtccataaaactcactcggataagccgtattattgaaccagacaaaacaacaagcgataaaaccaaagacagataaagcagctaaactataagacaagtaagcttctccagaccatacaaatgcacggcgagcccatgcgaaaggtttggttaagatatgccaaattccgccaaatacacaaatgaaacccaaccatacatgtccaccaattatatcttctaaatcatccacactaacaatccagccttctcccccaaaaggggattttagtaaataaccaaatataacaccggggctaagggtcaagttggttatttttcttacatccccccccccgggggcccaggtatcatatacaccgccaaaataaagagccttgagtactagaagaaaagcacctagacctaacaaaattaaatgaatacccaaaattgtagtcattttatttctatctttccatacataaccaaagaatggaaaagattcctcaagagtctcgggtcccagaagcgcgtgataaatgccaccgaagcctaagactgcggaggaaattaggtgaagtactccagatacaaagtacggaaaagtatcgagaacttctccccctggcccgactccccaacctagggtagctaagtgtggaagtaaaatcaacccttgttcatacatgggcttttctggcacgaaatgggccacttcaaataggttcattgctccggcccagaatacgattaatccggcatgggctacgtgggcgccaagtagtttaccggacaaattgataagtctagcattcccagcccaccaagcaaacccggtggtttcttggtcacgaccagctaaaacgaaagttccattaaagagcgtttccacgtggtagaacctcctcagggaatataagattttcatgaggctgatcctgagctgccatccacgcacgaataccctcgtttaaaagaatatttttggtgtagaaagtctcaaattcaggatcttccgctgcacggatttcctgggaaacaaagtcataggcacgtaagttcagagccaggccaactacgccaatagcactcatccataaaccggtgacggggacaaatagcataaagaaatgtaaccaacgtttgttggaaaaagcaacaccaaagatttgggaccaaaagcgattagcagtgaccattgaataagtttcttcagcttgagttgggttaaaagcgcgaaaagtatttgcaccatcaccgtcttcgaatagagtgttttctacggtcgctccatgaatagcgcataggagagccgcgcctaatactccggcaactcccatcatatgaaacgggttcaacgtccaattatgaaatccttggaagaaaaggatgaatcgaaatatcgctgctacgccaaaactcggcgcaaagaaccaaccggattgccccagtggataaataaggaatacagaaacaaaaacagcgattggaccagagaatgagattgcattataaggccgcaattgaatagaccgagcaagttcaaattggcgtaacatgaaacctattagtgcaaaagccccgtggagagctacaaaagtccataggccacctaattgacaccaacgagtaaaatctccttgtgcttccgggccccatagtagcaacaaagagtgtgctaaactattggcaggggtagaaactgctgcggttaagaaattacaaccttccaaataggaactagccaatccatgggtataccaagaagttacaaaagttgtccctgtaaaccaccctcctaaagcgaaataagcacaaggaaagagcaataagccggaccatcctacaaaaacgaaacggtcccttcgtaaccagtcgtccacagtatcaaatagatccttttcttctttaggaattctaccaagggctatagtcatagtgatcctcctattcaattacttcaaccatttccgagcacctcgtatcacttccaaggcatatgatagtttgattatctgtggacgatttctttctcgtgcaatgccgtttttcaatggtctcgaagatataaattttttcatttttatctatggagtcacaaccgaggtcgtggtaaatccataaattggattcgatttttttcttatacttttttcttatacttcttatactaaagc

SEQ ID NO: 4349 - DNA, 1422 bp, Brachypodium distachyon
ttagttaagagggttcatgtaaagaacaggttctaaatcacgatcgattcccttttcaaaacctgctgcagcagctcgggctcttcctgcatgccacaaatggcccacaaaaaagaagaatcctagaacaaaatgagaagtcgataaccaacttctaggagagacataattaactgcattgatctcggtagctacgccacccacggaatttaaagagcctaaaggagcatgggtcatatattccgctgaacgtcgttcttgccaaggttgtatgtcttttttcaacctactcaagtccaaaccgttgggcccccttagaggttctaaccatggagcacggaggtcccaaaaacgcatagtttcccctccaaagataacctctcccgttggggaacgcattagatatttacctaaacctgtgggtccttgagcagatcccacattagctccaagacgctggtctctaactagaaaagtaaatgcttgagcttgagaagcttctgggccggtgggtccataaaactcactcggataagccgtattattgaaccagacaaaacaacaagcgataaaaccaaagacagataaagcagctaaactataagacaagtaagcttctccagaccatacaaatgcacggcgagcccatgcgaaaggtttggttaagatatgccaaattccgccaaatacacaaatgaaacccaaccatacatgtccaccaattatatcttctaaatcatccacactaacaatccagccttctcccccaaaaggggattttagtaaataaccaaatataacaccggggctaagggtcaagttggttatttttcttacatccccccccccgggggcccaggtatcatatacaccgccaaaataaagagccttgagtactagaagaaaagcacctagacctaacaaaattaaatgaatacccaaaattgtagtcattttatttctatctttccatacataaccaaagaatggaaaagattcctcaagagtctcgggtcccagaagcgcgtgataaatgccaccgaagcctaagactgcggaggaaattaggtgaagtactccagatacaaagtacggaaaagtatcgagaacttctccccctggcccgactccccaacctagggtagctaagtgtggaagtaaaatcaacccttgttcatacatgggcttttctggcacgaaatgggccacttcaaataggttcattgctccggcccagaatacgattaatccggcatgggctacgtgggcgccaagtagtttaccggacaaattgataagtctagcattcccagcccaccaagcaaacccggtggtttcttggtcacgaccagctaaaacgaaagttccattaaagagcgtttccacgtggtagaacctcctcagggaatataagattttcat

SEQ ID NO: 4350 - DNA, 3249 bp, Chenopodium quinoa
aagaacaggttcaaaatcacgatcaattcctttttcaaatcctgctgcagctgcacgagcccttcccgcatgccacaaatgacctacgaataggaaaaatcctaaaacaaaatgagaagtagctaaccaacttctaggagagacataattgactgcattgatctcggtagccacccacccacagaatttaaagaacctaaaggagcatgggtcatatattctgcggaacggcgttcttgccaaggttgtatgtctttttccagccgactcaagtccaaaccatttggacctcttaggggttctaaccagggagcgcgcaaatcccaaaaccgcatagtttctcccccaaaattaacttctccagtcggagaacgcattagatacttacctaaaccagtaggtccttgagcggatcccacgttagccccaagacgttggtctctaactaaaaaagtaaatgcttgagcttgagaagcttctggtccagtaggtccgtaaaactcactaggataagcagtattattgaaccagacaaagcaacaagcaatgaaaccaaagacagataaagcagccaaactataagacaaataagcctctccagaccagacaagtgcgcggcgagcccatgcaaaaggtttagttaagatatgccagattccaccaagtatacaaatgaaacctatccatacatgccccccgattatatcttccaaatcgtccacactaacaatccacccttctcctccaaagcgattttagtaaataaccaaagataatactcggactaagggtgacgttggtaatttttcttacatctccgcctcctggagcccaggtatcatatacgcccccaaaataaagagccttgaacactagaagaaaggcgcctatacctaacaagattaagtgaatgcccaaaattgtggtcatttatttctatctttccacacataaccgaagaatggaaaagattcttcaagagtttcagggcccagaagtgcatgataaatacccccaaagcccaatacggccgacgaaattaagtgaaggactcctgatacaaagtatggaaaagtgtctataacttccccgccggggcctaccccccaacctagagtagctaggtggggaagtaaaattaatccttgttcatacatcggcttctctggtacgaaatgagccacttcaaacaggttcattgctccggcccagaatacgattaatccggcatgggctacatgagctccaagtagtttaccagataaattgataagtcgagcattcccggcccaccaagcgaaaccggtggtttcttggtcacgtccggctatagttaaagttccattaaagagcgtttccacggggtagaacctcctcagggaatataaggttttcatgaggctgatcttgagccgccatccaagcacgaataccttcgtttaagagaatatttttggtgtagaaagtttcaaattcaggatcttccgctgcacggatttcctgggaaacgaagtcataggcacgtaggttcaaagccagaccgactactccaagagcactcatccataaaccggttactggtacaaataacataaagaaatgtaaccaacgtttattggaaaaagcaacccaaaaatttgggaccaaaagcggttagcggtgaccattgaataagtttcttcggcttgggttgggttaaaagcccggaatgtatttgccccatcaccgtcttcaaataaagtattttctacggtagcgccatgaatagcgcatagtagagcggcgcccaatacaccggcaactcccatcatatgaaatggattcagtgtccaattatgaaacccttgaaaaaagagaatgaatcgaaatatagctgctacaccaaaactaggtgcaaagaaccaaccagactgacctagtggataaattaggaatacagaaacaaaaacagcaattggaccagagaatgcgattgcattataagggcgcaattgaacggatcgagcaagctcgaattgacgtaacataaaacctattagtgcgaaagcaccatgaagagcaacaaaagtccacaggccgcctaattgacaccaacgagtaaagtctccttgtgcttcaggaccccacagtaacaataaagagtgggactaaactattagcaggagtagaaactgccgcggttaagaaattgcaaccttccaaataagaactggccaatccatgggtataccatgaagttacaaaggttgtacctgtaaaccaacctcctaaggcgaaataagcacaaggaaagagcaatagcccagaccaacctacaaaaacgaaacggtccctccgtaaccagtcatccatactatcaaataaatctttttcgtctttagtaaatttaccaacggctatagtcatagtgatcctcctattcaactacttcaaccatttccgagcaccccatagcattttttggaatccgagaattcgatcatttaatttatggatgatttgatttctcgtataatattagctataaggtttcgaaaaaaaattataattaaaataaattccgaaattcaattattccttaatttgaacttattagactcaactattaatcttttgaaagagctcgtcaaggaacaaccaatctactcgctcgttaccgactgatcctcaaatcgaccttttctttctatcaacgaattcaattaagcttattgttgcatcttgttcataaaacggagcaaaagaaataaatatctttcgagattattctctaataaatatatgtttcgtttttgtctatttatagttagtttttccttccgatcaatcggaaatgtcagaatatatcgtttcattttcacggatcgaagaaagatacagagaattttcgatttttacttaatttgaattccatatgatattcacaataaaatactaggaaacttaaaatgagagcttctttcacgcatgcattctctatcccattgtcggaacaaaaatatgggatgcatggatatagaaatagttggtacaggaaaccacactatcatcgcaatcttatttgatagataagatcgaaatgcattccgttttggaatcaaagaaaacaaagatatggaagatggcttttttaggttgtgatttgaaataaccacaaagttttctcccttctagccggaagagactcgccaatttattcctatggaataactaggaatacaaagatttaatcggaaatatcgacaaatt

SEQ ID NO: 4351 - DNA, 5296 bp, Brachypodium distachyon
cctgcaatcgaagtagaagtaccaacggctcactgccatgaaccttcttgattcactaaggggaaattcacctccttctcgaatgggtatcattgacaaagggttgcgtttgtatcataatctacatgtagcgggtatagtttagtggtaaaagtgtgattcgttctattaataactgaatttaaaatgatatacttaaggcatccttaagttttttttctattccgatgaaaactttagttcttataaaggatttcatccttttcctctcaatagcgtattgaggaacaatatacattctcgtgatttgtataattgaaattgcatccaaaatacaaataggattatgagtacagagtcgcgaagcataattttacattggattaagtattccatatattaaaaatatgagtaaaggatctatggatggagatacaaaaaagttttttccaatcgtaactaaatctcctttaccttcaaaaagggaaaaggaagccaaatagctaaaagcggtagttttggtttactagaaccatcagcatattgtttaagctcggtggaaacccaattcttttcctcaaggatcccttgaatgaaattagggaacgaagtaagtagattagatggatttagatcgaatttctatctccttactctataaggatcatctagaaagcggagagctttggttctattcaaatagaaaagctgacatagatgttaagtggtgagaatatccataaaggagccgaatgaaatgaaaatttcatgttcggttttgaattagagacgttataaataatcaaccaacgtcgactataacccctagccttccaagctaacgatgcgggttcgattcccgctacccgctccattctgtatatgtataaaaggagtattccatttgtttgtctagacatagtagaggcccgtatttaaccttttccgttcaccattttctggtactgcagagcggagtagagcagtttggtagctcacgaggctcataaccttgaggtcacgggttcgattcccgtctccgcacttagcagtctctataaaaggactattccatttctatatatatggtacagggttgggtggtatccaatccaatttttttattcattacttcctggccttagagggcaaaattgagcagtctgcgaagccgcctgcctccataagaagaacaggcaaggtttctccctaccctgcagaaaagaaaaatgaaagaaacgcacagtctacctcccttccctttaaaagcagtttgccagttctttgtctcagtgatacccccctgttggagagttctatttccctctccggagccctcctttttttgagtggggtgaaaagtaagggtaataagggatagggtactagactaacacctaattaatatataatttattctaagtagttaaacattcaactagactaaattttttctcatagtacttgactaaagtaagcgggcgagcggcgggaatcgaacccgtatcttctccttggcaaggagatgttttaccattgaactacgctcgctacggaatatattttatagcgtatatccgcttgggtcgaccgtctatgtctgggtcgaccgtttcattttctattatattagagttttcctttttttgattgtctgtcaatcaatattctaatggcaatgcaatttcataatactgaaagagaagaggtagcaattcggaacgcaaattgcgttttaatgcgtctcactattcgaattttttcgaagaaatgtcctttttatttattttgtatcgggttactcaatactaaacaaatttatgaaatgagagaattcagaatagctacgagaaagactagaccaatccataatgatgtaccggaaaaaacaacgtttttattatttgaccaaccatcaggagaagcaaatacaaggggtacactaattactaagactgaggaagtcgcaattaatgcaaaaacagctaattggaaagcaatagtcatatttctaatcctccaagctatcatcaaataaagttgactacatatttgatccctcacttaacctaaattgtaaaaaatacaagaagtaggaggggtttaatcatgaatccattgattcttctctttaattaataattaaaacttattacttaccgcttttatttggatatggggattagggtaggggatttagtctttatttcaaaagcgggtatagcggatcttctatccgtgtatacagtatacagaaatatatcgaaaaaggatttgcatctgagatgtttctagaggttagtagatccttttatttttatatggctgtgttctatttctaggagtaaaatagggattaagctgtggagagatggctgagtggttgatagctccggtcttgaaaaccggtatagttctaggaactatcgagggttcgaatccctctctctccttttgcttattgaatacgtttgtttctttcatttttttttttttttctttattctgtccccttatctttcattcagaaaaaggaatgaatggctcggctaaatgaaataaccgagccagagcagaaaaaaacagtagaagtagaacaggtataaataagaaaatcttagttaagagggttcatgtaaagaacaggttctaaatcacgatcgattcccttttcaaaacctgctgcagcagctcgggctcttcctgcatgccacaaatggcccacaaaaaagaagaatcctagaacaaaatgagaagtcgataaccaacttctaggagagacataattaactgcattgatctcggtagctacgccacccacggaatttaaagagcctaaaggagcatgggtcatatattccgctgaacgtcgttcttgccaaggttgtatgtcttttttcaacctactcaagtccaaaccgttgggcccccttagaggttctaaccatggagcacggaggtcccaaaaacgcatagtttcccctccaaagataacctctcccgttggggaacgcattagatatttacctaaacctgtgggtccttgagcagatcccacattagctccaagacgctggtctctaactagaaaagtaaatgcttgagcttgagaagcttctgggccggtgggtccataaaactcactcggataagccgtattattgaaccagacaaaacaacaagcgataaaaccaaagacagataaagcagctaaactataagacaagtaagcttctccagaccatacaaatgcacggcgagcccatgcgaaaggtttggttaagatatgccaaattccgccaaatacacaaatgaaacccaaccatacatgtccaccaattatatcttctaaatcatccacactaacaatccagccttctcccccaaaaggggattttagtaaataaccaaatataacaccggggctaagggtcaagttggttatttttcttacatccccccccccgggggcccaggtatcatatacaccgccaaaataaagagccttgagtactagaagaaaagcacctagacctaacaaaattaaatgaatacccaaaattgtagtcattttatttctatctttccatacataaccaaagaatggaaaagattcctcaagagtctcgggtcccagaagcgcgtgataaatgccaccgaagcctaagactgcggaggaaattaggtgaagtactccagatacaaagtacggaaaagtatcgagaacttctccccctggcccgactccccaacctagggtagctaagtgtggaagtaaaatcaacccttgttcatacatgggcttttctggcacgaaatgggccacttcaaataggttcattgctccggcccagaatacgattaatccggcatgggctacgtgggcgccaagtagtttaccggacaaattgataagtctagcattcccagcccaccaagcaaacccggtggtttcttggtcacgaccagctaaaacgaaagttccattaaagagcgtttccacgtggtagaacctcctcagggaatataagattttcatgaggctgatctgagctgccatccacgcacgaataccctcgtttaaaagaatatttttggtgtagaaagtctcaaattcaggatcttccgctgcacggatttcctgggaaacaaagtcataggcacgtaagttcagagccaggccaactacgccaatagcactcatccataaaccggtgacggggacaaatagcataaagaaatgtaaccaacgtttgttggaaaaagcaacaccaaagatttgggaccaaaagcgattagcagtgaccattgaataagtttcttcagcttgagttgggttaaaagcgcgaaaagtatttgcaccatcaccgtcttcgaatagagtgttttctacggtcgctccatgaatagcgcataggagagccgcgcctaatactccggcaactcccatcatatgaaacgggttcaacgtccaattatgaaatccttggaagaaaaggatgaatcgaaatatcgctgctacgccaaaactcggcgcaaagaaccaaccggattgccccagtggataaataaggaatacagaaacaaaaacagcgattggaccagagaatgagattgcattataaggccgcaattgaatagaccgagcaagttcaaattggcgtaacatgaaacctattagtgcaaaagccccgtggagagctacaaaagtccataggccacctaattgacaccaacgagtaaaatctccttgtgcttccgggccccatagtagcaacaaagagtgtgctaaactattggcaggggtagaaactgctgcggttaagaaattacaaccttccaaataggaactagccaatccatgggtataccaagaagttacaaaagttgtccctgtaaaccaccctcctaaagcgaaataagcacaaggaaagagcaataagccggaccatcctacaaaaacgaaacggtcccttcgtaaccagtcgtccacagtatcaaatagatccttttcttctttaggaattctaccaagggctatagtcatagtgatcctcctattcaattacttcaaccatttccgagcacctcgtatcacttccaaggcatatgatagtttgattatctgtggacgatttctttctcgtgcaatgccgtttttcaatggtctcgaagatataaattttttcatttttatctatggagtcacaaccgaggtcgtggtaaatccataaattggattcgatttttttcttatacttttttcttatacttcttatactaaagcacgaggtgc

SEQ ID NO: 4352 - DNA, 4137 bp, Brachypodium distachyon
taagcgggcgagcggcgggaatcgaacccgtatcttctccttggcaaggagatgttttaccattgaactacgctcgctacggaatatattttatagcgtatatccgcttgggtcgaccgtctatgtctgggtcgaccgtttcattttctattatattagagttttcctttttttgattgtctgtcaatcaatattctaatggcaatgcaatttcataatactgaaagagaagaggtagcaattcggaacgcaaattgcgttttaatgcgtctcactattcgaattttttcgaagaaatgtcctttttatttattttgtatcgggttactcaatactaaacaaatttatgaaatgagagaattcagaatagctacgagaaagactagaccaatccataatgatgtaccggaaaaaacaacgtttttattatttgaccaaccatcaggagaagcaaatacaaggggtacactaattactaagactgaggaagtcgcaattaatgcaaaaacagctaattggaaagcaatagtcatatttctaatcctccaagctatcatcaaataaagttgactacatatttgatccctcacttaacctaaattgtaaaaaatacaagaagtaggaggggtttaatcatgaatccattgattcttctctttaattaataattaaaacttattacttaccgcttttatttggatatggggattagggtaggggatttagtctttatttcaaaagcgggtatagcggatcttctatccgtgtatacagtatacagaaatatatcgaaaaaggatttgcatctgagatgtttctagaggttagtagatccttttatttttatatggctgtgttctatttctaggagtaaaatagggattaagctgtggagagatggctgagtggttgatagctccggtcttgaaaaccggtatagttctaggaactatcgagggttcgaatccctctctctccttttgcttattgaatacgtttgtttctttcatttttttttctttattctgtccccttatctttcattcagaaaaaggaatgaatggctcggctaaatgaaataaccgagccagagcagaaaaaaacagtagaagtagaacaggtataaataagaaaatcttagttaagagggttcatgtaaagaacaggttctaaatcacgatcgattcccttttcaaaacctgctgcagcagctcgggctcttcctgcatgccacaaatggcccacaaaaaagaagaatcctagaacaaaatgagaagtcgataaccaacttctaggagagacataattaactgcattgatctcggtagctacgccacccacggaatttaaagagcctaaaggagcatgggtcatatattccgctgaacgtcgttcttgccaaggttgtatgtcttttttcaacctactcaagtccaaaccgttgggcccccttagaggttctaaccatggagcacggaggtcccaaaaacgcatagtttcccctccaaagataacctctcccgttggggaacgcattagatatttacctaaacctgtgggtccttgagcagatcccacattagctccaagacgctggtctctaactagaaaagtaaatgcttgagcttgagaagcttctgggccggtgggtccataaaactcactcggataagccgtattattgaaccagacaaaacaacaagcgataaaaccaaagacagataaagctgctaaactataagacaagtaagcttctccagaccatacaaatgcacggcgagcccatgcgaaaggtttggttaagatatgccaaattccgccaaatacacaaatgaaacccaaccatacatgtccaccaattatatcttctaaatcatccacactaacaatccagccttctcccccaaaaggggattttagtaaataaccaaatataacaccggggctaagggtcaagttggttatttttcttacatccccccccccgggggcccaggtatcatatacaccgccaaaataaagagccttgagtactagaagaaaagcacctagacctaacaaaattaaatgaatacccaaaattgtagtcattttatttctatctttccatacataaccaaagaatggaaaagattcctcaagagtctcgggtcccagaagcgcgtgataaatgccaccgaagcctaagactgcggaggaaattaggtgaagtactccagatacaaagtacggaaaagtatcaagaacttctccccctggcccgactccccaacctagggtagctaagtgtggaagtaaaatcaacccttgttcatacatgggcttttctggcacgaaatgggccacttcaaataggttcattgctccggcccagaatacgattaatccggcatgggctacgtgggcgccaagtagtttaccggacaaattgataagtctggcattcccagcccaccaagcaaacccggtggtttcttggtcacgaccagctaaaacgaaagttccattaaagagcgtttccacgtggtagaacctcctcagggaatataagattttcatgaggctgatcctgagctgccatccacgcacgaataccctcgtttaaaagaatatttttggtgtagaaagtctcaaattcaggatcttccgctgcacggatttcctgggaaacaaagtcataggcacgtaagttcagagccaggccaactacgccaatagcactcatccataaaccggtgacggggacaaatagcataaagaaatgtaaccaacgtttgttggaaaaagcaacaccaaagatttgggaccaaaagcgattagcagtgaccattgaataagtttcttcagcttgagttgggttaaaagcgcgaaaagtatttgcaccatcaccgtcttcgaatagagtgttttctacggtcgctccatgaatagcgcataggagagccgcgcctaatactccggcaactcccatcatatgaaacgggttcaacgtccaattatgaaatccttggaagaaaaggatgaatcgaaatatcgctgctacgccaaaactcggcgcaaagaaccaaccggattgccccagtggataaataaggaatacagaaacaaaaacagcgattggaccagagaatgagattgcattataaggccgcaattgaatagaccgagcaagttcaaattggcgtaacatgaaacctattagtgcaaaagccccgtggagagctacaaaagtccataggccacctaattgacaccaacgagtaaaatctccttgtgcttccgggccccatagtagcaacaaagagtgtgctaaactattggcaggggtagaaactgctgcggttaagaaattacaaccttccaaataggaactagccaatccatgggtataccaagaagttacaaaagttgtccctgtaaaccaccctcctaaagcgaaataagcacaaggaaagagcaataagccggaccatcctacaaaaacgaaacggtcccttcgtaaccagtcgtccacagtatcaaatagatccttttcttctttaggaattctaccaagggctatagtcatagtgatcctcctattcaattacttcaaccatttccgagcacctcgtatcacttccaaggcatatgatagtttgattatctgtggacgatttctttctcgtgcaatgccgtttttcaatggtctcgaagatataaattttttcatttttatctatggagtcacaaccgaggtcgtggtaaatccataaattggattcgatttttttcttatacttttttcttatacttcttatactaaagaactaaacatttgaattcaccattattccatgactccgatttcaaagcctatcttttaagggaaaaatgaaaaaaagtaacccctcttttcccatttgctctctattgcatgggtggaagaacaaaaatggaggattcttaaaaaaaaaagactttcgaaatcaatttttatgtgtagtggaaaggagttgcgatttattcttattcctatagagtatctagtaacaagaatataaaatcgtaaatagcgaaaaattattatcttgcagggtctaagtctaagaaaataaaaaaaattcgtttatacaatttcatctatatcgaatttat

SEQ ID NO: 4353 - DNA, 4825 bp, Glycine max
ttttatttactttttttttttttaagaaaaagaaagttctaattattaataaatatatctatatatatatatatacagatagatattctatatcttttatcttaattaatatttgacccctccttataatgtgttatagtttctttatttttaggaacttatccattccttttttaatgtgcccgacaatccgaaagaatctgggggaggggtcatttcgtttttgatctagaataaatagagctcaagaaatgagagaattaagaatacccacgagaaacactaatccaatccataatgatgtaccggaaaatacaacatttttgttattcgaccaaccttcaggagaagcaaatacaacaggtacactaatcaataaaataaatgaaatagcaattaatgcaaaacagctaattggaaagcaatagtcatgttctaatcctccaatttaccaacaaaagaactttaccatttgatcccccaaccccttgatccctttattgacaaaaaaattataataaaaaaacgcagaagggtttatcatgaattcattgattttttttacttattatcaaccctttgaggcatggatcgagggtagtttttttacttcacaaaaaggcatgttggattattccctatatacataccgatagaaaactaaacaaatagattcacatcggatatcttaccctttatagatatataaagatagataatataaagggtatccatttatatgctcatgttctattcagtggaataaagataaaatataaattagctttggagagatggctgagtggttgatagccccggtcttgaaaccggtatagttcggaacaaagactatcgagggttcgatccctctctctcctctttctcggcgaatcaatttgtttattttcttagtttctatcgaatcttttttttttcgatagaactaagaaaaaaggaaaagaaattcttatttaaatacgacccgctcaattcaacccaatatttatagtaatatttatagtaaataaaagtgatttctacttcataggatctcatgtctcaattaagaggagtcatggaaagaactggttcaaaatctcgatcaattcctttttcaaatcctgcggcagctgcgcgagctcttcccgcgtgccataaatggcctacaaataggaagaatcctagaacaaaatgagaagtagctaaccaacttctaggagaaacgtattcctcaattgagatgaggaaatcagacccacggaatttaaggaacctaaaggagcatgagtcatatattccgcagaacggcgttcttgccaaggctgtatatcttttttcagtctactcaagtctaaaccatcggaccccttagaggtctaaccaaggagcacgcaaatcccaaaaacgcatagtttctcccccaaaaatacttctcctgtcggggacgcattagatatttacctaaacctgtaggtccttgagcagatcctacattagccccaagacgttggtctctaactagaaaagtaaatgcttgagcttgagaagcttctggcccagtggcccgtaaaactcactaggataagcggtattataaaccagacaaagcaacaagcaataaaaccaaaaacagataaagcactaaactataagataagtaagcttctccagaccatacagtgcacgccgagcccatgcaaaaggtttggttaagatatgccagattccaccaagtatacaaatggaacccaaccatacatgccccccaattatatcttccaaatcgtccacactaacaatccacccttctcccccaaaaggtgattttaataaatatccaaatataatacttggactaagggtcaaattggttatttttcttacatctccgccccccggagcccacgtatcatatatacctccaaaataaagagccttgaatactagaagaaacgcacctatacctaacaagattaagtgatacccaaaattgtagtcattttatttctatctttccatacataaccgaagaatggaaaagattcttcaagagtctcaggtcccaaaagtgcatgataataccgccaaagcccaatactgcagaggaaattaagtgaagtactccagacacaaagtatggaaaggtgtctataacttcccccccaggacctaccccccaacctagagtagctagatggggaagtaaaattaaaccttgttcatacatgggcttctcgggtacgaaatgagccacttcaaaaaggttcattgctccggcccagaatactattaatccagcatgggctacatgggctcctagtagtttgccggataaattgataagtcgggcattcccggcccaccaagcgaaaccggtagtttcctggtcacgaccagttaaagctaaagttccattaaagagcgtttccacgtggtagacctcctcagggaatataaggttttcatgaggctgatcttgagccgccatccacgcacgaataccttcgtttaagagaatatttttggtgtagaaagtctcaaattcaggatcttccgctgcgcggatttcttgagaaacgaagtcataggcacgtaggttcagggccaaaccgactaccccaagagcactcatccataaaccagttactggtacaaataacataaagaaatgtaaccaacgtttattggaaaaagcaaccccaaagatttgggaccaaaagcgattagcagtaaccattgaataagtttcttcagcttgggttgggttaaaagcacggaatgtatttgcgccatcaccatcttcaaataaagtattttctacggtggcaccatgaatagcgcatagtagtgccgcgcccaatacaccagcaactcccatcatatgaaatgggtttaatgtccaattatgaaacccttggaaaaagaggatgaatcgaaatatagctgctacaccaaaactaggagcaaagaaccaaccagactgacccagtggataaataaggaatacagaaacaaaaacagcaattggaccagagaatgcgattgcattataaggccgcaattgaacagatcgagcaagttcaaattgacgtaacatgaaacctattaatgcgaaagcgccgtggagagcaacaaaagtccacagaccacctaattgacaccaacgggtaaaatctccctgtgcttcaggaccccacagtaacaacaaagagtgtgctaaactattagcaggagtggagactgcagcggttaagaagttgcagccttccaaataagaacttgccaatccatgagtataccatgaagttacaaaggtcgtacctgtgaaccaaccccccaaggcgaaataggcgcaagggaagagtaatagaccggaccaacctacaaaaacgaaacggtccctccgcaaccagtcatccataatatcaaataaatcattttcatctttggtaaatttaccaagagctatagtcatagcgatcctcctattcaactacttcaaccatttcccaacacctcatagcattttcagggatgggacggaccctcgaggcttttatcatttatctatctatatatagagagagataattttctcgtacactttcccttcttttttaattttaattggtttcgaataaaaaataatttatgagtctattgatatctagggcaaatcgatgaactcaatgtagttattcctttctattcttaaaaatcctccaagtcataaatcataaaatctcctatgactcaaaaatccgatagaaaatttttttaaaagaactgttcaagaaacaaatgatcccctctttcactccttatacccagcggatcctcagacatatttctctcctttcatcagagaatcttattcttgaatcttgtttgtgaacttacttctattttgtctagggaactactctaggatcatagattttataaatttctatttgatttacacttttttctttttattaattattatttgatttttttattcattattattattattttattaattattaaaaaaaatgaaatacaatattaaaaagaaaaaactgtaagtgaaagtttctgtctcacatacattaattgctggaaaaatatcgtacgcatcgatatgaaaagaaaatatttgatacgcgaagacataattgaatgtatttttcaattatttctataagataaaatctatctatatcgattttatcttatagaaataattgaaattgaaatgaattttttcttgtattcggaaaaaaagatgtttcaaatgaataaaaacttgtttggtggaacttggaataaggcccttctgagtaaagaaagggcatagcccttttttttataggaccttcacaggaacaagaagatttaattggaaatatcgacagattcttagggagtctaaaccaaaaaagtattaaaaagaaaatgaaaaaatcattgttcgaatttcatctttatccaatttgaatatcagaatagtaaatataggtataattcaatgggttaggtccacttactttttgttaatctttccctttttaaaaattttacactttttttttgaatttctttctttactatattctaatgaaattctatgattacttgattttttattacaaatagaaacttgttccaaatatccacaatatttcgattcttccttaaaatagaaatacgactgctttatttctggaaaaaaagtaaaaagccccttatcggatttgaaccgatgacttacgccttaccatggcgttactctaccactgagttaaaggggccctatttgattcaattcctaaataaggaa

SEQ ID NO: 4354 - DNA, 14469 bp, Triticum aestivum
cataccctacataacatatccaactcttcttggttcagggttttccgtttccgaagactagtaaaataggcggattctggaaccccaaggattcaatggtatatggatatggaaaatataagatttccgatcctagcgggaaaaggcggggaacagatacccaataggatataggatccttgggaggaacttttggtaatggccttgatcctctatgctattttttatttgttcttagttctattgaacttttttcattcttttaaacaagaatctaataaactagaattgagtcagtggaaaaaaggagagagaggaaagtgttaaatggagagagtcgactaatcagagacttttaggatcttctttacatcaggtaaatctgtcggccctgtccgttttttctttaagttacgactctttgctgcttacttctatcaagccatagggaaagtctatgatgaatttggaaaactcatctcactcttactctatggctcggacttaatgggggaagaaaacatcttccagaatttcttttttgttcaattctggacaaagaagaaaaggaaaaaggaatttatagggacagtgttaccccctatatcccctagtttatattgtaggaataataaaacaatttagcagtctgacacacttacgtccttgcaaagtaaataattattattgtagtcgtaaccgtagaataggatcctaatcaaaataaatacatttggttcaggcgctattagcatggtaagaaaagattttttacagaccagaggggctatctaaatcctaaagtaaaggcgagcgatcgaagtagaagtaccaacggctcagtgtcatgaaccttctccatctgattcaataagggggaattagccttcttgtcaaatggctatccttgacaaagggtaccatttataccataatctacaatgtagcgggtatagtttagtggtaaaagtgtgattcgttctattaataactgaatttgaaatgatatacttaaggcatccttaagtttttatttttatattccgatgaaaactttagttcttataaaggattaaatccttttcctctcaatagcatattgaggaagaatatacattctggcgatttgtatccaaagactaatttaaattgcatccaaaataaaaattggattatgagtacagagtcgcgaagcataattttgcattggattaagtattccaattttgaaaatatgagtaaaggatctatggatgaagatacaaaaaagttgatttccaatcgtaactaaatcttcttaaaataaggaataaggaagccaaatagctaaaaaacgatagttttggtttactagaaccatccgcatattgtttcagctcggtggaaacccaattcttttcctcaggatctcttgaatgaaattagggaacgaagtaagtagattagatggatttagatagaatttctatctcctactctataaggatcatctagaaagcagagagctttggttccattcaaatagaaaagctgacatagatgttaagtggtgagaatatccataaaggagccgaatgaaatcaaaatttcatgttcggttttgaattagagacgttaaaaataatcaaccaacgtcgactataacccctagccttccaagctaacgatgcgggttcgattcccgctacccgctccattctgtataaaaggagtattctatttgtctagacatgttagaggcttgtattcaagccttttttgtccaccagtttctggtactccagagcggagtagagcagtttggtagctcacgaggctcataaccttgaggtcacgggttcgattcccgtctccgcacttagcagtctgtataaaaggagtattctatttctctagatatggtagaggggcgtatccaacccttttttattcattagctcccggccctagagggcaaaattgagcagtttgcgaagtcacttgccttcaaaaaagaaggcgcaaggcttctccctaccctgcagaaaataaaatgaaacgaaagggacagtctacctctcccttccctttaaaacagtttgcccgttgtttgtctcagttaataccctaatttttggagctctcttggcgagttctatttctgcctccggagcgcccttcttttttgagtgggatgcaaaggaagggtaagatagtaagggatacggcactagactaacacctaattaatacttaatttaatataagtagttaaacagttaactagactaaactttttatcatagtactttgagaaattaagcgggcgagcggcgggaatcgaacccgtatcttctccttggcaaggagatattttaccattgaactacgctcgctacggtatatattttatagcgtatatccgcctgggtcgaccttctatgtctgggtcgacgtttcatttcattttctattatattagagttttccttttttattatctgtcaatgaatattctaatgggaatggaatttcataatactgaaagagaagagctagcaattcggaacgcaaattgcgttttaatacgtctcactattctaattttttagaagaaatggcctttattatttcttttttatggggttaataaatattaaccaaatttaatttaagaaatgagagaattcagaatagctacgagaaagactagtccaatccataatgatgtaccagaaaatacaacatttttattatttgaccaaccatcaggagaagcaaatacaaggggtacactaattactaagactgaggaagtcgcaattaatgcaaaaacagctaattggaaagcaatagtcatatttctaatcctccaagctaccatcaaataaagttgactacatatttgatccctcacttaaccaaaattgtaaaaaatacaagaagtaggaggggtttaatcatgaatccattgattcttctctttaattcaaatttattacttaaaccgcttttttatttggatatgggggtgagaagagattatttactctttatttcacaagcgggtatagcggatcctgtatccgtgtatacagtatacagagatatatcgaaaaggaacttgtatctgatatctttctagaggctaataaatctttttatttttatatggctatgttctatttgtaggagtaaaataaggattaggctgtggagagatggctgagtggttgatagctccggtcttgaaaaccggtatagttctaggaactatcgagggttcgaatccctctctctccttttgcttattgaatacgtttgtttctttcattttttttttttctgtcccttatctttctttcataaaaaggaatgaatggctcggctagatggaataaccgagccagaacagaaaaaagtagaacaggtataaataagaaaatcttagttaagagggttcatgtaaagaacaggttccaaatcacgatcgattcccttttcaaaacctgctgcagcagctcgggctcttcctgcatgccataaatggcccacaaaaaagaagaatcctagaacaaaatgagaagttgataaccaacttctaggagagacataattaactgcattgatctcggtagctacgccacccacggaatttaaagagcctaaaggagcgtgggtcatatattctgctgagcgtcgttcttgccaaggttgtatgtcttttttcaacctactcaagtccaaaccgttggggccccttagaggttctaaccatggagcacgaaggtcccaaaaacgcatagtttcccctccaaagataacctccccagttggggaacgcattagatatttacctaaacctgtgggtccttgagcggatcccacattagctccaagacgctggtctctaactagaaaagtaaatgcttgagcttgagaagcttctggcccggtgggtccataaaactcactcggataagctgtattattgaaccatacaaaacaacaagcgataaaaccaaagacagataaagcagctaaactataagacaagtaagcttctccagaccatacaaatgcacggcgagcccatgcgaagggtttggttaaaatatgccaaattccgccaaatacacaaataaaacccaaccatacatgcccaccaattatatcttctaaatcatctacactaacaatccacccttctccaccaaaaggagattttagtaaataaccaaatataacactgggactaagggtcaaattggtaatttttcttacatctccccccccaggggcccaggtatcatatacaccgccaaaataaagagccttgagtactagaagaaaagcacctagacctaacaaaattaagtgaatacccaaaattgtagtcattttatttctatctttccagacataaccaaagaatggaaaagattcctcaagagtctcgggtcccagaagcgcgtgataaatgccaccgaagcctaagactgcggaggaaattaggtgaagtacgccagatacaaagtacggaaaagtatctagaaccttcccccctggccctactccccaacctagagtagctaagtgtggaagtaaaatcaacccttgttcatacatgggcttttctggtacgaaatgggccacttcaaataggttcattgctccggcccagaatacgattaatccggcatgggctacatgagctccaagtagtttaccggacaaattgataagtctggcattcccagcccaccaagcaaagccggtggtttcttggtcacgaccagctaaaacgaaagttccattaaagagcgtttccacgtggtagaacctcctcagggaatataagattttcatgaggctgatcctgagctgccatccacgcacgaataccctcgtttaaaagaatatttttggtgtagaaagtctcaaattcaggatcttccgctgcacggatttcctgggaaacaaagtcataggcacgtaagttcagagccaagccaactacgccaatagcactcatccataaaccggtgacgggtacaaatagcataaagaaatgtaaccaacgtttattggaaaaagcaacaccaaagatttgggaccaaaagcggttagcagtgaccattgaataagtttcttcagcttgagttgggttaaaagcacggaaggtatttgcaccatcaccgtcctcaaatagagtgttttctacggtcgctccatgaatagcgcatagcagagccgcacctaatactccggcaactcccatcatatgaaatgggttcaacgtccaattatgaaatccttgaaagaaaaggatgaatcgaaatatcgctgctacgccaaaactcggcgcaaagaaccaaccagattgccccagtggataaataaggaatacagaaacaaaaacagcaattggaccagagaatgagattgcattataaggccgcaattgaacagaccgagcaagttcaaattggcgtaacatgaaacctattagtgcaaaagccccgtggagagctacaaaagtccatagaccgcctaattgacaccaacgagtaaaatctccttgtgcttcgggcccccatagtagcaacaaagagtgtgctaaactattggcaggggtagaaactgctgcggttaagaaattacaaccttccaaataggaactagccaatccatgggtataccaagaagttacaaaagttgtccctgtaaaccaaccccctaaagcgaaataagcacaaggaaagagcaataggccagaccatcctacaaaaacgaaacggtcccttcgtaaccagtcatccatagtatcaaatagatcattttcttctttaggaattctaccaagggctatagtcatagtgatcctcctattcaattacttcaaccatttccgagcacctcatatcactttccaaggcatatgatagttttatcatctgtggacgatttctttctcgttcaatgccctttttcaatggtctcgaagagagaaatttcccatttttatctatggagtcacaaccgaggtcgtggtaaatccatgaatttgattcgatttgtttttcttatactatttgtttttcttatactatagaaatagaaataaattttttttctttcttatactatagaaagaaataaacctttgaattcagcattattccaagactcctatttcaaagtctatcttttaagggaaaaatgaaaataaaagtaacccttcttttcccattccctctctattgcatgggtggaagaactaaaatagaggattctgaaaaaaaaaaggaccttcgaaatccaattttatgtgtagcgcaaaggagttgcgatttcttcttattcctatagaacatctagtaacaagaatatgaaatcgtaaatagcgaaaaattcttgtcttgcgcggtctaagtctaaggaaataaaaaaaattcgcttatacaatttcatctacatcgaatttatatatcagaatagcggatagaggcatcattaaaggagtcaggtctacttactttatgcttctttccaattttatggtggatttgatagaaccctttttgctttcttgataaataatcgacaaaaaaagcgttttttttatataacctgcttgttttattataattataacaagtcctatatggaaatgcccgctaaagagaaaatctatttgattgtctctcggccaatatcgatttttagaaagaaaaaacaagaattttcttctttttttattaacattaagaaaaaagaatataactaaaatggaattggcaatataatttttatagacttttgaaagaaaaaaaaggggtttttttgcaaccattatttcttatttcttgcctatatcatatcacggaaacctttcgctttggaacgtggagagatggctgagtggactaaagcggcggattgctaatccgttgtacaatttttttgtaccgagggttcgaatccctctctttccgctcccttggatcatttgggactttcgaattggaaagaattctgacccccggattttctcatagataaatgtacgaaacaaatccaataagaaaaaaaaaaaaacggaattattactcctcgcgtccaggattccgtcctgggtcattagataagaatccaaagataaagagtgaaacaaagaatatcactactgtataaacaaaaagtttgagagtaagcattacataatctccaagatttttttttaaggaatagattaccagtttttccttaccacacggatccactaggatggtttttttttgatacctaaaatgcaaaaatgaattcttgaaaaaaattgcaagaattcatttataataagcactcttatcaatagcaaaaatagggttaggtggttaggtattgtgtaggtacctgctcaacctaggtgcaggggagtagaaaggctgatccaaatttattgctgtagctacccattcaatgtagaagaatttaaatttgagaatcgaaggttcataatataaaaatataaaacttctcggcttttacccattttaaaatttttttggaatgaacacatcattcaatttggcatacagagtactaaagatttcatcgaaaacttacagcagcttgccaaacaaaggctaatagaaaaaagaatagaggtataacaggcataatatccacgattggattgaaaatagcataagcttcgggtaatttggcaaagaaaaaactagtaggataaagaacagaattaaaacagatacaggttaaactaagtatattaggcataacaagcatttcattcttgtagagtaaataattggatttttcttgagttatttttttaagggaaagaaggaaaaggcagattcaaaatcttttttcttcggactttcccaaacacaaaatacctccttgtattcgcactctcaaatgagagtggaataaattcgactttcatataatatcttaatagaattccatgtaatgatcaatgcatttttttgattctatattatccgcatgtgtagaatactagcaagagaatatccctccttttttatgtaattgaaatggtattgacgaataacaaataaacatactagtgtttattagtgtcgcataaaacccgaaatggggcgtggccaagtggtaaggcagcgggttttggtcccgttactcggaggttcgaatccttccgtcccagattgtttctgatgaaacaaacggtgaaatcatatagtattccgtacgagacaaaagtttattaaagagaataatgatatcttattctttctcagaaaacataataaagtcttaagtccagtcaaattgactatctttattttcatgaaaaaatgggatctatcaagcacattcaggatatgcctctactataaaatcacttagtcatatttttttcttccttttggtattcgagttgaagaagtacgagaattctataactaccaaaaactttcaatcttttcattggaatagtttttttagttattatagttaattgtttttggtactgaaaaaatatattactactagaattagaattctagtaattaaattaattaaacttttttggaggttgatagtttatttattgaggaagagtcaatccttctcttctcacttcaagattgatcatctcgagccatccgttgagggtggaaatttaagaataaataagttttaagcaaacttgtttagtcgtctttttcaaactatgtttcattcatatgatagaattttaatatgggtttaaataaattggatcttggcggaggcttcccggataaatacttactttcttttatccatattgctccatagatagcaagttttaattagtataaaaaaactaaaccaatgactattcatgattccatccatattggatcaattctctataccactttgcaatgaaaagaggaatgtttgttatggtaaaacttcgtttaaaacgatgtggtagaaagcaacgtgcgacttgaaggacatgatcgattgtggattttgctatccatcattttccatagtaatgaaaatgctcttggctcgacatagcctgttctattcgttccgaaccaaatttgcgctgggtttaagtaacatagtacacgatggagctcgagaggacagaattttttttatcaagggaaagaatctagggttagtgaaaactaataaattaggccaactttgtcagtctatccttaatatagaaataaatcgaaaggttcaaataagaagaaagtccaataaaagtatatcagaatcaatccctcttattagatttctatagaagagataaatgctttatcgaaggaaataagaaaaaagggtatgttgctactcttttgaaagaaaaaaataggaattcccgaagtaatgtctaaacctaaggatttcacaaatcaaagataaaggattccagaacaagtaaacacaattttcaattgtctcaacaacagagttggatcagaataaggaataaaagtcaattcgttcgaaatgagacaaagaaaagagtttaaagacgactcaaaaattttggaaggattttgccttcgaagtttgtcaggcaaaattagcccacttgagtcatgagtataaatgaaatttgttttttctgtaaggaaattaatgcacgtcatagtctaatttctattattatcgacagaaattcgaatcattttctcgagccgtatgaggagaaaacctcctatacgtttctaggggggggcgttgtttatctacatctatcccaataagctgtctatcgaatcgttgcaattgatgttcgatctcgaagagaaggaagagatcttcaaaaagtaggtttttatgatccgataaagaatcaaacttgtttaaatgttccagctattctctatttccttgaaaagggtgctcaaccgacaagaactgtttatgatattttaaggaaggcggaattctttaaagaaaaagaaagcactttgagttaattgaagaactaaatgaatcaaaaagtaggataggagaagattattagtattcctagttgtataattatttagacacaatttacctctttcttaatcctatttggatttatattatatcgtgctaatccaacataagcccctattttatttactttttctatctaatttgttttcttaccattgtatttccattgacaaaggtctattgaacaaatagaatttgtagatagatgggtctctttatcctcactccatattccatttttctccctacacttcgctcaaatgataagggtgttcctcttgcatgtattctcatacaatataatatatatttttaataaaaatcgctaaaaataaggagaatttggccatcgtgattagggtcgctcgttttttaactttactttagtggaatttaaccggacctgttcgttttggcatttgagtgtttttcatggtcgataaaaaaaatcttttgatgtcttactagttcaatgttttgacagaagcgcgcggtgtaattccattgatttttggatttcgatcgtatctaagatcctttttttatctgggttgctaactcaatggtagagtactcggcttttaagtgcgactatgatcttttacacatttggatgaaacaacaaattcgtccagactcttggtagagtctagaagaccacgactgatcctcaaaggtaatgaatggaaaaaatagcatgtcgtaataaaatcaatcttttttgaatggaatccaaaattacgattttctgggtctagtgaataaatggatagagcctggctccaattctggtaaaataaaaagcaacgagctgaacttcctaattggaatgattccccgctctaattagacgttaaaaatagattagtgccggatgcggggaaaggttgggttttcctatgagtggaccctttattttctttttagaaatcctaattattcttgattatggattgaataagggatgttatggattgaatgtgtaaaagaagcagtatattgataaagaggctgtattccaaagtcaaaagagcgattggcctgcaaaaataaaaacttgttctgttcttttttgaattagaacaaacataaactaattgggtagaaaaggagcagaaaaagatctgtggattagactccctttctttccagggtttgtattaaaaatgcaacaccctgttctgaccatattgcactatgtatcatcattcgataaaccgagaaatgcttcttctctctgattcaagtagaaatacaaatggaaaaattcgaagggtattcagaaaaacataaatctcgtcaacaatacttcgtctacccacttctctttcaggaatatatttatgcatttgcccacgattatggattaaatggttctgaacctgtggaaatagttgttagttgtaataacaagaaatttagttcactacttgtgaaacgtttaattattcgaatgtatcagcagaattttttggataactcggttaatcatcctaaccaagatcgattattggattacaaaaattatttttattctgagttttattctcagattctatctgaagggtttgcgatcgttgtggaaatcccattctcgctacgggaattattttgtccgaaagaaaaagaaataccaaagtttcagaatttacgctctattcattcaatatttcccttttttgaagacaaatttttgcatttggattatctatcacatatagaaataccctatcctatccatttggaaatcctggttcaactccttcaataccgtatccaagatgttccatctttgcatttattgcgattctttctcaactactattcgaattggaatagttttattacttcaatgaaatccttttttttttcaaaaagaaaataaaagactatttcgattcctatataactcttatgtatcagaatatgaattttttttgttgtttcttcgtaaacaatcttcttgcttaccattagcatcttctggaacttttctggaacgaatccacttttctaggaagatggaacattttgggataatgtaccctggtttttctcggaaaaccctatggttctttatggatcctcttatgcattatgttcgatatcaaggaaaggcaattcttgcatcaaaaggcactttttttttgaagaagaaatggaaatgctaccttatcaatttatggcaatattatttctgtttttggactcagccgcgaagaatccatataaaccaattagcaaactcttgcttcgattttatggggtacctttcaagtgtaccaaaaagttctttgttagtaaggaatcaaatgctggagaattcatttctaatagatactcgaatgaaaaaattcgataccatagtccccgctactctcctcataggatacttatcaaaagctcaattttgtactggatcggggcatcctattagtaaacccatttggacagatttatcagattgggatattcttgatcgatttggtcggatatgtagaaatctttttcattattatagtggatcttcgaaaaaacggactttgtatcgactaaagtatatacttcgactttcatgcgctagaactttagctcgtaaacataaaagcacggtacgaacttttatgcaacggttgggttcggcatttttagaagaattttttatggaagaagagcaagttttttctttgatgttcaccaaaacaactcttttttctttctgtggatcacacactgagcgtatttggtatttggatattatacgtatcaatgacctggtcaaccctcttaattaatcattagacgaaattaagaaacaggaaagggttgataaatgatcaagaaaaaacttttctatttttcattctgaaatgttctttttattataataaagagtaggtgaatcaacttactaattaaaaaattagtagaacttcctctttggaatagaaattggctatttctacatagggaaagtcgtgtgcaatgaaaaatgcaagcacgatttggggagggatttttctctattgtaacaaggaagaattatctactccatccgactagttccgggttcgagtcccgggcaacccatatagaaaagacccatcaaagtttttaactttgactcacttcatttacaaatacaaaattattggtttggttaatttagttatatggatagctaatctttgggctgacttggttgacattggtatatagtctatgttatactgttaaataacaagccttctattatctatattctagttaatacgtgtgcttgggagtccttgcaatttgaataaaccaagatcttaccatgactgcaattttagagagacgcgaaagtacaagcctgtggggtcgcttctgcaactggataactagcactgaaaatcgtctttacatcggatggttcggtgttttgatgatccctaccttattgaccgcaacttctgtatttattatcgccttcatcgctgcccctccagtagatattgatggtattcgtgagcctgtttctggttctttactttatggaaacaatattatctctggtgctattatccctacttctgcggcgatcggattgcacttttacccaatttgggaagctgcatctgttgatgagtggttatacaatggtggtccttatgagctaattgttctacacttcttacttggtgtagcttgttatatgggtcgtgagtgggaacttagtttccgtctgggtatgcgtccttggattgctgttgcatattcagctcctgttgcagctgctactgctgttttcttgatttaccctattggtcaaggaagcttttctgatggtatgcctttaggaatctctggtactttcaactttatgattgtattccaggcagagcacaacatccttatgcatccattccacatgttaggtgtagctggtgtattcggcggttccctattcagtgctatgcatggttccttggtaacctctagtttgatcagggaaactactgaaaatgaatctgctaatgagggttacaaatttggtcaagaggaagaaacttataatattgtggctgctcatggttattttggccgattaatcttccaatatgctagtttcaacaactctcgttctttacacttcttcttggctgcttggcctgtagtaggaatctggttcactgctttaggtattagtactatggctttcaacctaaatggtttcaatttcaaccaatctgtagttgatagtcaaggtcgcgttattaatacttgggctgatatcatcaaccgtgctaaccttggtatggaagtaatgcacgaacgtaatgctcacaacttccctctagacttagctgctgttgaagttccatctattaatggataaggtttttctgctaacatataagaatttttgaagaaagaaaagacagaaatacccaatatcttgctagaaca

SEQ ID NO: 4355 - DNA, 4864 bp, Festuca arundinacea
acttgcatctgagatctttctaggggttagtagatctttttatatggctatgttctacttgtacgaaaaaatagggattaggctgtggagagatggctgagtggttgatagctccggtcttgaaaaccggtatagttctaggaactatcgagggttcgaatccctctctctccttttgcttattgaatatgcttgtttcttgaattttttatctttattctgtcccttatctttctttcataaaaaggaatgaatggctcggctagatggaataaccgagccagaacagaaaaaaataaaacattagaacaggtataaataagaaaatcttagttaagaggattcatgtaaagaacaggttccaaatcacgatcgattcccttttcaaaacctgctgcagcagctcgggctcttcctgcatgccacaaatggcccacaaaaaagaagaatcctagaacaaaatgagaagttgataaccaacttctaggagagacataattaactgcattgatctcggtagctacgccacccacagaatttaaagagcctaaaggggcgtgggtcatatattctgctgaacgtcgttcttgccaaggttgtatgtcttttttcaacctattcaagtccaaaccattggggccccttagaggttctaaccatggagcgcgaaggtcccaaaaacgcatagtttcccctccaaagataacctccccagttggggaacgcattagatatttacctaaacctgtgggtccttgagcagatcccacattagctccaagacgctgatctctaactagaaaagtaaatgcctgagcttgagaagcttctggcccggtgggtccataaaactcactcggataagccgtattattgaaccatacaaaacaacaagcgataaaaccaaagacagataaagcagctaaactataagacaagtaagcttctccagaccatacaaatgcacggcgagcccatgcaaagggtttggttaagatatgccaaattccgccaaatacacaaatgaaacccaaccatacatgtccaccaattatatcttctaaatcatccacactaacaatccacccttctcccccaaaaggagattttagtaaataaccaaatataacactggggctaagagtcaaattggtaatctttcttacatctccccccccaggggcccaggtatcatatacaccgccaaaataaagagccttaagtactaaaagaaaagaacctagacctaacaaaattaagtgaatacccaaaattgtagtcattttatttctatctttccatacataaccaaaaaatggaaaagattcctcaagagtctcagggcccagaagcgcgtgataaatgccaccgaagcctaagactgcggaggaaattaggtgaagtactccagatacaaagtacggaaaagtatctagaacttctccccctggtcctactccccaacctagagtagctaagtgtggaagtaaaattaagccttgttcatacatgggcttttctggtacgaaatgagccacttcaaataggttcattgctccggcccagaatacgattaatccggcatgagctacgtgagctccaagtagcttaccggacaaattgataagtctggcattcccagcccaccaagcaaagccggtggtttcttggtcacgaccagctaaaacgaaagttccattaaagagcgtttccacgtggtagaacctcctcagggaatataagattttcatgaggctgatcctgagctgccatccacgcacgaataccctcgtttaaaagaatatttttggtgtagaaagtctcaaattcaggatcttccgctgcacggatttcctgggaaacaaagtcataggcacgtaagttcagagccaggccaactacgccaatagcactcatccataaaccggtgacgggtacaaatagcataaagaaatgtaaccaacgtttattggaaaaagcaacaccaaagatttgggaccaaaagcggttagcagtgaccattgaataagtttcttcagcttgagttgggttaaaagcgcggaaggtatttgcaccatcaccgtcctcaaatagagtgttttctacggtcgctccatgaatagcgcatagcagagccgcgcctaatactccggcaactcccatcatatgaaatgggttcaacgtccaattatgaaatccttggaagaaaaggatgaatcgaaatattgctgctacgccaaaactcggcgcaaagaaccaaccagattgccccagtggataaataaggaatacagaaacaaaaaccgcgattggaccagagaatgagattgcattataaggccgcaattgaacagaccgagcaagttcaaattggcgtaacatgaaacctattagtgcaaaagccccgtggagagctacaaacgtccataaaccgcctaattgacaccaacgagtaaaatctccttgtgcttccggcccccatagtagcaacaaagagtgtgctaaactattggcaggggtagaaactgctgcggttaagaaattacaaccttccaaataggaactagccaatccatgggtataccaagaagttacaaaagttgtccctgtaaaccaaccccctaaagcgaaataagcacaaggaaagagcaataggccagaccatcctacaaaaacgaaacggtcccttcgtaaccagtcatccatagtatcaaatagatcattttcttctttaggaactctaccaagggctatagtcatagtgatcctcctattcaattacttcaaccatttccgagcacctcacgtcacttccaaggcttatgatagttttattatctgtggacgatttgtttctcgttcaatgcccttttttcaatggtctcgaagatataaattttttatttttatctatggaggcacaaccgaggtcgtggtaaatccatgaattttattcgatttgtttttcttatactctagaaataaacatttcaattcagcattattccatgactcctatttgaaatttgaaagcctatctttaagggaaaaatgaaaataaaagtaacccctatattctcattccctctctatttcatgggtggaagaacagaaaaggaggattcttaaaaaaaaaaaaaggactttcgaaatctatttttatgtgtagcggaaaggagttgcgatttcttcttattcctatagaacatctagtaacaagaatagaaaatcgtaaataaaaaaaattcttgtcttgcgcggtataagtctaaggaaataaaaaaaattcgcttatacaatttgatccacatcgaatttatatatcagaatagcggatagaggcattattcaaggagtcagatctacttactttatggttctttccaattttatgttgggtttgataagaaccctttttgctttcttgataaataattgacaatcgacaaaaaagcgttttttctttttttttatatataacctgcttgttttattataacaagtcttatagggaaatgcccgctaaagagaaaatctatctgattgtctctcggccgatattggtttttagaaagaaaaaacaagaattttcttattttttttattaacattaagaaaaaagaatagaactaaaatggaattggcaatataatttttatatacttttgaaagaaaaaaaaagggtttttgcaatccttatttcttgtttctatcatatcacgtaaaccttttgatttggaacggggagagatggctgagtggactaaagcggcggattgctaatccgttgtacaatttttttgtaccgagggttcgaatccctctctttccgctccctcggatcattttggactttcaaattggaaggaattctgacccccggatttgctcatagataaatgtacgaaccaaatccaatttgtaagaaaaaataaaaaaaaatggaatttttactcctcgcgcccaggattccgtcctgggtcattagataagaatccaaagataaatagggaaacaaaaaatattactactgtataaacaaaaagtttgagagtaagcattacataatctccaagatttttttttaaggaatagattaccagtttttccttaccacatggatccactacgatgaattttgtttattttttatttttatagttcaaaatgcaaaaatgaattcttgaaaaaaaattggaagaattcatttataataagcactcttatcaatataaaaaatattgttaggtattgtgtaggtacctaaacctgctcaacgtaggtgcagaagggtagaaaggctgatcaaaatttattgatgcagctatccattcaatgtagaagaatttgcattttagagttgaaggttcataatataaaaatataaaagttctcgccttttacccattttttttcattttttggaatgaaaacaccattcaatttggtagatagagtactaaacatttcatcgaaaacttacagcagcttgccaaacaaaggctaatagaaaaaagaatagaggtatgacaggcataacatccacgatggggttgaaaatagcataagcttcgggcaatttggcaaagaaaaaactagtcggataaagaacagaattaaaacagatacaggttaaactaagtatattaggcataacaagcatttcattcttgtagagtaaataattggattttgattgagttatttttctaagggaaaaaggagaaggcagattccaaatcttttttcttcggactttcccaaacacaaaatacctcctcgtattcgcactcttaaatgagagtagaataaattcgactttccccccgtactctgcgttgataccactgcttagtcgtggtgt

SEQ ID NO: 4356 - DNA, 3764 bp, Avena sativa
agttttcctttttttattgtctgtcaatgaatattctaaaatgaatattctaataggaatggaatttcataatactgaaagagaagaggtagcaattcggaacgcaaattgcgttttaattttaatgcgtctcactattcgaatgttttcgaagaaatgccctttttattttttttgtacctgcctactaaatactaaacaaatttaagaaatgagagaattaagaatagctacgagaaagactagtccaatccataatgatgtaccggaaaatacaacgtttttattatttgaccaaccatcaggagaagcaaatacaaggggtacactaattactaagactgaggaagtcgcaattaatgcaaaaacagctaattggaaagcaatagtcatatttctaatcctccaagctaccatcaaataaagttgactacatatttgatccctcacttaaccaaaattgtaaaaaaatacaagaagtaggaggggtttaatcatgaatccattgattcttctctttaattaaaacttatttttacttaccgcttttttttatttggatatgggggtgaggagagggggtttagtctttatttcacaaatttcacaagcgggtatagcggatcatgtatccgtgtatacagtatacagagatatgtcgaaaagggacttgaatctgagatctttctataggttagtagagctttttatatggctatgttctatttgtaggagtaaaatagggattaggttgtggagagatggctgagtggttgatagctccggtcttgaaaaccggtatagttctaggaactatcgagggttcgaatccctctctctccttttgcttattgaatatgtttgtttctttaattttttttctttattctgtcccttatctttctttcataaaaaggaatgaatggctcggctagatggaataaccgagccagaacagaaaaaaagaaaacattagaacaggtataaataagaaaatcttagttaagagggttcatgtaaagaacaggttccaaatcacgatcgattcccttttcaaaacctgctgcagcagctcgggctcttcctgcatgccacaaatggcccacaaaaaagaagaatcctagaacaaaatgagaagtcgataaccaacttctaggagagacataattaactgcattgatctcggtagctacgccacccacagaatttaaagagcctaaaggcgcgtgggtcatatattctgctgaacgtcgttcttgccaaggttgtatgtcttttttcaacctactcaagtccaaaccgttggggccccttagaggttctaaccatggagcgcgaaggtcccaaaaacgcatagtttcccctccaaagataacctccccagttggcgaacgcattagatatttacctaaacctgtgggtccttgagcggatccgacattagctccaagacgctggtctctaactagaaaagtaaatgcttgagcttgagaagcttctggcccggtgggtccataaaactcactcggataagccgtattattgaaccatacaaaacaacaagcgataaaaccaaagagagataaagcagctaaactataagacaggtaagcttccccagaccatacaaacgcacggcgagcccatgcgaagggtttggttaagatatgccaaattccgccaaatacacaaatgaagcccaaccatatatgcccaccaattatatcttctaaatcatccacactaacaatccacccttctcccccaaaaggggattttagtaaataaccaaatataacactggggctaagggtcaaattggtaatttttcttacatctccccccccaggggcccaggtatcatatacaccgccaaaataaagagccttgagtactagaagaaaagcacctagacctaacaaaattaggtgaatacccaaaattgtagtcattttatttctatctttccatacataaccaaaaaatggaaaagattcttcaagagtctcgggtcccagaagcgcgtgataaatgccaccgaaacctaagactgcggaggaaattaggtgaagtactccagatacaaagtacggaaaagtatctagaacttctccccctggccctactccccaacctagagtagctaagtgtggaagtaaaattaacccttgttcatacatgggcttttctggtacgaaatgagccacctcaaataggttcattgctccggcccagaatacgattaatccggcatgggctacgtgagctccaagtagcttaccggacaaattgataagtctggcattcccagcccaccaagcaaagccagtggtttcttggtcacgaccagctaaaacgaaagttccattaaagagcgtttccacgtggtagaacctcctcagggaatataagattttcatgaggctgatcctgagctgccatccaagcacgaataccctcgtttaaaagaatatttttggtgtagaaagtctcaaattcaggatcttccgctgcacggatttcctgggaaacaaagtcataggcacgtaagttcagagccaggccaactacgccaatagcactcatccataaaccggtgacgggtacaaatagcataaagaaatgtaaccaacgtttattggaaaaagcaacaccaaagatttgggaccaaaagcggttagcagtaaccattgaataagtttcttcagcttgagttgggttaaaagcgcggaaggtatttgcaccatcaccgtcctcaaataaagtgttttctacagtcgctccatgaatagcgcatagcagagccgcacctaatactccggcaactcccatcatatgaaatgggttcaacgtccaattatgaaatccttggaagaaaaggatgaatcgaaatatcgctgctaccccaaaactcggcgcaaagaaccaaccagattgccccagtggataaataaggaatacagaaacaaaaacagcgattggaccagagaatgagattgcattataaggccgcaattgaacagaccgagcaagttcaaattggcgtaacatgaaacctattagtgcaaaagccccgtggagagctacaaaagtccatagaccgcctaattgacaccaacgagtaaaatctccttgtgcttccggaccccatagtaacaacaaagagtgtgctaaactattggcaggggtagaaactgctgcggttaagaaattacaaccttccaaataggaactagccaatccatgggtataccaagaagttacaaaagttgtccctgtaaaccaaccccctaaagcgaaataagcgcaaggaaagagcaataggccggaccatcctacaaaaacgaagcggtcccttcgtaaccagtcatccatagtatcaaatagatcattttcttctttaggaactctaccaagggctatagtcatagtgatcctcctattcaattacttcaaccatttccgagcacctcatgtcacttccaaggcatatgatagttttcttatctgtggacgatttgtttctcgttcaatgccctttttcaatggtctcgaagatagaaattttttatttttatctagggagtcacaaccgaggtcgtggtaaatccatgaatttgattcggtttgtttttcttatactatagaaatcaacatttcaattcagcattattccatgactcctactttaaaagcctatcttttaagggaaaatgaaaataaaagtaacccctctattctcgtttcctctctatttcatgggt

SEQ ID NO: 4357 - DNA, 1890 bp, Lolium multiflorum
cgcccgggcaggtacgagtaaaatagggattaggctgtggagagatggctgagtggttgatagctccggtcttgaaaaccggtatagttctaggaactatcgagggttcgaatccctctctctccttttgcttattgaatatgcttgtttcttgaattttttatctttattctgtcccttatctttctttcataaaaaggaatgaatggctcggctagatggaataaccgagccagaacagaaaaaataaaacattagaacaggtataaataagaaaatcttagttaagaggattcatgtaaagaacaggttccaaatcacgatcgattcccttttcaaaacctgctgcagcagctcgggctcttcctgcatgccacaaatggcccacaaaaaagaagaatcctagaacaaaatgagaagttgataaccaacttctaggagagacataattaactgcattgatctcggtagctacgccacccacagaatttaaagagcctaaaggggcgtgggtcatatattctgctgaacgtcgttcttgccaaggttgtatatcttttttcaacctattcaagtccaaaccattggggccccttagaggttctaaccatggagcgcgaaggtcccaaaaacgcatagtttcccctccaaagataacctccccagttggggaacgcattagatatttacctaaacctgtgggtccttgagcagatcccacattagctccaagacgctgatctctaactagaaaagtaaatgcctgagcttgagaagcttctggcccggtgggtccataaaactcactcggataagccgtattattgaaccatacaaaacaacaagcgataaaaccaaagacagataaagcagctaaactataagacaagtaagcttctccagaccatacaaatgcacggcgagcccatgcaaagggtttggttaagatatgccaaattccgccaaatacacaaatgaaacccaaccatacatgtccaccaattatatcttctaaatcatccacactaacaatccacccttctcccccaaaaggagattttagtaaataaccaaatataacactggggctaagagtcaaattggtaatctttcttacatctccccccccaggggcccaggtatcatatacaccgccaaaataaagagccttaagtactaaaagaaaagaacctagacctaacaaaattaagtgaatacccaaaattgtagtcattttatttctatctttccatacataaccaaaaatggaaaagattcctcaagagtctcagggcccagaagcgcgtgataaatgccaccgaagcctaagactgcggaggaaattaggtgaagtactccagatacaaagtacggaaaagtatctagaacttctccccctggtcctactccccaacctagagtagctaagtgtggaagtaaaattaagccttgttcatacatgggcttttctggtacgaaatgagccacttcaaataggttcattgctccggcccagaatacgattaatccggcatgagctacgtgagctccaagtagcttaccggacaaattgataagtctggcattcccagcccaccaagcaaagccggtggtttcttggtcacgaccagctaaaacgaaagttccattaaagagcgtttccacgtggtagaacctcctcagggaatataagattttcatgaggctgatcctgagctgccatccacgcacgaataccctcgtttaaaagaatatttttggtgtagaaagtctcaaattcaggatcttccgctgcacggatttcctgggaaacaaagtcataggcacgtaagttcagagccaggcctactacgccaatagcactcatccataaaccggtgacgggtacct

SEQ ID NO: 4358 - DNA, 2260 bp, Chenopodium quinoa
cacgatcaattccttttctaaatcctgctgcagctgcacgagcccttcccgcatgccacaaatgacctacgaataggaaaaatcctaaaacaaaatgagaagtagctaaccaacttctaggagagacataattgactgcattgatctcggtagccaccccacccacagaatttaaagaacctaaaggagcatgggtcatatattctgcggaacggcgttcttgccaaggttgtatgtcttttttcagccgactcaagtccaaaccatttggacctcttaggggttctaaccagggagcgcgcaaatcccaaaaccgcatagtttctcccccaaaaataacttctccagtcggagaacgcattagatacttacctaaaccagtaggtccttgagcggatcccacgttagccccaagacgttggtctctaactaaaaaagtaaatgcttgagcttgagaagcttctggtccagtaggtccgtaaaactcactaggataagcagtattattgaaccagacaaagcaacaagcaatgaaaccaaagacagataaagcagccaaactataagacaaataagcctctccagaccagacaagtgcgcggcgagcccatgcaaaaggtttagttaagatatgccagattccaccaagtatacaaatgaaacctatccatacatgccccccgattatatcttccaaatcgtccacactaacaatccacccttctcctccaaaaggcgattttagtaaataaccaaagataatactcggactaagggtgacgttggtaatttttcttacatctccgcctcctggagcccaggtatcatatacgcccccaaaataaagagccttgaacactagaagaaaggcgcctatacctaacaagattaagtgaatgcccaaaattgtggtcattttatttctatctttccacacataaccgaagaatggaaaagattcttcaagagtttcagggcccagaagtgcatgataaatacccccaaagcccaatacggccgacgaaattaagtgaaggactcctgatacaaagtatggaaaagtgtctataacttccccgccggggcctaccccccaacctagagtagctaggtggggaagtaaaattaatccttgttcatacatcggcttctctggtacgaaatgagccacttcaaacaggttcattgctccggcccagaatacgattaatccggcatgggctacatgagctccaagtagtttaccagataaattgataagtcgagcattcccggcccaccaagcgaaaccggtggtttcttggtcacgtccggctatagttaaagttccattaaagagcgtttccacggggtagaacctcctcagggaatataaggttttcatgaggctgatcttgagccgccatccaagcacgaataccttcgtttaagagaatatttttggtgtagaaagtttcaaattcaggatcttccgctgcacggatttcctgggaaacgaagtcataggcacgtaggttcaaagccagaccgactactccaagagcactcatccataaaccggttactggtacaaataacataaagaaatgtaaccaacgtttattaggaaaagcaaccccaaaatttgggaccaaaagcggttagcggtgaccattgaataagttctcggcttgggttggttaaaagccggaatgtatttgccccatcaccgtcttacaaataagtatttctacggtagcgccatgaatagcgcatagtagagcggcgccaatacaccggcaactcccatcatatgaaatggattcagtgtccaattatgaaacccttgaaaaagagaatgaatcgaaatatagctgctacaccaaaactaggtgcaaagaaccaaccagactgacctagtggataaattaggaatacagaacaaaaacagcaattggaccagagaatgcgattgcattataagggcgcaattgaacggatcgagcaagctcgaattgacgtaacataaaacctattagtgcgaaagcaccatgaagagcaacaaaagtccacaggccgcctaattgacaccaacgagtaaagtctccttgtgcttcaggaccccacagtaacaataaagagtgggctaaactattagcaggagtagaaactgccgcggttaagaaattgcaaccttccaaataagaactggccaatccatgggtataccatgaagttacaaaggttgtacctgtaaaccaacctcctaaggcgaaataag

SEQ ID NO: 4359 - DNA, 1440 bp, Oryza sativa
ataaataagaaaatcttagttaagaggggtcatgtaaagaacaggctccaaatcacgatcgattcccttttcaaatcctgctgcagcagcccgggctcttcctgcatgccacaaatggcccacaaaaaagaagaatcctagaacaaaatgggaagtcgctaaccaacttctaggagaaacataattaactgcattgatctcggtacctacgccacccacagaatttaaagagcctaaaggagcatgggtcatatattctgctgaatgtcgttcttgccaaggttgtatgtcttttttcaacctactcaagtccaaaccgttggggccccttagaggttctaaccatggagcacgaaggtcccaaaaacgcatagtttcccctccaaaaataacctctcccgttggggaacgcattagatatttacctaaacctgtgggtccttgggcagatcccacattagctccaagacgctgatctctaactagaaaagtaaatgcttgagcttgagaagcttctggcccagtaggtccataaaactcactcggataagctgtattattgaaccagacaaaacaacaagcgataaaaccaaagacagataaagcgcctaaactataagacaagtaagcttctccagaccatacaaatgcacggcgagcccatgcgaagggtttggttaagatatgccaaattctgccaaatacacaaatgaaacccaaccatacatgtcccccaattatatgttctaaatcatccacactaacaatccaaccctctcccccaaaaggggattttagtaaataaccaaatataacaccggggctaagggtcaaattggtaatttttcttacatctcctcccccaggagcccaggtatcatatatatcgccaaaataaagagctttgagtactagaagaaaagcacctatacctaacaaaattaggtgaatacccaaaattgtagtcattttatttctatctttccacacataaccaaagaatggaaaagattcttcaagagtctccggtcccagaagcgcgtgataaatgccaccgaagcctaagactgcggaggaaattagatgaagtactccagatacaaagtacggaaaagtatctagaacttctcccccgggccctactccccaacctagagtagctaagtgcggaagtaaaatcaacccttgttcatacatgggtttttctagtacgaaatgggccacttcaaataggttcattgctccggcccagaatacgattaatcctgcatgggctacgtgacctccaagtagtttacccgacaaattgataagtctggcattcccggcccaccaagcaaaaccggtggtttcttggtcacgaccagctaaaacaaaagttccattaaagagcgtttccacatggtagaacctcctcagggaatataagattttcatgag

SEQ ID NO: 4360 - DNA, 2618 bp, Taxus baccata
aaaaatagcgaaggatcccgctatcccgtctcccaacatggtaaatgaaaagaaattagatgaattatgattttatctagtttattttatcgtttaattaagaggggtcatggaaagaacaggttcaaaatcacgatcaattcctttctcaaatcctgctgcagctgcgcgagctcttcctgcatgccacaaatgacccacgaaaaagaaaaatcctagaacaaaatgagaggtggctaaccaacttcggggtgatacataattcaccgcattaatctcggtagctacaccacccacagaatttaaagaacctaaaggagcatgagtcatatattccgctgaacgtcgttcttgccagggttgtatgtcctttttcaacttactcaggtccaaaccattaggaccccttagaggttccaaccagggagcacgaagatcccaaaaacgcattgtttctcctccgaagataatttctccagtaggagaacgcattagatatttacctaaaccagtaggcccctgggcagaccctacactagctccaagacgttgatctctaactagaaaagtaaatgcttgagcttgagacgcctctgggccggttggcccatagaattcactgggataagctgtattgttaaaccaaacaaaacaacaagcaataaaaccaaagatagaaagagcagctaaactataggacaagtaggcttctcctgaccatacaaacgcacgacgagcccatgcaaaaggttttgttaagatgtgccagataccaccgaaaatacaaatggaacctaaccatacatgtcctccgattatatcttctagattgtccacgctaacaatccatccctctcctccaaaaggagacttgagcaaataaccaaatatagcaactgggttaagcgtaaggttcataatttttcttacatctccaccgccaggagcccaggtatcatatatgccaccaaaatacaaagccttgaagactagaagaaaagcaccaacacctagcaaaaattaagtgaatacctaaaattgtagtcattttatttctatctttccagacataaccaaaaatggaaaagattcttctaaagtttcgggtccgattagtgcgtgataaataccaccaaaacctaaaactgcagaagaaattaagtgaagtaccccagatacaaaatagggaaaagtgtccacaatttccccaccaggaccgactccccatcctaaagtagctagatggggaagtaaaatcaatccttgttcatacataggcttttccgatacaaaatgagccacttcaaatagattcattgctccagcccagaatacaattaatccggcatgagccacgtgagccccaagtaatttgcctgacaaattgataagtcgggcattaccagcccaccaagcgaaaccagtagtttcttggtcacgaccagctaaagatagagttccattaaagagcgtttccacggggtagaacctcctcagggaatataaggttttcatgaggctgatcttgagccgccatccaagcacgaataccttcgttcaagagaatattttttgtgtagaaagtttcaaattcaggatcttctgccgcacgaatctcctgagaaacaaagtcataggcacgtaagtttagagctagaccaactactccaatggcactcatccataaaccggtcactggcacaaataacatgaagaaatgtaaccaacgtttattggaaaaagcaaccccaaaaatttgggaccagaaacggttagcagttaccatagaataagtctcttcagcttgagttgggttaaaagcacggaacgtatttgcaccatcaccgtcttcgaataaagtattttccacggtagcaccgtgaatagcacatagaagagcagcacccaatactccggcaactcccatcatatgaaatggattcaaggtccaattatgaaaaccttgaaaaaagaggataaatcggaaaatagccgctacaccaaaactaggtgcaaaaaaccaaccagactggcctaatggatagatcaagaatacagaaacaaaaacagcaatcggagcagagaacgcaattgcattataaggtcgcaattgtacagatcgagcaagttcaaattggcgtaacatgaagcctattagaccaaaagcaccatgaagagcaacgaaagtccatagaccacctaattggcaccaacgagtaaaatctccttgtgcttcaggaccccataatagcagcaaagaatgtgctaaactattagcaggcgtagaaactgcggcagttaaaaaattacaaccttccaaatacgaactggccaatccatgagtataccatgaagtcacaaaggttgtacccgtgaaccatccacctagggcaaaataagcacaaggaaaaagcaatagaccagaccaacccacaaaaacaaaacggtctctgcgtagccagtcatccatagtatcaaataaagtttgttcctctttggaagactttccaagggctatagtcatagtaatcctcctatttaactattccgaccttttccgaacaccctatctgataaaatcaaaaggtatacgctggtttgtctatctatggatttaa

SEQ ID NO: 4361 - DNA, 4118 bp, Setaria italica
ataaattcgatgtggatgaaattggtgtataagcggattttttgtatttccttagacttagatcgcgcaaggcaagaatttttcgctatttacgatttcatattcttgttactagacgttctataggaataagaagaaatcgcaactcttttccgttacacataaaaagggtttcaaaagtcaattttgcttttcaatatctttctttttttcagaatcctatttttgttcttccacccatgcaatagagagcgaatgagaaaagaggggttattgttcccttaaaagagaggctttgaaataggaatcatggaataatgctgaattcaaatgtttatttctttatttctatagtgtaagaaaaataaattgaataaaattcgtggatttaccacaaccttggttgtgaccccatagataaaaatgcaaaatttctatcttcgagaccatgaaaaagggcattgaacgagaaagaaatcgtccacagataatcaaactatcgtatgccctggaagtaatatgaggtgctcggaaatggttgaagtaatgaataggaggatcactatgactatagccattggtagagttactaaagaagaaaatgatctattgatattatggacgactggttacgaagggaccgtttcgtttttgtaggatggtccggcctattgctctttccttgtgcttatttcgctttagggggttggtttacagggactacttttgtaacttcttggtatacccatggattggctagttcctatttggaaggttgcaatttcttaaccgcggcggtttccactcctgccaatagtttagcacactctttgttgctactatggggcccggaagcacagggggattttactcgttggtgtcaattaggtggtctgtggacttttgtcgctctccatggggcttttgcactaataggtttcatgttacgtcaatttgaacttgctcggtctgttcaattgcggccttataatgcaatttcattctctggtccaatcgcagtttttgtttccgtattccttatttatccactgggacaatctggttggttctttgcgccgagttttggcgtagcagctatattcgatttatccttttcttccaaggatttcataattggacgttgaacccatttcatatgatgggagttgccggagtattaggcgcagctctgctatgcgctatccatggggctaccgtagaaaacactctattcgaagatggtgatggtgcaaataccttccgcgcttttaacccaactcaagctgaagaaacttattcaatggtcactgctaaccgcttttggtcccaaatctttggtgttgctttttccaataaacgttggttacatttctttatgctatttgtacccgtcaccggtttatggatgagtgctattggcgtagttggcctggctctgaacctacgtgcctatgacttcgtttcccaggaaatccgtgcagcggaagatcctgaatttgagactttctacaccaaaaatattcttttaaacgagggtattcgtgcgtggatggcagctcagatcagcctcatgaaaatcttatattccctgaggaggttctaccacgtggaaacgctctttaatggaactttcgttttagctggtcgtgaccaagaaaccaccggctttgcttggtgggctgggaatgccagacttatcaatttgtccggtaactacttggagctcatgtagcccatgccggattaatcgtattctgggccggagcaatgaacctattgaagtggcccatttcgtaccagaaaagcccatgtatgaacaagggttaattttacttccgcacttagctactctaggttggggagtagggccagggggagaagttctagatacttttccttactttgtatctggagtacttcacataattcctccgcagtcttaggcttcggtggcatttatcacgcgcttctgggacccgagactctgaagaatcttttccattctttggttatgtatggaaagatagaaataaaatgactacattttgggtattcacttaattttgttaggtctaggtgcttttcttctagtactcaaggctctttattttggtggcgtatatgatacctgggcccccggggggggggatgtaagaaaaattaccaatttgacccttagtcccggtgttatatttggttatttactaaaatccccttttggggagaaggatggattgttagtgtggatgatttagaagatataattgggggacatgtatggttgggttccatttgtgtacttggaggaatttggcatatcttaaccaaaccctttgcatgggctcgccgtgcctttgtatggtctggcgaagcttacttgtcttatagtttagctgctttatccgtttttggttttatcgcttgttgttttgtctggttcaataatacggcttatccaagtgagttttacggacccactgggccagaagcttctcaagctcaagcatttacttttctagttagagaccagcgtcttggagctaatgtagggtctgcccaaggaccgacgggtttaggtaaatatctaatgcgttccccaacgggagaggttatttttggaggggaaactatgcgtttttgggaccttcgtgctccgtggttagaacctctaaggggccccaacggtttggacttgagtaggttgaaaaaagacatccaaccttggcaagaacgacgttcggcagaatatatgacccatgctcctttaggctctttaaattccgtgggtggcgtagctaccgagatcaatgcagttaattatgtctctcctagaagttggttagcgacttcccattttgttctaggattcttcttttttgtgggccatttgtggcatgcagggagagcccgagctgctgcagcaggctttgaaaagggaattgatcgtgatttggaacctgttctttacatgacccctcttaactaagattttttgatttctacctgttctacttttttttctgttctggctcggttatttcatctagccgagccattcatgcttttttatgaaaaaatgatataagcgggcagaacaaagaaaaacatagaaagaaacaaatgtattcaataaacaaaaggagagagagggattcgaaccctcgatagttcctagaactataccggttttcaagaccggggctatcaaccactcagccatctctccacagcccaatccctatttattcctacaaatagaacatagctatatgaaatgatctactaaactccgataacatctctcagatgcaagtccactttcgatatatctctgtatactgtatacacggatacagaatccgctatatccgtttgtgaaataaaggctaaatcccctcaactccatatccaaataaaagcggtaaggaaaaagttttaaagagaagaatccatggattcatgattaaacccctcctacttcttgtattttcgtacaattttgattaagtgagggatcaaatagaaatatgtagtcaactttatttgaaggtagtttggaggattttaaatatgactattgctttccaattagctgtttttgcattaattgcgacttcctcagtcttagtaattagtgtaccccttgtatttgcttctcctgatggttggtcaaataataaaaacgttgtattttccggtacatcattatggattggattagtctttctggtagctattctgaattctctcatttcttgaatttgtttagtatttagtagcccgatataaaataaataaaaagaaaggccctttttcgaaaaaattctgattttgatacacattaaaatgctattttcgttccgaattattatattagctcttctccttcattattatgaaattctattgccattagaatacagacaattaataaaaagaaaactctaatagaaaatgaaacggtcgacccagacatagacggtcgacccaggtggatataccctataaaatataggccgtagcgggcgtagttcaatgtagcgagcgtagttcagtggtaaaacatctccttgccaaggagaagatacgggttcgattcccgtcgctcgccaccttaa

SEQ ID NO: 4362 - DNA, 3643 bp, Medicago truncatula
tgaaattcgaacagtggatcttttttgtttttaatatctctttagttcggactccgcaagaatctgtcaatatttcggattaaatcttattgttcctaggaataaattgatactcctcttctccacgcagaagggtttattctaagttccaacatataagtcattttactttaaaaatatctttatttccgaatacaagaaaagatcaaattaaatttctattatttctttaagatataagatatctataaaaaaaatagaaaaatccatcaaatcatgacttcgagtatcaaatatttaattttcatatctatgcatactaaatttttaaagcaattaatggacgaaactttcacttagaatctattatttttaataaaactccatacaatattaaaaaatctgatagatagataaaatagatagataaaaaaatattcgaatttcttacctcgatctgcaaaaaaggtatactttgtaatttttttaatctgaacgaaagaaaaatacaactaaagaggacaataaaagaaattaaagtaaaatagaaagtaaaaataggattctatagtagtttcctagacatacaaattagaagaatatataaaactttttttttatttcacgaacaagattcaagaataatattatttaatattatttgataaaaggagagtagtctgtctggggatctgctggtaacaaaagtgataaaagggatcatttcatttgtttctggaatagttctttaaaaaatttatttatcagatttacgaatcataagacaattcccgcgtcatgacttcatgacttagggaattttttagaatagaaaggaataacccaattaagttaatggatttgacctagattaaatatcaatcgacaaaaaaagtatttttctattcgaaacccagtagaaaagaagggacagtctttgagaaatcatatcatatataaaatgaaaaaatcctcgaaggttctatccctgaaaatgctagggggtgttcggaaatggttgaagtagttgaataggaggatcactatgactatagctcttggtaaatttaccaaagatgaaaatgatttatttgatattatggatgactggttacgaagggaccgttttgtttttgtgggttggtccggtctattgctctttccttgcgcctattttgccgtggggggttggttcacaggtaccacctttgtaacttcatggtatactcatggattggcaagttcctatttggaaggttgtaacttcttaactgcggcagtctctactcctgctaatagtttagcacactctttgttgttactatggggtcctgaagcacagggagattttacccgttggtgtcaattgggtggtctgtggacttttgttgctctccacggtgctttcggattaataggttttatgttacgtcaatttgaacttgctcgatctgttcaattgcgcccttataatgcaatcgcattctccggtccaattgctgtttttgtttctgtattcctgatttatccactgggtcagtctggttggttctttgcgcctagttttggtgtagcagctatatttcgattcattctatttttccaagggtttcataattggacattaaacccatttcatatgatgggagttgctggtgtattgggcgctgccctactatgcgctattcatggtgctaccgtagaaaatacgttatttgaagatggtgatggcgcaaatacattccgtgcttttaacccaactcaagcggaagaaacttattcaatggtcaccgctaaccgcttttggtcccaaatctttggggttgctttttccaataaacgttggttacatttctttatgttatttgtaccagtaactggtttatggatgagtgctcttggagtagtcggtctggccctgaacctacgtgcctatgacttcgtttctcaagaaatccgcgcagcggaagatcctgaatttgagactttctacaccaaaaatattctcttaaatgaaggtattcgtgcgtggatggcggctcaagatcagcctcatgaaaaccttatattccctgaggaggttctaccacaaactaccggttttgcttggtgggccgggaatgcccgacttatcaatttatccggtaaactactgggggcccatgtagcccatgccggattaatagtattctgggccggagcaatgaacctatttgaagtcgctcatttcgtacccgagaagcccatgtatgaacaaggattaattttacttccccatctagctactctaggttggggggtaggtcctggaggggaagttatagacacctttccatactttgtctctggagtacttcacttaatttcttctgcagtattgggctttggcggtatttatcatgcacttctgggacctgagactcttgaagaatcttttcctttctttggttatgtatggaaagatagaaataaaatgactactattttaggtattcacttaattttgttagggataggggcttttcttctagtatttaaggcttcttattttggaggtatatatgatacctgggctccaggagggggggatgtaagaaaaattaccaacttaacccttagtccaagtattatattgggttatttactaaaatctccttttgggggagaggggtggattgttagtgtggacgatttggaagacataattggagggcatgtatggttgggttccatttgtatacttggtggaatctggcatatcttaactaaaccctttgcatgggctcgtcgtgcactagtatggtctggagaagcttacttgtcttatagtttagcagctttatccctttttggttttatagcttgttgctttgtctggtttaataatactgcttatcctagtgagttttatggtcctactggaccggaagcttctcaagctcaagcatttacttttctagttagagaccaacgtcttggagctaatgtaggatccgctcaaggaccgaccggtttaggtaaatatttaatgcgttctccgaccggagaggttatttttgggggagaaactatgcgtttttgggatctgcgtgctccctggttagaacctctaagaggtcctaatggtttggacttgagtagactgaaaaaagacatacagccttggcaagaacgtcgttctgcggaatatatgactcatgctcctttaggttctttaaattccgtgggtggcgtagctacagagattaatgcagtcaattatgtctctcctagaagttggttagctacttctcattttgttctaggattcttcctattcgtaggtcatttatggcacgcgggaagagctcgtgcagctgccgcaggatttgaaaaaggaattgatcgagattcggagcctgttcttttcatgactcctcttaattgagacatgaaatacaatgcttgacgtaagaatcactttgattttagtatacatattgggttgagtcgagcagatgatattgaaaaaatatatttttttttcaattcatttatatgtaatatctaatcttttttcgggctcggctaagtggtgatatagtcgagcccgaaaaaaccgagctaacctaaatcaataaaattcaaaaatacattcgctaag

SEQ ID NO: 4363 - DNA, 1675 bp, Chenopodium quinoa
aatactttttacgtatgacctgatcccatatgtaatatgtatgatggaagccaattgatttataccttaaaacgttgaatttcttgtctcaattaaggggggtcattgaaagaacaggttcaaaatcacgatcaattcctttttcaaatcctgctgcagctgcacgagcccttcccgcatgccacaaatgacctacgaataggaaaaatcctaaaacaaaatgagaagtagctaaccaacttctaggagagacataattgactgcattgatctcggtagccaccccacccacagaatttaaagaacctaaaggagcatgggtcatatattctgcggaacggcgttcttgccaaggttgtatgtcttttttcagccgactcaagtccaaaccatttggacctcttaggggttctaaccagggagcgcgcaaatcccaaaaccgcatagtttctccccaaaaatacttctccagtcggagaacgcattagatacttacctaaaccagtaggtccttgagcggatcccacgttagccccaagacgttggtctactaaactaaaaagtaatgcttgagcttgagaagcttctggtccagtaggtaccgtaaaactcactaggataagcagtattattgaaccagacaaagcaacaagcaatgaaaccaaagacagataaagcagccaaactataagacaaataagcctctccagaccagacaagtgcgcggcgagcccatgcaaaaggtttagttaagatatgccagattccaccaagtatacaaatgaaacctatccatacatgccccccgattatatcttccaaatcgtccacactaacaatccacccttctcctccaaaaggcgattttagtaaataaccaaagataatactcggactaagggtgacgttggtaatttttcttacatctccgcctcctggagcccaggtatcatatacgcccccaaaataaagagccttgaacactagaagaaaggcgcctatacctaacaagattaagtgaatgcccaaaattgtggtcattttatttctatctttccacacataaccgaagaatggaaaagattcttcaagagtttcagggcccagaagtgcatgactaaatacccccaaagcccaatacggccgacgaaattaagtgaaggactcctgatacaaagtatggaaagtgtctatacttcccgccgggcctacccccaacctagagtagctagtgggaagtaaaattaatccttgttcatacatcggcttctctggtacgaaatgagccacttcaaacaggttcattgctccggcccagaatacgattaatccggcatgggctacatgagctccaagtagtttaccagataaattgataagtcgagcattcccggcccaccaagcgaaaccggtggtttcttggtcacgtccggctatagttaaagttccattaaagagcgtttccacggggtagaacctcctcagggaatataaggttttcatgaggctgatcttgagccgccatccaagcacgaataccttcgtttaagagaatatttttggtgtagaaagtttcaaattcaggatcttccgctgcacggatttcctgggaaacgaagtcataggcacgtaggttcaaagccagaccgactactccaagagcactcatccataa

SEQ ID NO: 4364 - DNA, 3974 bp, Setaria italica
tatatccacctgggtcgaccgtctatgtctgggtcgaccgtttcattttctattagagttttctttttattaattgtctgtattctaatggcaatagaatttcataataatgaaggagaagagctaatataataattcggaacgaaaatagcattttaatgtgtatcaaaatcagaattttttcgaaaaagggcctttctttttatttattttatatcgggctactaaatactaaacaaattcaagaaatgagagaattcagaatagctaccagaaagactaatccaatccataatgatgtaccggaaaatacaacgtttttattatttgaccaaccatcaggagaagcaaatacaaggggtacactaattactaagactgaggaagtcgcaattaatgcaaaaacagctaattggaaagcaatagtcatatttaaaatcctccaaactaccttcaaataaagttgactacatatttctatttgatccctcacttaatcaaaattgtacgaaaatacaagaagtaggaggggtttaatcatgaatccatggattcttctctttaaaactttttccttaccgcttttatttggatatggagttgaggggatttagcctttatttcacaaacggatatagcggattctgtatccgtgtatacagtatacagagatatatcgaaagtggacttgcatctgagagatgttatcggagtttagtagatcatttcatatagctatgttctatttgtaggaataaatagggattgggctgtggagagatggctgagtggttgatagccccggtcttgaaaaccggtatagttctaggaactatcgagggttcgaatccctctctctccttttgtttattgaatacatttgtttctttctatgtttttctttgttctgcccgcttatatcattttttcataaaaaagcatgaatggctcggctagatgaaataaccgagccagaacagaaaaaaaagtagaacaggtagaaatcaaaaaatcttagttaagaggggtcatgtaaagaacaggttccaaatcacgatcaattcccttttcaaagcctgctgcagcagctcgggctctccctgcatgccacaaatggcccacaaaaaagaagaatcctagaacaaaatgggaagtcgctaaccaacttctaggagagacataattaactgcattgatctcggtagctacgccacccacggaatttaaagagcctaaaggagcatgggtcatatattctgccgaacgtcgttcttgccaaggttggatgtcttttttcaacctactcaagtccaaaccgttggggccccttagaggttctaaccacggagcacgaaggtcccaaaaacgcatagtttcccctccaaaaataacctctcccgttggggaacgcattagatatttacctaaacccgtcggtccttgggcagaccctacattagctccaagacgctggtctctaactagaaaagtaaatgcttgagcttgagaagcttctggcccagtgggtccgtaaaactcacttggataagccgtattattgaaccagacaaaacaacaagcgataaaaccaaaaacggataaagcagctaaactataagacaagtaagcttcgccagaccatacaaaggcacggcgagcccatgcaaagggtttggttaagatatgccaaattcctccaagtacacaaatggaacccaaccatacatgtcccccaattatatcttctaaatcatccacactaacaatccatccttctccccaaaaggggattttagtaaataaccaaatataacaccgggactaagggtcaaattggtaatttttcttacatccccccccccgggggcccaggtatcatatacgccaccaaaataaagagccttgagtactagaagaaaagcacctagacctaacaaaattaagtgaatacccaaaatgtagtcattttatttctatctttccatacataaccaaagaatggaaaagattcttcagagtctcgggtcccagaagcgcgtgataaatgccaccgaagcctaagactgcggaggaattatgtgaagtactccagatacaaagtaaggaaaagtatctagaacttctccccctggccctactccccaacctagagtagctaagtgcggaagtaaaattaacccttgttcatacatgggcttttctggtacgaaatgggccacttcaataggttcattgctccggcccagaatacgattaatccggcatgggctacatgagctccaagtagttaccggacaaattgataagtctggcattcccagcccaccaagcaaagccggtggtttcttggtcacgaccagctaaaacgaaagttccattaaagagcgtttccacgtggtagaacctcctcagggaatataagattttcatgaggctgatctgagctgccatccacgcacgaataccctcgtttaaaagaatatttttggtgtagaaagtctcaaattcaggatcttccgctgcacggatttcctgggaaacgaagtcataggcacgtaggttcagagccaggccaactacgccaatagcactcatccataaaccggtgacgggtacaaatagcataaagaaatgtaaccaacgtttattggaaaaagcaacaccaaagatttgggaccaaaagcggttagcagtgaccattgaataagtttcttcagcttgagttgggttaaaagcgcggaaggtatttgcaccatcaccatcttcgaatagagtgttttctacggtagccccatggatagcgcatagcagagctgcgcctaatactccggcaactcccatcatatgaaatgggttcaacgtccaattatgaaatccttggaagaaaaggataaatcgaatatagctgctacgccaaaactcggcgcaaagaaccaaccagattgtcccagtggataaataaggaatacggaaacaaaaactgcgattggaccagagaatgaaattgcattataaggccgcaattgaacagaccgagcaagttcaaattgacgtaacatgaaacctattagtgcaaaagccccatggagagcgacaaaagtccacagaccacctaattgacaccaacgagtaaaatccccctgtgcttccgggccccatagtagcaacaaagagtgtgctaaactattggcaggagtggaaaccgccgcggttaagaaattgcaaccttccaaataggaactagccaatccatgggtataccaagaagttacaaaagtagtccctgtaaaccaaccccctaaagcgaaataagcacaaggaaagagcaataggccggaccatcctacaaaaacgaaacggtcccttcgtaaccagtcgtccataatatcaatagatcattttcttctttagtaactctaccaatggctatagtcatagtgatcctcctattcattacttcaaccatttccgagcacctcatattacttccagggcatacgatagtttgattatctgtggacgatttctttctcgttcaatgccctttttcatggtctcgaagatagaaattttgcatttttatctatggggtcacaaccaaggttgtggtaaatccacgaattttattcaatttatttttcttacactatagaaataaagaaataaacatttgaattcagcattattccatgattcctatttcaaagcctctcttttaagggaacaataacccctcttttctcattcgctctctattgcatgggtggaagaacaaaaataggattctgaaaaaaagaaagatattgaaaagcaaaattgacttttgaaaccctttttatgtgtaacggaaaagagttgcgatttcttcttattcctatagaacgtctagtaacaagaatatgaaatcgtaaatagcgaaaaattcttgccttgcgcgatctaagtctaaggaaatacaaaaaatccgcttatac

SEQ ID NO: 4365 - DNA, 2700 bp, Picea glauca
cattttattcgttatgaatatatgatatattcatataatttgaacataatatggaaaatacatatatcttcaatcccattcgtaagtagataccatttcttaatggtccaattcttttttcaattacggaaaacccctcctccttggacctgaaggaaaaggcccttcagaagagctataaagccctccgggaggggggggggagttttaacctaaaacatctagaacagatctaagatatgaaagaattaaggatacctacaaaaaggactgatccgatccataatgatacacccgaaaatacaacatttttgctacttgaccaaccatcgggagaggcaagtgcaacaggtacaccaatcactagtaaaaatgaaatagcaattaatgcaaacacagccgattggaaagcaatagtcatggttgtaatcttacaagctcccaacagattgaatagactataccatccgatccccaattttcaattctgatcaaatgcactatggaaaggatttgaccataaattgatcgagtttttcaaactttttcaatttgatatttgagtgtgagaggagagggaaattcgtttcttttttccattccagattataatgagaaatcatcatatgtaacaggtatggttggtatcggcccgaccttacgcttatagttagatattacccgaaggggtagaatagaagttgtccccgggagagatggccgagtggttgatggctccggtcttgaaaaccggtatagttaaaaaactatcgagggttcgaatccctctctctcctgttttttttttcaaaaatcacatttattagttcggtccagtaaaaaaaagagaatagctcggctggagatagccgagctacaaggatccagttggaaagagagtcttttcaaatatttctatcccgccgatatgggagattgatgtaatgaaattgaatcgagttctcttccatctggttcgatctcttgtttcagttaagaggagtcatggaaagaacaggttcgaaatcacgatcaattcctttctcaaatcctgctgcagctgcacgagcccttcccgcatgccacaaatgacctacgaagaggaaaaatcctagaacgaaatgggaggtggctaaccaacttcggggagagacataattcaccgcattgatttcggtagctacaccacccacagaatttaaagaacctaaaggagcatgagtcatatattctgccgaacgtcgttcctgccaaggctgtatgtcttttctcaacttgctcaggtccaaaccattagggcctcttaggggttccaaccagggagcacggagatcccaaaaacgcatcgtttcccctccaaatataatttctccagtcggagaacgcataaggtatttacctaacccagtaggtccttgggcagaccccacactagctccaagacgttggtctctaactagaaaagtaaacgcttgagcttgagaagcttctgggccggtgggcccataaaattcactgggataagctgtattgttgaaccaaacgaaacaacaagcaataaaaccaaagagagataaagccgctaaactataggacaaataagcttctccggaccatacgaatgcacggcgagcccatgcaaaaggtttggttaatatatgccagataccaccgaagatacaaatggaacctaaccatacatgtcctccaattacatcttctagattgtccacgctaacgatccatccttctcctccgaaaggagatttcagtaaataaccaaatatagcacttgggttaagagtcgggttcgtaatttttcttacatctccaccgccgggagcccaagtatcatatacacctccaaaatacaaagccttgagcactagaagaaaagcaccaacacctagcaagattaggtgaatacccaagattgtggtcattttgtttctatctttccatacatagccaaagaatggaaaagattcttctaaagtttcaggtcctatgagtgcatgataaataccaccaaaacctaaaaccgcagaagaaattaagtgaagtaccccagatacaaaatatggaaaagtgtccacgatttccccaccaggaccgactccccatcctagagtagctagatggggaagtagaatcaatccttgttcatacataggcttttccggtacgaaatgagccacttcgaataggttcattgctccggcccagaatacaattaatccggcatgagccacgtgagccccaagcaatttaccagacaaattgataagtcgggcattaccggcccaccaagcgaaaccagtggtttcttgatcacgaccagctaaagctatagttccattaaagagcgtttccacggggtaggacctcctcagggaatataaggttttcatgaggctgatcttgagccgccatccaagcacgaataccttcgttcaggagaatatttttagtgtagaaagtctcagattcaggatcttctgctgcacggatctcctgggaaacaaaatcataggcacgtaagtttagagctagaccaactactccaatggcactcatccatgaaccggtcactggcacaaataacatgaagaaatgtaaccaacgtttattagaaaaaagcaaccccaaaaatctgggaccagaagcggttagcagtgaccatggaataagtctcttcag

SEQ ID NO: 4366 - DNA, 2775 bp, Brassica rapa
ttaagcgggcgagcggcgggaatcgaacccgtatcttctccttggcaaggagatattttaccattgaactgcgctcgctacggtatatattttatagcgtatatccgcctgggtcgaccttctatgtctgggtcgaccgtttcatttcattttctattatattagagttttcctttttttattatctgtgaatgaatattctaatgggaatggaatttcataatactgaaagagaagagctcgcaattcggaacgcaaattgcgttttaatacgtctcactattctaattttttagaagaaatggcctttattatttcttttttatggggttaataaatattaaccaaatttaatttaagaaatgagagaattcagaatagctacgagaaagactagtccaatccataacgatgtaccggaaaatacaacatttttattatttgaccaaccatcaggagaagcaaatacaaggggtacactaattactaagactgaggaagtcgcaattaatgcaaaaacagctaattggaaagcaatagtcatatttcgaatcctccaagctaccatcaaataaagttgactacatatttgatccctcacttaaaccaaaattgtaaaaaaatacaagaagtaggaggggtttaatcatgaatccattgattcttctctttaattcaaatttattacttaaaccgcttttttatttggatatgggggtgagaagagattatttactctttatttcacaagcgggtatagcggatcctgtatccgtgtatacagtatacagagatatatcgaaaaggaacttgtatctgatatctttctagaggctaataaatctttttattttttatatggctatgttctatttgtaggagtaaaataaggattaggctgtggagagatggctgagtggttgatagctccggtcttgaaaaccggtatagttctaggaactatcgagggttcgaatccctctctctccttttgcttattgaatacgtttgtttctttcatttttttttttctgtcccttatctttctttcataaaaaggaatgaatggctcggctagatggaataaccgagccagaacagaaaaaaagtagaacaggtataaataagaaaatcttagttaagagggttcatgtaaagaacaggttccaaatcacgatcgattcccttttcaaaacctgctgcagcagctcgggctcttcctgcatgccataaatggcccacaaaaaagaagaatcctagaacaaaatgagaagttgataaccaacttctaggagagacataattaactgcattgatctcggtagctacgccacccacggaatttaaagagcctaaaggagcgtgggtcatatattctgctgagcgtcgttcttgccaaggttgtatgtcttttttcaacctacttaagtccaaactccaaaccgttggggccccttagaggttctaaccatggagcacgaaggtcccaaaaacgcatagtttcccctccaaagataacctccccagttggggaacgcattagatatttacctaaacctgtgggtccttgagcggatcccacaacgttagctccaagacgttggtctctaactagaaaagtaaatgcttgagcttgagaagcttctggcccggtgggtccataaaactcactcggataagctgtattattgaaccatacaaaacaacaagcgataaaaccaaagacagataaagcagctaaactataagacaagtaagcttctccagaccatacaaatgcacggcgagcccatgcgaagggtttggttaaaatatgccaaattccgccaaatacacaaataaaacccaaccatacatgcccaccaattatatcttctaaatcatctacactaacaatccacccttctccaccaaaaggagattttagtaaataaccaaatataacactggggctaagggtcaaattggtaatttttcttacatctccccccccaggggcccaggtatcatatacaccgccaaaataaagagccttgagtactagaagaaaagcacctagacctaacaaaattaagtgaatacccaaaattgtagtcattttatttctatctttccagacataaccaaagaatggaaaagattcctcaagagtctcgggtcccagaagcgcgtgataaatgccaccgaagcctaagactgcggaggaaattaggtgaagtacgccagatacaaagtacggaaaagtatctagaacttccccccctggccctactccccaacctagagtagctaagtgtggaagtaaaatcaacccttgttcatacatgggcttttctggtacgaaatggcttcaaataagttcattgctccggcccagaatacgattaatccggcatgggctacatgagctccaagcagtttaccggacaaattgataagtctggcattcccagcccaccaagcaaagccggtggtttcttggtcacgaccagctaaaacgaaagttccattaaagagcgtttccacgtggtagaacctcctcagggaatataagattttcatgaggctgatcctgagctgccatccacgcacgaataccctcgtttaaaagaatatttttggtgtagaaagtctcaaattcaggatcttccgctgcacggatttcctgggaaacaaagtcataggcacgtaagttcagagccaagccaactacgccaatagcactcatccataaaccggtgacgggtacaaatagcataaagaaatgtaaccaac

SEQ ID NO: 4367 - DNA, 3594 bp, Brassica rapa
catctagaaagcggagagctttggttccattcaaatagaaaagctgacatagatgttaagtggtgagaatatccataaaggagccgaatgaaatcaaaatttcatgttcggttttgaattagagacgttaaaaataatcaaccaacgtcgactataacccctagccttccaagctaacgatgcgggttcgattcccgctacccgctccattctgtataaaaggagtattctctttgtctagacatgttagaggcttgtattcaagccttttttgtccaccagtttctggtactccagagcggagtagagcagtttggtagctcacgaggctcataaccttgaggtcacgggttcgattcccgtctccgcacttagcagtctgtataaaaggactattctatttctctagatatggtagaggggcgtatccaacccttttttattcattagttcccggccctagagggcaaaattgagcagtttgcgaagtcacttgccttcaaaaaaagaaggcgcaaggcttctccctaccctgcagaaaataaaaatgaaacgaaagggacagtctacctctctcttccctttaaaaaaagtttgcccgttgtttgtctcagttaatacccaatttttggagctctgttggcgagttctatttctgcctccggagcgccctctttttttgagtgggatgcaaaggaagggtaagatagtaagggatacggcactagactaacacctaatacctaattaatacttaatttaatataagtagttaaacagttaactagactaaactttttatcatagtactttgataaattaagcgggcgagcggcgggaatcgaacccgtatcttctccttggcaaggagatattttaccattgaactgcgctcgctacggtatatattttatagcgtatatccgcctgggtcgaccttctatgtctgggtcgaccgtttcatttcattttctattatattagagttttcctttttttattatctgtgaatgaatattctaatgggaatggaatttcataatactgaaagagaagagctcgcaattcggaacgcaaattgcgttttaatacgtctcactattctaattttttagaagaaatggcctttattatttcttttttatggggttaataaatattaaccaaatttaatttaagaaatgagagaattcagaatagctacgagaaagactagtccaatccataacgatgtaccggaaaatacaacatttttattatttgaccaaccatcaggagaagcaaatacaaggggtacactaattactaagactgaggaagtcgcaattaatgcaaaaacagctaattggaaagcaatagtcatatttcgaatcctccaagctaccatcaaataaagttgactacatatttgatccctcacttaaaccaaaattgtaaaaaaatacaagaagtaggaggggtttaatcatgaatccattgattcttctctttaattcaaatttattacttaaaccgcttttttatttggatatgggggtgagaagagattatttactctttatttcacaagcgggtatagcggatcctgtatccgtgtatacagtatacagagatatatcgaaaaggaacttgtatctgatatctttctagaggctaataaatctttttattttttatatggctatgttctatttgtaggagtaaaataaggattaggctgtggagagatggctgagtggttgatagctccggtcttgaaaaccggtatagttctaggaactatcgagggttcgaatccctctctctccttttgcttattgaatacgtttgtttctttcatttttttttttctgtcccttatctttctttcataaaaaggaatgaatggctcggctagatggaataaccgagccagaacagaaaaaaagtagaacaggtataaataagaaaatcttagttaagagggttcatgtaaagaacaggttccaaatcacgatcgattcccttttcaaaacctgctgcagcagctcgggctcttcctgcatgccataaatggcccacaaaaaagaagaatcctagaacaaaatgagaagttgataaccaacttctaggagagacataattaactgcattgatctcggtagctacgccacccacggaatttaaagagcctaaaggagcgtgggtcatatattctgctgagcgtcgttcttgccaaggttgtatgtcttttttcaacctacttaagtccaaactccaaaccgttggggccccttagaggttctaaccatggagcacgaaggtcccaaaaacgcatagtttcccctccaaagataacctccccagttggggaacgcattagatatttacctaaacctgtgggtccttgagcggatcccacaacgttagctccaagacgttggtctctaactagaaaagtaaatgcttgagcttgagaagcttctggcccggtgggtccataaaactcactcggataagctgtattattgaaccatacaaaacaacaagcgataaaaccaaagacagataaagcagctaaactataagacaagtaagcttctccagaccatacaaatgcacggcgagcccatgcgaagggtttggttaaaatatgccaaattccgccaaatacacaaataaaacccaaccatacatgcccaccaattatatcttctaaatcatctacactaacaatccacccttctccaccaaaaggagattttagtaaataaccaaatataacactggggctaagggtcaaattggtaatttttcttacatctccccccccaggggcccaggtatcatatacaccgccaaaataaagagccttgagtactagaagaaaagcacctagacctaacaaaattaagtgaatacccaaaattgtagtcattttatttctatctttccagacataaccaaagaatggaaaagattcctcaagagtctcgggtcccagaagcgcgtgataaatgccaccgaagcctaagactgcggaggaaattaggtgaagtacgccagatacaaagtacggaaaagtatctagaacttccccccctggccctactccccaacctagagtagctaagtgtggaagtaaaatcaacccttgttcatacatgggcttttctggtacgaaatggcttcaaataagttcattgctccggcccagaatacgattaatccggcatgggctacatgagctccaagcagtttaccggacaaattgataagtctggcattcccagcccaccaagcaaagccggtggtttcttggtcacgaccagctaaaacgaaagttccattaaagagcgtttccacgtggtagaacctcctcagggaatataagattttcatgaggctgatcctgagctgccatccacgcacgaataccctcgtttaaaagaatatttttggtgtagaaagtctcaaattcaggatcttccgctgcacggatttcctgggaaacaaagtcataggcacgtaagttcagagccaagccaactacgccaatagcactcatccataaaccggtgacgggtacaaatagcataaagaaatgtaaccaac

SEQ ID NO: 4368 - DNA, 2607 bp, Echinacea purpurea
ttcaaatcctgctgcagctgcgcgagctcttcctgcgtgccacaaatgccctacgaagaagaagaatcctagaacaaaatgagaagtagctaaccaacttctaggagacacataattgactgcattgatctcggtagctactccacccacggaatttaaagaacctaaaggagcatgagtcatatattctgcggaacgacgttcttgccaaggttgtatgtcttttttcagccgactcaagtccaacccatttggaccccttagaggttctaaccaaggagcacgcaaatcccaaaaacgcatagtttctcctccaaaaatgacttctccggtcggggaacgcattaaatatttacctaaaccggtaggcccttgagcggatcctacgttagctccaagacgttggtctctaactagaaaagtaaatgcttgagcttgagaagcttctggtccagtgggtccataaaactcactaggataagccgtattattgaaccagacaaaacaacaagcaatgaaaccaaagacagatatagccgctaaactataagataagtaagcctctccagaccatacaagtgcacgtcgagcccatgcgaaaggtttggttaagatatgccaaattccaccaagtatacaaatggaacctaaccatacatggcctccgattatatcttccaaatcgtctacactaacaatccatccttccccccaaagggcgattttagtaaataaccaaatatgatacttgggctaagcgtcaagttggtgatttttcttacatctcctcctcccggagcccaagtatcatatacgcccccaaaataaagagccttgaatactagaagaaaagcacctatacctaacaagattaagtgaatacctaaaattgtggtcattttatttctatctttccatacataaccgaagaatggaaaagattcttcaagcgtctcaggtcctaaaagtgcatgataaataccgccaaagcccaatactgcagaggaaattaaatgaaggactccagatacaaagtatggaaaagtatctataacttccccaccaggacctaccccccaacctagagtagctaggtggggaagtaaaattaatccttgttcatacataggcttttctggtacgaaatgagccacttcaaatagattcattgctccggcccagaatacgattaatccggcatgggctacatgagctcctagtagtttaccggataaattgataagccgggcattcccggcccaccaagcgaaaccggtggtttcttggtcacgaccagctaaagctaaagttccattaaagagcgtttccacggggtagaacctcctcagggaatataaggttttcatgaggctgatcttgagccgccatccaagcacgaataccttcgtttaagagaatatttttggtgtagaaagtctcaaattcaggatcttccgccgcgcgaatttcttgagaaacgaagtcataggcacgtaggttcaaggccagaccgactactccaagagcactcatccataaaccagttactggtacaaataacataaagaaatgtaaccaacgtttattggaaaaagcaaccccaaagatttgggaccaaaagcgattagcagtgaccattgaataagtttcttcagcttgagttgggttaaaagcacggaatgtatttgcgccatcaccatcttcaaataaagtattttctacggtagcaccatgaatagcgcatagcaaagcagcgcccaatacaccggcaactcccatcatatgaaatgggttcaatgtccagttatgaaatccttgaaaaaagaggataaatcgaaagatagctgctacaccaaaactaggcgcaaagaaccaaccagactgacctagtggataaatcaggaatacagaaacaaaaacggcaattggaccagagaatgcgattgcattataaggtcgcaattgaacagatcgagcaagttcgaattgacgtaacatgaaacctattagtccgaaagcgccgtggagagcaacaaaagtccacagaccgcctaattgacaccaacgagtaaaatctccttgtgcttcaggaccccatagtaataacaaagaatgtgctaaactattagcaggagtagaaactgcggcagttaagaaattgcagccttccaaataggaactggccaatccatgggtataccatgaagttacaaaggttgtacccgtgaaccaaccccctacggcgaaataggcacaaggaaagagcaataggccggaccagcctacaaaaacgaaacggtccctacgtaaccagtcatccataatatcaaacaaatcagtttcgtctttggtaaatttaccaagggctatagtcatcgtaatcctcctattcaactacttcgaccatttccgaacacctcatagtattttcggggcgtccaaagagtcgatcatttctgcatgattttttctcgtgcactaccccttacaattacaatacaatgggtttcgaagataaaaatactttattggcccataaattgaccacccaggtaaattcatgaattcaatttgattattccttcttattattaattattatttctt

SEQ ID NO: 4369 - DNA, 3482 bp, Abies balsamea
gatcaaatgcactacgaaaaggatttttacctagaaattgatcgagctttttctaaactttttttcctatttccagatgataatgggaaatcatcatatgtcacaggtatgttggtctgtcccttatgcttatagttaggtattatctgaagggtaggaatagaagttgtctccgggagagatggccgagtggttgatggctccggtcttgaaaaccggtatagtaaaaaactatcgagggttcgaatccctctctctcctgtttttttttttcaacaatcgcattaattatattagtccggtccagtaaaaaaaaaaaaaaaaagagaatagctcggctggatatagccgagctagaaggatccagttggaaagagagtatttgaaaatactcctatccctccgatatgggagatggatgtaatgaaattgaatttatttctcttccatctggttctatttcttgtttcagttaagaggagtcatggaaaggacaggttcgaaatcacgatcaatcctttttcaaatcctgctgcagctgcacgagcccttcccgcatgccacaaatgacctatgaacaagaaaaatcctaaaacgaaatgggaggtggataaccaacttcggggagagacataattcaccgcattgatttcggtagctacaccacccacagaatttaaagaacctaaaggagcatgagtcatatattctgccgaacgtcgttcctgccaaggctgtatgtcctttctcaacttgctcaggtccaaaccattagggccccttaggggttccaaccagggagcacggagatcccaaaaacgcatcgtttcccctccaaagataatttctccagtcggagaacgcataaggtatttacctaaaccagtaggtccttgggcagaccccacactagctccaagacgttggtctctaactagaaaagtaaacgcttgagcttgagaggcttctgggccggtgggcccatagaattcactaggataagctgtgttgttgaaccaaacgaaacaacaagcaataaaaccaaagacagatagagccgctaaactataggacaaataagcttctccggaccatacgaatgcacggcgagcccatgcaaaaggtttggttaagatatgccagataccaccgaagatacaaatggaacctaaccatacatgtcctccaattatatcttctagattgtccacgctaacgatccatccctctcctccgaaaggagatttcagtaaataaccaaatatagcacttgggttaagagtcgggttcgtaatttttcttacatctccaccgccgggagcccaggtatcgtatacacctccgaaatacaaagccttgagcactagaagaaaagcaccagcacctagcaagattaggtgaatacccaaaattgtggtcattttgtttctatctttccatacatagccaaagaatggaaaagattcttctaaagtttcgggtcctataagtgcatgataaataccaccaaaacctaaaaccgcagaagatattaagtgaagtaccccagatacaaaatatggaaaagtgtccacgatttccccaccaggaccgactccccatcctagagtagctagatggggaagtaaaatcaatccttgttcatacataggcttttccggtacgaaatgagccacttcgaataggttcattgctccggcccagaatacaattaatccggcatgagccacgtgagccccaagcaatttaccagacaaattaataagtcgggcattaccggcccaccaagcgaaaccagtggtttcttgatcacgaccagctaaagctatagttccattaaagagcgtttccacggggtaggacctcctcagggaatataaggttttcatgaggctgatcttgagccgccatccaagcacgaataccttcgttcaggagaatattttttgtgtagaaagtctcaaattcaggatcttctgctgcacggatctcctgggaaacaaaatcataggcacgtaagtttagagctagaccaactactccaatggcactcatccataaaccggtcactggcacaaataacatgaagaaatgtaaccaacgtttattggaaaaagcaaccccaaaaatctgggaccagaaacggttagcagtgaccatggaataggtctcttcagcttgagtcgggttaaaagcacggaacgtatttgcaccatcaccatcttcaaataaagtattttccacggtagcaccatgaatagcacatagaagagcagcacccaatactccggcaactcccatcatatgaaatggattcaaggtccaattatgaaaaccttgaaagaaaaggataaatcggaaaatagctgctacaccaaaactaggtgcgaaaaaccaaccggactgacccaatggatagatcaaaaatacagaaacaaagacagcaattggagccgagaatgcaattgcattataaggtcgcaattgtacagatcgagcaagttcaaattgacgtaacatgaaacctattagagcaaaagcaccatgaagagcaacgaaggtccatagaccacctaattgacaccaacgagtaaaatctccttgtgcttcaggaccccataatagcaacagagaatgcgctaaactattagcaggagtagaaactgcggcagttaggaaattacaaccttccagataggaactggccaatccgtgagtataccatgaagtcacaaaggttgtacccgtgaaccatccacctaaggcaaaataggcacaaggaaagagcaatagaccagaccaacccacaaaaacgaaacggtctctgcgtagccagtcatccatagtatcaaataaagttttttcttctttagaagactttccaagggctatagtcatagcgatcctcctatttcactatttcgaccatttccgagcaccctatatgatcaaaaggtatatgatgaattggggactaatttttcatccatcatcctttaaaaacaaatagggttccgaagattcgttgttggaacaaatatttttcaaattgaaccgaaccgatccaatataggtaaatgatagttcgatgctcgagttttctagagttcttatcttatcctcgaatcacttattgaataacataacatcgatggaacaatttacgtggagggaagtgcgctttctccccccccacttgaccaaattctattcacaatatctattctattcaatatttttgaatccattctcgtcttgaaccttctgcaatgcaacagaatgaaaagggagtatttctattctctctcattcatctctatttatattcttactactatatcgtggttcgatacgaatgagtctacgagcaggaacgagtagatgtttttcataactcatagagtttagaagaaaaatgactccaaagttattatctttctatagcaagaagttatatatttaaccattgtgatccaaaagtg

SEQ ID NO: 4370 - DNA, 3281 bp, Cedrus atlantica
tgaacctaaaacatctagaacagatctaagatatgaaagaattaaggatacctacgaaaaggactaatccgatccataatgatacacccgagaatacaacatttttgctacttgaccaaccatcaggagaggcaagtgcaacaggtacaccaatcactagtaaaaatgaaatagcaattaatgcaaacacagccaattggaaagcaatagtcatggttgtgatcttacaagctcccaacagattgaatagactataccatccgatccccaattttcaattctgatcaaatgcactacgaaaaggatttgaccataaattgatcgagctttttaaacttttcaaatttctatttgagtgtaagaggagagggaaatcgtttcttttttccattccagatgatgagaaattctcatatgtcacaggtatggttggtatcggcccgaccttatgcttatagttaggtattatccgaaggagtagaatagaagttgtctccgggagagatggccgagtggttgatggctccggtcttgaaaaccggtatagtaaaaaactatcgagggttcgaatccctctctctcctgttgttttttcaacaatcacatttattggtccaatccagtacaaaaaagagaatagctcggctggatatagccgagctacaaggatccagttggaaagagagtatttgaaaatactcctatcccgctgggagatggatgtaatgaaattgaatcgatttctcttccatctggttcgatcgcttgtttcagttaagaggagtcatggaaaggacaggttcgaaatcacgatcaattcctttctcaaatcctgctgcagctgcacgagccccttcccgcatgccacaaatgacctacgaagaagaaaaatcctagaacgaaatgagaggtggataaccaacttcggggagagacataattcaccgcattgatttcggtagctacaccacccacagaatttaaagaacctaaaggagcatgagtcatatattctgccgaacgtcgttcctgccaaggctgtatgtcttttctcaacttgctcaggtccaacccattagggccccttaggggttccaaccagggagcacggagatcccaaaaacgcatcgtttcccctccaaagataatttctccagtcggagaacgcataaggtatttacctaaaccagtaggtccttgggcagaccccacactagctccaagacgttggtctctaactagaaaagtaaacgcttgagcttgagaggcttctgggccggtgggcccatagaattcactgggataagctgtattgttgaaccaaacgaaacaacaagcaataaaaccaaagagagatagagccgctaaactataggacaaataagcttctccggaccatacgaatgcacggcgagcccatgcaaaaggtttggttaagatatgccagataccaccgaagatacaaatggaacctaaccatacatgtcctccaattatatcttctagattgtccacgctaacaatccatccctctcctccgaaaggagatttcagtaaatagccaaatatagcacttgggttaagagtcgggttcgtaatttttcttacatctccaccgccgggagcccaggtatcatatacacctccaaaatacaaagccttgagcactagaagaaaagcaccaacacctagcaagattaggtgaatacccaaaattgtggtcattttgtttctatctttccatacatagccaaagaatggaaaagattcttctaaagtttcgggtcctatgagtgcatgataaataccaccaaaacctaaaaccgcagaagaaattaagtgaagtaccccagatacaaaatatggaaaagtgtccacgatttccccaccaggaccgactccccatcctagagtagctagatggggaagtagaatcaatccttgttcatacataggcttttccggtacgaaatgagccacttcgaataggttcattgctccggcccagaatacaattaatccggcatgagccacgtgagctccaagcaatttaccagacaaattgataagtcgggcattaccggcccaccaagcgaaaccagtggtttcttgatcacgaccagctaaagctatagttccattaaagagcgtttccacggggtaggacctcctcagggaatataaggttttcatgaggctgatcttgagccgccatccaagcacgaataccttcgttcaggagaatattttttgtgtagaaagtctcaaattcaggatcttctgctgcacggatctcctgggaaacaaaatcataggcacgtaagtttagagctagaccaactactccaatggcactcatccataaaccggtcactggcacaaataacatgaagaaatgtaaccaacgtttattggaaaaagcaaccccaaaaatctgggaccagaaacggttagcagtgaccatggaataagtctcttcagcttgagtcgggttaaaagcacggaacgtatttgcaccatcaccatcttcaaataaagtattttccacggtagcaccatgaatagcacatagaagagcagcacccaatactccggcaactcccatcatatgaaatggattcaaggtccaattatgaaaaccttgaaagaagaggataaatcggaaaatagctgctacaccaaaactaggtgcgaagaaccaaccggactggcccaatggatagatcaaaaatacagaaacaaagacagcaattggagcagagaatgcaattgcattataaggtcgcaattgtacagatcgagcaagttcgaattgacgtaacatgaaacctattagagcaaaagcaccatgaagagcaacgaaggtccatagaccacctaattggcaccaacgagtaaaatctccttgtgcttcgggaccccataatagcagcagagaatgcgctaaactattagcaggagtagaaactgcggcagttaggaaattacaaccttccagataggaactggccaatccgtgagtataccatgaagtcacaaaggttgtacccgtgaaccatccacctaaggcaaaataggcacaaggaaagagcaatagaccggaccaacccacaaaaacaaaacggtctctgcgtagccagtcatccatagtatcaaattaaagtttttcttctttagaagactttccaagggctatagtcatagcgatcctcctatttcactatttcgaccatttccgagaaccctatatgatcaaaaggtatacgatgaattggggacaa

SEQ ID NO: 4371 - DNA, 4127 bp, Picea glauca
caacaagatcaagttggtaaggattaaaatatccttcattttcttttttcgattggatttctatgatctatcatcatagaggcggcccctttaccattctgtacaaataggctattctatttgtacgggtatggaaaaggggcgcattcaatccttgtttgtttcttagttcttcccagtccttctcttcatcgcggggtagagcagtttggtagctcgcaaggctcataaccttgaggtcacgggttcaaatcccgtctccgccagaccagaagataagaagtattttggtccagaaaggattactctcttcattctcattttataatagaatgaaaagtgaggaaaagaaaagatacgatcaatacatgaactattcattttcatattccatttgaatatggtgggtagcggggatcgaacccgcatcttctccttggcaaagagaaattttaccattcaaccatacccgcattttattcgttatgaatatatgatatattcatataatttgaacataatatggaaaatacatatatcttcaatcccattcgtaagtagataccatttcttaatggtccaattcttttttcaattacggaaaacccctcctccttggacctgaaggaaaaggcccttcagaagagctataaagccctccgggaggggggggagttttaacctaaaacatctagaacagatctgagatatgaaagaattaaggatacctacaaaaaggactgatccgatccataatgatacacccgaaaatacaacatttttgctacttgaccaaccatcgggagaggcaagtgcaacaggtacaccaatcactagtaaaaatgaaatagcaattaatgcaaacacagccgattggaaagcaatagtcatggttgtaatcttacaagctcccaacagattgaatagactataccatccgatccccaattttcaattctgatcaaatgcactatggaaaggatttgaccataaattgatcgagtttttcaaactttttcaatttgatatttgagtgtgagaggagagggaaattcgtttcttttttccattccagattataatgagaaatcatcatatgtaacaggtatggttggtatcggcccgaccttacgcttatagttagatattacccgaaggggtagaatagaagttgtccccgggagagatggccgagtggttgatggctccggtcttgaaaaccggtatagttaaaaactatcgagggttcgaatccctctctctcctgttttttttttcaaaaatcacatttattagttcggtccagtaaaaaaagagaatagctcggctggagatagccgagctacaaggatccagttggaaagagagtcttttcaaatatttctatcccgccgatatgggagattgatgtaatgaaattgaatcgagttctcttccatctggttcgatctcttgtttcagttaagaggagtcatggaaagaacaggttcgaaatcacgatcaattcctttctcaaatcctgctgcagctgcacgagcccttcccgcatgccacaaatgacctacgaagaggaaaaatcctggaacgaaatgggaggtggctaaccaacttcggggagagacataattcaccgcattgatttcggtagctacaccacccacagaatttaaagaacctaaaggagcatgagtcatatattctgccgaacgtcgttcctgccaaggctgtatgtcttttctcaacttgctcaggtccaaaccattagggcctcttaggggttccaaccagggagcacggagatcccaaaaacgcatcgtttcccctccaaatataatttctccagtcggagaacgcataaggtatttacctaacccagtaggtccttgggcagaccccacactagctccaagacgttggtctctaactagaaaagtaaacgcttgagcttgagaagcttctgggccggtgggcccataaaattcactgggataagctgtattgttgaaccaaacgaaacaacaagcaataaaaccaaagagagataaagccgctaaactataggacaaataagcttctccggaccatacgaatgcacggcgagcccatgcaaaaggtttggttaatatatgccagataccaccgaagatacaaatggaacctaaccatacatgtcctccaattacatcttctagattgtccacgctaacgatccatccttctcctccgaaaggagatttcagtaaataaccaaatatagcacttgggttaagagtcgggttcgtaatttttcttacatctccaccgccgggagcccaagtatcatatacacctccaaaatacaaagccttgagcactagaagaaaagcaccaacacctagcaagattaggtgaatacccaagattgtggtcattttgtttctatctttccatacatagccaaagaatggaaaagattcttctaaagtttcaggtcctatgagtgcatgataaataccaccaaaacctaaaaccgcagaagaaattaagtgaagtaccccagatacaaaatatggaaaagtgtccacgatttccccaccaggaccgactccccatcctagagtagctagatggggaagtagaatcaatccttgttcatacataggcttttccggtacgaaatgagccacttcgaataggttcattgctccggcccagaatacaattaatccggcatgagccacgtgagccccaagcaatttaccagacaaattgataagtcgggcattaccggcccaccaagcgaaaccagtggtttcttgatcacgaccagctaaagctatagttccattaaagagcgtttccacggggtaggacctcctcagggaatataaggttttcatgaggctgatcttgagccgccatccaagcacgaataccttcgttcaggagaatatttttagtgtagaaagtctcaaattcaggatcttctgctgcacggatctcctgggaaacaaaatcataggcacgtaagtttagagctagaccaactactccaatggcactcatccataaaccggtcactggcacaaataacatgaagaaatgtaaccaacgtttattagaaaaagcaaccccaaaaatctgggaccagaagcggttagcagtgaccatggaataagtctcttcagcttgagtcgggttaaaagcacggaacgtatttgcaccatcaccatcttcaaataaagtattttccacggtagcaccatgaatagcacatagaagggcagcacccaatactccggcaactcccatcatatgaaatggattcaaggtccaattatgaaaaccttgaaagaagaggataaaccggaaaatagctgctacaccaaaactaggtgcgaaaaaccaaccggactggcccaatggatagatcaaaaatacagaaacaaagacagcaattggagcagagaatgcaattgcattataaggtcgcaattgtacagatcgagcaagttcaaattgacgtaacatgaaacctattagaccgaaagcaccatgaagagcaacgaaggtccatagaccacctaattgacaccaacgagtaaaatctccttgtgcttcgggaccccataatagcagcagagaatgtgctaaactattagcaggagtagaaactgcggcagttaggaaattacaaccttccagataggaactggccaatccgtgagtataccatgaagtcacaaaggttgtacccgtgaaccatccacctaaggcaaaataggcacaaggaaagagcaatagaccggaccaacccacaaaaacgaaacggtctctgcgtagccagtcatcaacagtatcgaataaagttttttcttctttagaagactttccaagggctacagtcatagcgatcctcctatttcactatttcgaccatttccgagcaccctatatgatcaaaaagtatatgatgaattggggacaatttttcatccatcatcctttcaaaaacaaattgggtttcgaagattcgttgttggaacaaatattttaaactggaccgaaccgatccaatataggtaaatgcatgatagctcgatcccgagttttcagagttcctatctgatcctcgaatcacctattag

SEQ ID NO: 4372 - DNA, 3470 bp, Citrus clementina
gatagctatgaaattcgaacagtagattttttttatttgatatttctttggactccgcaagaatccgtcgatatttccgattcaatccgctttttcctaggcgttccatactaagatactaagaaagggtgattccaagttccaagacaagagttgtttccaatatgtttctttttctttgattcccgaaccgaacacaagaagatcaagtttgatctctatctaatttatattgatatatgatttatatataaatcagatcgcggcttcatgtatcaaatattttcatatcaaggcatacgatctttttgttttgttccgacaatgttaggatagtgggtgtgagaaagaaactttcatttacagtctcctattatttaatttaatattgtattgaatttaaaaaatcaaaattagaagagtacataaaaatatttatttttctcaatctcacccaagaagaaataaatagagcgagaggggtaggtctgggtatcaaccggtaaggagagaggggatcgcttcttctgaaaagttctttcaaagaattaatcgatctgattgatgagtcataataagcaactcatagttcagtttcaaaccagtattaacaagaaacaataggaaggaataaacgaattgagttcatggatttacctaagtaaggctatggaccaataaaggatttttatcttcgaaaccaattagaaggggcaatgtacggtacgagaaatcaaatcatccctaaatgatcgaatcctcgaaggacccggaagtgccataacataaggtgttcgaaaatggttgaagtagttgaataggaggaccgttatgactatagcccttggtaaatttaccaaagaggaaaaggatttatttgatattatggatgactggttacggagggaccgattcgtttttgtaggttggtctggcctattgctctttccttgtgcctatttcgctttagggggttggttcacaggtacaacctttgtaacttcatggtatacccatggattagccagttcctatttggaaggctgcaacttcttaaccgccgcagtttcgactcctgctaatagtttagcgcattctttgttgttactatggggtcctgaagcacaaggagattttactcgctggtgtcaattaggcggtctttggacttttgttgctttccacggtgctttcagactaataggtttcatgttacgtcaatttgaacttgctcgctctgttcaattgcgaccttataatgcaatagcattctctgctccaattgctttttttgtttctgtattcctgatttatccactaggtcagtctggttggttctttgcgcctagttttggtgtagcggcgatatttcgattcatcctttttttccaagggtttcataattggacattgaacccctttcatatgatgggagttgccggtgtattgggcgctgctctgctatgcgccattcatggcgctaccgtagaaaatactttatttgaagatggtgatggtgcaaacacattacgtgtttttaacccaacgcaagccgaaaaaacctattcgatggtcaccgctaaccgcttttggtctcaaatctttggggttgctttttccaataaacgttggttacatttctttatgttatttgtaccagtaaccggtttatggatgagtgctcttggagtagtcggcctagcccaaaacctacgtgcttatgacttcatttcccaagaaatctgtgcagcggaagatcctgaatttgagactttttacacaaaaaatattcttttaaacgagggtattcgtgcttggatggcggctcaagatcagcctcatgaaaaccttatattccctgaggaggttctaccccgtggaaatgctctttaatggaactttagctgtagcaggtcgtgaccaagaaaccaccggtttcgcttggtgggccgggaatgcccgacttatcaatttatccggtaaactgctgggcgctcatgtagcccatgctggattaatcgtattctgggccggagcaatgaacctctttgaagtggctcatttcgtaccagaaaagcccatgtatgaacaaggattaattttacttccccacctagctactctaggctggggggtaggtcctggtggggaagttatagacacctttccatactttgtatctggagtacttcacttaatttcctctgcagtattgggctttggcggtatttatcatgcacttctgggacctgagactcttgaagaatcttttccattcttcggttatgtatggaaagatagaaataaaatgaccacaattttgggtattcataggtataggtgcttttcttctagtattcaaggctctttattttgggggcgtgtatgatacctgggctccgggggggggagatgtaagaaaaattaccaacttgacccttagcccaagtgttatttttggttatttactaaaatccttctttggaggagagggtggattgttagtgtggatgatttggaagatataattggaggtcatgtatggttaggttccatttgtatatttggtggaatctggcatatcttaaccaagccttttgcatgggctcgccgtgcacttgtatggtctggggaggcttacttgtcttatagtttaggtgttttagctgtttttggtttcattgcttgttgctttgtctggtttaataataccacttatcctagtgagttttatagtcccactgggccagaagcttctcaagctcaagcatttacttttctggttagagaccaacgtcttggggctaatgtgggatccgctcaagggcctactggtttaggtaaatatctaatgcgttcccctactggagaagtcatttttgggggagaaactatacatttttgggatctgcgtgctccatggttagaacctctaaggggtcccaaccgtttagacttgagtaggttgaaaaaggacatacaaccttggcaagaacaacgttctgcggaatatatgactcatgctcctttaggttctttaaattctgtgggtggagtagctaccgagatcaatgcagttaattatgtctctccgagaacttggttagctacttctcattttgttctaggcttcttcttcttcgtaggtcacttatggcacgcgggaagagctcatgcagctgcagcagggtttgaaaaaggaattgatcgtgattttgaacttgttctttcgatgactcctcttaactgagacaggggatccaaggcgtatgcttaaaataaaatagaaattggtttgattgcaccctgcatattgagggaagcgggttatacttaaaaaaagtattcctttttcctttcttttcaactcagttatatctaatctattttattttttttttctggctcggctagggaggatagccgagccattcccttttatgagacgaaaaagccaagcaaacccaata

SEQ ID NO: 4373 - DNA, 4389 bp, Pinus taeda
gggagtgtgaacctaaaacatctagaacatatctaagatatgaaagaattaaggatacctacaaaaaggactgatccgatccataatgatacacccgaaaatacaacatttttgctacttgaccaaccatcgggagaggcaagtgcaacaggtacaccaatcactagtaaaaatgaaatagcaattaatgcaaacacagccaattggaaagcaatagtcatggttgtgatcttacaagctcccaacagattgaatagactataccatccgatccccaattttaaattctgatcaaatgcactatggaaaggaaaggatttgaccagaaattgatcgagctttcaaactttttcaatttgatatttgagtgtgagaggagagggaaattcgtttctttttttttccattccagatgatgaaaaatcatcatatatatgtcacaggtatagttggtatcgacccgactttatgcttatagttagggattatccgaaggggtagaatagaagttgtccccgggagagatggccgagtggttaatggctccggtcttgaaaaccggtatagataaaaaaactatcgagggttcgaatccctctctctccttttgtttttcaacaattgcatttaccggtccaataaaaaaaaagagaatagctcggctgtatatagccgagctacaaggatccagttggaaaaagagtatttgaaaagactcctatcccgccgatatgggagatagatgtaatgaaattgaatcgatttttcttccatctggtttgatctattgtttcagttaagaggagtcatggaaaggacaggttcgaaatcacgatcaatccctttctcaaatcctgctgcagctgcacgagcccttcccgcatgccacaaatgacctacgaataagaaaaatcctagaacgaaatgggaggtggataaccaacttcggggagagacataattcaccgcattgatttcggtagctacaccacccacagaatttaaagaacctaaaggagcatgagtcatatattctgctgaacgtcgttcctgccaaggctgtatgtcttttctcaacttgctcagatccaaaccattagggccccttaggggttccaaccaaggagcacggagatcccaaaaacgcatcgtttcccctccaaagataatttctccagtcggagaacgcataaggtatttacctaaaccagtaggtccttgggcagaccccacactagctccaagacgttggtctctaactaaaaaagtaaacgcttgagcttgagaggcttctgggccggtgggcccataaaattcactgggataaacggtattgttgaaccaaacaaaacaacaagcaataaaaccaaagagggatagagccgctaaactataggacaaataagcttctccggaccatacgaatgcacggcgagcccatgcaaaaggtttggttaagatatgccagataccaccgaagatacaaatggaacctaaccatacatgtcctccaattacatcttctagattgtccacgctaacgatccatccttctcctccgaaaggagatttcagtaaataaccaaatatagcacttggattaagtgtcgggttcgtaatttttcttacatctccaccgccgggagcccaagtatcatatacacctccaaaatacaaagcttttagcactagaagaaaagcaccaacacctagcaagattaggtgaatacccaaaattgtggtcattttgtttctatctttccatacatagccaaagaatggaaaagattcttctaaagtttcgggtcctatgagtgcatgataaataccaccaaaacctaaaaccgcagaagaaattaagtgaagtaccccagatacaaaatatggaaaagtgtccacgatttccccaccaggaccgactccccatcctagagtagctagatggggaagcagaatcaatccttgttcatacataggtttttccggtacgaaatgagccacttcgaataggttcattgctccggcccagaatacaattaatccggcatgagccacgtgagccccaagcaatttacccgacaaattgataagtcgggcattaccggcccaccaagcgaaaccagtggtttcttgatcacgaccagctaaagctatagttccattaaagagcgtttccacggggtaggacctcctcagggaatataaggttttcatgaggctgatcttgagccgccatccaagcacgaataccttcgttcaggagaatattttttgtgtagaaagtctcaaattcaggatcttctgctgcacggatctcctgggaaacaaaatcataggcacgtaagtttagagctagaccaactactccaatggcactcatccataaaccggtcactggtacaaataacatgaagaaatgtaaccaacgtttattggaaaaagcaaccccaaaaatctgggaccagaagcggttagcagtgaccatggaataagtctcttcggattgagtcgggttaaaagcacggaacgtatttgcaccatcaccatcttcaaataaagtattttccacggtagcaccatgaatagcgcatagaagagcagcacccaatactccggcaactcccatcatatgaaatggattcaaggtccaattatgaaaaccttgaaagaagaggataaaacggaaaatagctgctacaccaaaactaggtgcgaaaaaccaaccggactgtcccaatggatagatcaaaaatacagaaacaaagacagcaattggaccagagaatgcaattgcattataaggtcgcaattgtacagatcgagcaagttcaaattgacgtaacatgaaacctattagaccgaaagcaccgtgaagagcaacgaaggtccatagaccacctaattgacaccaacgagtcaaatctccttgtgcttcgggaccccataatagcagcaaagaatgtgctaaactattagcaggagtagaaactgcggcagttaggaaattacaaccttccagataggaactggccaatccgtgagtataccatgaagtcacaaaggttgtacccgtgaaccatccacctaaggcaaaataggcacaaggaaagagcaatagaccggaccaacccacaaaaacgaaacggtctctgcgtagccagtcatccacagtatcaaataaagtttttttttctttagaagactttccaagggctatagtcatagcgatcctcctatttcactatttcgaccatttccgagcaccctatatgatcaaaaggtatacgatgaattggggacaatttttcatccatcatcctttcaaaaaaaaaaatagggttccgaagattcgttgttggaacaaatatttgaaactggaccgaaccgattcaatataggtaaatgcatgatcgctcgatcccaaggtttcagagttcctatctgatcctcgaatcacctattgaataacatcgatggaacaatttaaggggagggaagtgcgctttctgccttccattgaccaaattctattcacaatatatattccattcaatcttttttattcattctcgtcttgaaccttctgcaatgcaacaaaatgaaaaggagtatttctattctctctcatccatctctatgtatactacatcgtggtccgatacgaatgagtctacggacaggaacgagtcgattttttcataactcatagagctaaatgaaatgactccaaagttcttctccttctatagcaagaagttatatattgaaccattgtgatccaaaaaccctttttttcccttttgttttctcttttcacatcttaatttcgatccgtttctcaccggtgtaatcaccatacggtacattcatatgaaaatatttagtacatcgtaatagaatcacatattttaagaaaatacgttgtccgtaattcggctcggaatggacttacttcaggatctatatctctttctgtccagggaagggagaagagatcataaaaatcgatccgacgaaacattcaatcaacaaccaaatagggagttcgatcaactaaataagatcgattaatttcggataggaaaggtccactttccaaatctccatcaaatttcaataccagagtagcttatatattcataagccaatgggtcaggttcacttacttctcctccgttttttccacttcttttgaagactggtaatttgaaattaccaggtatccataatacctctgatatgttaaaaattgacaaagatcgagtaaactatatactgatcctatagtagcaggattaagaagactatttttgataaaaatatagtggtcctccccccatattagttgtgagactccgtcataacaaatgtttttgcctgaaacctatc

SEQ ID NO: 4374 - DNA, 2903 bp, Pseudotsuga menziesii
tatcgagggttcgaatccctctctctccttttgttttttcaacaatcacatttattggtccggtccagtacaaaaaagagaatagctcggctatatccagccgagctacaaggatccagttggaaagaaagtattttcaaagactcctatcccgtcgatatgggagattgatgtaacgaaattgaatcgatttctcttccatctggttcgatcttcagttaagaggagtcattgaaaggacaggttcaaaatcacgatcaattcctttctcaaatcctgctgcagctgcacgagcccttcccgcatgccacaaatgacctacgaagaagaaaaatcctagaacgaaatgggaggtggataaccaacttcggggagagacataattcaccgcattgatttcggtagctacaccacccacagaatttaaagaacctaaaggagcatgagtcatatattctgccgaacgtcgttcctgccaaggctgtatgtcttttctcaacttgctcaggtccaaaccattagggccccttaggggttccaaccagggagcacggagatcccaaaaacgcatcgtttcccccccaaagataatttctccagtcggagaacgcataaggtatttacctaaaccagtaggtccttgggcagaccccacactagctccaagacgttggtctctaactagaaaagtaaacgcttgagcttgagaggcttctgggccggtgggcccatagaattcactgggatatgctgtattgttgaaccaaacgaaacaacaagcaataaaaccaaagacagctagagccgctaaactataggacaaataagcttctccggaccatacgaatgcacggcgagcccatgcaaaaggtttggttaagatatgccagataccaccgaagatacaaatggaacctaaccatacatgtcctccaattacatcttctagattgtccacgctaacgatccatccttctcctccgaaaggagatttcagtaaataaccaaatatagtacttgggttaagagtcgggttcgtaatttttcttacatctccaccgccgggagcccaagtatcatatacacctccaaaatacaaagccttaagcactagaagaaaagcaccaacacctagcaagattaggtgaatacccaaaattgtggtcattttgtttctatctttccatacatagccaaagaatggaaaagattcttctaaagtttcgggtcctatgagtgcatgataaataccaccaaaacctaaaaccgcagaagaaattaagtgaagtaccccagatacaaaatatggaaaagtgtccacgatttccccaccaggaccgactccccatcctagagtagctagatggggaagtaaaatcaatccttgttcatacataggcttttccggtacgaaatgagccacttcgaagaggttcattgctccggcccagaatacaattaatccggcatgagccacgtgagccccaagcaatttaccagacaaattgataagtcgggcattaccggcccaccaagcgaaaccggtggtttcttgatcacgaccagctaaagctatagttccattaaagagcgtttccacggggtaggacctcctcagggaatataaggttttcatgaggctgatcttgagccgccatccaagcacgaataccttcgttcaggagaatattttttgtgtagaaagtctcaaattcaggatcttctgctgcacggatctcctgggaaacaaaatcataggcacgtaagtttagagctagaccaactactccaatggcactcatccataaaccggtcactggcacaaataacatgaagaaatgtaaccaacgtttattggaaaaagcaaccccaaaaatctgggaccagaaacggttagcagtgaccatggaataagtctcttcagcttgagtcgggttaaaagcacggaacgtatttgcaccatcaccatcttcaaataaagtattttccacggtagcaccatgaatagcacatagaagagcagcacctaatactccggcaactcccatcatatgaaatggattcaaggtccaattatgaaaaccttgaaagaagaggataaatcggaaaatagctgctacaccaaaactaggtgcgaaaaaccaaccggactggcccaatggatagatcaaaaatacagaaacaaagacagcaattggaccagagaatgcaattgcattataaggtcgcaattgtacagatcgagcaagttcaaattgacgtaacatgaaacctattagaccgaaagcaccatgaagagcaacgaaggtccatagaccacctaattgacaccaacgagtaaaatctccttgtgcttcgggaccccataatagcagcagagaatgtgctaaactattagcaggagtagaaactgcggcagttaggaaattacaaccttccagataggaactggccaatccgtgagtataccatgaagtcacaaaggttgtacccgtgaaccatccacctaaggcaaaataagcacaaggaaagagcaatagaccggaccaacccacaaaaacgaaacggtctctgcgtagccagtcatccatagtatcgaataaagttttttcttctttagaagactttccaagggctacagtcatagcgatcctcctatttcactatttcgaccatttccgagcaccctatatgatcaaaaggtatacgatgaattggagacaattttgaatccatcagcctttcaaaaaaaattgggttccgaagattcgttgttggaacaaatattttgaaactgggctgaaccgatccaatataggtaaatgcatgatagctcgatcccgagttttcagagtttctatctgatcttcaaataacctattgaattacattgatggaacaat

SEQ ID NO: 4375 - DNA, 1525 bp, Cicer arietinum
ttttttggggctcggctaagtggtgatatagcggagccccaaaaatattagatataaatgaattgaaaaaaaatactttttcaatatgatctcctcgattcaacccaatatgtatactaaaatcaaagtgattcctacgtcaagcataggatttcatgtctcaattaagaggagtcatggaaagaacaggctcaaaatctcgatcaattcctttttcaaatcctgcagcagctgcgcgagctcttcccgcgtgccataaatgacctacgaataggaagaatcctagaacaaaatgagaagtagctaaccaacttctaggagagacataattgactgcattaatctctgtagctacgccaccaacggaatttaaagaacctaaaggagcatgagtcatatattccgcggaacgacgttcttgccaaggctgtatgtcttttttcagtctactcaagtccaaaccattaggaccccttaaaggttctaaccagggagcacgcagatcccaaaaacgcatagtttctcccccaaaaataacttccccagtcggggaacgcattagatatttacccaaaccggtaggtccttgagccgatcctacattagctccaagacgttggtctctaactagaaaagtaaatgcttgagcctgagaagcttctggtccagtcggaccataaaactcactaggataagcagtattattaaaccagacaaagcaacaagctataaaaccaaaaacggctaaagcacctaaactataagacaagtaagcttctccagaccatactagtgcacggcgagcccacgcaaagggcttggttaatatatgccagattccaccaagtatacaaatggaacccaaccatacatgccctccaattatgtcttccaaatcatccacactaacaatccatccttctcccccaaaaggagattttagtaaataaccgaatataatacttggactaagggttaagtttgtaatttttcttacatctccccctcctggagcccaggtatcatatatacctccaaaataagaagccttaaatactagaagaaaagcccctatacctaacaatattaagtgaatacctaaaatagtagtcattttatttctgtctttccatacataaccaaagaatggaaaagattcttcaagagtttcaggtcccagaagtgcatgataaataccgccaaagcccaatactgcggaggaaattaagtgaagtactccagacacaaagtatggaaaggtatctattacttcccctccaggacctaccccccaacctagagtagctagatggggaagtaaaattaagccttgttcatacatgggcttctcaggtacgaaatgagcgacttcaaataggttcattgctccggcccagaatactattaatccggcatgggctacatgggcccccagtagtttaccagataaattgataagtcgggcattcccggcccacaagcaaaccggtagttcttggtcacgaccagttaaagctaaagttcc

SEQ ID NO: 4376 - DNA, 4079 bp, Pinus pinaster
tcatcatatgtcacaggtatagttggtatcgacccgactttatgcttatagttagggattatacgaaggggtagaatagaagttgtcccccggagagatggccgagtggttaatggctccggtcttgaaaaccggtatagataaaaaactatcgagggttcgaatccctctctctccttttgtttttcaacaattgcatttaccggtccataaaaaaagagaatagctcggctgtatatagccgagctacaaggatccagttggaaaaagagtatttgaaaagactcctatcccgccgatatgggagatagatgtaatgaaattgaatcgatttttcttccatctggtttgatctattgtttcagttaagcggagtcatggaaaggacaggttcgaaatcacgatcgatccctttctcaaatcctgctgcagctgcacgagcccttcccgcatgccacaaatgacctacgaagaagaaaaatcctagaacgaaatgggaggtggataaccaacttcggggagagacataattcaccgcattgatttcggtagctacaccacccacagaatttaaagaacctaaaggagcatgagtcatatattctgctgaacgtcgttcctgccaaggctgtatgtcttttctcaacttgctcagatccaaaccattagggccccttaggggttccaaccaaggagcacggagatcccaaaaacgcatcgtttcccctccaaagataatttctccagtcggagaacgcataaggtatttacctaaaccagtaggtccttgggcagaccccacactagctccaagacgttggtctctaactaaaaaagtaaacgcttgagcttgagaggcttctgggccggtgggcccataaaattcactgggataaacggtattgttgaaccaaacaaaacaacaagcaataaaaccaaagagggatagagccgctaaactataggacaaataagcttctccggaccatacgaatgcacggcgagcccatgcaaaaggtttggttaagatatgccagataccaccgaagatacaaatggaacctaaccatacatgtcctccaattacatcttctagattgtccacgctaacgatccatccttctcctccgaaaggagatttcagtaaataaccaaatatagcacttgggttaagtgtcgggttcgtaatttttcttacatctccaccgccgggagcccaagtatcatatacacctccaaaatacaaagcttttagcactagaagaaaagcaccaacacctagcaagattaggtgaatacccaaaattgtggtcattttgtttctatctttccatacatagccaaagaatggaaaagattcttctaaagtttcgggtcctatgagtgcatgataaataccaccaaaacctaaaaccgcagaagaaattaagtgaagtaccccagatacaaaatatggaaaagtgtccacgatttccccaccaggaccgactccccatcctagagtagctagatggggaagcagaatcaatccttgttcatacataggtttttccggtacgaaatgagccacttcgaataggttcattgctccggcccagaatacaattaatccggcatgagccacgtgagccccaagcaatttacccgacaaattgataagtcgggcattaccggcccaccaagcgaaaccagtggtttcttgatcacgaccagctaaagctatagttccattaaagagcgtttccacggggtaggacctcctcagggaatataaggttttcatgaggctgatcttgagccgccatccaagcacgaataccttcgttcaggagaatattttttgtgtagaaagtctcaaattcaggatcttctgctgcacggatctcctgggaaacaaaatcataggcacgtaagtttagagctagaccaactactccaatggcactcatccataaaccggtcactggcacaaataacatgaagaaatgtaaccaacgtttattggaaaaagcaaccccaaaaatctgggaccagaagcggttagcagtgaccatggaataagtctcttcggcttgagtcgggttaaaagcacggaacgtatttgcaccatcaccatcttcaaataaagtattttccacggtagcaccatgaatagcgcatagaagagcagcacccaatactccggcaactcccatcatatgaaatggattcaaggtccaattatgaaaaccttgaaagaagaggataaaacggaaaatagctgctacaccaaaactaggtgcgaaaaaccaaccggactgtcccaatggatagatcaaaaatacagaaacaaagacagcaattggaccagagaatgcaattgcattataaggtcgcaattgtacagatcgagcaagttcaaattgacgtaacatgaaacctattagaccgaaagcaccgtgaagagcaacgaaggtccatagaccacctaattgacaccaacgagtcaaatctccttgtgcttcgggaccccataatagcagcaaagaatgtgctaaactattagcaggagtagaaactgcggcagttaggaaattacaaccttccagataggaactggccaatccgtgagtataccatgaagtcacaaaggttgtacccgtgaaccatccacctaaggcaaaataggcacaaggaaagagcaatagaccggaccaacccacaaaaacgaaacggtctctgcgtagccagtcatccacagtatcaaataaagttttttcttctttagaagactttccaagggctatagtcatagcgatcctcctatttcactatttcgaccatttccgagcaccctatatgatcaaaaggtatacgatgaattggggacaatttttcatccatcatcctttcaaaaaaaaatagggttccgaagattcgttgttggaacaaatatttgaaactgaccgaaccgattcaatataggtaaatgcatgatcgctcgatcccgagttttcagagttcctatctgatcctctcctcgaatcacctattgaataacatcgatggaacaatttaaggggagggaagtgcgctttctgccttccattgaccaaattctattcacaatatatattccattcaatattttttattcattctcgtcttgttctgcaatgcaacaaaatgaaaaggagtatttctattctctctcatccatctctatgtatactacatcgtggtccgatacgaatgagtctacgggcaggaacgagtcgacttttttcataactcatagagctaaatgaaatgactccaaagttattctccttctatagcaagaagttatatattgaaccattgacaaaaagtgaaacccttttttcccttttgttttctcttttcacatcttaatttcgatccgtttctcaccggtgtaatcaccatacggtacattcatatgaaaatatttagtacatcgtaacagaatcacatattttatttgtgtatcaatttcgtctaaacagagaaaatacgttgtccgtaattcggctcggaatggacttacttcaggatctatatctctttctgtccagggaagggagaagagatcataaaaatcgatccgacgaaacattcaatcaacaaccaaatagggagttcgatcaactaaataagatcgattaatttcggataggaaaggtccactttccaaatctccatcaaatttcaataccagagtagcttatatattcataagccaatgggtcaggttcacttacttctcctccgttttttccacttcttttgaagactggtaatttaaaattaccaggttatccataatacctctgatatgttcaaaattgacaaagatcgagtaaactatatactgatcctattgtagcaggatgaagaagactattattgataaaaatatagtggtcctccccccatattagttgtgagactccgtcataacaaatgttttgcctgaaacctatcatgacagataattttcgtccctgaaaaagggttttcatcttgaaaaagatgtggatcatacgatgagaaatggacacccgagccttctttcttcg

SEQ ID NO: 4377 - DNA, 2397 bp, Medicago truncatula
ttagttaagagggttcatgtaaagaacaggttccaaatcacgatcgattcccttttcaaaacctgctgcagcagctcgggctcttcctgcatgccataaatggcccacaaaaaagaagaatcctagaacaaaatgagaagttgataaccaacttctaggagagacataattaactgcattgatctcggtcgctacgccacccacggaatttaaagagcctaaaggagcgtgggtcatatattctgctgagcgccgttcttgccaaggttgtatgtcttttttcaacctactcaagtccaaaccgttggggccccttagaggttctaaccatggagcacgaaggtcccaaaaacgcatagtttcccctccaaagataacctccccagttggggaacgcattagatatttccctaaacctgtgggtccttgagcggatcccacattagctccaagacgctggtctctaactagaaaagtaaatgcttgagcttgagaagcttctggcccggtgggtccataaaactcactcggataagctgtattattgaaccatacaaaacaacaagcgataaaaccaaagacagataaagcagctaaactataagacaagtaagcttctccagaccatacaaatgcacggcgagcccatgcgaagggtttggttaaaatatgccaaattcccccaaatacacaaataaaacccaaccatacatgtccaccaattatatcttctaaatcatctacactaacaatccacccttctcccccaaaaggagattttagtaaataaccaaatataacactgggactaagggtcaaattggtaatttttcttacatctccccccccaggggcccaggtatcatatacaccgccaaaataaagagccttgagtactagaagaaaagcacctagacctaacaaaattaagtgaatacccaaaattgtagtcattttatttctatctttccagacataaccaaagaatggaaaagattcttcaagagtctcgggtcccagaagcgcgtgataaatgccaccgaagcctaagactgcggaggaaattaggtgaagtacgccagatacaaagtatggaaaagtatctagaacttccccccctggccctactccccaacctagagtagctaagtgtggaagtaaaatcaacccttgttcatacatgggcttctcgggtacgaaatgagcgacttcaaataggttcattgctccggcccagaatacgattaatccggcatgggctacgtgagctccaagtagtttaccggacaaattgataagtctggcattcccagcccaccaagcaaagccggtggtttcttggtcacgaccaggtggtagaacctcctcagggaatataaggttttcatgaggctgatcttgagccgccatccacgcacgaataccctcgtttaaaagaatatttttggtgtagaaagtctcgaattcaggatcttccgctgcacggatttcctgggaaacaaagtcataggcacgtaagttcagagccaagccaactacgccaatagcactcatccataaaccggtgacgggtacaaatagcataaagaaatgtaaccaacgtttattggaaaaagcaacaccaaagatttgggaccaaaagcggttagcagtgaccattgaataagtttcttcagcttgagttgggttaaaagcacggaatgtatttgcgccatcaccatcttcaaataacgtattttctacggtagcaccatgaatagcgcatagtagggcagcgcccaatacaccagcaactcccatcatatgaaatgggttcaacgtccaattatgaaatccttggaagaaaaggatgaatcgaaatatcgctgctacgccaaaactcggcgcaaagaaccaaccagactgacccagtggataaatcaggaatacagaaacaaaaacagcaattggaccagagaatgagattgcattataaggccgcaattgaacagaccgagcaagttcaaattggcgtaacatgaaacctattagtgcaaaagccccgtggagagctacaaaagtccatagaccgcctaattgacaccaacgagtaaaatctccttgtgcttctggcccccatagtagcaacaaagagtgtgctaaactattggcaggggtagaaactgctgcggttaagaaattacaaccttccaaataggaacttgccaatccatgggtataccaagaagttacaaaagttgtccctgtaaaccaaccccctaaagcgaaataagcacaaggaaagagcaataggccagaccatcctacaaaaacgaaacggtcccttcgtaaccagtcatccatagtatcaaatagatcattttcttctttaggaactctaccaagggctatagtcat

SEQ ID NO: 4378 - DNA, 2437 bp, Gnetum gnemon
ttagttaagaggagtcataaaaaggacgggttctaaatcgcgatcaattcctttttcaaaacctgctgcggctgcacgagcacgacctgcatgccacaaatgacctacaaagaaaaaaaatcctagaacaaagtgagaagtggctaaccaacttcgaggagaaacaaagtttactgcatttatttcagtagctacaccgcctactgaatttaaagagcctaaaggagcatgcgtcatatattcggccgagcgtcgttcttgccaaggttgtatatctttttttaatttactcaggtctaaaccattaggaccccttaacggttctaaccagggggcacgaagatcccaaaaacgcatggtttctcctccgaagataatctctccggtaggagaacgcataagatatttacccaaaccggttggtccttgagcagatcctacgctagctccaagacgctggtctcggactagaaaagtaaatgcttgagcctgagaagcttctggcccagtgggcccgtagaattcacttggatacgctgtattattaaaccaaacaaagcagcaagcgataaaaccaaagacagagagagcacctaaactatacgataaataagcttcgccagaccatacaaaggcgcgacgagtccaagcaaaaggtttagttaagatatgccagataccgccaaagatacatatggaacccaaccagaaatgtcctccaattagatcttctagattgtccacactaacgatccaaccctctcctccaaaaggagatttcagtaaataaccgaaaataatgttggggctaagagtcaaatttgtgatttttctaacatctcctccacctggagcccaggtatcgtatataccgccgaaaaacaaagctttaaatacgagaagaaaagcgccagcacccagtagaatgaggtgaatacccaaaatggtggtcattttattcctatctttccacgtgtaaccaaaaaaaggaaaagattcttctaaggtttcaggacctataagcgcatgataaataccaccaaagcctaaaactgcggatgaaattaaatggagtactcccgacacaaaataaggaaacgtgtccacgatttctccacccggacctactccccatcctagagtggcgagatgaggaagtaaaattaatccttgttcatacatcggtttttccggtataaaatgagctacttcgaaaaggttcattgaacctgcccagaatacaattaatccagcatgagatacgtgagctccaagtaatttacccgataaatttatgagtctggcattgccggcccaccacgcaaaacccgtagtttcttggtcacgaccggctaaagtaagagttccgttaaagagcgtttccacggggtaaaacctcctcggggaatataaggttttcatggggctgatcttgagctgccatccaagcgcgaataccttcgttcaagaggatattcttcgtatagaaagtctcgaattcagggtcttccgctgcacgtatttcctgagaaacaaaatcgtaggcacgtaagtttaaagctagaccaactactccaatggcgctcatccataaaccagtcaccggcacaaataacaagaaaaaatgtaaccaacgtttatttgaaaaagcaactccaaagatttgggaccagaagcgattagcagtaaccatggagtaagtttcttccgcttgagttgggttgaaagcacggaacgtatttgcaccatccccgtcttcaaacaaggtattttctacggttgcaccgtgaatagcacaaagaagagcagcacctaaaactccagcaactcccatcatgtgaaatgggttcaaggtccaattatggaaaccttggaaaaaaaggataaatcggaaaattgcggcgactccgaagctaggcgcaaaaaaccaaccggactggcctaacggataaatcaaaaaaaccgagacaaaaacagcaattggagcagaaaacgcaatagcattataaggtcgtaattgtacagatcgagcaagttcaaattgacgtagcatgaaccctattagaccaaacgcgccgtgcagagcgacaaaggtccataggccacctaattggcaccaacgagtaaaatctccctgcgcttcaggaccccataatagcagaagcgaatgagctaaactattagccggagtcgaaactgcagctgttaaaaaattacagccctctaaatacgaactagctaagccgtgggtataccacgaagtcacaaaggttgtccctgtaaaccatccccccaaagcgaaataagcacaaggaaagagtaaaaggccggaccaacctataaaaacaaagcggtctctgcgtagccagtcatccaggatatccaagaatgtttttttttctttggaaatttttccaaatgctatggtcataatcat

SEQ ID NO: 4379 - DNA, 3113 bp, Sorghum bicolor
tttctttatttcttttcttttatttcttttctatagtataagaaaaatgaattaaatgaaattcgtggatttagcacgaccttggttgtgaccccatagataaaaatgcaaaatttctatcttcgagacgactgaaaaagggcattgaacgagaaagaaatcgtccacagataatcaaactatcgtatgccctggaagtaatatgaggtgctcgaaaatggttgaagtaattgaataggaggatcactatgactatagccgttggtagagttactaaagaagaaaacgatctatttgatattatggacgactggttacgaagggaccgttttgtttttgtaggatggtccggcttattgctctttccttgtgcttatttcgctttagggggttggtttacagggactacttttgtaacttcttggtatacccatggattggctagttcctatttggaaggttgcaatttcttaaccgcggcggtttccacacctgccaatagtttagcacactctttgttgctactatggggaccggaagcacagggggattttactcgttggtgtcaattaggtggtctttggacttttgtcgctctccatggagcttttgcactaataggttttatgctacgtcaatttgaacttgctcggtctgttcaattgcggccttataatgcaatttcattctctggtccaatcgctgtttttgtttccgtattccttatttatccactgggacaatctggttggttctttgcgccgagttttggcgtagcagctatatttcggttcatccttttcttccaaggatttcataattggacgttgaacccatttcatatgatgggagttgccggagtattaggcgcagctctgctatgcgctatccacggggctaccgtagaaaacactctattcgaagatggcgatggtgcaaataccttccgtgcttttaacccaactcaagctgaagaaacttattcaatggtcactgctaaccgcttttggtcccaaatctttggtgttgctttttccaataaacgttggttacatttctttatgctatttgtacccgtcaccggtttatggatgagtgctattggcgtagttggtctggctctgaacctacgtgcctatgacttcgtttcccaggaaatccgtgcagcggaagatcctgaatttgagactttctacaccaaaaatattcttttaaatgagggtattcgtgcgtggatggcagctcaggatcagcctcatgaaaatcttatattccctgaggaggttctaccacgtggaaacgctctttaatggaactttcgttttagctggtcgtgaccaagaaaccaccggctttgcttggtgggctgggaatgccagacttatcaatttgtccggtaaactacttggagctcatgtagcccatgccggattaatcgtattctgggccggagcaatgaacctatttgaagtggcccatttcgtaccagaaaagcccatgtatgaacaagggttgattttacttccgcacttagctactctaggttggggagtagggccggggggagaagttctagatacttttccttactttgtatccggagtacttcacttaatttcctccgcagtcttaggcttcggtggcatttatcacgcgcttctgggacccgagactcttgaagaatcttttccattctttggttatgtatggaaagatagaaataaaatgactacaattttgggtattcacttaattttgttaggtctaggtgcttttcttctagtactcaaggctctttattttggcggcgtatatgatacctgggcccccggggggggggatgtaagaaaaattaccaatttgacccttagccccggtgttatatttggttatttactaaaatccccttttgggggagaaggatggattgttagtgtggatgatttagaagatataattggggggcatgtatggttgggttccatttgtgtacttggcggaatttggcatatcttaaccaaaccctttgcatgggctcgccgtgcatttgtatggtctggcgaagcttacttgtcttatagtttaggtgctttatctgtttttggttttatcgcttgttgttttgtctggttcaataatacggcttatccaagtgagttttacgggcccactggaccagaagcttctcaagctcaagcatttacttttctagttagagaccagcgtcttggagctaatgtagggtctgcccaaggaccgacgggtttaggtaaatatctaatgcgttccccaacgggagaggttatttttggaggggaaactatgcgtttttgggatcttcgtgctccgtggttagaacctctaaggggccccaacggtttggacttgagtaggttgaaaaaagatatccaaccttggcaagaacgacgttcagcagaatatatgacccatgctcctttaggctctttaaattccgtgggtggcgtagctaccgagatcaatgcagttaattatgtctctcctagaagttggttagcgacctcccattttgttctaggattcttcttttttgtgggccatttgtggcatgcaggaagagcccgagctgctgcagcaggctttgaaaagggaattgatcgtgatttggaacctgttctttacatgacccctcttaactaagattttttatttatacctgttctagtttttttctgttctggctcggttattccatctagccgagccattcatgcttttttatgaaagaatgatataagggggctgaacaaagaaaaacatagatagaaagaaacaaatgtattcaatatacaaaaggagagagagggattcgaaccctcgatagttcctagaactataccggttttcaagaccggagctatcaaccactcagccatctctccacagcccaatccctattttattcctacaaatagaacatagctatatgaaatgatctactaactcatctcagatgcaagtccactttcaatatatctctgtatactgtatacacggatacagaatccgctatatccgtttgtgaaataaaggctaaatcccctcccctcaactccatatccaaataaaagcgg

SEQ ID NO: 4380 - DNA, 2777 bp, Adiantum capillus-veneris
agtcctggaagaaaaggggggcttacctactaaatatctgacgtggcagaagggatctcccagagacaagaagggatgatatattggaacgacaagcagggaggagaaagaattgggcaaaaatgatgaatagaataaattgaaagaaaagtgaaaaaaaaaatggaaaagggcaagaaggccttgtgaaaatattacgatttttgatctcgcacgacaaattctgataaaatgacttatcaacaatctggtaatctcatattcaagagaactataccaactcctggaatatagaaataggaatgagggacctaaaagtggtttgggtagcttagtgggaacagatatgacaattgccattggaaaatcttccaaagaaccgaaagacttattcgacagtatggatgactggctcaggagagatcgttttgtatttgtgggttggtccggcttactactatttcccaccgcttacttcgccctggggggctggttcacgggtacgacctttgtgacttcgtggtatactcacggattagcaagttcttacttggagggatgcaatttcttgactgccgcggtatctacccctgctaatagtttggcccactctttgcttcttttgtggggtcctgaagcacagggggacttcactcgttggtgccaattggggggtttatggactttcgtcgcccttcatggttctttcgccttaataggttttatgttacgccaatttgaactggctaggtccgtacaattacgcccctacaacgcagtagctttctctggtccgattgcggtttttgtctccgtatttttgatttaccctttaggacaatccggttggttcttcgcacctagtttcggtgtagcggctatcttccgattcattttgttttttcaaggttttcataattggactctgaatccatttcatatgatgggggttgcaggagttctgggcgctgctctcctatgtgccattcatggtgctacagttgaaaatactctctttgaagacggcgacggtgcaaacacatttcgggcgttcaatccaactcagtctgaagagacttattcgatggtaactgcaaatcgcttctggtcccaaatatttggtgtcgctttttccaacaaacgctggttacattttttcatgttatttgtgccagtgacgggtttatggatgagtgctatcggagtagttggtctcgccttaaatttgcgcgcgtatgactttgtctcccaagaaattcgtgcagcagaagatcccgagttcgagactttctacacaaagaatatcttactaaacgaagggatccgtgcctggatggcagctcaggatcagcctcacgaaaatcttgtattccccgaggaggttttaccccgtggaaacgctctttaatggaactctctcgctgggtggtcgcgatcaggaaaccacgggttttgcttggtgggcggggaacgcccggttgattaatttgtctggtaaattgcttggtgcccacgtagctcatgctggtctgattgtattttgggctggagctatgaatttatttgaagtagctcacttcgtatcagagaagcctatgtatgagcagggattaattctacttccccacttggcaaccctgggttggggggtaggtcctggcggggaagtggccgataccttcccttactttgtttccggagtgctacatttgatttcttccgcagttttgggttttggaggcatatatcatgctttgattggtcccgaaactctggaagaatcttttcctttctttggttacacttggaaggataaaaataagatgactacaattctcggtattcatctaatattactaggtttcggcgctttcctactggttttcaaagcactctatttcggagggttgtatgatacatgggcacccggtggcggagatgtaagagaaattacgaatcttactctaaaccccaatattatctttggttacctactaaagtctccgtttggcggagagggatggattgcgagtgtagataatctagaagatattatcgggggacatgtgtggctcggatccatctgtattttcggcgggatttggcacatattaacaaaaccgtttgcctgggctcgtcgagcttttgtgtggtccggggaggcttatttatcctacagcttgggagctctagccatatttggcttcactgcctgctgtttcgtctggttcaacaacacagcatatcctagtgaattttatggtcccaccggtccagaagcttctcaagctcaagcttttaccttcctcgttagagaccaacgtctcggcgccaacataggttctgcccagggacctactgggttaggaaaatacctaatgcgttcccccaccggagaaattatttttgggggcgaaacaatgcgcttctgggatcttcgtgctccttggttagaacctctaagaggtccaaatggtttagatcttggtaagttgaaaagggatatacagccatggcaggagcgacgatctgcggaatatatgactcatgcacccttaggctccttaaactctgtaggcggggtagctaccgagattaatgctgtaaactatgtatctccccgaagttggttagcaacttctcactttgttttgggattctttttctttgtgggccatctatggcacgcaggtagggctcgtgcagccgcagccggctttgaaaaaggaattgaccgcgataccgaacccgttctttctatgacaccccttaattaa

SEQ ID NO: 4381 - DNA, 1402 bp, Chenopodium quinoa
agccaattgatttataccttaaaacgttgaatttcttgtctcaattaaggggggtcattgaaagaacaggttcaaaatcacgatcaattcctttttcaaatcctgctgcagctgcacgagcccttcccgcatgccacaaatgacctacgaataggaaaaatcctaaaacaaaatgagaagtagctaaccaacttctaggagagacataattgactgcattgatctcggtagccaccccacccacagaatttaaagaacctaaaggagcatgggtcatatattctgcggaacggcgttcttgccaaggttgtatgtcttttttcagccgactcaagtccaaaccatttggacctcttaggggttctaaccagggagcgcgcaaaatcccaaaaccgcatagtttctcccccaaaaataacttctccagtcggagaacgcattagatacttactaaaccagtaggtccttgagcggatcccacgttagccccaagacgttggtctctaactaaaaagtaaatagcttgagcttgagaagcttctggtccagtaggtccgtaaaactcactaggataagcagtattattgaaccagacaaagcaacaagcaatgaaaccaaagacagataaagcagccaaactataagacaaataagcctctccagaccagacaagtgcgcggcgagcccatgcaaaaggtttagttaagatatgccagattccaccaagtatacaaatgaaacctatccatacatgccccccgattatatcttccaaatcgtccacactaacaatccacccttctcctccaaaaggcgattttagtaaataaccaaagataatactcggactaagggtgacgttggtaatttttcttacatctccgcctcctggagcccaggtatcatatacgcccccaaaataaagagccttgaacactagaagaaaggcgcctatacctaacaagattaagtgaatgcccaaaattgtggtcattttatttctatctttccacacataaccgaagaatggaaaagattcttcaagagtttcagggcccagaagtgcatgataaatacccccaaagcccaatacggccgacgaaattaagtgaaggactcctgatacaaagtatggaaaagtgtctataacttccccgccggggcctaccccccaacctagagtagctaggtggggaagtaaaattaatccttgttcatacatcggcttctctggtacgaaatgagccacttcaaacaggttcattgctccggcccagaatacgattaatccggcatgggctacatgagctccaagtagtttaccagataaattgataagtcgagcattcccggcccaccaagcgaaaccggtggtttcttggtcacgtccggctatagttaa

SEQ ID NO: 4382 - DNA, 2667 bp, Pteridium aquilinum
ttgaggagcttagtgagggaatgaatatgaccatcgccattggaaaatcttccaaggaaccgaaagatttatttgatagtatggacgactggctcagaagagatcgttttgttttcgtgggttggtctggcctgttactgtttcccaccgcttactttgctttgggcggttggttcacaggcacaacttttgttacttcgtggtatacccatggattagccagttcttacttggagggatgtaatttcttgactgccgcggtatccactcctgccaacagtttggcccactccttgcttctgttgtggggtcctgaagcacaaggagatttcacccgttggtgccaattaggaggtttgtggaccttcgttgctcttcacggctctttcgctctaataggctttatgctacgtcaattcgaacttgctaggtccgtgcaactacgtccctacaacgcaatagctttttccggtccgattgcggttttcgtctctgtattcttgatttatcctttgggacaatccggttggttcttcgcacccagttttggtgtagcggctatcttccgattcattctgttttttcagggttttcataattggactctgaacccatttcatatgatgggggttgctggggtcctcggtgccgctctattatgtgctatccacggtgctacagttgaaaatactctatttgaagacggtgatggtgcgaacacattccgcgcgttcaacccaactcagtctgaagagacttattctatggtaaccgcaaaccgcttctggtcccaaatattcggtgttgctttctccaacaaacgttggttacacttcttcatgttattcgtgccagtaacgggtttatggatgagtgctattggagtagttggtctcgctttgaatctacgcgcgtacgacttcgtctctcaagaaattcgtgcagcagaagatcccgagttcgagactttttacacaaaaaacatattactaaacgagggtatccgtgcttggatggcagctcaggatcagccccacgaaaatcttgtattccccgaggaggttttaccccgtggaaacgctctttaatggaaccctttcgctgggtggtcgcgatcaggaaaccacaggttttgcttggtgggctggcaacgctcgactaatcaatctgtctggtaaattgcttggcgcccacgtggctcatgctggcctgattgtcttttgggctggagctatgaatctttttgaagtggctcatttcgtatccgagaagcctatgtacgagcaagggctaattctacttccccacttggctactctgggttggggggtgggtcccgcgggaagtaacagatacttttccctatttcgtttccggagtactccatttgatctcctctgcagttttggggtttgggggtatatatcacgccctgatcggacccgaaactttggaagaatcctttccattttttggttatacttggaaagataaaaataagatgaccacaattcttggtatccatttaatactactaggtcttggtgctttcctcttagttttcaaagcactctatttcgggggattgtatgacacatgggcacccgggggtggagatgtgagggaaattacgaatcttaccctaagtcctaacgttatcttcggttatctactgaaatctccttttggtggagaggggtggattgcaagtgtggataatctagaagatattatcggcggacatgtatggctgggttccatttgtctcttcggtggaatttggcacatattaacgaaaccgtttgcctgggctcgtcgcgctttcgtatggtccggagaagcttacttatcttacagtttgggggcccttgccatctttggtttcactgcctgctgcttcgtctggttcaacaacacagcatatcccagtgaattctatggtcccaccggtccagaagcttctcaggctcaagcttttacctttcttgtaagggaccaacgcctcggtgccaacataggttccgctcagggacctactggtttgggtaaatacctgatgcgttcccctacgggagaaattatttttggaggcgaaaccatgcgcttctgggaccttcgtgctccttggttagaacctttaagaggtcccaatggtttggatctgggtaagttgaaaaaggatatacaaccgtggcaagagcgacgatccgcggagtatatgactcatgcacccttaggttctctaaactccgtaggtggagtagctaccgagatcaatgccgtgaactacgtatctccccggagttggttagcaacctcccacttcgttctaggattcttttttttcgtgggtcatctgtggcacgcgggtagggctcgtgcagccgcagccgggtttgaaaaaggaattgaccgcgataccgaacccgttctttctatgacacccctgaattaaaacttggaaacatttgttgaataacacggggaagaaaaaggagtgaacaacgggtaaactaaactctatctatctaaatagctctatctaaatagatagatagatctcatcagctggcggcagatactaccaaggtatttttttctctctctcttttttaagagattgttttagaagattattagtaaccatcggttcttccgtccgttgct

SEQ ID NO: 4383 - DNA, 1529 bp, Chenopodium quinoa
ctgcagctgcacgagcccttcccgcatgccacaaatgacctacgaatggaaaaatcctaaaacaaaatagagaagtagctaaccaacttctaggagagacataattgactgcattgatctcggtagccaccccacccacagaatttaaagaacctaaaggagcatgggtcatatattctgcggaacggcgttcttgccaaggttgtatgtctttttcagccgactcaagtccaaaccatttggacctcttaggggttctaaccagggagcgcgcaaatcccaaaaccgcatagtttctcccccaaaaataacttctccagtcggagaacgcattagatacttacctaaaccagtaggtccttgagcggatcccacgttagccccaagacgttggtctctaactaaaaaggtaaatgcttgagcttgagaagcttctggtccagtaggtccgtaaaactcactaggataagcagtattattgaaccagacaaagcaacaagcaatgaaaccaaagacagataaagcagccaaactataagacaaataagcctctccagaccagacaagtgcgcggcgagcccatgcaaaaggtttagttaagatatgccagattccaccaagtatacaaatgaaacctatccatacatgccccccgattatatcttccaaatcgtccacactaacaatccacccttctcctccaaaaggcgattttagtaaataaccaaagataatactcggactaagggtgacgttggtaatttttcttacatctccgcctcctggagcccaggtatcatatacgcccccaaataaagagccttgaacactagaagaaaggcgcctatacctaacaagattaagtgaatgcccaaaattgtggtcattttatttctatctttccacacataaccgaagaatggaaaagattcttcaagagtttcagggcccagaagtgcatgataaatacccccaaagcccaatacggccgacgaaattaagtgaaggactcctgatacaaagtatggaaaagtgtctataacttccccgccggggcctaccccccaacctagagtagctaggtggggaagtaaaattaatccttgttcatacatcggcttctctggtacgaaatgagccacttcaaacaggttcattgctccggcccagaatacgattaatccggcatgggctacatgagctccaagtagtttaccagataaattgataagtcgagcattcccggcccaccaagcgaaaccggtggtttcttggtcacgtccggctatagttaaagttccattaaagagcgtttccacggggtagaacctcctcagggaatataaggttttcatgaggctgatcttgagccgccatccaagcacgaataccttcgtttaagagaatatttttggtgtagaaagtttcaaattcaggatcttccgctgcacggatttcctgggaaacgaagtcataggcacgtaggttcaaagccagaccgactactccaagagcactcatccataaac

SEQ ID NO: 4384 - DNA, 1514 bp, Chenopodium quinoa
ctgctgcagctgcacgagccttcccgcatgccacaaatgacctacgaatagaaaaatcctaaacaaaatagagaagtagctaaccaacttctaggagagacataattgactgcattgatctcggtagcaacccacccacagaatttaaagaacctaaaggagcatgggtcatatattctgcggaacggcgttcttgccaaggttgtatgcttttttcagccgactcaagtccaaaccatttggacctcttaggggttctaaccagggagcgcgcaaatcccaaaaccgcatagtttctcccccaaaaataacttctccagtcggagaacgcattagatacttacctaaaccagtaggtccttgagcggatcccacgttagccccaagacgttggtctctaactaaaaaagtaaatgcttgagcttgagaagcttctggtccagtaggtccgtaaaactcactaggataagcagtattattgaaccagacaaagcaacaagcaatgaaaccaaagacagataaagcagccaaactataagacaaataagcctctccagaccagacaagtgcgcggcgagcccatgcaaaaggtttagttaagatatgccagattccaccaagtatacaaatgaaacctatccatacatgccccccgattatatcttccaaatcgtccacactaacaatccacccttctcctccaaaaggcgattttagtaaataaccaaagataatactcggactaagggtgacgttggtaatttttcttacatctccgcctcctggagcccaggtatcatatacgcccccaaaataaagagccttgaacactagaagaaaggcgcctatacctaacaagattaagtgaatgcccaaaattgtggtcattttatttctatctttccacacataaccgaagaatggaaaagattcttcaagagtttcagggcccagaagtgcatgataaatacccccaaagcccaatacggccgacgaaattaagtgaaggactcctgatacaaagtatggaaaagtgtctataacttccccgcccgggcctaccccccaacctagagtagctaggtggggaagtaaaattaatccttgttcatacatcggcttctctggtacgaaatgagccacttcaaacaggttcattgctccggcccagaatacgattaatccggcatgggctacatgagctccaagtagtttaccagataaattgataagtcgagcattcccggcccaccaagcgaaaccggtggtttcttggtcacgtccggctatagttaaagttccattaaagagcgtttccacggggtagaacctcctcagggaatataaggttttcatgaggctgatcttgagccgccatccaagcacgaataccttcgtttaagagaatatttttggtgtagaaagtttcaaattcaggatcttccgctgcacggatttcctgggaaacgaagtcataggcacgtaggttcaaagccagaccgactactccaaga

SEQ ID NO: 4385 - DNA, 2147 bp, Chenopodium quinoa
gctgcacgagcccttcccgcatgccacaaatgacctacgaataggaaaaatcctaaacaaaatagagaagtagctaaccaacttctaggagagacataattgactgcattgatctcggtagccacccacccacagaatttaaagaacctaaaggagcatgggtcatatattctgcggaacggcgttcttgccaaggttgtatgtcttttttcagccgactcaagtccaaaccatttggacctcttaggggttctaaccagggagcgcgcaaatcccaaaaccgcatagtttctcccccaaaaataacttctccagtcggagaacgcattagatacttacctaaaccagtaggtccttgagcggatcccacgttagccccaagacgttggtctctaactaaaaaagtaaatgcttgagcttgagaagcttctggtccagtaggtccgtaaaactcactaggataagcagtattattgaaccagacaaagcaacaagcaatgaaaccaaagacagataaagcagccaaactataagacaaataagcctctccagaccagacaagtgcgcggcgagcccatgcaaaaggtttagttaagatatgccagattccaccaagtatacaaatgaaacctatccatacatgccccccgattatatcttccaaatcgtccacactaacaatccacccttctcctccaaaaggcgattttagtaaataaccaaagataatactcggactaagggtgacgttggtaatttttcttacatctccgcctcctggagcccaggtatcatatacgcccccaaaataaagagccttgaacactagaagaaaggcgcctatacctaacaagattaagtgaatgcccaaaattgtggtcattttatttctatctttccacacataaccgaagaatggaaaagattcttcaagagtttcagggcccagaagtgcatgataaatacccccaaagcccaatacggccgacgaaattaagtgaaggactcctgatacaaagtatggaaaagtgtctataacttccccgccggggcctaccccccaacctagagtagctaggtggggaagtaaaattaatccttgttcatacatcggcttctctggtacgaaatgagccacttcaaacaggttcattgctccggcccagaatacgattaatccggcatgggctacatgagctccaagtagtttaccagataaattgataagtcgagcattcccggcccaccaagcgaaaccggtggtttcttggtcacgtccggctatagttaaagttccattaaagagcgtttccacggggtagaacctcctcagggaatataaggttttcatgaggctgatcttgagccgccatccaagcacgaataccttcgtttaagagaatatttttggtgtagaaagtttcaaattcaggatcttccgctgcacggatttcctgggaaacgaagtcataggcacgtaggttcaaagccagaccgactactccaagagcactcatccataaaccggttactggtacaaataacataaagaaatgtaaccaacgtttattggaaaaagcaaccccaaaatttgggaccaaaagcggttagcggtgaccattgaataagtttcttcggcttgggttgggttaaaagcccggaatgtatttgccccatcaccgtcttcaaataaagtattttctacggtagcgccatgaatagcgcatagtagagcggcgcccaatacaccggcaactcccatcatatgaaatggattcagtgtccaattatgaaacccttgaaaaaagagaatgaatcgaaatatagctgctacaccaaaactaggtgcaaagaaccaaccagactgacctagtggataaattaggaatacagaaacaaaaacagcaattggaccagagaatgcgattgcattataagggcgcaattgaacggatcgagcaagctcgaattgacgtaacataaaacctattagtgcgaaagcaccatgaagagcaacaaaagtccacaggccgcctaattgacaccaacgagtaaagtctccttgtgcttcaggaccccacagtaacaataaagagtgggctaaactattagcaggagtagaaactgccgcggttaagaaattgcaa

SEQ ID NO: 4386 - DNA, 2315 bp, Amborella trichopoda
tataaattacatgtataaattttgaatttgcaaaatttgacaaaataaagacacaaatcaaataagtttgacccctcccgttaatttttagaatttttttttgttatttgcattttgggaacttctaacttatcttatattgtattgaatttgaacgtgtctcataacctgaaagaattcggggaggggtcgtttttggacctagaacgaccaggttcaagagataagagaattaaggatacctaccagaaagactaatccaatccataatgatgtaccggaaaatacaacatttttattacccgaccaaccatcaggagaagcaaatacaacgggtacactaatcagtaagattgatgaagtagcaattaatgcaaaaacagccaattggaaagcaatagtcatgtttctaatcctccaatttaccaataaaagaattatataccatttgatctctttatcagccaaaaaattgtcaaaaaaaaaatgcatcgaggacactttttttactttacaaaagggaacgctagatcatgcatctatatatatagatagctagatctatagattcatactcgatatatttctataatatactaaaggtatcaacttatatcgctatgtcttattcaatgaaaaaaaataaaatagaaattatctttcggagagatggccgagtggttgatagctccggtcttgaaaaccggtatagtccaaaacaaaggactatcgagggttcgaatccctctctctcctttttcttggtgaatagattagtttcgttagtttattgatttcagtattataagtggaatggctcggctattccacttagccgagccagaaaaaaaaatagattagatataaaaagaaagaaaaaaggaagactttaaaaatattaccgactcgcccaacttactaacttacttaataagtagggtggaatcaaattgattcctacttcaagcattgggtctcctgtcttaattaagaggagtcatgaaaagaacaggttctaaatcacgatcaattcctttttcaaatcccgctgcagctgcacgagcccttcccgcgtgccataaatgacctacgaataggaagaaccctagaacaaaatgagaagtagctaaccaacttctaggagagacataatttactgcattgatctcggtagctacaccacccacggaatttaaagaacctaaaggagcatgagtcatatattccgcagaacgccgttcttgccaaggctgtatgtctttttttcagcctactcaagtccaaaccgttgggaccccttagaggttctaaccagggagctcgtagatcccaaaaacgcatagtttcccctccaaaaataacttcccctgtcggtgaacgcattagatatttacctaaaccggtaggtccttgagcggatcccacgttagccccaagacgttggtctctaactagaaaagtaaatgcttgagcttgagaagcttctggaccagtgggcccgtaaaactcactaggataagcggtattattgaaccagacaaagcaacaagcaataaaaccaaaaactgataaagcacctaaactataagacaagtaagcctctccagaccatacaagtgcacgacgagcccatgcaaagggtttggttaagatatgccagattccaccaagtatacaaatggaacctaaccatacatgtcctccaattatatcttccaaatcgtccacactaacaatccacccctctccaccaaagggagatttgagtaaataaccaaatacaatacttggactaagggtcaaattggtaatttttcttacatctcctccccccggagcccaggtatcatatacacccccaaaataaagagccttaaagactagaagaaaagcacctatacctaacaaaattaagtgaatacccaaaattgtagtcattttatttctatctttccatacataaccgaagaatggaaaagattcttcaagagtttcaggtcccagaagtgcatgataaataccgccaaagcccaatactgcagaggaaattaagtgaagtactccagacacaaagtatggaaaggtatctagaacttccccgccgggccctaccccccaacctagagtagctaggtggggaagtaaaattaagccctgttcatacataggcttctctgggacgaaatgagccacttcaaataggttcattgctccggcccagaatacgattaatccggcatgagctacatgagcccccagcagtttaccggataaattgataagtcgggcattcccggcccaccaagcgaaaccgg

SEQ ID NO: 4387 - DNA, 2157 bp, Quercus alba
taagattgttgaagtaagcaattaatagacaaaaacaagaccaattggaaagcaatagtcatctttctaatcctccaatctatcaacaaaagaaactatataccatttgatccctttattggtatcggccaaaaaattgtatcagccaaaaaattctaataaaacgtatcatagagggattttatcacgaatctattaatgctgtatgacttattagcaccttttaccaccttattaaatcttattaaattaaggcatgagatcaaggaaaggtatttttttttttacttcattaaaagaggcccgccagatcattatctatatatatacagatcgatagctagacccataggatcgcaccggatatctttatatatataggtcgtaatggtatcaactcatatatccatgttctattcgttagaaaattaaaaaaaaaataataaaatagaaataatctttcggagaggtggccgagtggttgatagctccggtcttgaaaaccggtatagttcgaaacaaagaactatcgagggttcgaatccctctctctcctttttgctcgtggaatatatatatatatatttttattttattggttttgtccggctcagtattagtattctaaaagggaatggctcggctagggggatagccgagccagaacagaaaaaaaaagggttcaatatataatgagtcgaaaatgaaaataaaggaatactttttttttcaatacgtatgacctaacccaaccaaacaaatatgtatgatgaaatcaaatagattttgacttcaagcattagaattagatctcctgtcttagttaagaggagtcatggaaagaacaggttcaaaatcgcgatcaattcctttttcaaatcctgctgcagctgcacgagcccttcctgcatgccataaatgacctacgaataggaagaatcctagaacaaaatgagaggtagctaaccaacttctaggagagacataattgactgcattgatctcggtagctacaccacccacggaatttaaagaacctaaaggagcatgagtcatatattccgcggaacgtcgttcttgccaaggttgtatgtcttttttcagcctactcaagtccaacccattgggaccccttaggggttctaaccagggagcacgcaaatcccaaaaacgcatagtttctcccccaaaaatgacttctccagtcggagaacgcattagatatttacctaaaccggtaggtccttgggcggaccctacgttagccccaaggcgttggtctctaaccagaaaagtaaatgcttgagcttgagaagcttctggtccagtgggcccgtaaaactcactaggataagcggtattattgaaccaaacaaagcaacaagcaataaaaccaaaaacagctaaagcacctaaactataagacaagtaagcctccccagaccatacaagcgcacggcgcgcccatgcaaaaggtttggttaagatatgccagattccaccaagtatacaaatggaacccaaccatacatgccctccaattatatcttccaaatcgtccacactaacaatccatccctctcctccaaaaggggattttagtaaataaccaaatatgacgcttgggctaagggtcaagttggtaatttttcttacatctccccctccggggcccaggtatcatatacgcctccaaaataatagctttgaatactagaagaaaagcacctatacctaacaaaattaagtgaatacccaaaattgtagtcattttattctatctttccatacataaccgaagaatggaaaaagactcttcaagagtctcgggtcccagaagtgcgtgataaataccgccaaaagcccaatactgcagaggaaattgagtgaagtactccagacacaaagtatggaaaggtatctataacttccccaccaggacctaccccccaacctagagtagttaggtggggaagtaaaattaatccttgttcatacatgggcttttctggtacgaaatgagccacttcaaataggttcattgctccggcccagaatacgattaatccggcatgggctacatgagctcccagtaattaccggataaattgataagtcgggcacgttcccggcccaccaagcgaaacctgtggtttc

SEQ ID NO: 4388 - DNA, 1451 bp, Quercus alba
tgaaaataaggaatacttttttttttctaatacgtatgactaaccaaccaacaaatatgtatgatgaaatcaaatagattttgacttcaagcattagaattagatctcctgtcttagttaagaggagtcatggaaagaacaggttcaaaatcgcgatcaatcctttttcaaatcctgctgcagctgcacgagcccttcctgcatgccataaatgacctacgaataggaagaatcctagaacaaaatgagaggtagctaaccaacttctaggagagacataattgactgcattgatctcggtagctacaccacccacggaatttaaagaacctaaaggagcatgagtcatatattccgcggaacgtcgttcttgccaaggttgtatgtcttttttcagcctactcaagtccaacccattgggaccccttaggggttctaaccagggagcacgcaaatcccaaaaacgcatagtttctcccccaaaaatgacttctccagtcggagaacgcattagatatttacctaaaccggtaggtccttgggcggaccctacgttagccccaaggcgttggtctctaaccagaaaagtaaatgcttgagcttgagaagcttctggtccagtgggcccgtaaaactcactaggataagcggtattattgaaccaaacaaagcaacaagcaataaaaccaaaaacagctaaagcacctaaactataagacaagtaagcctccccagaccatacaagcgcacggcgcgcccatgcaaaaggtttggttaagatatgccagattccaccaagtatacaaatggaacccaaccatacatgccctccaattatatcttccaaatcgtccacactaacaatccatccctctcctccaaaaggggattttagtaaataaccaaatatgacgcttgggctaagggtcaagttggtaatttttcttacatctccccctccggggcccaggtatcatatacgcctccaaaataatagctttgaatactagaagaaaagcacctatacctaacaaaattaagtgaatacccaaaattgtagtcattttattctatctttccatacataaccgaagaatggaaagactcttcaagagtctcgggtcccagaagtgcgtgataaataccgccaaagcccaatactgcagaggaaattaagtgaagtactccagacacaaagtatggaaaggtatctataacttccccaccaggacctacccccaacctagagtagctaggtggggaagtaaattaatccttgttcatacatgggcttttctggtacgaaatgagccacttcaaataggttcattgctccggcccagaatacgattaatccggcatgggctacatgagctcccagtaatttaccggataaaattgataagtcgggcattcccggcccaccaagcgaaacctgtggtttcccccat

SEQ ID NO: 4389 - DNA, 1924 bp, Amorphophallus konjac
aactaccaacgacttaacctaaccaaattaaaactacttaacctatttacgtattacccccgtccttaacgtctaaaatttttagtataaatagcatcatcatcattgcgggatttgaccatgaatctatttgaattctttaaacttattacctactttatattttattttagtatttatttataacaaaacagatatactagatcctgcatatatctatatccacagtatacaatagatacatacagatggatacatatatagatcgcatctgagatgtaactataaatggttagtgtatcaacttatatggccatgttctatttgtaggaataaaatagaaattgtcttttggagagatggccgagtggttgatagctccggtcttgaaaaccggcatagttctgaacaaagaactatcgagggttcgaatccctctctctcctttttcttgcttgttgaatctttccttattggacggatatgctgtcataaaaggtaatggctcggccaggtgggataggatagccgagccagaacagaaaaaaatagaaaaaaatggaatagatataaatacaaaaatctcagctaagaggggtcatggaaagaacaggttccaaatcacgatcgattcccttttcaaatcctgctgcagctgcacgggcccttcccgcatgccacaaatgacccacaaaaaagaagaatcctagaacaaaatgagaggtagctaaccaacttctaggagatacataattgactgcattgatctcggtagctacgccacccacggaatttaaagaacctagaggagcgtgagtcatatattccgcggaacggcgttcttgccacggttgtatgtcttttttcagcctactcaagtccaaccccatttggacctcttagaggttccaaccaaggagcacggagatccccaaaaacgcatagtttccccctccaaaaatgatctctccggtcggggaacgcattagatatttacctaaaccagtaggtccttgagcggatcccacattaggccccaaggcgttggtctctaactagaaaagtaaagcttgagcttgagaagcttctggtccggttggcccaaaaaaattcactagggtaagcagtattattgaaccagacgaaacaacaagctataaaaccaaagacggataaagcacctaaactataagacaagtaagcctctccagaccagacaaatgcgcggcgagcccatgcaaagggcttggttaagatatgccaaattccaccaagtatacaaatggaacctaaccatacatgtcctccaattatatcttctaaatcgtccacactaacaatccatccttctcccccaaaaggagattttagtaaataaccaaatataacacttgggctaagggtcaagttggtaatttttcttacatctccccctccgggagcccaggtatcatatacaccaccaaaataaagagctttgaatactagaagaaaagcacctatgcctaacaaaattaagtgaatacctaaaattgtggtcattttatttctatctttccatacataaccaaagaatggaaaggattcttcaagagtctcaggcccaagaagcgcatgataaatgccgccaaagcctaagactgcagaggaaattaagtgaagtactccagacacaaagtatggaaaagtgtctataacttcccctcccggacctaccccccaacctagagtagctagatgtggaagtaaaatcaatccttgttcatacatgggcttttccggtacgaagtgagccacctcaaataggttcattgctccggcccagaatacaattaatccggacgtgggctacgtgagccccaagtagtttaccggacaaattgataagtctggcattcccagcccacaagcaaaaccggtggtt

SEQ ID NO: 4390 - DNA, 1457 bp, Triticum aestivum
ttttttttttctgtcccttatctttctttcataaaaaggaatgaatggctcggctagatggaataaccgagccagaacagaaaaaaagtagaacaggtataaataagaaaatcttagttaagagggttcatgtaaagaacaggttccaaatcacgatcgattcccttttcaaaacctgctgcagcagctcgggctcttcctgcatgccataaatggcccacaaaaaagaagaatcctagaacaaaatgagaagttgataaccaacttctaggagagacataattaactgcattgatctcggtagctacgccacccacggaatttaaagagcctaaaggagcgtgggtcatatattctgctgagcgtcgttcttgccaaggttgtatgtcttttttcaacctactcaagtccaaaccgttggggccccttagaggttctaaccatggagcacgaaggtcccaaaaacgcatagtttcccctccaaagataacctccccagttggggaacgcattagatatttacctaaacctgtgggtccttgagcggatcccacattagctccaagacgctggtctctaactagaaaagtaaatgcttgagcttgagaagcttctggcccggtgggtccataaaactcactcggataagctgtattattgaaccatacaaaacaacaagcgataaaaccaaagacagataaagcagctaaactataagacaagtaagcttctccagaccatacaaatgcacggcgagcccatgcgaagggtttggttaaaatatgccaaattccgccaaatacacaaataaaacccaaccatacatgcccaccaattatatcttctaaatcatctacactaacaatccacccttctccaccaaaaggagattttagtaaataaccaaatataacactgggactaagggtcaaattggtaatttttcttacatctccccccccaggggcccaggtatcatatacaccgccaaaataaagagccttgagtactagaagaaaagcacctagacctaacaaaattaagtgaatacccaaaattgtagtcattttatttctatctttccagacataaccaaagaatggaaaagattcctcaagagtctcgggtcccagaagcgcgtgataaatgccaccgaagcctaagactgcggaggaaattaggtgaagtacgccagatacaaagtacggaaaagtatctagaacttccccccctggccctactccccaacctagagtagctaagtgtggaagtaaaatcaacccttgttcatacatgggcttttctggtacgaaatgggccacttcaaataggttcattgctccggcccagaatacgattaatccggcatgggctacatgagctccaagtagtttaccggacaaattgataagtctggcattcccagcccaccaagcaaagccggtggtttcttggtc

SEQ ID NO: 4391 - DNA, 1593 bp, Amorphophallus konjac
agtcttttcggtagtagattggcgtacgtggttgagtagctccggcgttgaaaaccggacatagtctgacaaagaactatcaagggttcgaatccctctctacccctttttctttgcttgtttgaatctttccttattggacggatatgctgtcataaaaggtaatggctcggccaggtgggataggatagccgagccagaacagaaaaaaatagaaaaaaaatggaatagatataaatacaaaaatctcagctaagaggggtcatggaaagaacaggttccaaatcacgatcgattcccttttcaaatcctgctgcagctgcacgggcccttcccgcatgccacaaatgacccacaaaaaagaagaatcctagaacaaaatgagaggtagctaaccaacttctaggagatacataattgactgcattgatctcggtagctacgccacccacggaatttaaagaacctagaggagcgtgagtcatatattccgcggaacggcgttcttgccacggttgtatgtcttttttcagcctactcaagtccaacccatttggacctcttagaggttccaaccaaggagcacggagatcccaaaaacgcataggttccccctacaaaaatgatctctccggtcgggaacgcattagatatttacctaaaccagtaggtccttgagcggatcccacattagccccaaggcgttggtctctaactagaaaagtaaaaggcttagagcttgagaagcttctggtccggttggcccataaaattcactagggtaagcagtattattgaaccagacgaaacaacaagctataaaaccaaagacggataaagcacctaaactataagacaagtaagcctctccagaccagacaaatgcgcggcgagcccatgcaaagggcttggttaagatatgccaaattccacaagtatacaaatgaacctaaccatacatgtcctccaattatatcttctaaatcgtccacactaacaatccatccttctccccaaagagattttagtaaataaccaaatataacacttgggctaagggtcaagttggtaattttcttacatctccccctccgggagcccaggtatcatatacaccaccaaaataaagagctttgaatactagaagaaaagcacctatgcctaacaaaattaagtgaatacctaaaattgtggtcattttatttctatctttccatacataaccaaagaatggaaaggattcttcaagagtctcaggcccaagaagcgcatgataaatgccgccaaagcctaagactgcagaggaaattaagtgaagtactccagacacaaagtatggaaaagtgtctataacttcccctcccggacctaccccccaacctagagtagctagatgtggaagtaaaatcaatccttgttcatacatgggcttttccggtacgaagtgagccacctcaaataggttcattgctccggcccagaatacaattaatccggcgtgggctacgtgagccccaagtagtttaccggacaaattgataagtctggcattcccagcccaccaagcaaaaccggtggtttcttggtcacgac

SEQ ID NO: 4392 - DNA, 1301 bp, Camellia sinensis
gacttatcaatttatccggtaaactactaggagctcatgtagcccatgccggattaatcgtattctgggccggagcaatgaacctatttgaagtggctcattttgtaccagagaagcctatgtatgaacaaggattaattttacttccccacctagctactctaggttggggggtaggtcctggtggggaggttatagacacctttccatactttgtatctggagtacttcacttaatttcctctgcagtattgggctttggcggtatttatcatgcacttctgggacctgagactctggaagaatcttttccattcttcggttatgtatggaaagatagaaataaaatgaccacaattttaggtattcacttaatcttgttagggataggtgcttttcttctagtattcaaggctctttattttgggggcgtatatgatacctgggctcccggagggggagatgtaagaaaaattaccaacttgacccttagcccaagtattatatttggttatttactaaaatctccttttggaggggaaggatggattgttagtgtagacgatttggaagatataatcggaggacatgtatggttaggttccatttgtatacttggtggaatctggcatatcttaaccaaacccttcgcatgggctcgccgcgcgcttgtatggtctggagaggcctacttgtcttatagtttaggtgctttatctgtttgtggtttcattgcttgttgttttgtctggttcaataataccgcttatcctagtgagttttacggacctactggaccagaagcttctcaagctcaagcatttacttttctagttagagaccaacgtcttggggctaacgtgggatccgctcaaggacctaccggtttaggtaaatatctaatgcgttccccgactggagaagtcatttttggaggagaaactatgcgtttttgggatttgcgtgctccatggttagaacctctaaggggtccaaatgggttggacttgagtaggctgaaaaaagatatacaaccttggcaagaacggcgttccgcagaatatatgacccatgctcctttaggttctttaaattccgtggggggcgtagctaccgagatcaatgcagtcaattatgtctctcctagaagttggttatctacctctcattttgttctagcattcttcttattcgtaggtcatttgtggcacgcgggaagggctcgtgcagctgcagcaggatttgaaaaaggaattgatcgtgattttgaacctgttctttccatgaccccttttaattga

SEQ ID NO: 4393 - DNA, 2020 bp, Chenopodium quinoa
tgccacaaatagacctacgaataggaaaaatacctaaaacaaaatagagaagtagctaaccaacttctaggagagacataattgactgcattgatctcggtagcacccacccacagaatttaaagaacctaaaggagcatgggtcatatattctgcggaacggcgttcttgccaaggttgtatgtcttttttcagccgactcaagtccaaaccatttggacctcttaggggttctaaccagggagcgcgcaaatcccaaaaccgcatagtttctcccccaaaaataacttctccagtcggagaacgcattagatacttacctaaaccagtaggtccttgagcggatcccacgttagccccaagacgttggtctctaactaaaaagtaaatgcttgagcttgagaagcttctggtccagtaggtccgtaaaactcactaggataagcagtattattgaaccagacaaagcaacaagcaatgaaaccaaagacagataaagcagccaaactataagacaaataagcctctccagaccagacaagtgcgcggcgagcccatgcaaaaggtttagttaagatatgccagattccaccaagtatacaaatgaaacctatccatacatgccccccgattatatcttccaaatcgtccacactaacaaccacccttctcctccaaaaggcgattttagtaaataaccaaagataatactcggactaagggtgacgttggtaatttttcttacatctccgcctcctggagcccaggtatcatatacgccccaaataaagagccttgaacactagaagaaaggcgcctatacctaacaagattaagtgaatgcccaaaattgtggtcattttatttctatctttccacacataaccgaagaatggaaaagattcttcaagagtttcagggcccagaagtgcatgataaatacccccaaagcccaatacggccgacgaaattaagtgaaggactcctgatacaaagtatggaaaagtgtctataacttccccgccggggcctaccccccaacctagagtagctaggtggggaagtaaaattaatccttgttcatacatcggcttctctggtacgaaatgagccacttcaaacaggttcattgctccggcccagaatacgattaatccggcatgggctacatgagctccaagtagtttaccagataaattgataagtcgagcattcccggcccaccaagcgaaaccggtggtttcttggtcacgtccggctatagttaaagttccattaaagagcgtttccacggggtagaacctcctcagggaatataaggttttcatgaggctgatcttgagccgccatccaagcacgaataccttcgtttaagagaatatttttggtgtagaaagtttcaaattcaggatcttccgctgcacggatttcctgggaaacgaagtcataggcacgtaggttcaaagccagaccgactactccaagagcactcatccataaaccggttactggtacaaataacataaagaaatgtaaccaacgtttattggaaaaagcaaccccaaaaatttgggaccaaaagcggttagcggtgaccattgaataagtttcttcggcttgggttgggttaaaagcccggaatgtatttgccccatcaccgtcttcaaataaagtattttctacggtagcgccatgaatagcgcatagtagagcggcgcccaatacaccggcaactcccatcatatgaaatggattcagtgtccaattatgaaacccttgaaaaaagagaatgaatcgaaatatagctgctacaccaaaactaggtgcaaagaaccaaccagactgacctagtggataaattaggaatacagaaacaaaaacagcaattggaccagagaatgcgattgcattataagggcgcaattgaacggatcgagcaagctcgaattgacgtaacataaaacctattagtgcgaaagcaccatgaagagcaacaaaagtccacaggccgcctaattga

SEQ ID NO: 4394 - DNA, 1448 bp, Arachis hypogaea
attcagaatttcgatataattagattagatagaaatggattaaaacgaagaagtaaaatacttttatttttgattttaatctgacccgctcgactcaaccctatatgtatggtaaaatcaacgtgattcctacttcaagcattagatctcatatctcaattaagaggagtcatggaaagaacaggttcaaaatcgcgatcaattcctttttcaaatcctgcggcagctgcgcgagctcttcccgcgtgccataaatgacctacgaataggaagaatcctagaacaaaatgagaagtagctaaccaacttctaggagagacataattgactgcattgatctcggtagctacgccacccacggaatttaaagaacctaaaggagcatgagtcatatattccgcggaacgacgttcttgccaaggctgtatgtcttttttaagtctactcaagtccaaaccattgggacctcttagaggttctaaccagggagcacgtagatcccaaaaacgcatagtttctcccccaaaaaattacttctccggtcggggaacgcattaaatatttacctaaaccggtaggtccctgagcggatcctacattagccccaagacgttggtctctaactagaaagtaaaatgcttgagcttgagaagcttctggaccagtgggcccgtaaaattcactcggataagcggtattattaaaccagacaaagcaacaagcaataaagccaaaaacagataaagcacctaaactataagacaaataagcttctccggaccatacaagtgcacgccgagcccacgcaaaaggtttggttaaaatatgccaaattccaccaagtatacaaatcgaacccaaccatacatgccccccaattatatcttccaaatcgtccacactaacaatccatccctctcctccaaaaggtgattttagtaaataaccaaatataatacttggactaagggtcaagttggtaatttttcttacatcccccctcccggagcccaggtatcatatatacccccaaaataagagccttgaatactagaagaaaagcacctatgcctaacaagattaagtgaatacctaaaattgtagtcattttatttctatctttccatacataaccgaagaatggaaaagattcttcaagagtctcaggtcccagaagtgcatgataaataccaccaaagcccaatactgcagaggaaattaagtgaagtactccggacacaaagtatggaaaggtgtctataaccccccccccaggacctaccccccaacctagagttgctagatggggaagtaaaattaagccttgctcatacatgggcttctcgggtacgaaatgagccacttcaaataggttcattgctccggcccagaatactattaatccggcatgggctacatgagctcccagtagtttaccggataaattg

SEQ ID NO: 4395 - DNA, 1764 bp, Eutrema halophilum
atggatgaattctcttggattagtcggtctagctttgaacctacatgcctatgacttcgtttcccaggatatccgtgcagcggaagatccagaatttgagactttctatactaaaaatactcttttaaacgaaggtattcatgcttggatggcggctcaagatcagcctgatgaaaaccttctattccctgaggaggttctaccacgtggaaacgctctttagtggaactttagctttagctggtcgtaatcaagaaaccaccggcttcgcttggtgggccgggaatgcccgacttatcaatttatctggtaaactattgggagctcatgtagcccatgccggattataatcgtattctgggccagagcaatgaacttatttgaagtggctcattttgtacatgaaaagccatgtatgaacaaggaataattttacttccccacctagccactttaggctgggggtaggtccagggggagaagttatagacacctttccgtactttgtatctggagtacttcacttaatttcttctgcagttttgggctttggcggtatttatcatgcatttctgggacccgaaactcttgaatagtcttttccattttttagttatgtatggaaagatagaaataaaatgaccaccattttgggtattcacttaattttgttaggtgtaggtgcttttcttctagtattcaaggatctctattttgggggcgcatatgatacctgggctccaggaggggggatgtaagaaatattacaaatttgactcttagcccaagtgttatatttggttatttactaaaatctccctttgggggagaaggatagattgttagtgtggacgatttggaagatataattggagggcatctatgattaggttccatttgtttatttggtggaatctggcatatcttaaccaaaccttttgcctggacttgctgcgcacttgtatggtctggggaggcttacttgtcttatagtttagctgctttatctgtttgtggtttcattgcttgttgttttgtcgtgtttactaatactgcttaccctagtaagttttacggacctacagggccagaagcttctcaagatttacttttctagttagagaccaacgccttggagctaaagtggaatctgctcaaggacgtacatgtttaggtaaatacttaatgcattccccaactggagaagttatttttggaggagaaacaatgcatttttgggatctgcgtgctccctggttagaacctttaaggggtcctaacggtttggacttgagtaggttgaaaaaagatatacaaccttggcaagaacgacattctgccgaatatatgactcatgctcccttaggttccttaaattctgtagggggcgtagctaatgagatcaatgcagtcaattatgtctctccgagaagttggttatcgacctctcattttgttctaggattcttcatatttgtggttcatttatggcatgcgggaagggcttgagcagcggcagcaggatttgaaaaagaattgatcgtgattttgaacccgttctttatatgattcctcttaactaaagtagtagttaaaataggaaagtcaaaatcggttcatattaaaattaaaaagtcttctttgtttctttcatttcaatataatttttttctggctcggctcctccttttttatgatgttaagaagtaacaaaagtcaataaagaaaaaatatatcaatccaacaaaaggaggaaaattaaaa

SEQ ID NO: 4396 - DNA, 2036 bp, Zostera marina
tcctgcatgccataaatgacccacaaataggaagaaccctagaacaaaatgagaagtagctaaccaacttctaggagagacataattgactgcattgatctcagtagctacgccacccacagaatttaaagaacctaaaggagcatgagtcatatattccgccgaacgtcgttcttgccaaggttgtatgtctttttcaacctactcaagtccaaaccattgggacctcttaaaggttccaaccaaggagcacggagatcccaaaaacgcatagtttcccctccaaaaatgacctctccagtgggagaacgcattaaatatttacctaaaccagtagggccttgagcggatcctatgttagccccaagacgttggtctctaactagaaaagtaaatgcttgagcttgagaagcctcaggtccggtgggcccataaaattcactaggataagcagtattgttgaaccagacaaaacaacaagcgatgaaaccaaagacagctaaagcagctaaactataagataagtaagcttctccagaccagacaagggcacggcgagcccatgcaaaagggcttggttaagatatgccaaattccaccaaatatacaaatggaacccaaccatacatggcctccaattatatcttctaaatcgtctacactaacaatccagccctctcccccaaaggggagattttaataaaataaccaaatataacacttggactcagagttaagtttgtaatttttcttacatctcctcccccaggagcccaggtatcatatacaccaccaaaataaagagctttaaatactaaaagaaaagcgcctatacctaacaaaattaagtgaatacctaaaattgtggtcattttatttctatctttccatacatagccaaagaaaggaaaagattcttcaagagtctcaggtccaaagaagtgcatgataaatacccccaaaactaagactgcagaggaaattaagtgaagtaccccagatacaaagtaaggaaaggtgtctaataacttcccactggacctactcccaactagagtagctagatgcggaagtaaatcaaccttgttcatacatgggctctcgggtacaaaatgggccacttcaaagaggttcattgctccggcccaaatacattaatccggcgtgggccacgtgggccccgagtagtttaccggacaaattgataagtctggcattccggccaccaggcgaaacctgtgggtttcttggtcacggccagctaaagctaaagttccattaaagagcgtttccacggggtagaacctcctcagggaatataaggttttcatgaggctgatcttgagccgccatccaagcacgaataccttcgtttaagagaatattttggtatagaaagtttcaaattcaggatcctccgctgcacggatttcctgagaaacgaaatcataggcacgcaggttgagagccagaccgactactccaagagcactcatccataaaccggttactggtacaaataacataaagaaatgtaaccaacgtttattggaaaagcaaccccgaagatttgtgaccaaaagcggttagcagtgaccattgaataagtctcttccgcttgagttggattaaaagcacgaaatgtatttgcaccgtcaccgtcttcaaataaagtattttctacagtagcaccatgaatagcgcacaatagagcagcacctagtactccagcaactcccatcatatgaaatgggttcaatgtccaattatgaaatccttggaagaaaaggatgaatcgaaatatagctgctacaccaaaactaggtgcaaaaaaccaaccggactggcccagtggataaattaagaatacagaaacaaaaacagcaattggaccggaaaatgcaattgcattataaggcctcaattgcacagatcgagcaagttcaaattggcgtaacataaagcctattagtccgaaagcaccatgaagagcaacaaaagtccacaaaccacctaattgacaccaacgagtgaaa

SEQ ID NO: 4397 - DNA, 1447 bp, Tamarix hispida
  misc_feature (68)..(68): n is a, c, g, or t
  misc_feature (1352)..(1353): n is a, c, g, or t
gggggagctcatgtagcccatgccggattaatcgtattctgggccggagcaatgaacctatttgaagnggctcatttcgtaccagagaaacccatgtatgaacaaggattaattttactgccccacctagcgactctagggtggggggtcggccccggtggagaagttatcgacacttttccatactttgtatctggagtacttcacttaatttcctcggcagtattaggctttggcggtatttatcatgcacttctgggacctgagactcttgaagaatcttttccattctttggttatgtatggaaagatcgaaataaaatgaccacaattttgggcattcacttaatcttgttaggtataggtgcttttcttctcgtattcaaggctctttttttcgggggcgtttatgatacctgggctccaggcggcggagatgtaagaaaaataaccaacttgacccttagcccaagtattatatttggttatttactaaaatcgccttttgggggtgaaggatggattgttagtgtggacgatttggaagatataatcggagggcatgtatggttaggttccatttgtatacttggtggaatctggcatatcttaaccaaaccttttgcatgggctcgccgcgcacttgtatggtctggggaagcttacttgtcttatagtttaggtgctttatctgtctttggtttcattgcttgttgctttgtctggttcaataataccgcttatcctagtgagttttatgggcctactggaccagaagcttctcaagctcaagcatttacttttctagttagagaccaacgtcttggagctaacgtaggatccgctcaaggacctactggtttaggtaagtatctaatgcgttccccgactggagaagtcatttttggaggagaaacgatgcgtttttgggatttgcgtgctccttggttagaacctctaagaggtccaaacgggttggacttgagtcggctgaaaaaagacatccaaccttggcaagaacggcgatccgcggaatatatgactcatgctcctttaggttctttaaattctgtgggcggtgtagctaccgaaatcaatgcagtcaactatgtctctcctagaagttggttagctacttctcattttgttctagggttcttcctatttgtaggtcatttatggcatgcaggaagggctcgtgcagctgccgcaggatttgaaaaaggaattgatcgtgattttgaaccagttctttcgatgactcctcttaactaagacaagagatccaatgcttaaagtaggaatcaaattgattctatcatacatattggaatcagatcatcttgaaaaannaaaataaaagtaaagtattgtattcctttttttcaactcatttctatttaatccatttgatttctggcccggctaggtgagatagccgggccat

SEQ ID NO: 4398 - DNA, 1430 bp, Fraxinus spp
ataataaatagagttaaaaaaaaaagaaaaaggtaatactttttaagtataacctgatcccaatatgtatgatagaatcaaagtgattcttacttcaatccaagcattggatctcctgtctcatctcaattaagaggggtcatggaaagaacaggttcaaaatcacgatcaatcctttttcaaatcctgctgcagctgcacgagcccttcccgcgtgccacaaatgacctacgaagaaaaagaatcctagaacaaaatgagaggtagctaaccaacttctaggagagacataattgactgcattaatctcggtagctacgccacccacagaatttaaagaacctaaaggagcatgagtcatatattctgcggaacgccgttcttgccaaggttgtatgtcttttttcaacctactcaagtccaatccatttggacctcttagaggttctaaccagggagcacgcagatcccaaaaacgcatagtttctcctccaaaaatgacttctccggtcggggaacgcattagatatttacctaaacctgtaggtccttgcgcagatcctacattagccccaagacgttggtctctaactagaaaagtaatgcttgagcttgagaagcttctggtccagtaggtccgtaaaactcgctaggataagcggtattattgaaccagacaaaacaacaagcaatgaaaccaaagatggataaagccgctaaactataagataagtaagcctccccagaccatacaagagcgcgtcgagcccatgcgaagggtttggttaagatatgccagattccaccaagtatacaaatggaacctaaccatacatgtcctccgattatatcttctaaatcgtccacactaacaatccaccttccctccaaaggcgattttagtaaataaccaaatataatactagggctaagggtcaagttggtaatttttcttacatctcccctcccggagcccaagtatcatatacgcccccaaaataaagagccttgaatactagaagaaaagcacctagacctaacaagattaagtgaatacctaaaattgtggtcattttatttctatctttccatacataaccgaagaatggaaaagattcctcaagtgtctcaggtcccagaagtgcatgataaataccgccaaagcccaatactgcagaggaaattaaatgaagtactccagatacaaagtatggaaaggtgtctataacttccccccaggacctacccccaacctagagtagctagatggggaagtaaattaagccttgttcatacataggcttctctggtacgaaatgagccacttcaaataggttcattgctccggcccagaatacgattaatccggcatgggctacatgagctcctagtagttaccggataattaataagtcgagcattcccggccg

SEQ ID NO: 4399 - DNA, 1978 bp, Chenopodium quinoa
gagaagtagctaaccaacttctaggagagacataattgactgcattgatctcggtagccaccccacccacagaatttaaagaacctaaaggagcatgggtcatatattctgcggaacggcgttcttgccaaggttgtatgtcttttttcagccgactcaagtccaaaccatttggacctcttaggggttctaaccagggagcgcgcaaatcccaaaaccgcatagtttctcccccaaaaataacttctccagtcggagaacgcattagatacttacctaaaccagtaggtccttgagcggatcccacgttagccccaagacgttggtctctaactaaaaaagtaaatgcttgagcttgagaagcttctggtccagtaggtccgtaaaactcactaggataagcagtattattgaaccagacaaagcaacaagcaatgaaaccaaagacagataaagcagccaaactataagacaaataagcctctccagaccagacaagtgcgcggcgagcccatgcaaaaggtttagttaagatatgccagattccaccaagtatacaaatgaaacctatccatacatgccccccgattatatcttccaaatcgtccacactaacaatccacccttctcctccaaaaggcgattttagtaaataaccaaagataatactcggactaagggtgacgttggtaatttttcttacatctccgcctcctggagcccaggtatcatatacgcccccaaaataaagagccttgaacactagaagaaaggcgcctatacctaacaagattaagtgaatgcccaaaattgtggtcattttatttctatctttccacacataaccgaagaatggaaaagattcttcaagagtttcagggcccagaagtgcatgataaatacccccaaagcccaatacggccgacgaaattaagtgaaggactcctgatacaaagtatggaaaaagtgtctataacttccccgccggggcgtacccccaacctagagtagctaggtggggaagtaaaattaatccttgttcatacatcggcttctctggtacgaaatgagccacttcaaacaggttcattgctccggcccagaatacgattaatccggcatgggctacatgagctccaagtagtttaccagataaattgataagtcgagcattcccggcccaccaagcgaaaccggtggtttcttggtcacgtccggctatagttaaagttccattaaagagcgtttccacggggtagaacctcctcagggaatataaggttttcatgaggctgatcttgagccgccatccaagcacgaataccttcgtttaagagaatatttttggtgtagaaagtttcaaattcaggatcttccgctgcacggatttcctgggaaacgaagtcataggcacgtaggttcaaagccagaccgactactccaagagcactcatccataaaccggttactggtacaaataacataaagaaatgtaaccaacgtttattggaaaaagcaaccccaaaatttgggaccaaaagcggttagcggtgaccattgaataagtttcttcggcttgggttgggttaaaagcccggaatgtatttgccccatcaccgtcttcaaataaagtattttctacggtagcgccatgaatagcgcatagtagagcggcgcccaatacaccggcaactcccatcatatgaaatggattcagtgtccaattatgaaacccttgaaaaaagagaatgaatcgaaatatagctgctacaccaaaactaggtgcaaagaaccaaccagactgacctagtggataaattaggaatacagaaacaaaacagcaattggaccagagaatgcgattgcattataagggcgcaattgaacggatcgagcaagctcgaattgacgtaacataaaacctattagtgcgaaagcaccatgaagagacaaacaaaagtccacaggccgcctaatt

SEQ ID NO: 4400 - DNA, 1609 bp, Amorphophallus konjac
tatatagatcgcatctgagatgtaactataaatggttagtgtatcaacttatatggccatgttctatttgtaggaataaaatagaaattgtcttttggagagatggccgagtggttgatagctccggtcttgaaaaccggcatagttctgaacaaagaactatcgagggttcgaatccctctctctcctttttcttgcttgttgaatctttccttattggacggatatgctgtcataaaaggtaatggctcggccaggtgggataggatagccgagccagaacagaaaaaatagaaaaaaaatggaatagatataaatacaaaaatctcagctaagaggggtcatggaaagaacaggttccaaatcacgatcgattcccttttcaaatcctgctgcagctgcacgggcccttcccgcatgccacaaatgacccacaaaaaagagaatcctagaacaaaatgagaggtagctaaccaacttctaggagatacataattgactgcattgatctcggtagctacgccacccacggaatttaaagaacctagaggagcgtgagtcatatattccgcggaacggcgttcttgccacggttgtatgtctttttcagcctactcaagtccaacccatttggacctcttagaggttccaaccaaggagcacggagatcccaaaaacgcatagtttcccctccaaaaatgatctctccggtcggggaacgcattagatatttacctaaaccagtaggtccttgagcggatcccacattagccccaaggcgttggtctctaactagaaaagtaaagcttgagcttgagaagcttctggtccggttggcccataaaattcactagggtaagcagtattattgaaccagacgaaacaacaagctataaaaccaaagacggataaagcacctaaactataagacaagtaagcctctccagaccagacaaatgcgcggcgagcccatgcaaagggcttggttaagatatgccaaattccaccaagtatacaaatggaacctaaccatacatgtcctccaattatatcttctaaatcgtccacactaacaatccatccttctcccccaaaaggagattttagtaaataaccaaatataacacttgggctaagggtcaagttggtaatttttcttacatctccccctccgggagcccaggtatcatatacaccaccaaaataaagagctttgaatactagaagaaaagcacctatgcctaacaaaattaagtgaatacctaaaattgtggtcattttatttctatctttccatacataaccaaagaatggaaaggattcttcaagagtctcaggcccaagaagcgcatgataaatgccgccaaagcctaagactgcagaggaaattaagtgaagtactccagacacaaagtatggaaaagtgtctataacttcccctcccggacctaccccccaacctagagtagctagatgtggaagtaaaatcaatccttgttcatacatgggcttttccggtacgaagtgagccacctcaaataggttcattgctccggcccagaatacaattaatccggcgtgggctacgtgagccccaagtagtttaccg

SEQ ID NO: 4401 - DNA, 1531 bp, Chenopodium quinoa
cctaaaacaaaatagagaagtagctaaccaacttctaggagagacataattgactgcattgatctcggtagccacccacccacagaatttaaagaacctaaaggagcatgggtcatatattctgcggaacggcgttcttgccaaggttgtatgcttttttcagccgactcaagtccaaaccatttggacctcttaggggttctaaccagggagcgcgcaaatcccaaaaccgcatagtttctcccccaaaaataacttctccagtcggagaacgcattagatacttacctaaaccagtaggtccttgagcggatcccacgttagccccaagacgttggtctctaactaaaaaagtaaatgcttgagcttgagaagcttctggtccagtaggtccgtaaaactcactaggataagcagtattattgaaccagacaaagcaacaagcaatgaaaccaaagacagataaagcagccaaactataagacaaataagcctctccagaccagacaagtgcgcggcgagcccatgcaaaaggtttagttaagatatgccagattccaccaagtatacaaatgaaacctatccatacatcgccccccgattatatcttccaaatcgtccacactaacaatccacccttctcctccaaaaggcgattttagtaaataaccaaagataatactcggactaagggtgacgttggtaattttcttacatctccgcctcctggagcccaggtatcatatacgcccccaaaataaagagccttgaacactagaagaaaggcgcctatacctaacaagattaagtgaatgcccaaaattgtggtcattttattctatctttccacacataaccgaagaatggaaaagattcttcaagagtttcagggcccagaagtgcatgataaatacccccaaagcccaatacggccgacgaaattaagtgaaggactcctgatacaaagtatggaaaagtgtctataacttccccgccgggcctacccccaacctagagtagctaggtggggaagtaaaattaatccttgttcatacatcggcttctctggtacgaaatgagccacttcaaacaggttcattgctccggcccagaatacgattaatccggcatgggctacatgagctccaagtagtttaccagataaattgataagtcgagcattcccggcccaccaagcgaaaccggtggtttcttggtcacgtccggctatagttaaagttccattaaagagcgtttccacggggtagaacctcctcagggaatataaggttttcatgaggctgatcttgagccgccatccaagcacgaataccttcgtttaagagaatatttttggtgtagaaagtttcaaattcaggatcttccgctgcacggatttcctgggaaacgaagtcataggcacgtaggttcaaagccagaccgactactccaagagcactcatccataaaccggttactggtacaaataacataaagaaatgtaaccaacgtttattggaaaaagcaaccc

SEQ ID NO: 4402 - DNA, 3005 bp, Cicer arietinum
gctaaccaacttctaggagagacataattgactgcattaatctctgtagctacgccaccaacggaatttaaagaacctaaaggagcatgagtcatatattccgcggaacgacgttcttgccaaggctgtatgtcttttttcagtctactcaagtccaaaccattaggaccccttaaaggttctaaccagggagcacgcagatcccaaaaacgcatagtttctcccccaaaaataacttccccagtcggggaacgcattagatatttacccaaaccggtaggtccttgagccgatcctacattagctccaagacgttggtctctaactagaaaagtaaatgcttgagcctgagaagcttctggtccagtcggaccataaaactcactaggataagcagtattattaaaccagacaaagcaacaagctataaaaccaaaaacggctaaagcacctaaactataagacaagtaagcttctccagaccatactagtgcacggcgagcccacgcaaagggcttggttaatatatgccagattccaccaagtatacaaatggaacccaaccatacatgccctccaattatgtcttccaaatcatccacactaacaatccatccttcttaccccaaaggagtatttagtaaataaccgaatataatacttggactaagggttaagtttgttaattttcttacatccccccctcctggagcccaggtatcatatatacctccaaataagaagccttaaatactagaagaaaagcccctatacctaacaatattaagtgaatacctaaatagtagtcattttatttctgtctttccatacataaccaaagaatggaaaagattcttcaagagtttcaggtcccagaagtgcatgataaataccgccaaagcccaatactgcggaggaaattaagtgaagtactccagacacaaagtatggaaaggtatctattacttcccctccaggacctacccccaacctagagtagctagatggggagtaaaattaagccttgttcatacatgggcttctcaggtacgaaatgagcgacttcaaataggttcattgctccggcccagaatactattaatccggcatgggctacatgggcccccagtagtttaccagataaattgataagtcgggcattcccggcccaccaagcaaaaccggtagtttcttggtcacgaccagttaaagctaaagttccattaaagagcgtttccacgtggtagaacctcctcagggaatataaggttttcatgaggctgatcttgagccgccatccacgcacgaataccttcgtttaaaagaatatttttggtgtagaaagtctcaaattcaggatcttccgctgcgcggatttcttgagaaacaaagtcataggcacgtaggttcagggccagaccgactactccaagagcactcatccataaaccagttactggtacaaataacataaagaaatgtaaccaacgtttattggaaaaagcaaccccaaaaatttgggaccaaaagcggttagcggtgaccattgaataagtttcttccgcttgcgttgggttaaaagcacggaatgtatttgcgccatcaccatcttcaaataaagtattttctacggtagcaccatgaatagcgcatagtagggcagcacccaatacaccagcaacgcccatcatatgaaatgggttcaatgtccaattatgaaacccttggaaaaagagaatgaatcgaaatatagctgctacaccaaaactaggtgcaaagaaccaaccagactgacccagtggataaataaggaatacagaaacaaaaacagcaattggaccggagaatgcgattgcattataaggccgcaattgaacagatcgagcaagttcaaattgacgtaacataaaacctattaatccgaaagcaccgtggagagcaacaaaagtccacagaccacctaattgacaccaacgggtaaaatctccttgtgcttcaggaccccaaagtaacaacaaagagtgtgctaaactattagcaggagtagagactgcagcagttaagaagttacaaccttccaaataggaacttgccaatccatgagtataccatgaagttacaaaggtggtacctgtgaaccaacccccacggcgaataggcgcaaggaaaagacatagaccagaacaacccacaaaaacgaaacggtaccctccgtaaccagtcatccataatatcaaataaatactttttgtatctttggttaaatttaaccaagagcgatagtcatagtcatcctcctattcaactacttcaaccatttccgaacacctcctagcattttcagggatggaatcttcgagtcttttttctattttacatatgatatgattctcgtagactgccctcttttcttactgggttcgtaatagaaaaatcccttttttgttcgattgatacctaatctatgtaaaatccctgaacttcatttggtattcctttctatctttttcaaattccctaaatcatgaattgggaattgacttctgactcgtaaatcctataaataaattatttaaagaactgttccagaaacaaatgatcgcttttatcactctcgttcccagcggatccccagatatactactctccttttatcaaataatcttatcttattcttgaatgttgttcgtgaaataaaaaaaaggggttttttatattgtgtatgtctaggaaacaactagaggatcatattttttctttctatttgacatttatttcttttattgtcttctttgttctttttttgtttcgttcatattaaaaaaatcccaaagtatacttttttgcagatccaggtaagaaattcgaatatttttttctatttattttttttatctatctgtcaaatttttaaatattgtatcgaattttatttctatcgaatttgaatatcagaatagtagatatagttatgattcaatgggttaggtccacttacttttttt

SEQ ID NO: 4403 - DNA, 1453 bp, Chenopodium quinoa
ggaaaatactaaacaaaatagagaagtagctaccaacttctaggagagacataattgactgcattgatctcggtagcacccacccacagattttaagaacctaaaggagcatgggtcatatattctgcggaacggcgttcttgccaaggttgtatgcttttttcagccgactcaagtccaaaccatttggacctcttaggggttctaaccagggagcgcgcaaatcccaaaaccgcatagtttctcccccaaaaataacttctccagtcggagaacgcattagatacttacctaaaccagtaggtccttgagcggatcccacgttagccccaagacgttggtctctaactaaaaaagtaaatgcttgagcttgagaagcttctggtccagtaggtccgtaaaactcactaggataagcagtattattgaaccagacaaagcaacaagcaatgaaaccaaagacagataaagcagccaaactataagacaaataagcctctccagaccagacaagtgcgcggcgagcccatgcaaaaggtttagttaagatatgccagattccaccaagtatacaaatgaaacctatccatacatgccccccgattatatcttccaaatcgtccacactaacaatccacccttctcctccaaaaggcgattttagtaaataaccaaagataatactcggactaagggtgacgttggtaattttcttacatctccgcctcctggagcccaggtatcatatacgcccccaaaataaagagccttgaacactagaagaaaggcgcctatacctaacaagattaagtgaatgcccaaaattgtggtcattttatttctatcttccacacataaccgaagaatggaaaagattcttcaagagtttcagggcccagaagtgcatgataaatacccccaaagcccaatacggccgacgaaattaagtgaaggactcctgatacaaagtatggaaaagtgtctataacttccccgccggggcctaccccccaacctagagtagctaggtggggaagtaaaattaatccttgttcatacatcggcttctctggtacgaaatgagccacttcaaacaggttcattgctccggcccagaatacgattaatccggcatgggctacatgagctccaagtagtttaccagataaattgataagtcgagcattcccggcccaccaagcgaaaccggtggtttcttggtcacgtccggctatagttaaagttccattaaagagcgtttccacggggtagaacctcctcagggaatataaggttttcatgaggctgatcttgagccgccatccaagcacgaataccttcgtttaagagaatatttttggtgtagaaagtttcaaattcaggatcttccgctgcacggatttcctgggaaacgaagtcataggcacgtaggttcaaagccagaccgactact

SEQ ID NO: 4404 - DNA, 2303 bp, Quercus alba
ttatatttcattttaatgtgtctcacaacctgaaaatgaaagaattagaggggatcatttcatttttggatctaaatagaacaaataggttcaagagatgagagaattaaggatacccaccaaaaagactaatccaatccataatgatgtaccggaaaatacaacatttttgttatttgaccaaccatcaggagaagcaaatacaacaggtacactaatcagtaagattgttgaagtagcaattaatgcaaaaaacagccaattggaaagcaatagtcatctttctaatcctccaatctatcaacaaaagaaactatataccatttgatccctttattggtatcggccaaaaaattgtatcagccaaaaattctaataaaacgtatcatagagggattttaccacgaatctattaatgctgtatgacttattagcaccttttaccaccttattaaatcttattaaattaaggcatgagatcaagggaaaggtatttttttactttcattaaaagaggcccgccagatcattatctatatatatacagatcgatagctagacccataggatcgcaccggatatctttatatatataggtcgtaatggtatcaactcatatatccatgttctattcgttagaaataaaaaaaaaaataataaaaatagaaataatctttcggagaggtggccgagtggttgatagctccggtcttgaaaaccggtatagttcgaaacaaagaactatcgagggttcgaatccctctctctccttttttgctcgtggaatatatatatatattttttattttattggttttgtccggctcagtattagtattctaaaagggaatggctcggctagggggatagccgagccagaacagaaaaaaagggttcaatatataatgagtcgaaaatgaaaataaaggaatacttttttttctaatacgtatgacctaacccaaccaaacaaatatgtatgatgaaatcaaatagattttgacttcaagcattagaattagatctcctgtcttagttaagaggagtcatggaaagaacaggttcaaaatcgcgatcaattcctttttcaaatcctgctgcagctgcacgagcccttcctgcatgccataaatgacctacgaataggaagaatcctagaacaaaatgagaggtagctaaccaacttctaggagagacataattgactgcattgatctcggtagctacaccacccacggaatttaaagaacctaaaggagcatgagtcatatattccgcggaacgtcgttcttgccaaggttgtatgtcttttttcagcctactcaagtccaacccattgggaccccttaggggttctaaccagggagcacgcaaatcccaaaaaacgcatagtttctccccccaaaaaatgacttctccagtcggagaacgcattagatatttacctaaaccggtaggtccttgggcggaccctacgttagccccaaggcgttggtctctaaccagaaaagtaaatgcttgagcttgagaagcttctggtccagtgggcccgtaaaactcactaggataagcggtattattgaaccaaacaaagcaacaagcaataaaaccaaaaacagctaaagcacctaaactataagacaagtaagcctccccagaccatacaagcgcacggcgcgcccatgcaaaaggtttggttaagatatgccagattccaccaagtatacaaatggaacccaaccatacatgccctccaattatatcttccaaatcgtccacactaacaatccatccctctcctccaaaaggggattttagtaaataaccaaatatgacgcttgggctaagggtcaagttggtaatttttcttacatctccccctcccggggcccaggtatcatatacgcctccaaaataaatagctttgaatactagaagaaaagcacctatacctaacaaaattaagtgaatacccaaaattgtagtcattttatttctatctttccatacataaccgaagaatggaaaagactcttcaagagtctcgggtcccagaagtgcgtgataaataccgccaaagcccaatactgcagaggaaattaagtgaagtactccagacacaaagtatggaaaggtatctataacttccccaccaggacctacccccccaacctagagtagctaggtggggaagtaaaattaatccttgttcatacatgggcttttctggtacgaatgagcacttcaataggttcattgctccggcccagaatacgattaatccggcatgggctacatgagct

SEQ ID NO: 4405 - DNA, 2179 bp, Liriodendron tulipifera
tttttgtaggttggtccggtctattgctctttccttgtgcttatttcgctttaggaggttggttcacaggtacaacctttgtaacttcatggtatacccatggattggccagttcctatttggaaggctgcaatttcttaaccgctgcagtttctactcctgctaatagtttagcacattctttgttgctactatggggccctgaagcacaaggagattttactcgttggtgtcaattaggcggtctgtggacttttgttgctctccatggcgctttcggactaataggtttcatgttacgtcaattcgaacttgctcgatctgttcaattgcgaccttataatgcaatcgcattctctgctccaattgctgtttttgtttctgtattcctgatttatcccctaggtcagtctggttggttctttgcgcccagttttggtgtagcagctatatttcgattcatcctcttcttccaaggatttcataattggacgttgaacccatttcatatgatgggagttgccggagtattgggcgctgctctgctatgcgctattcatggtgctaccgtagaaaatactttattcgaagatggtgatggtgcaaatacattccgtgcttttaacccaactcaagctgaagagacttattcgatggtcactgctaaccgcttttggtcccaaatctttggggttgctttttccaataaacgttggttacatttctttatgttatttgtaccagtaaccggtttatggatgagtgctattggagtagtcggtctggctctgaacctacgtgcctatgacttcgtttcccaggaaatccgtgcagcggaagatcctgaatttgagactttctacaccaaaaatattctcttaaacgaaggtattcgtgcttggatggcggctcaggatcagcctcatgaaaaccttatattccctgaggaggttctaccccgtggaaacgctctttaatggaactttatctttagctggtcgtgaccaagaaaccaccgggttcgcttggtgggctgggaatgcccgacttatcaatttgtccggtaaactactcggcgctcacgtagcccatgccggattaatcgtattctgggccggagcaatgaacctatttgaagtggctcatttcgtaccagagaaacccatgtatgaacaaggattaattttacttccccatctagctactctaggttggggggtaggtccgggtggggaagttgtagacacctttccatattttgtatctggagtacttcacttaatttcctctgcagttttaggctttggcggtatttatcatgcacttctcggacctgagactcttgaagaatcctttccattcttcggttatgtatggaaagatagaaataaaatgaccacaattttgggtattcacttaatcttgttaggtataggcgcttttcttctagtactcaaagctctttattttgggggcgtatatgatacctgggctcccggggggggagatgtaagaaaaattaccaacttgacccttagcccaagtgttatatttggttatttactaaaatcgccctttgggggagaaggatggattgttagtgtggacgatttagaagatataattggaggacatgtatggttaggttccatttgtatacttggtggaatctggcatatcttaaccaaaccctttgcgtgggctcgccgcgcatttgtatggtctggagaggcttacttgtcttatagtttaggtgctttatctgtctttggtttcatcgcttgttgttttgtttggttcaataataccgcttatcctagtgagttttacgggcccaccgggccagaagcttctcaagctcaagcatttacttttctagttagagaccaacgtcttggggctaacgtgggatccgctcaaggacctactggtttaggtaaatatctaatgcgttccccgaccggagaggtcattttcggaggagaaactatgcgtttttgggatctccgcgctccctggttggaacctctaaggggtcccaatggtttggatttgagtaggctgaaaaaagacatacaaccttggcaagaacgacgttcggcggaatatatgactcatgctcctttaggttctttaaattccgtgggtggcgtagctaccgagatcaatgcagttaatt

SEQ ID NO: 4406 - DNA, 1261 bp, Chenopodium quinoa
agaagtagctaaccaacttctaggagagacataattgactgcattgatctcggtagccacccacccacagaatttaagaacctaaaggagcatgggtcatatattctgcggaacggcgttcttgccaaggttgtatgtctttttctagccgactcaagtccaaaccatttggacctcttaggggttctaaccagggagcgcgcaaatcccaaaaccgcatagtttctcccccaaaaataacttctccagtcggagaacgcattagatacttacctaaaccagtaggtccttgagcggatcccacgttagccccaagacgttggtctctaactaaaaaagtaaatgcttgagcttgagaagcttctggtccagtaggtccgtaaaactcactaggataagcagtattattgaaccagacaaagcaacaagcaatgaaaccaaagacagataaagcagccaaactataagacaaataagcctctccagaccagacaagtgcgcggcgagcccatgcaaaaggtttagttaagatatgccagattccaccaagtatacaaatgaaacctatccatacatgccccccgattatatcttccaaatcgtccacactaacaatccacccttctcctccaaaaggcgattttagtaaataaccaaagataatactcggactaagggtgacgttggtaattttcttacatctccgcctcctggagcccaggtatcatatacgcccccaaaataaagagccttgaacactagaagaaaggcgcctatacctaacaagattaagtgaatgcccaaaattgtggtcattttatttctatctttccacacataaccgaagaatggaaaagattcttcaagagtttcagggcccagaagtgcatgataaatacccccaaagcccaatacggccgacgaaattaagtgaaggactcctgatacaaagtatggaaaagtgtctataacttccccgccggggcctaccccccaacctagagtagctaggtggggaagtaaaattaatccttgttcatacatcggcttctctggtacgaaatgagccacttcaaacaggttcattgctccggcccagaatacgattaatccggcatgggctacatgagctccaagtagtttaccagataaattgataagtcgagcattcccggcccaccaagcgaaaccggtggtttcttggtcacgtccggctatagttaaagttccattaaagagcgtttccacggggtagaacctc

SEQ ID NO: 4407 - DNA, 2795 bp, Glycine max
cgcttttggtcccaaatctttggggttgctttttccaataaacgttggttacatttctttatgttatttgtaccagtaactggtttatggatgagtgctcttggggtagtcggtttggccctgaacctacgtgcctatgacttcgtttctcaagaaatccgcgcagcggaagatcctgaatttgagactttctacaccaaaaatattctcttaaacgaaggtattcgtgcgtggatggcggctcaagatcagcctcatgaaaaccttatattccctgaggaggttctaccacgtggaaacgctctttaatggaactttagctttaactggtcgtgaccaggaaactaccggtttcgcttggtgggccgggaatgcccgacttatcaatttatccggcaaactactaggagcccatgtagcccatgctggattaatagtattctgggccggagcaatgaacctttttgaagtggctcatttcgtacccgagaagcccatgtatgaacaaggtttaattttacttccccatctagctactctaggttggggggtaggtcctgggggggaagttatagacacctttccatactttgtgtctggagtacttcacttaatttcctctgcagtattgggctttggcggtatttatcatgcacttttgggacctgagactcttgaagaatcttttccattcttcggttatgtatggaaagatagaaataaaatgactacaattttgggtattcacttaatcttgttaggtataggtgcgtttcttctagtattcaaggctctttattttggaggtatatatgatacgtgggctccggggggcggagatgtaagaaaaataaccaatttgacccttagtccaagtattatatttggatatttattaaaatcaccttttgggggagaagggtggattgttagtgtggacgatttggaagatataattggggggcatgtatggttgggttccatttgtatacttggtggaatctggcatatcttaaccaaaccttttgcatgggctcggcgtgcacttgtatggtctggagaagcttacttatcttatagtttaggtgctttatctgtttttggttttattgcttgttgctttgtctggtttaataataccgcttatcctagtgagttttacgggcccactgggccagaagcttctcaagctcaagcatttacttttctagttagagaccaacgtcttggggctaatgtaggatctgctcaaggacctacaggtttaggtaaatatctaatgcgttccccgacaggagaagttatttttgggggagaaactatgcgtttttgggatttgcgtgctccttggttagaacctctaaggggtccgaatggtttagacttgagtagactgaaaaaagatatacagccttggcaagaacgccgttctgcggaatatatgactcatgctcctttaggttccttaaattccgtgggtctgatttcctcatctcaattgaggaatacgtttctcctagaagttggttagctacttctcattttgttctaggattcttcctatttgtaggccatttatggcacgcgggaagagctcgcgcagctgccgcaggatttgaaaaaggaattgatcgagattttgaaccagttctttccatgactcctcttaattgagacatgagatcctatgaagtagaaatcacttttattttactataaatattactataaatattgggttgaattgagcgggtcgtatttaaataagaatttcttttccttttttcttagtttctatcgaaaaaaaaaagattcgatagaaactaagaaaataaacaaattgattcgccgagaaagaggagagagagggattcgaaccctcgatagttctttgttccgaactataccggttttcaagaccggggctatcaaccactcagccatctctccaaaagctaatttatattttatctttattccactgaatagaacatgagcatataaatggataccctttatattatctatctttatattatctataaagggtaaagatatccgatgtgaatctatttgtttagttttctatcggtatgtatataggtgaataatccaacatgcctttttgtgaagtaaaaaaactaccctcgatccatgcctcaaaagggttgataataagtaaaaaaaatcaatgaattcatgataaaacccttctgcgtttttttattataaatttttttgtcaataaagggatcaaggggttgggggatcaaatggtaaagttcttttgttggtaaattggaggattagaaacatgactattgctttccaattagctgtttttgcattaattgctatttcatttattttattgattagtgtacctgttgtatttgcttctcctgaaggttggtcgaataacaaaaatgttgtattttccggtacatcattatggattggattagtgtttctcgtgggtattcttaattctctcatttcttgaagctctatttattctagatcaaaaacgaaatgacccctcccccagaattctttcggattgtcgggcacattaaaaaaggaatggataagttcctaaaaataaagaaaactataacacattataaggaggggtcaaatattaattaagataaaagatatagaatatctatctgtatatatatatatatagatatatttattaataattagaactttctttttcttaaaaaaaaaaaaagtaaataaaagatttgatagaatcgtaatttcaattcgattatatagatacatag

SEQ ID NO: 4408 - DNA, 1333 bp, Chenopodium quinoa
gagagacataattgactgcattgatctcgtagcacccacccacagaatttaagaacctaaaggagcatgggtcatatattctgcggaacggcgttcttgccaaggttgtatgtctttttctagccgactcaagtccaaaccatttggacctcttaggggttctaaccagggagcgcgcaaatcccaaaaccgcatagtttctcccccaaaaataacttctccagtcggagaacgcattagatacttacctaaaccagtaggtccttgagcggatcccacgttagccccaagacgttggtctctaactaaaaaagtaaatgcttgagcttgagaagcttctggtccagtaggtccgtaaaactcactaggataagcagtattattgaaccagacaaagcaacaagcaatgaaaccaaagacagataaagcagccaaactataagacaaataagcctctccagaccagacaagtgcgcggcgagcccatgcaaaaggtttagttaagatatgccagattccaccaagtatacaaatgaaacctatccatacatgccccccgattatatcttccaaatcgtccacactaacaatccacccttctcctccaaaaggcgattttagtaaataaccaaagataatactcggactaagggtgacgttggtaatttttcttacatctccgcctcctggagcccaggtatcatatacgcccccaaaataaagagccttgaacactagaagaaaggcgcctatacctaacaagattaagtgaatgcccaaaattgtggtcattttatttctatctttccacacataaccgaagaatggaaaagattcttcaagagtttcagggcccagaagtgcatgataaatacccccaaagcccaatacggccgacgaaattaagtgaaggactcctgatacaaagtatggaaaagtgtctataacttccccgccggggcctaccccccaacctagagtagctaggtggggaagtaaaattaatccttgttcatacatcggcttctctggtacgaaatgagccacttcaaacaggttcattgctccggcccagaatacgattaatccggcatgggctacatgagctccaagtagtttaccagataaattgataagtcgagcattcccggcccaccaagcgaaaccggtggtttcttggtcacgtccggctatagttaaagttccattaaagagcgtttccacggggtagaacctcctcagggaatataaggttttcatgaggctgatcttgagccgccatccaagcacgaataccttcgtttaagagaatatttttggtgtagtaaagttt

SEQ ID NO: 4409 - DNA, 1358 bp, Zostera marina
gcattgatctcagtagctacgccacccacagaatttaaagaacctaaaggagcatgagtcatatattccgccgaacgtcgttcttgccaaggttgtatgtcttttttcaacctactcaagtccaaaccattgggacctcttaaaggttccaaccaaggagcacggagatcccaaaaacgcatagtttcccctccaaaaatgacctctccagtgggagaacgcattaaatatttacctaaaccagtagggccttgagcggatcctatgttagccccaagacgttggtctctaactagaaaagtaaatgcttgagcttgagaagcctcaggtccggtgggcccataaaattcactaggataagcagtattgttgaaccagacaaaacaacaagcgatgaaaccaaagacagctaaagcagctaaactataagataagtaagcttctccagaccagacaagggcacggcgagcccatgcaaagggcttggttaagatatgccaaattccaccaaatatacaaatggaacccaaccatacatggcctccaattatatcttctaaatcgtctacactaacaatccagccctctcccccaaagggagattttaataaataaccaaatataacacttggactcagagttaagtttgtaatttttcttacatctcctcccccaggagcccaggtatcatatacaccaccaaaataaagagctttaaatactaaaagaaaagcgcctatacctaacaaaattaagtgaatacctaaaattgtggtcattttatttctatctttccatacatagccaaagaaaggaaaagattcttcaagagtctcaggtccaagaagtgcatgataaatacccccaaaacctaagactgcagaggaaattaagtgaagtaccccagatacaaagtaaggaaaggtgtctataacttccccacctggacctactccccaacctagagtagctagatgcggaagtaaaatcaacccttgttcatacatgggcttctcgggtacaaaatgggccacttcaaagaggttcattgctccggcccaaaatacaattaatccggcgtgggccacgtgggccccgagtagtttaccggacaaattgataagtctggcattcccggcccaccaggcgaaacctgtggtttcttggtcacggccagctaaagctaaagttccattaaagagcgtttccacggggtagaacctcctcagggaatataaggttttcatgaggctgatcttgagccgccatccaagcacgaataccttcgtttaagagaatattttggtatagaaagtttcaaattcaggatcctccgctgcacggatttcctgagaaac

SEQ ID NO: 4410 - DNA, 1420 bp, Chenopodium quinoa
taggagagacataattgactgcattgatctcggtagcacccacccacagatttaaagacctaaaggagcatgggtcatatattctgcggaacggcgttcttgccaaggttgtatgcttttttcagccgactcaagtccaaaccatttggacctcttaggggttctaaccagggagcgcgcaaatcccaaaaccgcatagtttctcccccaaaaataacttctccagtcggagaacgcattagatacttacctaaaccagtaggtccttgagcggatcccacgttagccccaagacgttggtctctaactaaaaaagtaaatgcttgagcttgagaagcttctggtccagtaggtccgtaaaactcactaggataagcagtattattgaaccagacaaagcaacaagcaatgaaaccaaagacagataaagcagccaaactataagacaaataagcctctccagaccagacaagtgcgcggcgagcccatgcaaaaggtttagttaagatatgccagattccaccaagtatacaaatgaaacctatccatacatgccccccgattatatcttccaaatcgtccacactaacaatccacccttctcctccaaaaggcgattttagtaaataaccaaagataatactcggactaagggtgacgttggtaatttttcttacatctccgcctcctggagcccaggtatcatatacgcccccaaaataaagagccttgaacactagaagaaaggcgcctatacctaacaagattaagtgaatgcccaaaattgtggtcattttatttctatctttccacacataaccgaagaatggaaaagattcttcaagagtttcagggcccagaagtgcatgataaatacccccaaagcccaatacggccgacgaaattaagtgaaggactcctgatacaaagtatggaaaagtgtctataacttccccgccggggcctacccccaacctagagtagctaggtggggaagtaaaattaatccttgttcatacatcggcttctctggtacgaaatgagccacttcaaacaggttcattgctccggcccagaatacgattaatccggcatgggctacatgagctccaagtagtttaccagataaattgataagtcgagcattcccggcccaccaagcgaaaccggtggtttcttggtcacgtccggctatagttaaagttccattaaagagcgtttccacggggtagaacctcctcagggaatataaggttttcatgaggctgatcttgagccgccatccaagcacgaataccttcgtttaagagaatatttttggtgtagaaagtttcaaattcaggatcttccgctgcacggatttcctgggaaacgaagtcataggcacgtaggttcaaagccagaccgactactccaagag

SEQ ID NO: 4411 - DNA, 2146 bp, Ananas comosus
cttgtgcttatttcgctttaggaggttggtttacaggtacaacttttgtaacttcatggtatacccatggattggccagttcctatttagaaggttgcaatttcttaaccgctgcagtttccactcctgcaaatagtttagcacattctttgttgctactatggggccctgaggcacaaggagattttactcgttggtgtcaattaggcggtctatggacttttgtcgctctccatggtgctttcggactaataggtttcatgttacgtcaattcgaacttgctcgatctgttcaattgcgaccttataatgcaatcgcattctctgctccaatcgctgtttttgtttccgtattcctgatttatccactgggtcaatctggttggttctttgcgcccagttttggcgtagcagctatatttcgattcatcctcttcttccaaggatttcataattggacgttgaacccatttcatatgatgggagttgccggagtattaggtgcagctctgctatgcgctattcatggtgctaccgtggaaaacactttattcgaagatggtgacggtgcaaatacattccgtgcttttaacccaactcaagccgaagagacttattcaatggtcactgctaaccgcttttggtcccaaatctttggggttgctttttccaataaacgttggttacatttctttatgttatttgtaccagtaaccggtttatggatgagtgctattggggtagtcggtctggctctgaacctacgtgcctatgacttcgtttcccaagaaatccgtgcagcggaagatcctgaatttgagactttctacaccaaaaatattcttttaaacgaaggtattcgtgcttggatggcggctcaggatcagcctcatgaaaaccttatattccctgaggaggttctaccacgtggaaacgctctttaatggaactttagctttagctggtcgtgaccaagaaaccaccggtttcgcttggtgggccggtaatgccagacttatcaatttgtccggtaaactacttggagctcacgtagcccatgccggattaatcgtattctgggccggagcaatgaacctttttgaagtggctcatttcgtaccagagcaacccatgtatgaacaagggttgattttacttccgcacctagctaccctaggttggggggtaggtccggggggggaagttatagacacctttccatactttgtatctggagtacttcacttaatttcctctgcagtcttaggctttggcggtatttatcatgcgcttctcggacctgagactcttgaagaatcttttccattcttcggttatgtatggaaagatagaaataaaatgactacaattttgggtattcacttaattttgttaggtataggtgcttttcttctagtactcaaggctctttattttgggggcgtatatgatacctgggccccaggggggggagatgtaagaaaaattaccaacttgacccttagccccagtgttatatttggttatttactaaaatctccttttgggggagaaggatggattgttagtgtggacgctttagaagatataattgggggacatgtatggataggttccatttgtatacttggtggaatttggcatatcttaaccaaacccttcgcatgggctcgacgtgcatttgtatggtctggggaggcttacttgtcttatagtttaggtgctttatctgtctttggtttcatcgcttgttgtttcgtctggttcaataataccgcctatcctagtgagttttacggacccaccgggccagaagcttctcaagctcaagcatttacttttctagttagagaccaacgtcttggagctaatgtgggatccgcccaaggacctactggtttaggtaaatatctaatgcgttccccgactggagaggttatttttggaggagaaactatgcgtttttgggatcttcgtgctccctggttagaacctctaaggggtcccaatggtttggacctgagtaggctgaaaaaagacatacaaccttggcaagaacgacgtccaccacaatatatgactcatgctcctttaggttctttaaattccgtgggtggcgtacctaccgacatcaatgcagtcaatt

SEQ ID NO: 4412 - DNA, 1275 bp, Nuphar advena
atgaaaaccttatattccctgaggaggttctaccccgtggaaacgctctttaatggaactttagctttagctggtcgtgaccaagaaaccaccggtttcgcttggtgggcggggaatgcccgacttatcaatctgtccggtaaattactcggagctcacgtggcccatgccggattaatcgtattctgggctggagcaatgaacctatttgaagtggctcatttcgtaccggagaagcctatgtatgaacaaggattgattttacttccccatctagctactctaggttggggggtgggtcctggcggggaagttgtagacacctttccatactttgtatctggagtacttcacttaatttcctccgcagtcctaggctttggcggtatttatcatgcgcttcttggacccgagactcttgaagaatcctttccattcttcggttatgtatggaaagatagaaataaaatgaccacaattttgggtattcacttaatcttgttaggtctaggcgcttttctcctagtgttcaaggctctttattttgggggcgtatatgatacctgggcccctggcgggggagatgtaagaagaattaccaacttgacccttagcccaagtattatatttggttatttaactaaagtctccctttgggggctaaagtctccctttgggggagaaggatggattgttagtgtggacgatttagaagatataattggaggacatgtatggttaggttccatttgtatacttggtggaatctggcatatcttaaccaaaccctttgcgtgggctcgtcgcgcatttgtatggtctggagaagcttacttgtcttatagtttaggggctttatctgtctttggtttcattgcttgttgtttcgtctggttcaataataccgcttatcctagtgagttttacgggcctactgggccggaagcttctcaagctcaagcatttacttttctagttagagaccaacgtcttggagctaacgtgggatccgctcaaggacctactggtttaggtaaatatctaatgcgttccccgaccggagagattatttttgggggagaaactatgcgtttttgggatctccgtgctccttggttggaacccctaaggggacctaacggtttggacttgagtaggttgaaaaaagacatacaaccttggcaagaacgacgttcggcggaatatatgactcatgctcctttaggttctttaaattccgtgggtggtgtagctacagagatcaatgcagtcaat

SEQ ID NO: 4413 - DNA, 1312 bp, Scabiosa columbaria
gaaagaaggaatcttttttgaagtaggatctgatcccaatatgtatgatggaatcaaattctacttcaggtattggatttcctgtcttaatttagaggggtcatggaaagaacaggttcaaaatcacgatcaattcctttttcaaaccctgctgcagctgcacgggcccttcccgcgtgccacaaatgacctacaaacaagaagaatcctagaacaaaatgagaagtagctaaccaacttctaggagagacataattgactgcattgatctcggtagctacgccacccacagaatttaaagaacctaagggagcatgagtcatatattctgcagaacgccgttcttgccaaggttgtatgtcttttttcagcctactcaagtccaacccatttggaccccttaaaggttctaaccaaggggcgcgcagatcccaaaaacgcatcgtttctcctccaaaaatgacttctccggtcggggaacgcattaaatatttacctaaaccggtaggtccttgagcggatccgacattcgctccaagacgttgatctctaactagaaaagtaaatgcttgagcttgagaagcttctggtccagtgggtccgtaaaactcactaggataagcagtattattgaaccagacaaaacaacaagcaatgaacccaaagagagataaagccgctaaactataagataagtaagcctccccggaccatacaagtgcacgtcgagcccatgcgaagggtttggttaagatatgccagattccaccaagtatacaaatagaacctaaccatacatgtcctccgattatatcttccaaatcatctacactaacaatccatccttcccctccaaagggcgattttagtaaataactgaatataatacttggactaagggtcaagttggtaatttttcttacatctccccctcctggcgcccaggtatcatatacgcccccaaaataaagagccttgaatactaaaagaaaagcacctatacctaacaagattaagtgaatacctaaaattgtggtcattttatttctatctttccatacataaccgaagaatggaaaagattcttcaagcgtctcaggtcctagaagtgcatgataaataccgccaaagcccaatactgcagaggaaattaaatgaagtactccagatacaaaatatggaaaagtgtctataacttccccaccgggacctaccccccaacctagagtagctaggtggggaagtaaaattaatccttgttcatacataggcttctctggtacgaaatgagccacttcaaataggttcatgg

SEQ ID NO: 4414 - DNA, 1870 bp, Chenopodium quinoa
atctcggtagccaccccacccacagaatttaaagaacctaaaggagcatgggtcatatattctgcggaacggcgttcttgccaaggttgtatgtcttttttcagccgactcaagtccaaaccatttggacctcttaggggttctaaccagggagcgcgcaaatcccaaaaccgcatagtttctcccccaaaaataacttctccagtcggagaacgcattagatacttacctaaaccagtaggtccttgagcggatcccacgttagccccaagacgttggtctctaactaaaaaagtaaatagcttgagcttgagaagcttctggtccagtaggtccgtaaaactcactaggataagcagtattattgaaccagacaaagcaacaagcaatgaaaccaaagacagataaagcagccaaactataagacaaataagcctctccagaccagacaagtgcgcggcgagcccatgcaaaaggtttagttaagatatgccagattccaccaagtatacaaatgaaacctatccatacatgccccccgattatatcttccaaatcgtccacactaacaatccacccttctcctccaaaaggcgattttagtaaataaccaaagataatactcggactaagggtgacgttggtaatttttcttacatctccgcctcctggagcccaggtatcatatacgcccccaaaataaagagccttgaacactagaagaaaggcgcctatacctaacaagattaagtgaatgcccaaaattgtggtcattttatttctatctttccacacataaccgaagaatggaaaagattcttcaagagtttcagggcccagaagtgcatgactaaatacccccaaagcccaatacggccgacgaaattaagtgaaggactcctgatacaaagtatggaaaagtgtctataactccccgccggggcctacccccaacctagagtagctaggtggggaagtaaaattaatccttgttcatacatcggcttctctggtacgaaatgagccacttcaaacaggttcattgctccggcccagaatacgattaatccggcatgggctacatgagctccaagtagtttaccagataaattgataagtcgagcattcccggcccaccaagcgaaaccggtggtttcttggtcacgtccggctatagttaaagttccattaaagagcgtttccacggggtagaacctcctcagggaatataaggttttcatgaggctgatcttgagccgccatccaagcacgaataccttcgtttaagagaatatttttggtgtagaaagtttcaaattcaggatcttccgctgcacggatttcctgggaaacgaagtcataggcacgtaggttcaaagccagaccgactactccaagagcactcatccataaaccggttactggtacaaataacataagaaatgtaaccaacgtttattggaaaaagcaaccccaaaattttgggaccaaaagcggttagcggtgaccattgaataagtttcttcggcttgggttgggttaaaagcccggaatgtatttgccccatcaccgtcttcaaataaagtattttctacggtagcgccatgaatagcgcatagtagagcggcgcccaatacaccggcaactcccatcatatgaaatggattcagtgtccaattatgaaacccttgaaaaaagagaatgaatcgaaatatagctgctacaccaaaactaggtgcaaagaaccaaccagactgacctagtggataaattaggaatacagaaacaaaaacagcaattggaccagagaatgcgattgcattataagggcgcaattgaacggatcgagcaagctcgaattgacgtaaca

SEQ ID NO: 4415 - DNA, 1290 bp, Chenopodium quinoa
cctaaacaaaatgagaagtagctaaccaacttctaggagagacataattgactgcattgatctcggtagccacccacccacagaatttaaagaacctaaaggagcatgggtcatatattctgcggaacggcgttcttgccaaggttgtatgtcttttttcagccgactcaagtccaaaccatttggacctcttaggggttctaaccagggagcgcgcaaatcccaaaaccgcatagtttctcccccaaaaataacttctccagtcggagaacgcattagatacttacctaaaccagtaggtccttgagcggatcccacgttagccccaagacgttggtctctaactaaaaaagtaaatgcttgagcttgagaagcttctggtccagtaggtccgtaaaactcactaggataagcagtattattgaaccagacaaagcaacaagcaatgaaaccaaagacagataaagcagccaaactataagacaaataagcctctccagaccagacaagtgcgcggcgagcccatgcaaaaggtttagttaagatatgccagattccaccaagtatacaaatgaaacctatccatacatgcccccgattatatcttccaaatcgtccacactaacaatccacccttctcctccaaaaggcgatttagtaaataaccaaagataatactcggactaagggtagacgttggtaatttttctttactatctccgcctcctcgagcccacggtatcatatacgcccccaaaactaaaagaagaccttgaaacactagaagaaaggacgcctatacctaacaagattaagtgaatgcccaaaattgtggtcattttatttctatctttccacacataaccgaagaatggaaaagattcttcaagagtttcagggcccagaagtgcatgataaatacccccaaagcccaatacggccgacgaaattaagtgaaggactcctgatacaaagtatggaaaagtgtctataacttccccgccggggcctaccccccaacctagagtagctaggtggggaagtaaaattaatccttgttcatacatcggcttctctggtacgaaatgagccacttcaaacaggttcattgctccggcccagaatacgattaatccggcatgggctacatgagctccaagtagtttaccagataaattgataagtcgagcattcccggccaccaagcgaaaccggtggtttcttggtcacgtccggctatagttaaagttccattaaagagcgtttccacggggtagaacctcctcaggg

SEQ ID NO: 4416 - DNA, 2181 bp, Cephalotaxus harringtonia
aattcaccgcattaatctcggtagctacaccacccacagaatttaaagaacccaaaggagcatgagtcatatattccgctgaacgtcgttcttgccagggttgtatgtcctttttcaatttactcaggtccaaaccattaggaccccttagaggttccaaccagggagcacgaagatcccaaaaacgcattgtttctcctccgaagataatttctccagtaggagaacgcataagatatttacctaaaccagtaggcccttgggcagaccccacactagctccaagacgttgatctctaactagaaaagtaaatgcttgagcttgagaggcctctgggccggtaggcccatagaattcactgggataagctgtattgttaaaccaaacaaaacaacaagcaatgaaaccaaagatagagagagccgctaaactataggacaagtaagcttctccagaccatacaaacgcgcgacgagcccatgcaaaaggttttgttaagatgtgccagataccaccgaagatacaaatggaacctaaccatacatgtcctccaattagatcttctagattatccacactaacaatccatccctctcctccaaaaggggacttgagtaaataaccaaatatagtacctggattaagcgtaaggttcgtaatttttcttacatctccaccaccgggagcccaggtatcatatatgccaccaaaataaaaagccttgaacactaggagaaaggcaccagcacctagcaagattaggtgaatacctaaaattgtggtcattttgttcctatctttccatacataaccaaaaaatggaaaagattcttctaaagtttcgggtccgattagtgcgtgataaatacccccgaaacctaaaactgctgaagaaattaggtgaagtaccccagatacaaaatagggaaaagtgtccacaatttcaccaccaggaccgactccccatcctagagtagctagatggggaagtaaaatcaatccttgttcatacataggcttttccggtacaaaatgagccacttcaaatagattcattgctccagcccagaatacaattaatccggcatgagctacgtgagccccaagtaatttgcccgacaaattgataagtcgggcattaccagcccaccaagcgaaaccagtggtttcttggtcacgaccagctaaagctagagttccattaaagagcgtttccacggggtagaacctcctcagggaatataaggttttcatgaggctgatcttgagccgccatccaagcacgaataccttcgttcaagagaatatttttgtgtagaaagtctcaaattcaggatcttctgctgcacgaatctcctgggaaacaaagtcataggcacgtaagtttagagctagaccaactactccaatggcactcatccataaaccggtcaccggcacaaataacataaagaaatgtaaccaacgtttattggaaaaagcaaccccaaaaatttgggaccagaaacggttagcagtgaccatagaataagtctcttcagcttgagtgggttaaaagcacggaacgtatttgcaccatcaccgtcttcaaataatgtattttccacggtagcaccgtggatagcacatagaagagcagcacctaatactccggcaactcccatcatatgaaatggattcaaggtccaattatgaaaaccttgaaaaagaggataaatcggaaaatagctgctacaccaaaactaggtgcaaaaaaccaaccagactggcctaatggatagattaagaatacagaaacaaaaacagcaatcggagcagagaacgcaattgcattataaggtcgcaattgtacagatcgagcaagttcaaattggcgtaacatgaaccctattagaccaaaagcaccatgaagagcaacgaaagtccatagaccacctaattgacaccaacgagtaaaatctccttgtgcttcaggaccccataatagtaacaaagaatgtgctaaactattagcaggcgtagaaactgcagcagttaaaaaattacaaccttccaaataagaactggccaatccatgagtataccatgaagtcacaaaggttgtacccgtgaaccatccacctagggcaaaataagcacaaggaaaaagcaatagaccggaccaacccacaaaaacaaaa

SEQ ID NO: 4417 - DNA, 1233 bp, Cajanus cajan
attggatctcatatcttaattaagaggagtcatggaaagaacaggttcaaaatctcgatcaattcctttttcaaatcctgcagcagctgcacgagctcttcccgcgtgccataaatggccaacaaataggaagaatcctagaacaaaatgagaagtagctaaccaacttctaggagagacataattgactgcattaatctctgtagctacgccacccacggaatttaaggaacctaaaggagcatgagtcatatattccgcggaacgacgttcttgccagggctgtatgtctttttttagtctactcaagtctaaaccattgggaccccttagaggttctaaccaaggagcacgcaaatcccaaaaacgcatagtttctcccccaaaaataacttctccagtgggagaacgcattagatatttacctaaacctgtcggtccttgagccgatcctacgttagccccaagacgttggtctctaactagaaaagtaaatgcttgagcttgagaagcttctggtccagtgggcccgtaaaactcactaggataagcggtattattaaaccaaacaaagcaacaagcaataaaaccaaaaacagataaagcacctaaactataagataagtaagcttctccagaccatacaagtgcacgccgagcccatgcaaagggtttggttaagatatgccagattccaccaaatatacaaatggaacccaaccatacatgccctccaattatatcttccaaatcgtccacactaacaatccatccttctcctccaaaaggggattttaataaatatccaaatataatacttggactaagggtcaaattggttatttttcttacatctccgccccccggagcccatgtatcgtatatacctccaaaataaagagccttgaatactagaagaaaagcacctatacctaacaagattaagtgaatacccaaaattgtagtcattttatttctatctttccatacataaccgaagaatggaaaagattcttcaagagtctcaggtcccagaagtgcatgataaatgccgccaaagcccaatactgcagaagaaattaagtgaagtactccagacacaaagtatggaaaggtgtctataacttcccctccaggacctaccccccaccctagagtagctagatggggaagtaaaattaaaccttgttcatacatgggcttctcgggtacgcaatgacatttcaaaagtta

SEQ ID NO: 4418 - DNA, 2359 bp, Chlamydomonas reinhardtii
aaagaaattgaatttaatctcaaaatacatttttgaaatttttttatattattttttagtatctaaaaaaaagcatttgctattagtaggacagttgtcatgttaatggagcttactttaccttagtatataaggtaatttaaatataaaaagatttaaaattatgtttttaattaacaattaaaaacgattaagttgttttaaatcaactttatttaataaatatgatctaaattatttttaaaattactttccaactgcaatttttagcacaaataaattagatcatatttaaaatacaagttataaaattctattcttaaaaacaacattatttttactctgtgttttaaaaatgttggagataagcttttgtccttaattcttttggattaatatggtacaagaggatttttgttgttaaaggtttcaccatatttattatttatatgggtggacgttaaaaattaaaaatttttatttaagcaaaactttatagaaatcaaaataatttgtacggaggtaatgcaaagtggaaacactttttaatggaacacttacagtaggtggccgtgaccaagaaacaacaggttttgcttggtggtcaggtaacgcacgtcttattaacctttcaggtaaacttttaggtgctcacgtagctcacgcgggtctaattgttttctgggcaggtgctatgaacttattcgaagtatcacacttcgtaccagaaaaaccaatgtatgaacaaggtttaattcttttaccacacatcgcaactttaggttacggtgtaggtccaggtggtgaaattattgatacattcccgtactttgtatcaggtgttttacacttaatttcatcagctgttttaggttttggtggtgtatatcactcattaattggtcctgaaacattagaagaatcatacccattctttggttatgtttggaaagacaaaaacaaaatgactaacattttaggttaccaccttatcatgttaggcttaggtgcatggttacttgtttggaaagctatgtactttggtggtgtttacgatacttgggctccaggtggtggtgacgttcgtgttattactaacccaacaacaaatgctgctgttatttttggttaccttgtaaaatctccatttggtggtgacggttggatttgtagcgttgataatatggaagatattatcggtggtcacatttggatcggtactttagaaatccttggtggtatttggcacatttatacaactccatggccatgggcacgtcgtgctttcgtttggtctggtgaagcttacctatcttacagtcttggtgctattggtgtaatgggcttcattgcttgttgtatgtcttggttcaacaatactgcttacccaagtgaattctacggtccaactggtccagaagcaagtcaatctcaagccttcactttcttagtacgtgaccaacgtttaggtgctaacgtagcttctgcacaaggtcctacaggtttaggtaaatacttaatgcgttctccaacaggtgaaatcattttcggtggtgaaactatgcgtttctgggacttccgtggtccatggttagaacctctacgtggtccaaacggtttagacttaaacaaacttaaaaatgatattcaaccttggcaagaacgtcgtgctgctgaatacatgactcacgctcctctaggttcattaaactctgtaggtggtgttgctactgaaattaacgcagttaacttcgtatctccacgttcatggttagcttgttcacacttctgtttaggtttcttcttcttcatcggtcacttatggcacgcaggtcgtgcacgtgctgctgctgctggtttcgaaaaaggtatcgaccgtttcgacgaaccagttctttcaatgcgtcctttagactaatttttattattattaaaattgggttgttaccatgtaacaacccaattttacaactatcagatttgttatttactaacaaaccattgaaatcgctcatctgacacggaaaatgccaatctttttaataactttatagcattttctatgctagacagaatccaaaaaatatgataaaatttattataatttttaataaaaatggcgggcgtagccaagtggtaaggcagtggattgtgactccactattcgcgggttcgaaccccgtcgttcgcctattaatttatctgctctgaaggagtattgttaacatacagacaacccaaaggttgtctgcgttagtagacaaaaaatcgaaaataagttataattattataaaaatctaagttgtacttagatttctttttcttagtagcagggtagagcagtctggtagctcgtgg

SEQ ID NO: 4419 - DNA, 1906 bp, Chenopodium quinoa
cagaatttaaagaacctaaaggagcatgggtcatatattctgcggaacggcgttcttgccaaggttgtatgtcttttttctagccgactcaagtccaaaccatttggacctcttaggggttctaaccagggagcgcgcaaatcccaaaaccgcatagtttctcccccaaaaataacttctccagtcggagaacgcattagatacttacctaaaccagtaggtccttgagcggatcccacgttagccccaagacgttggtctctaactaaaaaagtaaatgcttgagcttgagaagcttctggtccagtaggtccgtaaaactcactaggataagcagtattattgaaccagacaaagcaacaagcaatgaaaccaaagacagataaagcagccaaaactataagacaaataagcctctccagaccagacaagtgcgcggcgagcccatgcaaaaggtttagttaagatatgccagattccaccaagtatacaaatgaaacctatccatacatgccccccgattatatcttccaaatcgtccacactaacaatccacccttctcctccaaaaggcgattttagtaaataaccaaagataatactcggactaagggtgacgttggtaatttttcttacatctccgcctcctggagcccaggtatcatatacgcccccaaaataaagagccttgaacactagaagaaaggcgcctatacctaacaagattaagtgaatgcccaaaattgtggtcattttatttctatctttccacacataaccgaagaatggaaaagattcttcaagagtttcagggcccagaagtgcatgataaatacccccaaagcccaatacggccgacgaaattaagtgaaggactcctgatacaaagtatggaaaagtgtctataacttccccgccggggcctacccccaacctagagtagctaggtggggaagtaaaattaatccttgttcatacatcggcttctctggtacgaaatgagccacttcaaacaggttcattgctccggcccagaatacgattaatccggcatgggctacatgagctccaagtagtttaccagataaattgataagtcgagcattcccggcccaccaagcgaaaccggtggtttcttggtcacgtccggctatagttaaagttccattaaagagcgtttccacggggtagaacctcctcagggaatataaggttttcatgaggctgatcttgagccgccatccaagcacgaataccttcgtttaagagaatatttttggtgtagaaagtttcaaattcaggatcttccgctgcacggatttcctgggaaacgaagtcataggcacgtaggttcaaagccagaccgactactccaagagcactcatccataaaccggttactggtacaaataacataaagaaatgtaaccaacgtttattggaaaaagcaaccccaaaatttgggaccaaaagcggttagcggtgaccattgaataagtttcttcggcttgggttgggttaaaagcccggaatgtatttgccccatcaccgtcttcaaataaagtattttctacggtagcgccatgaatagcgcatagtagagcggcgcccaatacaccggcaactcccatcatatgaaatggattcagtgtccaattatgaaacccttgaaaaaagagaatgaatcgaaatatagctgctacaccaaaactaggtgcaaagaaccaaccagactgacctagtggataaattaggaatacagaaacaaaaacagcaattggaccagagaatgcgattgcattataagggcgcaattgaacggatcgagcaagctcgaattgacgtaacataaaacctattagtgacgaaagcaccatagaagagacaaacaaaagtccaacaggcc

SEQ ID NO: 4420 - DNA, 1375 bp, Oryza sativa
ttttgcgtattgaatacgtttgtttctttatttgttttttttgttctgtccccttatctttctttcatagaaaggaatgaatggctcggctagatagaataaccgagccagaacagaaaaaaacagtagaacaggtataaataagaaaatcttagttaagaggggtcatgtaaagaacaggctccaaatcacgatcgattcccttttcaaatcctgctgcagcagcccgggctcttcctgcatgccacaaatggcccacaaaaaagaagaatcctagaacaaaatgggaagtcgctaaccaacttctaggagaaacataattaactgcattgatctcggtagctacgccacccacagaatttaaagagcctaaaggagcatgggtcatatattctgccgaacgtcgttcttgccaaggttgtatgtcttttttcaacctactcaagtccaaaccgttggggccccttagaggttctaaccatggagcacgaaggtcccaaaaacgcatagtttcccctccaaaaataacctctcccgttggggaacgcattagatatttacctaaacctgtgggtccttgggcagatcccacattagctccaagacgctgatctctaactagaaaagtaaatgcttgagcttgagaagcttctggcccagtaggtccataaaactcactcggataagctgtattattgaaccagacaaaacaacaagcgataaaaccaaagacagataaagcgcctaaactataagacaagtaagcttctccagaccatacaaatgcacggcgagcccatgcgaagggtttggttaagatatgccaaattccgccaaatacacaaatgaaacccaaccatacatgtcccccaattatatcttctaaatcatccacactaacaatccaaccctctcccccaaaaggggattttagtaaataaccaaatataacaccggggctaagggtcaaattggtaatttttcttacatctcctcccccaggagcccaggtatcatatataccgccaaaataaagagctttgagtactagaagaaaagcacctatacctaacaaaattaggtgaatacccaaaattgtagtcattttatttctatctttccacacataaccaaagaatggaaaagattcttcaagagtctccggtcccagaagcgcgtgataaatgccaccgaagcctaagactgcggaggaaattagatgaagtactccagatacaaagtacggaaaagtatctagaacttctcccccgggccctactccccaacctagagtagctaagtgcggaagtaaaatcaacccttgttcatacatgggtttttctggtacgaaatgggccacttcaaataggttcat

SEQ ID NO: 4421 - DNA, 3074 bp, Abies balsamea
aattcaccgcattgatttcggtagctacaccacccacagaatttgaagaacctaaaggagcatgagtcatatattctgccgaacgtcgttcctgccaaggctgtatgtcctttctcaacttgctcaggtccaaaccattagggccccttaggggttccaaccagggagcacggagatcccaaaaacgcatcgtttcccctccaaagataatttctccagtcggagaacgcataaggtatttacctaaaccagtaggtccttgggcagaccccacactagctccaagacgttggtctctaactagaaaagtaaacgcttgagcttgagaggcttctgggccggtgggcccatagaattcactaggataagctgtgttgttgaaccaaacgaaacaacaagcaataaaaccaaagacagatagagccgctaaactataggacaaataagcttctccggaccatacgaatgcacggcgagcccatgcaaaaggtttggttaagatatgccagataccaccgaagatacaaatggaacctaaccatacatgtcctccaattatatcttctagattgtccacgctaacgatccatccctctcctccgaaaggagatttcagtaaataaccaaatatagcacttgggttaagagtcgggttcgtaatttttcttacatctccaccgccgggagcccaggtatcgtatacacctccgaaatacaaagccttgagcactagaagaaaagcaccagcacctagcaagattaggtgaatacccaaaattgtggtcattttgtttctatctttccatacatagccaaagaatggaaaagattcttctaaagtttcgggtcctataagtgcatgataaataccaccaaaacctaaaaccgcagaagatattaagtgaagtaccccagatacaaaatatggaaaagtgtccacgatttccccaccaggaccgactccccatcctagagtagctagatggggaagtaaaatcaatccttgttcatacataggcttttccggtacgaaatgagccacttcgaataggttcattgctccggcccagaatacaattaatccggcatgagccacgtgagccccaagcaatttaccagacaaattaataagtcgggcattaccggcccaccaagcgaaaccagtggtttcttgatcacgaccagctaaagctatagttccattaaagagcgtttccacggggtaggacctcctcagggaatataaggttttcatgaggctgatcttgagccgccatccaagcacgaataccttcgttcaggagaatattttttgtgtagaaagtctcaaattcaggatcttctgctgcacggatctcctgggaaacaaaatcataggcacgtaagtttagagctagaccaactactccaatggcactcatccataaaccggtcactggcacaaataacatgaagaaatgtaaccaacgtttattggaaaaagcaaccccaaaaatctgggaccagaaacggttagcagtgaccatggaataggtctcttcagcttgagtcgggttaaaagcacggaacgtatttgcaccatcaccatcttcaaataaagtattttccacggtagcaccatgaatagcacatagaagagcagcacccaatactccggcaactcccatcatatgaaatggattcaaggtccaattatgaaaaccttgaaagaaaaggataaatcggaaaatagctgctacaccaaaactaggtgcgaaaaaccaaccggactgacccaatggatagatcaaaaatacagaaacaaagacagcaattggagccgagaatgcaattgcattataaggtcgcaattgtacagatcgagcaagttcaaattgacgtaacatgaaacctattagagcaaaagcaccatgaagagcaacgaaggtccatagaccacctaattgacaccaacgagtaaaatctccttgtgcttcaggaccccataatagcaacagagaatgcgctaaactattagcaggagtagaaactgcggcagttaggaaattacaaccttccagataggaactggccaatccgtgagtataccatgaagtcacaaaggttgtacccgtgaaccatccacctaaggcaaaataggcacaaggaaagagcaatagaccagaccaacccacaaaaacgaaacggtctctgcgtagccagtcatccatagtatcaaataaagttttttcttctttagaagactttccaagggctatagtcatagcgatcctcctatttcactatttcgaccatttccgagcaccctatatgatcaaaaggtatatgatgaattggggacaatttttcatccatcatcctttaaaaacaaaatagggttccgaagattcgttgttggaacaaatattttcaaattgaaccgaaccgatccaatataggtaaatgatagttcgatgctcgagttttcagagttcttatcttatcctcgaatcacttattgaataacataacatcgatggaacaatttacgtggagggaagtgcgctttctccccccccattgaccaaattctattcacaatatctattctattcaatattttgaatccattctcgtcttgaaccttctgcaatgcaacagaatgaaaaggagtatttctattctctctcattcatctctatttatattcttactactatatcgtggttcgatacgaatgagtctacgagcaggaacgagtagatgttttcataactcatagagttagaaagaaaatgactccaaagttattatctttctatagcaagaagttatatatttaaccattgtgatccaaaagtgaaaaccttcttcttttttcccttttttttctcttttcatatctttatttcgatccatttccaccggtataatcaccaaagtaaaatgtctggtacattcatatgagaatgtttagtacatcgtgacagaaaaaatcacgtattcttttttttttttatctaattccgtctagagggataaaataggtttccgtaattcagatcggaatggacttaaagatctatatttctttg

SEQ ID NO: 4422 - DNA, 1509 bp, Sorghum bicolor
aatgaacctatttgaagtggcccatttcgtaccagaaaagcccatgtatgaacaagggttgattttacttccgcacttagctactctaggttggggagtagggccggggggagaagttctagatacttttccttactttgtatccggagtacttcacttaatttcctccgcagtcttaggcttcggtggcatttatcacgcgcttctgggacccgagactcttgaagaatcttttccattctttggttatgtatggaaagatagaaataaaatgactacaattttgggtattcacttaattttgttaggtctaggtgcttttcttctagtactcaaggctctttattttggcggcgtatatgatacctgggcccccggggggggggatgtaagaaaaattaccaatttgacccttagccccggtgttatatttggttatttactaaaatccccttttgggggagaaggatggattgttagtgtggatgatttagaagatataattggggggcatgtatggttgggttccatttgtgtacttggcggaatttggcatatcttaaccaaaccctttgcatgggctcgccgtgcatttgtatggtctggcgaagcttacttgtcttatagtttaggtgctttatctgtttttggttttatcgcttgttgttttgtctggttcaataatacggcttatccaagtgagttttacgggcccactggaccagaagcttctcaagctcaagcatttacttttctagttagagaccagcgtcttggagctaatgtagggtctgcccaaggaccgacgggtttaggtaaatatctaatgcgttccccaacgggagaggttatttttggaggggaaactatgcgtttttgggatcttcgtgctccgtggttagaacctctaaggggccccaacggtttggacttgagtaggttgaaaaaagatatccaaccttggcaagaacgacgttcagcagaatatatgacccatgctcctttaggctctttaaattccgtgggtggcgtagctaccgagatcaatgcagttaattatgtctctcctagaagttggttagcgacctcccattttgttctaggattcttcttttttgtgggccatttgtggcatgcaggaagagcccgagctgctgcagcaggctttgaaaagggaattgatcgtgatttggaacctgttctttacatgacccctcttaactaagattttttatttatacctgttctagtttttttctgttctggctcggttattccatctagccgagccattcatgcttttttatgaaagaatgatataagggggctgaacaaagaaaaacatagatagaaagaaacaaatgtattcaatatacaaaaggagagagagggattcgaaccctcagccgagccattcatgcttttttatgaaagaatgatataagggggctgaacaaagaaaaacatagatagaaagaaacaaatgtattcaatatacaaaaggagaga

SEQ ID NO: 4423 - DNA, 1439 bp, Arabidopsis lyrata
gacggctcaagatcagcctcatgaaaaccttatattccctgaggaggttctaccacgtggaaacgctctttaatggaactttagctttagctggtcgtgaccaagaaaccaccggtttcgcttggtgggccgggaatgcccgacttattaatttatctagtaaactattgggagctcatgtagcccatgccggattaatcgtattctgggccggagcaatgaacttatttgaagtggcccattttgtacccgaaaagcccatgtatgaacaaggattaattttacttccccacctagccactttaggatggggggtaggtcctgggggagaagttatagacacctttccgtactttgtatctagagtacttcacttaatttcttctgcagttttgggctttggcggtatttatcatgcacttcttggacccaaaactcttgaagaatcttttccctttttcggttatgtatggaaagatagaaataaaatgaccaccattttgggtattcacttaattttgttaggtgtaggtgcctttcttctagtattcaaggctctctattttgggggcgtatatgatacatgggctccgggagggggggatgtaagaaaaattacaaacttgactcttagcccaagtgttatatttggttatttactaaaatctccctttgggggagaaggatggattgttagtgtggacgatttggaacatataattggagggcatgtatggttaggttccatttgtatatttggtggaatctggcatatcttaaccaatgagttttacggacctacggggccagaagcttctcaagctcaagcatttacttttctagttagagaccaacgtcttggagctaacgtggggtctgctcaaggacctacatgtttaggtaaatacttaatgcgttctccgactggagaagttatttttggaggcgaaacaatgcgcttttgggatatgttgaaaaaagacatacaaccttggcaagaacgacgttcggcaaaatatatgactcatgctcctttaggttccttaaattctgtggggggcgtagctactgagatcaatgcagtcaattatgtctccccgagaagttggttatctacctctcatttttttctaggacttttcctattcgtgggtcatttatggcacgcgggaagggctcgggcagcggcagcgggatttgaaaaaggaattgatcgtgattttgaacctgttctttccatgactcctcttaactaaagtagtaggtaaaacaagaaagtaaaattcggttcatatttaaaagtcttctttgtttctttcaattcaatctaaatttttctggctcggctatactatccagccgagccattcacctttatttatcatgctaagaagtaaaaaaagccaataaagataaaaatatattcatccaacaaaagg

SEQ ID NO: 4424 - DNA, 1211 bp, Chenopodium quinoa
cacgatcaattcctttttcaaatcctgctgcagctgcacgagcccttcccgcatgccacaaatgacctacgaataggaaaaatcctaaaacaaaatgagaagtagctaaccaacttctaggagagacataattgactgcattgatctcggtagccaccccacccacagaatttaaagaacctaaaggagcatgggtcatatattctgcggaacggcgttcttgccaaggttgtatgtcttttttcagccgactcaagtccaaaccatttggacctcttaggggttctaaccaggggagcgcgcaaatcccaaaaccgcatagttcctaccccaaaaataacttctccagtcggagaacgcattagatacttacctaaaccagtaggtccttgagcggatcccacgttagccccaagacgttggtctctaactaaaaaagtaaatgcttgagcttgagaagcttctggtccagtaggtccgtaaaactcactaggataagcagtattattgaaccagacaaagcaacaagcaatgaaaccaaagacagataaagcagccaaactataagacaaataagcctctccagaccagacaagtgcgcggcgagcccatgcaaaaggtttagttaagatatgccagattccaccaagtatacaaatgaaacctatccatacatgccccccgattatatcttccaaatcgtccacactaacaatccacccttctcctccaaaaggcgattttagtaaataaccaaagataatactcggactaagggtgacgttggtaattttcttacatctccgcctcctggagcccaggtatcatatacgccccaaaataaagagccttgaacactagaagaaaggcgcctatacctaacaagattaagtgaatgcccaaaattgtggtcattttattctatctttccacacataaccgaagaatggaaaagattcttcaagagtttcagggcccagaagtgcatgataaatacccccaaagcccaatacggccgacgaaattaagtgaaggactcctgatacaaagtatggaaaagtgtctataacttccccgccggggcctacccccaacctagagtagctaggtggggaagtaaaattaatccttgttcatacatcggcttctctggtacgaaatgagccacttcaaacaggttcattgctccggcccagaatacgattaatccg

SEQ ID NO: 4425 - DNA, 1273 bp, Chenopodium quinoa
gcacccacccaccacgaattaaagaacctaaaggaagcatgggtcatatattctgcggaacggcgttcttgtccaaggttgtatgtctttttctagccgactcaagtccaaaccatttggacctcttaggggttctaaccagggagcgcgcaaatcccaaaaccgcatagtttctcccccaaaaataacttctccagtcggagaacgcattagatacttacctaaaccagtaggtccttgagcggatcccacgttagccccaagacgttggtctctaactaaaaaagtaaatgcttgagcttgagaagcttctggtccagtaggtccgtaaaactcactaggataagcagtattattgaaccagacaaagcaacaagcaatgaaaccaaagacagataaagcagccaaactataagacaaataagcctctccagaccagacaagtgcgcggcgagcccatgcaaaaggtttagttaagatatgccagattccaccaagtatacaaatgaaacctatccatacatggcccccgattatatcttccaaatcgtccacactaacaatccacccttctcctcccaaaggcgattttagtaaataaccaaagataatactcggactaagggtgacgttggtaattttcttacatctccgcctcctggagcccaggtatcatatagcccccaaaataaagagccttgaacactagaagaaaggcgcctatacctaacaagattaagtgaatgcccaaaattgtggtcattttatttctatctttccacacataaccgaagaatggaaaagattcttcaagagtttcagggcccagaagtgcatgataaatacccccaaagcccaatacggccgacgaaattaagtgaaggactcctgatacaaagtatggaaaagtgtctataacttccccgccggggcctacccccaacctagagtagctaggtggggaagtaaaattaatccttgttcatacatcggcttctctggtacgaaatgagccacttcaaacaggttcattgctccggcccagaatacgattaatccggcatgggctacatgagctccaagtagtttaccagataaattgataagtcgagcattcccggcccaccaagcgaaaccggtggtttcttggtcacgtccggctatagttaaagttccattaaagagcgtttccacggggtagaacctcctcagggaatataaggttttcatgaggctgatcttgagccgccatccaagcacgaataccttcgtt

SEQ ID NO: 4426 - DNA, 1388 bp, Chenopodium quinoa
attaaagaacctaaaggagcatgggtcatatattctgcggaacggcgttcttgccaaggttgtatgtcttttttctagccgactcaagtccaaaccatttggacctcttaggggttctaaccaggggagcgcgcaaatcccaaaaccgcatagtttctcccccaaaaataacttctccagtcggagaacgcattagatacttacctaaaccagtaggtccttgagcggatcccacgttagccccaagacgttggtctctaactaaaaaagtaaatgcttgagcttgagaagcttctggtccagtaggtccgtaaaactcactaggataagcagtattattgaaccagacaaagcaacaagcaatgaaaccaaagacagataaagcagccaaactataagacaaataagcctctccagaccagacaagtgcgcggcgagcccatgcaaaaggtttagttaagatatgccagattccaccaagtatacaaatgaaacctatccatacatgccccccgattatatcttccaaatcgtccacactaacaatccacccttctcctccaaaaggcgattttagtaaataaccaaagataatactcggactaagggtgacgttggtaatttttcttacatctccgcctcctggagcccaggtatcatatacgcccccaaaataaagagccttgaacactagaagaaaggcgcctatacctaacaagattaagtgaatgcccaaaattgtggtcattttatttctatctttccacacataaccgaagaatggaaaagattcttcaagagtttcagggcccagaagtgcatgataaatacccccaaagcccaatacggccgacgaaattaagtgaaggactcctgatacaaagtatggaaaagtgtctataacttccccgccggggcctaccccccaacctagagtagctaggtggggaagtaaaattaatccttgttcatacatcggcttctctggtacgaaatgagccacttcaaacaggttcattgctccggcccagaatacgattaatccggcatgggctacatgagctccaagtagtttaccagataaattgataagtcgagcattcccggcccaccaagcgaaaccggtggtttcttggtcacgtccggctatagttaaagttccattaaagagcgtttccacggggtagaacctcctcagggaatataagttttcatgaggctgatcttgagccgccatccaagcacgaataccttcgtttaagagaatatttttggtgtagaaagtttcaaattcaggatcttccgctgcacggatttcctgggaaacgaagtcataggcacgtaggttcaaagccagaccgactactccaagagcactcatccataaa

SEQ ID NO: 4427 - DNA, 3845 bp, Lupinus angustifolius
  misc_feature (308)..(464): n is a, c, g, or t
  misc_feature (2889)..(2967): n is a, c, g, or t
  misc_feature (3273)..(3543): n is a, c, g, or t
atgccctacgaataagaagaatcctagaacaaaatgagaagtagctaaccaacttctaggagagacataattgactgcatttatctcggtagctacgccacccactgaatttaaagaacctaaaggagcatgagtcatatattccgcggaacgccgttcttgccaaggctgtatgtcttttttcagtctactcaagtccaaaccattgggaccccttaaaggttctaaccagggagcacgcagatcccaaaaacgcatagtttctcccccaaaaataacttctccggtcggagaacgcattagatacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaatgcttgagcttgagaagcttctggtccagtgggcccataaaactcactaggataagcggtattattaaaccagacaaagcaacaagcaataaaaccaaaaacagatagagcagctaaactataagataagtaagcttctccagaccatacaagtgcacgccgagcccatgcaaaaggtttggttaagatatgccagattccaccaaatatacaaatggaaccgagccatacatgccctccaattatatcttccaaatcgtccacactaacaatccacccttctcctccaaaaggtgattttagtaaataaccaaatataatacttggactaagggtcaaattggtaatttttcttacatctcccccccctggagcccaggtatcatatatacccccaaaataaagagccttgaatactagaagaaaagcgcctatacctaacaagattaagtgaatacccaaaattgtagtcattttatttctatctttccatacataaccaaagaatggaaaagattcttcaagagtctcaggtcccagaagtgcatgataaataccgccaaatcccaatactgcagaggaaattaagtgaagtacgccagacacgaagtatggaaaggtgtctataacttctcccccaggacctaccccccaacctagagtagctagatggggaagtaaaatcaaaccctgttcatacatgggcttttcgggtacgaaatgagccacttcaaataggttcattgctccggcccagaatactattaatccggcatgggccacatgagcccccaacagtttaccagataaattgataagtcgggcattcccggcccaccaagcgaaaccggtagtttcttggtcacgaccagttaaagctaaagttccattaaagagcgtttccacgtggtagaacctcctcagggaatataaggttttcatgaggctgatcttgagccgccatccacgcacgaataccttcgtttaagagaatatttttggtgtagaaagtctcaaaataattcaggatcttccgctgcgcggatttcttgagaaacgaagtcataggcacgtaggttcagggctagaccgactactccaagagcactcatccataaaccggttactggtacaaataacataaagaaatgtaaccaacgtttattggaaaaagcaaccccaaagatttgggaccaaaagcggttagcggtgaccattgaataagtttcttcagcttgggttgggttaaaagcacggaatgtatttgcgccatcaccatcttcaaataaagtattttccacggtagcaccatgaatagcgcatagtagggcagcgcccaatacaccagcaactcccatcatatgaaatgggttcaatgtccaattatgaaacccttggaaaaagaggatgaatcgaaatatagctgctacgccaaaactaggcgcaaagaaccaacctgattgacccagtggataaatcaggaatacggaaacaaaaacagcaattggaccagagaatgcaattgcattataaggccgcaattgaacagatcgagcatatagcggctaccctcttttattgtcttctttgttcgattttattttcatttctttaagattactaaaaaaaaactatacttggtagtttttttttcagatcaaggtaagaaatcttaggtcaatattttttctatttttttatctatctgtcaaattaatattatattgaatttattttaagaataataaactgtaagtcaaaaagtctcgttctcgcagccattaattgccccagaatctcgtatgcatcgatatgaaaagaaaatatttgatatgtatgatacgcgaaaccatgatttaatatatttattttttctatagatatatcatatcttatagaaataataaaatttaaattgatctttttttttcttgtgttcggaaataaacgctatttaaaataaaatgacttgtgtatgttggaacttggaataagcctttctgtgtggaggagggtaataacaatttattctgctagaacctttaggacaagacacgatttaatcggaaatagcgactgattacggagtccaaaccaaagaagtattaaaaaaaatccaatgttcgaatctcatcgctatcgaatttgaatatcagaatagtcgatatagttatcattcaatgggttaggtccacttacttttttgaatctttcccattttttttgttggaataatcgacaataggaatatttaacaattaaaggagatatcataaaaaaaataataatataaatataaaaacgttccaccttctaactaaaattactttactatattcgaactcattagaatgataacttatttgaattcgaattcataattctattttgcaaatgaaattatatgattccttagtaaannnnnnnnnnnnnnnnnnnnnnnnnnnnnnnnnnnnnnnnnnnnnnnnnnnnnnnnnnnnnnnnnnnnnnnnnnnnnnncccttatcagatttgaaccgatgacttacgccttaccatggtgttatcaacgcagagttaaaggggccccgttcgattaaattccggaataaggaactagacaatatgagtctagtacatatatttgttactgcatatacttcttatatagataagattcaaatatatgtacatagatttatccgcatagcgacttattaatgaacaagaaattggatttaccgtgtaaatagagtatacttaagaaaatggtttattgatatttgatttgataaatatcaatgtaattaattttttcaaaaccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcatttgattaatacatactacatatacccaccaattcaaatatttgatcgaaatggattcaatttgtcctgcccctcaaccaaattattattcaaaaaaaaaaatcaataacttgttgatccccatccttcttaccccaattcccagattgattatcgttttttatttcgtgctttagtttagtgttaaatagaaatatatcgaccgaatttttacaatgaataaaaaaattctatggaattatgaaagatgaaaagatccttctgatcgaatcctatcatttcattatattgacaatt

SEQ ID NO: 4428 - DNA, 1192 bp, Chenopodium quinoa
ctaggagagacataattgactgcattgatctcggtagcacccacccacagaattaaagaacctaaaggagcatgggtcatatattctgcggaacggcgttcttgccaaggttgtatgtcttttttcagccgactcaagtccaaaccatttggacctcttaggggttctaaccagggagcgcgcaaatcccaaaaccgcatagtttctcccccaaaaataacttctccagtcggagaacgcattagatacttacctaaaccagtaggtccttgagcggatcccacgttagccccaagacgttggtctctaactaaaaaagtaaatgcttgagcttgagaagcttctggtccagtaggtccgtaaaactcactaggataagcagtattattgaaccagacaaagcaacaagcaatgaaaccaaagacagataaagcagccaaactataagacaaataagcctctccagaccagacaagtgcgcggcgagcccatgcaaaaggtttagttaagatatgccagattccaccaagtatacaaatgaaacctatccatacatcgccccccgattatatcttccaaatcgtccacactaacaatccacccttctcctccaaaaggcgatttagtaaataaccaaagataatactcggactaagggtgacgttggtaatttttcttacatctccgcctcctggagcccaggtatcatatacgcccccaaaataaagagccttgaacactagaagaaaggcgcctatacctaacaagattaagtgaatgcccaaaattgtggtcattttatttctatctttccacacataaccgaagaatggaaaagattcttcaagagtttcagggcccagaagtgcatgataaatacccccaaagcccaatacggccgacgaaattaagtgaaggactcctgatacaaagtatggaaaagtgtctataacttccccgccggggcctaccccccaacctagagtagctaggtggggaagtaaaattaatccttgttcatacatcggcttctctggtacgaaatgagccacttcaaacaggttcattgctccggcccagaatacgattaatccggcatgggctacatgagctccaagtagtttaccagataaattgataagtcgagcattcccggcccacaagcgaaaccggtgttcttggtcacgtccgg

SEQ ID NO: 4429 - DNA, 2317 bp, Chenopodium quinoa
ctcggtagcacccacccacagaatttaagaacctaaaggagcatgggtcatatattctgcggaacggcgttcttgccaaggttgtatgtcttttttcagccgactcaagtccaaaccatttggacctcttaggggttctaaccagggagcgcgcaaatcccaaaaccgcatagtttctcccccaaaaataacttctccagtcggagaacgcattagatacttacctaaaccagtaggtccttgagcggatcccacgttagccccaagacgttggtctctaactaaaaaagtaaatgcttgagcttgagaagcttctggtccagtaggtccgtaaaactcactaggataagcagtattattgaaccagacaaagcaacaagcaatgaaaccaaagacagataaagcagccaaactataagacaaataagcctctccagaccagacaagtgcgcggcgagcccatgcaaaaggtttagttaagatatgccagattccaccaagtatacaaatgaaacctatccatacatgccccccgattatatcttccaaatcgtccacactaacaatccacccttctcctccaaaaggcgattttagtaaataaccaaagataatactcggactaagggtgacgttggtaatttttcttacatctccgcctcctggagcccaggtatcatatacgcccccaaaataaagagccttgaacactagaagaaaggcgcctatacctaacaagattaagtgaatgcccaaaattgtggtcattttatttctatctttccacacataaccgaagaatggaaaagattcttcaagagtttcagggcccagaagtgcatgataaatacccccaaagcccaatacggccgacgaaattaagtgaaggactcctgatacaaagtatggaaaagtgtctataacttccccgccggggcctaccccccaacctagagtagctaggtgggaagtaaaattaatccttgttcatacatcggcttctctggtacgaaatgagccacttcaaacaggttcattgctccggcccagaatacgattaatccggcatgggctacatgagctccaagtagttaccagataaattgataagtgagggtcacgtccggctatagttaaagttccattaaagagcgtttccacggggtagaacctcctcagggaatataaggttttcatgaggctgatcttgagccgccatccaagcacgaataccttcgtttaagagaatatttttggtgtagaaagtttcaaattcaggatcttccgctgcacggatttcctgggaaacgaagtcataggcacgtaggttcaaagccagaccgactactccaagagcactcatccataaaccggttactggtacaaataacataaagaaatgtaaccaacgtttattggaaaaagcaaccccaaaaatttgggaccaaaagcggttagcggtgaccattgaataagtttcttcggcttgggttgggttaaaagcccggaatgtatttgccccatcaccgtcttcaaataaagtattttctacggtagcgccatgaatagcgcatagtagagcggcgcccaatacaccggcaactcccatcatatgaaatggattcagtgtccaattatgaaacccttgaaaaaagagaatgaatcgaaatatagctgctacaccaaaactaggtgcaaagaaccaaccagactgacctagtggataaattaggaatacagaaacaaaaacagcaattggaccagagaatgcgattgcattataagggcgcaattgaacggatcgagcaagctcgaattgacgtaacataaaacctattagtgcgaaagcaccatgaagagcaacaaaagtccacaggccgcctaattgacaccaacgagtaaagtctccttgtgcttcaggaccccacagtaacaataaagagtgggctaaactattagcaggagtagaaactgccgcggttaagaaattgcaaccttccaaataagaactggccaatccatgggtataccatgaagttacaaaggttgtacctgtaaaccaacctcctaaggcgaaataagcacaaggaaagagcaatagcccagaccaacctacaaaaacgaaacggtcctaccgtaaccagtcatccatactatcaaataaatctttttcgtctttagtaaatttaccaacggctatagtcatagtgatcctcctattcaactacttcaaccatttccgagcaccccatagcattttttggaatccgagaattcgatcatttaatttatggatgatttgatttctcgtataata

SEQ ID NO: 4430 - DNA, 1389 bp, Chenopodium quinoa
tgggtcatatattctgcggaacggcgttcttgccaaggttgtatgtctttttctagccgactcaagtccaaaccaatttggacctcttaggggttcgtaaccagggagcgcgcaaatcccaaaaccgacatagtttctcccccaaaattaactactccagtcggagaacgcattagatacttacctaaaccagtaggtcccttgagcggatcccacgttagccccaagacgttggtctctaactaaaaagtaaaatagcttgagcttgagaagcttctggtccagtaggtccgtaaaactcactaggataagcagtattattgaaccagacaaagcaacaagcaatgaaaccaaagacagataaagcagccaaactataagacaaataagcctctccagaccagacaagtgcgcggcgagcccatgcaaaaggtttagttaagatatgccagattccaccaagtatacaaatgaaacctatccatacatgccccccgattatatcttccaaatcgtccacactaacaatccacccttctcctccaaaaggcgattttagtaaataaccaaagataatactcggactaagggtgacgttggtaatttttcttacatctccgcctcctggagcccaggtatcatatacgcccccaaaataaagagccttgaacactagaagaaaggcgcctatacctaacaagattaagtgaatgcccaaaattgtggtcattttatttctatctttccacacataaccgaagaatggaaaagattcttcaagagttcagggcccagaagtgcatgataaatacccccaaagcccaatacggccgacgaaattaagtgaaggactcctgatacaaagtatggaaaagtgtctataacttccccgccggggcctaccccccaacctagagtagctaggtggggaagtaaaattaatccttgttcatacatcggcttctctggtacgaaatgagccacttcaaacaggttcattgctccggcccagaatacgattaatccggcatgggctacatgagctccaagtagtttaccagataaattgataagtcgagcattcccggcccaccaagcgaaaccggtggtttcttggtcacgtccggctatagttaaagttccattaaagagcgtttccacggggtagaacctcctcagggaatataaggttttcatgaggctgatcttgagccgccatccaagcacgaataccttcgtttaagagaatatttttggtgtagaaagtttcaaattcaggatcttccgctgcacggatttcctgggaaacgaagtcataggcacgtaggttcaaagccagaccgactactccaagagcactcatccaataaaccggttactaggtacaaa

SEQ ID NO: 4431 - DNA, 1543 bp, Chenopodium quinoa
tattctgcggaacggcgttcttgccaaggttgtatgtctttttcagccgactcaagtccaaaccatttggacctcttaggggttctaaccagggagcgcgcaaatcccaaaaccgcatagtttctcccccaaaaataacttctccagtcggagaacgcattagatacttacctaaaccagtaggtccttgagcggatcccacgttagccccaagacgttggtctctaactaaaaaagtaaatgcttgagcttgagaagcttctggtccagtaggtccgtaaaactcactaggataagcagtattattgaaccagacaaagcaacaagcaatgaaaccaaagacagataaagcagccaaactataagacaaataagcctctccagaccagacaagtgcgcggcgagcccatgcaaaaggtttagttaagatatgccagattccaccaagtatacaaatgaaacctatccatacatgccccccgattatatcttccaaatcgtccacactaacaatccacccttctcctccaaaaggcgattttagtaaataaccaaagataatactcggactaagggtgacgttggtaatttttctttcatctccgcctcctggagcccaggtatcatatagcccccaaaataaagagccttgaacactagaagaaaggcgcctatacctaacaagattaagtgaatgcccaaaattgtggtcattttatttctatctttccacacataaccgaagaatggaaaagattcttcaagagtttcagggcccagaagtgcatgataaatacccccaaagcccaatacggccgacgaaattaagtgaaggactcctgatacaaagtatggaaaagtgtctataacttccccgccggggcctaccccccaacctagagtagctaggtggggaagtaaaattaatccttgttcatacatcggcttctctggtacgaaatgagccacttcaaacaggttcattgctccggcccagaatacgattaatccggcatgggctacatgagctccaagtagtttaccagataaattgataagtcgagcattcccggcccaccaagcgaaacccgtggtttcttggtcacgtccggctatagttaaagttccattaaagagcgtttccacggggtagaacctcctcagggaatataaggttttcatgaggctgatcttgagccgccatccaagcacgaataccttcgtttaagagaatatttttggtgtagaaagtttcaaattcaggatcttccgctgcacggatttcctgggaaacgaagtcataggcacgtaggttcaaagccagaccgactactccaagagcactcatccataaaccggttactggtacaaataacataaagaaatgtaaccaacgtttattggaaaaagcaaccccaaaatttgggaccaaaagcggttagcggtgaccattgaataagtttcttcggcttgggttgggttaaaagcccggaatgtatttgccccatcaccgtcttcaaataaagtattttctacggtagcg

SEQ ID NO: 4432 - DNA, 929 bp, Vigna unguiculata
gctcttctaatggctttgtgccgattcgcttattgttcccctgcttcatctgcttccaccattattcgtttcccgaaatcaaaacacgttaaattctctttgctgtcattctcattcgcaacgatggaagctcctccagaaggttatcgaaggaacgttggtatctgtctcatgaacgctcacaaaaagattttcgcggcttcgaggctcgacattcccaatgcttggcaaatgccgcagggtggcattgatgaaggtgaggatccgagaaatgcagctatcagggaattaagagaagagacgggagttaattcggcagaagtgatcgctgaggtaccatattggttaacttatgatttcccaccgaaagtgagggagaaattaaatattcagtggggatctgattggaagggtcaggcacagaaatggtttcttttaaggttcactgggcaagatcaagaaatcaatcttctgggtgatggcaccgagaaagctgaatttggggaatggtcatggatatcacccgaacaagtaattgatcttgcggtagatttcaaaaagcctgtctacaaggaagtcctagcagagtttgctccatatttccaatagtcctatctctgtctgaaattgttacggctttccaatggcagtgcttttggcgattctgaggctgtttttaagaagaatgtattccaaataactacctagacaggcgaagagagctatttattgtatgtccgagtgaaatatatgtattatggttaaaattggcatatcaggaattgcatctttccacttccttttcttcatgatgaaacatggcacgtattttaccctatgaaatgagttttgtgagtactaacatacaaatgctgtccttttgtgaacgcagtaataagatttttgtccaaaagaaaaaaaaaaaaaaa

SEQ ID NO: 4433 - DNA, 2136 bp, Glycine max
gaaaaataggagtgacaataacaagcccccttgatgggccattataaagccttctattttgcactttgcctctctcttcctttcccttgatgtaataatggctttataccgattcgcttacttttcttctcctccttcctccatttttcgtttcccgaaatacccttcgaaacacgttaaattctctttgctgccactctcattcgcaacgatggaagctcctccagaaggttatcgcaggaacgttggtatctgtctcatgagcaatcacaaaaagattttcgcggcttcgaggctcgacattcccaattcttggcaaatgcctcagggtggtattgatgaaggtgaggatccaagaaatgcagccatcagggaattaagagaagagacaggagttaattctgcagaagtgattgctgaggtaccatattggttaacttatgacttcccaccaaaagtaagggagaaattaaatattcagtggggatctgattggaagggtcaggcacagaaatggtttctttttaagttcactggacaagatcaagaaattaatcttttgggtgatggtactgagaaagctgagtttggggaatggtcatggatatcacctgaacaagtaattgagcttgcagtggatttcaagaaacctgtctacaaggaagtcttagcagtgtttgctccatatttccaataatcttatctttggctgaaattgttatggcttcccaatgactggtaccttgggtgattcttagggctgctttaaaaaagaatatattccaaataactaccgagacaattattttctttttctcctctgggcaataaccatagggcaggcgaagagggctatttattgtatgtctgaatgaaatatgtattgtcatgaactccataacacctgtattgcatctgtccactttttttttttttttgtcatgatgaaatatggcaggcacgtattgttacataccaaatggtgtatgagaatgaattttgtgattactaacctacaaattgtatgtcttttggggaacacagtatcaggatttgagttaaaaaatcaagttaagaaagagtaaaaactctgtcacacaatacacactaatgtaagattgaactttaaatgtaaactataagaaagagtattttcttttttttgacagaattgaacgctttggttgaaaatatgtaatttgttgttttaagtgtgtgtctttctttgacataaacaaacacatttttgtgtgtgtgttttaagtggggtggtgagttagctgattttgacaactctaaggctgctatagacacgtgccggtgcagaagtaaacagccagcattcagatcagtgcatagcaggtcgaagcagctttcagacctggaaacgaagctggttcggaggagcggtctgttgtggctagggagctcataaagaacggtttgtgcaaggcgaggtgtcaatggaagacctacattagaatgaggatatgcaaatacatgcccttattatgagaaaattacatataaatatcttacatttttatacttagcctcctttattttatatatttgaattcattgtccttattttctcactcatcttattattttttattcaagtatttgatttgaaattttaatatttttttaatagattatctccatagacttagcgccctagttctatcattggctagtgctgatcagaagcgtgtttgctgttggtggtgcgtcgagccgcaatgttggcaaaggtggcttcaatgatgaaagatttggcatcacaaaaagtaaggttctttgtttggatgattcattgcagctagtggcatctccatggtggtggagtggaagaagatgaaagtctaacaataaaagggaattgcatgaaattgattgtttttttattgtatttcatattgttgatgcaaaaatttaaataatcatcgagccgatcaagacaatgtttcttgggaacaattacaatttcatgtaaatttttttaccgactttttagtataatttagcctaaaagattgttgtaatttatagaaaccttgaaattctacattacactcatcatcgtgtattaggaaatttaatgacaaagaggagaatgataattaccgagaa

SEQ ID NO: 4434 - DNA, 2203 bp, Glycine max
gaaaaataggagtgacaataacaagcccccttgatgggccattataaagccttctattttgcactttgcctctctcttcctttcccttgatgtaataatggctttataccgattcgcttacttttcttctcctccttcctccatttttcgtttcccgaaatacccttcgaaacacgttaaattctctttgctgccactctcattcgcaacgatggaagctcctccagaaggttatcgcaggaacgttggtatctgtctcatgagcaatcacaaaaagattttcgcggcttcgaggctcgacattcccaattcttggcaaatgcctcagggtggtattgatgaaggtgaggatccaagaaatgcagccatcagggaattaagagaagagacaggagttaattctgcagaagtgattgctgaggtaccatattggttaacttatgacttcccaccaaaagtaagggagaaattaaatattcagtggggatctgattggaagggtcaggcacagaaatggtttctttttaagttcactggacaagatcaagaaattaatcttttgggtgatggtactgagaaagctgagtttggggaatggtcatggatatcacctgaacaagtaattgagcttgcagtggatttcaagaaacctgtctacaaggaagtcttagcagtgtttgctccatatttccaataatcttatctttggctgaaattgttatggcttcccaatgactggtaccttgggtgattcttagggctgctttaaaaaagaatatattccaaataactaccgagacaattattttctttttctcctctgggcaataaccatagggcaggcgaagagggctatttattgtatgtctgaatgaaatatgtattgtcatgaactccataacacctgtattgcatctgtccactttttttttttttttgtcatgatgaaatatggcaggcacgtattgttacataccaaatggtgtatgagaatgaattttgtgattactaacctacaaattgtatgtcttttggggaacacagtatcaggatttgagttaaaaaatcaagttaagaaagagtaaaaactctgtcacacaatacacactaatgtaagattgaactttaaatgtaaactataagaaagagtattttcttttttttgacagaattgaacgctttggttgaaaatatgtaatttgttgttttaagtgtgtgtctttctttgacataaacaaacacatttttgtgtgtgtgttttaagtggggtggtgagttagctgattttgacaactctaaggctgctatagacacgtgccggtgcagaagtaaacagccagcattcagatcagtgcatagcaggtcgaagcagctttcagacctggaaacgaagctggttcggaggagcggtctgttgtggctagggagctcataaagaacggtttgtgcaaggcgaggtgtcaatggaagacctacattagaatgaggatatgcaaatacatgcccttattatgagaaaattacatataaatatcttacatttttatacttagcctcctttattttatatatttgaattcattgtccttattttctcactcatcttattattttttattcaagtatttgatttgaaattttaatatttttttaatagattatctccatagacttagcgccctagttctatcattggctagtgctgatcagaagcgtgtttgctgttggtggtgcgtcgagccgcaatgttggcaaaggtggcttcaatgatgaaagatttggcatcacaaaaagtaaggttctttgtttggatgattcattgcagctagtggcatctccatggtggtggagtggaagaagatgaaagtctaacaataaaagggaattgcatgaaattgattgtttttttattgtatttcatattgttgatgcaaaaatttaaataatcatcgagccgatcaagacaatgtttcttgggaacaattacaatttcatgtaaatttttttaccgactttttagtataatttagcctaaaagattgttgtaatttatagaaaccttgaaattctacattacactcatcatcgtgtattaggaaatttaatgacaaagaggagaatgataattaccgagaaaaagaataaataattccattgttttcaatggcttaaatttcagttactgtaatattttttgttgtat

SEQ ID NO: 4435 - DNA, 1069 bp, Glycine max
gggcttaaatggcccattataaagccttctaatttgcactttgtctctctctttccgttcccttgatgtaatggctttatgccgattcgcttactcttattctcctgcttctgcttccaccatttttcgtttcccgaaatacccttcgaaacacactaaattctccttgctaccactctcattctcaacgatggaagctcctccagaaggttatcgtaggaacgttggtatctgtctcatgaacaatcacaaaaagattttcgcggcttcgaggctcgacattcccaatgcttggcaaatgcctcagggtggtattgatgaaggtgaggatccaagaaatgcagctatcagggagttacgagaagagacaggagttaattcagtagaagtgatcgctgaggtaccatattggttaacttatgacttcccaccaaaagtgagggagaaattaaatattcagtggggatctgattggaagggtcaggcgcagaaatggtttctttttaagttcactgggcaagatcaagaaattaatcttttgggtgatggtactgagaaagctgagtttggggaatggtcatggatatcacctgaacaagtaattgagcttgcagtggatttcaagaaacctgtctacaaggaagtcttagcagtgtttgctccacatttccaataaatcttatctttggctgaaattgttactgatgccttgggtgattatgagggctgctttaaaaagaatgtattccaattaactaacgagaccattattctcttttttctcctcttggccataataacccatagggcgggagaagagggctgtttattttgtctgaatgaaatatgtattgtcatgaaaattgttgtgcaatgtattgcatttgcatctgtccgctgtttttgtcatgatgaagtattgttttttcttattcataggaattgaatatgatatcagaagttttataaaactcacacactatgttgaactaattaggcaagactcttttggtacaaggaaatattgtaacattgcattgtaaaatttatgaacatttaaattgataat

SEQ ID NO: 4436 - DNA, 1123 bp, Glycine max
taataacaagccccttccattaagtgggcttaaatggcccattataaagccttctaatttgcactttgtctctctctttccgttcccttgatgtaatggctttatgccgattcgcttactcttattctcctgcttctgcttccaccatttttcgtttcccgaaatacccttcgaaacacactaaattctccttgctaccactctcattctcaacgatggaagctcctccagaaggttatcgtaggaacgttggtatctgtctcatgaacaatcacaaaaagattttcgcggcttcgaggctcgacattcccaatgcttggcaaatgcctcagggtggtattgatgaaggtgaggatccaagaaatgcagctatcagggagttacgagaagagacaggagttaattcagtagaagtgatcgctgaggtaccatattggttaacttatgacttcccaccaaaagtgagggagaaattaaatattcagtggggatctgattggaagggtcaggcgcagaaatggtttctttttaagttcactgggcaagatcaagaaattaatcttttgggtgatggtactgagaaagctgagtttggggaatggtcatggatatcacctgaacaagtaattgagcttgcagtggatttcaagaaacctgtctacaaggaagtcttagcagtgtttgctccacatttccaataaatcttatctttggctgaaattgttactgatgccttgggtgattatgagggctgctttaaaaagaatgtattccaattaactaacgagaccattattctcttttttctcctcttggccataataacccatagggcgggagaagagggctgtttattttgtctgaatgaaatatgtattgtcatgaaaattgttgtgcaatgtattgcatttgcatctgtccgctgtttttgtcatgatgaagtattgttttttcttattcataggaattgaatatgatatcagaagttttataaaactcacacactatgttgaactaattaggcaagactcttttggtacaaggaaatattgtaacattgcattgtaaaatttatgaacatttaaattgataatgcatagatgaccgattgtgattaaacaaa

SEQ ID NO: 4437 - DNA, 912 bp, Cajanus cajan
ctttgctggtctctctcttcccgtaatgtaatggctttatgccgatttgcttactcttgttctcctgcttcttccgcttccacctttttccgtttcccaaaatacccttccaaacacgttaaattctccttgctgcgacactctttcgcaacaatggaagctcctccagaaggttatcgcaaaaacgttggtatctgtctcatgaacaatcagaaaaagattttcgctgcttccaggctcgacattcccaatgcttggcaaatgcctcagggtggtgttgatgaaggtgaggatccaagaaatgcagctataagggaacttagagaagaaactggagttagttctgcggaagtgattgcagaggtaccattttggttaacttatgacttcccaccaaaagtcagggagaaattaaatgctcagtggggatctgattggaagggtcaggcacagaaatggtttcttttcaagttcatcgggcaagatcaagaaatcaatcttttgggtgatggtactgagaaagctgagtttggcgaatggtcatggatatcacctgaacaaataattgagcttgcagtggatttcaagaagcctgtctacaaggaagtcctagctgtgtttgctccatatcttcaataatgttatatctggttgaaattgttatggcttcccaatgacagatgccttgggtgattctagaatgaatgtattgcaaacaactaccgagacaattgttctctttttctcctataggccacaaccataggacaagcgaagagggctatttattgcatgtctgaatcaaatatgtattgttatgccatgtattgcatctgtccactattttgtcatgatgaaatatggcccatattggtacgtatcaaaatgtgcacgagaatgaattgtgattac

SEQ ID NO: 4438 - DNA, 1697 bp, Glycine max
gaaacaaaaccactggaagtaacagtaacagttaggaacaagaaaactgtagaaagagtaagaaggatttggaattgagaatttccatggcggcggcgacgaacttgttagcaacactgggggatctggagagggactccttcgtggctcttctttcgaagctgatcgctgaatcgaagtacgtccagaacaacccgccggagctcattccccaagaggacagagtggtgaagcacgtcttggacgttctgttaccgttcagcaccaccaccggcggtggacccttgctcgtaaaccacgtcacctaccacgccggcagagggaacctcatcgtggagtaccccggcaccgttcccggcaaaatcctctcgttcgtcggatgccacatggacgtcgtgaccgccaatcccaacgattgggatttcgatccattttcgttgagcgttgacggtgataagcttcggggtcgtggaactactgactgtttgggacacgtggcgcttgtcacggaactcatgaggaagctcggggagaccaagcccaatttgaagtcaagtgttgttgctgtttttatcgccaatgaagagaattctgcgataactggtgttggtgtggatgcacttgtcaaagatggcctcctcaataaactcaaggatggccctctgtattggattgacacggcggataaacaaccatgcgttgggactggtggtatgataccttggaaacttcacgtcaccgggaggctctttcatagtggattagctcataaagctataaatgcgctagagctagccatggatgctctaaaggaaatccagttgcgattttactcagacttcccacctcatcctcaggaacaggtttatgggtttgcaaccccttcaaccctgaagccaacccaatggagttatccaggaggtggaatcaatcaaattccaggggaatgtacaatttcaggagatgtcagattaactccattctacaatgtaaaggatgttatgaaaaagctgcaagaatacgtggacgatattaatgagagtgcacagaagctagaatctaggggtccagtttcaaaatatgtcctacctgatgaaaacataagaggaagacttactttatcttttgatgaggcactgtctggagttgcttgtgatcttaattctagaggttttcatgttttatgcaaagcaactgaagaagtagttgggtatgtaaagccttactctattactgggagtttgcctctcattcgggaactacaggaagaaggttttgatgttcaaacttctggctacggcctaatggctacttaccatgcccagaatgagtactgcctctttacggatatgtcccaaggatatcgggtcttcgcgagaatcatctctcaattggaagagtgagaatagcagaggaactaataattctggtgtctcgtgggctatgaagatgttcgtgttcagatatatgaacataatttctgttatattgtgtagagggttcggtattactgacttttcttcagcatgataggcgaaactagttttttccacataaatttctccggggaaaagtacgtttttgataccatgaaaatttaatgctcctttcactttatttttcttttaggctaaaatatagccacttatcttcttcttttttattctaaattgatttcctaattttttgatgtttta

SEQ ID NO: 4439 - DNA, 1596 bp, Glycine max
aggaacaagaaaactgtagaaagagtaagaaggatttggaattgagaatttccatggcggcggcgacgaacttgttagcaacactgggggatctggagagggactccttcgtggctcttctttcgaagctgatcgctgaatcgaagtacgtccagaacaacccgccggagctcattccccaagaggacagagtggtgaagcacgtcttggacgttctgttaccgttcagcaccaccaccggcggtggacccttgctcgtaaaccacgtcacctaccacgccggcagagggaacctcatcgtggagtaccccggcaccgttcccggcaaaatcctctcgttcgtcggatgccacatggacgtcgtgaccgccaatcccaacgattgggatttcgatccattttcgttgagcgttgacggtgataagcttcggggtcgtggaactactgactgtttgggacacgtggcgcttgtcacggaactcatgaggaagctcggggagaccaagcccaatttgaagtcaagtgttgttgctgtttttatcgccaatgaagagaattctgcgataactggtgttggtgtggatgcacttgtcaaagatggcctcctcaataaactcaaggatggccctctgtattggattgacacggcggataaacaaccatgcgttgggactggtggtatgataccttggaaacttcacgtcaccgggaggctctttcatagtggattagctcataaagctataaatgcgctagagctagccatggatgctctaaaggaaatccagttgcgattttactcagacttcccacctcatcctcaggaacaggtttatgggtttgcaaccccttcaaccctgaagccaacccaatggagttatccaggaggtggaatcaatcaaattccaggggaatgtacaatttcaggagatgtcagattaactccattctacaatgtaaaggatgttatgaaaaagctgcaagaatacgtggacgatattaatgagagtgcacagaagctagaatctaggggtccagtttcaaaatatgtcctacctgatgaaaacataagaggaagacttactttatcttttgatgaggcactgtctggagttgcttgtgatcttaattctagaggttttcatgttttatgcaaagcaactgaagaagtagttgggtatgtaaagccttactctattactgggagtttgcctctcattcgggaactacaggaagaaggttttgatgttcaaacttctggctacggcctaatggctacttaccatgcccagaatgagtactgcctctttacggatatgtcccaaggatatcgggtcttcgcgagaatcatctctcaattggaagagtgagaatagcagaggaactaataattctggtgtctcgtgggctatgaagatgttcgtgttcagatatatgaacataatttctgttatattgtgtagagggttcggtattactgacttttcttcagcatgataggcgaaactagttttttccacataaatttctccggggaaaagtacgtttttgataccatgaaaatttaatgctcctttcactttatttttcttttag

SEQ ID NO: 4440 - DNA, 1732 bp, Cajanus cajan
ggcccaatgaaaacttaatctcaagataggcccaaccagtgagcccaagagagaaagcgtgaactgtaactcaaccaatagcagttcgttacagatcggagaagaggaagaggaagaggaagaggcgtagcaagagggatattggaattgccatggcttcgacgacgaacttgttagcaacattaggggatctggagagggaatcgttcgtgtcccttctctcgaagctgattggggaatcgaagcacgtgcagaacaacccgccggagctgattccccaagaggacagagtggtgaagcacgtgctcgactcactcttacccttcagcaccagcaccggcggtggccccttgctcctcaaccacgtcgcctacctccccggccgagggaacctcatcgtcgagtaccccggcaccgttcccggcaaaatcctctccttcgtcggctgccacatggacgtcgtcaccgccaatcccgacgattgggattttgatccgtttacgctgagcatcgatggggataagcttcggggtcgtggaaccaccgattgcttgggacacgtggcacttgtcacgcaactcatgaagaagctcggggaaaccaagccaaaattgaaatccactgttgttgctgtttttattgccaatgaagagaattctgcaattactggagttggtgtagatgcacttgtcaataatggcctcctcaataagctaaaggatggccctctgttttggattgacacggctgataaacaaccatgtgtagggactggaggtatgataccttggaaactaaacgtcacagggaagctctttcacagtggattagctcataaagctataaatgcactggagctagccatggatgctctaaaggaaattcagttacgattttaccatgactttccacctcatcctcgggaacaggtttatgggtttgcaaccccttcaaccatgaaaccaacacaatggagttatccaggaggtggaataaaccaaattccaggggaatgtactatttcaggagatgtcaggttaactccattctacaatgtcaaggatgtaatgaagaagctgcaagaatacgtgaacaatattaatgagaatatacaaaaactagaaacaaggggtccagtttcaaaatatgtcctacctgatgaaaacataaaaggaagccttactttgacttttgacgaggcattgtctggtgttgcttgtgatcttaattctagaggtttccatgttttatgcaaagcaactgaagaagtagttggccatgtaaagccttactcaattactgggagtttgcctctcattcgggaactacaggatgaaggttttgatgttcaaacttcgggctatggcctaatggttacttaccatgccaagaatgagtactgcctttttacggacatgtcccaaggatatggagtcttcgccaggatcatctctcaattggaagattcagaatagcttaggaaccaataatactggtgtctcgtgggctatgaagatgtttttagtgagatatgaacataattcaactgttaaactgtatagaggattagttcgctgttgctaacttttcttcagcatgatcggcgaaactagtttaatccccataaattctccggcgaaaattacctttttatcccatgaaaatttaacgttcctttcactttatttttattggccaaaatataatgttggttccctgtctgatttttttt

SEQ ID NO: 4441 - DNA, 2155 bp, Cicer arietinum
gtagtctttaaaaatatttggggctgggagggaaaatggagggggtgcagattacaaaaccccaacctgtaatagtaaaccgtagacccaaaaatcacctgtaacagtaaccttagacaaaaaataactgctaatctgaaataacagttacatatcggagacgcaaaagagaacccgaggaggaagaagagtttctaagtccgatggctacatcgaagaagttgttagaaacattaggcgacttagaaagggattcatttgtaccccttctctcgaaactaatcggtgaatcgaaacacgtgcaaaacaatccaccggaactgatcccggaagaagacagagtagtcaaacacgtgttaaactcactcttaccgttcagcaccaccaccggtggcggtcctttaattctcaaccacgtcacttattttcccggtagaggtaatctcattgtcgagtaccctggtaccgttcccggaaagatcctttccttcgttggttgccacatggatgttgtaactgcaaaccctaacgattgggattttgatccgtttagtttgagtatcgatggtgataaactaaggggtcgtggaactactgattgtttgggacacgtggcgcttgttactgaattgatgaggaagcttggtgaaactaagccaaatttgaaatcaactgttgtcgctgtttttatagcgaatgaagagaattcttctattactggtgttggtattgatgcacttgttcaagatggtcttcttagtaagctaaaggatggtcctttgttttggatagacacggctgataaacaaccttgtgttggcactggtggtatgataccttggaaacttcatgtcactgggaaactttttcatagtggattagctcacaaggctataaatccgctggaacttgccatggatgcaataaaggaaatccagctgcgattttacagggacttcccacctcatcctcaggaacaggtttacgggtttgcaaccccttcaaccatgaaaccaacccaatggagttatcctggaggtgggatcaaccaaattccaggggaatgtactatttcaggagatgttagcgtgaaggatgtaatgaagaaactgcaagagtatgtggctgatattaatgagaatatacagaagcttgaatctcggggtccagtttcaaaatatgtcctatctgatgcaaatttaagggggagccttactctaacttttgatgaggctacatcgggagttgcttgtgatctaaattctagaggttttcatgtattatgcaaagcaactgaggaaatagttgggcatgtaaaaccttactcaattactgggagtttgcctctcattcgagaacttcaggatggaggttttgatgttcagacttgtggctatggtctgatggcaacttaccatgcccagaatgagtactgtctttttacagacatgtcccaaggataccgggtgtttgcaagcatcgtcgctcaattagaagattgagaatagcagaggaactaataatgcaagcgtctactaggctatgaagttgtcttgttgagtttaatttaatatgagtaacagtaaactgtgcaaatgattagttcgttgttgaattttcttgaacatttacaagatggaccaaataatttatcagccataagtttctgcttaaaagtagggatatgttacttccactcctttgttttgacatttcaaccctttctccatcaaaatatttttaatgcacaaatagccctttttatactcaagtcaatacccacacatctttcacttctttcattcaaacacctccatcacctcatctctctttatcaaacctccgacgacaaccattctttggtggctaaccctcactgaccaccaccttttttcaggtgagtatttcttctctagtagatattggactatcataagatttcgtattcatctcagacctgcccaatacaactaaacaggcctataccgagtggagagcaagcccaagtatttccatagtcttgatgaagctcggtcgaaccgtaattaacatgggttttgtactgtgcacccccattttacctcccacccccaaatattttttaagactactttgcctttgtttagtttgcataaaataatagaaaattttacca

SEQ ID NO: 4442 - DNA, 1744 bp, Lupinus angustifolius
tcttatttcataatttaatcaccaggtgaatataacagtcactgacagagaaagaggaaaaggtaaaggtttcgaaattccaaatccaatttccatggctgacttgaaagaaacacttggggatctgaatagggattccttcgttccccttctgtctaaactaatcggcgaatccaagtatgtacagaacaacccaccggaccttattccacaagaagacagagtcgtaaaccacgttctcgacgctctccgaccattcagcaccaccaccggtggcggccccttgatcctcaaccacgtcgcttattttcccggaagaggcaatctcatcgttcagtaccctggaaccgtccctggcaaaatcctttcctttgttggttgccacatggatgttgtaaccgctaatcccaacgattgggattttgatccgtttagtttgagcattgaaggggataaacttaagggtcgtggaacaactgattgtttgggacatgttgcacttgttacagaactaatgaggaagcttggtcaaaccaagcctaaattgaaatcaaccgtggttgctgtttttatagctaatgaagagaactctgctatatctggagttggtgtcgatgcacttgttaaagacggcctcctcgataacctaaagcaaggaccactgttttgggttgacactgcagataaacaaccttgtgtaggcactggcggtatgataccttggaaacttcatgtcacagggaagctcttccacagtgggttagctcataaagctataaatcccctagagctagccatggaagctctaaaggaaatccagttgcgattttatagagacttcccaccgcatcctcaggaacaagtctatgggtttgcgactccctcaaccatgaaaccaacccaatggagttatcctggaggtggaatcaaccaaattccaggggagtgtactatttcaggagatgtcaggttaactccattctacaatgtgaagaacgtaatggagaagctgcaagaatatgtagacgatattaataaaaatatagagaagatagaatcacggggtccagtttcgaaatatgtcctacctgatgaaaacttaagaggaagccttactctaacttttgatgaggcaagttctggagttgcttgtgaccttaattccagaggtttccatgttttatgcaaagcaactgaggaagtggttgggcatgtaaaaccttactcaattacagggactttgccactcatccgggatctaaaggatgaaggttttgatgttcaaacttgtggctatggtctaatggcaacttaccatgccaagaatgagtactgtctttttacagatatgtctcaaggatatggggtgtttgtgagcattatctctcaattggaagattgaaaataacagtgaatgtaatactagcgtctcttgggctatgaagatgtttgttgagaattcagatcaatataatttgaagtgacattgaaaatgtatcgatttatttattaaaaaattatgcaacaaattaatggtatggctttaagtggatgcatactccaaatttcaaatagtattcgatgcaaatcccattttgacaacagaaaaaacagaggtgtgggaatagtaaatgcatgtaaccttactcaataaatgaagatgtttccaaaatttgaactcgtaaacttaattaataaccactaagcaataatttactgtgtcaaactcacccttaaagttgcc

SEQ ID NO: 4443 - DNA, 2110 bp, Arachis hypogaea
tacttaggtaacataataatttaacataggatagaagtatggtctgtatctttgaaagaaaaaaaattgaaagaccaacattaattttttttttggccagcattgttagctaaaaacactaatttttgctgaccctctaacatttttttccttaaaataataatacaaaataactagaaaataaattcactacaactagctaaagaaaataacctacatgcatatatttaatgggtcaaccatttaatggatcactaattaaccacatataaggcccaataaactaggcccaattagtattggcccatcaggaaagcccaagagagagacgtgagtggagctacggaagtggaagaactgaacccgtaactgattaactgtaacaaggaaaaagggaggaagaggaagaagaagaaggaagtagggtttgcagtgtcgatggctaaagtgaaagagatacttggggacctacagagggactctttcgtggaactgctctcgaaactcatcggagaatcaaagtacgtgcagaacaaccccccggagctgattccagaagaagacagggtggtcaagcacgtgctcgactccctcctccccttaagcaccaccaccggcggcggtcccttgatccttaaccatgtcacctacttccccggcagaggcaacctcatcgtcgagtaccccggcacctccccggacaaaatcctctccttcgttggctgccacatggatgtcgtcaccgccaaccccaacgattgggattttgatccgtttacgttgagcattgacggggataagcttaggggtcgtggaaccactgattgtttgggacacgtggcacttgtgaccgagcttttcaggaagctcggggaaaccaagcccagtttgaaatcgagtgttgttgctgttttcatagcgaatgaagagaattctgccataactggagttggtgtcgatgctctcgttaaagatggcctccttaacaagcttaagaaaggcccactgttttggatcgatacggctgataaacaaccttgtataggaactggtggaatgataccttggaaacttcatgtcaccggaaaactctttcacagtgggttagctcataaagctataaatcctctggagctagccatggatgctctaaaggaaatccagtcacgattttatgaagactttccaccacatccacaggaacagatctatgggtttgccaccgcatcaaccatgaaaccaacccagtggagctatcctggaggtggaatcaaccaaattccaggggaatgtactatttcaggagatgtcaggttaaccccattttacaatgtgaaggatgtagtgacaaagctgcaagaatatgtggacgacattaatctcaacatacataagctagaaacacggggtcctgtttcaaaatatgtcttgcctgatgatgacttaagggggagccttactctaacttttgatgaggcaaattctggagtagcttgtgatcttaattccagaggctaccatgttttgtgcaaagcaactgaagaagtagttgggcatgtgaagccttactcaattactggaagtttgccactcattcgggagctacaggatgaaggttttgatgtccaaactgctggatatggtctaatggctacataccatgcccagaatgagtactgcctttttacggatatgtctcaagggtatcgagtttttgcaagcatcatcgctcagttagaggaagattgagactactagttgaacttcattctagcattccacgacctatgaatatgtcattgcagctaaagctgaagaccttaagtgactctatgtattcattttattgtatgaagtagtagtttggtggtattgatttctacactagtcttacgaaaatagttgacttaatacgctattatctaagttacatgttgttatatactattactaatagatattttcttttcctttttgggtgatatatgatgctccatgtgagaaattgttcaattaaaattttctgttttatctacccaaaataaattccttttctttatgaagaatcttatgtaacattgtttagatgcttatctatttacctactttc

SEQ ID NO: 4444 - DNA, 1395 bp, Lotus japonicus
gagtttttgcaacattttcagaaacaggagaagaagaagacgaagaagagtaagaaaacagtttcagaatttccatggcggcagcgacgacgttgttagaaaccttaggcgatctggacagagattccttcgtgccccttctctcgaagctgatcggcgaatccaaacacctccagaacaacccgccggagcttatcccggaagaggacagggcggtgaagcatgtcatggacgtcctcctccccttcagcaccaccaccggcggcggccccttgatcctcaaccacgtcacctacttccccggcagaggcaacctcatcgtcgagtaccctggtacccaccctagcaaggtcctctccttcgtcggttgccacatggatgtcgtcaccgccaatcccaacgactgggattttgatccgtttacgttgagtgttgatggggataaactcaggggtcgtggaactactgattgtttgggacatgtggctcttgtcactgaactcatgaggaagcttggggaaacaaagccgaatttgaaatcaactgttgttgctgtttttattgccaatgaagagaattctgctataactggtgttggtgtggatgcacttgtcaaagatggtctcctcaacaagctcaagaatggccctctgttttggatcgacacggcagataaacaaccttgtgtaggcactggtggtatgataccttggaaacttcatgtcacggggaagctctttcacagtggattagctcataaggctataaatccactggaactagccatggatgctatgaaggaaatccagttgcgattttatagagacttcccacctcatcctcaggaacaggtttatgggtttgcaaccccttcaaccatgaaaccaacccaatggagttatcctggaggtggaatcaaccaaattccaggggaatgcactatttcaggagattgctctaataccttgttcagtgtcaaggatgttatgaagaagttgcaagagtatgtgggtgatattaatgaaaatataagtaagctagaagcacgaggtccagtttcaaaatatgtcctatctgatgaaaacttaaggggaagccttactataactttcgacgaggcaatgtctggagttgcttgtgatcttaactctagaggtttccatgttttatgcaaagcaactgaggaagtagttgggcatgtaaagccttactcaatgactggtagtttacctctcattcgagaacttcaggatgaaggatttgatgttcaaacttctggctacggtctaatggcaacttaccatgcccagaatgagtactgtctttttaacgacatgtcccaaggatatcgggtgttcacgagtgtcatctctcaattggaagactaggaaggac

SEQ ID NO: 4445 - DNA, 2126 bp, Prunus mume
tgaaattataaaaatcgaaattcagtcattttaaaattttatgtaattttcaatttatttaggtatagggtaaagtagggatcaaaatttaacatgttcttatgattctgccttttgcaaagttgtaattctgccttttgcaattcccactgtcgagttccaagtcgttagccacactccaccctgctactgtttctctctctctccccctctttatcccggtcgacttcggaagccaaaacccacccaaaaacaaaaaaaaaacaaaaattctcatttcacagccatggcttcctcaaccgacctcaagaaaatactaggtgacctcaacaaggactccttcatatcccttctctccaagcttattggggagtccaagtacctccaaaacaacccacctgaactgatccctcaggaggaccgagcggtcaagcacgtgcttgattccctcctgccccttagcaccaccacaggcggtggacccttggtgatcaaccatgtaacatactttcctggcagaggaaacgttattgtagaatacccaggaactgtgcctgggaagatcttgtcctttgtggggtgtcacatggacgtggtcactgcaaatcctaatgactgggagtttgatccattctcattgagcattgatggtgataagcttcgtggccgtggaaccactgattgcttgggccatgttgcacttgtagctgagctcatgagacggctcgcagagacaaagccaaaattgaagtccactgtggttgcagtctttatagcaaatgaagaaaattctgccatttcaggtgttggtgtggatgcactcgtgaaggatgggctactcagtaagctaagggaaggacctctgttttggattgacacggcagataaacaaccttgcgttggtactggtggtatgataccttggaagcttcatgtgactggcaagcttttccacagtggtttagcacacaaggctataaaccctttggagctagctatggaagcactgaaagagatccagtcacggttctatagagactttcctccccatcctaaggaagaggtctacggatttgcaacaccgtcaaccatgaaaccaactcaatggagttatcctgggggcggaataaatcaaattccagcagagtgcacaatttcaggagatgtcaggttaactcccttctacaatgttaaggacgtgatggaaaagcttcaagaatatgtggatgacattaatgaaaacattggaaagcttgactcacgaggtccggtgtcaaagtatgtcctaccagatgaaaacttaaggggaagcctcacattaagttttgatgagacgtcgtctggagttgcttgtgatctcaactcccgtggctttcacgtattatgtaaagctactgaagaggttgttgggcatgtgaagccttactcaattactggaagtttgcctctcattcgagaactgcaggatgaaggatttgatgttcaaacgtctggctacggcttgatggccacataccatgccaagaatgagtactgccttttttccgatatgcgccaaggctaccaggtgtttgtcagcattatctctcaactagaggactgagaaatagcaaagagaaaagaagaaaactagaagactgagaataacaagttgcaatgatactaccaaatcacaccaaaaatgaatctgcaccacgcctcgagtcttgactagaagaatgagaatcgaggggaaaataaagggaagtgaaaagaaagtagaagattgagaataatgagaaattgtaaatgatacctaccgaaccatggctgatcggtattgttcagaatttccaatagtcatagctaagcaaaatgttaatttttaactctggttacgcgaagggcttgtgttttttcgttgagttgagtacatgtgaagtgtttatggttgttatccctattttcatatatgtttgaaggcgaaattctgtagtgacggtgtcatatatggaccccacatctggataatttcattaaatttaggtgaagttactatttagatgaatcatgtggctaatatgaagtccacatctattgttcatatatgacaccctcatcatagaatgactcttgtttgaagcatt

SEQ ID NO: 4446 - DNA, 1635 bp, Medicago truncatula
gaaaaaaaaaatctgaaactctgaagtgacagttacaaaaaaaattaaaaacgaaagagaaacagaggaagaagaagaataatttcgaaatccaatgactacaccaacgaagaacttgttagaaacactaggaaacttagagaaggattcattcataccccttctcacgaacctaatcggtgaatcgagacacgtgcagaacaacccaccggaactgattcctgaagaagacagagtagtcaagcacgtgttaaactcgctattaccgctcagcaccaccaccggcggtggtccgttaatcatcaaccatgttacctatttccctggcagaggtaacctcatcgtcgagtaccctggtaccgttcccggcaagatcctctcctttgttggatgtcacatggacgtcgtcaccgccaatcccaacgattgggattttgatccgtttactttgagcattgatggagataaattgaagggacgtggaactacggattgtttgggacatgtggcacttgttactgaactgatgaagaagcttggtgaaacaaagccgaatttgaaatcaactgttgttgctgtttttattgcaaatgaagagaattctgctataactggtgttggtgttgatgcacttgttcaagatgggttgctcaataagctaaaggaaggtcctttgttttggatcgacactgctgataaacaaccttgtgttggaactggtggtatgataccttggaaacttcatgtcactggaaaaatgtttcatagtggattagctcacaaggctataaatcccctggagctagccatggatgcgataaaggaaatccaactgaaattttacaatgacttcccacctcatcctcaagaacaggtttatgggtttgcaaccccttccaccatgaaaccaacccagtggagctatcctggaggtggaatcaaccaaattccaggggaatgtaccatttcaggagacgtcaggttaactccattctacaatgtgaaggatgtaatgaagaagctgcaagaatatgttgacgaaattaatgagaatatacataagctagaatctcggggtccagtttcaaaatatgccttatctgatgaaaacttaagggggagcctaactctaacttttgatgaggctaattctggagttgcttgtaatctcgattctagaggtttccatgttttatgcaaagcaactgaggaaattgttggccatgtaaagcctttctcaattactgggagcttgcctctcattcgggaacttaaggatgaaggttttgatgttcagtgttgtggctatggtctgatggcgacgtaccatgcccagaatgagtactgtctatttacagatatgtgtcaaggataccgggtgtttgcaagcatcatcgcgcaattggaagactgagaatagcagaggaactaataatacaaaagtgtctagtggcctgtgaagatgtcttgttgagattaatatgaataatggttagattgtgcaaatgataagttctttgttgctaattttcttgaacatttacaagatggacaaactagtacaatttctgttaaaaattaggtaaagttatttcaattcccttgttttgacatcttctccatcctttctccttt

SEQ ID NO: 4447 - DNA, 1603 bp, Medicago truncatula
gtagcatcaagaaaaaaaaaatctgaaactctgaagtgacagttacaaaaaaaattaaaaacgaaagagaaacagaggaagaagaagaataatttcgaaatccaatgactacaccaacgaagaacttgttagaaacactaggaaacttagagaaggattcattcataccccttctcacgaacctaatcggtgaatcgagacacgtgcagaacaacccaccggaactgattcctgaagaagacagagtagtcaagcacgtgttaaactcgctattaccgctcagcaccaccaccggcggtggtccgttaatcatcaaccatgttacctatttccctggcagaggtaacctcatcgtcgagtaccctggtaccgttcccggcaagatcctctcctttgttggatgtcacatggacgtcgtcaccgccaatcccaacgattgggattttgatccgtttactttgagcattgatggagataaattgaagggacgtggaactacggattgtttgggacatgtggcacttgttactgaactgatgaagaagcttggtgaaacaaagccgaatttgaaatcaactgttgttgctgtttttattgcaaatgaagagaattctgctataactggtgttggtgttgatgcacttgttcaagatgggttgctcaataagctaaaggaaggtcctttgttttggatcgacactgctgataaacaaccttgtgttggaactggtggtatgataccttggaaacttcatgtcactggaaaaatgtttcatagtggattagctcacaaggctataaatcccctggagctagccatggatgcgataaaggaaatccaactgaaattttacaatgacttcccacctcatcctcaagaacaggtttatgggtttgcaaccccttccaccatgaaaccaacccagtggagctatcctggaggtggaatcaaccaaattccaggggaatgtaccatttcaggagacgtcaggttaactccattctacaatgtgaaggatgtaatgaagaagctgcaagaatatgttgacgaaattaatgagaatatacataagctagaatctcggggtccagtttcaaaatatgccttatctgatgaaaacttaagggggagcctaactctaacttttgatgaggctaattctggagttgcttgtaatctcgattctagaggtttccatgttttatgcaaagcaactgaggaaattgttggccatgtaaagcctttctcaattactgggagcttgcctctcattcgggaacttaaggatgaaggttttgatgttcagtgttgtggctatggtctgatggcgacgtaccatgcccagaatgagtactgtctatttacagatatgtgtcaaggataccgggtgtttgcaagcatcatcgcgcaattggaagactgagaatagcagaggaactaataatacaaaagtgtctagtggcctgtgaagatgtcttgttgagattaatatgaataatggttagattgtgcaaatgataagttctttgttgctaattttcttgaacatttacaagatggacaaactagtacaatttctgttaaaaattaggtaaagttatt

SEQ ID NO: 4448 - DNA, 1739 bp, Trigonella foenum-graecum
aaagacaaaacatatgggccggagtggactatcatcaaatagcccattcgtaaagcccaacagagagtgaaccaaaacaacatggaacagttacatcaagaccaaaaaaacacctgtaacagtaaacataagaagaagaaaaacctgcaattccgaagtaacagttagaaaagaaaaaaacaaaaagaaacagaagaagaagaagaacatcgaaattcaatggcaacaacgaagaacttgttggaaacactaggaaacttagagaaggattcattcataccccttctctccaacctgatcgatcaatccagacatgtgcagaacaacccaccggagctgattcctgaagaagacagagttgtcgaccacgtgctaaactctcttttaccggtcagcaccaccaccggtggtggtccgttaattatcaaccatgttacttattttcccggcagaggtaacctcatcgtcgaatatcccggcaccgttcccggcaagatcctctcctttgttggctgtcacatggatgtcgtcaccgccaatcccaacgattgggattttgatccgtttagtttgagcattgatggagataaactgaggggacgtggaactactgattgtttgggacacgtggcacttgttactgaactgatgaagaagctaggtgaaactaagccgaatttgaaatcaactgttgttgctgtttttatagcgaatgaagagagttctgctataactggtgttggtattgatgcacttgttcaagatgggctactcaataagcttaaggaaggtcccttgttttggatcgacacagctgataaacaaccatgtgttggaaccggtggcatgataccttggaagcttcatgtcactgggaaaatgttccatagtggattagcccacaaggctataaatcccctggagctagccatggatgcgataaaggaaatccaactgaaattttaccaagatttcccacctcatcctcaggaacaggtttatgggttcgcaactccttcgaccatgaaaccaacccaatggagttatcctggaggtggaatcaaccaaattcccggggaatgtaccatttcaggagacgtcaggttaactccattctacaatgtgaaggatgtaatgaagaagctgcaagattatgttgacgatattaatgagaatatacataagctagaaggtcggggtccagtttcaaaatatgccctatctgatgaaaacttaagggggagcctaactctaacttttgacgaggctaattctggagttgcttgtgatctcaattctagaggtttccatgttttatgcaaagcaactgaggaaatagttggccatgtaaagcctttctcaattactgggagtttgcctctcattcgggaacttaaggatgaaggttttgatgttcagtgttgtggctatggtctgatggcaacttaccatgcccagaatgagtactgtctttttacagatatgtgccagggataccgggtgttcgcgagcataatcgcgcaattggaagattgagaatagcagaggaactaataagatgtgtctagtgggatatgaagatgtcttgttgaaattaatatgaatgatggttagattgtgcaaatgattagttcttggacaaactaaatttttagctctaaatttctagtattgtaatgtacttcactcccttgttttgacattatcaacacttatgcaggttgttccctcagtttttg

SEQ ID NO: 4449 - DNA, 1665 bp, Quercus alba
agaaaaatggcttcttcttctgcgcacgtaaaagaaacgctaggtgagctgaacaaggagtccttcgtgagcctcctctcgaagctgattggggaagccaagtacgtccagaacaatcccccggacctgattccagaggaagacagagtggcgaaacacgtgttggactctcttcttccttacagcacaaccacaggtggaggacctttgatcgtcaaccatgtcacctatcatcaaggcagaggcaatatcattgtggagtatcctgggactgtccctggcaatgtcttgtccttcgttggttgtcacatggatgtggttactgctaatcctaatgattgggaatttgatcctttctcattgagcattgatggtgataaacttcgcggccgtggaactactgattgtttggggcatgttgcgcttgtaactgaactcatgaagaggctaggggagacaaaaccaaaattgaagtccactgttgttgctgtctttatagccaatgaagagaattctgccatttcgggagttggtgtggatgcactcgtgaaagatggactacttaataagctgaaggatggtccactgttttggattgacacagcagataaacaaccttgtgttggtactggtggtatgattccttggaaacttaaagtgactgggaagctttttcacagtggtttagcccataaggctataaatcctttggagctagcaatggaagcattaaaagagatccaatcaaggttttacagagactttcctccccatcctaaggaacaggtctatgggtttgcaacaccttcaaccatgaaaccaactcaatggagttatccaggaggtggaatcaatcagattccagctgagtgtacaatttcaggagatgtcaggttgactcccttctacaatgtaaaggatgtaatgtcaaagcttcaagagtatgtggatgacattaatgagaacgtagacaagctagattcacgtggtcctgtttccaaatatgtcttaccagatgaaaacttaaggggaagccttacacttagttttgatgagacaatgtctggagttgcatgtgatcttaactcacgtggctttcatgtattgtgtaaagcaactgaagaggtagttgggcatgtaaagccttactcgattactggaagtttgccactcattcgagaactgcaggatgaaggatttgatgttcagacttcaggatatggtttaatggccacataccatgccaagaatgagtattgtcttctttctgacatgtgccaaggctaccaggtctttgtcagcatcatctctcagttagaagattgacgatacaaggatatgctaaaaataaaacccaataatggcccttaactgtgttttcaacagccaactcattacggttggataaaatttattgatgtgattggcgtaatatttcagaatgagttaccaactgcacaataagcctttttttctgatctggattttattcattaagatttgcttatccttatagtttcatgtgagatttagtactgggacagtccatggatggtgaacatgaggtgaacggcgacaaagaatttacatattcctcctatctcttcagttacaccaattcctttgattggagtttgactgagcaagccggtatgattcagttca

SEQ ID NO: 4450 - DNA, 1763 bp, Prunus persica
attcccactgccgttttccaagtcgtcagccacactccaccctgcaactgtttctctctctctctccccctctttataccggtcgacttcgaaagccaaaacccacaaaagaaaaaaaaaagatttctcatttcacagccatggcttcctcaaccgacctgaagaaaatactaggtgacctcaacaaggaatccttcatatcccttctctccaagctcattggggagtccaagtacctccaaaacaacccacccgaactgatccctcaggaggaccgagcggtcaagcacgtgcttgattccctcctgcccctaagcaccaccactggcggtggacccttggtgatcaaccatgtaacctactttcctggcagaggaaacgttattgtagaatacccaggaactgtgcctgggaagaccttgtcctttgtggggtgtcacatggacgtggtcactgcaaatcctaatgactgggagtttgatccattctcattgagcattgatggtgataagcttcgtggccgtggaaccactgattgcttgggccatgttgcacttgtagctgagctcatgagacggctcgcagagacaaagccaaaattgaagtccactgtggttgcagtctttatagcaaatgaagaaaattctgccatttcaggtgttggtgtggatgcactcgtgaaggatgggctactcagtaagctaagggaaggtcctctgttttggattgacacggcagataaacaaccttgcgttggtactggtggtatgataccttggaagcttcatgtgactgggaagcttttccacagtggtttagcacacaaggctattaaccctttggagctagctatggaagcactgaaagagatccagttgcggttctatagagactttcctccccatcccaaggaagaggtctatggatttgcaacaccttcaaccatgaaaccaactcaatggagttatcctgggggcggaataaatcaaattccagcagagtgcacaatttcaggagatgtcaggttaactcccttctacaatgttaaggacgtgatggaaaagcttcaagaatatgtggatgacattaatgaaaacattggaaagcttgactcacgaggtccggtgtcaaagtatgtcctaccagatgaaaacttaaggggaagcctcacattaagttttgatgagacgtcgtctggagttgcttgtgatctcaactcccgtggctttcacgtattatgtaaagctactgaagaggttgttgggcatgtaaagccttactcaattactggaagtttgcctctcattcgagaactgcaggatgaaggatttgatgttcaaacgtctggctacggcttgatggccacataccatgccaagaatgagtactgccttttttcggatatgcaccaaggctaccaggtttttgtcagtattatctctcaactagaagactgagaatcagcaaagagaaaagaagaaaactagaagactgagaataacaagttgcaatgatactaccaaatcacaccaaaaatgagtactgcctttttctgatgtgtgccaaggcttgactagtcttgactagaagaatgagaatcgaggggaaaataaagggaagtgtagaagattgagaataatgagaaattgcaaatgatacctaccgaaccatggctgataggtattgttcagaatttccaatagtcatagataagcaaaatgttaattttaaactctggttacgtgaatggcttgtgttttttc

SEQ ID NO: 4451 - DNA, 1612 bp, Fagus grandifolia
tcgccgaaattaaatttaatgaataagcttaatccagtgctagatttggtaggtataattttggtttgaaaacattttgtcagctcctagacagaacagcggtaggctgaagctgagtttgatttgagaatggcttcctcgcacgtaaaacaaacgctaggtgagctggacaaggattccttcgtgaccctcctctcgaaactgattggggaagccaagtacgttcagaacaatccccctgagctgatcccagaggaggacagagtggtcaagcacgtcttggaagcccttcttccctatagcaccaccacaggtggaggacccttggtcatcaaccatgtcacctattatcaaggcagaggcaatattattgtggagtatcctggcactgtgcctggaaacatcttgtccttcgttggttgtcacatggacgtggtcactgctaatcctaatgattgggaatttgatcctttctcattgagcattgatggtgataaacttcgcggccgtggaactactgattgtttggggcatgtggcccttgtaactgaactcatgaagaagctaggggagacaaagccaaaattgaagtccactgttgttgctgtctttatagccaatgaagagaattctgccatttcgggggttgtgtggatgcactcgtgaaagatggactactcaataagttgaaggatggtccattgttttggattgacacagcagataaacaaccttgtattggtactggtggtatgcttccttggaaacttaaagtgaccgggaagctttttcatagtggtttagcacataaggctataaatcctttggagctagcaatggaagcactaaaagagatccaatcacggttttacagagactttcctccccatcctaaggaacaggtctatgggtttgcaacaccttcaaccatgaaaccaactcagtggagttatccaggaggtggaatcaatcagattccagctgagtgtacgatttcgggagatgtcaggttaactcccttctacaacataaaggatttaatgacgaagcttcaagagtatgtggatgacattaatgacaacatagagaagctagacacacggggtcctgtttccaaatatgtcttaccagatgaaaaccttaggggaagccttacaataagttttgatgaagcaatgtctggagttgcatgtgatcttaattcacgtggctttcatgtattgtgtaaagcaactgaagaggtggttgggcatgtaaagccttactcaattactgggagtttgccactcattcgagaactgcaggatgaaggatttgatgttcaaacttcaggctatggtttaatggccacataccacgccaagaatgaatactgtcttctttctgatatgtgtcaaggctaccaggtttttgtcagcatcatctctcagttggaagattgactgtacaaggatatgagctaataatacaaccaaacaatggcccttaactgtgttttcaacagccaagttattacggtcagataaatttgttaatgtgattggcataatatttcagagtgagctaccaactgcacacacaatatgccttgtttttttttttttcctgtatc

SEQ ID NO: 4452 - DNA, 1606 bp, Castanea mollissima
aagaagggaaaaaaacaaaatggcttcttcttctgcgcacgtaaaagaaacgctaggtgagctgaacaaggaatccttcgtgagcctcctctcgaagctgattggggaagccaagtacgtccagaacaatcccccggacctgattccagaggaagacagagtggtgaagcacgtgttggactctcttcttccttacagcacaaccacaggtggaggacctttgatcatcaaccatgtcacctattatcaaggcagaggcaatatcattgtggagtatcctgggactctccctggcaatgtcttgtccttcgttggttgtcacatggatgtcgttactgctaatcctaatgattgggaatttgatcctttctcattgagcattgatggtgataaacttcgcggccgtggaactaccgattgtttggggcatgttgcgcttgtaactgaactcatgaagaggctgggggagacaaaaccaaaattgaagtccactgttgttgctgtgtttattgccaatgaagagaattctgccatttcgggagttggtgtagatgcactcgtgaaagatggactacttaataagctgaaggatggtccactgttttggattgacacagcagataaacaaccttgtgttggtaccggtggtatgattccttggaaacttaaaataactgggaagctttttcacagtggtttagcccataaggctataaatcctttggagctagcaatggacgcattaaaagagatccaatcaaggttttacagagactttcctccccatcctaaggaaaaggtctatgggtttgcaacaccttcaaccatgaaaccaactcaatggagttatccaggaggtggaatcaatcagattccagctgagtgtacagtttcaggagatgtcaggttgactcccttctacaatgtaaaggatgtaatgtcaaagcttcaagagtatgtggatgacattaacgagaacgtagacaagctagattcacgtggtcctgtttccaaatatgtcttaccagatgaaaacctaaggggaagccttacgcttagttttgatgaggcaatgtctggagttgcatgtgatcttaactcacgtggctttcatgtattgtgtaaagcaactgaagaggtagttgggcatgtaaagccttactcgattactgggagtttgccactcattcgagaactgcaggatgaagggtttgatgttcagacttcaggatatggtttaatggccacataccatgccaagaatgagtattgtcttctttctgatatgtgccaaggctaccaggtctttgtcagcatcatctctcagttagaagattaacgattcaaggatatgctaaaaataaaacccaataatggccctttcctgtgttttcaactgccaagtcattacgattggataaactttattgatttgattggcgtaacatttcagaatgagttaccaactgcacaataagcctgtttttctgatccggattttgttcatttagatttgcttatacttatagtttcatgtgggatttagtagtgggacagtccatggatggtgaacaagaggtgaatggtgacaaaaagaatttacata

SEQ ID NO: 4453 - DNA, 1594 bp, Gossypium raimondii
gcaaaacgcaaattctcccctgtttcgtcctaagaacctctctccaatggcaacttcaaacttgaagcaaacactaggcgatctaaacaaggaatccttcatctcactgctaaccaaaatcataggtgaatccaagttcttacaaaacaacccaccagaactaatcccggaagaagacagggtaatcaaacatgtactagattgtctgctcccttacagcaccacaaccggtggtcctttgatcgttaaccatgtcacttatttccctggtagaggcaatcttattgtggaatatcctgggactcaacccggcaagatcttgtcttttgttggtatgcatatggatgttgtcaccgctaaccccaatgattgggattttgatcctttctcgttgagcatcgatggcgataagcttcgtggccgtggaactactgattgtttgggacatgttgcacttgtgactgaactaatgaagagacttgctgagacaaaaccgaagctagaatcgactgtcgttgcagtttttatagctaatgaagagaactcggctataactggagttggtgttgatgctttagtgaaggatggtctgcttgataaactgaagggaggcccacttttctggattgatacagctgataaacaaccttgcattggtaccggtggtatgataccatggaaacttcaggtgacggggaagctttttcacagtggtttaccgcacaaggctataaatgcattggagctcggcatggaagcacttaaggaaattcagctacggttttataaagacttcccaccccatccggatgagcaagtatatggatttgctacaccatcaaccatgaaaccaacgcaatggaattatccaggtggtggaatcaatcaaataccaggagagtgtacaatatcgggagatgtcaggttaactcctttctacaatgtaaaagatgtaatgagtaagcttcaagaatacgtagattacataaacgaaaatctaaacaagctagacacacggggtccggtttcaaaatatatcctccatgacgaaaaccttagaggaagccttactttgactttcgacgaggcaatgtccggtgttgcttgtgatctcaattctcgtggattccatgtattgtgcaaagcaactgaagaggctgttggacatgtgaagccttactcaattaccggaagtttgccactcattcgggagctacaagatgaaggttttgatgttcaaactgctggctacggtttaatggccacgtaccacgccaagaacgagtactgccttctttccgatatgtgccaaggttatcacgtatttaccggcatcatcgctcagctagaggattgaaagatgacaatagattaaatatgaactttcataatagttttctcatcaataataatgtcatttgaactgtttgtatgaatccctactgcacaaaatttattgttagtttgttaaatgtggttttatttatttagtgctgtttgttgatgcaaattgtaggtaggaaaatgggtaaattatggtttcggtccttctattacgttcaatattaagatttagtccgagtgttttaatttg

SEQ ID NO: 4454 - DNA, 1689 bp, Gossypium hirsutum
gggacgattaccttgcaaaacgcaaactctcccctgtttcgtcctaagaacctctctccaatggcaacttcaaacttgaagcaaacactaggcgatctaaacaaggaatccttcatctcactgctaaccaaaatcataggtgaatccaagttcttacaaaacaacccaccagaactaatcccggaagaagacagggtaatcaaacatgtactagattgtctgctcccttacagcaccacaaccggtggtcctttgatcgttaaccatgtcacttatttccctggtagaggcaatcttattgtggaatatcctgggactcaacccggcaagatcttgtcttttgttggtatgcatatggatgttgtcaccgctaaccccaatgattgggattttgatcctttctcgttgagcatcgatggcgataagcttcgtggccgtggaactactgattgtttgggacatgttgcacttgtgactgaactaatgaagagacttgctgagacaaaaccgaagctagaatcgactgtcgttgcagtttttatagctaatgaagagaactcggcaataactggagttggtgttgatgctttagtgaaggatggtctgcttgataaactgaagggaggcccacttttctggattgatacagctgataaacaaccttgcattggtaccggtggtatgataccatggaaacttcaagtgacggggaagctttttcacagtggtttaccgcacaaggctataaatgcattggagctcggcatggaagcacttaaagaaattcagctacggttttataaagacttcccaccccatccggatgagcaagtatatggatttgctacaccatcaaccatgaaaccaacgcaatggaattatccaggtggtggaatcaatcaaataccaggagagtgtacaatatcgggagatgtcaggttaactcctttctacaatgtaaaagatgtaatgagtaagcttcaagaatacgtagattacataaacgaaaatctaaacaagctagacacacggggtccggtttcaaaatatatcctccatgacgaaaaccttagaggaagccttactttgactttcgacgaggcaacgtccggtgttgcttgtgatctcaattctcgtggattccatgtattgtgcaaagcaactgaagaggctgttggacatgtgaaaccttactcaattaccggaagtttgccactcattcgggagctacaagatgaaggttttgatgttcaaactgctggctacggtttaatggccacgtaccacgccaagaacgagtactgccttctttccgatatgtgccaaggttatcacgtatttaccggcatcatcgctcagctagaggattgaaagatgacaatagattagatatgaacttgcataatagttttctcatcaataataatgacatttgaactgtttgtatgaatatgaccatatcattcaggtccctactgcacaaaatttattgttagtttgttaaatgtggttttatttatttagggctgtttgttgatgcaaattgtaggtaggaaaatgggtaaattatggtttcggtccttctattacgttcaatattaagatttagtccgagcgttttaatttgatataatttagttaatcttagcaggtagcaccatggattgttcataaataattcatcatgtt

SEQ ID NO: 4455 - DNA, 1374 bp, Gossypium raimondii
gggacgattaccttgcaaaacgcaaattctcccctgtttcgtcctaagaatctttctccaatggcaacttcgaacttgaagcaaacactaggcgatctaaacaaggaatccttcatctcactgctaaccaaaattataggtgaatccaagttcttacaaaacaacccaccagaactaatcccggaagaagacagggtaatcaaacatgtactagattgtctgctcccttacagcaccacaaccggtggtcctttgatcgttaaccatgtcacttatttccctggtagaggcaatctcattgtggaatatcctgggactcaacctggaaagatcttgtcttttgttggtatgcatatggatgttgtcaccgctaacccaaatgattgggattttgatcctttctcgttgagcattgatggcgataagcttcgtggccgtggaactactgattgtttgggacatgttgcacttgtgactgaactaatgaagagacttgctgagacaaaaccgaagctagaatcgactgtcgttgcagtttttatagctaatgaagagaactcggctataactggagttggtgttgatgctttagtgaaggatggtctgcttgataaactgaagggaggcccacttttctggattgatacggctgataaacaaccttgcattggtaccggtggtatgataccgtggaaacttcaagtgacggggaagctttttcacagtggtttaccgcacaaggctataaatgcattggagctcggcatggaagcacttaaagaaattcagctacggttttataaagacttcccaccccatccggatgagcaagtatatggatttgctacaccatcaaccatgaaaccaacgcaatggaattatccaggtggtggaatcaatcaaataccaggagagtgtacaatatcgggagatgtcaggttaactcctttctacaatgtaaaagatgtaatgaataagcttcaagaatacgtagattacataaacgaaaatctaaacaagctagacacacggggtccggtttcaaaatatatcctccatgacgaaaaccttagaggaagccttactttgactttcgacgaggcaatgtccggtgttgcttgtgatctcaattctcgtggattccatgtattgtgcaaagcaactgaagaggctgttggacatgtgaagccttactcaattaccggaagtttgccactcattcgggagctacaagatgaaggttttgatgttcaaactgctggctacggtttaatggccacgtaccacgccaagaacgagtactgccttctttccgatatgtgccaaggttatcacgtatttaccggcatcatcgctcagctagaggattgaaag

SEQ ID NO: 4456 - DNA, 1580 bp, Malus domestica
ccacctttttcggaattcccgacctcagccacactcctctctctctctctctctctctctctctctctcgctctctcaatctctttgtccaccacgacccgagaaagccaaaacccacaggaaaagaaatattctgatttcgcaggcagccatggcttcctccaccgacgtgaagaaaatagtaggcgacctggacaaggagtccttcgtatcccttctctccaagcttattggggagtccaagtatctccagaacaacccacctgagctgatccctcaagaggacctagccgtcaagcacgtcctcgattccctgcttccccatagtaccaccacaggcggtgggcttttggtgatcaaacacgtgacctacttccccggcagaggcaacgttattgtggagtacccgggaactgttcctgggaagatcttgtccttcgttggctgtcacatggacgtcgtcactgctaatcccaatgactgggaatttgatccattctcattgagcatcgatggagataaacttcgtggccgtggaactactgattgcttgggtcatgttgcacttgtaaccgagctcatgagaaggctggcagagacaaagccaaaattgaagtcaactgtggttgcagtctttatagcaaatgaagagaattctgccatttcaggagttggtgtggatgcgctcgtaaaggatgggctactcagtaggctaaaggatggtcctctgttttggattgacacagcagataaacaaccttgcatcggtactggtggtatgataccttggaagcttcatgtgactgggaagctttttcacagtggtctggcacacaaggctataaaccctttggagctagctatggaagcactgaaagagatccagttgcggttctatagagattttcctccccatcccaaggaagaggtctgtggatttgctacaccatcaaccatgaagccaacacaatggagttatccaggtggtggaataaatcaaattccagctgagtgcacaatttcaggagatgtcaggttaactcccttctacaacgttaaggatgttatgaaaaagcttcaagaatatgtggatgacattaacgaaaacataggaaatgtagagtcacgaggtccggtttcaaagtatatcttaccagatgaaaacctaaggggaagccttacattaagttttgatgaggcaatgtccggagttgcttgcgatctcaactcccgtggatttcatgtattgtgtaaagctactgaagaggttgttggtcatgtaaaaccgtactcaattactggaagtttacctctcattcgagaactgcaggatgaaggattcgatgttcaaactgctggctacggcttgatggcaacataccatgccaagaatgagtactgccttttttccgatatgcgccaaggctaccaggtgtttgtcagcgttatctctcaactagaagactgagaatctgctaagaaacaaaaacaacttagaagaacgagaataacaagaagttgcaatgataccaaatcacaccaaaaatgagtagtgcctttttctgatgttttccgaggct

SEQ ID NO: 4457 - DNA, 1673 bp, Gossypium hirsutum
caaaactctcccctgtttcgtcctaagaatctttctccaatggcaacttcgaacttgaagcaaacactaggcgatctaaacaaggaatccttcatctcactgctaaccaaaattataggtgaatccaagttcttacaaaacaacccaccagaactaatcccggaagaagacagggtaatcaaacatgtactagattgtctgcttccttacagcaccacaaccggtggtcctttgatcgttaaccatgtcacttatttccctggtagaggcaatctcattgtggaatatcctgggactcaacctggaaagatcttgtcttttgttggtatgcatatggatgttgtcaccgctaacccaaatgattgggattttgatcctttctcgttgagcattgatggcgataagcttcgtggccgtggaactactgattgtttgggacatgttgcacttgtgactgaactaatgaagagacttgctgagacaaaaccgaagctagaatcgactgttgttgcagtttttatagctaatgaagagaactcggctatatctggagttggtgttgatgctttagtgaaggatggtctgcttgataaactgaagggaggcccacttttctggattgatacggctgataaacaaccttgcattggtaccggtggtatgataccgtggaaacttcaagtgacggggaagctttttcacagtggtttaccacacaaggctataaatgcattggagctcggcatggaagcacttaaagaaattcagctacggttttataaagacttcccaccccatccggatgagcaagtatatggatttgctacaccatcaaccatgaaaccaacgcaatggaattatccaggtggtggaatcaatcaaattccaggagagtgtacaatatcaggagatgtcaggttaactcctttctacaatgtaaaagatgtaatgaataagcttcaagaatacgtagattacataaacgaaaatctaaacaagctagacacacggggtccggtttcaaaatatatcctccatgacgaaaaccttagaggaagccttactttgactttcgacgaggcaatgtccggtgttgcttgtgatctcaattctcgtggattccatgtattgtgcaaggcaactgaagaggctgttggacatgtgaagccttactcaattaccggaagtttgccactcattcgggagctacaagatgaaggttttgatgttcaaactgctggctacggtttaatggccacgtaccacgccaagaacgagtactgccttctttccgatatgtgccaaggttatcacgtatttaccggcatcatcgctcagctagaggattgaaagatgacaatagattagatatgaactttcataatagttttctcatcaataataatgacatttgaactgtttttatgaatatgactatatcattcaggtccctactgcacaaaatttattgttagtttgttaaatgtggttttatttatttagtgctgtttgttgatgcaaattgtaggtaggaaaatgggtaaattatggtttcggtccttctattacgttcaatattaagatttagtctgagtgttttaatttgatacaattaagttagttaatcttagcatgtagcaccatggattgtttcataaataattcatcatgtt

SEQ ID NO: 4458 - DNA, 1586 bp, Malus domestica
gccatggcttcctcctccaccgacgtgaagaaaatagtaggcgacctggacaaggagtccttcatatcccttctgtccaagctcattggggagtccaagtacctccagaacaacccacctgacctcatccctcaagaggaccgagtcgtcaagcacgtgctcgattccttgctgccccttagcaccaccacaggcggtggtcccttggtgatcaaccacgtgacctacttccccggcagaggcaacgttattgtggagtacccaggaactgttcctgggaagatcttgtcctttgttggctgtcacatggacgtcgtcactgctaatcccaaagactgggaatttgatccattctcattgagcatcgaaggagataaactccgtggccgtggaaccactgattgcttgggtcatgttgcacttctaactgagctcatgagaaggctggctgagacaaagccaaaattaaagtcaacaatggttgcagtctttatagcaaatgaagagaattcttccatttcaggagttggtgtggatgcgcttgtgaaggatgggctactcagtaagctaaaggatggtcctctgttttggattgacacggcagataaacaaccttgcattggtactggtggtatgataccttggaagcttcatgtgactgggaagctttttcatagtggtttaccacacaaggctataaatcctttggagctagctatggaagcactgaaagagatccagttgcggttctatagagattttcctccacatcccaaggaagaggcctatggatttgcaacaccgtcaaccatgaagccaactcaatggacttatccaggtggtggaataaatcaaattccggctgaatgcacaatttcaggagatgtcaggttaactcccttctacaacgttaaggatgttatggaaaagcttcaagaatacgtggatgatattaacgaaaacatagaaaagttagagtcacgaggtccagtttcaaagtatgtcctaccagatgaaaacctaaggggaagtcttacattaagtttcaacgaggccacgtctggagttgcttgtgatctgaactcccgtggatttcatgtattgtgtaaagctactgaagaggttgttggtcatgtaaagccgtactcaattactggaagtttacctctcattcgagaattacaggatgaaggattcgatgttcaaactgctggctacggcttgatggcaacataccatgccaagaacgagtactgcctttttacagatatgagccaaggctaccaggtgtttatcagcgtgatcgctcaactagaagactgagaatctgagaagaaacaaaagcaaatttgaagaataagaataaaaagaagttgcggtctctggtgtctcaactagacgagagaatcgggggcaaaagtgggtaagaaagaaacttagaaagttgataaataatgagaagttgcaaatggtacctagctaatcatggagacaagtatatattccaataaagaaagcaaaatgttggtataatctttgcttctggtaagggcatatgttctgcactgagttgagtgcatttcgtt

SEQ ID NO: 4459 - DNA, 1665 bp, Theobroma cacao
gcttctgaaacgcaaactctccactttcatccgagtctacggtcaaatggcaacttcgaacgtgaaacaaacactgggcaatctgaacaaggactcgtttgtgtcacttctaacaaaggtcataggagaatccaagtttcttcaaaacaacccgccggaactgatcccagaggaagacagggtggtgaagcatgtactagattgtctcgtcccttacagcacgacaactggaggaggacctttggttgttaaccatgttacttgtttccccggaaggggcaatctcattgtggaatatcctgggactgagcctggcaagatcttatcatttgttgggatgcatatggatgtcgtcaccgctaatcctaatgattgggattttgatcctttctcattgagcattgatggtgataaacttcgtggccgtggaactactgactgtttgggacatgttgcccttgtaactgaactcatgaggaaacttggggagagaaaaccgaaactaaaatcaaccgttgttgcagtttttatagccaatgaagaaaactcagcaataactggagttggtgttgatgcactagtgaaagatggtctgcttgataagctgaagggaggccctcttttctggattgatacagcggataaacaaccttgcattggtactggtggtatgataccctggaaacttcatgtaacggggaagctttttcacagtggtttagcacacaaggctataaatccattggagctgggcatggaagcacttaaagaaatccagcttcgtttttacaaagactttcccccccatccaaatgagcaagtatatggatttgctacaccatcaaccatgaaaccaactcaatggagttatccaggtggtggaatcaatcaaattcctggagagtgtacactatcaggagatgtcaggttaactcctttctacaatgtaaaagatgtaatggagaagctacaagaatatgtagatgacataaatgagaatatagatgagctggacacacagggtccagtttcaaaatatatcctccatgatgaaaaccttagaggaagccttacattgacttttgatgaggcaatgtctggagttgcttgtgaccttgattcccgtggctttcatgtattgtgcaaagcaactgaagaggcagttggttatgtgaagccttactcaattactggaactttgccactcattcgggagctgcaagatgaaggtttcgatgttcaaactgctggttatggtttaatggccacataccatgccaagaatgagtattgccttctttctgatatgtgccaaggctacgatgtgtttaccagcatcatctcccagttagagaactgatgcaataaagtagatatgtcttaatgatcctactcgatacgcatcgtgatcattcccctataaatgattcaacacaatcatatgatatttgagcagtttatatgaatattacgacgcaaatgcccactgcacgcagcttacttgttggcttgtttaatgtgggttttacttatttagtttctaaaagcattcattcttccaaactttggatgggaatttggggtttcctcaagtcaagcgctccattttagctatgtctgatgttcttgggtgaaattttaatgtcagaaattggctcaacgcga

SEQ ID NO: 4460 - DNA, 2136 bp, Theobroma cacao
aggaagagtgccaatgaattctttagatagtctagttttgattaacttggtgtgagatttttttgttttttcaatgcttgaaatatgatttttcatttactatgtgtgaaggtgctatcgagagcgcaagaaaagctaaggaaaaaagaaaatggaaaagcaccgtttcaaatgtaaaaattcaaaggaagagaaggatttatttttaagaagaataaatgaaaacaagattagggtttgattgagtgatagactggttctaatttttgaattggaccaaatcctagcccatggaatacttaatcccatgtcggcctgctttccatgcacctttttttcgaatgcaaaatataaattatacgctgtctccgaggtggagaatcggcttctgaaacgcaaactctccactttcatccgagtctacggtcaaatggcaacttcgaacgtgaaacaaacactgggcaatctgaacaaggactcgtttgtgtcacttctaacaaaggtcataggagaatccaagtttcttcaaaacaacccgccggaactgatcccagaggaagacagggtggtgaagcatgtactagattgtctcgtcccttacagcacgacaactggaggaggacctttggttgttaaccatgttacttgtttccccggaaggggcaatctcattgtggaatatcctgggactgagcctggcaagatcttatcatttgttgggatgcatatggatgtcgtcaccgctaatcctaatgattgggattttgatcctttctcattgagcattgatggtgataaacttcgtggccgtggaactactgactgtttgggacatgttgcccttgtaactgaactcatgaggaaacttggggagagaaaaccgaaactaaaatcaaccgttgttgcagtttttatagccaatgaagaaaactcagcaataactggagttggtgttgatgcactagtgaaagatggtctgcttgataagctgaagggaggccctcttttctggattgatacagcggataaacaaccttgcattggtactggtggtatgataccctggaaacttcatgtaacggggaagctttttcacagtggtttagcacacaaggctataaatccattggagctgggcatggaagcacttaaagaaatccagcttcgtttttacaaagactttcccccccatccaaatgagcaagtatatggatttgctacaccatcaaccatgaaaccaactcaatggagttatccaggtggtggaatcaatcaaattcctggagagtgtacactatcaggagatgtcaggttaactcctttctacaatgtaaaagatgtaatggagaagctacaagaatatgtagatgacataaatgagaatatagatgagctggacacacagggtccagtttcaaaatatatcctccatgatgaaaaccttagaggaagccttacattgacttttgatgaggcaatgtctggagttgcttgtgaccttgattcccgtggctttcatgtattgtgcaaagcaactgaagaggcagttggttatgtgaagccttactcaattactggaactttgccactcattcgggagctgcaagatgaaggtttcgatgttcaaactgctggttatggtttaatggccacataccatgccaagaatgagtattgccttctttctgatatgtgccaaggctacgatgtgtttaccagcatcatctcccagttagagaactgatgcaataaagtagatatgtcttaatgatcctactcgatacgcatcgtgatcattcccctataaatgattcaacacaatcatatgatatttgagcagtttatatgaatattacgacgcaaatgcccactgcacgcagcttacttgttggcttgtttaatgtgggttttacttatttagtttctaaaagcattcattcttccaaactttggatgggaatttggggtttcctcaagtcaagcgctccattttagctatgtctgatgttcttgggtgaaattttaatgtcagaaattggctcaacgcgatgttggtaagcagccgggcaaatagattaggcttaatacaagaatcgaataaaatgagtacgcagtaattaaattcagaaacttgta

SEQ ID NO: 4461 - DNA, 1769 bp, Eucalyptus grandis
atgaaggaagagcaccctacatgtctgagagggctaagaggaaaaacgttatacgattgtgggaataagaataaaaatcaaagagagaagagaatcgcttcatatcgacacttcctcctcctccatatctcgtccttcaaggtttcatcttctccggcgccacctctctctctctctctctcctctgtgtccatcatgggttcttcgtccgacgtgaaggcgacgctgggggatctcgagagggagtcgttcacggccctcctctcgaagctcatcggggaggcccggtacgtccagaacaaccctcccgatttgatcccccaggaggacaggatcgtcaggcacgtcctcgactccctcctccccctcagcacctccaccggcggcggccccctggtggtgaaccacgtcaactaccaccccaacaggggcaacctcatcgtggagtacccggggaccgtgcccgggaagatcctgtccttcgtcgggatgcatatggatgtcgtcacggcggatcctagtgcctgggagtttgatcctttctcgttgagcatcgatggggataaactctgtggtcgtggaacgacggattgtttaggacacgttgccctggtaaccgaactcatgaagaggttgggggagacaaagcccaacctgaagtcaaccgtagttgctgttttcattgctagtgaggaaaattcttccattccaggcgtgggggtggatgctcttgtaaaagatggattgcttaataagctgaaggatggtcctttattttggattgacactgctgataaacaaccttgcattggtactggtggtatgattccttggaaactcaaagctacgggaaagcttttccacagtggtttagcacataaggctataaatcctctggaactggccatggaggcactgaaagagattcagacaaggttttacaatgattttcctccacatgccaaggagcaggtctatggatttgctactccgtcaacgatgaaaccaacccagtggtcttatcctgggggtggaatcaatcaaattcctgcagagtgcacaatttctggagatgtcagattgacaccattctacaatgtaacagatgttgtgaagaagctgcaggaatatgtagatgacataaatgctaacatagagaaattagattcacggggtccagtgtcaaagtatgtcttacctgatgagaacctgaggggaagacttagtataagttttgatgaggcatcgtctggggttgcttgtgatcttaattcccgtggctatcatgtattatgcaaagcaaccgaagaggtcgtgggccatgtgaagccttactcaataacaggaaccctgcctctcatcagggaactgcaggatgaaggctttgacgttcaaacttcaggatatggtctaatggcaacataccatgcaaagaatgagtattgcctcttttctgatatgagccaaggctaccgtgtgttcgccagcgtcatcagccaattagaagattgactctcgacatgaagacataaaaagaccatactgtcagattatcgcctacaagaatttagtcaaatgacaacgaaaattcccaaagaggttatttcctttttttgatgaacaaatttacgcaagagtttgtcaatcgattagacagttgtcaaacaaggttttgcttccctgtattgcttatgcaccatctgtttcacttgaatgaacttggaattataagattatgttgcttaataatatgtcgaccaatctctaac

SEQ ID NO: 4462 - DNA, 1594 bp, Vitis vinifera
ttccagagtctcggcttctttgtctctcgctgactccccatacccatcagaaatggtgaaggacacggtgggcgatctcaacactgactccttcgtaaagcttctctcgaagcttatcggagaatccgaatacgtccagaacaacccgccggaccttatacctcaggaagaccggattgtgaggcatgtcctcgacgcacttcttccctacagcacccaaaccggcggcggaccactcatagtcaaccacgtcacttactttcccggcagaggaaacgtcattgttgagtaccccggcactgtgcctgggaagatcttgtcctttgttggaatgcacatggatgtcgtcacggccaaccctaacgattgggattttgatcctttcacactgagcattgatggggataaacttcgtggccgtggaactactgattgtttagggcatgttgcacttataactgaactcatgagaaggctaggagagaccaagccaaaactgaagtctactgtggttgctgtcttcatagccaatgaagagaactcggctatttcaggggttggtgtggatgctctggtaaaagatggattgctgaataagctaaaggaaggtcctctgtattggattgacacagcagataaacaaccctgcattggtactgggggtatgatcccatggaaacttagagtgactgggaagctttttcatagtggtctaccacacaaggctataaatccattggagctagccatggatgcagttaaagaaatccagctgcgtttctatagagatttccctccccatccaaaggagcaaatctatgggtttgcaacaccatcaaccatgaagccaactcaatggcattatccaggaggcgggatcaatcaaattccagctgagtgtacgatttcaggagatgtcaggttaactccattttacaatgtgatagatgtaatgaagaagttacaagaatatgtagatgacataaataaccacatcgagaggctagaatcacggggcccagtttcgaaatatgtcctaccagatgaagacctaaggggaagccttacaataagttttgatgaggcaatgtctggagttgcttgtgatcttaaatctcatggcttccatgtactatcgaaggcaactgaggaggtggttgggtatgtgaagccttactcaatcactgggagtttgccgctcattcgtgaactgcaggatgaaggctttgatgttcaaacctcaggctatggtttaatggcgacataccatgccaagaatgaatactgccttctttctgatatgtgccaaggctaccaagtgtttgtcagcatcatttcccagttggaagattgacactgctgactgctaaatcataccagcaaacataaaatatgcaaatgcttaaataaactcatgaacttttcttctctaatcctttcagtattaaagggattgtataagttttcaaagccagttacttgttttacatgcagggcttacgtttcttgatttgatattgactgcctttagttttgttttccttccccttctctatgttttcagacaatctcatgctcaacatactaagattct

SEQ ID NO: 4463 - DNA, 2847 bp, Vitis vinifera
aacggtttccagagtctcggcttctttgtctctcgctgactccccatacccatcagaaatggtgaaggacacggtgggcgatctcaacactgactccttcgtaaagcttctctcgaagcttatcggagaatccgaatacgtccagaacaacccgccggaccttatacctcaggaagaccggattgtgaggcatgtcctcgacgcacttcttccctacagcacccaaaccggcggcggaccactcatagtcaaccacgtcacttactttcccggcagaggaaacgtcattgttgagtaccccggcactgtgcctgggaagatcttgtcctttgttggaatgcacatggatgtcgtcacggccaaccctaacgattgggattttgatcctttcacactgagcattgatggggataaacttcgtggccgtggaactactgattgtttagggcatgttgcacttataactgaactcatgagaaggctaggagagaccaagccaaaactgaagtctactgtggttgctgtcttcatagccaatgaagaaaactcggctatttcaggggttggtgtggatgctctggtaaaagatggattgctgaataagctaaaggaaggtcctctgtattggattgacacagcagataaacaaccctgcattggtactgggggtatgatcccatggaaacttagagtgactgggaagctttttcatagcggtctaccacacaaggctataaatccattggagctagccatggatgcagttaaagaaatccagctgcgtttctatagagatttccctccccatccaaaggagcaaatctatgggtttgcgacaccatcaaccatgaagccaactcaatggcattatccaggaggcgggatcaatcaaattccagctgagtgtacgatttcaggagatgtcaggttaactccgttttacaatgtgatagatgtaatgaagaagttacaagaatatgtagacgacataaataaccacatcgagaggctagaatcacggggcccagtttcgaaatatgtcctaccagatgaagacctaaggggaagccttacaataagttttgatgaggcaatgtctggagttgcttgtgatcttaaatctcatggcttccatgtactatcgaaggcaactgaggaggtggttgggtatgtgaagccttactcaatcactgggagtttgccgctcattcgtgaactgcaggatgaaggctttgatgttcaaacctcaggctatggtttaatggcgacataccatgccaagaatgaatactgccttctttctgatatgtgccaaggctaccaagtgtttgtcagcatcatttcccagttggaagattgacactgctgactgctaaatcataccagcaaacataaaatatgcaaatgcttaaataaactcatgaacttttcttctctaatcctttcagtattaaagggattgtataagttttcaaagccagttacttgttttacatgcagggcttacgtttcttgatttgatattgactgcctttagttttgttttccttccccttctctatgttttcagacaatctcatgctcaacatactaagattctgcaatagattgtgccctacatcagttgcagtttgtctgactaatttctttttgcaggccgagtagaaactgtcttggttaatagaaattagaatatgagagaatagtttatcggtaaaaataaaaaataaaataaataaacaaataagccatgaatgcaatccccttagtattatgaaattttgtatatattgtttgtatacaattattcctacgttctacttcctctgagattcgtccaagacacaacaggctctgctacataatatacaaatctgatccaaacccagctacccctttacacatgttcatgatttattttttacttctgtcttaagctgctggaccctctggcgcagtcttctgcggtggtcgtgaatcttccaaaggccgtgtcccagtataacagtggagtatataccgtgtgtgatgatgggagcaagaatattatttgtctgacatttgcatcagaaaaattacagcaaaatttatcaggtttcgatctctgacgttaagccagcagttagtttaataatcacaaagagtaggtaaccagggttacctggatccattcaaacccaagataaagggctaggagtccttccagaagtggagagtagatctttttcatttgccttctttcataccaggctgcacaatgttcaacagaaatagacaagggtgaaggacccatggtattcactattcatttatcaaaaatatccaccaccccaaaaacataagtaacaccatgaagctattcacagattaataagtcgaggaacaaggattaaacctgcaaagagcttttttagatccgcacgaccggagcgagattgcaaaactggtgcaaccacataagtaggatctgatgtggaaaaagaaacttgtaaatcaaagtgtaggaaatgaaatgattaggtacattgtttaaaagaggtttgatataatcaaccttttggagaggcagccacataatagagggaaccagtaagagcagctgtgattacagctgcaaacgcctgggcaaatggcacaaatggaggcagcactccagtctacaatttgaagaattcacagtaagatataaattcagttgtcatgacagtccgaaaccaaggaaggagctcttaccagagatgtcatccctcgagcatcggtcacaaaattggtgccccttagaaatatatcagccaatgctccctacaacaaatatcacaatttctcatatcactagtagcatcaaag

SEQ ID NO: 4464 - DNA, 2035 bp, Populus trichocarpa
ggcaacagtgtcaattagcataaattccaagcaaaggagatccgtttcgcagctttatagagactccacatacagagagagttacagcattttgtcaacagactctctctctcagtctctcaccgagacactacaagctaatgaccgatattgaacaaatcctaggagacctgaacaaggactcctttgtttccctcttgaaaaacatcattggggagtccaaatatgtccagaacaacccaccagagttgatccctgaagaagacagggttgtcacacatgtattgaattctcttctcccctacagcaccaccactagaggaggtcccttgattgtgaatcatgtctcttgtttccctaaaagaggcaatcttattgtggagtaccctggtacagaaccaggaaagatcttgtcttttgttggcatgcacatggatgttgttactgctaatcccaatgattgggagtttgatccattttcgttgagcattgatggggaaaaacttcgtggccgtggaaccacggattgtttgggacatgttgctcttgtgactgaactgatgaagaagttgggggagacgaagctgaaattgaagtcaacagtagttgcagtctttatagccaatgaggagaattcttccataacaggggtcggtgtggatgcacttgtgaaagatggtctgctcaataagctgaagggaggccctctattctggattgacacagcagataaacaaccttgcattggtactggcggtatgattccttggaaacttcacttcaccgggaaactttttcatagtggtttaccacataaggctataaatcctttggagctggggatggaggcacttaaagagatacagtctcgattttacgaggacttcccaccccataaggaagagcaagtatatggatttgcaacaccatcaacaatgaagccaactcaatggagttatccaggaggtgggatcaatcaaattcctgctgagtgtacaatttcaggagatgtcaggttaacacccttctatagtgtcaaagatgtgatggacaaactacaagaatatgtggatgaaataaatgagaacattgagaagcttgacacaaggggcccggtttcaaaatatgtcctcccagaagaaaacctgagggggagccttactgtgaccttcaatgaagcgtcatctggagttgcctgtgatcttaaatcccgtggctttgaagtgttgtgtaaagcaactgaaaaagtagttgggcatgtaaagccttactcaatcacagggactttgccactaattcgagagctgaaagatgaaggttttgatgttcaaactacaggctacggtttaatggccacatatcatgccaagaatgagtactgcctgctttctgatatgtgccaaggctaccagattttttccagcatcatcagtcaattagaagcttgatttgcaacgaagtggatgtcataacaataccaccagattctagatgagaagcgtgttatgttaaagaaataaatgactatcatgtaaactctgttaatttctagttttgaagggcatccaatatgcttcttttttctctttttctttttttttcgagttgccccagcttcctggaaattggaacgtgatgtttccaatatatatctggattttgttccatttatagtttgtccttggcttgtagtagatttggcacttggacattaagcgatgattctcatatccagcattcctcgcattgagctcccctggcaggactagctgcgtggatgtgttctctcactaatttgggtgtatctcgaaatgggtaaatcctaaactagctcatttttcgttctttctttcttcaggttctggacgaggaagctcattgattctcttgattttatcgttatgtaattttctaggattttgtatacatgtaagctcaagtcacgactaaatactaaaatgtacatatcgctaaattatgtcatgatattagacaagtaatttttaaagttttttaaatttattgaatttttttt

SEQ ID NO: 4465 - DNA, 1831 bp, Populus trichocarpa
aaaaaaggactttcgcaacttaacactctctctttctcacgcacagacacaacaccctaatggctgatattgaacaagtcctaggagacctgaacaaggattcctttgtctcactcttgacaaacctcattggagagtccaaatatgtccaaaacaaccccccagagctgatccctgaagaagacagggttgtcaagcatgtgttgaattctcttcttccttacagcaccaccactggaggaggtccactgattgtgaatcatgtctcttatttccctcaaagaggcaatcttattgtggagtaccctggtaccgaacaaggaaagatcttgtcttttgttggcatgcacatggatgttgtcactgccaatcccaatgactgggagtttgatccattttcattgagcatcgatggggaaaaacttcgtggccgtggaaccactgattgtttgggacatgttgcccttgtgactgaactgatgaagaagttgggggagacaaagccaaaattgaagtcaacagtagttgcagtctttatagctaatgaggagaattctgccataacaggggttggcgtggatgcacttgtaaaagatggtctgctcaataagctgaagggaggtcctctatattggattgacacagcagataaacaaccttgcattggcactggtggtatgattccttggaaacttcatgtcactgggaaactttttcatagtggtttaccgcataaggctataaatcctttggagctgggcatggaggctcttaaagagatacagtcacgattttacagggactttccacctcataaggaagagcaagtatatggatttgcaacaccatcaactatgaagccaactcaatggagttatccaggaggtgggatcaatcaaattcctgctgagtgtacaatttcgggagatgtcaggttaactcccttctacagtgtcgaagatgtgatgagcaaactacaaaagcatgtggatgacataaatgagaacattgagaagcttggcacaaggggcccggtttcaaaatatgtactaccagaagaaaacctaagggggagtcttgctgtgacctttgatgaggcatcgtcaggagttgcctgtaatctaaaatcacgtggctttgaagtgttgtgtaaagcaactgaaaagatagttgggcatgtaaaaccgtattcaatcacagggactctgccactaattcgagagctgaaagatgaaggtttcgatgttcaaactgcaggctatggtttaatggccacataccatgccaagaatgagtactgcctgctttctgatatgtgccaaggctaccagatttttaccagcatcatctctcaattagaaaattgactcgcagcgaagtggatgacataacaacaccaccagattccagatgagtagcttgttacgttatagaaataaatgattgtcatgtaaactctgttaatttgaagttttgaagggcatctaatatgctttttcagcaagagttgcctgctgcttggaatatgatgtttctgtttttcatctggatattattccatttatagcttttccttgcctcgtagtagatttggcgcttggacagtcatttgatgattctcataaacaactttccttgcattcagctcccctggcaggctgctttcacttggttcttaaataaaaaggatggaaaagacttgagcttaaacatttatagctatttaattacctgtgctacgctacttgtgggattccaagatattttttaacacaatagaatgaagaatgtgttggtattgtgactgtattttcttgcatcacgaaaatga

SEQ ID NO: 4466 - DNA, 1616 bp, Manihot esculenta
aaccgaatattttatctttcactttcactgcattataagaatccagtccatctagtaggcaaaagtagcatcctttactgaacatatcctctctctttccatggctaacgtcgaagaaatcctaggagaactggacaaggagtcatttgttaccctcttgagaaagatcataggagagtcgaaacatgtccaaaacaacccacctgagctgatcccagaagaggacagggtggtgaagcatgtcttggattctctcctcccttacagcaccacctctggaggaggtcccttgattgtgaatcatgtctcttatttccccggtcgaggcaatcttattgttgagtatcctggcactgagcctggaaagatcctgtcatttgttggcatgcatatggatgttgtcactgctaaccccaacgattgggagtttgatccattctcattgaccatcaatggggataaactttgtggccgtggaactactgattgtttgggacatgttgctgttgtgacagaactcatgaagatgttggccgagaaaaagcctaaattgaaatcaacagtagttgctgtcttcatagctaatgaagagaattctgccataacaggagtcggtgtggatgcgcttgtgcaagatgggctgcttgataagctgaaaggaggacctctattctggattgatacggctgataaacaaccttgcattggtactggtggtatgataccttggaaacttcatgtgacagggaagctttttcacagtggtttagcacataaggctataaattctttggagctagccatggaggcacttaaagagatacaatcacgattttataaggactttccccctcatccaaaagaacaaaactatggatttgcaacggcgtcaacaatgaaaccaactcagtggaattatcctggaggtgggatcaatcaaattcctgctgaatgtacgatttcaggagatgtcaggttaactcccttctacaatgtcacagatgttaaaaaaaagctacaagaatatgtggatgacataaatgagaacatagagaagctagatacaaggggtccagtttcaaaatatgtcctacctgatgaaaacttaaggggaagccttactttgacttttgatgaggcgatgtctggagttgcatgtgatcttgattctcgtggctttcatgtattgtgtaaggctactgaaaagatagttgggcatgtaaaaccatattcaatcactggaagtttgccactgattcgagagttgcaagatgaaggttttgatgttcaaactacaggctacggtttaatggccacatatcatgccaagaatgagtattgcctactttcagatatgtgccaaggctacaaagtttttgtgagcatcatctcccagttagaagattgatcataaacatcacttaacgcccagattatccccactagattacctcatgaacatgttatttatagacgcaaacaattgctgataagggatgctaatctactcctaataaaaggcttaagattggtcatgtttcactcttgtgctatacaagttaccgtccagaacttcaaacttgatcttataatatatatattttttggcagttcaa

SEQ ID NO: 4467 - DNA, 1439 bp, Heritiera littoralis
aatggcaacttcgaacgtggaacaagcactaggcaacctaaacaaggaatcttttgtgtcacttctaacaaagatcataggggaatccaagttccttcagaacaaccctccagaactgattccggaagaagacagggtagtgaaacatgttctggattgtctcctcccttacagtacaacaactggagcaggacctttggttgttaaccatgttacttattttcctggaagaggcaatctcattgtggagtatcctgggactgagcctggaaagatcgtgtcttttgttgggatgcatatggatgttgtcactgctaatcccaatgattgggattttgatcctttttcactaagcattgatggtgataaacttcgtgcccgtggaactactgattgcttgggacatgttgtccttgtaactgaactcatgaggaaacttgctgagacaaaaccaaaactaaaatcaactgttgttgcagtttttatagccaatgaagagaactctgcgataactggagttggaattgatgcactggtgaaagatggtctgcttgataagctaaagggaggccctcttttctggattgatacggcggataaacaaccttgcattggtactggtggtatgataccgtggaaacttcatgtgactgggaagctttttcacagtggcttagcgcacaaggctataaatgcattagagctaggcatggaagcacttaaggaaatccagctgcagttttataaagactttccaccccatccaaaggagcaagtatatggatttgctacaccatcaactatgaaaccaactcaatggagttatccaggtggtggaatcaatcaaattcctggagagtgtacaatagcaggagatgttaggttaactcctttctacaatgtgaaagatgtaatggagaagctacaagaatatgtagatgacataaatgaaaatatagacaagctggacactcggggtcctgtttcaaaatatatcctacatgatgaaaaccttagaggaagccttacactgacttttgatgaggcaatgtctggagttgcttgtgatcttgattctcgtggcttccatgtattgtgcaaagcaactgttgaggcagttgggcatgtgaagccgtactcaattactggaagtttgccactcattcgggagctgcaagatgaaggttttgatgttcaaactgctggctacggtttaatggccacataccatgcgaggaatgagtactgccttctttctgatctgtgccaaggctatcacgttttcaccagcatcatctccctgttagaggattgagacaactaattatatatgaactagataaggatcataatcttcataatcattccccacataaatgatgcaaaatcatacgatattttagcagtttatatgaatattactatgtatgtgcttattg

SEQ ID NO: 4468 - DNA, 1626 bp, Euonymus alatus
aatggctacttcgcaaattaagcaaaccctaggagacatggacaaggagtcctttgtctccctcctcaggagcctaattggtgagtctcggtacgtgcagaacaacccaccagagctgatacccgaagaagacagagtggtcaagcacgtcatgaactctctcctcccttacagcaccacctccggaggaggtcccctgattctcaaccatgtcgcttacttccctaacgaggggcaatctcattgtggaataccctggcactgttcctgggaaagttctctcctttgttgggatgcacatggatgttgtcactgcaaatcctaatgactgggaatttgatccgttctcactgagcattgatggggataaacttcgtggccgaggaactactgattgtttggggcatgttacccttgtaactgaacttatgaagaggcttggggagacaaaaccaaaattgaagtcgagtgtggttgcagtctttatagcaagtgaagagaattcttccataccaggggttggtgttgatgcacttgttagacaaggcctgttagataagctgaagggagggcctttattctggattgacacagctgataagcaaccttgcattggtactggtggcatgataccttggaaacttcacgtgacagggaagctttttcacagtggtttagcgcacaaggctataaatccactggagttgggcatggaagcaataaaagagatacaatcccggttttatagagattttcctccccatccaaaggagcaggtctacggatttgcaaccccatcaactatgaaaccaactcaatggagttatccaggaggtgggataaaccaaattcctggagagtgcacaatctcaggagatgtcagattgactcccttttatagcgttacagatgtcattcaattgcttagagaatatgtggatgacataaatgaaaacatacagaagctagaaacaaggggtcctgtttcaaaatacatcctaccagatgaaaatttgaggggaagtcttacaataacttttgatgaggcaaattctggagttgcttgtgatcttgattctcgtggctttcatgtcttgtgtaaagctactgaggaggtagttgggcatgtaaagccttattcaataactgggagtttgccactcattcgtgagttgcaagatgaaggctttgatgttcaaacttcaggctatggtttaatggccacataccatgccaagaatgagtactgccttctttctgatatgtgtcaaggctaccagattttcgtcagcatcatcgaccaattagaagactgaccgtctgaagaggacgtgtgctaatgaaattaagcaagttcatctgattgtgagattttcgatagttgcacaaggaaataaaagaagcaaaagcataaatcatataaatccgtgggagatagtgatatgcttcttcatacaataataagcaattccatattttgatttgattttttgatcagtaggctgcaattcttgctgttgatcatagtatgcttctgatccctgatgtagttatctattgctgtcaatagctaaaatgtacgtctactgccttaaaagtactgaataaactatatgctcttctgaa

SEQ ID NO: 4469 - DNA, 2304 bp, Ricinus communis
tccaattcactcaaattctcaaaaaagaaaaaaagaaaaaggaatccaattcagtagcagcacgcagcagagtaaccgaatattttatctttcactttcactgcattataagaatccagtccatctagtaggcaaaagtagcatcctttactgaacatatcctctctctttccatggctaacgtcgaagaaatcctaggagaactggacaaggagtcatttgttaccctcttgagaaagatcataggagagtcgaaacatgtccaaaacaacccacctgagctgatcccagaagaggacagggtggtgaagcatgtcttggattctctcctcccttacagcaccacctctggaggaggtcccttgattgtgaatcatgtctcttatttccccggtcgaggcaatcttattgttgagtatcctggcactgagcctggaaagatcctgtcatttgttggcatgcatatggatgttgtcactgctaaccccaacgattgggagtttgatccattctcattgaccatcaatggggataaactttgtggccgtggaactactgattgtttgggacatgttgctgttgtgacagaactcatgaagatgttggccgagaaaaagcctaaattgaaatcaacagtagttgctgtcttcatagctaatgaagagaattctgccataacaggagtcggtgtggatgcgcttgtgcaagatgggctgcttgataagctgaaaggaggacctctattctggattgatacggctgataaacaaccttgcattggtactggtggtatgataccttggaaacttcatgtgacagggaagctttttcacagtggtttagcacataaggctataaatgccttggagctagccatggatgcacttcaagagatgcaatcacgcttttacaaggactttcctcctcatccaagagagcaggtctatggatttgcaacggcatcaactatgaaaccaactcaatggagttatcctggaggagggatcaaccaaattcctggggagtgtacaatttcaggagatgtcaggttaactcccttctacaatctagtagacgtgaagaatatgctacaagagtatgtggatgacataaatgagaacatagagaagttaggtacaagaggtccagtttcaaaatatgttctacctgacgaaaacctgagagggagcattactctgacctttgaagaggcgatgtctggagtggcatgtaatcttgattctcgtggctttcatgtattgtgtaaggcaactgaaaaagtcgttggtcatgtaaagccatactcgatcactgggagtttgccactgattcgggagttgcaagaggaaggctttgatgttcaaactgctggctatggtttaatggctacataccatgccaagaatgagtactgcctgctttctgatatgtgccaaggctaccgagtttttgttagcatcatctctcagttagaagattgatcataaacatcacttaacgcccagattatccccactagattacctcatgaacatgttatttatagacgcaaacaattgctgataagggatgctaatctactcctaataaaaggcttaagattggtcatgtttcactcttgtgctatacaagttaccgtccagaacttcaaacttgatcttataatatatatattttttggcagttcaataattgttatgttgtccgcatgaagagtgccttaaatttagaaaattaatgaaaaaagaaattactagtgcaattttggcttattcgtttctggcatttatagcttagagttcatattctacaacattcgctctaaaaacaacaccccttggaagagacatttgcaaaagggactagctcttttatgctcatttaccctctcctacaagtatacttcctatgcttgtttatgtttacaacaatttcggggcctataaatatacacaatctgattctacattttacagacaacagtatatatcctcacctgaaatgaacaattatctcagcatgtagcattcaagtttctcgctcttttttccttctcacatagctacttcatttccttgttgagtttattctatcaaatttaagctgctgtattctctggcgcagccttctacgatggtcatgtatcttccaaagtccatgtcccaacacaacggccgaatatatgccatgtgtaatcattggtgcaagaatattatttgtctgcaaaatttatcagaatattttaatgaagcataaatctgttagtttgagccttctaaacgcagtcaataaatatgtctttaa

SEQ ID NO: 4470 - DNA, 1826 bp, Fragaria vesca
tatataatcggttatgaatgactaaaagaaaaaataaaatggactgaaaatactctatagttcggtccaatctcataatattttctctttttcaactccaattcgttatatacactccactctctccctttctcattctctctcgtcgatcaccgaagattccgactagctctgtcaaccatggacgtgaagaaaaccctaggcgacctcgacaaggagtccttcatcaccctcctctccaagctcatcggcgaggccaagttcgtccagaacaacccgccggacctgattccccaggaggaccgagttgtgaagcacgttctcgactcgctcctcccactcagcaccaccaccggcggcggacccttgctcatcaatcacgtgacttactaccccggcaggggcaacgtgattatcgagtacccggggactgtccccggcaaagtcttgtcctttgtggggtgccacatggacgtcgtcactgccaatcctgaagactgggaatttgatcccttctccttgagcattgatggggacaaactgtgtggacgaggaaccactgattgcttagggcatgttgcacttgtaactgagctcatgaaaaggctggcagagacaaaactaaaactgaagtcaactgtggtagttgtcttgatagcaaacgaagagaactctgccatttcaggagttggtgtggatgcacttgttaaggatgggctactcaataagctaaaggatggtcctttgttttggatagatacagcagataaacaaccatgcattggtactggtggatcgataccttggaagcttcatgtgaccgggaagctttttcacagtggtttagtgcacaaggctataaaccctttggagctagctatggaagcattgaaggagatccaatcacggttctatagagactttcctccccacgagaaggaaaaggtgtatgaatatgcaacaccatcaactatgaaaccaacccaatggagttatccaggtggtggaataaatcaaattccaggggagtgtacaatttcaggagatgtcaggttgactccattctacgatgttaaggacgtgatgaaaaagcttcaagaatatgtggatgacattaatgaaaacataacaaagctagacacacgaggtccagtttcaaagtatgccctgcctgatgaaaacttacggggaaggcttacaataagctttgatgaggcatcatctggagttgcttgtgacttggagtcttgcggctttcatgtgttatgcaaagctactgaagaggttgttggccatgttaagccttactcgattaccggaactttgcctctcattagagaactgcaggatgaaggattcgatgttcaaacttccggctatggtttgatgtctacataccatgccaagaacgagtactgcttgttttctgatatggcacaaggctaccgggtgtttgcaagtgttatctcccaactagaagattgaggatcagcaaagaagaaagtaccagaattaaagatttagaataatgagggaaactacaagtgggaaatggtagtgcaaaatcatactttgaacactgcatttgttctttttagatgccaagctgacaagttactgcaattaaactgcatatcctggtttagttacagtagcttcacacataccataggaaaacttgtcttactttgtagcttggtggagaatatgaccttacttcaagcttagagatcggtgttgaaaacttgtctgactaatagctatcttttatgtattgaagtttctttcatttccttctcatttggttttcttaaaacatagtcaaa

SEQ ID NO: 4471 - DNA, 1485 bp, Carica papaya
tttcctccatttccaacacataaacctccctgtattgcgtatcacgcagttcatcactgaagtcatgccatcctgcaacgcgctcagagaaaccctaggctttcttaacaaggaatcattcctctgccttctgactaagttaatcggagaatcaaagtacgtgcaaaacaatccacccgagttgattccagaggaggacagggtggtcaagcatgtactggattccctccttccgtacagcaccaccactggcggaggacccctcgttgtcaaccatgtcagttactttccttgcagaggaaatctgatcgtcgagtatcccggcaccgttcccgacaagatcttgtcgttcgttggcatgcacatggatgttgtcactgctaatcctaatgattgggaatttgatccattttcactgagtattgatggcgataaacttcgtggccggggaaccactgactgtttggggcatgttgctcttgtaactgagcttatgaggactttaggtgagaaaaaacctcaattaaaatcctctgttgttgcagttttcatagcgaatgaggagaattctgccataactggggttggtgtggatgcgcttgtgaaagatggactccttgataagcttaaagagggtcctcttttctggattgacacagctgataaacaaccatgcattggtactggcggcatgattccttggaaacttcacgtgactgggaaactttttcatagtggtttagctcacaaggctataaattctttggagctagcaatggaagcacttaaagaaatccaatctcgattttataaggacttcccaccacatccaaaggaggaggtttatggatttgcaactccatcaaccatgaaaccaactcagtggagttatccaggcggtggaatcaatcaaattcctgctgagtgcacaatatcaggagatgtcaggttaactcctttctacaatgtaaaggatgtgatgcagaagctgcaggaatacgttgatgacataaatgagaacatacatcagcttgatacacggggcccggtctcaagatatacactacctgatgaaaatctgaggggaagccttacaataatttttgaggaggcaatgtctggagttgcttgtaatctcgactctcgtgggtttcatgttctgtgtaaagcaactgaagaggcagtcggccatgtgaaaccttactcaataacagggagtttgcctctcattcgggagctacaagaagaaggctttgatgttcaaactgcaggttatggtttaatggcaacatatcatgcgaagaacgagtactgccttctttctgatatgtgccagggctatgatgtttttgtgaagataatttcggatttagaagaatgatagaacatcgaagtttttgtttcaaaggcaatataatgccgggatgaagtcactttgacgtttcaatttggtaccataatctgataataagtttttggtgattg

SEQ ID NO: 4472 - DNA, 2554 bp, Vaccinium corymbosum
catattctccacggcgtctccttccgtaaaagaggctctcggtgacctaaacaaagagtccttcgttaccctcctttcaaagctgatcggagagtccaagtacgtgcagaacaatccacccgagctaatcccagaggaggacaggatcgtgaggcacgtgctcgacgtcctcctccccctcagcaccaccaccggcggtggcccactcatatgcaaccacgtcgcttaccatcccaacagaggcaaccttattgtcgaataccctggaactgaaccagacaagatcttgtccttcgttggcatgcacatggatgttgtcactgctaacccaagtgattgggattttgatccattttctttgggtattgatggggataaactctctggccgtggaacgaccgattgtttagggcatgttgctcttgtaactgaacttatgaggaggttgggcgagacaaagccaaagttgaagtcgactgtggttgcagtattcatagccagtgaagaaaactcatccatcactggagttggtgtggatgcattagtgaaagatggcttgcttaataagttaaaggatggtcctctgttttggattgacacagcggataaacaaccttgcatcggtactggtggtatgataccatggaaacttcatgtcatgggaaagctttttcacagtggtcttccacacaaggctataaatccttggaactagctatggaagcactcaaagagattcaattgcggttttaccgagattttccgctcatcccaaagaacaagtctatggttttgcaacaccatcaactatgaaaccaactcaatggagctatccaggaggcggtatcaatcaaatcccaaaaagagtgtacaatttcaggagatgtcaggttgactccattttacaacgtaacagatgttatgacaaagctacaagaatatgtagaagacttgaacgccaacccagagaagctagatgtgcggggaccagtttcaaaaatatgtcctaccagacgaaaaaccttagggggagaattactataagtttcaatgaggcatcgtctggagttgcttgcaatcttgattcgcgtggcttccacgtattatgcaaagccacagaagaagctgttggccatgtaaaaccctactctatcactgggactttgcccctcattcgagaactccaggatgaaggctttgatgttcaaacttcaggctacggtttaatggccacataccatgcgaagaacgaatactgccttctttctgatatgtgccaaggttaccaggtatttgccagcatcatttgccaattagaagactgatgttccacaaccgaagaaggaagcgcaaaccaattaccccatagcaaaatgcattaaaaactgctaacttcaagaaacatgaaaaattgttacagttaccatttctggtttaccggattatctttgacagtggaaaatttggtctatacagactgatgctattcaactgtttaaattattcgtatgcattataattctgtcatacatctgtaaatatagcaggattatctactcagtataatcgagctctgctacaagcactatacaaatttcctccctatccaactacgaacttggtattatgcgacactaaaatttaccagagctcttcccttcttgtttgagttgctggatccgttggtgtagtctccgtctgtggtcgtgaatcttccaaaggccgtgccccaatataacagcagagtatatgccgtgtgttataatgggcgcaagaatattattcgtctggatccattcaaaccctaggtaaagtgctagaattccttccagcaggggagagtagatctttttcatttgtctcctttcataccaagccgcgaagagcttttttagatcttgacgaccagagttcgattgtagaactggtgcaactacataagtaggatcttttggagacgcggccacataatagagtgaaccagtaagagcggccgtgatcactgctgcaaatgcctgagcaaatggtacaaatggaggcagcactcccgtcagggatgccattccatgagcatccgtaactaaatcactgctccgcagaaatatatcagccaatgccccctgaacagcagcccggtagaaaagctcctcaccaacagagctcgcggcaacaatgagtatgaactgccaaggcgccattccgtagaagaagctcctcagctcctcatcctctacatccctaatagcacgagcttgaggcgataccttcacaacttcatcatcgagtataaacagcagagccatgattggaggagcggcgtatccaagtccttctacgattgcatctaatgacggatcaaaacctcccatggaatcgattcctgtaaccgaacatatgaatcttccagctaatcccattgcaacgtatataccaattccataactgagtcggacaacagctccgatttgctcccaaacggcgagctcagcttctcctaaggcgccattgaatgtggtcacctccatagcagagctcgtgtaccctaccccaccac

SEQ ID NO: 4473 - DNA, 1654 bp, Tropaeolum majus
aaagaacacataaaaaattgcatcacaactcgctgctgcgctctaacaactcgtaacagaatctctctctggtactatggcatcttccgatgtagtaagaaaaatgctcggttctctcgacaaggaatccttcgtttctctcatgactaaagtaataggagaatccaagtacgttcaaaacaatccaccggacttgattccggaggaagacagggtggtcaagcatgtaatggattctctactcccttacagcaccaccaccggaggaggacctctggtgatcaaccatgtcagttactttcctggaagaggcaatctcatagtggagtaccctggcaccgtccccgggaagatcttgtccttcgttggcatgcacatggatgtcgtcactgcaaatcctaacgattgggaattcgatccatttgcattaagcattgatggtgataaacttcgtggacgtggaactactgattgtttggggcatgttgctcttgtaactgaactcatgaagaagctaggggagactaaaccgaagttgaaatcaaccgtggttgcagttttcatagccagtgaagagaattcatccataatgggggttggtgttgatggactagtgaacgatgggcttcttgataagcttaaagggggtccactttattggatcgatactgccaataaacaaccttgtattggtactggtggcatggtaccttggaaacttcatgtcactgggaagcttttccatagtggtttggctcataaggctataaatcctttggagctagccatggacgccgtgaaagatatccaaactcgattctaccaagattttccaccccatccaaaagaacagatctatggatatgagacaccatctaccatgaaaccaactcaatggagttatcctggaggtggaatcaatcaaattcctgctgaatgtactatatctggggatgtcaggttaactccgttttatgatgtaaaagatgttatgaagaagctacaggaatatgttgatgaaataaacgagaacatacagaaatttgattcaagaggtccagtttctaaatatagtctaccagacgaaggtctcaggggaagtcttacaataacttttgacgaggcaaactctggagtagcttgtgatcttgattctcgtggctttcatgttctgtgcaaagcaactgaagaggtagttgggcatgtaaaaccatactcaatcaccgggagcctacctctcattcgggaacttcaagatcaaggctttgatgttcaaacttcaggctatggtttgatggaaacatatcatgccaaaaatgagtactgcctcctctccgatatgtgccaaggctacgacgtgtttgctagcatcataacccaactagaagattaaatatcgtcgcactgacgataccaacacacaaacatggacccgaacacaccaataacatttgtcacaaatagatcaagggaacttgattttattgataagattgttcatgaaaagagaaacttaccaataccatttacaagttgcagtgcagtgcattttacatgtatgtactgccaataacaacaatagaatgatttgtcaagactaaaaaaaaaaaagaaacggccgagatcccacgagcacaggaggtagagccccccc

SEQ ID NO: 4474 - DNA, 2974 bp, Lippia dulcis
aaaacaatgggtataacttataagacataaaaccaacggttctcatctctccgtcccaaaaatcttcacaccccacgaccatgctcaaccttcacggcactgtgttatcacggctatttccccactgattttcatagccaaaagggtcctcctgtctgagcaagatggagctttcgttgctgtctttgtctccgaaaccgcctacgacggcgccgttttggagtcgccctggaggtttaaacaatcatttcgttacgcccatggatgtgatgaagaagagaagaacgagagagtattgcgtggtgagggcggaggggaatggtggtgaagcggtggagagcagagagagagagagcggaggagggtacagggcttcggctatggaggtgaccacattcaatcagagctttaatgacgctgctgattttcctgtctgggagaaaattggtgctattgttagactcggttatggaattggaatctatggtgcaatggctttggctggaaggtttatatgctcgatttctggtatcgattgcaatggaggatttgatctaacattagatgccattgttgaaggattgggatatgcagctccgccaattatggcccttctctttatactagatgatgaagttgtgaaactgtctccttatgcccgtgcaataagggatgttgaggatgaggagttaagaagcttcttttacgggatgtccccgtggcagtttatgctcattgttgcagcaagctctgttggcgaggagctcttttaccgtgctgctgttcagggagcattggcagaaatatttctaaagagcagtgatttagttgctgatgctcgaggaatggcttcactgactggagtgctacctccatttgtcccatttgcacaggcatttgctgccgttatcacagctgctcttactggttcactttattatatggctgcctctcctaaagaccctacctatgtagttgcaccagtactgaagtcgcgctctggtcgtgaagatctaaagaaactcttttcagcatggtacgaaaggaggcaaatgaaaaagatatactcccctctcctagaggcaactttggcactttatcttggatttgaatggattcagacgaacaacattcttgcaccaatcataacgcatgggatatactcatgtgttattctcggccatggcctttggaagatccacgaccatcagagaaggctacgtcgaagagttcgcaagcttaaaactgagggcaaagtctcgcgaaaattatgaatcagctgcttgctccataaggagatagtctcaagcaacacaaagtgtatcaaacatatataatagctagatagggtatagaaacgtataggtgtatgtaattagtgagaaatacagtgtgcgggtacattctgcttgtacataagaaatgaaaagggtttcagttttgattataataaatcaacgaaacttcatttttcactgcaacaatcaaatgtgaaaattatatcatctagatgctgtgcgtagcaggatttaattactcagtcacgtagcagagtgtattgtaacccaaaaaaaaataaaaaatgcatgatgatgttattattacaagatactgagaaattgtattgattcaattttccaactgagatatgatgctaacgaagaccccatagccttggcacatgtcggagagaagacaatactcattcttcgcatggtaggtagccattaagccgtagccagcagtttggacatcaaaaccctcatcctgtagctcacgtatcagtggcaagctaccagtgatagaataaggtttacatggccaaccacctcttcagtagctttgcataatgcatggtagccacgagaatcaagactgcaagccacgccagatgtggctccatcaaaagtaatagttattcttcctctaaggttctcatctggtagaacatatttcgagacaggtcctcgcatctccagcttttctatgttaacattcaagtcttcaacatattcttgaaacttcttcattacatcagttacactataaaacggagttaacctaacatctccacaaatggtacactcagccggaatttggttgatgccacctccaggataactccactgagttggtttcatggttgatggtgttgcaaagccatactactttttcatttggatggggtggaaagtctctgtaaaaccgtaactggatctctttaagagcttccatagctaactccaagggattgattgccttgtggcataaaccactgtgaaaaagctttccataaacctgaagcttccatggtatcataccaccagtaccaatgcaaggctgtttatctgctgtatcaatccaaaacaaaggtccttgctttaatttgttaagcaatccatctttcactaatgcatcaaccccaacaccaggaatagacgaattctcctcactggcaataaagacagcaaccaccgtggactttaactgaggctttgtctcacccagtctcctcattaattcagctacaagagcaacgtgccctaaacagtctgtcgttccacgccctctaagtttgtctccatcaatgctcatagaaaaggggtcaaaatcccaatcagacggattagctgtaacgacatccatgtgcatgccgacgaacgacaagattttgccgggctgtgttccagggtattccacaatgaggtttcctctgtttggcttgtaggtgacatggttaatgaccagtgggccaccctcagtggtgctgaaagggcggaggacgtccagtacgtgcccgacgatcctgtcctcctccggtatgaggtccggcgggttgttctggacatactttgactcgccgattagcttcgacaaaagaatcacgaaagattccttgtttaggtctcctagagtttgctttaagcttggggcagcctattttttatgaataatgtttgctgaaagtagcagg

SEQ ID NO: 4475 - DNA, 1556 bp, Amsonia hubrichtii
ttaggcatggcttcttcagtaaagcaaacgctaggcgatctggacaaggaatcgttcgtaacccttttatctaaattgataggggaggcagagtacgtacagaacaacccaccggagctgatccccgaagaggacaggattgttaagcacgtattggagaagctactccctttcagcaccactactggcggtggtccactaatcatcaaccatgtcacttacaagcccaatagaggcaaccttattgtggagtaccctggaactgtgcctaacaaaattctctcctttgttggcatgcatatggatgtcgttactgccagccgttctgattgggaatttgatcctttttccttgagcattgatggtgataaactcaggggacgtggaactactgattgcttaggacatgttgctcttgtagctgaacttatgcggaaattgggagagacaaagccgcaactgaaatccactgttgttgctgtcttcattgctagtgaggaaaactcatctattcctggggttggtgtggatgcattggtgaagcatgggttactcaataaattaaaaaatggtcctctattttggatagacacagctgataaacagccttgcattgggactggtggcatgataccgtggaaacttcatgtcactggaaagcttttccacagtggtctggctcacaaggctatcaaccccttggagcttgcgatggaagcacttaaagtgatccagtcacggttctataaagatttccctccccatcccaaggaacaagtttatggatttgcaacgccatcaaccatgaaaccaactcaatggagttatccagggggtgggatcaatcaaattcccgctgagtgttccatttcaggggatgttaggttgacaccgttttacaatgtatctgatgtcatgaagaagttacaggagtatgttgaagatttaaaccagaacattgaaaagcttgatactcgaggccctgtttcaaaatatgtgctgcacgaagaaaacctgaggggaaggatcgctataagttttgatgagcctaattccggagttgcatgtgatcttgaatcccatggcttcaaagtattatgcaaagctactgaggaggtggttggccatgtaaaaccctattctataactgggagcttgccacttatacgtgaattgcaggatgagggctttgatgttcaaaccgctggttatggcttaatggcaacataccatgccaagaatgaatactgccttctttcagacatgtgccagggctacggagtctttgccagtatcatttcacagctagaagattgatcataatcagaggcccctattggatggtattaaagccggaccaccatagatcacactgagaattatatggccttctcctttatcttctgatgaattcactgttcttctttcacattcactaacatcttaaaactcttcgtggtgaagttcttgtgtatcaggagatacctcacttgttgctttgaaacctatgtgcactaattgaatggtaactgtgttcatttgtttcaagggatcct

SEQ ID NO: 4476 - DNA, 1634 bp, Tripterygium wilfordii
gttacgtttgcaagttctataaataactctgctaaatctcattctgttcgatacttcgaaaccaatccaatcataccacctctgtcaatggcgacttcgcaaattaagcaaaccctaggagacatggacaaggagtcctttgtctccctcctcaggaacctaattggtgagtctcggtacgtgcagaacaacccaccagagttgatacccgaagaggacagagtggtcaagcacgtcatgaactccctcctcccttacagcaccaccaccggaggaggtcccctgattctcaaccatgtcgcttatttccctaacaggggcaatctcattgtggagtatcctggcactgttcctgggaaagttttctcctttgttgggatgcacatggatgttgtcactgcaaatcctaatgactgggaatttgatccattctcactgagcattgatggggataaacttcgtggccgaggaactactgattgtttgggccatgttgcccttgtaactgaacttctgaagaggcttggggagacaaagccaaaattgaagtcaagtgtggttgcggtctttatagcaagtgaagagaattcttccataccaggggttggtgtcgatgcacttgttagacaaggtctgctagataagctgaagggagggcctttattctggattgacacagctgataagcaaccttgcattggtactggtggcatgataccttggaaacttcacgtcacagggaagctttttcacagtggtttagcgcacaaggccataaatccattggagttgggcatggacgtgttaaaagagatacaatcccggttttacagagattttcctccccatccaaaggagcaagtctacggatttgcaaccccgtcaactatgaaaccaactcaatggagttatccaggaggtgggataaaccaaattcctggagagtgcacaatctcaggagatgtcagattaactcccttttacagcgtgacggatgtcattaaaattcttaaagaatatgtggatgacataaatgagaacatagagaagctagaaacaaggggtcctgtttcaaaatacatcctaccagatgaaaatctgaggggaagtcttacaataacctttgatgaggcaaattctggagttgcttgtgatcttgattctcgtggctttcatgtcttgtgtaaagctactaaggaggtagttgggcatgtaaagccttattcaataactggaagtttgccactcattcgcgagttgcaagacgaaggctttgatgttcaaactgcaggctatggtttaatggccacataccatgccaagaatgagtactgccttctttcagatatgtgtcaaggctaccagatttttgtcagtatcatcgatcaattagaagactgacctgaccatctgaagaggatgtgtgctaatgaaactaaacaagttcatctgattatgacattttcgatagttggataagggaagaaaaaaaacaaaaacaatcatctaaacaaggggagatagtgatctccttgtttatacaataatcagaaattccatattttgatttgatttttccattttagcagttgtagaaaacactcaggaaagttgtggattgtttatcgtctatt

SEQ ID NO: 4477 - DNA, 1836 bp, Utricularia gibba
ctgcggtgggtgtgaagggcactctgggggagttggatagggactcgttcgtcgcacttttgggcaaattgattggagagtcgaagtatgtgcagaacaatccgccggagttgatcccggaggaagacaggatcgtgggtcatgttctccaagtcctccgtccgtacagcactgccaccggcggcgggccgcttgttattaatcacgttgcgtacaagcccaataggggaaaccttattgtggagtaccctggaactgagcctgggaaaatcttgtcttttgttgggatgcatatggatgtggttaccgccaaccctgatgattgggattttgatccttttactctgagcattgatggagataagcttcgaggtcgaggtactacggattgtttagggcatgtggcccttgtggctgagctaatgaagaagttgggagaaacaaagcctaagctgaagtccactgtggttgcggtttttattgccagtgaagagaactcctctataccaggagtaggagttgatgcactagtaaagcaaggattgcttgacaagctgaaacatggacctctgtactggattgacacagcagataaacagccatgcattggtaccggtgggatgataccatggaaacttcatgttactggaaagctttttcacagtggtcttgctcacaaggctatcaatcccttggagctagctatggaagccttaaaagagatacagttacgtttttacaaggatttccctccacatcccaaggaaaaagtatatggtttcgctactccatcaaccatgaaaccaactcagtggagctatcctggaggtggcattaatcaaattccagctgagtgcacaatttgcggagatgttaggttgaccccattttacggtgttgctgatgttatgaagaagctccaggagtatgttgaggacttgaataccaacatcgaaaaccttgaaacaagagggttagtgtcaaagtatgttctaccagaagagaacctcaggggaaggatttttattagctttgatgaagcaatgtctggggtggcttgcgatcttgaatctcccggcttccaagtgctttgcaaagcaacagaagaagtggtcggccatgtaaagccgtattcaatcaccggtagtttgccactcattcgtgagttgaaggatgaaggttttgatgttcaaacttctggatatggcttaatggcgacctatcatgcaaaaaaacgatactgcctcttctctgacatgtgccaaggatatgccgtctttgttaacatcatctcccagttggaagattgaacctttcttggtgatcggtcacatactgcaggagcaaggtcaatacaccccccttctgcccacaataatcatcagcttccagaactgacttctgctgattgttcctcaaatgaagttttagtgtgtggtttgcaataaataaagtttctggaaatacatgcatttctctctactagtcttcaccaatgtcgtcaagctgtatttttaagtttgttccatcgtgtttctagacatggatccccgcttttggattatgcaatcagtttcttgtggcatcagtagcttacaacaatagaaaaccatgaaattcctggtctgctgtactgttgctacttccttgctttatgtcattggcttctctaaaacagcattgaggtacatctcattcttgataacaggattatcattcttcctccatatggtccgtctcagtgtcctgaaacgcactcgctcgaacatcggaatgtacgttccgttgagctgttcggtgaagcagaagaatgactccagccagaagactccctcg

SEQ ID NO: 4478 - DNA, 1938 bp, Panax ginseng
aagcagtggtatcaacgcagagtacatggggacaaaacccatctcccagaaccttttccggtttgatgaactgtgtttctgaaacctattccaactactacatataactagtgtacctcagtttccccaaattctcaatttctctgtcaatggctgcttcttctctgaaagaaaccctaggtgacctgaacaaggactcatttgtgaccctattgtcgaagctgataggggaatcgaaattcgtgcaaaataacccaccggagctgatcccggaggaggacagaatcgtcaagcacgtgctcgacgccgtcatccccttcagcaccaccactggaggcggccctctgatcgtcaaccatgtcacttatatccccaaaagagggaaccttattgtagaatacccaggaactgaacctggcaagatcctttcttttgttggaatgcacatggatgttgtcactgctaaccctgatgattggacttttgatcctttcgcgttgagcattgagggggataaactacggggccgtggaacgactgattgcttaggacatgttgccctggtggctgaactcatgaggagacttggggagacgaagccaaaactaaagtcaactgtggttgcagtcttcatcgctagtgaagagaactcatctattccaggagttggtgtggatgcactagtgaaagatggattgcttaataagttaaagcaaggtcctttgttttggattgacacagcagataaacaaccttgcatcggtactggtggaatgataccctggaaacttcatgttactggaaagctatttcacagtggtctaccacacaaagctattaatcctttggagcttgctatggaagttcttaaagtgatccagttgaggttctacaaagactttcctcctcatgctaaagaagaagtatatggctttgcaacgccatcaaccatgaaaccaactcaatggagttatccaggaggtgggatcaatcaaattccggctgagtgtaccatttcaggagatgtcaggctgactccattttacaacatatcagatgtgatgaagaagctacaagaatatgtcgatgagttaaatatcaatatagagaagatagattcaagagggcccgtttcaaaatatgtcctaccagatgagaatttgaggggaagcatcaaaataagttttgatgaggcatttcctggagttgcttgcgatcttgattctcgtggcttccatgtattgtgcaaagctactgaacatgtggttggccatgtaaaaccatactctatcactggaagtttgcctctcataagagatctgcaggatgaaggttttgatgttcaaacttcaggctatggcttgatggctacataccatgccaagaatgagtactgccttctttctgacatgtgccaagggtaccaggtgtttgtcagtgtcattggccaattagaagattgatgaggttacacaatcccaagctggtagtcataccaatcataaacttggatgacatggtattaaccaaaataagctttgtgatcgattttcatacttagtttgtaaaaaaggattcccgtagtgtcaatcctatgatgcctttatttgaatttcggcattaagctgctaattaaacgttgtatattgtcaacagtttgcttgcccgatttaaaaattgcattttatttatttattttatatgatgtgctttgaaattcttgatattggtatcaaatccgagattgctttaatctttgcctagataaaataattatcttaagagacagcgatggatgttaaactatgcaatggggatgcaccttctgttatgaaaggattgaatttaggcaagttttgtttacaaaaaaaaaaaaaaacaaaaaaaaaacaaaaaaaaaacaaaaaaaaaacaaaaaaaaacaaaaaaaacaaaaaa

SEQ ID NO: 4479 - DNA, 1417 bp, Beta vulgaris
gtttaataaccaatcgtggactctaatgcttgtgaaacctgttttctctcttgaactctcttcaatggcatcatcagaaataaagcaaataattggagaactaaacaaagaatcattcgttgatctcttaaccaaactcatcggagaatccaagtacttacagaacaacccacctgaactgattccagaagaagacagggttgtgaatcacttgcttgaaattctctctcctctctccaccactactggaggtgggcccctcatcatcaaccatgctacttactatccgaagaggggaaacctcattgttgagtatccgggtactcaacccggaaaagttctctcctttgtgggttgtcatatggatgtggttaccgctaatcctactgattgggactttgatcctttctcactgagcatcgatggtgataaacttaggggccgagggactacagactgtctgggacatgttgccttgatcgctgaattaatgaagaaactaggggagacaaaaccaaaattgaagtcgactgtggttgctgtcttcatagcaaatgaggagaactccgcgataactggcattggtgttgatgctcttggaaaggacggattgcttgataagttgaaggatggtcctctgttctggatagacacagcagataagcagccttgcattggtactggaggcgtgataccatggaaattacagggtcatggaaaactttttcacagtggccttgcacacaagggaataaatgctatggaaatgacaatggaagcacttaaggagatccagttacgattttacaaagatttccctccacatccccaagaggaagtctatggatttgcaactccatcaactatgaagccaactcagtggacttatccaggagggggtatcaaccagatccctggtgagtgtacgatttcaggtgatgtcaggctaactcccttctatgacgtaactgactgcatgaaaaagcttcaagagtatgttgatgacatgaattctaacattgagaagctagatactagaggaccagtttcaaaatatgtgctacctgatgaaaatataagcggaagacttgtaataacttttgatgaggccaacaatggtgtggcttgtgatctcaattctcgtggctttcacgtattatgcaaagctactgaagaagttgttggtcatgttaaaccctactcaatcacgggaagtttgccactgattcgtgatctacaggatgatggatttgatgttcaaacagcaggctacggtctaatggcaacataccatgccagaaatgagtactgccttctctcagacatgtgccaaggctaccaaatttttgctagcattattgcacaattagaagattgacctctcagcaaatcatgattgctttacaccttttatgtt

SEQ ID NO: 4480 - DNA, 1491 bp, Fagopyrum esculentum
ttgatcggccatggattccaatggtacgcgattgctaggggaactggacaaggattccttcgtctctctgctccgcaaactcatcggagaatccaatacctcagacaatccgccggagctgattccagaggaagacagggtagtcaagcacgttcttgactatcttcttcctttctctacttccaatggcggtccacttatcgtcaaccacgtcacttaccatgccaaccgcggcaacctcatcgtcgagtatcccggaaccgagcccgaccgagtcctttccttcgttggctgtcacatggacgtcgtcaccgctaaccccgatgattgggaatttgacccattctcattgagtatcgatggtgataaactctgtggtcgaggaactactgactgcttggggcatgttgctctcattgctcaactgatgaagaagttgggagagacaaaaccaaagttgaagtcatctgtggttgctgtcttcattgccaatgaagaaaactcagacataacaggtgttggcgtggatgctcttgtgaaggatggactgttaaataagctgaaaaatggacctcttttctggattgacacggctgataagcaaccttgcattggtactggtggcatgataccttggaagcttcatgtgactggcaaacttttccacagtggcctggcacacaaggctgtcaattctttagagttggccatggaagcattaaaggtgatccagttacggttttataccgatttccctccacatcctcaagaaaaagtgtatgagtttgcaacaccatcaaccatgaagccaactcaatggagttatcctggaggtggaattaatcagatccctggtgagtgtgtaatatcaggtgatgtcaggttgacacccttttacagtgtaactgatgtaatgaacaagctaaagcaatacgtggatgacatcaatgctaatatagagaagctagatacaagaggaccggtttctaaatatgtacttccagaggaaaacattaggggaagactttcaataagctttgaagaggcattgtctggggttgcttgtgatctcaattctcgtggttttcatgtattatgcaaagctacagaagaggtcgttggacacgtcaaaccttactccattactgggagcctgcccctcattagagaactcaaggatgagggttttgatgtacaaacttcaggctatggtttaatggcgacatatcacgccaagaacgaatactgccttctctcagacatgtgtcaaggatattcagtctttgtaagcatcatctcccagctagaagagtgatattttcactattaatcaacatgcaggttacagctctcttactttgtttgagtgacctatgctcagacctttatgttgaccagttgtcatactgaacttgttttttttgttttctctttacaacttcttggtatctaattatatatttgaagtataagtattcttgcaattagttt

SEQ ID NO: 4481 - DNA, 2208 bp, Panax ginseng
aagcagtggtatcaacgcagagtacatggggaccggaaccttttcgggtttgatgatcggtgtttctttgaacctattccaactactacatataactagtgtaccatcctcagtttccccaaattctcaatttctctgacaatggctggttcttctctgaaagaaaccctaggtgacctgaacaaggactcatttgtgaccctattgtcgaagctgataggggaatcgaaattcgtgcaaaaataacccaccggagctgatcccggaggaggacagaatcgtcaagcacgtgctcgacgccgtcctccccttcagcaccaccactggaggcggccctctgatcgtcaaccatgtcacttatatccccaaaagagggaaccttattgtagaatacccaggaactgagcctggcaagatcctttctttcgttggaatgcacatggatgttgtcactgctaaccctgatgattggacttttgatcctttcgcgttgagcattgagggggataaacttcgggcccgtggaacgactgattgcttaggacatgttgccctggtggctgaactcatgaggagacttggggagacgaagccaaactaaagtcaactgtggttgcagtcttcatcgctagtgaagagaactcatctattccaggagttggtgtggatgcactagtgaaagatggattgcttaataagttaaagcaaggtcctttgttttggattgacacagcagataaacaaccttgcatcggtactggtggaatgataccctggaaacttcatgttactggaaagctatttcacagtggtctaccacacaaagctattaatcctttggagcttgctatggaagttcttaaagtgatccagttgaggttctataaagactttcctcctcatgctaaagaagaagtatatggctttgcaacgccatcaaccatgaaaccaactcaatggagttatccaggaggtgggatcaatcaaattccggctgagtgtaccatttcaggagatgtcaggctgactccattttacgacatatcagatgtgatgaagaagctacaagaatatgtcgatgagttaaatatcaatatagagaagatagattcaagagggcccgtttcaaaatatgtcctaccagatgagaatttgaggggaagcatcaaaataagttttgatgagtcatttcctggagttgcctgcgatcttgattctcgtggcttccatgtattgtgcaaagctactgaacatgtggttggccatgtaaaaccatactctatcactggaagtttgcctctcataagagatctgcaggatgaaggttttgatgttcaaacttcaggctatggcttgatggctacataccatgccaagaatgagtactgccttctttctgacatgtgccaagggtaccaggtgtttgtcagtgtcattggccaaatagaagattgatgaggttacacaatcccaagctggtagtcataccaatcataaacttggatgacatggtattaaccaaaataagctttgtgatcgattttccatacttggtttgtaaaaaaggattctagcagtgtcaatcctatgatgcctttatttgaatttcggcattaagctgctaattaaactttgtatattgtcaaaagtttgcttgccctatttaaaaattgcattttttaaatttattttatatgatatgctttgaaattcttgatattggtatcaaatccgagattgctttaatctttgcctagaagtaaactgcctggatgtaaaataattatcttaagagacggcgaaggatgttaaactatgcaagggggatgcaccttctgttaggaaaggttgaatttaggcaagttttgtttcaatcctgaaagagagttgatggtatcacattgagctactgttactcacaatggtgaacttcttatgtactcccttggttccacttgcaaattatgcaaatatcaagggtatttttgtttcgtgtttttccccaaatgacatgttatttggttagttgtggcagcttagtattcaggtaagaagaaagagcttgtgaaactattaaatttatttgtacaaatatcaattctttaaatataatatatgcatgataaacttcttatgcatttatgcataaaatgtataaaaaaattaggacgagtcgtgggaggcaaggcacacaggggataggccccc

SEQ ID NO: 4482 - DNA, 1700 bp, Solanum tuberosum
gcttcccctaggtttgctctgttccgaaaacaaggcatcagctcactactacaatggctacttcagcttctgtaaagcagattttgggcgatctaaacaaggattcattcgtaacccttttggggaaactgatcggcgagtctaaatatgtacagaacaatccgccggagcttatcccggaggaagacaggattgtgaatcacgttcttgatacacttcttccttatagcaccaccaccggcggcggaccactgatcatcaatcatgttacttataagcctaataggggtaatcttattgtggagtacccgggtactcagcccggaaaaatcttgtcttttgttggaatgcatatggatgttgtcactgccaaccctgatgattgggaatttgatcccttttcattgagcatcgatggtgataaacttcgaggacgtggaactactgattgtttaggtcacgtggctcttgtatccgagcttatgagacggcttggggagacaaagccacagttgaaatccacggtggttgctgttttcatagccagtgaagagaactcatctatccctggggttggtgtggatgcattagtgaaggatggattgcttgataagttaaagcaaggccctctattctggattgacacagcagataaacaaccatgcattggtactggtggcagtataccgtggaaacttcatgtaaccggaaaacttttccacagtggtctaccccacaaggctatcaatcctctggagcttgctatggaagcactcaaagaaattcagtcccgcttctatatagatttccctgcgcatcctaaagaacaagtctatgaattcgctacaccatcaaccatgaaaccaactcagtggttttatcctgggggtggaatcaaccaaattcctggtgagtgcactgtttctggagatgttaggttgactccattttacaatgtatcagatgctatgaagaaattacaagaatatgttgatgacttgaatgccaacattgaaaaacttgatggtcgaggccctgtttcaaaatatgttctgccagatgagaacttaaggggaagaatcactataagtttcgacgaagcttcgtctggagttgcttgtgatctcaattctcggggatttcatgtactatgcaaagctaccaaagaggaagttgggcatgtaaaaccatattctataaccggtactttgccattgataagagatctacaggatgagggttttgatgttcaaacttctggctacggcttaatggctacataccatgcaaagaatgaatactgtctactgtctgacatgtgccaaggttaccgggtctttgcaagcatcatcgcacagttggaagattgatctgaggtttgattacatcacaattcagagactggttgacagaattaggttttcgatataatacaggaaaagtagatctctttgctgacgactcctgctataatagtgcttgttctttgttgaatctgtgactaatctaaatacttgaaatgaccttttaacttatatttgaagtcaattttaacttgttaaaagtaaatccccagcattacagtatcatttgtttgtcattagtcttcctatagccacctagattggtgtattgcgcattcagaatctgtgaaatagtttgcttttgtccttaatatccaatttgcttttaaaaaaaaa

SEQ ID NO: 4483 - DNA, 1661 bp, Solanum lycopersicum
gtgtgaaaagtaggatttgttaaaacatcaaacttcttcccctaggtttgctctgttccgaaaataaggcatcagctcactacaatggctactacagcttctgttaagcagattttgggcgatctaaacaaggattcattcgtaacccttttggggaaactgatcggcgagtccaaatatgtacagaacaatccgccggagcttatcccggaggaagacaggattgtgaatcacgttcttgatacacttcttccttatagcaccaccaccggcggcggaccattgatcatcaatcatgttacgtataagcctaataggggtaatcttattgtggagtacccgggtactcagcccggaaaaatcttgtcttttgttggaatgcatatggatgttgtcactgccaatcctgatgattgggaatttgatcccttttcattgagcattgatggtgataaacttcgaggacgtggaactactgattgtttaggtcatgtggctcttgtatccgagcttatgaggcggcttggggagacaaagccacagttgaaatccacggtggttgctgtcttcatagccagtgaagagaactcatctatccctggggttggtgtggatgcattagtgaaggatggattgcttgataagttaaagaaaggccctctattttggattgacacagcagataaacaaccatgcattggtaccggtggcagtataccgtggaaacttcatgtaactggaaagctttttcacagtggtctcccccacaaggctatcaatcctctggagcttgctatggaagcactgaaagaaattcagtcccgcttctatagagatttccctgcgcatccaaaagaacaagtctatgaatttgctacaccatcgaccatgaaaccaactcagtggttttatcctgggggtggaatcaaccaaattcctggtgagtgcactgtttctggagatgttaggttgactccattttacagtgtatcagatgctatgaagaaattacaagaatatgttgatgatttgaatgccaacattgaaaaacttgatggtcgaggccctgtttcaaaatatgttctgccagatgagaacttaaggggcagaatcactataactttcgacgaagcttcgtctggagttgcttgtgatctcaattctcggggatttcatgtactatgcaaagctaccaaagaggaagttgggcatgtaaaaccatattctataactggtactctgccattgataagagatctacaggacgagggttttgatgttcaaacttctggctacggcttaatggctacataccatgcaaagaatgaatattgtctactgtctgatatgtgccaaggttatcgcgtctttgcaagcgtcatcgcgcagttggaagattgatctgaggtttgattacatcacaattcagagactggttgacagaattaggtttatgataaagtagaactctttcactgatgactcctgttataaatgttgctggttctttgttgaatctgtgactaatttaagtacttgagctgacgttttaacttatacttgaagtaaattttagctttgttaaaactaaatccccagcattacagtatcatgtgtttgtcattagtcttttgcgcgttcagaatctatgaaatagtttg

SEQ ID NO: 4484 - DNA, 1728 bp, Ocimum basilicum
tcacaaatacattttcatcgggaaaaaagaacaagagaatacggctaattattcgaataaattcatataatctactaatttttctctcaagttgttttctccgtcgaagaatctcagcaaaatccatcgtctctcactgagaaagcacagcagcaatcgcagaaaaatggctgccgcagtcgttaagcagactctcggagatctgaacaaggactccttcgtgcctcttctgtcgaagctgatcggcgagtccaagttcgtgcagaacaacccgccggagctcatcccggaggaggacaggattgtctcccacgtgctcgacgtcctccgcccctacagcaccgccaccggcggcggccctctcctcatcaatcacgccacctacaagccccgccgcgggaacctcatcgtcgagtaccccggcactcagcccggaaaaatcctctctttcgtcggaatgcacatggatgtcgtcaccgccaacccttccgattgggaatttgatccattcagtttgagtatcgacggtgataagcttagagggcgtggaactactgattgtttggggcacgtcgcactggtgactgaattaatgaggagactgggggaaacaaagcctcaactgaaacatactgttgttgctgtcttcattgccagcgaagagaattcgtctatacctggtgtcggggttgatgcgttggtgaaggagggattgctcaacaaattaaaggagggacctctgttttggattgatactgccgataaacagccttgcattggtacgggtggtatgataccgtggaagcttcatgctactgggaagctttttcacagtggtcttgcccataaggctatcaaccctatagagctagctatggaagcactcaaagtcatacagaaacgtttctatgaagattttccacctcatccaaaggaacaagtatatggttttgcaacaccatcaacaatgaaaccaactcagtggttttatccaggaggaggcatcaatcaaatcccggctgagtgtacagtttctggagatgttagattgaccccattttatagtgttactgatgtaatcaagaagcttcaagaatacgtcgaagacctaaacacaaacatagaaaaactggacacacgaggtcccgtttcaaagtatgtgttaccagatgagaacctcaggggaaggttggctattagctttgatgaagcaatgtcgggagtggcttgtaatctcgaatctcgtggcttccacgtcctatgcaaagctaccgaagaggtggttggtcatgtaaaaccatattctatcactggtagcttacctctcatacgcgagttgcaggaagagggttttgatgtgcaaactgctggctacggcttaatggctacatatcatgccaagaacgagtactgtctcttctccgacatgtgccaaggctatcgcgtgtttgctagtatcatttctcagttagaagaagagtgaatcggcttgatcattggctcccggcttatgcataatcaagaacaactccacttacagtttcaggtcagctttttagggttcgaatcgcagataaaatagatatagattactctcacggttcctttttcttggattgacaagggatattcgaatgactgcatgataaaagaaatggtgggattttatataatatcgtactctttccagattgtatgtttttcattaagacatatgagtgcattttt

SEQ ID NO: 4485 - DNA, 1327 bp, Euphorbia peplus
caagtttaggagaccttaacaaggaatcctatgtgtctctccttaaaaagatcatcggagaatcgaaatatgtccaaaacaacccaccggaactgatcccggaggaagacagagtggtgaagcatgtcctagattcccttctacctctcagcaccagctccggcggaggtccattgatcgtgaatcatgtctcttattttcctaagcgagggaatcttattgtggaatatccaggcacccaaccaggaaaaatcgtgtcttttgttgggatgcatatggatgttgtcactgctaatcctaatgactgggagtttgatccattttcactgagcattgagggagataaacttcgtggccgtggaactactgactgtttgggacatgttgctcttgtaactgaactcatgaagaggttagccgagacaaagccgaaactaaaatcaactgtggtggcagtgttcatagccagtgaagaaaattctacaataacaggggttggcgtggatgcacttgtccgtgataagctccttgataagctcaaaggaggtcctttgttttggattgatacagcggataaacagccttgtattggtactggtggtatgattccttggaaacttcatgtcacggggaaactttttcacagcggtcttgcacacaaggccataaatcctctagaactagcaatggagtcacttaaagagatacaatcacgattttataaggacttcccccctcatgcaaaggagcaagtatatggattcgcaacaccgtccacaatgaaaccaacacaatggagttatcctggaggtgggatcaaccaaattccagcggagtgtactatttccggagatgtcaggttgactccattctacaatgtattagatgtgaagaacaagctccaagaatatgtggacgacataaatgagaacatagaaaagctagatagaagaggtccagtttcaaagtattgtctacctgatgaaaacatgaagggaagccttactttgacttttgaagaagcaatgaatggagttgcatgtgatcttgattctcgtggctttcacgtattatgcaaagcaactgaaaaggttgttgggcatgtaaaaccctactctattactgggagtttgcctttgatacgagagttgcaagatgaaggttttgatgttcaaactgcaggctatggtttaatggcgacttaccatgccaagaatgagtactgcctacttacagatatgtgccaaggctatcgagtttttgtcagcatcattgctcaactggaaagtttatctgaataaaatcataaccaccaaacaacagagta

SEQ ID NO: 4486 - DNA, 1577 bp, Solanum lycopersicum
acttcttcccctaggtttgctctgttccgaaaataaggcatcagctcactacaatgactactacagcttctgttaagcagattttgggcgatctaaacaaggattcattcgtaacccttttggggaaactgatcggcgagtccaaatatgtacagaacaatccgccggagcttatcccggaggaagacaggattgtgaatcacgttcttgatacacttcttccttatagcaccaccaccggcggcggaccattgatcatcaatcatgttacgtataagcctaataggggtaatcttattgtggagtacccgggtactcagcccggaaaaatcttgtcttttgttggaatgcatatggatgttgtcactgccaatcctgatgattgggaatttgatcccttttcattgagcattgatggtgataaacttcgaggacgtggaactactgattgtttaggtcatgtggctcttgtatccgagcttatgaggcgtcttggggagacaaagccacagttgaaatccacggtggttgctgtcttcatagccagtgaagagaactcatctatccctggggttggtgtggatgcattagtgaaggatggattgcttgataagttaaagaaaggccctctattttggattgacacagcagataaacaaccatgcattggtaccggtggcagtataccgtggaaacttcatgtaactggaaagctttttcacagtggtctcccccacaaggctatcaatcctctggagcttgctatggaagcactgaaagaaattcagtcccgcttctatagagatttccctgcgcatccaaaagaacaagtctatgaatttgctacaccatcgaccatgaaaccaactcagtggttttatcctgggggtggaatcaaccaaattcctggtgagtgcactgtttctggagatgttaggttgactccattttacagtgtatcagatgctatgaagaaattacaagaatatgttgatgatttgaatgccaacattgaaaaacttgatggtcgaggtcctgtttcaaaatatgttctgccagatgagaacttaaggggcagaatcactataactttcgacgaagcttcgtctggagttgcttgtgatctcaattctcggggatttcatgtactatgcaaagctaccaaagaggaagttgggcatgtaaaaccatattctataactggtactctgccattgataagagatctacaggacgagggttttgatgttcaaacttctggctacggcttaatggctacataccatgcaaagaatgaatattgtctactgtctgatatgtgccaaggtttccgggtctttgcaagcgtcatcgcgcagttggaagattgatctgaggtttgattacatcacaattcagagactggttgacagaattaggtttatgataaagtagatctctttcactgatgactcctgttataaatgttgctggttctttgttgaatctgtgactaatttaagtacttgagctgacgttttaacttatacttgaagtaaattttagctttgttaaaactaaatccccagcattacagt

SEQ ID NO: 4487 - DNA, 1794 bp, Chenopodium quinoa
ttacaaaaactcctttgcttacagatataccctccattttgcttctaaaaacaagtttcctctatcgtgctctcacagtctcttcttcaatggcaccatcatcagaattagatcaaacacttggagaactaaacaaagaatcattcgtcaatctcttaaccaaattaattggcgaatccaaatacttacagaacaacccacctgaattaatcccagaagaagacagggttgtcaaccacttacttgagattctctctcctctttccaccaccaccggaggtgggcccctcatcatcaaccatgcaacttactacccgaaaagaggaaaccttattgttgagtatccgggtactgaacccggcaaagttgtctcctttgtgggttgtcatatggatgttgtcactgctaatccttctgattgggacttcgatcctttctcattgagcatcgatggtgataaacttaggggtcgagggactacagactgtttgggacatgttgccttggtagctgcattgatgaagaagctaggggaggcaaaaccaaaattaaagtctactgtggttgcggtcttcatagcaaatgaggagaactcagctataacaggcattggtgttgatgctcttggaaaggatggattgcttgataagttgaagggaggtccactgttttggatagacacagctgataaacaaccttgcattggtactggtggagtgataccatggaaattacagggtgttggaaaactttttcacagtggccttgcacacaaggcagtaaatgctatggaaatgacaatggaagcacttaaggagatacagttacgattttacaaagattttcctccacaccctgaagagaaacgctatggatttgcaaccccatcaaccatgaagcccactcaatgggtttatccaggagggggtatcaaccagatccctggcgagtgtactatttctggtgatgtcaggctaactcccttttacgatgttaatgactgtatgaaaaagcttcaagaatatgtcgatgacataaattctaacattgagaagctagatacgagaggaccagtttcaaaatatgtgctacctgatgaaaacataaggggaagactcacaataacttttgacgaggccaacaatggtgtggcttgtgatcttgattctcgtggtttccacgtcttatgcaaagctactgaagaagttgttggtcatgttaagccatactccatcactggaagtttgccactgattcgtgatctaaaagatgacggatttgatgttcaaacagcaggatatggtctaatggcaacttaccatgccaagaatgaatactgccttctgtcggacatgtgccaaggctaccgagtctttgctagcgttattgcacaactagaagactgacttcctgcggattatatttgctctggattttaaaagtttttattaatgctcaagacatggatatacatttactgttaaataacagtcataataataagttcatttataagaatggattgagtttaatcatgtaacattccatgtgttaaagtaatatggtcatcagtaaatcagtagtattatgcttctgtcaaaacttacagaattgaaccaaaatgattttgcatggatagccaagtggttcaactgatccagccaagctcggtttctgcttggtcagatcctggtgggtggcccagtggattgcatgggtatcaagtgggtaaacggttcggccaccccggcattagtctaaatgatttatccattaatattgacgaaagaccat

SEQ ID NO: 4488 - DNA, 1634 bp, Triphysaria pusilla
acatccaaaaatggctgcttcaagcgtaaccgaaacactgggaaacctaaacaaggactcatttgtatcccttttgtcgaagctgatcggtgagtcgaagcacgttcagaacaacccgcctgaattaattccggaggaggacaggatcgtcagacacgtgcttgacgtcctcagcccattcagttctgcaaatggcggcccgctcctcatcaatcatgtcgcttacaagcccaacagggggaatctcatcgttgaataccctggaactcagcccggaaaaatcctgtcctttgtcggcatgcacatggatgtcgtaactgcgaacccgtctgattgggattttgatccttttactatgagcatcgacggggacaaactaagaggacgtggaactactgattgtttggggcatgttgcccttgtagctgagctaatgaggcgactcggagaaacaaagcctcaactaaagtcaactgtggttgctgtctttatcgccagtgaagagaattcatctatccctggagtaggagttgatgcattagtgaaggatggattgctcgataaattaaagcacggaccattgttttggattgatacggccgataaacagccttgcattggtactggtggtatgataccatggaagcttaatgttactggaaagctttttcacagtggtctagcccacaaggctatcaatccctttgaactggctatggaagctcttaaagtgatccagtcaagattttacacagactttccagcccatccaaaagaagaagtatatgggtttgcaacaccatcaaccatgaaacctactcagtggagttatcctggaggtggcatcaatcagataccagctgactgtacagtttgcggagatgttaggttgactccattttatagtgttactgatgtaattaagaagcttcaagaatatgttgaagacttgaatgccaacatagagaagctggacacacgaggacctgtttcaaaatatactctaccagatgagaacctcaggggaagtttgaccattacatttgatgaagcatcgtctggagtagcttgcaatcttgactctcgtgggttccatgtgttatgcaaagctactgaagaggtggttgggcatgtaaaaccatactctatcactggtaccttgccactcatacgtgaattacaggatgaaggtttcgatgtgcaaacttctggatacggcttaatggctacataccatgccaagaatgagtattgccttctgtctgacatgtgccaaggctatggagtctttgtaagagtcatttcacagttggaagattgagaatcatgattgtggacttgatgaaagatatatataacatttggtttaatgatgggataatttctctatcgtcttgtgatgattagttatttcacatggttcacaatatgtactacttcgcaaactagtttctgcttttattctgttttcttttctcctaaatttgttttagatgcaatattattttatattaattattgcaaaacaaaggttaccaagacaagacctaagcaattggatctcaatttctgaagcatgattattttcatgaaataaattcagccctccaatgaataactattatattctcggc

SEQ ID NO: 4489 - DNA, 1697 bp, Triphysaria pusilla
gtccaccctaaaaaatcgattaaaagacgatccaaagcaaatttcacactacacatccaaaaatggctgcttcaagcgtaacgcaaacactgggaaacctaaacaaggactcatttgtatcccttttgtcgaagctgatcggtgagtcgaagcacgttcagaacaacccgcctgaattaattccggaggaggacaggatcgtcagacacgtgcttgacgtcctcagcccattcagttctgcaaatggcggcccgctcctcatcaatcatgtcgcttacaagcccaacagggggaatctcatcgttgagtaccctggaactcagcccggaaaaatcctgtcctttgtcggcatgcacatggatgtcgtaactgcgaacccgtctgattgggattttgatccttttactatgagcatcgacggggacaaactaagaggacgtggaactactgattgtttggggcatgttgcccttgtagctgagctaatgaggcgactcggagaaacaaagcctcaactaaagtcaactgtggttgctgtctttatcgccagtgaagagaattcatctatccctggagtaggagttgatgcattagtgaaggatggattgctcgataaattaaagcacggaccattgttttggattgatacggccgataaacagccttgcattggtactggtggtatgataccatggaagcttaatgttactggaaagctttttcacagtggtctagcccacaaggctatcaatccctttgaactagctatggaagctcttaaagtgatccagtcaagattttacacagactttccagcccatccaaaagaagaagtatatgggtttgcaacaccatcaaccatgaaacctactcagtggagttatcctggaggtggcatcaatcagataccagctgactgtacagtttgcggagatgttaggttgactccattttatagtgttactgatgtaattaagaagcttcaagaatatgttgaagacttgaatgccaacatagagaagctggacacacgaggacctgtttcaaaatatactctaccagatgagaacctcaggggaagtttgaccattacatttgatgaagcatcgtctggagtagcttgcaatcttgactctcgtgggttccatgtgttatgcaaagctactgaagaggtggttgggcatgtaaaaccatactctatcactggtaccttgccactcatacgtgaattacaggatgaaggtttcgatgtgcaaacttctggatacggcttaatggctacataccatgccaagaatgagtattgccttctgtctgacatgtgccaaggctatggagtctttgtaagagtcatttcacagttggaagattgagaatcatgattgtggacttgatgaaagatatatataacatttggtttaatgatgggataatttctctatcgtcttgtgatgattagttatttcacatggttcacaatatgtactacttcgcaaactagtttctgcttttattctgttttcttttctcctaaatttgttttagatgcaatattattttatattaattattgcaaaacaaaggttaccaagacaagacctaagcaattggatctcaatttctgaagcatgattattttcatgaaataaattcagccctccaatgaataactattatattctcggcaaaaaaaaaaa

SEQ ID NO: 4490 - DNA, 1739 bp, Aquilegia formosa
ctctccctaaaactctctcttgaatcgatcatcaatgggttcttcatcttcactaaaggagataattggtgatctaaacagagattcatttgtaccccttctctctaaattgattggggagtctaaatttcttcaaaacaatccaccagaattgattccagaagaaaacagagtagctaaacacgttttagatgttttacttccttatagtactacttctaatggtggacctttgataattaaccatgttacatatattcaaggaagaggtaatttgattgttgaatacccaggaactgtacctggaaagattgtgtcttttgttggaatgcatatggatgttgtgacagctaatcctcaagactgggattttgatcctttctctctgactgttgatggggacaaactccaaggtcgtggaacaactgactgtctgggccatgttgctctcgtaactgaactcatgcggaggctaggtgaaacaaaaccagcattgagatcatccgttgttgctgtctttatagccaatgaagagaactcttcaattgcgggcattggtgtggatatgcttgtgaaagatggattgcttgacaagctcaagaaaggtcctctgttttggattgatactgcagataaacagccttgtattggtactggtggtatggtatcttggaatcttcatgcaacagggaagcttttccatagtggtctagctcacaaggctataaatcctttagaattagcaatggaagcacttcaagaaattcagttgcgattttacagggacttccctcctcatccaaaagaagagatctatggatttgcaacaccttcaacaattaaaccaacacagtggagttatccaggtggtggagtcaatcaaattccaggcgaatgtacaatatcaggagatgtcaggttaactcctttctacaacatagaagatgtgacaaagaagttacaggaatatgtcgatgatatcaatgcaaacattgagaagctaggtactcgtggtccagtttcgaaatatgttctcccagatgaaaatctcagaggaaggcttacaatcagttatggagaggcgccaatgactggagttgcttgtaatcttgattcgcgtggtttccatgtgttatgcaaagcaactaaagatgtggttggacatgtgaagccctactccatcactgggagtttgccattgattcgagaactgcaggatgaaggctttgatgttcaaactgcaggctatggcttgatggccacataccacgcaaagaatgaatactgccttttctctgatatgagccaaggctttgaagtgtttgtgagtgtcatctcccagttagaagatgacaactaaaataatctttcaccacttgtggtattgaacttcagcttctggtgctataggaagtttagactgatcaaataaatttaatcctagaaagagaaattttcataaggaaaagctaggttagtgctgtttgatccaacatggttgggatatcttctagtactttgggcagttatgccattgtaatttttacagttaacttttcattaatatcttattctcttatggagccaaaaataagtgttttctaccctagaggttaccatttagtcactactggtgctttaatattgaccatcctttaatggaagagctaaggaggtcataggcgaagtcatatgactgctttgaatgcatgatattagccttgccctttgtattattt

SEQ ID NO: 4491 - DNA, 1617 bp, Arabidopsis lyrata
aaaccttaaacaacacacgaagctcgtaacaagcaaaccgaaacttatttgttttgtttgcaaatcacaaaaaaaaaaaccacatctttggtgcaacaatggcttcgtattccaaagcactggtcgaattcataggctctcttgacaaagactcatacgtttctctcttatcaaaactcatcggcgagtcaaaattcgtccagaacaatcctccggagctcatccctcaagaggacctaatcgtcaaacacgtccttgagtctctccgtccttatagcacagaaactggtggtggtcctctggtgatcaatcatgtggcgtatcattcaggcagaggtaatctcatcgttgagtacccaggatctgttcccggaaagatcttgtctttcgtcggaatgcatatggacgtcgtcaccgcgaatcctgatgattgggaatttgatcctttttcgctaagcatagatggtgataagcttcgtggtcgtgggacaacagattgtcttggtcacgttgctcttgtcaccgaactcatgaagagactcgggcaaactaaaccgtcattgaaatcaacggtggtggcggttttcatcgctagtgaagagaactcttccattcctggtgttggtgtggacatgctggttaaagataaacttcttgataagctcaaatccggacccttgtattggattgatacggcggataagcagccgtgtgttggaactggcggtatgataccgtggaagattcattttaccggaaagcttttccatagcggtttagctcacaaggcgattaacgcgatggagttagcaatggaagggcttaaggaaatccaagcccggttctacagagactttccgcctcacccacaagagaaagtttatggttttgcaacaccatccaccatgaagcctacacagtggtcttatccagcaggcggaatcaaccaaatccctggagaatgtaccgtttccggtgatgtcaggttaactcctttctacgaagtgaaggaagtgataacgaagttgcaagagtatgttgacgacataaacggtaacatagagaagctcgaaacccgtggtcctgtttcgaaatatgtcttgccagatgagaatttacggggaaggctcacgttaagctttgatgaagcatcagctggagttgcgtgtaatcttgattcccccggctttcatgttttatgcaaagcaaccgaagaagttgttggacacgtgaaaccttactcgatcaccggtactttgcctctaatccgagacctcaaggatgaaggtttcgatgtgcaaacttcaggatacggtctcatggctacatatcatgcaaagaacgaatactgccttcttacagacatgtgccaaggctttgatgtcttcgttaggatcatttctcaacttgaagaacaagactaaaatgagatagaagatcataaaataaaagcttcacatagctactctctcattaacttaatggttctatacatttactttgcttctatctatttgtacaagtcaatggtggctcaatacataagacactttacaaaatttaaaacaaaggataatgtttattcagttatttatctatcttgagttgtcgtcacct

SEQ ID NO: 4492 - DNA, 1655 bp, Chenopodium quinoa
attttgcttctaaaaacaagtttcctctatcgtgctctcacagtctcttcttcaatggcaccatcgtcagaattagatcaaacacttggagaactaaacaaagaatcattcgtcaatctcttaaccaaattaatcggagaatccaaatacttacagaacaacccacctgaattaatcccagaagaagacagggttgtcaatcacttgcttgagattctctctcctctttccaccaccaccggaggtgggcccctcatcatcaaccatgcaacttattacccgaaaagaggaaaccttattgttgagtatccgggtactgagcccggtaaagttgtctcctttgtgggttgtcatatggatgttgtcactgctaatccttctgattgggacttcgatcctttctcattgagcatcgagggtgataaacttaggggtcgagggactacagactgtttgggacatgttgccttggtagctgaattaatgaagaagctaggggaggcaaaaccaaaattaaagtctactgtggttgcagtcttcatagcaaatgaggagaactcagctataacaggcattggtgttgatgctcttggaaaggatggattgcttgataagttgaagggaggtccactgttctggatagacacagcagataaacaaccttgcattggtactggtggagtgataccgtggaaattacagggtgttggaaaactttttcacagtggccttgcacacaaggcagtaaatgctatggaaatgacaatggaagcacttaaggagatacagttacgattttacaaagattttcctccacaccctgaagagaaacgctatggatttgctaccccatcaaccatgaagcccactcaatgggtttatccaggagggggtatcaaccagatccctggcgagtgtacgatttctggtgacgttaggctaactcccttttacgatgttactgactgtatgaaaaagcttcaggaatatgtcgatgacataaattctaacatgagaagctagatacgagaggatcagttcaaatatgtgctacctgatgaaaacataaggggaagacttacaataacttttgacgaggccaacaatggtgtggcttgtgatcttgattctcgtgggttccatgtcttatgcaaagctactgaagaagttgttggtcatgttaaaccatactccatcaccggaagtttgccactgattcgtgatctaaaagatgacggatttgatgttcaaacagcaggatatggtctaatggcaacttaccatgccaagaatgaatactgccttctgtcggacatgtgccaaggctaccgagtctttgctagcgttattgcacaactagaagactgacttcctgcgaattatgattgctctggaatttaaagttttcattattgcacaagacatggatatacatttactgttatataacagtcataataataagttcaatttttaaaaggaaaaaaacaaaaaaaaaagaaaaaaaaagaaaaaaaaaaacaaaaaaaaaaacaaaaaaaaaagaaaaaaaaaacaaaaaaagaaaaacaaaagaaaagaaagaagaaagaagaagaagaagaagaagaagagaagagagagagaaaagaaaaaaaaaaaaaaagaaaagagaa

SEQ ID NO: 4493 - DNA, 1617 bp, Arabidopsis thaliana
aaaccttaaacaacacacgaagctcgtagacaagctgaccaaaaccttattagttttgtttgcaaaccccaaaagaaaaaacatctttggtgtaacaaaaatggcttcgtcttccaaagcactgatcgaatccataggctctcttgacaaagactcatacgtttctctcttatcaaaactcataggcgaatctaaattcgtccagaacaatccgccggagctcatccctcaagaggacctaatcgtcaaacacgtccttgactctctccgtccttatagcacagaaactggtggtggtcctctggtgatcaatcatgtcgcgtatcattcaggtagaggtaatctcatcgttgagtacccaggatctgttcccggaaagatcttgtctttcgtcggaatgcatatggacgtcgtcactgcgaatcctgatgattgggaatttgatcctttctcgctaagcatagatggtgataagcttcgtggtcgtgggacaacagattgtcttggtcacgttgctcttgtcactgaactcatgaagaaactcgggcaagccaaaccggcgttgaaatcaacggtggtggcggttttcatcgctagcgaagagaactcttccattcctggtgttggtgtggacatgctggtgaaagacaaacttcttgataagctcaaatccggacccttgtattggattgatacagcggataagcagccgtgtgttggaactgggggtatgataccatggaagcttcagtttactggaaagcttttccatagcggtttagctcacaaggcgattaacgcgatggagttagcaatggaagggcttaaggaaatccaagctcggttctacagagactttccgcctcacccacaagaggaagtttatggttttgcaacaccatccaccatgaagccaacacagtggtgttatccagcaggtggaatcaaccaaatccccggagaatgtactgtttcgggtgatgtcaggttgactcctttctatgacgtgaaggaagtgataacgaagttgcaagagtatgttgacgacataaacggtaacatagagaggctcgaaacccgtggtcctgtttcaaaatatgtcttaccagatgagaatttacggggaaggctcacgttaagttttgatgaagcatcagctggagttgcgtgtaatcttgattctcccggctttcacgttctatgcaaagcaaccgaagaagttgttggacacgtgaagccttactcgatcaccggtactttacctctaatccgagacctccaggatgaaggttttgatgtgcaaacttcaggatacggtctcatggctacatatcatgcaaagaacgaatactgccttcttacagacatgtgccaaggctttgatgtcttcatcaggatcatttctcaacttgaacaagtataaaatcagatggaagatcataaaataaaagcttcacatagctactctcttattaactaaatggttctatacatttactttgcttctatctatttgtacaagtcaatggtggctcaatacttcagacactttacaaaatttaaaacaaaggataatgttttatacagttatttatctatcttgagttgttgtcacct

SEQ ID NO: 4494 - DNA, 1567 bp, Arabidopsis thaliana
gacaagctgaccaaaaccttattagttttgtttgcaaaccccaaaagaaaaaacatctttggtgtaacaaaaatggcttcgtcttccaaagcactgatcgaatccataggctctcttgacaaagactcatacgtttctctcttatcaaaactcataggcgaatctaaattcgtccagaacaatccgccggagctcatccctcaagaggacctaatcgtcaaacacgtccttgactctctccgtccttatagcacagaaactggtggtggtcctctggtgatcaatcatgtcgcgtatcattcaggtagaggtaatctcatcgttgagtacccaggatctgttcccggaaagatcttgtctttcgtcggaatgcatatggacgtcgtcactgcgaatcctgatgattgggaatttgatcctttctcgctaagcatagatggtgataagcttcgtggtcgtgggacaacagattgtcttggtcacgttgctcttgtcactgaactcatgaagaaactcgggcaagccaaaccggcgttgaaatcaacggtggtggcggttttcatcgctagcgaagagaactcttccattcctggtgttggtgtggacatgctggtgaaagacaaacttcttgataagctcaaatccggacccttgtattggattgatacagcggataagcagccgtgtgttggaactgggggtatgataccatggaagcttcagtttactggaaagcttttccatagcggtttagctcacaaggcgattaacgcgatggagttagcaatggaagggcttaaggaaatccaagctcggttctacagagactttccgcctcacccacaagaggaagtttatggttttgcaacaccatccaccatgaagccaacacagtggtgttatccagcaggtggaatcaaccaaatccccggagaatgtactgtttcgggtgatgtcaggttgactcctttctatgacgtgaaggaagtgataacgaagttgcaagagtatgttgacgacataaacggtaacatagagaggctcgaaacccgtggtcctgtttcaaaatatgtcttaccagatgagaatttacggggaaggctcacgttaagttttgatgaagcatcagctggagttgcgtgtaatcttgattctcccggctttcacgttctatgcaaagcaaccgaagaagttgttggacacgtgaagccttactcgatcaccggtactttacctctaatccgagacctccaggatgaaggttttgatgtgcaaacttcaggatacggtctcatggctacatatcatgcaaagaacgaatactgccttcttacagacatgtgccaaggctttgatgtcttcatcaggatcatttctcaacttgaacaagtataaaatcagatggaagatcataaaataaaagcttcacatagctactctcttattaactaaatggttctatacatttactttgcttctatctatttgtacaagtcaatggtggctcaatacttcagacactttacaaaatttaaaacaaaggataatgttttatacagttatttat

SEQ ID NO: 4495 - DNA, 1672 bp, Aristolochia fimbriata
cattgaactcggcgtcgaacggacgccaccgctctcaagcgagcctcatcccttaaccagtcgccatggcttcttctgcctcgctgaattctcttctgggtgagctaaacagagattccttcgtgacccttctcggaaagatcatcggcgaggccaagcacgtgcagaacaatccgccggagctcgtgcccagagaggacagggtcgcgcggcacgtactcgatgcccttctacccctcagcacatccactggcggtgggccgcttatcgtcaaccatgtcagctacgtcgaaggaagaggaaacgtcatcgtggaataccccggcacggttcctggaaaaatcctctctttcgtcggatgtcacatggacgttgtcactgcgaatccccaagactgggactttgatcctttctcgttgagcattgatggagataaactgcggggccgtgggactactgattgcttgggtcatgtagcacttgtaactgaactcatgagaaaacttggagagactaaacccgtccttaaatcaactgtagttgctgtgcttatagctaatgaggaaaattcttctgttgccggagtaggtgttgatgcacttgtgaaagatggcttgcttgataagctcaagaagggtcccctattttggattgatacagctgacaagcagccttgcataggtactggaggaatgatagcatggaaactcagagcgtcagggaaacttttccatagtggtcttccccacaaggcaatcaatcctcttgagcttctaatggaagcttttcaggagatccagcttcgattctacagggactttccaccacatcccaaggaacaagtctatgggtttgcaactccttcaaccatgaaacctacccaatggagctatccaggaggtggggttaatcagattccagccgaatgtacaatttcaggagatgttaggttgacccctttttacaatgtagcagatgtcgaaaaaaagttgcgggaatatgttgatgatattaatggcaacattgaaaagcttcctacacgagggcctgtttccaaatatgatctccctgatgaaaatttgaagggcaggctgacgctaagttttgatgagtcaatgatgtctggggtggcctgtagcctagagtcccctggtttccgtgtactgtgcaaagcaactgaggaggtggttgggcatgtgaagccctactccataacaggaagtttgccactgatccgggagttgcaggatgaaggttttgatgttcaaaccgcaggctacggcttaatgtccacttatcatgcaaagaatgagtactgccttttctcagatatgtgtcaaggttttaaagtatttgtaagcatcatttcacaactggaagaacacgagtaggcatccatgtaaacaaactgataataaagcagaagacttactacagaagaataactgtaattaggtgagcctgtgcaaggcaatggccttacagaggtggtgaccagtctgaaagatatatttgttgatgttctgattcttaaacattattctttcaattcaccgtcagtgtcttccggtaacttgtgctcactcagtaggcgagaattacttattgcaacacgagagtgtaatgaaacaatacaagaagtttaagtagagcatccacacttattattcaa

SEQ ID NO: 4496 - DNA, 1384 bp, Eutrema halophilum
tagcaaagcaaaacgaaaaaaaacattctctctggtgtgtgtaactatgtcgtcgtcgtcttcttcgaacgcaatgatcgaatccataggctctcttaacaaagactcattcgtctctcttctatcgaaactcatcggcgaatccaagttcgtacagaacaacccgccggagctaatcccgcaagaggatcgaatcgtgaatcacgtcctcgattctctccgtccgtacagcaccgaaactggtggtggtcgtctggtgatcaaccatgttgcgtatcactcaggaaggggcaatctcatcgtcgagtacccaggttctgtccccggaaagatcctgtctttcgtcggaatgcatatggacgtcgtcaccgcgaatcccgacgaatgggaatttgatcctttctcgctaagcatagatggtgataagcttcgtggtcgtgggactacagattgtcttggtcacgttgctcttgtgaccgagcttatgaagaggcttggggagactaaaccagctttgaaatcatcggtggtggcggttttcatcgccagcgaagagaactcttcgattcctggtgttggtgtggacatgcttgttaaagacaaacttcttgataagctcaaatccggacccttgttttggattgatactgctgataagcagccgtgtattggaaccggaggtatgattccgtggaagcttcatgttaccggaaagcttttccacagtggtttagctcacaaggcgattaacgcgttggagttaggaatggaagggcttaaggaaatccaatcacggttctacagagactttccgcctcacccacaggagaaagtttatggttttgcaacaccatccaccatgaagccaacacaatggagttatccaggaggcggaatcaaccaaatccctggagaatgtaccgtttccggtgatgtcaggttgactcctttctatgacgtcaaggaagtgatgaagaagctgcaagagtatgtagaggacataaacagtaacatagagaaactcgccacccgtggtcctgtttcgaaatacgtcttaccagatgagagtttacggggaaggcttacgttaagctttgatgaagcatcagctggagttgcatgtaaccttgattcccgcggattccatgttctatgcaaagcaactgaagatgttgtcgggcacgtgaagccttactcgatcaccggtactttgcctctaatccgagacctcaaggatgaaggtttcgatgtgcaaacttcaggatacggtctcatggctacatatcatgcaaagaatgagtactgtcttcttacagacatgtgccaaggctttgatgtcttcgttaggatcatctctcaacttgaacaagactaaataaagcag

SEQ ID NO: 4497 - DNA, 1537 bp, Brassica juncea
taaaaacctacgacaacgccacacgacttcgccgctttctcgaacacacaaacgaaagaaacatctccgggtgtgcaaacaatggcgtcgtcgtcgtcgatgatcgaatcactaggctctctcaacaaagactccttcgtctcactcctatcgaaactgatcggcgaatcgaagttcgtccagaacaatccgccggagctcatcccgcaggaggatcggatcgtgaaccacgtcctcgactctctccgtccttacagcaccgaatccggcggtggtcctctcgtgatcaaccacgtggcgtatcactcgggaagaggtaacctcatcgtggagtacccaggatccgtccccggaaaaatcgtctctttcgttgggatgcatatggacgtcgtcaccgccaatcccgatgaatgggagtttgatcctttctcgctaagcatagatggtgataagcttcgtggtcgtgggactacggattgtcttggtcacgttgctcttgtgactgagctcatgaagaggcttggggagactaaaccggctttgaaatcatcggtggttgcggtgttcatcgctagtgaagagaactcttccattccaggtgttggtgtggacatgctcgttaaagacaaacttcttgacaagctcaaatccggacctttgttttggattgatacggcggataagcagccgtgtattggaaccggcggtatgattccgtggaagcttcatgttactggaaagctttttcacagcggtttagctcacaaggctattaacgcgatggagttagggatggaagggcttaaggagatccaatcccggttctacagagactttccgccacacgagcaagagaaagtttatggttttgcaacgccatccaccatgaagccaacacaatggagttatccaggaggcggaatcaaccaaatccctggagactgtaccgtctccggtgatgtcaggttgactcctttctatgacgtgaaggaagtgatgaagaagctgcaagagtatgttgacgacataaacactaacattgagaaactcgcgacccgtggtcctgtttcaaaatacgtcttgcctgaagagaatttacgtggaaggctcacgtttagctttgatgaagcatcagctggggttgcatgtaatcttgattcccgcggctttcacgttctatgcaaagcaactgaagaagttgtcgggcacgtgaagccttactcaatcaccggtactttgcctcttattcgagacctcaaggatgaaggtttcgatgtgcaaacttcaggatacggtctgatggctacatatcatgcaaagaacgagtactgccttctttcagacatgtgccaaggctttgatgtcttcgttaggatcatttctcagcttgaacaagactaaagaagatgaatgcaataaaaaagcttctctcttattagctaatggttatatacactttgctttctatctatttgtacaataatgtcaatggttgctcaatacattaaaaagacaattcacaaaatttaaaaacaaa

SEQ ID NO: 4498 - DNA, 3227 bp, Eutrema halophilum
ctttccacgccttctagctaaacatgctgattaatttatttacctcgttattaaattttagtttaactaatgattaaaaaacgtaacactcaacccaaaaggtaaaaagaaaaccttaaacaacacaacacgatttcgccgcaaggctcacacaacaagctaaaaaccgaagctttatttgttttagcaaagcaaaacgaaaaaaaacattctctctggtgtgtgtaactatgtcgtcgtcgtcttcttcgaacgcaatgatcgaatccataggctctcttaacaaagactcattcgtctctcttctatcgaaactcatcggcgaatccaagttcgtacagaacaacccgccggagctaatcccgcaagaggatcgaatcgtgaatcacgtcctcgattctctccgtccgtacagcaccgaaactggtggtggtcgtctggtgatcaaccatgttgcgtatcactcaggaaggggcaatctcatcgtcgagtacccaggttctgtccccggaaagatcctgtctttcgtcggaatgcatatggacgtcgtcaccgcgaatcccgacgaatgggaatttgatcctttctcgctaagcatagatggtgataagcttcgtggtcgtgggactacagattgtcttggtcacgttgctcttgtgaccgagcttatgaagaggcttggggagactaaaccagctttgaaatcatcggtggtggcggttttcatcgccagcgaagagaactcttcgattcctggtgttggtgtggacatgcttgttaaagacaaacttcttgataagctcaaatccggacccttgttttggattgatactgctgataagcagccgtgtattggaaccggaggtatgattccgtggaagcttcatgttaccggaaagcttttccacagtggtttagctcacaaggcgattaacgcgttggagttaggaatggaagggcttaaggaaatccaatcacggttctacagagactttccgcctcacccacaggagaaagtttatggttttgcaacaccatccaccatgaagccaacacaatggagttatccaggaggcggaatcaaccaaatccctggagaatgtaccgtttccggtgatgtcaggttgactcctttctatgacgtcaaggaagtgatgaagaagctgcaagagtatgtagaggacataaacagtaacatagagaaactcgccacccgtggtcctgtttcgaaatacgtcttaccagatgagagtttacggggaaggcttacgttaagctttgatgaagcatcagctggagttgcatgtaaccttgattcccgcggattccatgttctatgcaaagcaactgaagatgttgtcgggcacgtgaagccttactcgatcaccggtactttgcctctaatccgagacctcaaggatgaaggtttcgatgtgcaaacttcaggatacggtctcatggctacatatcatgcaaagaatgagtactgtcttcttacagacatgtgccaaggctttgatgtcttcgttaggatcatctctcaacttgaacaagactaaataaagcagatgacaaaataaaaagctttacatagcttatctcttattagctaatggttctatacacttacttttgctttctatctacttgtacaagtgaatggttgctcaataacataagataatttacaaaattttaaacaagagggtaatgtttttttttattcagttatttatctatctggagttgtcgtcaccttcagtttcaagcttatggacccgtaatcgcagtctttgctggtgatggtgaagcttccagagaccatttcccaatacaacagctgagtatatgccatgtgtgatgataggagcaagaagattgtttgtctgcactgaatccattcaaagccaaggtatagacccaatagcccttcaagaagaggagagtagattttcttcatttgtcttcgttcgtaccacgctacaaaacgaacatagataatctttttaagtgtcttgattgtaaaacatatctgaagtatattatatgctttactgaattttaagcacacctgcaaacaacttcttcagctcgtcacgggcagagcgagttttcaagaccggtgccattatataagtcggatctaagagaagtaacaaaacaagataagccaagaggtcaaaaggtttttgtaacatatattacggttttaacgagtagtgaggaacctttaggggaagcagcgatgtaatagagagaaccagtgagagcggctgtaatagtggctgcaaatgcttgagcaaacggtacaaatggaggcaagattccagtctgaaaatttcaacaatttgaagtcaatttgatattatacgagtctaaggaacaggagggagatgagtaagaagagaaagcataccaaagcaaccattcctcgagaatctgagatgagatctgtgcctcttaggaatatatcagctatatgcggcacaaaacctggaatgcagcgcgatagaagagctcttctccaactgaactagcagcaaccactaagataaactaaagaaagacagaaagacaaggctcaatgattcttctaaatttcaaaagattctattaggaatcttcacctgccaagctgacattccatagaagaagccacgaagctcctcatcttcaacatctctaatggcacgagcgtgcggtgacaatttcacaacttcatcctaaacaaatacaacaaaacattcaaatctttctccataaacaccaagaaaaccttcatcgtcaccatcacaaagatagatccttattccctacttacatcaagaatgaagagaagagccatgatcggtggagaagcataaccaagtccagcaataattgcatctaaagaagcattaaaacctcctgtgtaatcgattcctgctacttcacatataaaccttccagctacagccattccacagtatattcctgctcaatccccaaaatacacaaagttagtatttttgttaatgcttacaacaaatttgcttgatcaccgagttgactcaccgattccataactcagcctaacaacagcaccgattttatcccaagcactaaaatcgccgccgcttccgccgacaaattcgccgactgatgtaacctctcctgaaggtccagccaaaccgccgctaccgccgacaaactctccgccgctgaaacctcccaccgacgttacatct

SEQ ID NO: 4499 - DNA, 3609 bp, Brassica rapa
attaactttcacgccttcgctgtacatacgctaattaatttattcaccgtatcaattattagttaactacttacgcacacatcattacaagacatgtaacactccacccaaaaccttaaaaaaaaaccttcgacaacacacgacttcgccacattctcaaaaccaaagctttcatctctttccgcaaacaaaaaaaaacatctccggtgtgcaacaatggcgtcgtcgatgatcgaatcactaggctctctcaacaaagactccttcgtctcgctcctatccaaactaatcggcgagtcaaagttcgtccagaacaacccaccggagctcatcccgcaggaggatcggatcgtgaaccacgtcctcgactctctccgtccttacagcaccgaatccggcggtggtcctctcgtgatcaaccacgtggcgtatcactcgggaagaggtaacctcatcgtggagtacccaggatccgtccccggaaaaatcgtctctttcgttgggatgcatatggacgtcgtcaccgccaatcccgatgaatgggagtttgatcctttctcgttaagcatagatggggataagcttcgtggtcgtgggactacggattgtcttggccacgttgctcttgtgactgagctcatgaagaggcttggggagactaaaccggctttgagatcatcggtggtggcggttttcatcgctagtgaagagaactcttctattccaggtgttggtgtggacatgttggttaaagacaagcttcttgataagctcaaagccggaccattgttttggattgatacggcggataagcagccgtgtattggaaccggcggtatgattccgtggaagcttcatgttaccggaaagcttttccacagcggtttagctcacaaggctattaacgcgatggagttaggaatggaagggcttaaggagatccaatcccggttctacagagactttcctcctcatgaacaagagaaagtttatggttttgcgacgccttccaccatgaagccaactcaatggagttatccgggaggtggaatcaaccaaatccctggagactgtaccgtctccggtgatgtcaggttgactcctttctatgacgtgaaggaagtgatgaagaagttgcaagagtatgttgacgacataaacgctaacatagagaaactcgctactcgtggtcctgtttcgaaatacgtcttgcctgaagagaatttacgtggaaggctcacgttaagctttgatgaagcatcagctggagttgcgtgtaatcttgattcccgcggctttcacgttctatgcaaagcaactgaagaagttgtcgggcacgtgaagccttactccatcaccggtactctgcctctaatccgagacctcaaggatgaaggtttcgatgtgcaaacttcaggatacggtctgatggctacatatcatgcaaagaacgagtactgccttctttcagacatgtgccaaggctttgatgtcttcgttaagatcatttctcagcttgaacaagactaatgcaataaaaaaagcttcacatagcttctctcttattattagctaatggttctatacactttgctttctatatctattttgtacaacaatgtcaatggctgctcaatacattaaagacaattcacaaaatttaaaaacaaaagggtatttattttagctatttatctatcttgagttgttatcaccttcagtctcaagcttctgtacccttaggcgcagtcgttgctggtgatggtgaagcttccatagaccatttcctagtacaacagctgagtatatcccatgtgtgatgattggtgcaagaagattgtttgtctgcaatattgttttcaatgattattacttcaacaagtcgaagaatagggtttaacaaaagtagtacaatactacctgaatccactcaaagccgaggtatagacccaaaagaccttcgagaagaggagagtagatcttcttcatctgtcttcgctcgtaccacgctgcaggaagtaacacagaggaatccttttaagtatttgatcatagaacatatctaaagtattatgcttagttttaggaacctgcaaacagcttcttcagctcctcacgtgcagagcgagttttcaagacaggtgccattatataagtcggatctaagaaaaataacagaacacaattggttaagaggttatgaaacatagaaaagggctttaagagtagtgagagagacctttaggggaagcagccatgtaatagagagaaccggtgagagcagcagtgatggcagctgcaaatgcttgagcaaagggtacaaacggaggcaagattcctgtctgaaaagtttcaatagtatgaagtcataaaggaaaatgaagaagatgagacagaagagagagtataccaaagcgaccattccccgagaatctgagatgagatctgtgcctcttaagaatatatcagctagcgcaccctgaaacgcagctcgatagaagagctcctctccaattgaacttgcagtaactactaagataaactaaagaaaaaaaagacaaaagggctcaatggtaccaattcttttaaagtttcaaatgatcctgttaaagagttatttcacctgccaagctgacatgccatggaagaagcctcgaagctcctcatcttcaacatctctaatggcacgagcgtgcggcgacaccttcacaacttcatcctacaaaagaaacaatctctcattaaacacaaaaccattaaaagagagagagatgcctgctcttaacttacatcaagaatgaagagaagagccataataggtggagaagcataaccaagaccagcagtaatagcatctaaagaagcattaaaacctcctgtgtaatcaatccctgccacttcacatataaaccttcccgctacagccatcccacagtatatccctactcatatcccacaaaccttaatcaaaatccacaaaagtttcaaacttttttttttttttaaagttagctttgatcaccgagttgactcacccattccgtaactcagcctcacaacagcaccgaccttatcccaaccactgaagtctccgccgccgcttccacccacaaactcgcccaccgatgtaacctctcccgaaggtccagctaactcgccgccgctgaaacttcccaccgacggcacagctaactcgtcgtcgatcacctcgccgctgctctgcgatgacgacgacgacgctttgacagacctcggtttctctaaagaaagaccatttaaccgcgagcttctcttccgctgcaactctgatctcgaactcgccggagaatcgaaaagctttctaaatccaccgcttccactgcaccaagacgaagacgaagaagaagagaaagcgactctcgttgtactgcatgtcaacagaggaagacccatttaactacacgcgatatctctcaggcgaatttatcataatacgccggtgatctcgccggagagactctgttcttagtgagagaaagagacggtgaccgcgcgtttttattttgtaataaatagaaagcaaaactctcaaccgtcggatgatagacacagaggttaatccaacggtta

SEQ ID NO: 4500 - DNA, 2799 bp, Brassica napus
acgacttcgccacattctcaaaaccaaagctttcatcaatttccgcaaacaaaaaaaaaaacatctccggtgtgcaacaatggcgtcgtcgatgatcgaatcactaggctctctcaacaaagactccttcgtctcactcctatccaaactgatcggcgagtcaaagttcgtccagaacaacccgccggagctcatcccgcaagaggatcggatcgtgaaccacgtcctcgactccctccgtccttacagcaccgaatccggcggcggtcctctcgtgatcaaccacgtggcgtatcactcgggaagaggtaacctcatcgtggagtacccaggatctgtccccggaaagatcgtctctttcgttgggatgcatatggacgtcgtcaccgccaatcccgatgaatgggagtttgatcctttctcgttaagcatagatggggataagcttcgtggtcgtgggactacggattgtcttggtcacgttgctcttgtgactgagctcatgaagaggcttggggagactaaaccggttttgaaatcatcggtggtggcggttttcatcgctagtgaagagaactcttctattccaggtgttggtgtggacatgttggttaaagacaagcttcttgataagctcaaatccggaccattgttttggattgatacggcggataagcagccgtgtattggaaccggcggtatgattccgtggaagcttcatgttaccggaaagcttttccacagcggtttagctcacaaggctattaacgctatggagttagggatggaagggcttaaggagatccaatcccggttctacagagactttccgcctcatgaacaagagaaagtttatggttttgcgacgccttccaccatgaagccaacacaatggagttatccgggaggtggaatcaaccaaatccctggagactgtaccgtctccggtgatgtcaggttgactcctttctatgacgtgaaggaagtgatgaagaagctgcaagagtatgttgacgacataaacactaacatagagaaactctcaacccgtggtcctgtttccaaatacgtcttgccagaagagaatttacgtggaaggctcacgttaagctttgatgaagcatcagctggagttgcatgtaatcttgattcccgcggctttcacgttctatgcaaagcaactgaagaagttgtcgggcacgtgaagccttactccatcaccggtactttgcctctaatccgagacctcaaggatgaaggtttcgatgtgcaaacttcaggatacggtctgatggctacatatcatgcaaagaacgagtactgccttcttacagacatgtgccaaggctttgatgtcttcgttaagatcatttctcagcttgaacaagactaatgcaataaaaaaaagcttcacatagcttctctcttattattagctaatggttctatacactttgctttctatatctattttgtacaacaatgtcaatggttgctcaatacattaaagacaattcacaaatttaaaacaaaagggtagtatttattttagctatttatctatctggagttgttatcaccttcagtctcaagcttctgtacccttaggcgcagtcgttgctggtgatggtgaagcttccagagaccatttcctagtacaacagctgagtatatgccatgtgtgatgattggtgcaagaagattgtttgtctgaatccattcaaagcctaggtatagacccaaaagaccttcgagaagaggagagtagatcttcttcatttgtcttcgctcgtaccacgctgcaaacagcttcttcagctcatcacgtgcagagcgagttttcaagataggtgccattatataagtcggatctttaggggaagcagccatgtaatagagagaaccggtgagagcagcagtgatgacagctgcaaatgcttgagcaaagggtacaaacggaggcaagattcctgtcaaagcgaccattccacgagaatctgagatgagatctgtgcctcttaggaatatatcagctagtgcaccctgaaacgcagcacggtagaagagctcctctccaatcgaacttgcggtaactactaagataaactgccaagctgacatgccatggaagaagcctcgaagctcctcatcttcaacatctctaatggcacgagcatgcggcgacaccttcacaacttcatcatcaagaatgaagagaagagccatgataggtggagaagcataaccaagtccagcagtaatagcatctaaagaagcattaaagcctcctgtgtaatcaatccctgctacttcacatataaaccttcccgctacagccatcccacagtatattccgattccgtaactcagcctcacaacagcaccgaccttatcccaaccactaaaatctccgccgccgctcccacccacaaactcgccgaccgatgttacctctcccgaaggtccagctaactcgccgctgctaaaacctcccaccgacggcacagctaaaccgcgcgtcaccgctgcatctccgtcgtcgatcacttcgccgctgctctgtcccgctgatgatgacgacgacgctctgatagacctcggtttctctaaagaaaggccatttaaccgcgagtttctcttcccgtgcaactcggatctcgaactcgccggagaatcgaaaagctttctaaatccaccgcttccactgcaccaagacgaagacgaagacgaagaagaagagaaagccactctcgtcgtactgcatgtcaacaaaggaagacccatttaactacacgcgat

SEQ ID NO: 4501 - DNA, 2111 bp, Brassica napus
attctcaaaaccaaagctttcatctctttccgcaaacaaaaaaaaacatctccggtgtgcaacaatggcgtcgtcgatgatcgaatcactaggctctctcaacaaagactccttcgtctcgctcctatccaaactaatcggcgagtcaaagttcgtccagaacaacccaccggagctcatcccgcaggaggatcggatcgtgaaccacgtcctcgactctctccgtccttacagcaccgaatccggcggtggtcctctcgtgatcaaccacgtggcgtatcactcgggaagaggtaacctcatcgtggagtacccaggatccgtccccggaaaaatcgtctctttcgttgggatgcatatggacgtcgtcaccgccaatcccgatgaatgggagtttgatcctttctcgttaagcatagatggggataagcttcgtggtcgtgggactacggattgtcttggccacgttgctcttgtgactgagctcatgaagaggcttggggagactaaaccggctttgagatcatcggtggtggcggttttcatcgctagtgaagagaactcttctattccaggtgttggtgtggacatgttggttaaagacaagcttcttgacaagctcaaatccggaccattgttttggattgatacggcggataagcagccgtgtattggaaccggcggtatgattccgtggaagcttcatgttaccggaaagcttttccacagcggtttagctcacaaggctattaacgcgatggagttaggaatggaagggcttaaggagatccaatcccggttctacagagactttcctcctcatgaacaagagaaagtttatggttttgcgacgccttccaccatgaagccaactcaatggagttatccgggaggtggaatcaaccaaatccctggagactgtaccgtctccggtgatgtcaggttgactcctttctatgacgtgaaggaagtgatgaagaagttgcaagagtatgttgacgacataaacgctaacatagagaaactcgctactcgtggtcctgtttcgaaatacgtcttgcctgaagagaatttacgtggaaggctcacgttaagctttgatgaagcatcagctggagttgcgtgtaatcttgattcccgcggctttcacgttctatgcaaagcaactgaagaagttgtcgggcacgtgaagccttactccatcaccggtactctgcctctaatccgagacctcaaggatgaaggtttcgatgtgcaaacttcaggatacggtctgatggctacatatcatgcaaagaacgagtactgccttctttcagacatgtgccaaggctttgatgtcttcgttaagatcatttctcagcttgaacaagactaatgcaataaaaaaagcttcacatagcttctctcttattattagctaatggttctatacactttgtctttctatatcttattttgtacaacaatgtcaatggttgctcaatacaattaaagacaattcaactaaattaaaacaaaagggtagtatttattttagctatttatctatctggagttgttatcaccttcagtctcaagcttctgtacccttaggcgcagtcgttgctggtgatggtgaagcttccatagaccatttcctagtacaacagctgagtatatcccatgtgtgatgattggtgcaagaagattgtttgtctgaatccactcaaagccgaggtatagacccaaaagaccttcgagaagaggagagtagatcttcttcatctgtcttcgctcgtaccacgctgcaaacagcttcttcagctcctcacgtgcagagcgagttttcaagacaggtgccattatataagtcggatctttaggggaagcagccatgtaatagagagaaccggtgagagcagcagtgatggcagctgcaaatgcttgagcaaagggtacaaacggaggcaagattccggtcaaagcaaccattccacgagaatctgatataagatttgtgcctcttaagaatatatcagctagtgcaccctgaaacgcagcgcgatagaaggacctcctacccaactcgaacttgactagtaactactaacgataaactgaccaagcta

SEQ ID NO: 4502 - DNA, 1783 bp, Elaeis guineensis
cctagggaaccgaactaggctcgacgatcctatctccactccattgttccctttattctctcttctcccccacccggaaaaaatccaatccaaatccaatggcggcttccgtgaaggatgtgctgggcgagctcgaccgggactcgtacgtctccctcctgaccaagatcgtgggcgaggcccgccacgtccagaacaaccccccggacctcatccccaaggaggaccgcgtcgcccgccacgtcctcgacgccctcctcccactcagcaccaccaccggcggcggccctctcatcgtctcccatgtcgtctacgccgaaggccgcggcaacgtcatcgtcgagtaccccggctccgcccccggtaaaatcctctccttcgtcggctgccacatggacgtcgtcaccgccaaccccaccgactgggactttgatcccttctcgctgagcgtggacggggacaagctccggggccgggggacgacggattgcctcgggcacgtggcgcttgtgacggagctgatgcggcggctggggcagaccaggccggagcttaagaacaccgttgtcgcggtgttcatcgccaatgaggagaactcgtcggtgctggggatcggcgtcgatgccctggtcaaggacgggttgctcgataaattaaaggcaggacctttattttggattgatacggctgacaagcaaccgtgtattggtactgggggaatgatagcgtggaggctccgagccacagggaagcttttccacagcggtcttgcccacaaggctatcaacccgctggagttagccatggaagcacttaaagagattcagtcacgattttatagagacttccctccacatcctaaggaagaggtttatggctttgccacaccatcaacaatgaaaccaacccagtggagttatcctggaggtggtgtcaatcagattccagctgagtgtactatatcgggggatgtaaggttaactcctttctatagcacaacagatgtggtcaagaaattacaggagtatgtagatgatataaatgccaacatagagaagctagattcacgtggcctagtatcaaaatatgtacttccagatgaaaatctgagaggaaggcttacaatcacttttgatgaggctgtgatgtctggggttgcttgcaatcttgattctcgtggttttcatgtcttatgtaaagcaactgaggaagtggttggctatgtgaagccctactcgatcacgggaagcttgccattgattcgagagttacaggatgagggttttgatgtgcaaacttctggatatggcataatggctacataccatgcaaggaatgaatactgcctattttctgatatgtgccaaggtttccgtgtgttcgtgagcatcatctcccaattggaagaggatagcaactgacagatccacttgatttattttctgatatgttccgaggttacaccgtttttgtcatagtgaagttttatgataaacagattattcattatgtaggctgaatccttcttctataccatgcatatggcaagacttttatgatattgcatttcatctgaattctgtacagacaacagttctcgctgaaagcatgtcctagttcaagatcccatcaagaaaacattgtatgaagcaccataaagaaattaatcaacaaatgtactaattcgataaatcgcctgattgttttattagagtaagacaaccatgttattttttttcttctgagaaatagaaccgtctaacttttgactaaaaaaaaaaaa

SEQ ID NO: 4503 - DNA, 1479 bp, Centaurea maculosa
ggggatagagaactttgattcatcaagaaacgtaaagatggtgggtagtggcgtaaaagaaaccctgggagagctgaacaaggattccttcgtaacccttctcggaaaactcatcggagaatccaagtacgttcagaacaacccgccggacctcataccggaggaggatagaatcgtccgccatgtcctcgatgtcctccgaccactttccaccaccaccgccggtggccctcttatcgtcaaccacgctacttataaacctaatagagggaatctgatagtggaataccctggaactgagccaggaaagatcatctcttttgttggaatgcatatggatgttgtcactgctaatccttctgaatgggattttgatccattctcattgagcattgatggagagaagcttcgagggcgtggaacaactgactgtttgggacatgttgcccttgtaactgaactcatgaagaagttagggcagacaaagccaaagcttaagtccactgtggttgccgtcttcatagctagcgaagagaattcttccattccaggagttggtgttgatgcacttgttaaagatggacttcttgataagctaaagcatggacctttgttttggatcgacacagctgataaacaaccttgtattggtacgggtggtatgataccttggaagcttcacgttaccgggaagctttttcatagtggtctagcacacaaggctattaatccttttgagctagcaatggaggcactgaaagagatccaaacaaggttttatagagatttccctcctcattctaaagaacaagtttatggatttgcaactccttcaactatgaaaccaactcagtggtcttatccaggaggtgggatcaaccaaattcctgctgattgcaccatctcaggagatgtcaggttgacgccattttacaatgtgccagatgtaatcaagaagctaaaagagtacgtagaagatttaaattcgaatattgagaagcttgatacaagagggcctgtgtcaaaatacgttctaccagatgagaacctcagagggagaattgagatttcatttgatgaagcgtcatctggagttgcatgtaacctcgagtctcgtggcttccatgtgttgtgccaagctactaaagatgctgttggccatgtaaaaccctactccataactggaactttgccgctaattcgagaactacaggatgaaggttttgatgttcaaactgcaggctatgggttgatggctacttaccatgcaaaaaacgagtattgccttctatccgacatgtgccaaggctaccaggtgttcaccggtattattgctcagcttgaggagtagtcgtccttttttttaacacctttttagttacgttgtatcgtaatcaatgaaacctatgcatataacaaataactagtttgactggattcttaatctatagtcgtttcttagaggtagtttagataagc

SEQ ID NO: 4504 - DNA, 2826 bp, Brassica oleracea
  misc_feature (217)..(217): n is a, c, g, or t
  misc_feature (254)..(254): n is a, c, g, or t
  misc_feature (1483)..(1483): n is a, c, g, or t
  misc_feature (1819)..(1820): n is a, c, g, or t
  misc_feature (1827)..(1827): n is a, c, g, or t
  misc_feature (1841)..(1841): n is a, c, g, or t
  misc_feature (1850)..(1850): n is a, c, g, or t
  misc_feature (1859)..(1859): n is a, c, g, or t
  misc_feature (2027)..(2027): n is a, c, g, or t
  misc_feature (2030)..(2030): n is a, c, g, or t
  misc_feature (2048)..(2048): n is a, c, g, or t
  misc_feature (2050)..(2050): n is a, c, g, or t
  misc_feature (2060)..(2060): n is a, c, g, or t
  misc_feature (2062)..(2062): n is a, c, g, or t
  misc_feature (2093)..(2093): n is a, c, g, or t
  misc_feature (2128)..(2128): n is a, c, g, or t
aatttccgcaacaaaaaaaaaaacatctccggtgtgcaacaatggcgtcgtcgatgatcgaatcactaggctctctcaacaaagactccttcgtctcactcctatccaaactgatcggcgagtcaaagttcgtccagaacaacccgccggagctcatcccgcaagaggatcggatcgtgaaccacgtcctcgactccctccgtccttacagcaccgnatccggcggcggtcctctcgtgatcaaccacgtggcntatcactcgggaagaggtaacctcatcgtggagtacccaggatctgtccccggaaagatcgtctctttcgttgggatgcatatggacgtcgtcaccgccaatcccgatgaatgggagtttgatcctttctcgttaagcatagatggggataagcttcgtggtcgtgggactacggattgtcttggtcacgttgctcttgtgactgagctcatgaagaggcttggggagactaaaccggttttgaaatcatcggtggtggcggttttcatcgctagtgaagagaactcttctattccaggtgttggtgtggacatgttggttaaagacaagcttcttgataagctcaaatccggaccattgttttggattgatacggcggataagcagccgtgtattggaaccggcggtatgattccgtggaagcttcatgttaccggaaagcttttccacagcggtttagctcacaaggctattaacgctatggagttagggatggaagggcttaaggagatccaatcccggttctacagagactttccgcctcatgaacaagagaaagtttatggttttgcgacgccttccaccatgaagccaacacaatggagttatccgggaggtggaatcaaccaaatccctggagactgtaccgtctccggtgatgtcaggttgactcctttctatgacgtgaaggaagtgatgaagaagctgcaagagtatgttgacgacataaacactaacatagagaaactctcaacccgtggtcctgtttccaaatacgtcttgccagaagagaatttacgtggaaggctcacgttaagctttgatgaagcatcagctggagttgcatgtaatcttgattcccgcggctttcacgttctatgcaaagcaactgaagaagttgtcgggcacgtgaagccttactccatcaccggtactttgcctctaatccgagacctcaaggatgaaggtttcgatgtgcaaacttcaggatacggtctgatggctacatatcatgcaaagaacgagtactgccttcttacagacatgtgccaaggctttgatgtcttcgttaagatcatttctcagcttgaacaagactaatgcaataaaaaaaagcttcacatagcttctctcttattattagctaatggttctatacactttgctttctatatctattttgtacaacaatgtcaatggttgctcaatacattaaagacaattcacanaatttaaacacaaaagggtagtgttttattcatttattttttaatctatcttgaactgttgttgtcaccttcagtttcaagcttatgtacccggaggcgcagtctttgctggtgatggtgaagcttccagagtccattacccaatacaacagccgagtatatgccatgtgtgatgataggagcaagaaggttgtttgtctgaatccattcaaagcctaagtacagacccaaaagcccttcaagaagaggagagtagatcttcttcatctgtctcctctcgtaccacgctgcaaacaactgcttgagctcgtcacgggcagaaggagttttcaagannggtgccnttatataagtcggntctttaggngaagcagcnatgtaatagagagagccagtgagagcggcggtaatagcggctgcaaacgcttgagcaaacggtacgaacggaggcaatagtccagtcaaagcgaccattcctcgaggatctgagatgagatctgtgcctcttaggaatatatcagctagtgcaccctgaaacgcagcncgntagaagagctcctctccnancgaacttgcngnaactactaagataaactgccaagctgacatnccatggaagaagccacgaagctcctcatcttcaanatctctaatggcacgagcgtgcggcgacactttcacaacttcatcatcaagaatgaagagaagagccatgataggtggagaagcataaccaagaccagcgataatagcatctaaagaagcattaaaacctcctgtgtaatcgattcctgctacttcacatataaaccttcccgccacagccattccacagtatattccgattccgtaactcagcctaacaacagcaccgatcttatcccaatctccgccgcttccaccgacaaactccccgactgacgtcacctctcccgacggtccagctaacaccccgctgccgaagcttcccaccgacgttacatctcccgaaggcacagctacacttcttgccgccgccgccgcatccccgtcgtcgatcacttcgccgctactctgtcccgacgaagacgctttaactcccctcgacttctctaacgaaagactgcttctcttcccgctacgcttccgaagctccgatctcgaactcgccggagactcgtaatgcctataactacgatcactactcttgaaccatgacgaagacgaagacgaagacaaagaagaagaggagaaagcgactcttgtcgtactacaagtcaacaaaggaagacccattagattttacacgcgacagctctcaggcgaattcgccggagagactctgttcttcatctagtgtgagc

SEQ ID NO: 4505 - DNA, 1822 bp, Brassica rapa
aacgtaaccgaagctgtaagactctcttctgtctcttgtgtgctagcaacaacaatggaatccttaggctctcttaacaaagactcattcgtttcactcttatcgaaactcatcggcgaatccaagttcgtccagaacaatccgccggagctcatcccgcaagaggatcgaatcgtaaaccacgtcctcgactctctccgtccttacagcacagaaactggtggtggtcctcttgtgatcaatcatgtggcgtatcactcgggaagaggcaacctcatcgtggagtacccaggatctgtccccggaaagatcttgtctttcgtcggaatgcacatggacgtcgtcaccgccaatcccgacgaatgggagtttgatcctttctcgctgagcatagatggggataagcttcgaggtcgtgggactacggattgtcttggtcacgttgctctagtgactgagctcatgaagaggcttggggagactaaaccggcgttgaaatcatcggtggtggcggtttttattgctagtgaagagaactcttcgattccaggtgttggtgtggacatgctggttaaagacaagcttcttgataagctcaaatccggaccattgttttggattgatactgcggataagcagccgtgtattggaacgggtgggatgattccttggaagcttcatttaaccggaaagcttttccacagcggtttagctcacaaggcgattaacgctatggagttaggaatggaagggcttaaagaaattcaatcccggttctacagagactttcctcctcacccacaagagaaagtgtatggttttgccacgccatccaccatgaagccaacacagtggagctatcctggaggcggaatcaaccagattcctggagaatgtaccatctccggtgatgtcaggttgactcctttctatgacgtgacggaagtgatgaagaagctgcaagagtatgtagacggcataaacactaacatagagaatctcgcaacccgtggtcctgtttccaaatacgtcttaccagatgagaacttacgtggaaggctaacgttaagctttgatgaagcatcagctggagttgcatgtaatcttgattcccgcggctatcacgttctttgcaacgcaaccaaagaagtcgtcgggcacgtgaagccttactcgatcaccggtactttgcctcttatccgagacctcaaggatgaaggtttcgatgtgcaaacttcaggatacggcctcatggctacatatcacgcaaagaacgagtactgtcttcttacagacatgtgccaaggctttgatgtcttcgttaggatcatttctcaacttgaacaagactaaacactttactttgaagacaataaaaataaaagcttcaagtagctgctctcttatttggttctaaacactttactttctatttgtacaagtcaatgaaggttcaatacataaaagacaatttacaaaactttaaacacaaaagggtagtgttttattcatttattttttaatctatcttgtactgttgttgtcaccttcagcttcaagcttatgtacccgtaggcgtagtctttgttggtgatggtgaagcttccagagaccattacccaatacaacagccgagtatatgccatgtgtgatgataggagcaagaaggttgtttgtctgaatccattcaaagccgaggtagagacccaaaagcccttcaagaagaggagagtagatcttcttcatctgtctcctctcgtaccacgctgcaaacaacttcttgagctcgtcacgggcagaaggagttttcaagacgggtgcc

SEQ ID NO: 4506 - DNA, 1634 bp, Catharanthus roseus
taaagcaaacgctaggcgatctggacaaggaatcattcgtgacccttttatccaaactgatcggagagtcgaagtacgtacagaacaacccaccggagctgatcccagaggaggacagaattgtaaatcatgtattggagaagctccaacctttcagcaccgccaatggtggtccgcttataatcaaccatgtcgcctacaagcccaagagaggaaaccttattgtggagtatcccggaactgtgcctaacaaaattctctcatttgtggggatgcacatggatgtcgttactgccaacccttctgattgggaatttgatccattttccatgagcattgatggagataaacttcggggacgtgggactaccgattgcttagggcatgttgctcttgtagctgaacttatgaggaaattaggtgagacaaagccacaattgaaatccactgttgtagctgtcttcattgccagtgaggaaaactcatctattcctggggttggtgtggatgcgttggtgaaggatggattgcttaataaattgaaacatggccctctattttggattgacacagctgataaacagccttgcatcgggactggtggcatgataccatggaaacttcatttctccggaaagcttttccacagtggtctgcctcacaaggctattaatccattggagcttgccatggaagcatttaaagagattcagttacggttctataaagacttcccttcccatcccaaagaacaactttatggattcgcaacaccgtcaaccatgaaaccaactcaatggagttatccagggggtggtataaatcaaattccagctgagtgtaccatttcaggggatgtcaggttgactccattttacaatgtatcggatgtgataaagaaattagaggagtatgttgaagacttaaatcagaacatagaaaagcttgatactcgaggtcctgtttcaaaatatgtgctaccagaagaaaacctcaggggaaggattggtataacttttgatggggcaaattctggagttgcatgtaatcttgaatccaatggcttcaaagtattatgcaaagctactgaggaggtggttggtcatgtaaagccatactcaattacaggcagtttgccactgatacgggaattgcaggatgagggattcgatgtgcaaactgctggctatggtttaatggcaacttaccatgcgaagaatgaatactgccttctttcagacatgtgccagggttaccaaatctttgccagcatcatttcacagcttgaagatttatcataaacaacagatcataccccaatggccctttttagatggtattagagcttgatcaccagatcatgtcggataaagttggcttgtgtatctgatgagatgaatctacaattgttcttcttccatatttcagtaacaagttaaaagtttttctttgttagacctcttttctgatggggagattggtcaagacctcttattcaacgtgtatattaaaccatatacagagtaaatttgccaaaagaggaaaaccatatacatagaaataaaaacggcaacatctgatgacattattacattttattaaatcaaacaacaaaaaaatattcttatcaaaaa

SEQ ID NO: 4507 - DNA, 1767 bp, Eutrema parvulum
ttcgccgcattctcaactatggcgtcgtcttctaaggcaatgatcgaatcattaggctctcttaacaaagactctttcgtctcactcctatcgaaactcatcggcgaatcgaagttcgtccagaataatccgccggagctcatcccgcaagaggatcgaatcgtaaatcacgtcctcgattctctccgtccttacagcaccgaaactggtggtggtcctcttctgatcaatcatgttgcgtatcattcaggaagaggtaatctcatcgtcgagtacccaggatctgtccccggaaagatattgtctttcgtcggaatgcatatggacgtcgtcaccgcgaatcctgatgaatgggaatttgatcctttttcgctaagcgtagatggggataagcttcgtggtcgtgggactacagattgtcttggtcacgttgcccttgtgaccgagctcatgaagaggctcggggagaccaaaccggcgttgaaatcatcggtggtggcggttttcatcgccagcgaagagaactcttccattccaggtgttggtgtggacatgcttgttaaagacaaacttcttgacaagctcaaatccggaccattgttttggattgatactgcggataagcagccgtgtattggaactggtggaatgattccgtggaagcttcattttaccggaaagcttttccacagcggtttagctcacaaggcgattaatgcgttggagttaggaatggaagggcttaaggaagtccaatcccggttctacaaagacttcccgcctcacccacaagagaaagtttatggctttgcgacaccatccaccatgaagccaacacaatggagttatcctgtaggcggaatcaaccaaatccctggagaatgtaccgtttccggtgatgtcaggttgactcctttctatgacgtgaaggaagtgatgacgaagctgcaagagtatgtagacgacataaacactaacatagagaacctcgctacccgcggtcctgtttcgaaatacgtcttaccagatgagaatttacgtggaaggctcacgttaagctttgatgaagcttcagctggagttgcatgtaatcttgattcccgcggctttcacgttctatgcaaagcaaccgaagaagttgtcgggcacgtgaaaccttattcgatcaccggtactttgcctctaatccgagacctcaaggatgaaggtttcgatgtgcaaacttcaggatatggtctcatggctacatatcatgcaaagaacgagtattgtcttctgacagacatgtgccaaggctttgatgtcttcgttaggatcatttctcaactagaagaagactaaaatcagatagaagaaaacaaaataaaagcttcatatagctttctctcttatttactaatggtttctatacacttactttgctttatatctatttgtacaagtcaatggtggctcaatacaaaagaaaatttacaaaatttaaaacaaaggataatgttttattcagttattttatctatcttgagttgttgtcaccttcagtttcaagcttctgtacccgtaggcgcagtctttgctggtgatgatgaagcttccagaggccatttcccaatacaacagctgagtatatgccatgtgtgatgataggagcaagaagattatttttttgcctgaatccattcaaagccgaggtatagacccaacagcccttcgagaagaggagagtagattttcttcatttgtcttcgctcgtaccaagctgcaaaa

SEQ ID NO: 4508 - DNA, 1633 bp, Plantago ovata
cggccgggggcgtaaattggattggattgagcagaaatatagtactactagcagcacccaaacttatccgcatctgaaagcaacaatggcgacagtgaagcagattctaggggacctaaacaaggaatcgttcgtctcactcctatccaagctcatcggcgagtcaaagtttgtccagaacaacccgccggagttgattcctgaggaggatcggatcgtcaaccacgtcctcgatgtcctcaaaccattcagcaccgccaccggcggaggtccacttgtcatcaaccacgtggcctacaagccgaacagaggaaacctcatcgtcgaataccctggtactcaacctggaaagatcatgtcctttgttggtatgcatatggacgtcgtcactgccaatccctccgattgggattttgatcctttcactttgggcatcgaaggagacaagcttaaagggcgtggaactactgattgtttggggcatgtagcccttgtagctgaattgatgagacgtctgggagagacaaagcctaagttaacttccactgtggttgctgtctttattgccagtgaagagaattcatctattcctggggtcggagttgatgctttagtgaaggatgggttactggatagcttaaagcagggacctctcttttggattgatacagcagacaaacagccttgcattggtactgggggtatggtaccatggaagctccatatttctggaaaacttttccacagtggtctagcccacaaggcaatcaatccactcgagctggcaatggaagcctttaaagagattcagttacgattttatcgagactttccacctcatgcaaaagaagagctttatggatttgcaacgccttccactatgaaaccaactcagtggagttatccaggcggcggtatcaatcaaatcccagctgagtgcacactctgcggagatgttaggttgaccccattttacagtgtaacagatgtaataagtaaacttaaagagtatgttgatgacttgaatgccaacatcgaaaagctggacacacgaggacccgtatctaagtatgtcctaccagatgagaacctcacgggaagattatctattagttttgacgaagcgaattctggagtggcctgtagtctcgattctcgtggtttccatgtgctgtgcaaagctactgaagaggtggttggacatgtaaaaccctattccattacgggtagcttaccactcattcgtgaactgcaggatgagggctttgatgtgcaaacttgtggctatggcttaatggctacatatcatgcgaagaatgagtattgccttctctcggacatgtgccagggatatggggtgtttgttagtatcatttcgcagctggaggactgaatgagattgttcgttgacagaaatcgaatgactgattgaagattcgacttatttaaggacttgatgtaggtgaaatgggacactaccttttgacttgagcattgagaataacacaatagtcaatagggtgctcttgtccatggctggtgtaggggttaaaagagtcgaaagaaaacagaaggatgtactctgactttgttatcatttatcagatcaataccaaagtttatacgaaaaaaa

SEQ ID NO: 4509 - DNA, 1655 bp, Tabernaemontana elegans
tgaagcaagcgctaggtgatctgaacaaggaatcattcgtgacccttttgtcaaagctgataggggagtcggagcacgtccagaacaatccaccggagctgatccccgaggaggacaggattgtaaagcacgtaaaggagaagctcctccctttcagcaccaccacttgcggtggtccacttatcatcaaccatgtcacctacaagcccaatagaggcaaccttattgtggagtaccctggaactgagcctaacaaaattgtctcctttgttggcatgcatatggatgtcgttactgccaaccgttctgattgggaatttgatcctttttcattgagcattgatggagataaactacggggacgtggaactactgattgcttagggcatgttgctcttgtagctgaacttatgaggaaattaggagagacaaagccacaattgaaatccactgttgttgctgtttttatcgctagtgaggaaaactcatctattcctggggttggtgtggatgcattggtgaaacatggattactcaataaattaaaaaatggccctctcttttggattgacacagctgataaacagccttgcattgggactggtggcatgataccgtggaagcttcatgtcactggaaagcttttccacagtggtctgcctcacaaggctatcaatccattggagcttgcgatggaagcacttaaagagatccaattacggttctataaggacttccctccccatcccaaggaacaagtttatggatttgcaacaccatcaacaatgaaaccaactcaatggagttatccagggggtgggattaatcaaattccttttgactgtacgatttcaggggatgttaggttgactccattttacaatgtatcggatgtgataaagaagttacaggggtacgttgaagacttaaatcagaacattgaaaagcttgatactcgaggccctgtttccaaatatgtgctaccggaggaaaacctcaggggaaggattgatataagttttgatgaggctaattctggagttgcatgtgatcttgaatcccgtggcttcaaagtattatgcaaagctactgaggaggtggttggccatgtaaaaccctattctattactggtagtttgccacttataagggaattgcaggatgaaggcttcgacgttcaaactgctggctatggcttaatggcaacataccatgccaggaatgaattctgccttctttcagacatgtgccagggctacaaaatctttgccagtgtcatttcacagctagaagattgaccataatgacaggccattgttggatggtattaaagcttgaccatcatagatcatgctgagaagaaatatggccttctcctttatctgctgatgaatttacttgttcttcttcaacattcgctattgtgctaaggttttctcttcacacccgacttcttatatatggagagagatatctctttggaaatctttgtgcactaatatgaaagtaaattgtgttaattggttttcaaacgattcactcaccagagtcgggatggatagctgtgactttgtttacaacaggttgtaggttttgggtccaatctagtgaaaaataaatttgtccttcagtttagccttccgcctttttcattc

SEQ ID NO: 4510 - DNA, 1401 bp, Centaurea maculosa
gaatcaatctttgagatcttaaaaatggtgggcagtggcgtaaaagaaacgcttggagagctgaacaaggattccttcgtaaccctaatcggaaaactcatcggagaatcaaagtacgttcagaacaacccgccggacctcatcccggaggaggatagaatcgtccgccatgtcctcgatgtcctccgcccactttccaccaccaccggcggaggacctcttatcgtcaaccacgttacctataaacctaatagagggaatctgatagtggagtaccctggaactgaaccaggaaagatcatctcttttgttggaatgcatatggatgttgtcactgctaatccttctgaatgggattttgatccattctcattgagcattgatggagagaagcttcgagggcgtggaacaactgattgtttgggacatgttgcccttgtaactgaactcatgaagaagctagggcagacaaagccaaagcttaagtccactgtggttgccgtcttcatagctagtgaagagaattcttccattccaggagttggcgttgatgcacttgttaaagatggacttcttgataagctaaagcatggacctttgttttggatcgacacagcggataaacaaccttgcattggtacgggtggtatgataccttggaagcttcacgttaccgggaagctctttcatagcggtctagcacacaaggctattaatccttttgagctagcaatggaggcactgaaagagatccaaactaggttttacagagatttccctcctcattctaaagaacaagtttatggatttgcaactccttcaactatgaaaccaactcagtggtcctatccgggaggtgggatcaaccaaattcctgctgattgcaccatctcaggagatgtcaggttgacgccattttacaatgtgccggatgtaatcaagaagctaaaagagtacgtagaagatttaaattcgaatattgagaagcttgctacaagagggcctgtgtcaaaatacgttctaccagatgagaacctcagagggagaattgagatttcgtttgatgaagcgtcatctggagttgcatgtaaccttgagtctcgtggcttccatgtgttgtgccaagctactaaagaggccgttggccatgtaaaaccctactccataactggaactttgccgctaataagagaactacaggatgaaggttttgatgttcaaactgcaggctatgggttgatggctacttaccatgcaaaaaatgagtattgccttcttcccgacatgtgccaaggctaccaggtgttcaccggtattattgctcagcttgaggagtagtcgccttttttttaacacctttttagtttacgttgtatcgtaatcaatgaaaccaatgcatat

SEQ ID NO: 4511 - DNA, 2711 bp, Brassica napus
ccttcagtcgctttaccgtcaacaaaaaaaaacaatttccggtgtgcacaatggcgtcgtcgatgatcgaatcactaggctctctcaacaaagactccttcgtctcgctcctatccaagactgatcggcgagtcaaagactcgtccagaacaacccgccggagctcatcccgcaggaggatcgaatcgtgaaccacgtcctcgactctctccgtccttacagcaccgaatccggcggtggtcctctcgtgatcaaccacgtggcgtatcactcgggaagaggtaacctcatcgtggagtacccaggatccgtccccggaaaaatcgtctctttcgttgggatgcatatggacgtcgtcaccgccaatcccgatgaatgggagtttgatcctttctcgttaagcatagatggggataagcttcgaggtcgtgggactacggattgtcttggtcacgttgctcttgtgactgagctcatgaagaggcttggggagactaaaccggctttgagatcatcggtgatggcggttttcatcgctagtgaagagaactcttctattccaggtgttggtgtggacatgttggttaaagacaagcttctcgacaagctcaaagccggaccattgttttggattgatacggcggataagcagccgtgtattggaaccggcggtatgattccgtggaagcttcatgttaccggaaagcttttccacagcggtttagctcacaaggctattaacgcgatggagttaggaatggaagggcttaaggagatccaatctcggttctacagagactttcctcctcatgaacaagagaaagtttatggttttgcgacgccttccaccatgaagccaactcaatggagttatccgggaggtggaatcaaccaaatccctggagactgtaccgtctccggtgatgttaggttgactcctttctatgacgtgaaggaagtgatgaagaagctgcaagagtatgttgacgacataaacactaacatagagaaactctcaacccgtggtcctgtttcgaaatacgtcttgccagaagagaatttacgtggaaggctcacgttaagctttgatgaagcatcagctggagttgcgtgtaatcttgattcccgcggctttcacgttctatgcaaagcaactgaagaagttgtcgggcacgtgaagccttactccatcaccggtactctacctctaatccgagacctcaaggatgaaggtttcgatgtgcaaacttcaggatacggtctgatggctacatatcatgcaaagaacgagtactgccttctttcagacatgtgccaaggctttgatgtcttcgttaagatcatttctcagcttgaacaagactaatgcaataaaaaagcttcacatagcgtctctcttattattagctaatggttctatacactttgctttctatatctattttgtacaacaatggcaatggttgctcaatacattaaagacaattcacaaaattttaaaacaaagagtaatacttattttagctatttatctatcttgagttcttgttgtcaacttcagtttcaagcttctgtacccttaggcgcagtcgttgctggtgatggtgaagcttccatagaccatttcctagtacaacagctgagtatatcccatgtgtgatgattggtgcaagaagattgtttgtctgaatccactcaaagccgaggtatagacccaaaagaccttcgagaagaggagagtagatcttcttcatctgtcttcgctcgtaccacgctgcaaacagcttcttcagctcctcacgtgcagagcgagttttcaagacaggtgccattatataagtcggatctttaggggaagcagccatgtaatagagagaaccggtgagagcagcagtgatggcagctgcaaatgcttgagcaaagggtacaaacggaggcaagattccggtcaaagcaaccattccacgagaatctgatataagatttgtgcctcttaagaatatatcagctagtgcaccctgaaacgcagcgcgatagaagagctcctctccaactgaacttgcagtaactactaagataaactgccaagctgacatgccatggaagaagcctcgaagctcctcatcttcaacatctctaatggcacgagcgtgcggcgacaccttcacaacttcatcatcaagaatgaagagaagagccatgataggtggagaagcataaccaagaccagcagtaatagcatctaaagaagcattaaaacctcctgtgtaatcaatccctgctacttcacatataaaccttcccgctacagccatcccacagtatatccccattccgtaactcagcctcacaacagcaccgaccttatcccaaccactgaaatctccgccgccatttccacccacaaactcgcccaccgatgtaacctctcccgaaggtccagctaactctccgccgctgaaacttcccaccgacggcacagctaactcgtcgtcgatcacctcgccgctgctctgcgatgacgacgacgacgctttgacagacctcggtttctctaaagaaagaccatttaaccgagagcttctcttccgctgcaactcggatctcgaactcgccggagaatcgaaaagctttctaaatccaccgcttccactgcaccaagacgaagacgaagaagaagagaaagcgactctcgtcgtactgcatgtcaa

SEQ ID NO: 4512 - DNA, 1517 bp, Raphanus sativus
  misc_feature (251)..(251): n is a, c, g, or t
  misc_feature (287)..(287): n is a, c, g, or t
gggacttcgccatattctcaagtcttaactaaaagaaaaacacacatctccggtgtgcaacaatggcgtcgtcgacgatcgaatcatcactaggctctctcaacaaagactccttcgtctcgctcctatcgaaactgatcggcgaatcgaagttcgtccagaacaacccgccggatctcatcccgcaggaggatcggatcgtgaaccacgtcctcgactctctccgtccttacagcaccgaatccggcggnggccctctcttgatcaaccacgtggcgtatcactcnggaagaggcaacctcatcgtcgagtacccaggatccgtccccggaaagatcgtttctttcgtcggtatgcacatggacgtcgtcaccgcgaatcccgatgaatgggagtttgatcctttctcgttaagcatagatggggataagcttcgtggtcgtgggactacggattgtcttggtcacgttgctcttgtgactgagctcatgaagaggcttggggagactaaacccgttttgaaacaatcggtggtggcggttttcatcgctagtgaagagaactcttctattccaggtgttggtgtcgacatgttggttaaagacaaacttcttgacaagctcaaatccggaccattgttttggatagatacggcggataagcagccgtgtattggaaccggtggtatgattccgtggaagcttcatgttactggaaagcttttccacagcggtttagctcacaaggctattaacgcgatggagttgggaatggaagggcttaaggagatccagtcccggttctacagagactttcctcctcatgaacaagagaaagtttatggttttgcgacgccttccaccatgaagccaactcaatggagttatccgggaggtggaatcaaccaaatccctggagactgtaccgtatccggtgatgtcaggttgactcctttctatgacgtgaaggaagtgatgaagaagctgcaagagtatgttgacgacataaacactaacattgagaaactcgcgacccgtggtcctgtttcgaaatacgtcttgcctgaagagaatttacgtggaaggctcacgttaagctttgatgaagcatcagctggagttgcgtgtaaccttgattcccgcggctttcacgtactatgcaaagcaaccgaagaagttgtcgggcacgtgaagccttactccatcaccggtactctgcctctaatccgagacctcaaggatgaaggtttcgatgtgcaaacttcaggatacggtctgatggctacatatcatgcaaagaacgagtactgccttcttacagacatgtgccaaggctttgatgtcttcgttaagatcatttctcagcttgaacaagactaaagaagatgaatgcaataaaagcttctctcttattattagctaatggttctatacactttgctttctaagtttctatctatttgtacaatgtcaatggttgctcaataaagaaaagacaattcacaaaatttaaaagca

SEQ ID NO: 4513 - DNA, 1538 bp, Tragopogon dubius
agagaattctgatctgtaccgcaacattctcccagtttgctaaaaccacactctcccctctctccggcgatggtggcttcagccgtaaaagaaactctcggagacctaaacaaggattctttcgtcacccttctcaccaaactcatcggagaatccaaatacgttcagaacaatccaccggacctcatcccggaggaggatagaatcgttcgccatgttcgtgatgtcctcctccctcatagcaccgccaccggcggcggcccactcatcatcaaccatgtcacatataaacccaatagagggaatctcatagtggagtaccctggaactgaatccggaaagatcctttcttttgttggaatgcatatggatgtcgtcaccgcaaatccttctgaatgggattttgatccattttcaatgagcattgacggagacaagcttcgtgggcgtgggacaaccgattgtttgggacatgttgcccttgtagccgagctcatgaagaagctagggcaaacaaagccaaaacttaaatccactgtggttgctgtgttcatagcaagtgaagagaactcttccattccaggagttggtgttgatgcacttgttaaagatggactccttgataagctgaaatatgggcctttgttttggattgacacagccgataaacaaccttgcattggtacgggtggtatgataccatggaaacttcatgtcatcggaaaactttttcacagtggtctagctcacaaggctattaatccttttgagctagcgatggaagcactcaaagagatccaaacaaggttttacaaagatttccctcctcattctaaagaagaagtttatggatttgcaacaccttcgactatgaaaccaactcaatggacttaccctggaggtgggatcaatcaaattccttccgattgcacgatttcgggagatgttaggttgaccccattttacaatgtgccagatgtaattaagaaacttaatgaatatgtagaagatttaaatacaaatatacagaagattgcgacaagggggcccgtgtcaaaatatgtcttaccagatgagaaccttagagggaaaattgagatttcgtttgatgaggcatcatcgggagttgcatgtaacctggagtcacgtggcttccatgtgttgtgtgacgctactaaagatgctgtgggacatgtaaaaccctactccataactgggaccttgcctcttatacgagaactacaagatgaaggttttgatgttcaaactgcaggctatgggttgatggctacttatcatgcgaaaaacgagtattgccttctttctgacatgtgtcaagggtaccaagtgtttactggtatcattgctcggctagaggagtgatttgtctttttgaacaccctttcagttgaataattgtttttagtttcttaattgagaatttgggattagattactagaaaccatgtgtttatcaagtttgaaacttcaaccatgttttattacataaagttaaaaacaacaaaattaagttcgca

SEQ ID NO: 4514 - DNA, 1055 bp, Glycine max
ttttttttagttgttgttgtgtacttgtgtttcaattcattcttcggttgttctctatttgcgttttctcattttctttctttcgttctcttccgtggaacgagtagtagaaacttgaaatcaaaaggcagcgggggaaaaagaaaagagagaagtagggttcgaaaatggcagcagaatcatcagagggcgaagaagaaaccaagttaagcggaggtaaccaattgctcatagttgacgatgacttaacggaaatgggaaagaaagccgcttggagcgtgagttcctgcaaacccggtaacggcgtttcctctctccgtgacgacaatctcgaaacttattggcaatccgacggagggcaaccccatttagttaacattcagtttcagaagaaagttagacttcaattaattgtgctgtacgtggatttcaagcttgacgagagttacacgccgagcaaagtttccatccgtgccggtgatggttttcacaacttgaaggagattaagaccgtggaactcgtgaagccaactggatgggtttatctttccttgtctggagttgatcctagggatacctttgtgaatactttcatgttgcaaattgctgtgttgtcaaaccatctcaatggaagggatactcacgtgcggcagatcaaagtttacgggcctcgaccgaaccctatcccacatcagccattccaatttacttcaagggaattcatcacctactcttctataagatgagagtttatggaaggatttgatgaagccaccaagtgttaaatcaaaggatgcttcccactaagttattatagcatctggaaggtctgaaaccaaatcactacagaccgaaatgtcaaaaatacatttcacttcaatagtattcttaaaaattgtcatatcagtaaatgtggccatcagtgattcagtatcctttgtgtcttgctagtatttataatttgttgagatttgcaatgctattcagggtttgacttccttgaagagttctatatttattaattaacaaaatgatatgtgcattgtgtgaatttc

SEQ ID NO: 4515 - DNA, 1047 bp, Vigna unguiculata
gaagaatcttgaaaaataagagagagagatagggttgtctgaggtttcggggaatggcagcagaatcatcagagggcgaagaagaaacaaagttgagcggaggaaaccaattgttgacggtagacgatgacttaacggagatggggaaaaaagctgcttggagcgtcagttcttgcaagcccggtaacggtgtttcctctctccgtgacgataacctcgaaacctattggcaatccgacggagcgcaaccccatttggttaacgttcagtttcagaagaaagttagacttcaactaattgtgctgtacgtggatttcaagttggacgagagttacacgccgagtaaagtttccatccgtgccggtgatgggtttcacaacttgaaggagattaagaccgtggaactagtgaagccaactgggtgggtctatctgtcgttgtctggagttgatcctagggatacctttgtgaacactttcatgttgcaaattgctgtgttgtcaaaccatctaaatggaagggatactcatgtgcggcaaatcaaagtttatgggcctcgaccgaatcctattccacaccagccatttcaatttacttcaagggagttcatcacctactcttctataagatgagaatttacggaaagagttaatgaagaaacctggtcttaaatcaaaggatgctgctcattaagtgattatattatctggaatgtctgaaaccaaatcactactggccgaaatttcaagtatatttcacttcaatattcttaaaaattgtcatcagtaaatgaggccatcagtaattcaggaccctgtgtctcgcaaatatttatatttcgttttacttgtgctagtgctctatagtagaagctgtagattcagctattactagatattttccttgtggtttgtatcagttagttgtattagtttttctgtttcacagtcagttagtttctgtcagttttcagctttacatagtcttatataaactttgttctgtgtacactttattcagttgttaatacaacgagaaattatcccc

SEQ ID NO: 4516 - DNA, 1189 bp, Glycine max
atttaaaaccaggcctaattttaattctaatttataaaaactgaaaaacataaaactaaaagtcccccctttgtttttttttagttgttgttgtgtacttgtgtttcaattcattcttcggttgttctctatttgcgttttctcattttctttctttcgttctcttccgtggaacgagtagtagaaacttgaaatcaaaaggcagcgggggaaaaagaaaagagagaagtagggttcgaaaatggcagcagaatcatcagagggcgaagaagaaaccaagttaagcggaggtaaccaattgctcatagttgacgatgacttaacggaaatgggaaagaaagccgcttggagcgtgagttcctgcaaacccggtaacggcgtttcctctctccgtgacgacaatctcgaaacttattggcaatccgacggagggcaaccccatttagttaacattcagtttcagaagaaagttagacttcaattaattgtgctgtacgtggatttcaagcttgacgagagttacacgccgagcaaagtttccatccgtgccggtgatggttttcacaacttgaaggagattaagaccgtggaactcgtgaagccaactggatgggtttatctttccttgtctggagttgatcctagggatacctttgtgaatactttcatgttgcaaattgctgtgttgtcaaaccatctcaatggaagggatactcacgtgcggcagatcaaagtttacgggcctcgaccgaaccctatcccacatcagccattccaatttacttcaagggaattcatcacctactcttctataagatgagagtttatggaaggatttgatgaagccaccaagtgttaaatcaaaggatgcttcccactaagttattatagcatctggaaggtctgaaaccaaatcactacagaccgaaatgtcaaaaatacatttcacttcaatagtattcttaaaaattgtcatatcagtaaatgtggccatcagtgattcagtatcctttgtgtcttgctagtatttataatttgttgagatttgcaatgctattcagggtttgacttccttgaagagttctatatttattaattaacaaaatgatatgtgcattgtgtgaatttctttttcctttttcctatcatcatagtttcttacttttcacacaaaaactaaaatgaaatt

SEQ ID NO: 4517 - DNA, 1245 bp, Glycine max
caaaaaaataaaatttaaaaccaggcctatttttgttttaatttcaatccttttttcttttttgttcttaaattcattttcggttcttccccatttgcatttcttccgtggaaccagtagtcaaaacttgaaatcaaatcaggagcgggggaaaaagaaaagagagagaagtagggttcgaaaatggcagcagaatcatcagagggcgaagaagaaaccaagttaagcggagggagcttattgctgaccgttgacgacgacttaacggaaatgggaaagaaagccgcttggagcgtcagttcctgcaaacccggtaacggcgtttcctctctccgtgacgacaatctcgaaacctattggcaatccgacggagggcaaccccatttggtcaacattcagtttcaaaagaaagttagacttcagttgattgtgctgtacgtggatttcaagcttgatgagagttacacgccgagcaaagtttccatccgtgccggtgatggttttcacaacttgaaggagattaagaccgtggaactcgtgaagccaactgggtgggtttatctatccttatctggagttgatcctagggatacctttgtgaacactttcatgttgcaaattgctgtgttgtcaaaccatctcaatggaagggatactcacgtgcggcagatcaaagtttacgggcctcgaccgaaccctatcccacatcagccattccaatttacttcaagggagtttatcacctactcttctataagatgagagtttatggaaggaattgatgaagccacctagtgttaaatcaaaggatgctgcccactaagtgattatatcatctggaaggtctgaaaccaaatcactgcagaccgaaatgtcaaaaatacatttcacttcaatattcttcttgaaaattgtcatcagtaaatgtgaccatcagtgattcagtaccctttgtgtctggctagtatttataatttgtttagattcagggtctgacttccttgaagagttctataattattaattaacaaaatgatatgtgcattgtgtgaatttctatttcctctttcttatcatcatagtttctatgaaattggcactaacgccatggtattggtttatctagttctactgctgaagaatataatctacagacgtgtttttctttttcattcaaggattctggtgtggttaattagttggttagttaaaagatctcatttaaccaaatgaatatttcatatc

SEQ ID NO: 4518 - DNA, 1312 bp, Glycine max
atatttgtgtttgcaaaaatttctgtccccatatccatatttatgagagtaaaagagtgagcttgaatgcttgatatctgttatgaactgctgggtttgggctcatgtaagcttaagggctctactattggtacttaaaaaaagaaaactcccatctttttacaaaaagtagtcaaaacttgaaatcaaatcaggagcgggggaaaaagaaaagagagagaagtagggttcgaaaatggcagcagaatcatcagagggcgaagaagaaaccaagttaagcggagggagcttattgctgaccgttgacgacgacttaacggaaatgggaaagaaagccgcttggagcgtcagttcctgcaaacccggtaacggcgtttcctctctccgtgacgacaatctcgaaacctattggcaatccgacggagggcaaccccatttggtcaacattcagtttcaaaagaaagttagacttcagttgattgtgctgtacgtggatttcaagcttgatgagagttacacgccgagcaaagtttccatccgtgccggtgatggttttcacaacttgaaggagattaagaccgtggaactcgtgaagccaactgggtgggtttatctatccttatctggagttgatcctagggatacctttgtgaacactttcatgttgcaaattgctgtgttgtcaaaccatctcaatggaagggatactcacgtgcggcagatcaaagtttacgggcctcgaccgaaccctatcccacatcagccattccaatttacttcaagggagtttatcacctactcttctataagatgagagtttatggaaggaattgatgaagccacctagtgttaaatcaaaggatgctgcccactaagtgattatatcatctggaaggtctgaaaccaaatcactgcagaccgaaatgtcaaaaatacatttcacttcaatattcttcttgaaaattgtcatcagtaaatgtgaccatcagtgattcagtaccctttgtgtctggctagtatttataatttgtttagattcagggtctgacttccttgaagagttctataattattaattaacaaaatgatatgtgcattgtgtgaatttctatttcctctttcttatcatcatagtttctatgaaattggcactaacgccatggtattggtttatctagttctactgctgaagaatataatctacagacgtgtttttctttttcattcaaggattctggtgtggttaattagttggttagttaaaagatctcatttaaccaaatgaatatttcatatcaatgtgtctctcttc

SEQ ID NO: 4519 - DNA, 950 bp, Lupinus angustifolius
tgtgattgattgttattattaaagatggctgcagaatcatcagaaggagaagaagaaggaaaagtaacaggagggaatcaaattctgatgatagatgatgatcttagagaaatgggaaagaaagctgcttggagtgtcagttcttgcaaacccggcaatggagttatttcccttcgtgatgataatcttgaaacttattggcaatctgatggagcacaaccccatttggttaatattcaattccagaagaaagttagattacaattaattgttctctatgtggatttcaagcttgatgagagttacacgccaagcaaaatttccattcgtgctggtgatggttttcataacttgaaggagataaaaactgtggaacttgtgaagccaactggctgggtttatctgtcgttatctggagctgatccgcgggaaacttttgtcaacacttttatgctgcaaattgctgtgttgtcaaaccatctcaatggaagggatactcatgtgcggcagatcaaaatttatggacctcgaccgaatcctattccacatcaaccgtttcaatttacttcaagggagttcatcacctactcttcaatcagatgagagtttatggaagaaatgaatcaagccaagctagttttaaataaaagatgaatcaaaaggtctgaaaccatatcaatagttactaaagtgccaaaactcaaacattttagtgcccatcccccccatctcttgttagtgtttataatttgtcttggtatagaatagttggtatgatttgttccagggggggggggcacgatttaaacgatgaacttggatcacttcaagaaacactagattatgccttgtttcattcatcataatgttactgaagtgtcaaaactcaaacattttactgcaatattcaactgaactaatttgtgccatttgtgaatgtgactataagg

SEQ ID NO: 4520 - DNA, 1258 bp, Glycyrrhiza uralensis
ggtgggggatattgcacaaaaaagtctctccatttgaaattatttttgggtgagttccgccgtcatttccccccatcctcctctctcactcaatcctctccattctctctctagttaccagtccaccgggaactagcggaaatataaaaaaaaataaaaattacagagagtgtgtgtgtgtgtgagagaaaggggtagggttttgagagagagagagagagagagagagaagagatgagtcggaagaagattggatgagtttagaaatggcagcggaatcatcggagggggaagaagacgggaagctgagcggagggaaccagttgctgatggtggacgacgagctcaccgagttgggcaagaaggccgcctggagtgtcagctcctgcaaacccggcaacggcgtctcttctctccgcgacgacaacctcgacacctattggcaatccgacggagcccaaccccatttggttaacattcaattccaaaagaaagttagactacaattagttgtgctctatgtggatttcaagcttgacgagagttacacgcctagcaaggtttccatccgcgccggggacggctttcacaacttgaaggagataaaatctgcggaacttgtgaagccaactggttgggtttatctctcattatctggagttgatcctcgggaaacgtttgtgaacacttttatgttgcaaattgctgttttgtcaaaccatcttaatggaagggatacacacgtgcggcagatcaaagtttatgggcctagaccgaaccccattccacatcagccatttgagtttacttcaagagagttcatcacctactcctgtataagatgagattttattttatggaaggaattgatcaagccaatccagtgttaaatcgaagaatgctgctcactgagggattatatcaaaccaaatcactagtcactcgtgtcagaaatatatttcactgatatattcatctcaaaaattgacatcaggaaatgtggctatcagtaccctttatttatgtcttgctaatatttatagtttgtttagatttgcaattgcaagtgctctacaatagccttagattcgggtctgcattctctgaggcatcctatttttattatgtcagaacaaaatgacctggatatcgtgtgaatttctctgtgatactcaaacctgctatctttcttccttccccatcaagcagttttgtaatgagggtttgatcacagtggacaattggacatcctgcataa

SEQ ID NO: 4521 - DNA, 1801 bp, Cicer arietinum
aaaaaaacaatctttcatcatcttttccctttgtcaaaaaaaatctcatcttcacctcttacccttaactccctgccccacggcggaagcctaccagcgccaccaccggccaccgcgccgtcctctcctcttctctctcccagttgcgctgcctttgtccctcctcttttctcttctcctctctcgcgcgcctgttgtccgttaaactcagccacgaaggccctcctccggccacgccaccgtcgagctcgacctccacggccctccaaccgtgataaatcattgacacaacaagtttccagtttccaccccttgggccagggttctggatccgctattggatattagatagagaatgttgatcagtaaataaacagcattggtaacgaattgacctgaagaaagttgcaaaaaggacacagcagtagaatcaatgagtttagaaatggcagcggaatcatcggagggtgaagaagaaggaaagttgagcggaggtaaccaagtattgatcgtggatgacgaactccgggaattagggaagaaggccgcctggagtgttagctcctgcaaacccggcaatggcgtctcttctcttcgagatgacaacctcgaaacctattggcaatctgatggagcccaacctcattttgttaacattcaattccaaaagaaagttcgattacaattagttgtgctctatgtggatttcaaacttgacgagagttacactcccagcaagatttcgatccgcgccggcgatggctttcacaacctcaaggagataaaagctgtggaacttgtcaaaccaactggttggctttatctctcattgtctggaattgatcctcgtgacacttttgtcaacacctttatgttgcaaattgctgtgttgtcaaaccatctcaatggaagagacacacatgtgcggcaaatcaaagtttatggacctagaccgaaccctattccacaacagccatttcaatttacttcagaagagttcatcacctactctactataagatgagattttatgtaagaaattattcaagccaaaacttagtgttaaatcaaagaaggctactcactgattgattatatcatgggaagggtctgatgaaaccaaaccactagccacttaggtggcaaaaatatatttcactgatatttatattcttaaaaacatgccatgaggaaatgtggctatcagtatcctttgtttttttgcttgtatttataatttgtttagatctacaagtggtttataataggattaaatatgggatctgcattttcggaggcatcctatttttattatttctgaacaaaatgatatgtagatatcatgggaatttctgttatattcaacccgctatttttcttccttctcccatgccgcaatttatttcctgagcacagtctatagcacaaccaatcaaaatctaagtcttgttaattttcaatggtggaaaagggaggagcaagaagatcacgagtaatagtgccgatggatggggctgagctattaaaatattaaaatgataataagtcatcaaaaggcttttagaagttattttaatattatcttgagtttttaattagttaacctatgtccataaacactgatcctgcaagagtccctaatctatcttccgtatgccctttgtttgagtcctgccatctagttttgtcattggctagcttttcacatgtaagatcttcctatattggaaattctagaattttaaccattatacagtaatatttgtgtcgtttttcgttgcaatcaatcactagcaagtac

SEQ ID NO: 4522 - DNA, 1032 bp, Cajanus cajan
gagacgagcatttgcgttttctcattttctcattttctctctctcaatcgtttccttctagcagttgcaagtttgaactttgaaatgttataaaagcggcaaaagaaaagagagggggagggttggaattgagaaaagagaaatggcggcagaatcatcagagggcgaagaagaaactaaattgagcggaagctaccaattgctcacaatccccgatgacttaacggaaatgggaaagaaagccgcttggagtgtcagttcctgcaaacccggtaacggcgtttcctctctccgtgacgacaacttcgatacctattggcaatctgacggcgcccaaccccatttggttaacattcagtttcaaaagaaagttagacttcaattaattgtgatgtacgtggatttcaagcttgatgagagttacacgccgagcaaaatttccatccgtgccggtgatggctttcacaacttgaaggagattagaatcgtggaaattgtgaagccagttgggtgggtttatatatccttgtctggatttgatcctcgggaaacctttgtgaacactttcatgttgcaaattgctgtgttgtcaaaccatctcaatggaagggatactcatgtgcggcagatcaaagtttatgggcctcgaccgaaccctattccgcatcagccatttcaatttacttcaagggagttcatcacctactcttcaataagatgagtggttatggaaggaattaagaagtcaacccagtgttaaattcaagaatcactagacactgaaatgtcaaagtatacttcacttcgatattcatcttaaaagttgtcatcagtaaatgtaactattagtgattcagtaccctatgtgtcttgcaagtattaataatttgtttagatttgcaagtgctctgtagtagctacagattcggggtctggcttgcttgaagggtattctatattcattaacaaaatgatatttccttcgtgtgaattatttatcatcataatttacttttgacaggaaaattataa

SEQ ID NO: 4523 - DNA, 1021 bp, Medicago truncatula
ggttagtgaaagggtgaagtagtgaattgaaagaatgagtttagaaatggcagcggaatcatcagaaggtgaagaagaaggaaagctaagcggaggtaaccaagttttgattgtagatgaagacctccgtgaattagggaaaaaagccgcctggagtgttagctcctgcaaaaccggcaacggcgtttcttctcttcgcgacgataatctcgaaacctattggcaatctgatggtgctcaacctcattttgttaacattcaattccaaaagaaagttcgattacaattagttgtgctctatgtggattttaagcttgatgagagttatacacccagtaagatttccattcgtgcaggggacggttttcacaaccttaaggagattaaagctgtggaacttgtgaaaccaactggttggctttatctctcattatctggacttgatcctcgtgaaacttttgtcaacacttttatgttgcaaattgcggttttatcaaaccatctcaatggaagggatactcatgtgcggcagatcaaagtttatgggccaagaccgaaccccattccgcagcaaccatttcaatttacttcaacagaattcatcacctactctacgataagatgacgttttatgaaggagttaatcaagccagtctagtgttaaattggagaagactgctcactgattgattatatcatgcagagattctaaaccaaaccactagccattcagatggtaaaaatatatctcactgataccaatgtcaaaacatgtcatcaggaaatgtggctgtcagtgtaccgcttgctggtacttatagtttggttagatttgcaagtgggtttataataggattagatatggccctttgtttcttgcttatttatagtttgtttagatctgcaagtggtttataataggattagttatgggatctgcattctctgaggcatcctatttttattatttcagaacaaaaagatatgtggatatcatttgaatttctttgcaatattcaac

SEQ ID NO: 4524 - DNA, 1019 bp, Trigonella foenum-graecum
agaagtttgaagaatgagtttagaaatggcagcggaatcatcagaaggtgaagaagaaggaaagctaagcggaggtaaccaaatattgattatagatgacgacctccgtgaattgggcaaaaaggccgcttggagtgtcagctcctgcaaaaccggcaacggcgttcttctcttcgtgacgacaatctcgaaacctactggcaatctgatggagctcaacctcattttgttaacatccaattccaaaagaaagtcagattacaattagttgttctctatgtggatttcaagcttgatgagagttatacgcccagtaagatttccattcgcgccggtgatggctttcacaaccttaaggagataaaagctgtggaacttgtgaaaccaactggttggctttatctttcattatctggacttgatcctcgtgaaacttttgtcaacactttttatgttgcaaattgcggtgttatcaaaccatctcaatggaagggatacacatgtgcggcagatcaaagtttatgggcctagactgaaccccattccacagcagccatttcaatttacttcaagagagttcatcacctactctactataagatgagactttatggaaggaattaatcaagccagtttgtttggtgttaaatcagagaaggctgctcactgattgactatatcgtgcggagggtctgatgaaaccaaaccactagccactcatatggcaaaagtatatttcactgatatgaatgttcatgtcatcaggaaatgtggctatcagcaccctttgtttttttgcttgctggtatttatagtttgtttagatctacaagtggtttataataggattagatatgggatctgcattctctgaggcatcctatttttattatttcaaaacaaaatgatatctggatgacatttgaatttcgttgcgattttcaacctgctatcttttgtattgttccctcatgcagacaacagtctatatctaggtaatgcattttagataataagcc

SEQ ID NO: 4525 - DNA, 837 bp, Medicago truncatula
gaattgaaagaatgagtttagaaatggcagcggaatcatcagaaggtgaagaagaaggaaagctaagcggaggtaaccaagttttgattgtagatgaagacctccgtgaattagggaaaaaagccgactggagtgttagctcctgcaaaaccggcaacggcgtttcttctcttcgcgacgataatctcgaaacctattggcaatctgatggtgctcaacctcattttgttaacattcaattccaaaagaaagttcgattacaattagttgtgctctatgtggattttaagcttgatgagagttatacacccagtaagatttccattcgtgcaggggacggttttcacaaccttaaggagattaaagctgtggaacttgtgaaaccaactggttggctttatctctcattatctggacttgatcctcgtgaaacttttgtcaacacttttatgttgcaaattgcggttttatcaaaccatctcaatggaagggatactcatgtgcggcagatcaaagtttatgggccaagaccgaaccccattccgcagcaaccatttcaatttacttcaacagaattcatcacctactctacgataagatgacgttttatgaaggagttaatcaagccagtctagtgttaaattggagaagactgctcactgattgattatatcatgcagagattctaaaccaaaccactagccattcagatggtaaaaatatatctcactgataccaatgtcaaaacatgtcatcacgaaatgtggctgtcagtgtaccgcttgctggtacttatagtttggttagatttgcaagtgggtttatatagattagata

SEQ ID NO: 4526 - DNA, 1296 bp, Ricinus communis
ataatacaaaatcctttctcctttttttttttttctttctatttaaattttcctgttagctctgccaagtctttgcaggtgcattcctctgtggtcgcagctttgatctcaaaggagtataatagaaaatggcaacagaatcatcagagggagaagaagaagggaagattacaggagggaatcagcacctggttgtagatgatgatctcagagaaatgggaaaaaaggctgcttggagtgtaagctcttgcaagcctggcaatggcgtctcttctctccgcgacgacaatctagattccttttggcagtcggatggtgcgcaacctcatttggtgaacattcaattccaaaagaaagtaaagctgcaattggttctgctctatgtggatttcaagcttgacgagagctataccccaagtaagatttctatccgcgctggtgatggatttcacaacttaaaggagatcaagactgtggagcttgtcaagccaactggatgggtttacctatccttatctggaaatgatcctagggaaacttttgtgaatacatttatgttacaaattgctgtgctgtcaaaccatcttaatggaagggatactcatgttcggcagatcaaagtttatgggcctcgattgaatcctattcctcatcagccttttcaatttacttcaagagagtttatcacatactcttctgtgagatgagcaatgtgatctggcaaaaaagaaaaaaatagaatcctactgaaagtgtatgaagcctgcagctgaaagtagacaagaccatccaagaaccataagttttacccgttatctactaccttatgcaattagtcaaaagatatgtaaacctttctgatgcacacgttcttgccaaggaagtgtcaggtgacagtgaaaaggcattaatggattctgaacttaccataattactatttgctatgttgtcaaattcatttctctagcaacaagttcagaatgataaggcctccaccctcccatcaggtgagtccgacattgaaacgggtgaggatcaggctcaaagtctaacgccggatattttctctattaactgatgggcttggataataggttttagaaatttcagcgagttattttcgcccaaaaagtgccctagctgtaaacattaagggcaaaactgtaccttttcatctgagtttataagggactgagttgactcagtctgaaactgagacgagtgaggattagactcaaaatctaaccccgtttactttctctatggattacaggtttttgaaagttgaatggctt

SEQ ID NO: 4527 - DNA, 950 bp, Gossypium hirsutum
cggacgcgtgggcaaattagggtttttcaatttcaaaaaatggctacggaatcttcagaatcggaagaagaagggaagatcacaggaggaaaccaacacctaatcgttgaagatgacctgagagagatgggcaaaaaagcagcttggagtgtcagctcttgtaaaactggcaatggcgtctcttctctccgtgacgacaatctcgaaacctattggcaatcagatggtgcccagcctcatttagttaacattcagttccagaagaaagttaaattgcagctagttgtactttatgtggatttcaagcttgatgagagctacacaccaagtaagatctctattcgagctggtgatggctttcataacttgaaggagattaaaactgtggaacttgtcaagcctactggttgggtttatctttcattatctggaaatgatccccgtgaaacttttgtcaatacatttatgttgcaaattgtggttttgtcaaatcaccttaacgggagagatactcatgttcgccagatcaaagtttatggacctcgaccgaatcctattccacaccaaccattccagtttacgtcaagggaattcattacatactccactgtgaggtaatagatgtgacggaatagctagtttggggtagaaatgaacatggcatatgaaatgtagaatattgtctctgatagaagagatacgagctcgttagaactatgaggagtctgtaaatctctcaatgttggtaggaacaaaaagagaatgatattgtcagtattcactctcttgtgcttgtgctgttcagatggtactagctttgatagtatcccatttcgggttcttttctgatcattttcctctgtctttagacattgtgacattctattattcaagaaaagtccatatagttttgatttgtcaaaaaagaaaaagtaccgactgcgactctg

SEQ ID NO: 4528 - DNA, 744 bp, Cucumis sativus
tcgtggagagactttcaggcgcgcggcggtggacggggacggagacggcggtgacaatcctgagagcgtggaggggcagtgtcgagtgccgagcgtgagctgaaggagggggatctcggttaccggcaatcaatcgagatagcggagctcgaggaggccgagcctatggcgacggagtcgtcagagggagaagaggatgtgaagctaacaggaggaaatcaagtcctcgttgttgaggacgatctcagagaaatggggaaaaaagctgcctggagtgtcagctcgtgcaaacctgggaatggcgtctccgccctacgcgacgataacctcgaaacttattggcaatctgatggcgttcaacctcatttggtgaacattcaatttcagaagaaagtgaaattacagctggttgttctgtacgtagatttcaagctggacgagagctacacgcctagtaagatatctatacgtgcaggggacggcttccataatttgaaggaaattaaaaccgtggagctcgttaagccaactggttgggtttacctattattgtccggaaatgatccaaaggatacttttgtgaacacttttatgctgcaaattgccgttctatcaaatcacctgaatggtagggatactcatgtccgccagatcaaaatctatggacctcgaccgaacccaattcctcatcaaccatttcaatttacttcaagggagttcatcacttattctattataagatga

SEQ ID NO: 4529 - DNA, 1084 bp, Theobroma cacao
ggagggaattgggggattttggttttttgaatagttcaaattagggtttgcattttcaaagaatggctacggaatcttcagagtcagaagaagaagggaagattacaggaggaaatcaacatctaatcgtcgaagatgacctgagagaaatgggaaaaaaagcagcttggagtgtcagctcttgtaaaacgggcaatggcgtctcttctctccgtgacgacaatcttgaaacctattggcaatctgatggagcccagcctcatttagttaacattcagttccagaagaaggttaagttgcaacttgttgtactttatgtggatttcaagcttgatgagagctacacaccaagtaagatctgcattcgagccggtgatggctttcataatttgaaggagattaaaactgtggaacttgtcaagccaactggttgggtttatctttcattatccggaaatgatcctcgcgaaacttttgtcaatacctttatgctgcaaattgcggttttgtcaaatcaccttaatgggagggatactcatgtgcgccagatcaaagtttatgggcctcgactgaatcctattccgcaccaaccgttccaatttacctcaagggaattcattacatactccactgtgagataataaaagtgacctaatagctggcttggggttgaaaaggacatggaatatcatatgtggaatcgtgtctcagattgaagagaactaagaacgttgctgaaagcaatttaaatatataacatgatgatggttttgtatcaatcaacatttataggaagaaaaagagttgatattgtctgtattcactcccttgtgctcgtgctgagcagatggtttaaactagcttggatagtatcccgttttaggttctttttcagatcttttcctttttctaatgcctttggtcattgtgacattctattatttgaggaaaggcgacagatattctaattagtcactctgcaacaaattatgttgtccttgttcctgtatcatacctcgtgggtcattgcacctcctagtaaaaggaaagaatttgccacaggtttcttctggtcaggttgcct

SEQ ID NO: 4530 - DNA, 2142 bp, Gossypium raimondii
taattagacaccaatcctgttttcctaacttttaaatggctgtttatattttgggagggcttttagcattaacggggatatttttttgaaaagaaaataaaattagggtttttcaatttcaaaaatggctacggaatcttcagaatcggaagaagaagggaagatcacaggaggaaaccaacacctaatcgttgaagatgacctgagagaaatgggcaaaaaagcagcttggagtgtcagctcttgtaaaactggcaatggcgtctcttctctccgtgacgacaatctcgaaacctattggcaatcagatggtgcccagcctcatttagttaacattcagttccagaagaaagttaagttgcagctagttgtactttatgtggatttcaagcttgatgagagctacacaccaagtaagatctctattcgagctggtgatggctttcataacttgaaggagattaaaactgtggaacttgtcaagcctactggttgggtttatctttcattatctggaaatgatcctcgtgaaacttttgtcagtacatttatgttgcaaattgtggttttgtcaaatcaccttaacgggagagatactcatgttcgccaaatcaaagtttatggacctcgaccgaatcctattccacaccaaccattccagtttacgtcaagggaattcattacatactccactgtgaggtaatagatgtgacgtaatagctagcttggggtagaaatgaacatggcatatgaaatgtagaatattgtctctgattgaagagaaccgagctcgttagaactatgaggagtctgtaaatctctcaatgttggtaggaacaaaaagagaatgatattgtcagtattcactcccttgtgcttgtgctgttcagatggtactagctttgatagtatcccatttcgggttcttttctgatcattttcctctgtctttagacattgtgacattctattattcaagaaaagtccatatatgttttgatttgtcactctgcacaccaatttcctttttccttgtgttcccatgtcatatatcgtatttaatccaaagttttatcatcatttgaaatattgaagttgggaatgcatattccaacttgagattcaaatcatctggtatactttggaatattgctctcatatatgttgaaaggtccctggattccaggcattgctttagtaaggcagctgattgtattataggccttggttcattttcggttcagatgagtttcggctgggatgatactaagataaggaagctcccaagtgtgtacaaatagagtttgtcccccaaaacaaatcaagtggatataagaatttgttgttagcttagatttgattctaagatgataaaataacatacaaggctagtttgggatctctaaccaatagtgatcattgacaagccgcttcggtgtcgaagctgcttaggcagattgcaaaggcttggaaagcagatagagggtatccataatccatggtgaagatatcctttctgatgttcccaaactgtaagactaccttctcttgctcttcaggtgatacgttatgagatggatcaagagctgcaacaagctggaaattcttaacagaagccatggtcacactccctctgaagttaaggcaccagcactgtaactgttcataggagccttgtttttaagggttaacggctctcctgagccaagagagaataccagtgtggccgggagccttggggagatgatgtctatcatcaattcatcgaaggattgcataaatgctgatggtgtcagagcagtgcctccttcctgaatagctgagacaggaattgagtacaaaaaacgatgcattctccttggtccttgtgctcaaagtacgttgagctcataggtaatgccacctatgctgtagttgcatgccggtaatcttggagaaacctgcttgaaattgaatctaagatttgatcgggaagttgatgggattatcgagtcacaaggcgattgactgtcgaatatggtgaacttggtacccaaaaatttagacctgaaaagaaatctcaatgtgttcatcatggacaagaagagagatcaaagaaatcgaagaagcaacataagtgacttaactctcaaaaagcaagga

SEQ ID NO: 4531 - DNA, 1588 bp, Theobroma cacao
actaaacttttcttgattaagctcttaattaggggagagagaaaaaaatcttaattaaggagggttttagtaacttttaaatggccgtttatatttgggagggaattgggggattttggttttttgaatagttcaaattagggtttgcattttcaaagaatggctacggaatcttcagagtcagaagaagaagggaagattacaggaggaaatcaacatctaatcgtcgaagatgacctgagagaaatgggaaaaaaagcagcttggagtgtcagctcttgtaaaacgggcaatggcgtctcttctctccgtgacgacaatcttgaaacctattggcaatctgatggagcccagcctcatttagttaacattcagttccagaagaaggttaagttgcaacttgttgtactttatgtggatttcaagcttgatgagagctacacaccaagtaagatctgcattcgagccggtgatggctttcataatttgaaggagattaaaactgtggaacttgtcaagccaactggttgggtttatctttcattatccggaaatgatcctcgcgaaacttttgtcaatacctttatgctgcaaattgcggttttgtcaaatcaccttaatgggagggatactcatgtgcgccagatcaaagtttatgggcctcgactgaatcctattccgcaccaaccgttccaatttacctcaagggaattcattacatactccactgtgagataataaaagtgacctaatagctggcttggggttgaaaaggacatggaatatcatatgtggaatcgtgtctcagattgaagagaactaagaacgttgctgaaagcaatttaaatatataacatgatgatggttttgtatcaatcaacatttataggaagaaaaagagttgatattgtctgtattcactcccttgtgctcgtgctgagcagatggtttaaactagcttggatagtatcccgttttaggttctttttcagatcttttcctttttctaatgcctttggtcattgtgacattctattatttgaggaaaggcgacagatattctaattagtcactctgcaacaaattatgttgtccttgttcctgtatcatacctcgtaggtcattgcacctcctagtaaaaggaaagaatttgccacaggtttcttctggtcaggttgccttgaaaccttaatatcatttgaaatattggacctgtgatatagattccaagttactggaaacaccaggacaatagctattctattaattttaaagaatgagacatcaaggacatatttttttaaaagtattctctgacttgtgattcaagtcatgtagtgtctagctttcgaatatgattcattgtccaagttcaagctcttttttgacaaggactctgctccaggtattgctttagttggccagttgattgtacaccatcaaggtggattttcgggtcatacatctactattgttaatgcgaatcattttactagttggaggaagccttggttctttttcccttcgggtgtggcttctgctgggaagatacttttaaatgtaaggaaaataattgcaagtaacatca

SEQ ID NO: 4532 - DNA, 1231 bp, Manihot esculenta
aggcgaatctcatcttcggtcgccggcgaaagaccaccctaccccccgacgccgctcacgcccactgtttaggtgcctgtaaccatgatcctcaaagattctcttacataacaaacatcctcagtcttttcctccaggctccacgaaactaccacgtccatacctaccgagaaatcaaccaccattgccgccacatttccaactcttttcgacaaaaacctcccacgatatctacatgtaacggcacggcactaggttcgtgccttcgcttgagaggtccaaggcgagacgcttctctcaccaaatcgcttaaactcagcggaacacgttcatccattcccaactgctggtggttcgcatgatctgatgaagattgaaggcttcatatctatatcttcagaattggagtgtaatagaaaatggcaacagagtcatcagagggagaagaagaagggaagattacaggagggaatcagcacttgattgtagatgatgacctcagagaaatgggcaaaaaggctgcttggagtgtcagctcttgcaaacctggcaatggtgtctcctctctgcgagatgacaaccttgattccttttggcaatctgatggtgcgcagcctcatttggtgaacattcaatttcagaagaaagtaaagttgcaattggttgtactttatgtggatttcaagcttgatgagagctatacccccagtaagatatcaatttgtgctggcgatggatttcacaacttgaaggagatcaagactgtggaacttgtcaagcctactggctgggtatatctatccttatctggaactgatcctagggaaacttttgtcagtacatttatgctgcaaatagctgttctgtcaaatcatcttaatggaagggatactcatatacgtcagatcaaagtttatgggcctcgaccgaatcctataccccatcagccttttcagttcacttcgagagagtttattacgtactcatctgtgagatgagaaatgtgatagcaggaaaacagagaagcggaactatcggtgaactgtgtgacaaatggagctgaaagtaacctaccatccagaaagcatgcgttttggacatctggaatctattacgttctgcaattaccaatgaaaaaagatactcggattgagttgatgctacttattattgtatggtacctttctctagttttaatggcttttatatcagatacattctaattgtgtac

SEQ ID NO: 4533 - DNA, 1033 bp, Gossypium raimondii
gtttatattttgggagggcttttagcattaacggggatatttttttgaaaagaaaataaaattagggtttttcaatttcaaaaatggctacggaatcttcagaatcggaagaagaagggaagatcacaggaggaaaccaacacctaatcgttgaagatgacctgagagaaatgggcaaaaaagcagcttggagtgtcagctcttgtaaaactggcaatggcgtctcttctctccgtgacgacaatctcgaaacctattggcaatcagatggtgcccagcctcatttagttaacattcagttccagaagaaagttaagttgcagctagttgtactttatgtggatttcaagcttgatgagagctacacaccaagtaagatctctattcgagctggtgatggctttcataacttgaaggagattaaaactgtggaacttgtcaagcctactggttgggtttatctttcattatctggaaatgatcctcgtgaaacttttgtcagtacatttatgttgcaaattgtggttttgtcaaatcaccttaacgggagagatactcatgttcgccaaatcaaagtttatggacctcgaccgaatcctattccacaccaaccattccagtttacgtcaagggaattcattacatactccactgtgaggtaatagatgtgacgtaatagctagcttggggtagaaatgaacatggcatatgaaatgtagaatattgtctctgattgaagagaaccgagctcgttagaactatgaggagtctgtaaatctctcaatgttggtaggaacaaaaagagaatgatattgtcagtattcactcccttgtgcttgtgctgttcagatggtactagctttgatagtatcccatttcgggttcttttctgatcattttcctctgtctttagacattgtgacattctattattcaagaaaagtccatatatgttttgatttgtcactctgcacaccaatttcctttttccttgtgttcccatgtcatatatcgtatttaatccaaagtttta

SEQ ID NO: 4534 - DNA, 1147 bp, Tropaeolum majus
agtaagactcatttcctctccgatagccccaaaccaagtcttccgtttacactacttctccctcgcgagtctcgccggacgggaacttgtccaccattgtagatctccactcgatctcgtaccatcgatttcaaatatatctagattttcttagagaaaatggcgaccgagtcttcagaatcggaagaagaaggaaagatcaaaggaggtaatgagaagctgacagtagatgatgacttaagagagatggggaagaaagctgcctggagtgtcagctcctgcaaaccaggcaacggtgtctcttcacttcacgacgacaatcttgaaacctattggcaatcagatggcccacaaccccatttggttaatattcagttccaaaagaaagtcaagcttcaactagttgttctatatgttgatttcaagcttgatgagagctatacgccaagcaagatctctattcgcgctggtgatggattccataacttaaaggagattaaaaccgtggagcttgtgaagcccaccggatgggtatatctttcattatctggaactgatcctcgggaaacctttgtcaacacctttatgttgcaaattgcggtcctctcaaatcacctgaatgggagggatacccatgtgcggcaaatcaaagtttacgggccacgaccaaatcctataccgcaccaaccatttcaatttacttcaaccgagtttattacttactctactgtcagatgagacatcctgaccaaatgaatgtgaaatgggcacatagcctggactaccatctcaaactgggaggagctaagtatacaaaatgctaaaaacgacaatattatgttcgcccagaagagtttcggtagtcatgtaaaatctatcacttcaagcgtccttatttcatgaaattgaattgtggttaagtagaatttcctttaagctgttttttgccgggtgctctgatatatacatatatatatatatattatgtaacagagtgatgagaaaacggtatgcctaccatggttaaggaattaacatggattatattgattgggtaatacctgcacgctctttgttcggttatgcacgcgcactcttcactcttgatcagtacattgcatttgtattacatgtattatattgctgt

SEQ ID NO: 4535 - DNA, 1040 bp, Sesamum indicum
aattttcaattataattatatgatcgttttcaaaaattataattatatgatcaacggctgaattagggtttatcctcaaaacccaaatcaattattgcggtgcaaaatggcggaatcgtccgagggggaggaggaagggaagttgacgggagggaaccagcagctgatggtggacgatgacctccgggagatgggaaagaaggcagcttggagcgtcagctcctgcaagcccggaaacggggtcgcttccctccgagacgacaatctcgatacctactggcagtcagatggtgcacagcctcatctagtgaatatccagttccagaagaaagttaaacttcaattagttgttctttacgtcgatttcaagcttgatgagagctacacacctagtaagatctcaattcgtgctggcgatggtttccacaacttgaaggagataaaagcagtggagcttgctaagccaactggctggatgtacatctcattgtctgggagtgatccaagggaaacttttgtgaatactttcatgttgcaaatagcagtattgtctaatcatctgaatggaagggatactcatgtgcgccaaatcaaagtttatgggcctcgaccgaatcccatcccacaccaaccatttcagttcacttcgactgagttcattacttactctactctcaggtaacatatcgcaagaggcaaacaagaaatgttaatggagtgagcttcaagtcattgttcgttattatggtcagccaggtggattccagtatgaggaactattcaaggtacaatgatgtttagctgcatgaggaacttttcaaggtacactaattacttgttgtaagcctaaaattgagtaaaccacccttccaagaggaactgttttgcctgatgattatttgcactaacatttattcgggggagctacaacaaatcgtagccaccatttgaagcacttatctttttccttcccagaattcacttgcattttcttatgtacatgttgtgaaatgtggaaaggaatcaccattctactatgg

SEQ ID NO: 4536 - DNA, 1158 bp, Citrullus lanatus
atgagagtgaaagatttcgacaagcaaggagcgagaaatagtgcaaagccgaacggaggcttcttgcggagggagagactatcaggctcgcggtggcggacggagacggcagcggcaatccagagagagtggagcacagtgtcgcgcgccgagagtgagcgtaaggagtgggctctcggtcaccggcgatcaatcgagatagcggagctcgaggaagccgagcctatggcgacggagtcgtcagagggggaagacgatgtgaagcttactggaggaaatcaagtcctcgtggtggaagacgatctcagagaaatggggaaaaaggccgcctggagtgtcagctcgtgcaaacctgggaatggcgtctccgccctacgcgacgataacctcgaaacttattggcaatctgatggcgttcaacctcatttggtgaacattcaatttcagaagaaagtgaaattacagttggttgttctctacgtagatttcaagcttgacgagagctacacgccgagtaagatatctatacgcgcaggggacggcttccacaatttgaaggaaattaaaaccgtggagctcgttaagccaactggttgggtttatctatccttgtccggaaatgatccaaaggatactttcgtgaacacttttatgttgcaaattgccgttatatcaaatcacctgaatggcagggatactcacgtccgccaaatcaaaatttatggacctcgaccgaacccaattcctcatcaaccatttcaatttacttcaagggagttcatcacttattctattataagatgacaggtgcgaccagaaaaaagctcatgatgaatgattggaatcagcaagtgagcgatgcttgtcccaaccgcggaaaaattgtatgtatattttgtttgaagttaaatagattccttatgaccatatcaacctggatctctttggaaaactttgatggttctataatcaggcattggtgtcgtgtttaaatagttgcaattaggactgtacttttaaaattttaggagattcaacctttatttccccttatctgtaatgtaatgtgtaattgtttgtaaataaaacaaaccgtagcttctttaattctaggcttattggagaacaaagagacttccctgctttgaaaattgcatt

SEQ ID NO: 4537 - DNA, 1225 bp, Amsonia hubrichtii
gcactgggaaatgaagagtcgatgagtcagcagagagaaagagacttttggaattcacttttgctgaagaatatataaagtgattcccaccaatttagctgaaaagggaaaaagtgattcccgctcttgttcatttgaaatcagtttgcttgtagataaacagtcgcatttgatttgaataatgtccggggagcctctgtgatgattgcatctttaccttctctattaagctagggttataagaagtattggctggtagatatcttgattaatttatccagtaatcaattgagatggcggaatcatcagagggagaggaagaggggaagcttactggaggaaaccagcagctagtggtggacgatgacctgcgcgagatggctaagaaagccgcttggagcgtcagctcttgcaaacccggaaatggcgtccttgctcttcgagacgacaacctcgatacctactggcagtcagatggagcacagcctcatcttgtgaatattcagtttcagaagaaagtgaagctccaactagtggttctgtatgtggatttcaagcttgacgagagttatacccctagtaagatctcaattcgagctggcgatggtttccacaacttgaaagagattaaagtagttgagcttgtcaagccaactggatgggtgtatatatcattgtctggaaatgaccctcgggaaacttttgtgaacacattcatgttgcaaatagcagtattatcaaaccacctgaacgggagggacactcatgtgcgccaaatcaaagtctatgggcctcgtccaaatccgattccacatcaaccatttcagttcacttctagagagttcattacatactcaactgtgagatgaagctcgagaccttgttttctcaaattggaaaaggaaagaatggattatatgcgtgaagaggtgataatgagaattgcaagaagacagttaagttatagggattagtggagcgcttcgagttctgcttctgaatacaattgctccggttgtgctctgtttggatgtcctttgtgattgtacctcccatgttctgtttctcagttttgcacgttatgaaccagtgattcttttctgttttatcatttcacctcttctggttcctcgtagaagatatgtatgtttttgctgttactcttttgtataagagtggtgatgtactagagtgtataatgatgagtttttccatgtctcattcc

SEQ ID NO: 4538 - DNA, 1181 bp, Quercus alba
tttttgaaagtgacagtcctcttcttttccctccttctcccttcactttaccgattcatctctccttctctctgccacatttcagttcctcaaacttcaccaactcccctctctttgttttgagtatttgggaaaagtatcagagacgttgaagattgcaggttccgtcagagattattaaaagactaatagcaacaaagtaaaaagttaggcttatggcgacagaattgtcagagggagaagaagaagggaaagttactggtgggaatcaggtgctgatagtggaagatgaccttagagaaatggggaaaaaggctgcctggagtgtaagctcttgcaagcccggcaatggcgtctctgccctccgtgatgagaaccttgagacctattggcaatcagatggtgcacaacctcatttggttaatattcaatttcagaagaaagttaagcttcaattagttgttctttatgtggatttcaagcttgatgagagctacacacccagtaagatctccattcgtgctggcgatggtttccacaatctgaaggagataaaaactgtggaacttgtcaagccaagtggttgggtatatctgtccttgtctggaaatgatcctagggaaacttttgtcaacacttttatgttgcaaattgctgtgttgtcaaaccacctgaatgggagggatactcatgtgcggcagatcaaagtttacggccctcgaccgaaccctataccgcatcaaccatttcactttacttcaagggagttcattacctactcttttgtgagatgagagaagcatgcagttgatagcccgatcatattaataaccatgaggatatatctctagtcatgtatagttacatttgattttctcaataccaaagttgggtgggttttcaattgtttgtttttagcacgaattgaggggccatttttcctaacattcctgacatcttgggaaaattcaatggaattttcgtgttgttacttcgcattcaagttttacaccaagtgcaaaactctttggtcaatagtgattcttctactatgtttgtacttccacctcaaggtatttgacaaagttggtgatcattctattggtagtgtctgtttcatggattgaattcagaagtcagaggagttatagctaaagattactatcccgtttctcttaacc

SEQ ID NO: 4539 - DNA, 1217 bp, Populus trichocarpa
gttttcaaattctggtttgacataaagcttacttttcatacagcattacatagtacattcactcaaaattagggtttttgtttggtcaaaattgaaccaagttactgacctttaagctacatttgggtggtgtagtatacttgtaaacaaaaaatggcgacagaatcatcagaaggagaagaagaagggaagatcacaggaggaaacaagctcttggttatagaagatgatcttagagaaatgggaaaaaaagctgcttggagtgttagttcttgcaaacctggaaatggggtctcttctcttagagatgacaatcttgacacttattggcaatcagatggagcacagccccatttggttaatattcaatttcagaagaaagtgaagctgcaattagttgttctttatgtggattttaagcttgatgagagttacacacctagtaagatttcgattcgtgctggtgatgggtttcataatttgaaggagattaagactatggaacttgtgaagccaactgggtgggtttatctttccttatctggaaatgatcccagggaaacatttgtcaatacatttatgttgcaaattgctgtgctatcaaatcaccttaatggaagggatactcatgtacgccagatcaaagtttatgggcctcagctgaacccttttccacatcagccttttcaatttacttcaagggaattcattacatactcttctgtgagatgagaaacatgaccaccaaaaaaagaggaatttcgatactatatcaagcagagcggtgaagcatgtagctgaaagtagccagatcatcaaaaaacgatgaagagtttttatcctcgtatccattgcctgttaactatggtgttcatatatcaacagttgttgaagaaagtagatacatgggtattaagatcatgtcactaattggttttctagtgatcagaagtatccagtctcatattgtcttgcgagtattgatccaaggcagctagaaataggggaccatatcttagatgatgttctgtaagcctaacgaggattttgacattttgaggatctcatgggtacaaaatgtagttactctgctttccttaaaaatccaggcgacctcatacttggaaatgttggatttcaatcatttttcaggaatagaagagcaggtggaaacagagctagagtttgcaccaaacatttggcaactaaaattcagt

SEQ ID NO: 4540 - DNA, 1080 bp, Populus trichocarpa
caagtagtttagcgatgccagttacttgataactacggcaaccgtctataaaaccaagcgacaagccgtctagcaattataaaactcttacctcctttcaccagaagcaagatttcaaattctggtttggcataaagtttacatttcctacagtgcttcctgatactggttaacgaagaatggcaacagaatcatcggaaggagaagaagaagggaagatcacaggaggaaacaagcacttggtaattgaagatgatcttagagaaatgggaaaaaaagctgcttggagtgttagttcttgcaaacctggaaatggggtctcttctcttagagatgacaatcttgacacttattggcagtcagatggagcacaaccgcatttggttaatattcaatttcagaagaaagtgaagctgcagttagttgttctttacgtggattttaagctggatgagagttatacacctagtaagatttcgattcgtgctggtgatggttttcataatttgaaggagattaagactatggagcttgtgaagccaactgggtgggtttatctgtccttatctggaaatgaccctagggaaacatttgttaacacatttatgttgcaaattgctgtgctatcgaatcatcttaatggaagggatacccatgtacgccagatcaaagtttatggacctcgaccgaacccttttccgcatcagccttttcaatttacttcaagagagttcattatgtactcctctgtgagatgagaaatatgaccttgccaacaaaggagaagaattgtgaaactgtctcaagaggagaggtgaagcatgtagctaaaagtagccagaccatcgaagaatgatgaagagtttcttcctgagggttttctttgagcctcataaggattttgtcattttgagaatcacatgggtataaaatgttgttactctgcttaaaaattgaggcaattataatcattttccaggtaccgagagcaggtggaaccgaagctagagttggcacctgaaattctctttttgtcccccaatattgataaacattaatggaacctggctttgaccaaaa

SEQ ID NO: 4541 - DNA, 1233 bp, Prunus mume
tgggccgatatcatcataagctggagtagctcagttggttagagcgtgtggctgttaaccacaaggtcgaaggttcgaacccttcttctagcgtcacaattttgtccattttctctttttaaaaccgccaaattaaccagcgccttttacataaacctgaagtctaaaacactacgagaaattacaattcaaattttcaaaatcatcaacagaggcgcttcatttttgcagactttttatttttattttatgatataaagggttttgctttgattgattgttcgcatcaggctgctctttaagctagggtttggggtttttggtacttgatcaaattagggtttttcttttcttcttcctgttcatagaagaaccatagaagaagaggccatggcgacagaatcatcagagggagaagaggaagggaagctgacaggagggaaccaagtgctaacagtggacgatgatctcagagaaatgggcaagaaggccgcttggagtgtcagctcttgcaaggccggcaatggcgtctcatctctccgtgacgacaatcttgatacttattggcaatcggatggtgcgcaacctcatttagtaaacattcaattccagaagaaagtgaagctccaacttgttgttctctatgtggatttcaagcttgatgagagctatacaccttgtaagatctcaattcgtgccggggatggcttccacaacttgaaggacataaaaactgttgagctcgataagccaactggttgggttcatatatcattgtctggaaatgatcctagggaaacttttgtcaatacttttatgttgcaaatctccgtgttatcaaatcaccttaatggaagggacactcatgtgcggcagatcaaagtttacggccctcgaccgaaccctattccgcatcagccatttcagtttacttcaagagagttcatcacctattcttctgtgagatgagaaatgtgacctggcatagaaagaaacagatgggaaatgtaatatctgtaacattatgatgtaatgtccaccggtaatgaaaaatgttgtttggtacttttatggcatgatttgaattttcatttgagttctctagaacagctttgagtttttgtttgttcttttggttggggtgtgagctgtgcctaggcctacattgcctacatgaaacatcgttgtccagcagtattagaatattaaacaataaaaacatcattgaccatc

SEQ ID NO: 4542 - DNA, 780 bp, Prunus persica
tttatttttattttatgatataaagggttttgctttgattgattcttcgcatcaggctgctctctaagctagggtttggggtttttggtacttgatcaaattagggtttttcttttttcttttcttcttcctgttcatagaagaaccatagaagaagaggcaatggcgacagaatcatcagagggggaagaggaagggaagctgacaggagggaaccaagtgctaacagtggacgatgatctcagagaaatgggcaagaaggccgcttggagtgtcagctcttgcaaggccggcaatggcgtctcatctcttcgtgacgacaatcttgatacttattggcaatcggatggtgcgcaacctcatttagtaaacattcaattccagaagaaagtgaagctccaacttgttgttctctatgtggatttcaagcttgatgagagctatacaccttgtaagatctcaattcgtgccggggatggcttccacaacttgaaggacataaaaactgttgagctcgataagccaactggttgggttcatatatcattgtctggaaatgatcctagggaaacttttgtcaatacttttatgctgcaaatctccgtgctatcaaatcaccttaatggaagggacactcatgtgcggcagatcaaagtttacggccctcgaccgaaccctattccgcatcagccatttcagtttacttcaagagagttcatcacctattcttctgtgagatgagaaatgtgacctggcatagaaagaaacagatgggaaatg

SEQ ID NO: 4543 - DNA, 1185 bp, Tripterygium wilfordii
aattaggagggtagatgccattaatggccacgagcgagttggagactcggagtcgccttcttaaaagttgaatttgaattatgtaagcactgcatccaacacttttaattgactgcagttgtatattttcataaattacaacgaaaattcacaatccagattgctagctatcccacaattagggtttcgagtgttttggtgacattagggtttttatcgtgtgaagtccctttgcttaaccgcattggagtttgagaaatggcgacagagtcatcagaaggagaagatgaggggaagataaccggagggaaccagcatctgattgtggacgacgatcttagagagatgggcaagaaggctgcttggagtgtcagttcgtgcaagcccggcaatggcgtctcttctctccgtgatgaaaatcttgatacatattggcaatcagacggtgcacagcctcatttggtgaatgttcagttccagaagaaagtgaagctgcatttggttgttctatatgttgatttcaagacttgatgagagctatacaccaagtaaaatttccattcgagctggtgatggatttcacaacttgaaggagataaaaactgtggagcttgtcaagccaactggttgggtttatatatcattatctggaaatgatcctcgggaaacttttgtcaatacctttatgttgcaaatcattgtgatgtcaaatcatctcaatgggagggatactcatgtccgccagattaaagtttatgggcctcgaccaaaccctattccgcaccaaccatttcagtttacttctcgagaatttattacttattcttctgtgagatgagaatgtagcctagtagacgagagccagtgtgtcattctggagaggattacagattctggacatgtaaaatctgtaacagcttagtgctcctatttctcttgaaactcaagtctacgaattattcaacagaaatgttgtcatcagctgaggagcttagaaatgaggccatttcctgattttgttcttcctaattgcattttctttgctcaagtgatttacatctccaagtgagcatctaagcaatttgcactgccactgccagatggtttgatgttctgtggtgatcttgctttgttatgtacctctttttttgataaattgctttggaatgtacttgcccttagctc

SEQ ID NO: 4544 - DNA, 985 bp, Panax ginseng
tatcatcgtttgttaaaaaaacttcaaattattaactcaactggatttgtagtacttaaactaaataggggttttgggagagatcagttagttcggttaaatggcgacggaatcatcggagggagaggaagaagcgaaattgatcggagggaatcagcagctggtggtggatgatgaccttcgggagatggcgaagaaggctgcgtggagtgtcagctcttgtaagcccggcaatggcgtcctctctctccgtgacgataaccttgattcctactggcaatcagatggtgcgcagccacatcttgtaaatattcagtttcagaagaaggttaagctccaattagttgttctttatgttgatttcaagcttgatgagagctatacccccagtaagattgctatccgtgctggtgatggcttccataacttgaaggagattaaaactgtggaacttgttaagccgacaggttgggtgtatatttccttgtctggaaatgatcctcgggaagcgtttgtgaacactttcatgttgcaaattgcagtgttgtcaaatcatcttaacgggagagatacccatgtgcgccagataaaagtttatgggcctcgaccgaaccctattccacaccaactgtttcaattcacttccagggagttcataacatattcgattgtaagatgaggaattccttgaattctgcaccttaaaccagcaaaaagtaaacgagacctgtgttgaaacttgaatgtaacaagccggagcatacaagcttcatgaggagtttcttgttagtaaagttgtgttgctttcatgatctgtttgcagttcaccttctacctaacaatgattaaaactgtaattaccttctgtattaaggatccggcatcgaatggcagtcccacaaagagtaattatattcccttgcaaagagttttttttttttggttttctagaaaatatataggtaatacaaacccttagacatga

SEQ ID NO: 4545 - DNA, 933 bp, Fagus grandifolia
tcactcactactgtctgatctctctctctcactttcgcgtgtcaccggcgtcgtgaggaagaggtgacgacgccctgggttttccgccgccgtgaggaagacccttcggccttcgcatttcgcgccgccgtgagcccaacaaaatcccgtgacccatttctgctgattgcaagtttcttcagagattattaagagagtgattgcaagaaggtaaaaagttaggtttatggcgacggagtcgtcagagggagaagaagaagggaaagttacaggtgggaatcaggcgctgatagtggaagatgaccttagagaaatggggaagaaggccgcttggagtgtaagctcttgcaagcctggcaatggcgtctctgctctccgcgacgacaacctcgagacctattggcaatcagatggtgcacaacctcatttggttaatattcaattccagaagaaagttaagcttcaatcagttgttctttatttggatttcaagcttgatgagagctacacgcctagtaagatctccattcgtgccggtgatggcttccacaatctgaaggagataagaactgtggaacttgacaagccaagtggttggatacatctatccttgtctggaattgatcctagggaaacttttgtcaacacttttatgttgcaaattgctgtgttgtcaaaccacctgaatgggagggatactcatgtgcggcagatcaaagtttacgggcctcgaccgaaccctataccgcatcaaccatttcactttacttcgagggagttcattacctactcttctgtgagatgagaaaggtgacccagcaaaactgtgttgaactttgtcggagtgaagcatgctgctgatggccagatcatattaagaaccatgaggattcatctctagtcatgtatagttagtgacattgattttctcaa

SEQ ID NO: 4546 - DNA, 992 bp, Manihot esculenta
accgtcatctgaaaactctccaccccgcaatcctcagattttctcctatacaacaaacatccatcctcaactctcaacctcccccaaattacacctctcttcccgcctcaaaatcaaccacgttcacaccccaattgcaaccaatttcgaccaaaaccgcccactattctctgcatgcagtcggtaataaaccttcctagagcaacttctcctcacccatctcccccgttgtttctcttttaccttatatctctcgcacttcgccctttttctgtgtatttttgtgtttccagctgcacccaattcttgccttggcatgagagggtccggcaagacaattctttcaccaaatcgcttaatcggagctcgtttcatctgtcccaacagctgatctgatagagtgtaacagaaaatggcaactgagttatcagagggagaagaagaagggaagattacaggggggaatcaattcctgattttagatgatgacctcagagaaatgggcaaaaaagccgcttggagtgtcagctcttgcaagcttggcaatggcgtctcctctctccgggatgacaatcttgattccttttggcaatcggatggtgcgcaacctcatttggtgaacattcaattccagaagaaagtaaagctacaattgattgtactctatgtggatttcaagcttgatgagagctatacccccagtaagatctctattcgcactggcgatggatttcacaacttgaaggagatcaaggctgtggaacttgtcaagccaactggctgggtttatctatccttatctagaaatgatcctagggaaacttttgtgaatacatttatgttacaaattgctgtgctatcaaatcatcttaatggcagggatacccatgtaaggcagatcaaagtttatgggcctcgaccgaatcctataccccatcagccttttcaatttacttcaagggaattcattacatactcttctgttagatgag

SEQ ID NO: 4547 - DNA, 867 bp, Gossypium hirsutum
ggaatcttcagaatcggaagaagaagggaagatcacaggaggaaaccaacacctaatcgttgaagatgacctgagagaaatgggcaaaaaagcagcttggagtgtcagctcttgtaaaactggcaatggcgtctcttctctccgtgacgacaatctcgaaacctattggcaatcagatggtgcccagcctcatctagttaacattcagttccagaagaaagttaagttgcagctagttgtactttatgtggatttcaagcttgatgagagctacacaccaagtaagatctctattcgagctggtgatggctttcataacttgaaggagattaaaactgtggaacttgtcaagcctactggttgggtttatctttcattatctggaaatgatcctcgtgaaacttttgtcagtacgtttatgttgcaaattgtggttttgtcaaatcaccttaacgggagagatactcatgttcgccaaatcaaagtttatggacctcgaccgaatcctattccacaccaaccattccagtttacgtcaagggaattcattacatactccactgtgaggtaatagatgtgacgtaatagctagcttggggtagaaatgaacatggcatatgaaatgtagaatattgtctctgattgaagagaaccgagctcgttagaactatgaggagtctgtaaatctctcaatgttggtaggaacaaaaagacaatgatattgtcagtattcactcccttgtgcttgtgctgttcagatggtactagctttgatagtatcccatttcgggttcttttctgatcattttcctctgtctttagacattgtgacattctattattcaagaaaagtccatatatgttttg

SEQ ID NO: 4548 - DNA, 871 bp, Carica papaya
atggaaggaaaaacgctcaaatcaaatatagggttttgttctgcataatgtaacagaggttttagggttcagattcgaattagggcattttaatcttgtctcgctgtttcgagataatctcagagagagataaatggcgacggagtcatccgaatcagaagaggaagggaaaatcagaggaggaaatgagacgctgattgtggatgacaatctgagagagatggggaagaaagctgcctggagtgttagctcttgcaagcccggcaatggcgtctcctctctccgtgatgacaatctcgatacctattggcaatcagatggtgcgcagccgcatttagttaatatccagttccagaagaaagttaagctacaattagttgtcctatatgttgatttcaagcttgatgagagctatactccaagtaagatctccattcgagctggcgatggcttccacaacatgaaggagatcaaagctgtggagcttgtgaagccaacaggttgggtttatatatccttgtctggaaatgatcctagggaaacttttgtcacacctttatgttgcaaattgctgtcttatcaatcaccttaatgggagggatactcatgtgcgccaaatcaaagtttatggaccaagaccgaatccaatcccacatcaacagtttcaatttacatcgagggaattcattacttactcatccataagatgaggcaatgagaaaacaaagtgggagaaaggtaagtatgtcatagcttcccaaactggcggggtccgaggatatttgatgagaacaaccagatgatggaagtgccggataaatatgtggtaaaacaacggtataggcatatatatatatatatgtatatgtat

SEQ ID NO: 4549 - DNA, 982 bp, Catharanthus roseus
gatctccccggagcggaacggtgtaatttggttctgagagaattcacaaagcctgattgagaggtgaaggtgattcaaatggaggtgaagtttttctaagaaatactagcaccaagtgatgcactgattaatcaaaccaaaattcaattgaaatggcggaatcatctgagggagaggaagaggggaagcttaccggaggaaatcagcagcttgtggtagatgatgacctccgtgagatggccaagaaagccgcatggagtgtcagctcttgcaaacctggcaatggtgtccttgctcttcgtgatgacaacctcgatacctactggcagtcagatggagcacagcctcatcttgtgaacattcaatttcagaagaaagtgaagctccaactagtggttttgtatgtggatttcaagcttgatgaaagttacactcctagtaagatctcaattcgtgctggagatggtttccaaaacttgaaagaaattaaagtagtcgaacttgtcaagccgactggttgggtgtatatttcattgtctgggaatgatcctcgggaaacttttgtaaacacattcatgttgcaaatagcaatattatcaaaccaccttaatggaagggatactcatgtccgccaaatcaaagtctatggacctcgtccaaatccgattccacatcaaccattccagttcacttctagggaattcattacatactcaactgtgagatgaaactcatctgccctgtgcccagcagcattagaaagaagagactgaacggatgaagaggcgattcagagaattagttagggactggtagaatgttctttatactctttctatatttctgttctaatttggatgtccgtgcactcacaatcgtctagtacactcttttattctgtgtcccatgtggtggttttaacccccatatcattgtatttcccatttgaaatatttcttagttttgaatcttaatcattgtc

SEQ ID NO: 4550 - DNA, 1302 bp, Tabernaemontana elegans
ggactgtcagtcttctctgtgaacaacatcggcagagataacgcggatgggtggtggtggatcggtagcatggagaaatgaagagttaacagacacaaaaactttagaattcccttctggtggagctatataaagtgattccgaccaatttcgctgaaaaaaaataaataaaaatattgattcccgctcttgttcatttgaaatctgtttgctaagagttgttgtagataaccagtcagtatttgatttgaataatgttggaggagcttctgtgatgattgcatcttttacctttataacatcaaacagtaatttagtggagtacttttgagctagggtttataaggagcaatagcaccctatcttgattgattgaaccagtgagcaattgggatggcagaatcatcagagggagaggaagatgggaagcttactggaggaaaccagcagctggtggtggatgatgacctccgcgagatggccaagaaagctgcttggagcgtcagctcttgcaaacccggcaatggcgtcctagctcttcgagacgacaatctcgatacctactggcagtcagatggagcacagccgcatcttgtgaacattcaatttcagaaaaaagtgaagctccaactagtggtactgtatgtggatttcaagcttgatgagagttacacacctagtaagatctcaattcgagctggtgatggtttccacaacttgaaagagattaaggtagttgagcttgtcaagccaactggttgggtgtacatatcattgtctgggagtgaccctagtgaaacttttgtaaacacattcatgttgcaaatagcagtattatcaaatcatcttaacgggagggatactcatgtgcgccaaatcaaagtctatgggcctcgtccaaatccgattccacatcaaccattccagttcacttctagagagttcattacatactcaactgtgagatgaagtttgagaccttgtgtttcaaattggaaaaggaaattatggatgttttgagtatggagaggtgatgatgagaatttcaaggagacagttgttctggttgtattgactggtggaacgctctctgagcgcactgcctctgtatgctggtgttctggttgtgctctgttttggatgcccttgtggttttacctcccatgtcattctatttctcgtttttaatgttattaatcattggtttttcccccatgccaagtaaaggttgataattacttggctttctaactgttctgttttttctattgtacttcttttggtttccttattagaagatat

SEQ ID NO: 4551 - DNA, 926 bp, Malus domestica
gcggattttggatttagggttttgatttgattggttttctgctatccagctaggcttttttgggttttaggaactcgatcaaattagggttctttttcttctaattcctgttcaaagaatcaatcatagaagaggaggcaatggcgacggagtcatcggagggagaagaggatgcgaagctgacgggagggcaccagctgctggtagtcgacgacgatctcagagaaatgggcaagaaggctgcttggagcgtcagctcctgcaaggccggcaatggcgtctcgtctctccgtgacgacaatctcgacacctactggcaatccgacggtgcgcagcctcatttggtgaacattcaattccagaggaaagtgaagctccaacttgttgttctctatgtggatttcaagcttgacgagagctatacgccgtgtaagatctcaatccgagccggcgacggctttcacaacttgaaggacataaaaactgtggagcttgataagccaacgggttgggttcatatatcactgtctggaaatgatccaagggaaacttttgtcaacacttttatgttgcaaatctctgtgttatcgaatcacctgaatgggagagacactcacgttcgccagatcaaagtttacggccctcgaccgaaccctattccacatcagccgtttcagtttacttcaagggagttcattacctattctactgtgagatgagaaatgcgatccgacgaagaaacaaagagacgggaaatgccggaccttgaaccgaaactggacggaatccctaaaccacattctaagcgcggcgaggaagtttctttgtaatatttgtaacattttgaatctccgatgtaatgttcactggcaataaactgatgtttgatacgttcattacataatttgaattttcagccgagttct

SEQ ID NO: 4552 - DNA, 836 bp, Chelidonium majus
gagggaaaatggcgacggagtcggacggggaagaggaagggaagctgataggtgggaatcagcatctagtggtggatgatgacctccgtgagatggctaagaaggctgcctggagcgtcagctcttgcaagtccggcaatggcgtccaatcccttcgtgatgacaacctagatacctactggcaatcggatggtgcgcagcctcacttagtaaacatccagttccagaaaaaagtcaaattgcaactagttgtcctgtatgttgatttcaaacttgacgagagctacactcccagtaagatctctattcgggctggcgacggtttccataatttgaaggagataaaaactgtggaactcgtgaagccagtcggttgggtttatatatccttatccgggactgatccccgagaagcctttatcaacaccttcatgttgcaaatttctgtgctctctaatcaccttaatggaagggatacccatgtgcgtcagattaaagtttatggacctcgaccgaacccaattcctcaccaaccatttcagttcacgtcaagggagttcattacttactcttctgtgaggtgagaagttccagaccttgctttccaatagtatgaagtgcaattccaggactaaaagcagaaaagagccctttcagttcagaattcctggtgtcatttaaagtgttttttttattgtatagtggaggtccttgtcgacacaaagctcccaatcctttttgttggttttggttacattttatcagtaaaggtattaaaggctgtttggtagtggaaaccattcttcttttattgctgagaatttgttttctcgctc

SEQ ID NO: 4553 - DNA, 1068 bp, Euonymus alatus
gggagaaatggcaacagtgtcatcagaaggagaagatgaggggaagataaccggagggaaccagcacctgattatcgacgacgatcttagagagatgggcaagaaggctgcttggagtgtcagctcgtgcaagcccggcaatggcgtctcttctctccgtgatgaaaacctcgacacatattggcaatcagacggtgcacagcctcatttggtgaatgttcagttccagaagaaagtgaagctgcagttggttgttctatatgtggatttcaagcttgacgagagctatacaccgagtaaaatctccattcgagctggtgatggatttcacaacttgaaggagataaaaactgtggagcttgtcaagccaactggttgggtttatatatcattatctggaaatgatcctagggaaacttttgtcaatacctttttgttgcaaatcattgtgctgtcgaatcacctaaatgggagggatactcatgtccgccagattaaagtttatgggcctcgaccaaaccctattccgcaccaaccgtttcagtttacttctccagaatttattacttattcttcagtgagatgagaatccaacacagtagacaagggaggcagcatcatactggagaggattacagcataaagttaccagatcattcaaggaccgtgaagagatttcctaattctggacatttaaactcaagtctacaaattattcaaaaagaaatgttattagatgtttccttacgtttgcggggactagcttggaaatggggccatttcccaaccttattcttcctaattgcactttctttgcttcattgatctacatctgaaagtgaggatctatgcaattcgcactgcaatatggcttgatggtctggggtgatctttctttggtatttttttttttttttgatgaattgctttggaatgtacttgcctttagccccatggaaatcaactagtcaattagatatcttgatgttcttcaatgtattgtgtttgacattttccaaagagactttgtgtaagtttattatgaatggattagagacctgttattgg

SEQ ID NO: 4554 - DNA, 933 bp, Actinidia deliciosa
  misc_feature (81)..(81): n is a, c, g, or t
  misc_feature (85)..(85): n is a, c, g, or t
  misc_feature (87)..(87): n is a, c, g, or t
  misc_feature (95)..(95): n is a, c, g, or t
  misc_feature (98)..(98): n is a, c, g, or t
ccacaaaggctcccctgggctgtagcctaggggagcccagcccagccccaaaactgaaaccctcctctgttctcctctcanactntnagccaccnaanacttaaacacacgtctcctctcagactctctctcctctgttctcacacggtcacacaccgaaaccctagatctctcacgcagttgcagtcttgcagaggagctgatcttcgttctccaaccgtcggattcacaaacagatcgtgtctgcttttgggtctctctcagaatccccaattgtgcaaccacaataaaaatggcaacggaatcatcagagggagaggaagaaagtaagatggtgggagggaaccagcagctgatggtagaggatgacctccgcgaaatggccaacaaggccgcctggagcgtcagctcttgcaagcctggcaatggcgtcactgccctccgcgatgacaacctcgacacctactggcaatcagacggtgcacaacctcaccttgtaaacattcaatttcagaagaaagtgaagcttcaattagtggttttgtatgtggatttcaagcttgatgagagctacacgccaagtaagatctctattcgtgcaggtgatggattccataatttgaaggaggtaaaaactgtggagctcatcaagcctactggttgggtgtacatatcgttatcaggaaatgatcctcgggaaacttttgtcaataccttcatgttgcaaattgccgtgttgtcaaatcatcttaatggaagagatactcatgtgcgccagataaaagtttatgggcctcggctgaaccctattccgcaccaaccctttcagttcacctcaagggagtttattacttactccactgtgagatgaggaacacaaatgttgcgtgtttaagcaaatcatcctgctgaatgtgattcattggggtttct

SEQ ID NO: 4555 - DNA, 1029 bp, Vinca minor
atatcaacgaaggtaaaaagcaatcgcttaatttgtggttttttagtagtgaaaaatatggcaactgtaacattgttaccctaatgaattgaagtccaggatgtctattttctattgtctcatatagttttcttcagctttgactatcttttttttatatttcttgaatacattttgaactacttcaatgtagcttgcagtttcatttaagtaaaggatcaatagcttcttcatgtttttcagtattaggagtccggtagagatcttagtactagtggaagccaggattggcatctgaagctaaattgcatatttaccttctctcctttcctttcttttcctccttgacgttagcagtaaaatagtgatttactggattgctcctatgatacagtttctaagaagtactagcaccaagtaaatacattgattaattaaaccaaaattctattcaaatggcggaatcatctgagggagaggaagaggggaagctcacaggaggaaatcagcagctcgtggtagatgatgacctccgtgagatggccaagaaagcggcttggagcgtcagctcttgcaaacctggcaatggtgtccttgctcttcgcgatgacaaccttgatacctactggcagtcagatggagcacagcctcatcttgtgaatattcaatttcagaagaaagtgaagctccaactagtagttgtgtatgtggatttcaagcttgatgagagttacacccccagtaagatctcaattcgggctggcgatggtttccacaacttgaaagagattaaagtagtcgagcttgtcaagccaactggttgggtgtatatttcattgtctgggaatgatcctcgggaaacttttataaacacgttcatgttgcaaatagcgatactatcaaatcaccttaatggaagggatactcatgtacgccaaatcaaagtctatgggcctcgtccaaatccaattccgcatcaaccatttcagttcacttctagagagttcattacatactcaattgtgagat

SEQ ID NO: 4556 - DNA, 1081 bp, Centaurea maculosa
aaactgaccggccctgattatatctaacaaatggcgacggaatcatcggagggagaagaagaaacgaagctaatgggagggaatccgcagctggtggtcgacggtgacctccgtgagatggcaaagatggctgcttggagtgtaagctcttgtaaacctggcaatggcgtttcttctcttcgagacgacaattatgaaacctattggcaatcagatggtgcacaaccgcatcttgttaacattcagtttcagaagaaagttaagcttcaattagtggcgctttatgttgatttcaatcttgatgagagttacacgcctagtaagatctcagttcgtgctggagatggatttcataacttaaaggagataaaaacagtagaacttgtgaagccaactggttgggtatacatatctttatctggaaacgatcctcgggaggcttttgtgaatacgtttatgttgcaaatcgctatattgtcaaatcatctcaacggaagggatacgcatgttcgccagattaaagtctacggaccacgaccgaatcctataccacaccagccatttcaattcacttcaactgaattcattacttattcaactgttagataaaaggaagccattgcatgtacttttgttgtcttgttcacatatagagagatcaggtatgcgtacattttactcaaattcgattcctagatgagatatattgggctggtttcattagtataataccatctaaagtttatgatcggttgttctcaatatttgtttttttggttaaaaagaatggtgcttaatgtgttcatttacacatcatgattccatttcacacattgattttttaatacttgttttttcattatccttcatatcaacctattcttgcttcattctaaactggtatataccctatgggtggcaatcgtgctatgttcgggttggcgggtcaggaaagcttaatccggacacgacccatataattaatcgtgtcgcattgatgttgtgtatatgcttaacccttatatcacctgtctaactataagggttcgcaggttggcgggtcatagaagggttggtgtgt

SEQ ID NO: 4557 - DNA, 1171 bp, Panax ginseng
tatcatcgtttgttaaaaaaacttcaaattattaactcaactggatttgtagtacttaaactaaataggggttttgggagagatcagttggttcgattgaatggcgacggaatcatcggagggagaggaagaagcgaaattgatcggagggaatcagcagctggtggtggatgatgaccttcgggagatggcgaagaaggctgcgtggagtgtcagctcttgtaagcccggcaatggcgtcctctctctccgtgacgataaccttgattcctattggcaatcagatggtgcgcagccacatcttgtgaatattcagtttcagaagaagttagttgttctatatgttgatttcaagcttgatgagagctatacccccagtaagattgctatccgtgctggtgatggcttccataacttgaaggagattaaaactgtggaacttgttaagccgacaggttgggtgtatatttccttgtctggaaatgatcctcgggaagcgtttgtgaacactttcatgttgcaaattgcagtgttgtcaaatcatcttaacgggagagatacccatgtgcgccagataaaagtttatgggcctcgaccgaaccctattccacaccaactgtttcaattcacttccagggagttcataacatattcgattgtaagatgaggaattccttgaattctgcaccttaaaccagcaaaaagtaaacgagacctgtgttgaatgtaacaagccggagcatacaagcttcatgaggagtttcttgttagtaaagttgtgttgctttcatgatctgtttgcagttcaccttctacctaacaatgattaaaactgtaattaccttctgtattaaggatccggcatcgaatggcagtcccacaaagagtaattatattcccttgcaaagtagtttttttttttggtttctagaaaatatataggtaatacaaacccttagacatgattacttttgaatcattttttccaattttatagtcgagtactaaatttattataaaatattattaaccaaaaaaaaaaaaacaaaaaaaaaaaaaacaaaaaaaaaaaacaaaaaaaaaaacaaaaaaaaacaaaaaaaaacaaaaacaagaagagagacacacagagacagacaccaacacacaaccacccccccccccccccccc

SEQ ID NO: 4558 - DNA, 622 bp, Ambrosia trifida
aaatatttaaaccaaacccattacgtcaatggctactgaatcatcggagggagaagaagaaaccaagctgatgggtggaaacccacagctggtggtggatagtgatcttcgtgagatggccaagaatgcggcctggagcgtaagctcgtgtaagcccggcaatggcgtgtcgtctcttcgagatgataattatgaaacttactggcagtcagatggtgcgcagccgcaccttgttaatattcagtttcagaagaaagttaagcttcaattagtcgcgctttatgtcgattttaatcttgatgagagttatacgcctagtaagatctcgattcgtgctggagatggttttcataacttaaaggagataaaaactgtagaacttgtcaagccaactggttgggtgtacatatctttatccggcaatgatcctagggaaacttttgtaaacacattcatgttgcaaattggtgtgttgtcaaatcatctcaacgggcgggatacacacattcgccagataaaagtctacggaccacaaccgaaccctataccacaccaaccatttcaatttacttcaaccgaattcattacttattcaactctgagatgaggaacctaaagatac

SEQ ID NO: 4559 - DNA, 1287 bp, Centaurea maculosa
  misc_feature (363)..(363): n is a, c, g, or t
  misc_feature (368)..(368): n is a, c, g, or t
  misc_feature (400)..(400): n is a, c, g, or t
  misc_feature (785)..(785): n is a, c, g, or t
  misc_feature (821)..(821): n is a, c, g, or t
  misc_feature (1210)..(1210): n is a, c, g, or t
  misc_feature (1215)..(1215): n is a, c, g, or t
ggcggggattatgtgatgtacgttggttgtttgggcttttgtattgtttttccctattagttgtttgctactgttttaatttttcgatttgaagaactaatctctagggttcttttttttttgtttttttgtttagggttctttatgttgagtttgatcgattttgaacaatatttgatggaaatcgatggtttgtcaagataatttatactaataaacgtatttggtgcttcaatttcaactgtttcaggggatccatgttcaaaaatctgaagagtagagaagagacctaatccctacccaaacctccattgaagaagcttcaagcaccaccagtgcagtgcatcatagattttgcttgangtctnccagtgaactcttcttcgattgagtgatttgnaaactgagcattttttttgcttttcgccatgggcatccgaaatctcaggaccggccctgattatatctaacaaatggcgacggaatcatcggagggagaagaagaaacgaagctaatgggagggaatccgcagctggtggtcgatggtgacctccgtgagatggcaaagatggctgcttggagcgtaagctcttgtaaacctggcaatggcgtctcttctcttcgagacgacaattacgaaacctattggcaatcagatggcgcacaaccgcatcttgttaacattcagtttcagaagaaagttaagcttcaattagtggcgctttatgttgatttcaatcttgatgagagttatacgcctagtaagatctcggttcgtgctggngatggttttcataacttaaaggagataaaaacagtngaacttgtgaagccaactggttgggtatacatatctttatctggaaacgatcctcgggaggcttttgtgaatacgttcatgttgcaaatcgctatattgtcaaatcatctcaatgggagggatacgcatgttcgccagattaaagtctacggaccacgaccgaatcctataccacaccagccatttcaattcacttcaactgaattcattacttattcaactgttagataaaaggaagccattgcatctacttttgttgtcttgttcacatatagagaggccaggtatgcgtacattttacttaaattcgattcctagatgagatatattgggctggtttcattagtataataccatctaaagtttatgattggttgttctcaattttnatttnttgggttagaaagaatgttgcttaatgtgtttatttacacatcatgattccatttcacacattgatttttat

SEQ ID NO: 4560 - DNA, 1136 bp, Cirsium arvense
acgcggggacagttccagggctccatgcctttctcaagagaagagaagaggcctaaacctaaccaaaccaagccccattgaagaagcttcaagcaaccaccaggataggtcctgattatatctaacaaatggcgacggaatcatcggagggagaagaagaaacgaagctaatgggagggaatccacagctggtggtggacggtgacctccgtgagatggcaaagatggctgcttggagcgtaagctcttgtaaacctggcaatggcgtctcttctcttcgagacgacaattacgaaacctattggcaatcagatggcgcacaaccgcatcttgttaacattcagtttcagaagaaagttaagcttcaattagtggccctttatgttgatttcaatcttgatgagagttatacgcctagtaagatctcggttcgtgctggagatggttttcataacttaaaggagataaaaacagtagaacttgtgaagccaactggttgggtatacatatctttatctggaaatgatcctcgggaggcttttgtgaatacgttcatgttgcaaatcgctatattgtcaaatcatctcaacgggagggatacacatgttcgccaaattaaagtctacggaccacgaccgaatcctataccacatcagccatttcaattcacttcaactgaattcattacttattcaactgttagatagaaggaagccattgtctgtacttttctttcacatacagggaggtcaggcatgcgtatattttacacaaaagttcaattcctagatgagatatattgggctcgtttgattagtataacaccatcttaagtttatgatctgttgttctcagtttatatttttttggttaaaatgaatggtgtgcttaatgtgtttatttacacatcgtgattccgtttgacacattgaatttttaatacttgttttttcattatccttcatatcaaaaagaaaaaacagatttattacacatttgatccctcgacttccatcaaatctcattagacccctcttctgaccaagtcaattacattttaagtccataagtgtaatacaacgtactaggccccttcttctatttaagggttctacaaactaactagttgtttttat

SEQ ID NO: 4561 - DNA, 1234 bp, Citrus clementina
gattgccgaagcatggttttgtcgtttgtaaaataacaaacggagacgccccctttagattcgaggaagtagaatagatcaacaactaccctttccccaataaatcccagcaaaatcgacatcagtccatccaaagccatcggagcggagtcaattattgtgtggaataagctaatggcaacagagtcatcagaatcagaagaagaagggaagatcactggaggaaatcatcaattattaattgatgacgatcttagagaaatgggaaagaaagctgcttggagtgtcagctcttgcaagcctggcaatggcgtctctgctcttcgcgatgacaatctcgatacttattggcaatcggacggtgctcagcctcatttggttaatattcagttccagaagaaagttaagttgcaattagttgtgctttatgtggattttaagcttgatgagagctatacacctagtaaaatctctgttcgagcaggtgatggttttcataacttgaaggagataaaaactgtggaacttgtcaagccaactgggtgggtctatatatcgttatctggaaatgatcctagggacacttttgtcaacacttttatgttgcaaattgttgtgttgtcaaaccatcttaatgggagggatactcatgtgcgccagatcaaaatttatggacctcgaccgaaccccattccacatcaacagtttcagtttacatcaagtgagtttatcacttactctactgtgaggtgaggtcagaaatttgccgcatagtgaaagatcttaatagcctcgtggcatttgctgtgggaaataaagctttgaagctcaaaaatattcagataatataagatttttaccatgttcttcgaggcatgtactactctagtgttatgatgttaatgatctcatatggaactgggtatcccttagccttaggaggttccgtagttcacgagctactgcttatggtcacatccctcaatgaagtcaataaccgagttagaagagaaaaagaaactggaaggagaagacgatgatggaatgtgaatgctgccagttaattttaacgggcttcttatgatgtttcctggcattgtttgttttgattgcaaagcttgttttttcacatttttattactattattattttattttgtttgaaagagagttactgagtagtagacagacgaagctattttaaattcaaatacgtaaaacgctgcgtttagta

SEQ ID NO: 4562 - DNA, 951 bp, Vitis vinifera
gtcgtccaatagtaccacaattcaaattggcggacgaggttagggttttaaaccgtgagaaaaggagggaggataaccggaagaaattggaatggcaacggagtcatcggagggagaggaagagggcaagatgatcggaggaaatcagcacctggttgtcgacgacgacctccgtgagatggccaagaaggctgcttggagcgttagttcttgcaaggctggcaatggcgtccttcttcttcgcgacgacaacctcgatacctattggcaatccgacggtgctcagcctcatcttgtaaacattcaattcctcaagaaagtgaagttgcaactggttgtaatttatgtggatttcaagctggacgagagctacacgccgagtaagatctctattcgagccggagatggcttccacaacttgaaggagataaagactgtggaacttgtcaagccaactggttgggtttacatatccctatctggaaatgatcctcgggaaacttttgtgaacacttttatgttgcaaattgctatattgtcaaatcaccttaatgggagagatactcatgtgcgccagatcaaagtttatgggcctccaccgaaccccatcccacgccagcccttccaattcacttcaagggagttcattacttactcttctgtgagatgagaagaacaggagcatgtactcaaaagtacaggggagaaggaagagagtaccagaattgtgttagactctaaagcaaattcgtgaaataacatgtagttccctgttagcatggactatattaatattctgctggggttttcaaatcattgatatacgatagattgaagaagcatgtatttatagttccctgtttcttggttcctatgtaacatttgttcgtctgaaaatagaacataaatttgtaaaatcagtttggttattgtgcgttttcttagtttggg

SEQ ID NO: 4563 - DNA, 890 bp, Centaurea maculosa
cttcaagcaccaccaggttgtaattgacaacacgaaaaatcagatcataattcgttgaattgtgtctatctaagaaatggcgacggaatcatcggagggagaagaagaaacgaagctaatgggagggaatccgcagctggtggtcgatggtgacctccgtgagatggcaaagatggctgcttggagcgttagctcttgtaagcctggcaatggcgtctcttctctaagagacgacaattacgaaacctattggcaatcagatggcgcacaaccacatctcgttaacattcagtttcagaagaaagttaagcttcaattagtggcactttatgttgatttcaatcttgatgagagttatacgcctagtaagatctcggttcgtgctggtgatggttttcataacttacaggagataaagacagtggaacttgtgaaaccaactggttgggtatacatatctttatctggaaacgatcctcgggaggcttttgtgaatacgttcatgttgcaaatcgctatattgtcaaatcatctcaatgggagggatacgcatgttcgccagattaaagtctacggaccacgaccgaatcctataccacaccagccatttcaattcacttcaactgaattcattacttattcaactgttagataaaaggaagccattgcatctacttttgttgtcttgttcacatatagagaggccaggtatgcgtacattttacttaaattcgattcctagatgagatatattgggctggtttcattagtataataccatctaaagtttatgattggttgttctcaattttcatttcttgggttagaaagaatgttgcttaatgtgtttatttacacatcatgattccatttcacacattgatttttat

SEQ ID NO: 4564 - DNA, 816 bp, Centaurea maculosa
gagttccagggctccatgcctttgccattcaaaatctgaaagagaaaagagagccacctaaaacctgaccaacctccattgaagaagcttcaatcaccaccaggataggtcctgattatatctaacaaatggcgacggaatcatcggagggagaagaagaaacgaagctaatgggagggaatccacagctggtggtggacggtgacctccgtgagatggcaaagatggctgcttggagcgtaagctcttgtaaacctggcaatggcgtctcttctcttcgagacgacaattacgaaacctattggcaatcagatggcgcacaaccgcatcttgttaacattcagtttcagaagaaagttaagcttcaattagtggccctttatgttgatttcaatcttgatgagagttatacgcctagtaagatctcggttcgtgctggagatggttttcataacttaaaggagataaaaacagtagaacttgtgaagccaactggttgggtatacatatgtttatctggaaatgatcctcgggaggcttttgtgaatacgttcatgttgcaaatcgctatattgtcaaatcatctcaacgggagggatacacatgttcgccaaattaaagtctacggaccacgaccgaatcctataccacatcagccatttcaattcacttcaactgaattcattacttattcaactgttagatagaaggaagccattgtctgtacttttctttcacatacagggaggtcaggcatgcgtatattttacacaaaagttcaattcctagatgagatatattgggctcgtttgatta

SEQ ID NO: 4565 - DNA, 870 bp, Cirsium arvense
tcgtctccctctttcacgactcctctcagattcttgtatcaaaactcaaacttgattttcaggagatcgtaatcataattggttggattgaatctaagagattacaatcggatcaaatggcaacggaatcatcggaaggagaagaagaaacgaagctgatgggaggaaatccgcagctggtggtggatggtgacctccgtgagatggcaaagatgtctgcttggagtgtaagctcttgtaaacctggaaatggcgtttcttctcttagagatgacaattacgaaacctattggcaatcagatggtgcacaaccacatcttgttaacattcaatttcagaagaaagttaagcttcaattagtggcgctttatgttgattttaatcttgatgagagttatacacctagtaagatctcggttcgtgctggagatggtttccataacttaaaggagataaaaacagtagaacttgtgaagccaactggttgggtatatatatctttatctggcaatgatcctcgggaagcttttgtgaatactttcatgttgcaaattgctatattgtcaaatcatctcaacggaagggatacacatgttcgccagataaaagtctacggaccacgaccgaatcctataccacaccaaccatttcaatttacttcaactgaattcattacttactcaactgttagataaggaaagctacaaaaggtgttggattggtggtttacagtttgccttttacttttgttatctggttgactaatagaggtcaggtatgcatacattttacaccgaaatcctgcttttatttatatgagatataatagacttgtttgtatttaaaaaaagaaaaaagtaaccgactgcg

SEQ ID NO: 4566 - DNA, 853 bp, Taraxacum officinale
  misc_feature (803)..(803): n is a, c, g, or t
cggcggggaatacaactgggtttttgggctccatgccgttgcctttcaaatagaatctcccccctccgcctccgcctccgccgtatctgaacttctgtgacctacgaggttaaagaaaagctttcagctccagctatttctcgttataatacaactgttacgctatagaccagatcgttattagttgttctgaatcaagggattacgcaaaatggctacggagtcatccgagggagaagaagaaacgaaactcatgggagggaatccgcaactggtggtcgatggcgacctccgtgagatggcaaagatggctgcttggagcgttagctcttgtaaacctggcaatggcgtctcttctcttcgagatgacaattatgaaacctactggcaatcagacggtgcacaaccacatcttgtcaacattcagtttcaaaaaaaagttaaacttcaattagttgcactttatgtcgattttaatcttgatgagagttatacacctagtaagatctcaattcgtgctggagatggctttcataacttaaaggagataaaaacagtagaacttgtaaagccgactggttgggtacacatatctttatctggaaatgatcctcgggaggcttttgtaaataccttcatgttgcaaattggtatattgtcaaatcatcttaatgggagggatacacatgtccgccagataaaagtatatggaccacgaccaaatcctattccacaccaaccatttcagttcacttcaagtgaattcattacttactcaactgtgagatgatgaggaatctaanagaatgttgtttgatgtgttattgacgatattagtcatatgcattgtttc

SEQ ID NO: 4567 - DNA, 1053 bp, Euphorbia peplus
tttaccgcgcgctctctttgcttcattcaaatttcacctaaggtgattcacattctaatccaggactcttctttgaagatttcagctatggtgtttccaaatcattgaggattttgttggttactagtcaggggggttgcctggggaaaatacagatttttttattatttttaaatgatggtctaaaacgtcgacctccaacaacaaagtcgatcttcaagaaagctgccgatcttctcttctcccgagttccgtccggcctcccctgctcgccgtcgcctcgtcgccggctgtgtatcctccactactcacgcttaatatcaattttagggtttactgatttgaggccaaatggcaacagagttatcagagggagaagaagaaggaaagatcgtaggcggtaatcaacatctcattgttgatgcttttctcagagaaatgggcaagaaggctgcttggagtgttagttcttgcaaacctggcaatgctgtctcttctctccgcgacgataatcttgataccttctggcaatcggatggtgctcagcctcatctcgtcaacattcaattccagaagaaagaaaaactgcagttggttgtagtctatgtggattttaagcttgatgagagttatacccccagtaagatatccattcgtgctggtgatggatttcacaacttgaaggagatcaagactgtggagcttgtcaagccaactggctgggtttatctatccttatctggaaatgatcccagggaaacttttgtgaatacttttatgctacaaatagctgtgctatcaaatcatcttaatggaagggatactcatgtgcggcagatcaaagtttatgggcctcgaccgaacccatttccccagcagccttttcaatttacttcacgagagtttattacatatgcgaatgtgagatgagaaatgtgactttaacaggaaacagagaaagctgagactgggcagatcatccaacaagcattatcagcatctctccaggcatattttttgcaatctccacaacatgtcctggacagtaataca

SEQ ID NO: 4568 - DNA, 984 bp, Vitis vinifera
gccaggaccaggtgtgggcttagttgggtcgtccaatagtaccacaattcaaattggcggacgaggttagggttttaaaccgtgagaaaaggagggaggattaccggaagaaattggaatggcaacggagtcatcggagggagaggaagagggcaagatgatcggaggaaatcagcacctggttgtcgacgaagacctccgtgagatggccaagaaggctgcttggagcgttagttcttgcaaggctggcaatggcgtccttcttcttcgcgacgacaacctcgatacctattggcaatccgacggtgctcagcctcatcttgtaaacattcaattcctcaagaaagtgaagttgcaactggttgtaatttatgtggatttcaagctggacgagagctacacgccgagtaagatctctattcgagccggagatggcttccacaacttgaaggagataaagactgtggaacttgtcaagccaactggttgggtttacatatccctatctggaaatgatcctcgggaaacttttgtgaacacttttatgttgcaaattgctatattgtcaaatcaccttaatgggagagatactcatgtgcgccagatcaaagtttatgggcctccaccgaaccccatcccacgccagcccttccaattcacttcaagggagttcattacttactcttctgtgagatgagaagaacaggagcatgtactcaaaagtacaggggagaaggaagagagtaccagaattgtgttagactctaaagcaaattcgtgaaataacatgttgtagttccctgttagcatggactatattaacattctgctggggatttcaaatcattgatatacgatagattgaagaagcatgtatttatagttccctgtttcttggttcctatgtaacatttgttcgtctgaaaatagaacataaatttgtaaaatcagtttggttattgtgcgttttcttagtttgggttg

SEQ ID NO: 4569 - DNA, 1043 bp, Lactuca sativa
gggatttattttatttttttcaaaaaagaaaatcttccctctcccctcctccataatcaatacctgaaacttctgaagaagaagcttcacgcaccaagtccttatctcgcctcctcgcaattgatatctggctttacaattttacccactgtctactctcgttataattaacaactgttggacaatagatcagatcgttattccttggcaaaatggcgactgaatcatcggagggagaagaagaaacgaaactcacgggagggaatccgcaactggtggtagatggcgaccttcgtgagatggcaaagatggctgcttggagcgtaagctcttgtaaacccggcaatggcgtctcttctcttcgggatgacaattacgaaacctattggcaatcagatggcgcacaaccacatctcgttaacattcagttccaaaagaaagttaaacttcaattagtggcgctttatgttgatttcaatcttgatgagagttatacacctagtaagatctcaattcgtgctggagatggtttccataacttaaaggagataaaaacagtagaacttgtgaaaccaactggttgggtacacatatctttgtctggaaatgatcctcgggaagcttttgtaaataccttcatgttgcaaattggtatattgtcgaatcatcttaacgggagggatacacatgtccgccagataaaagtttacggaccacgaccgaatcctattccacatcaaccatttcagtttacttcaagtgaattcattacttactcaactgtgagatgaagaaaatttaaaaggcttgttggattttgatggtttacatgttagttaactcagctgtaccattttaaatttatggtcaaaggttgctcaatatggtttttttatttttggaaaagaatggtgtttaatgtgttattgataacattggccatatgcactgtttctttttttgtccaaaatgggtcatttcttccccaatgaaatgtttatttatttatgtaagaatggtggtttacttgcatgagaatttac

SEQ ID NO: 4570 - DNA, 968 bp, Mimulus guttatus
acactcacaatttccccccctttttactcgatccaacaatagttatctgaatttcgacattcaaaaataatcaattactactacatgattaacggttgaaattagggtttatccctcgccccaaaaccagaccaattgctggcggtgtaaaatggcggactcgtcggagggggaggaggaagggaagctgagcggcggaaaccaacagctggcggtggacgaagagctccgtgaaatggcgaagaaagccgcttggagtgtcagctcctgcaaacccggaaacggcgtcgcttcaatccgcgacgacaatctcgattcttactggcagtcagatggtgcacagcctcatctagtcaatatccagttccagaagaaagttagacttcaattagttgttttgtatgtcgatttcaagcttgacgagagctacacacctagcaagatctcgattcgagccggtgatggtttccacaacttgaaggagataaaggcagtggagctcgttaagccaactggttgggtgtatatatcgttgtctgggactgatccaagggaaacctttgtgaatacgttcatgttacaaattgctatcttgtccaatcatctaaacgggagagatacgcatgtgcgccaaatcaaagtttacgggcctcgaccgaatcctattccaagacagccgtttcaattcacttcgaacgagttcattacttactctattctgagataaagtgaatttacctccccttctgatttttgaggaacgaaactgaaatcacagctttgtagttgtaggagattggttggaacaacataatttaacgggatcgttgttttggaactcgagatctatactaagttagtctgatatccttttttatttcgtaatatgtaggggtattgttgtaaatttatttaacagttttcatctggcttgtcggtttttcataatatattatttgtttcatgtt

SEQ ID NO: 4571 - DNA, 900 bp, Mimulus guttatus
taacggttgaaattagggtttatcccccgccccaaaaccagagcaattgctggcggtgtaaaatggcggactcgtcggagggggaggaggaggggaagctgagcggcggaaaccagcagctggcggtggacgaagagctccgtgaaatggcgaagaaagccgcttggagtgtcagctcctgcaaacccggaaacggcgtcgcatctatccgtgacgacaatctcgattcttactggcagtcagatggtgcacagcctcatctagtcaatatccagttccagaagaaagttagacttcaattagttgttttgtatgtcgatttcaagcttgacgagagctacacacctagtaagatctcgattcgagccggtgatggtttccacaacttgaaggagataaaggcagtggagctcgttaaaccaactggttgggtgtatatatcgttgtctgggactgatccgagggaaacctttgtgaatacgttcatgttacaaattgctatcttgtccaatcatctaaacgggagagatacgcatgtgcgccaaatcaaagtttacgggcctcgaccgaatcctattccaagacagccgtttcagttcacttcgaacgagttcattacttactctattctgagataaagtgaatttaccctcccttctgatttttgaggaatgaaactgaaatcacagctttgtagttgtaggagattggttggaacaacataatttaacgggatcgttgttttggaactcgagatctatactaagttattctgatatccgttttttattttgtaacctgtaggggtattgttgtaaatttatgtaacagttttcattctggcttatcgatctttcataatatatgggtttcacattatgaattaattttgaacttctg

SEQ ID NO: 4572 - DNA, 836 bp, Papaver somniferum
aatattgtgaccgactgaggctgtgagagatggcgactgaatcagacggagaagaagaaggaaagcttatcggtggaaatcaacatctagttgtagatgatgaccttcgtgagatggctaaaaaagctgcttggagtgtcagttcttgcaagtctggtaatggtgttcaatccattcgcgacgacaatctcgatacctactggcaatcagatggtgctcagcctcacttagttaacatccaattccaaaaaaaagtcaaattacaattagttgtcatgtatgttgatttcaagcttgatgaaagttacacacctagcaaggtatctattcgggccggggatggttttcataatttgaaggagataaaaactgtggaactcgtgaagcccgtaggttggatgtatatacccttgtctggaactgagcctcgggatgcctttctcaacactttcatgttacaaattgctatcatctccaatcaccttaatggaagggatacccatgtacgccagataaaggtttatggacctcgaccgaatccaattccccaccaaccctttcagttcacttcaagggagttcatcacttactcttctatcagataaggaaacaagaccgttctttgtaaatcatcttttagcggggtgaaagactaagagcataatggagccttttcagttcagaagaggggtaacatgaaaaaagtaaaagttatctgttgttgatcaaaaggaaatccttctaaactatttgcttttggtttttgataaaccatggagcttcttggctgagcacttgtctctcctcctccagaccattttcatgtggtcctgtaa

SEQ ID NO: 4573 - DNA, 1068 bp, Euonymus alatus
gagaaatggcaacagtgtcatcagaaggagaagatgaggggaagataaccggagggaaccagcacctgattatcgacgacgatcttagagagatgggcaagaaggctgcttggagtgtcagctcgtgcaagcccggcaatggcgtctcttctctccgtgatgaaaacctcgacacatattggcaatcagacggtgcacagcctcatttggtgaatgttcagttccagaagaaagtgaagctgcagttggttgttctatatgtggatttcaagcttgacgagagctacacaccgagtaaaatctccattcgagctggtgatggatttcacaacttgaaggagataaaaacggtggagcttgtcaagccgactggttgggtttatatatcattatctggaaatgatcctagggaaacttttgtcaatacctttttgttgcaaatcattgtgctgtcgaatcactaaatgggagggatactcatgtccgccagattaaagtttatggacctcgaccaaaccctattccgcaccaaacgtttcagtttacttctccagaatttattacttattcttcagtgagatgagaatccaacaccgtagacaagggaggcagcatcatactagagaggattacagcatatagttaccagatccttcaaggaccttgaagggatttcctaattctggacatttaaactcaagtctacaaatgattcaaaaagaaatgttattagatgtttccttacgtttgcggggactagcttggaaatggggccatttcccaaccttaattcttcctaattgcactttctttgcttcattgatctacatctgaaagtgagaatctatgcaattcgcactgctatacagcttgatggtctgggttgatctttctttggtattttctttttttgatgaattgctttggaatgtacttgcctttagccgcattgaaatcaactagtcaattagatatcttgatgttcttcagtgtattgtgttttacattttccaaagagactttgtgtaagttttattatgaatggattagagacctgttattgattgc

SEQ ID NO: 4574 - DNA, 854 bp, Heritiera littoralis
taggctacagaatcttcggagttagagggagaaggggagattacaggaggagatcagcacctaatagtcgaagacgaccttagagaaatggggaaaaaagcagcttggactgtcagctcttgtaaaactggcaatggcgtttcttctctccgtgacgacaatcttgaaacctattggcagtcagatggagcccagcctcatttagttaacgttcagttccagaagaaggttaagttgcaactagttgtaatttatgtggatttcaagcttgatgagagctacacaccaagtaagatctctattcgagcaggtgatggcttccataacttgaaggagattaaaactgtggaacttgtcaagcctaccggttgggtttatctttcattatccggaaatgatcctcgtgaaacttttgtcaatacctttatgctgcaaattgcgattttgtccaatcaccttaatgggagggatactcatgtgcgccagatcaaagtttatgggccccgaccgaatcctattccgcaccaaccatttcaatttacttccagggaattcattacatactccactgtgagataataaatgtgacctaatagctggtttggggtggaaagtgacatgcatatgaaatgtggaatcttgtctcagattgaagagaactaagcacgttgctgaaagaaaccatatattctttaaaactaagaggagcttctcataggaacatggtgatggctttatatctatcaatatttatttagggaaaagacttggtattgtcactattcactccctcctgcttgtgctgatcagattgtttaaattatcttgaatagtatcgctttttagattctttt

SEQ ID NO: 4575 - DNA, 895 bp, Ocimum basilicum
cagcagataataatactataaatgaatagtagtgcatttcaaaattctttatatcaatcatcgaattagggtttaatctaatctggtagaaaatggcggaatcgtcggagggggaggaggaagggaagctgacgggaggaagtgcgcagttggtggtggacgacgacctccgtgatatggccaagaaggccgcctggagcgttagctcctgcaagccaggaaacggcgttgcttccctccgcgacgacaatctcgatacctactggcagtcagatggtgcacaacctcatcttgtgaacatccagttccagaagaaagttaaacttcagctagttgttttgtatgttgatttcaagattgatgagagctacactccgagcaagatctcgattcgagctggagatggtttccacaatctgaaggagatcaaaacagtggagcttgataaaccaactggttggatgtatatatcattgtctgggagtgatccgagggaaacttttgtgaatactttcatgttgcaaattgctgttttgtctaatcatcttaacggaagggacacgcacctgcgccaaattaaagtttatggaccgcgaccgaatcccattccccaccaaccattccacttcacttcaactgagttcattacttattcaattctgagatgaagtggatttgcctccgctgaaattcgagattcttagaaagttaagactcctttctgtactattagtggtcttttcggaacaacactctttgtctgtatgtagcttgtccaaatcctacatgtttcgtactatgcagaactgcagatgtgttggttcacaatttttatgccatattgtgatcgtgatatggcatattcattcataactataaatttactaaactgtgg

SEQ ID NO: 4576 - DNA, 1168 bp, Eucalyptus grandis
ccggtgtttacggctttttcattttttcaaacagcaaaagcgctccagtcggataccgtcgatcctactctctctctctctctccggctgtttccgatggcgacggaatcgtcggaaggagaggacgaagggaagatcaccggcggcaaccccgtgctcgccgtcgacgacgacctccgcgagatgggcaagaaggccgtctggagcgtcagctcctgcaagcccggcaacggcgtctcctccctccgcgacgacaacctcgacacttactggcaatccgacggcgcgcagccgcatctggtgaacgttcagtttcagaagaaggtgaagctccagatggtggccctctacgtggatttcaagcttgacgagagttacacgcccagtaagatctcgattcgtgctggggatggattccacaatctgaaggagataaagacggtggaacttttgaagccgtccgggtggattcctatatctctatctggaaatgatcctcgggaaactttcgtcaacacttttatgttgcaaatagcggtgttgtcaaatcacctgaatggacgagacacacatgtgcggcagatcaaagtttatggtcctcgaccgaacccatttccacatcagcctttccaatttacatcgacagagtttatcacttactcctgcgtgagatgagaaacgagaatctccagattaaaaggggatgagaaatgtaagatcttgtgcttcaagggcccttgaagagtgtcttttgggaatgcgagttacatggctttattctctaccctcgaggccatcctgatatcttcctacatacccaggtgagacttcactggtgcaagcgatccagtgcaggggcagtgcccatccacaagcttacagattaattggagagtgggcagcaaagagagacatgaatgatattttcagtttcttctcattattgctttagcagactgttgaaattgcaaccatgttgatgctctggcgacctggcgaccttcatctattgatgcttgttgttgattgagcctccaagttcaattgagttcggagagttaaattactttctagtgcacgctgccttgtcatcatctgttctgtttaaaagtgaagcctgccgtagcgccttttcccagtagtgtgctgtaatcgtcgtttctctttc

SEQ ID NO: 4577 - DNA, 1179 bp, Nicotiana benthamiana
ttctcagaatttgaaaaactcgaatacctggggcttctgaattggggattacatcaaaattggggatttcagtacttgcattaagaacagccaagcaaagtattattatacaaatcaaagaaaaagttaaggtgagtgaaattcagctatggcggattcatcagagggggaggaagaagggaaactgacaggaggaagccagcagctagttgtagatgatgacctccgggaaatgggtaaaaaggctgcttggagtgtcagctcctataaacccggcaatggtgtcctttcccttcgcgatgacaacctcgatacctattggcaatcagatggcgcacagcctcatcttgttaatgttcagtttcagaagaaagttaagcttcaattagttgtcctgtatgttgatttcaagcttgacgaaagctatacacctggtaagatctctatccgagcaggcgatggatttcacaacttgaaggagataaaagcagtggagcttgtcaagccaactggatggatctatatatctttatctgggaatgatccgcgtgaaacctttgtcaacactttcatgctgcaaataggtgtgctctcaaatcatcttaatggaagggacactcatatccgccagattaaagtctacgggccaagaccgaaccctatccctcttcagccatttcagtttacttctacagagtttattacttattctactgtgagatgaagctcaagggactacgtcaagaggcaagataccaaccatatatattgatatcaagtagcaaactgggggtacaaaagaatcctttttcttttgaaaacagaccaaatcccacattaccaaacctgggatcctgtcccttggacgactttgagtaatgggagaatgacaactggaccctgcagtggtagaacctcataaaccagagtatgatattgataagttgtaggtccatagaatgtctatacttggtttatagttttctagaaaattccatttacaaaattacaagaatatatcgcttcactatagaccgtgtgacgaatgactatcagtaggtagtgtcttgtagttttattgtatttctcccagttcttaatctgtctgctatacctggaagaggatgagcttgttctcttccgtacatttttgttccaacgcatattggctaacttttc

SEQ ID NO: 4578 - DNA, 911 bp, Papaver somniferum
tctttctgcgattaatgatataaattcattctctccgcatttttttttgttgtatactcctggtagaatattgtgactgactgaggctatgagagatggagactgaatcagacggagaagaagaaggaaagcttatcggtggaaatcaacatctagttgtagatgatgaccttcgtgagatggctaaaaaagctgcttggagtgtcagttcttgcaagtctggtaatggtgttccatccattcgcgacgacaatctcgatacctactggcaatcagacggtgctcaacctcacttagttaacatccaattccagaaaaaagtcaaattacaattagttgtcatgtatgttgatttcaagcttgatgaaagttatacacctagcaaggtatctattcgggctggggatggttttcataatttgaaggagataaaaaccgtggaactcgtgaagccggttggttggatgtatatacccttatctggtactgagcctcgggatgcctttcccaacactttcatgttacaaattgcgatcatctccaatcaccttaatggaagggatacccatgtacgccagataaaggtttatggacctcgaccgaatcctattccccaccaaccctttcagttcacttcaagggagtttatcacttactcttctatcagataaggaacttcgtaaattatcttttagcagggtgcaagactaagagcagaaaagagccttttcagttcagaataggggtaacatgaaactttttgaaggtatctgttgttgataaaaaaaatattaatctttctaaactatttgctttgttggtttttgataaaccatggagcttcttggctgagcacttgtctctcctcctccagaccatattcatgtggtcctgtaactaacatttgaaaa

SEQ ID NO: 4579 - DNA, 927 bp, Papaver somniferum
ctctgcgattaatgatgtaaattcattctctccgcattttttttggtatactcctggtagaatattgtgacttactgaggctgtgagaaatggcgactgaatcagacggagaagaagaaggaaagcttatcggtggaaatcaacatctagttgtagatgatgaccttcgtgagatggctaagaaagctgcttggagtgtcagttcttgcaagtctggtaatggtgttcaatccattcgcgacgacaatctcgatacctactggcaatcagacggtgctcaacctcacttagtaaacatccaattccagaaaaaagtcaaattacaattagttgtcatgtatgttgatttcaagcttgatgaaagttacacacctagcaaggtatctattcgggcgggggatggttttcataatttgaaggagataaaaactgtggaactcgtgaagccggttggttggatgtatatacccttgtctggtactgagcctcgggatgcctttctcaacactttcatgttacaaattgctatcatctccaatcacctgaacggaagggatacccatgtacgccagataaaggtttatggacctcgaccgaatcctattccccaccaaccctttcagttcacttcaagggagtttatcacttactctactatcagataaggaacttcgtaaatcatcttttagcggggtgcaagactaagagcagaaaagagccttttcagttcagaataggggtaacatgaaactttttgaaggtatctgttgttgataaaaaaaaatttgatctttctaaactatttgctttgttggtttttgataaaccatggagcttctttggctgagcacttgtctctcctcctccggaccattctcatgtggtcctgtaactaacatttgaaaattatattttgcgaaagcttgc

SEQ ID NO: 4580 - DNA, 839 bp, Arabidopsis thaliana
tgaaccaaaaagacgaatttttcaaaacctcgtcggagaggtttaggcttaaagaaacaaattgttggaatctcaattctcgaatctgacatctcggagaagagatatggcgacagagtcatcggaatcggaagaagaaggaaagattagtggaggaaactataagctaatcatagacgacgatctaagagagatgggtaaaaacgcagcttggagcgttagctcttgtaagcccggcaatggcgtcaccactctccgcgacgacaatctcgagacttattggcaatcagatgggttacaaccacatttgattaacattcaattccagaagaaagtgaaactgcagttagtggttttgtacgttgactttaagcttgatgagagctatacaccaagtaaaatctctattcgagctggtgatggttttcataacttaaaggagattaaaagtgtggagcttgttaaaccaactggttgggtttgcttatctttgtctggaaccgatccacgggaaacttttgtcaatacatttatgttacaaatagccattttgtcaaatcacctcaacgggagagatactcatatccgccagatcaaagtttacggccctagaccaaatcctattccgcaccaaccttttcagtttacatcgatggagtttctcacttattcaacactgagatgagaaatttgagcaggagaagtttgaagaacatggactatgaaagatactgatgttgataccacatgaagagtctataatcagattagttattgttgttgtgcaatggcttttgtttatatattacattggatataacaatcataacttcagtaag

SEQ ID NO: 4581 - DNA, 996 bp, Echinacea purpurea
aacaatgttgtttacttgcttatagaggtggcaaaatgaacccagacatcaatttgtagatcttaatgggcgttttatataacctgatgggttatgttgggttaactagtttgttcaagggggtcaggtagatacacatacacatacacgaagggttcttcataatctttcaaacactcgcaaatcggcgttatgatttgagttacactcgcattttgttaattcaacaacaagcaattccagcaaatttacggtttcacatcgaggcacaacaacacatcataatctgttgaattgaatcaaatctgttacgtcaatggcgaccgaatcatcggagggagaagaagaaacaaaactgatgggcggaaatccacagctggtggtggatagtgatctccgtgagatggcgaagaacgccgcttggagtgtaagctcttgtaaacccggcaatggcgtgtcgtctcttcgagatgataattatgaaacctactggcaatcggatggtgcgcaaccccaccttgttaatattcagtttcagaagaaagtaaagcttcaaatagtggcgctttatgtggattttaatcttgatgagagttatacacctagtaagatctcgattcgtgttggagatggttttcataacttgaaggagataaaaactgtagaacttgtgaagccaactggttgggtccccatatctttatccggcaatgatcctcgggaaacttttgtaaatacattcatgctgcaaattggtgtattgtcaaaccatctcaacgggagggatacacacatccgccagataaaagtctatggaccacaaccgaaccctataccacaccaaccttttcaattcacttcagcggaattcattacttactcgactctcaggtgaggaacattttgcatacccaattaagtgcagtaccatcgtatgtttaaagtcaattgtgtgctcttattttcgttctttttgttgttggaacgaacgtgcat

SEQ ID NO: 4582 - DNA, 1101 bp, Arabidopsis thaliana
aaatttatagtgatgttgaacatcacaatcttatcatggttttcatggaattgaatcgttaatgacttgtgtaggtgaaactattctaattccaagtgtttgtcacttttattcagaaagtaaagtaattgccgtttctgttttaacaaaacaagtatcaggccgttccaagcgttcactaacgacacgacgtttgtttatgaaccaaaaagacgaatttttcaaaacctcgtcggagaggtttaggcttaaagaaacaaattgttggaatctcaattctcgaatctgacatctcggagaagagatatggcgacagagtcatcggaatcggaagaagaaggaaagattagtggaggaaactataagctaatcatagacgacgatctaagagagatgggtaaaaacgcagcttggagcgttagctcttgtaagcccggcaatggcgtcaccactctccgcgacgacaatctcgagacttattggcaatcagatgggttacaaccacatttgattaacattcaattccagaagaaagtgaaactgcagttagtggttttgtacgttgactttaagcttgatgagagctatacaccaagtaaaatctctattcgagctggtgatggttttcataacttaaaggagattaaaagtgtggagcttgttaaaccaactggttgggtttgcttatctttgtctggaaccgatccacgggaaacttttgtcaatacatttatgttacaaatagccattttgtcaaatcacctcaacgggagagatactcatatccgccagatcaaagtttacggccctagaccaaatcctattccgcaccaaccttttcagtttacatcgatggagtttctcacttattcaacactgagatgagaaatttgagcaggagaagtttgaagaacatggactatgaaagatactgatgttgataccacatgaagagtctataatcagattagttattgttgttgtgcaatggcttttgtttatatattacattggatataacaatcataacttcagtaagcttatcaaccaagacctccataaaacatttgacacagtgattttggagatacggatttaaag

SEQ ID NO: 4583 - DNA, 803 bp, Nicotiana benthamiana
atgcgttttcccaatccacttctcaaaaattgaaaaactggaaaacctagggcttccgaattggggattacatcaaaattgggattttagttcttgcattaagaacagccaagcaaagtattatacaaatcaaagaaaaagttaaggtgagtgaaattcagctatggcggattcatcagagggagaggaagaagggaaactgacaggaggaagccagcagctagttgtagatgatgacctccgggaaatgggtaaaaaggctgcttggagtgtcagctcctataaacccggcaatggtgtcctttctcttcgcgatgacaacctcgatacctattggcaatcagatggcgcacagcctcatcttgttaatgttcagtttcagaagaaagttaagcttcaattagtcgtcctgtatgttgatttcaagcttgatgaaagctatacacctggtaagatctctatccgagcaggtgatggatttcacaacttgaaggagataaaagcagtggagcttgtcaagacaactggatgggtctatatatctttatctgggagtgatccgcgggaaacctttgtcaacactttcatgctgcaaatagctgtgctctcaaatcatcttaatggaagggacactcatatccgccagattaaagtctacgggccaagaccgaaccctatccctcttcagccatttcagtttacttctacagagtttattacttattctactgtgagatgaagctcaagggactacgccaagaggcaagatgccaaccatatatattgatatcaggtagcaaact

SEQ ID NO: 4584 - DNA, 1265 bp, Solanum phureja
ctttaatttatcaacttataatagtctcttaagtgacaaacattatattatcaaacatataaaagttcgatttatgataccatctaatttctatgtcccattttaattgtgtttttaacttcttctttttccgtccattaaaaaaataaataaatataaaatataatttattaagtaatttttattatttaaatagttttttaaaattacttctttaacgtttagttgtcaatttggatctttgattttttaaaataacatttcctttttagataattttttaagatataaattagaatatttgaatttatgaaaaaaaaaaaatggtgcaacacatcctccatttccccaaatccacttttcaaaattgaaaaacagtacgcgctcgaaaacctagggtttatgttgttgcaaacaattggggattttacctagttgaattaagagcttaatcaatggcggattcatcagagggtgaggaagaagggaaactaacaggaggaagccagcagttagttgtagatgatgacctccgggagatgggtaaaacagcagcttggagtgtcagctcttataaacccggcaatggggttctttcacttcgcgatgataaccttgaaacctattggcaatcagatggtgcacagcctcatcttgttaatgttcaatttcagaaaaaagttaagcttcaattagtcgtcctgtatgttgatttcaagcttgacgaaagctatacacctggtaagatctctatccgagcaggtgatggctttcacaacttgaaggagataaaagcagtggaacttgtgaagccaactggatggatgcatatatctttatctggtaatgatccacgtgaaacttttgtcaacactttcatgctgcaaatagctgtgctctcgaatcatcttaatggaagagacactcatatccgtcagattaaagtctatgggccaagaccgaaccctatccctcttcagccatttcagttcacttctacagagtttattacttattctgctgtgagatgaagctcaagggactatcccaagaggaaagatgccaacaatatttattgatattaaaatgcaaacatgattttgccatgaaagttgaagaatgatcttgctacgtagctttggaactacgactccctttttaagtgttatcaattattagcattttgtgaaattgtaggatgatgttatgctggttgtgtagcaatgttgctagacatgaccttggtaaccatacaaattataccc

SEQ ID NO: 4585 - DNA, 885 bp, Fragaria vesca
agatttgattttaaagggttttgctataaatctactagggtttaataaggtttagagaatccgagaatggcggaatcatcggagggagaagaggaagggaagctgacagtagggaaccaagtgctgatggtggaagacgacctccgagaaatgggcaagaacgccgcttggagcgtcagctcttggaagtccggcaacggcgtgtcgtatctccgcgacgacaatctcgacacttactggcaatccgacggcgctcagcctcattcggtcaacattcagttccagaagaaagtcaagctccaacttgttgttctgtacgtggatttcaagcttgatgagagctacacgccttcgaagatatcgattcgtgctggggatggcttccacaacttgaaggacataaaaactgttgagctcgataagccgaggggttggattcatatatcattgtctggaaatgatgcaagggaaacttttgtgaacacatttatgctgcaaatctctgtgttatcaaatcaccttaatgggagggacacgcatgtgcgccagatcaaactatatggccctagaccgaaccctattccacatcagccatttcagtttacttcaagggagttcattacctatgcttctatcagatgagaaatgcggctcggcatagacagatggaaatcgggtttagtcctattccagtctaaacaccgcagagaagtttttctgtgtaatatatttgcatgatgttcattgttaaaaataatgttatttgatctatggatccaaaaagaaacttcagagtttcttttggtgggcagccctatatgcctgtactaaaaacatctttgttcatcaatctctatcttgaacttggagcaatgtctggatact

SEQ ID NO: 4586 - DNA, 995 bp, Helianthus annuus
gaggtacaaaattaacgtgggtagtaatccggttgacaaatcagcgtctgagttaagggtgcagttataggtaaataaaagcatggagtatgctaaaccatgggagatatgaggcatggagctggggttatagaactgaagaagcttcatccccttgggtatctcagcagcaccagacctacgaatcgaagaagcttggagcacaagccccaatcgaataatctagggtttcactgtttccagtaacacaccataatccattcaactgaatcaatccgattacgtcaatggcgactgaatcatcagaaggagaagaagaaacgaaactgacgggcggaaccccgcagctggtggtggaccgtgacctccgtgagatggccaagaacgccgcttggagtgtaagctcttgtaaacccggcaatggtgtgtcgtctcttcgagatgataattatgaaacctactggcaatcggatggtgcgcaaccacaccttgttaatattcagtttcagaagaaagttaagcttcaattagtggcgctttatgtcgattttaaccttgatgagagttatacgcctagtaaggtttcagttcgtgctggagatggttttcataacttgaaggagataaaaactgttgaacttgtcaagccaaatggttggatgaacatacctttatctggcaatgatcctcgggaaacttttgtaaacacgttcatgctgcagatcgctgtattgtcaaaccatctcaacgggcgggatacgcacgtccgccagataaaagttttcggaccacaaccgaaccctataccaaaccaaccatttcaatttacttcaacagaattcattacttactcaactatcagatgaggaacctaagtttgcctgcccaattaagtgcagtaccatcttaagtttaaagtcaactgtgtgtgaaatttctatctttttgttgttggaaaaaacgtgtactgtacaaacatcagcattttctttgtc

SEQ ID NO: 4587 - DNA, 1109 bp, Solanum lycopersicum
aaaattacttcttcaatgtttggttgtcgatttggatcttgattttttaaaattaacatttcttttttagataattaagatatgaatataattcaaaatatttgaattttagaagaagaaaaaaaaaaggtgtaacacatcctccatttccccaaatccacttttcaaaattgaaaaacagtaatgcgctcgaaaagctagggtttatgttgttgcagacaatttggggattttatctagttgaaattaagagcttaatcaatggcggattcatcagagggtgaggaagaagggaaactaacaggaggaagccagcagttagttgtggatgatgatctccgggagatgggtaaaaaagcagcttggagtgtcagctcttataaacctggcaatggagttctttcacttcgcgatgataaccttgaaacctattggcaatcagatggtgcacagcctcatcttgttaatgttcaatttcagaaaaaagttaagcttcaattagtcgtcctgtatgttgatttcaagcttgacgaaagctatacacctggtaagatctctatccgagcaggcgatggctttcacaacttgaaggagataaaagcagtggaacttgtgaagccaactggatggatgcatatatctttatctggtaatgatccgcgtgaaacttttgtcaacactttcatgctgcaaataggtgtgctctcgaatcatcttaatggaagggacactcatatccgccagataaaagtctatgggccaagaccgaaccctatccctcttcagccatttcagttcacttctacagagtttattacttattctgctgtgagatgaagctcaagggactatcccaagaggaaagatgccaaccatatttatcgatatcaaaatgccacaattttgccatgaaagttaaagaatgatcttgctacgtagctttagaactacgaatcccttttgaagtgttatcaagtactagcattttgagaaattgtatgatgatcttatgttgtgtagcaatgttgccaaactgactttggcaaccatacagattatacccccaagaagtaactttatacaagtcaaggtctgaaatctgtcattta

SEQ ID NO: 4588 - DNA, 1297 bp, Solanum lycopersicum
ctttaatttctcaacttataatatagttactctaagtgacaaacgttatattatcaaaaatagaaaagttagatttaagatacattctaatttctatgtcccattttaattatgcttttaactttttttcccatccattaaaaatattaataaatgtaaaatataatttatttttcaaaaaattacttcttcaatgtttggttgtcgatttggatcttgattttttaaaattaacatttcttttttagataattaagatatgaatataattcaaaatatttgaattttagaagaagaaaaaaaaaaggtgtaacacatcctccatttccccaaatccacttttcaaaattgaaaaacagtaatgcgctcgaaaagctagggtttatgttgttgcagacaatttggggattttatctagttgaaattaagagcttaatcaatggcggattcatcagagggtgaggaagaagggaaactaacaggaggaagccagcagttagttgtggatgatgatctccgggagatgggtaaaaaagcagcttggagtgtcagctcttataaacctggcaatggagttctttcacttcgcgatgataaccttgaaacctattggcaatcagatggtgcacagcctcatcttgttaatgttcaatttcagaaaaaagttaagcttcaattagtcgtcctgtatgttgatttcaagcttgacgaaagctatacacctggtaagatctctatccgagcaggcgatggctttcacaacttgaaggagataaaagcagtggaacttgtgaagccaactggatggatgcatatatctttatctggtaatgatccgcgtgaaacttttgtcaacactttcatgctgcaaataggtgtgctctcgaatcatcttaatggaagggacactcatatccgccagataaaagtctatgggccaagaccgaaccctatccctcttcagccatttcagttcacttctacagagtttattacttattctgctgtgagatgaagctcaagggactatcccaagaggaaagatgccaaccatatttatcgatatcaaaatgccacaattttgccatgaaagttaaagaatgatcttgctacgtagctttagaactacgaatcccttttgaagtgttatcaagtactagcattttgagaaattgtatgatgatcttatgttgtgtagcaatgttgccaaactgactttggcaaccatacagattatacccccaagaagtaactttatacaagtcaaggtctgaaatctgtcatttacatatagcca

SEQ ID NO: 4589 - DNA, 1039 bp, Arabidopsis lyrata
tgaatcgcttataactttgtaagtgtttgatcacttttattcagaaagtaaagtataatgccgtttctgcttaacaaaactaaacatcatgccgtttcaatcattcattaacgacacgacatttgtctataagccaaaagacgaattctcaaaacctcgtcggagggttttagaagaggaatctcaaatctcaaatctcaaatctgggatctcggagaggagatatggcgacggagtcatcggaatcggaagaagaaggaaagattagaggaggaaacgataagctaatcatagacgacgatctaagagagatgggtaaaaacgctgcttggagtgtcagctcttgtaagcccggcaatggcgtcaccactctccgcgacgacaatctcgaaacctattggcaatcagatgggttacaaccacatttgattaatattcaattccagaagaaagtgaaattgcagttagtggttctctacgttgactttaagcttgatgagagctatacaccaagtaaaatctctattcgagctggtgatggttttcataacttaaaggagattaaaagtgtggagcttgttaaaccaactggttgggtttgcttatctttgtctggaactgatccacgggaaacttttgtcaacacatttatgttacaaatagccattttgtcgaatcacctcaacgggagagatactcatatccgccagatcaaagtttacggccctagaccaaatcctattccgcaccaaccgtttcagtttacatctatggagtttctcacttattcgacactgagatgaaagatttgagcaggagaagtttgaacaacatgggactgtgaaagatactgctattgataccacaggaagagtctataatcagattaggttttgaagcttatagtttcacatattgttgtgtaatggcttttgtttatatattacattggatataacaatcataacttcattaagcttatccaccaaaagccccatcaaacttttgacacggtgaatttggagagatgggtttaaag

SEQ ID NO: 4590 - DNA, 997 bp, Arabidopsis lyrata
aagtgtttgatcacttttattcagaaagtaaagtataatgccgtttctgcttaacaaaactaaacatcatgccgtttcaatcattcattaacgacacgacatttgtctataagccaaaagacgaattctcaaaacctcgtcggagggttttagaagaggaatctcaaatctcaaatctcaaatctgggatctcggagaggagatatggcgacggagtcatcggaatcggaagaagaaggaaagattagaggaggaaacgataagctaatcatagacgacgatctaagagagatgggtaaaaacgctgcttggagtgtcagctcttgtaagcccggcaatggcgtcaccactctccgcgacgacaatctcgaaacctattggcaatcagatgggttacaaccacatttgattaatattcaattccagaagaaagtgaaattgcagttagtggttctctacgttgactttaagcttgatgagagctatacaccaagtaaaatctctattcgagctggtgatggttttcataacttaaaggagattaaaagtgtggagcttgttaaaccaactggttgggtttgcttatctttgtctggaactgatccacgggaaacttttgtcaacacatttatgttacaaatagccattttgtcgaatcacctcaacgggagagatactcatatccgccagatcaaagtttacggccctagaccaaatcctattccgcaccaaccgtttcagtttacatctatggagtttctcacttattcgacactgagatgaaagatttgagcaggagaagtttgaacaacatgggactgtgaaagatactgctattgataccacaggaagagtctataatcagattagatattgttgtgtaatggcttttgtttatatattacattggatataacaatcataacttcattaagcttatccaccaaaagccccatcaaacttttgacacggtgaatttggagagatgggtttaaag

SEQ ID NO: 4591 - DNA, 796 bp, Lippia dulcis
cgtcggagggggaggaggaagggaagctgaccggcggaaacccgcagctggtggtggacgacgaccttcgtgagatggccaagaaggccgcttggagcgtcagctcctgcaagcccggaaacggcgttacttccctccgcgacgacaatcttgatacctactggcagtcggatggtgcgcagcctcatcttgttaatatccagttccaaaagaaagttaagcttcaattagttgttctgtatgtcgatttcaagcttgatgagagctacactcctagcaagatctcgattcgagccggtgatggtttccacaacttgaaggagataaaaacagtggagcttgttaaaccaactggttgggtgtatatatcattgtctggaactgatccgagggaaacttttgtgaataccttcatgttgcaaattgctgttttgtcaaatcatttgaacggaagggactacccacctgcgccaaatcaaagtttatggacctcgaccgaatcccactcccccacctaacctttcacttcacttcgacagagttcattacttactcaattctgcgatgaagtggatttgcattggctcagattagagaattacaaaaggctccaatggtttttgtagtaacccggcattactaaccatataatttttggtggtctttgctttcagaaatccttaccatcttgtggttgtgatatggtgtaatatctttgtaactactattgtttagccaaacgactgctattgtttagccaaatgtacggacatgttgacaattaaaaaagaaaaaa

SEQ ID NO: 4592 - DNA, 1190 bp, Nicotiana tabacum
  misc_feature (31)..(31): n is a, c, g, or t
  misc_feature (35)..(35): n is a, c, g, or t
  misc_feature (46)..(46): n is a, c, g, or t
  misc_feature (51)..(51): n is a, c, g, or t
  misc_feature (54)..(54): n is a, c, g, or t
  misc_feature (60)..(60): n is a, c, g, or t
  misc_feature (70)..(70): n is a, c, g, or t
  misc_feature (79)..(79): n is a, c, g, or t
  misc_feature (82)..(82): n is a, c, g, or t
  misc_feature (103)..(104): n is a, c, g, or t
  misc_feature (113)..(114): n is a, c, g, or t
  misc_feature (135)..(135): n is a, c, g, or t
  misc_feature (150)..(150): n is a, c, g, or t
  misc_feature (156)..(156): n is a, c, g, or t
  misc_feature (249)..(249): n is a, c, g, or t
  misc_feature (404)..(404): n is a, c, g, or t
  misc_feature (1079)..(1079): n is a, c, g, or t
cttttcaaaattgaaaacactatgcgctcgnaaanctagggtttcngaatnggnattacntcaaaattgnggatttcanttnttgcattaagaacagccaagnnaagttatannaatcaaagaaaaagttaaggngagtgaaattcagcnatggcngattcatcagagggagaggaagaagggaaactgacaggaggaagccagcagctagttgtagatgatgacctccgcgaaatgggtaaaaaggcngcttggagtgtcagctcctataaacccggcaatggtgtcctttcccttcgcgatgacaacctcgatacctattggcaatcagatggcgcacagcctcatcttgttaatgttcagtttcagaagaaagttaagcttcaattggtcgtcctgtatgntgatttcaagcttgacgaaagctatacacctggtaagatctctatccgagcaggcgatggatttcacaacttgaaggagataaaagcagtggagcttgtcaagccaactggatgggtctatatatctttatctgggaatgatccgcgtgaaacctttgtcaacactttcatgctgcaaattggtgtgctctcaaatcatcttaatggaagggacactcatatccgccagattaaagtctacgggccaagaccgaaccctatccctcttcagccatttcagtttacttctacagagtttattacttattctactgtgagatgaagctcaagggactatgtcaagaggcaagatcccgaccatatatattgatatcaagtagcaaactggaggtacaaaagaatcctttttcttttgaaacagaccaaatcccacactaccaaacctgggatcccgtcccttggacgactttgagtaatgggagaatgacaactggaccctgcagtggtagaacctcataaaccagggtatgatattgataagttgtaggtccataggatgtctatacttggtttgtagttttctagaaaattccatttacaaaattacaagaatatatcacttcattatagaccctgtgacgaatgactatcagtacgtagtgtcttgtagttacnttgtatttctcccaattcttaatctgtctgctatacctggaagaggatgatcatggattcgcttgccctcttccgtacatttttgttccaaagcatattggctaacttttc

SEQ ID NO: 4593 - DNA, 865 bp, Ipomoea nil
gaatttgaaaaactaaaatcagaaatcctaactcgttgcgagtcgcgacgtagccgcaaagctccaagctaaagtcgctgcctcgccggaccacggaccagactccattactccaagctcgttgtcaacttcgcctactgcaggaccagttacccgctcacggctagaccattcactcgctcaccgccggatttctctgacaaaagcagcaaagtccaccgaagtaaggtaaactcaatggcagattcatcagaaggagaggaagaagggaagctgacaggaggtagccaacagcttttggttgatgatgacctctgtgagatggctaagaaggctgcttggagtgtcagctcttgcaaagctggaaatggcattacttcccttcgagatgataaccttgatacatactggcaatctgatggtgcacaacctcatctggtaaatatacagttccagaagaaagtaaagctccaattagtagttttatatgttgatttcaagcttgatgagagctacacccctagtaagatttcaattcgtgccggtgatggtttccacaacttgaaggagataaaatcagtggaacttgtcaagccaaccggatgggtgtatatatcattgtctgggaatgatcctcgtgaaacctttgtcaacactttcatgttgcaagtgacaattttgtcaaatcatctgaatgggagggacactcatatccgccagattaaagtctatggacctaggccgaatcccattccacttcaaccattccagttcacctcaacagagttcattacctactctattgtgaggtaaaactcagaagaacatcaacatgtttcaatgtaacaaaaccaactgcaagcat

SEQ ID NO: 4594 - DNA, 1264 bp, Aristolochia fimbriata
gaaaactaaaattctaattttacaagtttataacacttacttttcatatccacaagcattttatattattttaattttattttatttttgatccgacatgcattttacttcacacactcgaacgaatttgcattcttgggggaaatgaaaagagggactttcatttccgacaagggatgaaaaatttaaaacactggtcgagggctcgctcttgcttttccaccttcgaaattcaaaagctcgaatccacgttccagaattcagtcgtagcttgcattttcagaagcgatcggtctagcttccatcgattttggtaattttaatctgatatgctgttgtgttgaatggctacaatagagtccgaaggtgaggaagaaggtaagctggtagggaatcagcatctggtggtcgacaatgaccttcaggagatggctaaaaaggctgcttggagtgtcagctcttgcaaacagggcaatggtgttcttgctctgcgtgatgacaatctagatacttactggcaatccgacggtgctcagccacatctggtaaatatacagttccagaagaaagttaggttgcatctagttgtactatatgtggactataagctagatgagagctacacaccaagcaagatatctatccgtgctggtgatggcttccacaacttgaaggagataaaatcagtggaacttgtgaagcctgttggctgggtttatatatctttgtctggaactgatccaagagagactttcatcaacacattcatgctgcaacttgctgtgctgtccaatcacctgaatggaagagatacacacgtgcgtcagatcaaagtttacgggcctcggccgaacccgattcctcatcagccatttcaattcacttctaaagaattcattgcttattcttgtgtgagatgatgatttattgggtatccaaatttgggcagaagctagaattggggaaaatcagagagttgcttatttcttagctgtgggattagacaactacatcgcgctcatttgtgggaagggtgattgatggagtagaaattagtatcaaattcaactatttcatgctaattgttttgaattctcgaaacccagaaagcaactagttgaaagcaccgtcagccaccaatttccctaattaagagttgtaactttagtgtcatttttgagcctgtctgagttggtgcctgttcttcctaatttatttggatcttaacgaatttatttaggcggtaaaggttggttattatgaa

SEQ ID NO: 4595 - DNA, 780 bp, Beta vulgaris
ctcctcgactccgcgttctccctcctcgactctcttctacctcatcgtctggcttgtgccattgtgccttcatctcgccggggtcagagttctgccttcagggtctgccgtctgtgggactggatccaaggtgaattctaacagctgcgaagatggcaacagagtcatctgagggagaggatgaaggaaagctagttggaggcagcaaaaatttggatgtggatggtgacttgagagagatgacgaaaaatgcagcttggagtgttagctcatgcaagcctggcaatggtgttcaatgtctccgagatgacaattccgaaacctattggcaatctgatggagcacagcctcatctcataaacattcagtttcagaagaaagtgaaattgcaactaattgttctctatgtcgatttcaagcttgacgagagctacacacctagcaagatctctattcgagctggtgatggcttccataacttgaaggaaataaaaacaatagagctagtcaagccaactggatgggtgtgtatctcattatccggaaatgatccacgggaaacttttgttaatacgttcatgctccaactagcggttttgtcaaatcatcttaatgggagggatacccatgtacgccagatcaaagtttatggacctcgaccgaatccttttccgcgtcagccatttcagttcacgtctgccgagtttttgacatactccactgttagataaggataacgagatgctaatgtgcctacatggctacatatatcctgcactg

SEQ ID NO: 4596 - DNA, 1348 bp, Solanum melongena
agaatatttgaatttatgaaagaaactcgattctttcaaaattgaaatctgaaggcgctcgaaaacctagggtttatgttcttgcatccaattggggattggacgtaagagctaaatcaaaggcaaaaagcagtaaaaagtgaatgaatggcggattcatcagagggtgcggaagaagggaaaataacaggaggaagccaacagctagttgtagatgatgacctccgggaaatgggtaagaaagcagcttggagtgtcagctcttataaacccggcaatggggttctttcacttcgcgatgacaaccttgatacttattggcaatcagatggtgcacagcctcatcttgttaatgttcaattccagaaaaaagtgaagcttcaattagtcgtcctgtatgctgatttcaagcttgacgaaagctatacacctggtaagatctctattcgagcaggcgatggctttcacaacttgaaggagataaaagcagtggaacttgtgaagccaactggatggatgcatatatctttatctggtaatgatccgcgtgaaacttttgtcaacactttcatgctgcaaatagctgtgctctcaaatcatcttaatggaagggacactcatatccgccagattaaagtctatgggccaagaccgaaccctattcctcttcagccatttcagttcacttcttcagagtttattacttattctactgtgagatgaagctcatgggactatctcaagaggaaagatgccaacaatatctattgatctcaaaatgctaactggggatacaaaaagaatccctttttctcttgaaacagaccaatccccctattaacaaacctgagatcctgtctcttagatgacttgagcaataggacaatgaaaatttggtcctgcaatggtagaaccccgtgaaccaggcttactgcttgactacttgcttttcttctctatgatattgataagtcgtaggccaattggatgtctatggtttgtggtactcaagaaaattcctggttacaatcctagttggcttcatataaaccccgtcactgacacccatattttctcccaattttatgtaatctttctgtgatacctggaattgtggatttgcttgctctctcaggtgtatctgtttccaagcatattggctaagtacttgtaaatcttggtttgatctactttcaacttgtttcattcttgcttgtacccttcctggctccctgttttggctgccaattttttaaaaaactatgtagatatgtatagatggtgcacatctagtaccgtgatttcatcatgaaacatgaagaatgatcttgcttgcatagctttgggc

SEQ ID NO: 4597 - DNA, 1262 bp, Euphorbia peplus
ttctctgccgttccaattcattctcattccgtcgccgctcaccgttttcctcgactttgaatttcacggtggagaatttgcacagtttcgtactcgtttcgtcgttcttcaacgagatccatcaatttgctcaattttctcaccggcggcggtttatcggtcatattgagtctcgatttcctcaatttcaaaatcaacaccctcaatttcgccggcaaatttatgaacgaaacaacgaactacggcctctaattagactcagagtctttgataacgagagaagaaggctcagtcgtggctcaattataagtatacgcacacgctgcccatcgcctccgccacctcctgccaccgccgaccttccgccaccgaccgtccgacactcgagcaggaagatttagatggcatcagagggagaagaagaaggaaagatcgtaggcggtaatcaacatctgattgttgattcttttctcagagaaatgggcaagaaagctgtttggagtgttagttcttgcaaacctggcaatgctgtctcttctctccgcgacgataatcttgataccttctggcaatcggatggtgctcagcctcatctcgtgaacattcaattccagaagaaagaaaaactccacttggttgtagtctatgtggattttaagcttgatgagagttatacccccagtaagatatccattcgtgccggtgatggatttcacaacttgaaggagatcaaaactatggagcttgtcaagccaactggctgggtttatctatccttatctggaaatgatcccagggaaacttttgtgaatacttttatgctacaaatagctgtgttatcaaatcatcttaatggaagggatactcatgtgcggcagattaaagtttatgggcctcgaccgaacccatttcctcatcagccttttcaatttacttcacgagagtttattacatatgcgaatgtgagatgagaaatgtgagtttaacaggaaacagagaaagctgagactggggagatcatccaacaagcataatcagcgtctctccagacatatcttttgcaatttccacagaaacatgtcctggacagtaatacaaaaaatgaaagggcacaactttatggaaataaagtgatagatttgtattttacaattgtagtggcttgaactagtgtgtgttttttggtaatttataagctctactaagaatatgtctatgtctgatctagtgcccttgctgcacagtaatacaaaaaatgaaag

SEQ ID NO: 4598 - DNA, 1035 bp, Silene vulgaris
caaaacctctaaattgcccgccaatctttgataggagactggtgagagccactaagatggcaacggaatcgtctgatggggaggagggaaagctaattggaggtagtaagcatttgagtgtggatagtgatctaagagagatgacaaagaatgctgcttggagtgttagttcttgcaagcctggtaatggcgttcaatgcctccgagatgacaattttgaaacctattggcaatctgatggagcacaacctcatgtgattaacattcagttccagaagaaagtgaaactgcaactgattgttctctatgtcgattacaagcttgatgagagctacactccgagtaaaatttcgataagagctggtgatggattccataacctgaaggaaataaagacagtggaactggtcaagccgactggctggatacatgtatcattgtctggaaatgatccaagggaggtttttgtcaatacatttatgctgcagattgctgttttgtctaatcaccttaacggtagggatactcatgtgcgccagatcaaagtctatggacctcgaccgaacccaattccgtgtcaacctttccagttcacctcctctgagttcgtgacatattcaactgtaagataaagatgccggacattgctggctgctgtatcatgttttattacttgcatttttccggaaggattgtatcatgttcatgatcctatatccaccatcaaggggagttcagggaccttaatgtagaagaagtaacaccaatttactatctagtgtgcagatgtaagctagctttgttacgagttattgatggggtactcataagtcataacctaggttcgtaaccttttagaatcaaaattggcgttgtagctccctgtaattcatgatccgaaacttatgggaagaagaggatttggcatgagttgtcctcgatgctaacgtttttcatacaacaaaccgtaatggtgttttgtaatttaattccatgaggaaattgagctgtttaatctaatatattctgcatact

SEQ ID NO: 4599 - DNA, 1012 bp, Eutrema parvulum
ttatgtgaattgtttactcagaaaataaagcaatcatgtcgtttccggttaacagaaacaaacctcatgtcgttttaagttttcactaacgacacgccgttttcctatgaggcaagccacagagccataagacgaattcaaaacctcgttggaagggttttagcagaaagtgttgaaatctcaaatctgaaatctcgaatctcagatctggacatcggagatagatatggcgacagaatcatcggaatcggaggaagaaggaaagattagaggaggaaacgataagctaattgtagacgacgatctgagagagatggggaaaaacgcagcttggagcgttagctcttgcaagcccggcaatggcgttaacactctccgtgacgacaatctcgagacctattggcaatcagatggtttacaaccacatctgattaacattcagtttcagaagaaagtgaaattacagttagtggttctgtacgttgactttaagcttgacgagagctatacacccagtaaaatctctgttcgtgctggtgatggctttcataacttaaaggagataaaaagtgtggagcttgttaagccatctggttgggtttgcctatcactgtccggaaccgatccacgggaaacttttgtcaatacattcatgttgcaaatagccattttgtcgaatcacctcaacgggagagatactcatatccgccagatcaaagtttatggccctagaccgaatcctattccgcgccaaccatttcagtttacttcaatggagtttctcacttattccacgctgagatgagagcttcgggcaggagaagtttgaagaacatggactgttgaagtgtgtctacattaggttttaaagctcaagtttcatatgttgttgtgtaatggcttctgtttatatattacattggatataactatcataacttcattaaccttatccaccaagagccccatcaaatttttgtcacagtgaattaggagaggcaggtttaaagca

SEQ ID NO: 4600 - DNA, 1000 bp, Eutrema parvulum
tttactcagaaaataaagcaatcatgtcgtttccggttaacagaaacaaacctcatgtcgttttaagttttcactaacgacacgccgttttcctatgaggcaagccacagagccataagacgaattcaaaacctcgttggaagggttttagcagaaagtgttgaaatctcaaatctgaaatctcgaatctcagatctggacatcggagatagatatggcgacagaatcatcggaatcggaggaagaaggaaagattagaggaggaaacgataagctaattgtagacgacgatctgagagagatggggaaaaacgcagcttggagcgttagctcttgcaagcccggcaatggcgttaacactctccgtgacgacaatctcgagacctattggcaatcagatggtttacaaccacatctgattaacattcagtttcagaagaaagtgaaattacagttagtggttctgtacgttgactttaagcttgacgagagctatacacccagtaaaatctctgttcgtgctggtgatggctttcataacttaaaggagataaaaagtgtggagcttgttaagccatctggttgggtttgcctatcactgtccggaaccgatccacgggaaacttttgtcaatacattcatgttgcaaatagccattttgtcgaatcacctcaacgggagagatactcatatccgccagatcaaagtttatggccctagaccgaatcctattccgcgccaaccatttcagtttacttcaatggagtttctcacttattccacgctgagatgagagcttcgggcaggagaagtttgaagaacatggactgttgaagtgtgtctacattaggttttaaagctcaagtttcatatgttgttgtgtaatggcttctgtttatatattacattggatataactatcataacttcattaaccttatccaccaagagccccatcaaatttttgtcacagtgaattaggagaggcaggtttaaagca

SEQ ID NO: 4601 - DNA, 597 bp, Aquilegia formosa
gaaaatggcgacagaatcagatggagaagaagaagggaagttaataggaggaaatcagaatctagttgttgatgaagatttaagagaaatggcgaagaaagcttcttggagtgtcagttcttgtaagtctggtaatggtgttcaatttcttcgtgatgacaacctcgaaacctactggcaatcagatggtgctcaacctcacttggtcaacattcaatttcagaaaaaagtcaaattgcagctagttgtgctttatgtggattttaagctagatgagagttacacgccgagcaagatatctgttcgggctgggaatggatttcataatctgaaggagataaaaactgtggagcttgtgaaaccaataggttggatttatatatcgctatctggaactgatccacgagatacatttattaacacctttatgctgcaaattgcgattctgtccaatcatctgaacggaagggatacccatgtacgccagatcaaaatatatgggcctcgactgaaccctgttccttgccaaccatttcagtttacgtctcaggagttcatcaagtattctattctgagatagaaagcattgaagcctgc

SEQ ID NO: 4602 - DNA, 929 bp, Brassica rapa
atgttgtttcctgttaacaaacaagaactttatgtcgttttagtgattattaacgacacgacgtttttcgtttttcctatgagcgaggccacttgagccataaagacgaattcaaaccctcggtgggagggttttagcaaaaaagtgttgaaatcggagattagacatggcgacggaatcatcggaatcggaggaagaagggaaaatcagaggcggaaacgataagctaatcgtggacgacgatctgagagagatgggcaaaaacgcagcttggagcgtcagctcttgcaagcccggcaatggcgtcaacactctccgcgacgacaatctcgagacctattggcaatcagatggtttgcaaccacatttgatcaacattcagttccagaagaaagtgagattacagttagtggctttgtacgttgactttaagcttgacgagagctatacgcctagtaagatctctgttcgtgctggtgatggctttcataacttaaaggaggtaaaaagtgttgagcttgtaaagccatctggttgggttagcatatctctctctgggaccgatccacgggaaacatttgtgaatacattcatgttgcaaatagccatgttgtcaaatcacctcaacgggagagatactcatatccgtcagatcaaagtttatggccctagaccgaatcctattccgcgccaaccatttcagtttacttcaacggagtttatcacttattccacactgagatgagagagctttgggcaggacaagtttgagactgttgaaggtcactgccattggatccccgggaagacactctactgtcacattaggttttaaaaactattatatgttgttgtgttatggcctctgttgatatattacgttggatataacttcattaagcttttccaccaagagccccatcaagttt

SEQ ID NO: 4603 - DNA, 712 bp, Brassica napus
gacatcggagattagatatggcgacggaatcatcggaatcggaggaagaagggaaaatcagaggcggaaacgataagctaatcgtggacgacgatctgagagagatgggcaaaaacgcagcttggagcgtcagctcctgcaagcccggcaatggcgtcaacactctccgcgacgacaatctcgagacctattggcaatcagatggtttgcaaccacatttgatcaacattcagttccagaagaaagtgagattacagttagtggctttgtacgttgactttaagcttgacgagagctatacgcctagtaagatctctgttcgtgctggtgatggctttcataacttaaaggaggtaaaaagtgttgagcttgtaaagccatctggttgggttagcatatctctctctgggaccgatccacgggaaacatttgtgaatacattcatgttgcaaatagccatgttgtcaaatcacctcaacgggagagatactcatatccgccagatcaaagtttatggccctagaccgaatcctattccgcgccaaccatttcagtttacttcaacggagtttatcacttattccacactgagatgagagagctttgggcaggacaagtttgagactgttgttacattaggttttaaaactattatatgttgttgcgtaatggcctctgtttatatattacgttggatataatttcattaagc

SEQ ID NO: 4604 - DNA, 2365 bp, Fragaria vesca
gatcaaacgtcagccgtcgactacgcctggcgctactgtcaccttcacggccgctgctatatcctctccatcttcaccacgttccatccccaaacgacggcgtcgggtccaatccccaacggcttgaccatagatcgtcggagggctcgaggatactgatcggcttcgagtttgttttggaacaggtgattcaaaagaggttgtgtgcaaaatagtggacacatactgttttgctgctgtttctgtgtctgttaccctggatcccttctatttcttattgcggttaagattctgcttgaaaacaaagaatttgattcagcttctgtagtcttcttgaagttttgacaatctgaggttcacaggaatccaagaatggcggaatcatcggagggagaagaggaagggaagctgacagtagggaaccaagtgctgatggtggaagacaacctccgagaaacgggcaagaacgccacctggagcgtcagctcctggaagtccggcaacggtgtgtcgtatctccgcgatgacaatctcgatacttattggcaatcagacggtgctcagcctcatttggtcaacattcagttccagaagaaagtgaagcttcaacttgttgttctctacgtggatttcaaacttgatgagagctatacgccatctaagatattgattcgtgctggggatggcttccacaacttgaaggatataaaaactgttgagctctataagccgaggggttggatttatatatcattgtctggaaatgatgcaagggaaactttcgtcaacacatttatgctgcaaatctctgtgttatcaaatcaccttaacgggagggacacgcatgtgcgccagatcaaactatatggccctagactgaaccctattccacatcagccatttcagtttacttcaagggagttcagtacctatgcttctatcagatgagaaacgtggcacggcatggacacatggaaagattggacatcgagtttcaatcctattccaatctaaacaccgcatgttttacatagaacttctttatgctttgatcatgctgctgcaaatagtagatatgggtccggtgactgttccattaactttttatctcattggtacaattgaaattgaatcaagaagatgaatacttaatctttgaatgactgttatgttgattttgtattgaacacaacttacagttacccaaattatactactattgtctctaatccatttactcaattccaagacatggatttcgtctactgcaattccatgaattaacagcagaacttgatggacaatcagtccttgcagatatttttggctgcatcaaagaagtcaatacagatcttcaaaggaaaaaaatcattcggaattgatatgtgaatttacacttgaaaattggaggagggaacagctaaaaattagcttttggggtgctctttgaagaagcttcgatgtccaagctcttcggaaattaccagcaccagtctttgctctgttcacagcttgagagcaacccaactgaaaggggaaaccactgcaacaggaacagcacatacatgtgtcatctacaatccacctgttgaagaggaggagaaatacaaagcagaaaggaatcattcttttgtaaagcttcaattcagagaatctcaacctttgatggatggtgttataggtgttgtccaaacacaggatgctacagggagctaaaacaacaagaagacactgatgcgtttacttgcaatgtggatggtacacaaacacctattccaaatttcaaggtacatatgacaatccatgacaacgatgatcaaaaatgtgattcttaagggaaaatcagcagagcaattctttggctgcagctgcgaagaattagtgaatgcaaagtcaataactatgatgaattattggtgaaactcgaccagaagtaattgagaaaaagagggagagactcgtatctttgaaccaaagtcaataactatgatgaattattggtgacaagcattcaagccaactcaggaagttcactgccagcagcacacaaagaatcggttattgctacaccagaaaaagtatcggacagaaaaagaggagcagatgcaactacaaatgtaatgtctcaatcagatgcagagaagaaatgcaaaaggtaacacaattgaaaattcattgttttttagtcttttgttacaagtttataacctgaattgaggaagtctttcatctaaattgaacttatatagaactccagaccgatactcatttaaaaatatagttttcattagttgctaataatttcctatatgatatcaaaacaactaaataatttcgttttctatatatgctactgcatttcatc

SEQ ID NO: 4605 - DNA, 1209 bp, Eutrema halophilum
attccaatttccaaatgtttgctgttctcttaacacagaaagtaaagcatcatgtcgtttccgttcaactgaaaaaaaactcatgtcgttttaagcgttccttaacgacacggcgtttatttatgagccacgccccaaggcgaattcaaaacctcgttggaagggttttagcggaaagtactgttagaaatctctgatatcgaatctcggatctcgtttcactgacatcggagatagatatggcgacggaatcatcggaatcggaggaagaagggaagattagaggaggaaacgagaagctaatcgtagaagacgatctaagagagatggggaagaacgccgcttggagcgttagctcttgcaagcccggcaatggcgtcaacactctccgcgacgacaatctcgagacctattggcaatcagatggtttacaaccacatctgattaacattcagttccagaagaaagtgaaattgcagctagtgtttctgtacgttgactttaagctcgacgagagctatacaccaagtaaaatctcaattcgagctggtgatggttttcataatttaaaggagattaaaagtgtggagcttgtaaagccaactggttgggtttgcctatctctgtctggaaccgatccacgggaaacttttgtcaatacattcatgttgcaaatagccattttgtcgaatcacctcaatgggagagatactcatatccgccagatcaaagtttacggccctagaccgaatcctattccgcgccaaacatttcagtttacttcaatggagtttctcacttattccacactgagatgagaactttgtgcaaggagaagtttgaagaccatggattgtgaaagatcaatgctaactttgggcaggagaagtttgacaacacggactgtgaaagatcgctgctattggatcccctggaagagtctattctcacattaggttttaaagctcagagtatcatatgttgtgtaatggctgctgtttaaatattacactggatgtaaccatcataacttcattaagcttatattagataagcttatgttttaaagctcagagtttcatatgttgtgtaatggcttctgtttatatattacattggatataacaatcataacttcattaaacttatccaccaagagcccaatcaaatttttttggtcacagtgaattaggagaggcggttttaaag

SEQ ID NO: 4606 - DNA, 1116 bp, Eutrema halophilum
ttaacacagaaagtaaagcatcatgtcgtttccgttcaactgaaaaaaaactcatgtcgttttaagcgttccttaacgacacggcgtttatttatgagccacgccccaaggcgaattcaaaacctcgttggaagggttttagcggaaagtactgttagaaatctctgatatcgaatctcggatctcgtttcactgacatcggagatagatatggcgacggaatcatcggaatcggaggaagaagggaagattagaggaggaaacgagaagctaatcgtagaagacgatctaagagagatggggaagaacgccgcttggagcgttagctcttgcaagcccggcaatggcgtcaacactctccgcgacgacaatctcgagacctattggcaatcagatggtttacaaccacatctgattaacattcagttccagaagaaagtgaaattgcagctagtgtttctgtacgttgactttaagctcgacgagagctatacaccaagtaaaatctcaattcgagctggtgatggttttcataatttaaaggagattaaaagtgtggagcttgtaaagccaactggttgggtttgcctatctctgtctggaaccgatccacgggaaacttttgtcaatacattcatgttgcaaatagccattttgtcgaatcacctcaatgggagagatactcatatccgccagatcaaagtttacggccctagaccgaatcctattccgcgccaaacatttcagtttacttcaatggagtttctcacttattccacactgagatgagaactttgtgcaaggagaagtttgaagaccatggattgtgaaagatcaatgctaactttgggcaggagaagtttgacaacacggactgtgaaagatcgctgctattggatcccctggaagagtctattctcacattaggttttaaagctcagagtatcatatgttgtgtaatggctgctgtttaaatattacactggatgtaaccatcataacttcattaagcttatattagataagcttatgttttaaagctcagagtttcatatgttgtgtaatggcttctgtttatatattacattggatataacaatcataacttcattaaac

SEQ ID NO: 4607 - DNA, 884 bp, Antirrhinum majus
gagagagtgatttgcacatgatttgacaacttattgctatcattttcccactcttttttgctaaaaattatgaataaatactcaaataaatcttgcccaaagcatttaccggtttcatcagaaaagcacttccgcgattaatggcggaaactccgccgtcggatggggaggaggaagggaagttgacaggtggcagcctacaattggtcgtggagggcgatctccgcgagatggcgaacaaggccgcctggagcgttagctcgtgcaagccgggaaacggcgttgcttcactccgagacgacaatctcgatacttactggcaatcggatggtgctcagccgcatttagttaatattcagttccagaagaaagttaaacttcagttggttgttttctacgttgatttcaagctcgatgagagctacacgccgagtaagatttcgattcgagctggtgatggtttccacaacttgaaggagataaaaacagtggagcttgtaaaaccatctggctgggtgcatatatcattatctgggagtgatccaagggaaacttttgtgaacactttcatgttgcaaattgcggtgatagctaatcatctaaatgggagggacactcatgtgcgccaaatcaaagtttatgggcctcgaccgaaccccatcccacaccaaccatttcagtttacttcaacagagttcattacatattctattctaagatgaatatggtgccctttactggaacttaaagattctaatataccagcaatttgcaaatatcagtataagattgagtttataaaccatctaagttaatatagtcatgtttttatgaccagctatatactgttagattgtactatcctattttctatgcttttttta

SEQ ID NO: 4608 - DNA, 603 bp, Chenopodium quinoa
gaacttccaaaatggcaacagaatcatctgaaggagaagatgaaggaaagcttgtcggaggtagcaaggatttggttgtcgatggtgatctgcgcgagatgacgaagaatgcagcttggagtgtcagttcttgtaaacctggtaatggtgttcaatgtctccgagatgataatttcgaaacgtattggcagtctgatggagcacaaccgcatatgattaacattcaatttcagaagaaagtaaaattgcaacttattgtgctgtatgtcgattttaagctcgacgagagttacacacctagtaagatatcgattcgtgctggtgatgggtttcataacatgaaggaaataaaagctgtggagttagttaagccatctggttgggtgtacatctcattatctggaaatgatgcacgggaaacatttgttaatactttcatgctgcaaattgctgttttgtcaaatcaccttaatggaagggatacccatgtgcgccagatcaaagtttatggacctagaccgaatcctgttcctcgtcagccatttcagttcacctctgctgagtttttgacatactccactgtcagatgaggatagtgagatg

SEQ ID NO: 4609 - DNA, 892 bp, Raphanus sativus
  misc_feature (173)..(173): n is a, c, g, or t
  misc_feature (868)..(868): n is a, c, g, or t
gggatccataaagacgaattcaaaccctcgtctagagggttttagcaacaaaaaaaagtgtttgacatcggagattagatatggcgacggagtcatcggaatcggaggaagaagggaagatcagcggaggaaacgagaagctaatcgtggacgaggatctgagagagatgggnaaaaacgcagcttggagcgttagctcttgcaagcccggcaacggcgtcaacactctccgcgacgacaatctcgagacctattggcaatcggatggtttgcaaccacatttgatcaacattcagttccagaagaaagtgagattacagttagtggctttgtacgttgactttaagcttgatgagagctatacgcctagtaagatctctgttcgtgctggtgatggctttcataacttaaaggaggtaaaaagtgttgagcttgtaaagccatctggttgggtttccgtatctttgtctgggaccgatccgagggaaacatttgtgaatacattcatgttgcaaatagccatgttgtcaaatcacctcaacgggagagatactcatatccgtcagatcaaagtttatggccctagaccgaatcctattccgcgccaaccatttcagtttacttcaacggagtttctcacatactccacgttgagatgagagctttgtgcaggaggagtgtgaagaacatggactgttgaagataactgctgattgatctcgggaagactctactgtcgcgttaggtttaaaaactattatatgttgttgtgtaatggcctctgcttatatattacattggatcatataacaatcataacttcattaatcttaccaccaagagccccatcagtttttggtcccagtgngttaggagaggcaggtttaaagca

SEQ ID NO: 4610 - DNA, 623 bp, Triphysaria pusilla
aaaactttattccggtgtaaaaaaatggcggagtcgtccgagggggaggatgaagggaagctcaccgtcggacaccctcagcttgttgtagaagacgacctccgtgaaatggcgaaaaaggccgcctggagcgtcagttcctgcaagcctggaaatggcgtcgtctcactccgtgacgacaatctcgatacctactggcagtcagatggtgcacagcctcatctagtaaatatacagttccaaaagaaagtaaaactgaaattagttgttgtctatgttgatttcaagctcgatgagagctacacacctagtaaaatctcggttcgagctggtgatggtttccacaacttgaaggagataaaaacagtggagctttctaagccaagcggttgggtgcatatttcgttatctgggagtgacccaagggaaacctttgtgaatacattcatgttgcaaattatgattgtgtctaatcatctcaatggaagggacactcatgtgcgccaaatcaaagtttatggccctcgaccgaatccaattccatgccaaccctttcagttcacttcaaatgagttcattacttactctactctcagatgaagtggattataggctgacattga

SEQ ID NO: 4611 - DNA, 785 bp, Triphysaria pusilla
cagaaatagggttcatcctcaaatcccaaaccaaaacttcattccggtgtaaaaaaatggcggagtcgtccgagggggaggatgaagggaagctcaccgtcggacatccccagcttgttgtagaagacgacctccgtgaaatggcgaaaaaggccgcctggagcgtcagttcctgcaagcctggaaacggcgtcgtctcactccgtgatgacaatctcgatacctactggcagtcagatggtgcacagcctcatctagtaaatatacagttccaaaagaaagtaaaactgaaattagttgttgtctatgttgatttcaagctcgatgagagctacacacctagtaaaatatcggttcgagctggtgatggtttccacaacttgaaggagataaaaacagtggagctttctaagccaagcggttgggtgcatatttcgttatctgggagtgacccaagggaaacctttgtgaatacattcatgttgcaaattatgattgtgtctaatcatctcaatggaagggacactcatgtgcgccaaatcaaagtttatggccctcgtccgaatcccatcccttgccaaccctttcagttcacttcaaacgagttcattacttactctactctgagatgatgtggatagggtgaaaacgagaaattaaaaaataaataaacataatttacatttgtatcggagattgtgtagttgctatatatataaacaaattttcaccttgtttaaaaattggcatagatcttcctggagttgcagtttatgctggtcatt

SEQ ID NO: 4612 - DNA, 656 bp, Triphysaria pusilla
caaatcccaaatcaaaaactttattccggtgtaaaaaaataggcggagtcgtccgagggggagggatgaagggaagctcaccgtagggcaccctcagcttgtggtagaagacgatctccgtgagatggcgaaaaaggccgcctggagcgtcagttcctgcaagcctggtaacggcgtcgtctcactccgtgacgacaatctcgacacctactggcagtcagatggtgcacagcctcatctagtaaatatacagttccaaaagaaagtaaaactgaaattagttgtcgtgtatgttgatttcaagctcgatgagagctacacacctagtaaaatatcggttcgagctggtgatggtttccacaacttgaaggagataaaaacagtggagctttctaagccaagcggttgggtgcatatttcgttatctgggagtgacccaagggaaacctttgtgaatacattcatgttgcaaattatgattgtgtctaatcatctcaatggaagggacactcatgtgcgccaaatcaaagtttatggccctcgaccgaatccaattccatgccaaccctttcagttcacttcaaatgagttcattacttactctactctcagatgaagtggatagggtgaaaacgagaaattaaaaaataaataaa

SEQ ID NO: 4613 - DNA, 828 bp, Cleome spinosa
gggagatcgctcctcctcagcgaaaattccagagagagagagagagatggcgacggagtcatcagaatcggaggaagaagggaagatcagaggagggaatgataagctgatcgtggacgaagatctgagagagatggggaagaacgctgcttggagcgtcagctcttgcaagcccggcaatggcgtctccgctctccgcgacgacaatctcgagacctactggcaacggtctgcagccacatctggttaacatccagttccagaaaaaggtgaaattgcagttagtggttatgtacattgatttcaagctcgacgagagctacacaccgagtaagatttcgattcgagccggagatgggttccacaacttgaaggagattaagaatatagagcttgtgaagccaactggttgggttcacatatccttgtctggagccgatccacgggaaactttcgttaatacatttatgttgcaaatagctgtttcgtcgaatcacctcaacggaagggattctcacatccgccagatcaaagtttacggccctagaccgaatcctatcccgtgccagccctttcagttcacttcaatggagttcatcacttactcaactgtgagatgagcaatcaccgattggaccgagaagttccacttccttgcttgtgacacagttcccatattcaagcaatgaaacagcttgaaaaggacattctttcaatcttggtttcaaaagagagagacatttgagaacaaaccttgcttaggatttcggggatctttgtttaccagatcagttatacccatgaaactcccgagctatgagaactaga

SEQ ID NO: 4614 - DNA, 1040 bp, Phalaenopsis aphrodite
cttcactcccttctcccggcttccttgtttcgctcaaagctatctccttggtgaccaaatcctcacgatacacttgcgatcagagataactggtaaggcaacgacgggattgcgttgtacagagacccaaattcctatctactccactttcctctctgcttctaccaaaagaaatcctgctcgaaatccgttactagacaggccgttaacgaccagattacagtaacgatcttgaacaggaatagccagtcgtgagatctacttccttgcggctttcgttagttctttaaaagaaggtctgagaaggcgatggggtcgagaataatggctacagagtcagacggcgaagaagagacagccggaaagttgaccggaagcccgaacttggttgttgatgatgactcgagggagatggcaaagaaagcagcgtggtccgtcagttcctgcaagcccggtaacggtgtcctctccctccgcgatgacaatctcgagacttattggcaatcagatggagcacagccccatttggtgaatatccagtttcaaaagaaggtcaagctgcaattattggtgctctatgtcgactacaagcttgacgagagctataccccaagcaaaatctctatacgcgcgggggatggcttccacaatatgaaagagattaaaacagtggagctagtgaagccagttggttgggttcatatatccttatcaggaactgatcctcgtgatacatttatccacaccttcatgctccaactagccgttctatccaatcacttgaatgggagggacacacacatacgacagatcaaaatatacggtcctcggccgaatcccattcccacccttccatttcattttacttcgaaggagttcattagttattcaactattaggtgaggagcagacaaaatcatcagttactctcctgcaagccaaaagctaagtcttttgaaacttactttaagcagacctttgatggatgaatgggtagtaagcttatgtgtttatcctttctttatcattttatatttccg

SEQ ID NO: 4615 - DNA, 1214 bp, Amborella trichopoda
ttttcaatttctagggaaagtttacactgttatcaaatgggttaatgatagtttttccgagtttgaaaaataaaaagtaaaattgaaaacaagcccaaacccaacttttctcaaggcactgttggaccctgtgccggaactttggtgaaatttcacggggcgcaagcccttcaaattctacaacgcgcgcatccgagcctgccaaaactcatcgtccttccacggcatctgcaactctctctctggagaactctgtccgctcgttctccctcttatttttctcaatcactctttctcaagtcaaggttccaccctaaagccagagctcctttttttgccgtttcaagcccactgtgtcaactgcaaaccggagttaagcatggcgactgaatcagagggggaggatgagggaaagcttcccggaatccttaatttggtggtcgatgatgatctaagagaaatggcgaagaaggcggcctggagtgtgagctcttgtaagcctggcaacggcgtccacttccttagagatgataatttagagacttactggcagtctgatggtgctcagccacatttagtgaatattcaattccagagaaaagtgaagttgcagttactcgtactctatgtagatttcaagcttgatgaaagctacacaccaagcaagatttctgttcgcgctggtgatggtttccataacttaaaggagataaaaatggtggaacttaggaagccaattggatgggtctccatagcgttatctggcactgatcctcgggagacattcatcaacacattcatgctgcagcttgcagtgttgtcgaatcacttgaatggaagggacacacatatacgccagattagagtttatggacctcgaccgaacccagttcctcaccaaccatttcaatttacttccaaggaatttaccatgtactcctcaatacgatgaactccatttgtgtttctgtttcactccacacaatgttagctttcttttaatagtttagtcaccctaactgaggcattatcttcataatgttactagtcctttacaagtatcctttctttgcattttttaaaatcatgcttatcaatttctgtataataggtcttcctcaaaaaaacaaaatctgtataataggggtccgggttggttatgttgtttgctgaactgatttaatgaattaagcttgtgcttgtcaaacaaagaa

SEQ ID NO: 4616 - DNA, 1048 bp, Musa acuminata
aaagcgtttgcagaaagggtgggaataggcggccatggcgacggaatcggacggggaagaggagacagcgacggccgcggggaagctgacggggagtcctcagctgtcggttgacgacgatctccgtgagatggcgaagaaggccgcgtggagcgtcagctcttgcaagcccgggaacggcgtcctctccctccgcgacgagaacctcgatacctactggcaatcggatggagcccaaccccatctggtcaatatccagtttcagaagaaggttaagctgcagttggttgtcctctatgtggatttcaagttggatgagagttacacaccaagcaagatctcaatccgtgctggtgatggtttccacaacctaaaggagataaaaactgtggagcttgtgaagccagttggttgggtccatatctctttgtctggtaatgatccccgggaaacctttattcatacttttatgctccaaattgctgttttatccaatcatctgaatggaagggacacacacatacgtcaagtcaaaatatacgggcctcgaccgaaccctgttccccttcaaccatttcattttacttcgaaagaattcatcacttactcgatccttcggtaacaatcgtccttatagatatgcaggaagtgtggaagatcagcagtccttcctggtgtgagcacactgaaaaacaagaatttgttctaacattttatcttgaaatttccagacataattttgtgcaaatttccgagctttatcttggtgcaaaagctcaacaagattctgaaccaatttacagagacctgttgggtatttaactctttcattggattcaaccacacgatttttcagtacaagttcctgaaaacctgaattgtgtaattcaaattatacttatgtagacattgcttgtggttcctcctatcacttaaaaagtaattaatattcaagcaacatgatctgcaggcacaaaggattttgattcagtcaatgttcaagattctatgaccataatgttctaacagtgatctcctctggtttcag

SEQ ID NO: 4617 - DNA, 1135 bp, Elaeis guineensis
caaaaattattcgggctgctctgccgcttttcgcttcgtactttctcctttccctctattggcccgctctgttctcggcaaaatcgtgagggctcgtggtggtcgacaatggcgacggagtccgatggggaggaggatacggcggggaagctaacagggagccagcacctggaagtcgacgacgatctccgcgaaatggccaagaaggccgcctggagcgtcagctcctgcaagcccggcaatggcgtcctcgccctgcgcgacgacaacctcgacacctactggcaatcggatggagctcagccccatttggtgaatatccagttccagaagaaggttaagctgcaactactggttctctatgtggatttcaagcttgatgagagctacacgccgagcaagatctctattcgtgctggtgatggtttccacaatctgaaggagataaaaactgtggagttcaagaagccagttggttgggttcacatacccttatctggaactgatccccgggagacatttattcacactttcatgctccaacttgctgttttgtccaatcacttgaatgggagggacacacatgtgcggcagatcaaaatatatgggcctcgtccgaaccctgttcctcatcaaccatttcattttatttcgaaggaattcatcacctactcaactcttagataggatcaatagtgacaatatcttaaacaggatgaaaatggtggcaatagcaaacatgaagaactgcatgcatcttggaaagcattcagaaaccacaactttcaattgtataacccatcatattctccttagacttgtagtaagtttatatttgacatgcattggtgtagtgagttggatattaactggtttaccaatccattaaatttcctcatgcggtgccagttgttcatcatattatgggcggtaacatggcctctattgttgttatattatgaaacagccttaaaaactgtatgcttttatttttgtgctgtctgttagctttggcagaatgcaaaagccttgtatatatggctgctcaagatgttccatttttcacataccctatgagcctatgattgttacagataactcttaaacaataaaaaaaataaacagctagcacgac

SEQ ID NO: 4618 - DNA, 972 bp, Amorphophallus konjac
gtcccacggactcgggagtcggagggggaggaggaggtggggaggctgacggggaaccagcacctggtggtggacgacgacctgcgggagatggcgaagaaggccgcctggagcgtcagctcctgcaagcctggcaacggcgtcctctccctccgcgacgacaacctcgatacctattggcagtccgatggtgcccaacctcatttagtgaatatccagtttcagaaaaaggtcaagttgcaactattggtactttatgtggatttcaagcttgatgagagttatacaccaagcaaaatttctatccgtgctggtgatggtttccataacttgaaggaaataaagaccgtggaactagtgaagcctgttggttgggtctatatatccttatctgggacagatcccccgtgaagcatttatccacactttcatgttacagcttgctgttctttcgaatcacctaaatggaggacactcatgtgcgccaagtcaaagtctatggccctcgcccgaacccgttcctaatcaaccatttcatttacttcaaaggggtttcttacatatgcttctcttaggtgagagttcttctgcttccaatcacctctggagtttctggaaaccagtttgacgcgaatttgggctgtttcatggaggaaaactgcaaagcactgagatgtattacatccggaagtctgagtgacaacattgaactgccgtatgtttttatcatctgcaaaagcagcaaaacccgagttttctttgtcgagtgttttcactgggaaaacgggatcattgtgctacatgcaagccttctcaagcgccaaaagggaaaagaaaaatggaggagaagaaagatttgtgtctcttttttttaagctcctttcctgagctcaagggcgtacacgaaataattacatacatacctctacaatctatatggttctattatatgaccttcattttttatgttgt

SEQ ID NO: 4619 - DNA, 1055 bp, Capsicum annuum
cccaaatgcagacctagggtttgggttttgcaataatcagaggaaatgggggattcatcatcaggagaagaagaagggaaggttcgaggaggaaggcaggagctaattgtagatgatgagttgcggagatggtaaaaagcagcatggagtgtcagctcttataaccgggcaatgctgttctttcccttcgcgatgataaccttgatacctattggcaatcagatggtgcacaacctcatcttgttaatgttcaatttcagaagaaagttaagcttcaattagtcgtcctgtatgttgatttcaagcttgacgaaagctatacacctggtaaggtctctatccgagcaggagatggctttcacaacttgaaggagataaaagcagtggagcttgtcaagccaactggatgggtgcatatatctttatcgggtaatgatccgcgtgaaacttttgtcaacactttcatgctgcaaatagctgtgctctcaaatcatcttaatggaagggacactcatatccgccagattaaagtctatgggccaagaccgaaccctatccctcttcagccatttcagttcacttctacagagtttgttacttattctgctgtgagatgaagctcaagggactatctcaggaggatagatttcaacaatatatattgatatcaaaatgcaaactgggggttagaacagagtccttttttctcctgaaacagaccaatccccctgttaccaaacctgagatccggttcctcggatgacgtgagtaataagagaatggaaattgggtcctgcaatggcagaacctcgtgaaccaggcttactacttgactacttgcttttcttctctaggatattgatcagtcttaggcccattggatgtctatggttggtttgtgttattctaggaaatatctgtatacaatcatatttggtttcacataaacctgtcactaacaaccatgttggttgtattaatttgtagagtctcccaatttctcagtaatctatctgctatagtatacctggaagagcggatttgcttgctgtttc

SEQ ID NO: 4620 - DNA, 953 bp, Phaseolus vulgaris
actctcatatttactctgttctctgtccccatacccactaccattgcatcttgccgctgcaactctcttccttctcttcagcttccattcgcaatggcttcggagaagaaactatccaaccccatgcgggaaatcaaggtccagaagctcgtcctcaacatctccgtcggagagagcggagatcgtctcaccagagccgcaaaggtgttggaacagcttagtggccaaacccctgtgttttccaaagcaagatacactgtccgttcttttggtatcagaagaaatgaaaagattgcatgctatgtcactgttagaggtgacaaggcaatgcagcttctggagagtggattgaaggtgaaggaatatgaacttctgcgaagaaacttcagtgatactgggtgctttggatttggtattcaggagcatattgacttgggaatcaagtatgatccctcaactggtatttatgggatggacttctttgttgttctggaacgccctggctatcgcgtcggccgccgccgccgctgcaagtctcgtgttgggatccagcatcgtgttaccaaggaggattctatgaagtggttccaggtgaaatacgaaggtgtgatcctcaacaagtcacaggcaattgtttagttaaattagctagttgttttgaggagtttacaagttttgttgttttaaattcgatgcttcttcctttaaatagcttgaattactggaatattgaaggtacttgtttttgacatccatattaatacgccttgacccttaattggatgttctatattttgcctttcctctagccgttgtgtttgaagaacatattcattcatagaacactggttttctcattgcattgcctttaagtttttgccccttctgaggaatatataatcaccacaagttaatgaagttgtgagggtgaaagaatgctttcaattgttgaa

SEQ ID NO: 4621 - DNA, 999 bp, Glycine max
aaaactcattggaccctttgcagtgcgcctagtgattctagtgacgcaactcgacaacagagtgaataaaaaaagcgtttcaacgtcgtcgttttacttctcctttgtttgattagggttttttcgcttcttctattcactctgttacggtgcaacctagcagcctccaaatccaatggcttcagagaagaaactttcgaacccaatgagggagataaaagtgcagaagctcgtcctcaatatctctgttggcgagagtggagatcgtctcaccagagccgccaaggtgttggaacaacttagtggccaaaccccagtgttttccaaagcaaggtacactgttcgttcctttgggattagaagaaatgagaagattgcatgctatgtcactgtcagaggtgacaaggcaatgcaacttttggagagtggtttgaaggtgaaggaatatgaacttctcagaaggaacttcagtgatactggttgctttggctttggtattcaggagcatatcgatttgggaatcaagtatgatccttcaactggtatttatggaatggatttctttgttgttctggagcgtcctggctatcgtgtcggacgccgccgaaggtgcaagtcccgtgttggaattcagcaccgtgtcacaaaggaggatgctatgaagtggttccaggtgaaatatgagggagtgatccttaacaagtcccaggcaattgtttagttagattgagttcactttagtttgaaggcaagttttgaaacattgtttgtcatttcagtttcatgatgaagcatatggattaacatgagccctgtttaaactgcacttttattgcaaagaacttgtgaaccccacgttatgcaattatgcttggcaattcacttagttttctttgcaaccaaataagagaagcaagtgcaaaacatttttacttgcgagggcccgaactagctaaatatacctcaatactgtggaaaatactcctctatataagaaca

SEQ ID NO: 4622 - DNA, 1084 bp, Glycine max
aaaactcattggaccctttgcagtgcgcctagtgattctagtgacgcaactcgacaacagagtgaataaaaaaagcgtttcaacgtcgtcgttttacttctcctttgtttgattagggttttttcgcttcttctattcactctgttacggtgcaacctagcagcctccaaatccaatggcttcagagaagaaactttcgaacccaatgagggagataaaagtgcagaagctcgtcctcaatatctctgttggcgagagtggagatcgtctcaccagagccgccaaggtgttggaacaacttagtggccaaaccccagtgttttccaaagcaaggtacactgttcgttcctttgggattagaagaaatgagaagattgcatgctatgtcactgtcagaggtgacaaggcaatgcaacttttggagagtggtttgaaggtgaaggaatatgaacttctcagaaggaacttcagtgatactggttgctttggctttggtattcaggagcatatcgatttgggaatcaagtatgatccttcaactggtatttatggaatggatttctttgttgttctggagcgtcctggctatcgtgtcggacgccgccgaaggtgcaagtcccgtgttggaattcagcaccgtgtcacaaaggaggatgctatgaagtggttccaggtgaaatatgagggagtgatccttaacaagtcccaggcaattgtttagttagattgagttcactttagtttgaaggcaagttttgaaacattgtttgtcatttcagtttcatgatgaagcatatggattaacatgagccctgtttaaactgcacttttattgcaaagaacttgtgaaccccacgttatgcaattatgcttggcaattcacttagttttctttgcaaccaaataagagaagcaagtgcaaaacatttttacttgcgagggcccgaactagctaaatatacctcaatactgtggaaaatactcctctatataagaacaggcataacaaatacaggaattatgataattttctaatcatcaaataccagaaaaatgcaccaagcaccaagtagatggtcactct

SEQ ID NO: 4623 - DNA, 1074 bp, Glycine max
atccttagactagaattaataaagggtgaaaatgtccattcaaatgctttattatttccaatgaggcgcaccaagaaaataataggttgtattaagtaattgcccaacaaactgagtgtgttgctaaaaaaaaagagagcaacccgcaacgttgtggtttcggttccgctttattatacgttcaattgacaaacatccaacctttttgtttggggttttctgattaactctttcttctcataactctgccgccgcaacagccccaaatccaatggcttcagagaagaaactttcgaacccaatgagggagataaaggtgcagaagctcgtcctcaatatctccgttggcgagagtggagatcgtctcaccagagccgctaaggttttggaacagcttagtggccaaacccctgtgttttccaaagcaaggtacacggttcgttcctttgggattagaagaaatgagaagattgcatgctatgtcactgtcagaggtgacaaggcgatgcaacttttggagagtggtttgaaggtgaaggaatatgaacttctcagaaggaacttcagtgatactggttgctttggctttggcattcaggagcatatcgatttgggaatcaagtatgatccttcaactggtatttatggaatggacttctttgttgttctggagcgtcctggctatcgtgtgggacgtcgccgaaggtgcaagtcccgtgttggaatccagcaccgtgtcacaaaggaggatgctatgaagtggttccaggtgaaatatgagggagtgatccttaacaagtctcaggcgattgtttagttagattgagttcatttcaggggagtgtttttatcagttttgtcaactatctttctgggatagtatcttaattttgaggcaggttttgaatcaatgtttctcatttcagttttgtgatgaagcacatgtattaacaatagcccttttaaacgacacttttattgcaacaagaacatgtgagacacttttaaatgcattctctttattgattatttattgaaaatgatcaaattttgtgggtcttatatcatatttaa

SEQ ID NO: 4624 - DNA, 1088 bp, Glycine max
atccttagactagaattaataaagggtgaaaatgtccattcaaatgctttattatttccaatgaggcgcaccaagaaaataataggttgtattaagtaattgcccaacaaactgagtgtgttgctaaaaaaaaagagagcaacccgcaacgttgtggtttcggttccgctttattatacgttcaattgacaaacatccaacctttttgtttggggttttctgattaactctttcttctcataactctgccgccgcaacagccccaaatccaatggcttcagagaagaaactttcgaacccaatgagggagataaaggtgcagaagctcgtcctcaatatctccgttggcgagagtggagatcgtctcaccagagccgctaaggttttggaacagcttagtggccaaacccctgtgttttccaaagcaaggtacacggttcgttcctttgggattagaagaaatgagaagattgcatgctatgtcactgtcagaggtgacaaggcgatgcaacttttggagagtggtttgaaggtgaaggaatatgaacttctcagaaggaacttcagtgatactggttgctttggctttggcattcaggagcatatcgatttgggaatcaagtatgatccttcaactggtatttatggaatggacttctttgttgttctggagcgtcctggctatcgtgtgggacgtcgccgaaggtgcaagtcccgtgttggaatccagcaccgtgtcacaaaggaggatgctatgaagtggttccaggtgaaatatgagggagtgatccttaacaagtctcaggcaattgtttagttagattgagttcatttcaggggagtgtttttatcagttttgtcaactatctttctgggatagtatcttaattttgaggcaggttttgaatcaatgtttctcatttcagttttgtgatgaagcacatgtattaacaatagcccttttaaacgacacttttattgcaacaagaacatgtgagacacttttaaatgcattctctttattgattatttattgaaaatgatcaaattttgtgggtcttatatcatatttaatgattttctcatga

SEQ ID NO: 4625 - DNA, 967 bp, Glycine max
aagcccatcaacggttttggttctcctttataatcataaactccctcacctctctttgtttgattagggtttgtcattagcacttcttcttttcacactgccgctgcaacaatggcttcagagaagaaactttcgaacccaatgagggagataaaagtgcagaagctcgttctcaatatctctgttggcgagagtggagatcgtctcaccagagccgccaaggtgttggaacaacttagtggccaaaccccagtgttttccaaagcaaggtacactgttcgttcctttgggattagaagaaatgagaagattgcatgctatgtcactgtcagaggtgacaaggcaatgcaacttttggagagtggtttgaaggttaaggaatatgaacttctcagaaggaatttcagtgatactggttgcttcggctttggtattcaggagcatatcgatttgggaatcaagtatgatccttcaactggtatttatggaatggatttctttgttgttctggagcgtcctggctatcgtgttggacgtcgccgcaggtgcaagtcccgggttggaattcagcaccgtgtcacaaaggaggatgctatgaagtggttccaggtgaaatatgagggagtgatccttaacaagtcccaggcaattgtttagttagattgagttcgctgtaggattgtgttatcagttttgtcaactatagctcaatctttctgtgatagtatgttaattttgaggcaggttttgaatcaatgtttatcatttcagtttcgtcatgaagcatatggattaacattagccctgattaaacggcacttttattacgaagaactcgtgcacccccctcgttatgcgattatgcttggcaattttcttagttttctttgcaaccaaataagaagcatgtgcaaaacattttacttgcgagggcccgatatagctaaatatttttcctcaatccagc

SEQ ID NO: 4626 - DNA, 1126 bp, Glycine max
attccaaaacttattgggccctttgcaaccatattgacagggtgtgcacaaaagcccatcaacggttttggttctcctttataatcataaactccctcacctctctttgtttgattagggtttgtcattagcacttcttcttttcacactgccgctgcaacaatggcttcagagaagaaactttcgaacccaatgagggagataaaagtgcagaagctcgttctcaatatctctgttggcgagagtggagatcgtctcaccagagccgccaaggtgttggaacaacttagtggccaaaccccagtgttttccaaagcaaggtacactgttcgttcctttgggattagaagaaatgagaagattgcatgctatgtcactgtcagaggtgacaaggcaatgcaacttttggagagtggtttgaaggttaaggaatatgaacttctcagaaggaatttcagtgatactggttgcttcggctttggtattcaggagcatatcgatttgggaatcaagtatgatccttcaactggtatttatggaatggatttctttgttgttctggagcgtcctggctatcgtgttggacgtcgccgcaggtgcaagtcccgggttggaattcagcaccgtgtcacaaaggaggatgctatgaagtggttccaggtgaaatatgagggagtgatccttaacaagtcccaggcaattgtttagttagattgagttcgctgtaggattgtgttatcagttttgtcaactatagctcaatctttctgtgatagtatgttaattttgaggcaggttttgaatcaatgtttatcatttcagtttcgtcatgaagcatatggattaacattagccctgattaaacggcacttttattacgaagaactcgtgcacccccctcgttatgcgattatgcttggcaattttcttagttttctttgcaaccaaataagaagcatgtgcaaaacattttacttgcgagggcccgatatagctaaatatttttcctcaatccagcgaaaaatactcctctctaagatacaggcataataaatacaggagtaatgatcattttcgaatcatcaaataccagaaaaagtgcaccaagcaccacgttgatgctcac

SEQ ID NO: 4627 - DNA, 978 bp, Glycine max
ttgggccctttcgagtgagtccatataattctgacccaaattgacaccaaagtgagtagatctattaaaaaatattgcaacccgaattggggttttactttttatcattgatccttctcttccctctgccgccgcaccctgcaaattcaatggcttcagagaagaaactatcgaacccaatgagggaaataaaggtgcagaaactcgtcctcaatatctccgttggtgagagtggagatcgtctcaccagagccgccaaggtgttggaacagcttagtggccaaaccccagtgttttccaaagcaaggtacactgttcggtcctttgggattagaagaaatgagaagattgcatgctatgtcactgttagaggtgataaggctatgcaacttttggagagtggtttaaaggtgaaggaatatgaacttctcagaaggaacttcagtgatactggctgcttcggcttcggtattcaggagcatattgatttgggaatcaagtatgatccttcaactggtatttacggaatggatttctttgttgttctggagcgtcctggctatcgcgtgggacgtcgccgaaggtgcaagtcccgtgttggaattcagcaccgtgtcacaaaggaggatgctatgaagtggttccaggtgaaatatgagggagtgatccttaacaagtctcaggcaattgtttagttagattgagttcactttaggagtgtgtgatcagttttgttaactataacttgatctttctgtgatagtatcttaattttaaggcaggttttgaatcaatgtcatttcagtttcatgatgaagcatttggattaacaatagccctttttaaacgacatttttactgcaaagaacttgtgaacccctcgttatgcaattatgcttgtcaatttactttgttttctttctaccacattagagaagcctgtgtgcaaaacattttacttgtgagtgctcaaattag

SEQ ID NO: 4628 - DNA, 1131 bp, Glycine max
ttttcggcattttaaaaaaactgctgagtgtcccaagcagttgtcaaaagtttattgggccctttcgagtgagtccatataattctgacccaaattgacaccaaagtgagtagatctattaaaaaatattgcaacccgaattggggttttactttttatcattgatccttctcttccctctgccgccgcaccctgcaaattcaatggcttcagagaagaaactatcgaacccaatgagggaaataaaggtgcagaaactcgtcctcaatatctccgttggtgagagtggagatcgtctcaccagagccgccaaggtgttggaacagcttagtggccaaaccccagtgttttccaaagcaaggtacactgttcggtcctttgggattagaagaaatgagaagattgcatgctatgtcactgttagaggtgataaggctatgcaacttttggagagtggtttaaaggtgaaggaatatgaacttctcagaaggaacttcagtgatactggctgcttcggcttcggtattcaggagcatattgatttgggaatcaagtatgatccttcaactggtatttacggaatggatttctttgttgttctggagcgtcctggctatcgcgtgggacgtcgccgaaggtgcaagtcccgtgttggaattcagcaccgtgtcacaaaggaggatgctatgaagtggttccaggtgaaatatgagggagtgatccttaacaagtctcaggcaattgtttagttagattgagttcactttaggagtgtgtgatcagttttgttaactataacttgatctttctgtgatagtatcttaattttaaggcaggttttgaatcaatgtcatttcagtttcatgatgaagcatttggattaacaatagccctttttaaacgacatttttactgcaaagaacttgtgaacccctcgttatgcaattatgcttgtcaatttactttgttttctttctaccacattagagaagcctgtgtgcaaaacattttacttgtgagtgctcaaattagggaaatatacctcaatatatttcgcattcccctaaagagaagtgctgggaacagacatttttttaaatacgttctcgtaccagttacaatttattgaaa

SEQ ID NO: 4629 - DNA, 1032 bp, Glycine max
tccaaaaattgattgggccctttgcagtgagacctagtgatttccactgacccaatttgacaaacagctaaaagagaacgagtgaatagaataaaatgcgccaccacgtcgtcgttttgattctcctttatgtttgattagggttttctcattaacgcttcttctctcttcactctgcgaaggtgcaacctgacagcctccaaatccaatggcttcagagaagaaactttcgaacccaatgagggagataaaagtgcagaagctcgtcctcaatatctctgttggcgagagtggagatcgtctcaccagagccgccaaggtgttggaacaacttagtggccaaaccccagtgttttccaaagcacggtacactgttcgttcctttgggattagaagaaatgagaagattgcatgctatgtcactgtcagaggtgacaaggcaatgcaacttttggagagtggtttgaaggtgaaggaatatgaacttcttagaaggaacttcagtgatactggttgcttcggctttggtattcaggagcatatcgatttgggaatcaagtatgatccttcaactggtatttatggaatggatttctttgttgtactggagcgtcctggctatcgtgtcggacgccgccgtaggtgcaagtcccgtgttggaattcagcaccgtgtcacaaaggaggatgctatgaagtggttccaggtgaaatatgagggagtgatccttaacaagtcccaggcaattgtttagttagattgagttcactttaggagcgtgttatcagttttgtcaactatagctcgatctttctgtgatagtatgctaattttaagggaagttttgaaacattgtttgtcatttcagtttcgtgattaaagcatatggatcaacattagccctgtttaaacggcacttttgttgcaaagaacttgtgaacccctcgttatgcaattatgcttggcaatttacttcgttttctttgcaaccaaataagagaaggatgagcaaaacatttatacttgcgaggg

SEQ ID NO: 4630 - DNA, 1287 bp, Glycine max
tccaaaaattgattgggccctttgcagtgagacctagtgatttccactgacccaatttgacaaacagctaaaagagaacgagtgaatagaataaaatgcgccaccacgtcgtcgttttgattctcctttatgtttgattagggttttctcattaacgcttcttctctcttcactctgcgaaggtgcaacctgacagcctccaaatccaatggcttcagagaagaaactttcgaacccaatgagggagataaaagtgcagaagctcgtcctcaatatctctgttggcgagagtggagatcgtctcaccagagccgccaaggtgttggaacaacttagtggccaaaccccagtgttttccaaagcacggtacactgttcgttcctttgggattagaagaaatgagaagattgcatgctatgtcactgtcagaggtgacaaggcaatgcaacttttggagagtggtttgaaggtgaaggaatatgaacttcttagaaggaacttcagtgatactggttgcttcggctttggtattcaggagcatatcgatttgggaatcaagtatgatccttcaactggtatttatggaatggatttctttgttgtactggagcgtcctggctatcgtgtcggacgccgccgtaggtgcaagtcccgtgttggaattcagcaccgtgtcacaaaggaggatgctatgaagtggttccaggtgaaatatgagggagtgatccttaacaagtcccaggcaattgtttagttagattgagttcactttaggagcgtgttatcagttttgtcaactatagctcgatctttctgtgatagtatgctaattttaagggaagttttgaaacattgtttgtcatttcagtttcgtgattaaagcatatggatcaacattagccctgtttaaacggcacttttgttgcaaagaacttgtgaacccctcgttatgcaattatgcttggcaatttacttcgttttctttgcaaccaaataagagaaggatgagcaaaacatttatacttgcgagggtccgaactagctaaatttacctcaatactgtggaaaatactcctctatatgatacaggcataacaaatacaggaattatgatagcgtcaaatgcaatacagctcttgtatcatcatactccatgtaaaccaataaaaaaatatataccatacttatctcaatctatcatgcattttgccaaaagagagtcttgttgcaacagactctcatctaccatctccatctcccaaaactgttcacatggagatataaacc

SEQ ID NO: 4631 - DNA, 937 bp, Cajanus cajan
tctttggggtttttatatcataaagtattaactctttcgcttcacttcgccgccgcaacgctgcaacctaacagtgacacgctccaaatccaatggcttcggagaagaaactgtcgaacccaatgagggagataaaggtgcagaagctcgtcctcaatatctccgttggtgagagtggagatcgtctcaccagagccgccaaggtgttggaacaacttagtggccaaaccccagtcttttccaaagcaaggtacactgttcgttcctttgggattagaagaaatgagaagattgcgtgctatgtgactgtcagaggtgacaaggcaatgcaacttttggagagtggtttgaaggtgaaggaatatgaacttctgagaaggaacttcagtgatactggctgttttggctttggtattcaggagcatattgatttgggaatcaagtatgatccttcaactggtatttatggaatggatttctttgttgttctggagcgtcctggataccgtgtgggacgtcgccgaagatgcaagtcccgtgttggaattcagcaccgtgttacaaaggaggatgctatgaagtggttccaggtgaaatatgagggagtgatcctcaacaagtctcaggcaattgttggttagaccagttaactttaggagtgtgttatcagttttgtcaacagtattttaatctttgtgggatagtatcttaatttggaggcagattttgaatcaatgtcatttcagttttgtgaagaagcacatggattaacaatagccctgttaaacgacttttttattgcaaagaatttgtgaaccttcgttattcaattgtgcttgtcaacaatttagcttgttttctttgcaaccaattgagaagcttgtgcagtacattttacttgcgagggccctaattaacgaaatagaccctctcaata

SEQ ID NO: 4632 - DNA, 973 bp, Cajanus cajan
aggggtattatagtcatagtgcacataaaaaaccctagccgctcctcctctcatattaacgttgttgtttctgccccaaacatactcgcattgtttcttctgtgccgctgttactctctcttcagattccattcccaatggcttcggagaagaaactatccaaccccatgcgggaaatcaaggtccagaagctcgtcctcaacatctccgtcggtgaaagtggcgatcgtctcaccagagccgcaaaggtgttggagcagcttagtggccaaaccccagtgttttccaaagcaaggtatactgtccgttcttttggtatcagaagaaatgaaaagattgcatgctacgttacagttagaggggacaaggcaatgcagcttttggagagtggattgaaggtgaaggaatatgaacttctgagaagaaactttagtgataccgggtgttttggctttggtattcaggagcacattgacttgggaatcaagtatgatccttcaactggaatttatggaatggatttctttgttgttttggagcgccctggttatcgtgtcggacgtcgtcgccgttgcaagtctcgtgtagggatccagcatcgtgtcaccaaggaggatgctatgaaatggttccaggtgaaatacgaaggtgtgatcctcaacaagtcacaggcaattgttggttaaattgagctagttgtttgaggagtttgaaagttttgttattttaaatttgatgcttcttggtttagtagcttaaatttctagaatatgaatgcgactggtcatatgagctatttaaagtatttgattttgacatataaattgaatatcatgcctttgacccttaatggaatgttatattttgcatttcttctacccgttttgtttgaggaatatatgtacaaattctccagtgattttctgtcgtttcttgcatttgcccttcaatttctggccttcctaggatgaaa

SEQ ID NO: 4633 - DNA, 1232 bp, Cicer arietinum
gggccaactaagtttggcccaaatggactgataattaaatacggttaacgttgtcgtttcgatgctcacttgaaggcaaaatcttctgattttgtggttttattcgttcatcgccctattcctcccttcgcctctctgccgccgccgcaacacttcaacctcccaatccaatggcttcggagaagaaattgtcgaacccaatgagggagattaaggttcagaagctcgtcctcaatatctccgtcggtgagagtggagatcgtctcaccagagccgccaaggtgctcgaacaacttagtggccaaaccccagtgttctccaaagcaaggtacactgttcgatcctttgggattagaagaaatgaaaagattgcatgctatgtcactgttagaggtgataaggcaatgcaacttctggagagtggtttgaaggtgaaggagtatgaacttctgaggaggaacttcagtgataccggctgttttggctttggtattcaggagcatattgatttgggaatcaagtatgatccttccactggtatttatggaatggatttctttgttgttctggagcgccctggttatcgtgtgggtcgtcgccgcagatgcaagtcccgtgtcggaatccaacaccgtgtaacaaaggatgatgcaatgaagtggttccaggtgaaatatgagggagtgatccttaacaaatcccaggcaattgtttagttaaaccaagttctctttaggagtaagctactactgtttttgtcaactatagtttgatcatctgggatagtgtcttaattttcaggcagattttgaatcattgtttttattatattttctgttgttttttgatgaagcacatggattaactttgacatgttaaaatactcttatgctaagtttctgaacctccagtaaagcaaggcaaacaattttcgttattttattggctccaaatgaataaaaagagaaacgtgaaaaatattttacttttgaggctcctgataatcgaaacaggccctctccaccacccctatttacatctgaatcaatgctcagttcaagtcatccttctatttgcaattcaatcaatataggcatagcattgccgcattagcatcaacattccatgttgtgttctgtaacttacactcaaaattgtctgagtttaattttggatggcaaaatgtgtagtactaaaatatgaggccattgatacggagaacaagtcaccta

SEQ ID NO: 4634 - DNA, 957 bp, Glycine max
aaaaaaagagcaacccgcaacgttgtggtttcggatccgctttattatacgtgcaattgacaaacatccaacctttttgtttggggttttctgattaactctttcttctcataactctgccgccgcaacagccccaaatccaatggcttcagagaagaaactttcgaacccaatgagggagataaaggtgcagaagctcgtcctcaatatctccgttggcgagagtggagatcgtcttaccagagccgctaaggtgttggaacagcttagtggccaagcccctgtgttttccaaagcaaggtacacggttcgttcctttgggattagaagaaatgagaagattgcatgctatgtcactgtcagaggtgacaaggcaatgcaacttttggagagtggtttgaaggtgaaggaatatgaacttctcagaaggaacttcagtgatactggttgctttggctttggcattcaggagcatatcgatttgggaatcaagtatgatccttcaactggtatttatggaatggacttctttgttgttctggagcgtcctggctatcgtgtgggacgtcgccgaaggtgcaagtcccgtgttggaatccagcaccgtgtcacaaaggaggatgctatgaagtggttccaggtgaaatatgagggagtgatccttaacaagtctcaggcgattgtttagttagactgagttcatttcaggggagtgtttttatcagttttgtcaactatctttctgggatagtatcttaattttgaggcaggttatgaatcaatgtttctcatttcagttttgtgatgaagcacatgtattaacaatagcccttttaaacgacacttttattgcaacaagaacatgtgagacacttttaaatgcattctctttattgattatttattgaaaatgatcaaattttgtgggtcttatatcatatttaatgatttttctca

SEQ ID NO: 4635 - DNA, 1176 bp, Glycine max
tccaatgagatacaccaaaaaataataggttgtattaagtaattgcccaacaaattgagtgtgttgatcaaaaacaaaaaaagagcaacccgcaacgttgtggtttcggatccgctttattatacgtgcaattgacaaacatccaacctttttgtttggggttttctgattaactctttcttctcataactctgccgccgcaacagccccaaatccaatggcttcagagaagaaactttcgaacccaatgagggagataaaggtgcagaagctcgtcctcaatatctccgttggcgagagtggagatcgtcttaccagagccgctaaggtgttggaacagcttagtggccaagcccctgtgttttccaaagcaaggtacacggttcgttcctttgggattagaagaaatgagaagattgcatgctatgtcactgtcagaggtgacaaggcaatgcaacttttggagagtggtttgaaggtgaaggaatatgaacttctcagaaggaacttcagtgatactggttgctttggctttggcattcaggagcatatcgatttgggaatcaagtatgatccttcaactggtatttatggaatggacttctttgttgttctggagcgtcctggctatcgtgtgggacgtcgccgaaggtgcaagtcccgtgttggaatccagcaccgtgtcacaaaggaggatgctatgaagtggttccaggtgaaatatgagggagtgatccttaacaagtctcaggcgattgtttagttagactgagttcatttcaggggagtgtttttatcagttttgtcaactatctttctgggatagtatcttaattttgaggcaggttatgaatcaatgtttctcatttcagttttgtgatgaagcacatgtattaacaatagcccttttaaacgacacttttattgcaacaagaacatgtgagacacttttaaatgcattctctttattgattatttattgaaaatgatcaaattttgtgggtcttatatcatatttaatgatttttctcatgattttattgtttttaataagttccaacctattagagtgtgcttttgaagtagtgtggtatcctggcactcttcccctaaataccaaaccattgcaaattcatgctattgacattcaataatcaatagtaattctgctacact

SEQ ID NO: 4636 - DNA, 784 bp, Manihot esculenta
agacgttcttctccacagcctcttcttctctgcatcaaagcgcgcgtctaaactgcaacaaatggcttcggagaagaagctctcaaatcccatgagggagattaaggtgcagaagcttgtacttaacatctccgtcggcgaaagtggcgatcgtcttacccgtgccgccaaggtgcttgagcaactcagtggtcagacccctgtgttctctaaggctaggtacactgttagatcttttgggatcaggcgtaatgagaagattgcttgctatgtgactgtgaggggagacaaggccatgcagctgcttgagagcgggttgaaggtcaaggaatatgaacttttaagaaggaacttcagtgataccggttgctttggatttggtattcaggagcacattgatcttggaattaagtatgacccatcaactggtatttatggtatggacttctttgttgttctcgagcgcccaggttaccgtgtgggtcgtcgccgaagatgcaagtcacgtgttggaatccaacacagggtgacaaaggaggatgccatgaagtggttccaagtgaaatacgaaggtgtcatccttaacaagtcccaagctattggagcttagaagtggttggattatattaagttttggcgagttgtcatgttttggctggacaatatttgttttcttggaattagaaactttttttttgaatggttactagctcgaatactaattctggttcattattttactgtgggttctctatttatatgagtagattatgctaaaattgtg

SEQ ID NO: 4637 - DNA, 846 bp, Vigna unguiculata
ggggggttttttgttattaattcttctcttccatccgccgccgccgtaacggtgctccctagtagcctccaacaatggcttcagagaagaaactgtcgaaccctatgagggagataaaggtacagaagctcgtcctcaatatttctgttggcgagagtggagatcgcctcaccagagcagcaaaggtgttggaacaactgagtggccagaccccagtgttctccaaagcaaggtacactgttcgttcctttgggattagaagaaacgagaagattgcttgttatgtcactgttagaggtgacaaggcaatgcaacttttggagagtggtttgaaggtgaaggagtatgaactcctcagaaggaacttcagcgatactggctgctttggctttggcattcaagagcatattgatttgggaatcaagtatgacccttcaaccggtatttatggaatggatttctttgttgtgttggagcgtcctggttaccgtgttggccgtcgccgaaggtgcaagtcccgtgttggaattcaacaccgtgtcacaaaggatgatgctatgaagtggttccaggtgaaatatgagggagtgatccttaacaagtctcaagcaatttagtttgagttcactttagtagtgtgttatcaattttgtcaaactatagttccatctttctatgataggatcttaattttgagccagggtttgaatccatgtttttcatttaagtttttcgatgaagcaacatgtattagcactgttagatgacactttaattgtgaagttgtgaacccctcgttatgcaattatgctttgtaacaatttcgtttctttaaaaaaaaataac

SEQ ID NO: 4638 - DNA, 752 bp, Vigna unguiculata
gccgctgcaactctctcccttctcttcagcttccattcgcaatggcttcggagaagaaactatccaaccccatgcgggaaatcaaggtgcagaaactcgtcctcaacatctccgtcggcgagagtggtgatcgtctcaccagagccgcaaaggtgttggagcagcttagtggccaaaccccagtgttttccaaagctagatacactgtccgttcttttggtatcagaagaaatgaaaagattgcatgctatgtcactgtcagaggtgacaaggcaatgcaacttctcgagagtggattgaaggtgaaggaatacgaacttctgcgaagaaacttcagcgacactggctgctttggctttggtattcaggagcatattgacttgggaatcaagtatgatccctcaactggtatttatggaatggacttctttgtcgttctggagcgccccggctaccgtgttggccgccgccgccgctgcaagtctcgtgttgggatccagcatcgtgttaccaaggacgatgctatgaagtggttccaggtgaaatacgagggtgttatcctcaacaagtcacaggcaatttaattaaattagctagttgttttgaggagtttgcaagttttgttgttttaaatttgacgcttcttcatttaaatagcttgaattactggaatattaatgcgagaagcaatgtgagttattatttagatgtacttgtttttgacatccatattaatacgcctttgatccttt

SEQ ID NO: 4639 - DNA, 986 bp, Medicago truncatula
agttaatggggataaaaaatattgtaccaaaaaaaaaaaaaaaccaaaactataactataaaaaaatgaaataaaaaaaagggtattatagtccatacacacccatcaaaaccctagtaaccttcttctctccactattaaatctcgttctttctcattgcttcattgccgcacaacctctcttccatttccgatcccaaatggcttcggagaagaaactctcgaaccccatgagggatattaaggttcagaaacttgttcttaatatctctgttggtgaaagtggcgatcgtctcaccagagctgcaaaggtgttggaacaactcagtggccaaaccccagtgttttccaaagctcgatacactgtccgttcttttggtattagaagaaatgaaaagattgcttgctatgtgactgttagaggtgacaaggcaatgcaacttttggagagcggtttgaaggtgaaggaatatgaattgctgagaagaaattttagtgatactgggtgttttggattcggtattcaggagcatattgatttgggaatcaagtatgatccttctaccggtatttatggaatggactttttcgttgttctagagcgtcccggttaccgtgtgggacgtcgtcgtcggtgcaaggctcgtgttgggatccaacatcgggtaacaaaggatgattccatgaagtggttccaggtgaaatatgagggtgtgatcctcaacaagtcacaggcgattgtttagttacttaggctagttgacaaagcaatttgcaagttttgttaattataatttgaagtttcttgaaccattatcttaaacttcttgaatatctgtctggttatatggaccgtcttaaagtatttatttctgatcctttattttgttgtctattatgaattggatattctatgttttgcattcatttatcaatgtttgaatatcagtagaaaaaatcatatttattcggtttgattcatttta

SEQ ID NO: 4640 - DNA, 1398 bp, Cajanus cajan
gtgggcctttgggcctatggatgaaatctgggtttcaccaaaaataaaaaagaaccccgtgaaagcaaaaccctagttccctccctttcattcccacaacaacagagccgcggcaagaaactcgtgtcccagtctctgccaccgattccacaatggcttccgaaaagaaactctccaatcccatgcgagaaatcaaggtccagaaactcgtcctcaacatctccgtcggcgagagcggtgatcgtctcactcgcgcagccaaggttttggaacaactcagtggccaaacccctgttttctccaaagctaggtacactgtgcgttcgtttgggatcagaagaaacgagaagatcgcttgctatgtgacggtgaggggtgacaaggcgatgcagcttctggagagtggtttgaaggtgaaggagtacgagctgctgaggaggaacttcagcgacactggctgcttcggcttcggcattcaggagcacattgatttgggaatcaagtatgatccttcgactggtatttatggaatggatttctttgttgttcttgagcgccctggctatcgcgtgggacgtcgtcgtcgttgcaaggctcgtgttggaatccaacatcgtgtcactaaggaggatgcaatgaagtggttccaagttaaatacgaaggtgtgatcctaaacaagtcccaggcaattgtcggttaaatcaggctattcgtaagtgcaattcccgatttatgttgttcattatagtttcatgtttattttcttgaattagtacggatattactcttacaggtcaattgagctgtttttgacaattttttttttaatattattaaattttggcgaatgctctacatgtatttttagcatttatctactcactactagcgtgaatttgaattacatggataatagttcaatgtttttgctttgtttgatcaacatgtcagtaagatggttgattttcgagattttgtaggagaaaatttaaatgcaaaaattaataactgctattttagtgtgcgtgtttagcagggatttttgaaaaatgccacttttttatttttatttttttataactttttattactgattatttaatattttatttatttataataatggatgtgtctaacgtgtgctgtagagttagctgtgcatcatataagcaatgccctcgctaattataggttaactttctttttcctcctattgtttagtatataacatcaaacccaatagccttaactatttggacgatgatgatattaaactgaaaccatttcgttgatcaagtttacaactttcaatgtttgatgttatttatgaaaactaataaaaagtgtgcaatggaggacctgaataatccagtctaaaaagcttgacttgcatgatt

SEQ ID NO: 4641 - DNA, 1126 bp, Glycine max
aaaaaaaagcccatcaacgtcgttttgttctctttatagtcacaaactcctatggttgattagggttttatctcattaacgtttcttctcttcactctgcccgctgcatcaatggcttcagagaagaaactttcgaacccaatgagggagataaaagtgcagaagctcgtcctcaatatctctgttggcgagagtggagatcgtctcaccagagcctccaaggtgttggaacaacttagtggccaaaccccagtgttttccaaagcaaggtacactgttcgttcctttgggattagaagaaatgagaagattgcatgctatgtcactgtcagaggtgacaaggcaatgcaacttttggagagtggtttgaaggtgaaggaatatgaacttctcagaaggaacttcagtgatactggttgcttcggctttggtattcaggagcatattgatttgggaatcaagtatgatccttcaactggtatttatggaatggatttctttgttgttctggagcgacctggctatcgtgttggacgtcgccgaagatgcaagtcccgtgttggaattcagcaccgagtcacaaaggaggatgctatgaagtggttccaggtgaagtacgagggagtgatccttaacaagtcccaggctattctttagttagattgagttcactttaggagtgtgttatcagttttgtcaactatagctcgatctttctgtgatattatgttaattttaaggcaggttttgaatcaatgtttgtcatttcagtttcgtgatgaagggtatggattagccctgtttaaacggcacttttattgcaaagaactcctgaaccccgcgttatgcaatgatgttgggcaatttacttagttttctttgcaaccaaataagagaagcatgtgcaaaacattttacttgcgagggccagaactagctaaatatacctcaatacggtggaaaatactcctccccatttactgatgtagacacaatgtgttcatatctcctactggaaaattccactaaatggaggagtattttccactttttaaatgtattttctcttggttaaaatttattgaaaatatcaaattttgtgggtgttatatcatttaaagattct

SEQ ID NO: 4642 - DNA, 1370 bp, Glycine max
aaaaaaaagcccatcaacgtcgttttgttctctttatagtcacaaactcctatggttgattagggttttatctcattaacgtttcttctcttcactctgcccgctgcatcaatggcttcagagaagaaactttcgaacccaatgagggagataaaagtgcagaagctcgtcctcaatatctctgttggcgagagtggagatcgtctcaccagagcctccaaggtgttggaacaacttagtggccaaaccccagtgttttccaaagcaaggtacactgttcgttcctttgggattagaagaaatgagaagattgcatgctatgtcactgtcagaggtgacaaggcaatgcaacttttggagagtggtttgaaggtgaaggaatatgaacttctcagaaggaacttcagtgatactggttgcttcggctttggtattcaggagcatattgatttgggaatcaagtatgatccttcaactggtatttatggaatggatttctttgttgttctggagcgacctggctatcgtgttggacgtcgccgaagatgcaagtcccgtgttggaattcagcaccgagtcacaaaggaggatgctatgaagtggttccaggtgaagtacgagggagtgatccttaacaagtcccaggctattctttagttagattgagttcactttaggagtgtgttatcagttttgtcaactatagctcgatctttctgtgatattatgttaattttaaggcaggttttgaatcaatgtttgtcatttcagtttcgtgatgaagggtatggattagccctgtttaaacggcacttttattgcaaagaactcctgaaccccgcgttatgcaatgatgttgggcaatttacttagttttctttgcaaccaaataagagaagcatgtgcaaaacattttacttgcgagggccagaactagctaaatatacctcaatacggtggaaaatactcctccccatttactgatgtagacacaatgtgttcatatctcctactggaaaattccactaaatggaggagtattttccactttttaaatgtattttctcttggttaaaatttattgaaaatatcaaattttgtgggtgttatatcatttaaagattctcctgattttattttgaataaattttaaccaataaccgtgagtttgaaggagtgctatctctttcatggtaatatctgaaatgctaaattcagatccttttaagcatcaatgtgcaaagttgaaaactgccggtgaaaaaagaataaatttaaagatgaagagcaaagttaacaacagttacgggaaaaagaaattgaaaatttctaagatacagggataacaaataataattttctaatcacca

SEQ ID NO: 4643 - DNA, 793 bp, Trigonella foenum-graecum
tcacatccacagcctcttttccgtttccaatcccaaatggcttcagagaagaaactctcaaaccccatgagggaaatcaaggttcagaaacttgttctcaatatttctgttggtgaaagtggcgatcgtctcaccagagccgctaaggtgttggaacaactcagtggccaaaccccagtgttttctaaagcaagatacactgtccgttcttttggtatcagaagaaatgaaaagattgcatgctatgtcactgttagaggtgacaaggcaatgcagcttttggagagtggtttgaaggtgaaggaatatgaattgctgagaagaaactttagtgataccgggtgttttggattcggtattcaagagcacattgatttgggaatcaagtacgatccttctactggtatttatggaatggacttctttgttgttcttgagcgacctggttaccgtgtgggacgtcgtcgtcggtgcaaggctcgtgttgggatccaacatcgggtcacaaaggatgatgcaatgaagtggttccaggtgaaatatgaaggtgtgatcctcaacaagtcacaggcgattgtttagttactaggctagttgacagagcaatttgcaagttttgttaattataatttgaagtttctcgaacattatctaaatttcttgaatatttttatgcctggttatatggactgtctcaagatatttatttctaatcctttattttattgtctcagttatggaattgaatattctttgttttgcattcatctatgtttgaaaaacaatagtccaa

SEQ ID NO: 4644 - DNA, 882 bp, Trigonella foenum-graecum
ggtgaagggtataattgtcatttgctcccgttaaaagcacaaaaccctaataacttgtattcttcttcaatccatcgtcattgttaccgtctcaatcttccattccaccactcgcgccgttctgtcacaacaattcattccaaatggcgtcggagaagaaattgtctaatccaatgagggaaatcaaagtgcaaaaactcgtcctcaacatctccgtcggtgaaagtggagatcgtctcaccagagccgcaaaggttcttgaacagctaagtggccaaacccctgttttctccaaagctaggtacactgtccgttcctttggtattagaaggaatgaaaagattgcatgctacgtcactgttagaggcgacaaggcaatgcagcttttggagagcggtttgaaggtcaaggaatatgaactgttgaggagaaacttcagtgataccgggtgttttggcttcggtattcaggaacatattgatttgggaatcaagtatgatccttccactggtatttatggaatggatttctttgttgtcttggagcgccctggctatcgtgttggacgccgtcgccgttgcaaggcacgtgttggaatccaacatcgtgtcacaaaggatgacgccatgaagtggttccaagttaaatatgaaggtgtgatcctaaacaagtcccaagcaattgtttagtgagatcaggccgttcttaagttgaagttctaaattttgttgagtgtagtttgatgttttcttgaatcgttagcttaaatttctgcattgctatggattctactttttacaggttatgtaagctgtttgtttaattttctccaaatatcatcaatttttgacatcaatactgattgcatgctgatgttagagt

SEQ ID NO: 4645 - DNA, 823 bp, Antirrhinum majus
cggcacgagaaagccctagctccgtcttcacttcatatttagggttttgttttgtacctcctgcatttccccccaatcaccaactacagcaccaccatggcgtcagagaagaaactgtcaaatccaatgagggagatcaaagtgcagaagcttgttctcaacatctccgtcggtgaaagtggagatcgtctcacaagagctgctaaggtgttggaacaactcagtggccaaactcctgttttttccaaggcaagatacactgtgcgatcctttgggatcaggcgtaatgaaaagatagcatgttatgtcactgtcagaggtgataaggcaatgcagctccttgagagtggcctaaaggtcaaggaatatgagttgttgagacgaaacttcagtgacactggctgcttcggttttggtattcaggaacacattgatcttggaatcaagtatgacccttcaaccggtatttatggtatggatttctatgtcgtactggagcgtcctggttatcgtgtgggtcgtcgtcgaagatgcaaatctcgtgttggaatccagcacagggttactaaggaggattcaatgaagtggttccaggtgaaatatgaaggtgtaatcctcaacaagtcaaatgctatcggtgcttaaagtagtatctagatttgcgatgtcttttgttcattacaattattctgttcaatgttttgtagaatataatctatttgtcatcggcgacgggattctgtgttactttcgacctggaaattctgaacaagaaagattttgttgtgcttttatcgtttttaaaatctcaaagcgtttgggt

SEQ ID NO: 4646 - DNA, 843 bp, Antirrhinum majus
  misc_feature (99)..(99): n is a, c, g, or t
  misc_feature (106)..(106): n is a, c, g, or t
  misc_feature (116)..(116): n is a, c, g, or t
  misc_feature (127)..(127): n is a, c, g, or t
  misc_feature (710)..(710): n is a, c, g, or t
  misc_feature (749)..(749): n is a, c, g, or t
caaaacaaaaccctagcgtcactcttatttctgaatttcttcatttagggtttgttccttattttcccccaaatcctcctccgccgctaatcctccacngcagctncaatggcgtnagagaagaagntatcgaatccgatgagagagattaaggttcagaagctcgttctcaacatctccgtcggtgaaagtggagatcggctcactcgagctgctaaggtgttggagcaactcagtggtcaaactcctgttttctccaaagcacgatacaccgtgaggtcttttgggatcaggcgtaatgaaaagatagcgtgctatgttaccgtcagaggtgataaggcaatgcagctcctggaaagcggcctcaaggtcaaggaatacgagttgttgagacgtaatttcagtgacactggctgttttggttttggtattcaggagcacattgatctcggaatcaagtatgacccttcaactggtatctatggtatggatttctatgttgtattggaacgccccggttaccgtgtgggccgccgccgtaggtgcaagtctcgagttggtatccaacacagggtcacgaaagaggactcaatgaagtggttccaggtgaagtatgaaggtgttatcctgaacaagtccaacgctattggagcttaggttggagcttgaagtattacatgacctttatgagctatgtttctattggtccnttttttggctaaagttttgtagaatttcatacatgtctncattgacaggttttttgctatttccatcttttaacatattcaaaatgacggttttgttgtgccttttattttcattagtaaagtagcaaattac

SEQ ID NO: 4647 - DNA, 814 bp, Citrus clementina
caaaaaccctagtgtatgtaactcaacatcactcttacatattagggtttgttccgtctccgtcttcactgagcagcggcagtaactcatcatcagcaaacccgaatggcttcagagaagaaactttcgaaccccatgagggaaattaaggttcagaagcttgtgctcaacatctccgttggtgaaagtggagatcgtctcaccagagccgctaaggtgctggagcaactcagtggacagacacctgttttctccaaggccaggtacactgttcggtcttttgggatcagacgtaatgagaagattgcatgctatgtgactgttagaggtgacaaggcaatgcagcttttggagagtggattgaaggtgaaggaatatgagcttctgcgtcggaatttcagtgacactggctgttttggctttggtattcaagagcatattgatcttggaatcaagtatgatccttccactggaatttatggtatggatttctttgtggttctggagcgcccgggttatcgtgtaggtcgccgccgtaggtgcaagtctcgtgttgggattcagcaccgtgtcacgaaggaagatgcaatgaaatggttccaggtcaaatacgaaggtgtgatcctcaacaagtcccagaatattggtgcttaagccctttgtgtgatgacgattttgcatttatagtgttgatgtttgtagacactggctattacttggcgttttgcaaacctgagttagatgctttcggtagttcaagatattttgttatttgtctatttaaattttattatcaagattatggcttagctgc

SEQ ID NO: 4648 - DNA, 816 bp, Glycyrrhiza uralensis
cttctttatagacaccacaccagcttccgtagcctctgaatttgggggtttcttcatcgctctgttcccttctcctttgccgccgcagcatatcagcctgcaaattcaatggcctcggagaagaaactgtcgaacccaatgagggagatcaaggtgcagaagcttgttctcaacatctccgtcggtgaaagtggagatcgtctcaccagagccgccaaggtgctggagcaacttagtggccaaacgccagtgttctccaaagcaaggtacactgttcgttcctttgggattagacgaaatgagaagattgcatgctatgtcactgttagaggtgacaaggcaatgcaacttttggagagtggtttgaaggtgaaggaatatgaacttctgagaaggaactttagtgacactgggtgtttcggcttcggtattcaggagcatatcgatttgggaatcaagtatgatccttcaactggtatttacggaatggatttctacgttgttctggagcgccctggttatcgcgtggggcgtcgccgtaggtgcaagtcccgtgttgggattcaacaccgtgtcacaaaggaggatgctatgaagtggttccaggtgaaatacgagggagtgatccttaacaagtcccaggcacttgttggttaaactgagttctttttaggagtatgttaccatttttgtcaactatagttttatctttctgggatagtatcttaattttcaggcagattttgaatcaatgtttttatggtcttttctgttattttatgatgaagcacatgaattaactgaatgaatcctatg

SEQ ID NO: 4649 - DNA, 881 bp, Medicago truncatula
agttagtgagcagtatacaccatatcccgagtgttaccgtctccattcgcgccgttctctttcgtttctgtcagaaagaacaaccaattcattccaaatggcgttgtcagagaagaaactgtcgaatcctatgagggaaatcaaagtgcaaaaacttgtcctcaacatctccgttggtgaaagtggagatcgtctcaccagagctgcaaaggttcttgaacagctaagtggccaaactcctgttttctccaaagctaggtacaccgtccgttcctttggtattagaaggaatgaaaagattgcatgctacgtcactgttagaggcgacaaggcaatgcagcttttggagagtggcttgaaggtcaaggaatatgagctgttgaggagaaacttcagtgataccgggtgttttggcttcggtattcaggaacatattgatttgggaatcaagtatgatccttccactggtatttatggaatggatttttttgttgtcttggagcgccctggttatcgtgttggacgtcgtcgtaggtgcaaggcaagagttggaatccagcatcgtgtcacaaaggatgatgccatgaagtggttccaagttaaatatgaaggtgtgatcctaaacaagtcccaggcaattgtttagtgagatcaggacattcttgagtacgagttctgaattttgttgagtgtagtttgatgtttcttgaatcagtagcttaaatttctgcattggtatgaatactacttttgaccagatatgtaagatgtttgtttaattttttttcttctcccaatatcatcaaattttgacatcaaaactgattgcaagcttatgttacagagtatctatctaatctatttttgttttcatttatcca

SEQ ID NO: 4650 - DNA, 786 bp, Tropaeolum majus
gacggattctgcttgcgttcgaaacgatggcctccgagaagaagctagcaaaccccatgagggagataaaggttcagaagctcgtactcaatatctcagtcggtgaaagtggagatcgtctcacacgtgccgccaaggtcctggagcaactcagtggccaaaccccagttttctctaaagctaggtacactgttagatctttcgggattaggcgtaatgagaagattgcgtgctacgtgactgtcagaggagacaaggcgatgcagcttcttgagagtggtttgaaggttaaggaatacgagcttttgaggaggaacttcagtgacactggttgcttcgggttcggtatccaggaacatattgatttgggtatcaagtatgatccctcaactggtatctatggtatggacttctttgttgtgttggaacgcccaggttaccgtgttggtagacgtcgcagatgcaagtctcgcgttggaattcaacacagagttacaaaggaggattcaatgaaatggttccaggtgaaatatgaaggtgttatcctcaacaagtcccaaaatattggagcttaaaaagaaatccctttgtatttcaaagtatgtcctcagttttgttcacccgttttccttttcactttacatgttttcttttattatgaccaacttcgtaatgtaagatgtactagttttttgatattttaagtgtatggccaaaagattttgtgtttaattactatcatctgcaattctcccaccacatataatgtttgccattaaccatcaa

SEQ ID NO: 4651 - DNA, 1115 bp, Tropaeolum majus
cggccggggggtaggactaaatgtgtaattaaatctctctgtgtagccctaatttaatctaccttcgcttactgtctcttcgtccttgctctctgcaccttcagcacaagatggcatcagagaagaaattagcgaaccccatgagggaaattaaggttcagaagctcgtcctcaacatctctgttggtgagagcggcgatcgtcttactcgtgcggctaaggtgttagaacaacttagtggtcaaaccccagtcttttccaaagcaaggtatactgttaggtcctttggaatcaggcgtaacgaaaagattgcttgctacgtcaccgtgagaggagacaaagcaatgcagcttctggagagtggtttgaaggtgaaggaatatgagcttttgaggaggaacttcagtgacactggttgcttcgggtttggtatccaggagcacattgatcttggtatcaagtatgatccatcgacaggtatctatggtatggatttctttgttgtattagaacgccctggctaccgtgttggtcgtcgtcgcagatgcaagtcccgtgttggaattcagcacagagtaacgaaagaggattcgatgaagtggttccaggtcaaatacgagggcgtcattctcaacaagtcccaaaacattggagcttaaaaaggcaagcttatacttttagtttatcatcttcgtttctggacttgtcacttgtttacttggtgtctgtattggggtttgagatatttcatggtaagttttggggtattgattcattattgtatgattcgtttttgctgcaatcttttattatttatcattccattcggaccaaattttgagttttaagttaactggagaaaaaagccgaagagggccaatagaattggtgcgttacgtaccagagcatactgtttccgaacctgctcttgggcgcctaaagagggcctaggagccattttctttctgcattcaatggaaaccaatttaattaccttcaaaaagaataattaagatagaatatttcttgtttttatttttccaaaaaaaaaggacacttgaacattctaccataattcttactattgagtcattaattactttatcacgtatgaa

SEQ ID NO: 4652 - DNA, 826 bp, Tropaeolum majus
tctttcttcttcttgctccaaatttttgtagctctctgtcgatcaatccctactatggcttccgagaagaagttagctaacccaatgagggagattaaggttcagaagcttgttctgaacatctccgtcggtgaaagcggagatcgtctcacccgtgcggctaaggttttggagcaactcagtggacaaactccagttttctccaaggcaaggtacactgttaggtcttttgggatcaggcgtaatgagaagattgcttgctacgtgaccgtcaggggagacaaggcgatgcaacttctagagagtggtttgaaggtcaaggaatacgagctcttgaggagaaacttcagtgacactggatgcttcggttttggtattcaggaacatattgatttgggtatcaagtatgacccctcaaccggtatttatggaatggacttctttgtggttttggagcgcccagggtaccgtgttggcagacgtcgcagatgcaagtctcgtgttggaattcagcacagagttaccaaggaagactcaatgaagtggttccaagtcaaatatgaaggtgtcatcctcaacaagtctcagaatattggagcttagataagatccatatttttgctgtttaagatttttcttttaactagaatattaaagtaacttcttttttgaggatatttatttaacgttgtttagattgttttgatactatcaaacatattgaaagacagtttatttgtttacttgtgccaatatgagttttgaccgttagaataaacacctcaaactatcatctaaagggataataaatgcatcttttgaatct

SEQ ID NO: 4653 - DNA, 820 bp, Citrus sinensis
caaaaaccctagtgtatgtaactcaacatcactcttgcatattagggtttgttccgtctccgtcttcgtcttcactgagcagcggcagtaactcatcatcagcaaacccgaatggcttcagagaagaaactttcgaaccccatgagggaaattaaggttcagaagcttgtgctcaacatctccgttggtgaaagtggagatcgtctcaccagagccgctaaggtgctggagcaactcagtggacagacacctgttttctccaaggccaggtacactgttcggtcttttgggatcagacgtaatgagaagattgcatgctatgtgactgttagaggtgacaaggcaatgcagcttttggagagtggattgaaggtgaaggaatatgagcttctgcgtcgaaatttcagtgacactggctgttttggctttggtattcaagagcatattgatcttggaatcaagtatgatccttccactggaatttatggtatggatttctttgtggttctggagcgcccgggttatcgtgtaggtcgacgccgtaggtgcaagtctcgtgttgggattcagcaccgtgtcacgaaggaagatgcaatgaaatggttccaggtcaaatacgaaggtgtgatcctcaacaagtcccagaatattggtgcttaagccctttgtgtgatgacgattttgcatttatagtgttgatgtttgtagacactggctattacttggcgttttgcaaacctgagttagatgcttttggtagttcaagatattttgttatttgtctatttaaattttattatcaagattatggcttagctgc

SEQ ID NO: 4654 - DNA, 968 bp, Prunus mume
tctgaggcagcccaaatcagaaataaaaaccctagctcactcatcgctcacatcgtctctccccctatatttgtattgccttctccgagtttctgctgcttcgccttctctacacactctcataccacaatggcgtcggagaagaagctggcaaatcccatgagggaaatcaaagtccagaagctcgtcctcaatatctctgtcggagaaagtggtgatcgactcaccagagccgccaaggtcttggaacaactcagtggccaaacccctgtcttctccaaagctcggtacacggtgcgatccttcggtatcaggcgtaatgagaagattgcctgctacgtgactgtgagaggcgacaaggcaatgcaacttctggagagtggactgaaggtcaaggaatacgagctcttgcgcaggaacttcagtgacaccggctgcttcggcttcggtattcaggaacatatcgatcttgggatcaagtatgacccttcaactggtatctatggcatggacttttttgttgttttagagcgcccaggataccgtgttggtcgtcgtcgcagatgcaagtcgcgtgttggaattcagcacagggttaccaaggaggatgcaatgaagtggttccaggtcaaatatgaaggggtcattcttaacaagtcccaaaatattgttaactagacagatctactagtcttggatattttgttttagttttggcaagctgctactttctacaaatttctatgtatcaggagttagtatctccattaaagagatgtgccagtaattttgatcttgaaaacttgatgatgtcctcttttttcgactcttgttgcttatatggagcagccgttatttctgtcagcaaattttagtttgctttgtgaccattttgttactcatctgtcttattatttgttgccaatatcaaatggcttattgaaatctgattgataggcttgattttt

SEQ ID NO: 4655 - DNA, 1009 bp, Prunus persica
atgaacctcggtttaaggaccaagaatcccgcaagctcatctgagggttcgagctcctggaagcccacaagtatagttgggctacatccgacccaaaaggctcgggttcaaatctgggttctgaggcagcccaaatcagaaataaaaaccctagctcgctcatcactcacatcgtctctccccctatatttgtattgccttctccgagtttctgctgctccgccttctctgcacactctcataccacaatggcgtcggagaagaagctggcgaatcccatgagggaaatcaaagtccagaagctcgtcctcaacatctctgtcggagaaagtggtgatcgactcaccagagccgccaaggtcttggaacaactcagtggccaaacccctgtcttctccaaagctcggtacacggtgcgatccttcggtatcaggcgtaatgagaagattgcctgctacgtgactgtgagaggcgacaaggcaatgcaacttctggagagtggactgaaggtcaaggaatacgagctcttgcggaggaacttcagtgacaccggctgcttcggcttcggtattcaggaacatatcgatcttgggatcaagtatgacccttcaactggtatatatggcatggacttttttgttgttttagagcgcccaggataccgtgttggtcgtcgtcgcagatgcaagtcgcgtgttggaattcagcacagggttaccaaggaggatgcaatgaagtggttccaggtcaaatatgaaggggtcattcttaacaagtcccaaaatattgttaactagacagatctactagtcttggatattttgttttagttttggcatgctgctactttctaccaatttcaatgtatcaggagttagtatctccattaaagagatgtgctagtaattttgatcttgaaaacttgatgatgtcctcgtgtttcgactcttgttgcttatatggagcagccattattactgtcagcaaattttagtttgctttgtgacca

SEQ ID NO: 4656 - DNA, 772 bp, Platanus occidentalis
tcccccaaatcccccacccaacctccatagcagacagccatggcttcggagaagaagctgtccaacccaatgagagagatcaaggtacagaagctcgtgctcaacatctccgtcggagaaagcggagatcgtcttaccagagccgccaaggtgttggagcagctgagtggccaaacccccgtgttctcgaaagctaggtacactgttcgatcgttcggtatcagacgtaatgaaaagattgcgtgctatgttaccgtcagaggtgacaaggcgatgcagcttctggagagcggattgaaggtgaaggagtacgagctcgttgaggaggaacttcgagtgataccggctgtctttggcttcggctattcaggaacatattgatctcggaatcaagtatgatccttcgactggctatttacggtatggacttttatgtcgttctggaacgtccagggtaccgtgttggtcgtcgacgcaggtgcaagtctcgcgttgggatccagcacagggtcacaaaagaggatgcaatgaagtggttccaggtcaaatacgagggtgtgatcctcaacaaatcccagaacatcacaggttgagagattccttaggccagtttcaagttttggcaagttcaagttactgttttttgttgttctctgtagacgtggagtcataatttcctttttgtttttctaattattttgagctatagcagtattagtttcactggttgtgatcatgttatgacatctttaagttgattttagctgtgagg

SEQ ID NO: 4657 - DNA, 860 bp, Arachis hypogaea
actcactctcaatttccttagcagccaaactgcgcaacatcgtccctccccaaagctcttccaccaatggcttcggagaagaaactttcgaaccctatgagggagattaaggttcagaagctcgttctcaacatctccgtcggtgagagtggcgatcgtctcactagagccgctaaggtgctcgagcaactcagtggtcaaacccctgtcttttccaaagcaaggtacactgtccgttcctttgggattagaagaaatgagaagattgcttgctacgtcaccgttagaggcgacaaggccatgcagcttctggagagtggtttgaaagtgaaggaatatgagctcttgagaagaaacttcagtgatactgggtgctttggctttggcattcaggagcacatcgatttgggaatcaagtatgatccatcaactggtatttatggaatggatttcttcgttgttctagagcgcgctggatatcgtgtgggacgtcgccgcaggtgcaagtcacgagttggtattcagcaccgtgtcacaaaggaggatgccatgaaatggttccaggtcaaatacgaaggagtgatcctcaacaaggcccagactattgtttagttttccttgttttacttagctatttcagatctttttgtgtgtccctccttttgcttagagcctcttttactcagttaccttgtttcgtttcattttatttactatatggctttgtttttggcacctggaacactcatggggtcccaagagatatttccaaaagcgtgggtactttatctattgaagaagctagaaaggttaatattagtaagaggtgcaatgatagctaacttagtaatgatgtataa

SEQ ID NO: 4658 - DNA, 957 bp, Cicer arietinum
gtcatttaaatcgataaaaagctaaaaaccctaatagcgggttgtttccacctcgaatccaatccaacgatatatgagtgagtgttgccgcctcatcactcatcactcactccttcttccacctctcgctccgtttctctacacctacagttattccaaatggcttcggagaagaaactgtcgaatccaatgagggaaatcaaagttcagaaactcgttctcaatatttccgttggtgaaagtggagatcgtctcaccagagccgccaaggttcttgaacagcttagtggtcaaacccctgttttctccaaagctaggtacactgtccgttcctttggtatcagaaggaatgaaaagattgcttgctatgtcactgttagaggtgacaaggcaatgcagcttttggagagtggtttgaaggtcaaggagtacgagttgttgaggagaaacttcagtgataccggatgttttggctttggtattcaggagcatattgatttgggaatcaagtacgacccttccactggtatctatggtatggatttctatgttgtcttggagcgtcctggatatcgtgttggacgtcgtcgccgatgcaaggcacgtgttggaatccaacatcgtgtcacaaaggacgatgccatgaagtggttccaagttaaatatgaaggtgtgatcctaaacaagtcgcaggcaattgtttagttgaatcaggccattcttaagtacgagttctaaattttgttgagtgtagtttgatgttttttgaatctgtaacttatttcttcactggtatgaatgttactctctacatgttacttaagctgtttgtttactttttcttctaaatatcattaaattttgacatcaatactgatttgcgagaccactgatttagttttgttttaatctatctattcatcgaatatgttccacctctggaattggtgttttgaa

SEQ ID NO: 4659 - DNA, 1016 bp, Cicer arietinum
ataaaataaggggtattatagtcaatgtacataaaaaccctaaccctattcctcgactcatattctctttcatcctccgacctattttcgttgcttctctcaacaaactcgtccaatcccaatggcttcggagaagaaactttcgaaccccatgagggaaatcaaggttcagaaactcgtccttaacatctccgttggtgaaagtggcgatcgtctcaccagagccgctaaggtgttggaacagctcagtggccaaaccccagtgttttcaaaagcaagatacactgtccgttccttcggtattagaagaaatgaaaagatcgcatgctatgtcactgttagaggtgacaaggcaatgcagcttttggagagtggtttgaaggtgaaggaatatgaactgctgagaagaaactttagtgatactgggtgttttggctttggtattcaggagcatattgatttaggaatcaagtatgatccttcaactggtatttatggaatggacttctatgttgttctagagcgccctggttatcgtgtgggacgtcgtcgtcgttgcaaggctcgtgttggaatccaacatcgggtcacaaaggacgatgctatgaagtggttccaggtgaaatatgaaggtgtgatcctcaacaagtcacaggcgattgtttagttatataggctaaatttcttaattataatatgatgtttaaatttattgaacatttttgtgtctggttatatggactgtgtaaaggtatttctaatcctttatttttgttgtctcaattatggattgaatattctaagttttgcattcatctatgtttggagaacatgtttaaaattcttgcattttcttttggatttatggtcttttgagggtgtaatctcgtatgtttacgctggtagtccaaacatttagtgtcgtttaagctatttatgtgtaaatttgatattgcatttgggtttaatatataaccacatttatatggagaaattgagatagtcaattgaagggc

SEQ ID NO: 4660 - DNA, 940 bp, Cicer arietinum
tgctctttcaccctccaaaaatactttcgttgcttctctctgccgctgtgctcaacaaattcttccaatcccaatggcttcggagaagaaactttcaaaccccatgagggaaatcaaggttcagaaactcgtccttaacatttccgttggtgaaagtggcgatcgtctcaccagagccgctaaggtgttggaacaactcagtggccaaaccccagtgttttcaaaagctagatacactgttcgttcctttggtattagaagaaatgaaaagatcgcatgctatgtcactgttagaggtgacaaggcaatgcaacttttggagagtggtttgaaggtgaaggaatatgaactgctgagaagaaactttagtgatacagggtgttttggatttggtattcaggagcatattgatttaggaatcaagtatgatccttcaactggtatttatggaatggacttttatgttgtcctggagcgccctggttaccgtgtgggacgccgtcgtcgttgcaaggcccgtgttggtatccagcatcgagtcacaaaggatgatgctatgaagtggttccaagtgaaatatgaaggtgtgatcctcaacaagtcacaggcgattgtttagttatttaggctaattgacaaagcaatttgcaagttttgttaattataatatgatgtttcttaaatcggtagttttaaatttcttgaacatttgtttcttatatggactattttaaggtatttatttcttatcctgtattttattgtcttaattatgaattgaatattataaattttgcattcaactatgtttgaagaacatatttagaaattcttgcatttttctcttcaatttcaggtcttttgagggtgtgtaatcccatatatctataagcttttaatatttgactagtttttgccattagaaattgaatttgcagaa

SEQ ID NO: 4661 - DNA, 810 bp, Vigna unguiculata
ccttcactctgccgctgcaaaagcactactctctgcgcgggattccacaccattccgtcaacaatggcctccgagaagaaactctccaatccgatgcgagaaatcaaagtgcagaaactcgtcctcaacatctccgtcggcgagagcggcgatcgtctcactcgcgctgccaaggtgctcgaacaactcagtggccaaacccctgttttctccaaagcaaggtacactgtgcgttcctttgggattagaagaaacgagaagatcgcgtgctatgtgacggtgcggggtgacaaggcgatgcagcttttggaaagtggtttgaaggtgaaggagtacgagcttctgaggaggaacttcagcgacactggctgctttggcttcggcattcaggagcacattgatttgggaatcaagtatgatccttctactggtatttacggaatggatttctttgttgttttggagcgtcctggctatcgcgttggacgacgccgtcgatgcaagtctcgtgttggaatccagcaccgtgtgacaaaggacgatgccatgaagtggttccaagttaaatatgaaggtgtcatcctaaacaagtcccagaatatttagtttttatcagcaactgttgttcattaccctttcttgttctttttttcaattattagtgccggatcttatttttacaagtcactagctgtttgacaattttttttcaatatcattaaattttgacatctatatttaccatccggatgaaattgaattgcatgtgtaatgttttaatattttagcttcatttgatcttgctattgt

SEQ ID NO: 4662 - DNA, 798 bp, Vigna unguiculata
tctctgcgcgggattccacaccattccgtcaaaaatggcctccgagaagaaactctccaatccgatgcgagaaatcaaagtacagaaactcgtcctcaacatctccgtcggcgagagcggcgatcgtctcactcgcgctgccaaggtgctcgaacaactcagtggccaaacccctgttttctccaaagcaaggtacactgtgcgttcctttgggattagaagaaacgagaagatcgcatgctatgtgacggtgaggggtgacaaggctatgcagcttttggaaagtggtttgaaggtgaaggagtacgagcttctgaggaggaacttcagcgacactggctgctttggcttcggcattcaggagcacattgatttgggaatcaagtatgatccttctactggtatttacggaatggatttctttgttgttctggagcgtcctggctatcgcgttggacgacgccgtcgatgcaagtctcgtgttggaatccagcaccgtgtgacaaaggacgatgccatgaagtggttccaagttaaatatgaaggtgtcatcctaaacaagtcccagaatatttagttttaatcagcaactgttgttcattaccctttcttgttcttttcttcaattattagtgccggatcttatttttacaagtcactagctgtttgacaattttttttttaatatcattaaattttgacatctatatttaccatccggatgaaattgaattgcgtgtgtaatgttttaatattttagcttcatttgatcttgctattgtaaaaaaaaaaaaaaaa

SEQ ID NO: 4663 - DNA, 776 bp, Cucurbita pepo
tcagcaacagcaacaccccagccgcagcagcccgcctgaagactccaatggcttcggagaagaagttgtcgaaccccatgagggatattaaggtgcagaaactcgtcctcaatatctcagtcggtgagagtggagatcggctcaccagagctgctaaggtgcttgagcaactcagcggccagagccccgtgttctccaaagcgagatacactgtacgatcgtttggaatcagacgtaatgagaagattgcttgctatgtcaccgttagaggcgacaaggcgatgcagcttttggaaagtggactgaaggttaaggagtacgagttgcttcgcaggaacttcagtgacactggttgctttggctttggtattcaggagcacattgatcttgggatcaagtacgatccatccactggtatctatggtatggatttctttgtggtcttggagcgaccaggataccgtgttggacgtcgcaggaggtgcaagtctcgtgtcgggatccagcacagagtcacaaaggaagatgccatgaagtggttccaggtgaaatatgagggtgtgattcttaacaagtcacagcaaatagtctaagagttataaaattttgtggttttgtaagcctgactgaagctctttgttttgtttcctttgaatgtttctgggatttaatggagatttttaggataaatttggagaactctgttagtcatatgtttgattagttatatcctttgtgacctgagaattaagctatcaatctacctggtttttatt

SEQ ID NO: 4664 - DNA, 827 bp, Glycyrrhiza uralensis
gacctccctctctcactcacctcttccatccatattagtgagttacgcctcctcacacacttcattctggtgctgccgcaaccgcgcctctctctgtctctcattgtgactgtgtgtggaattccaattccaattccaaatggcttcggagaagaaactgtcgaatccgatgagggagatcaaagtgcagaagctcgtcctcaacatctccgtcggtgaaagcggagatcgtctcaccagagccgccaaggtcctcgaacagcttagtggccagacccctgttttctccaaagctagatacactgtccgttcctttggtattagaaggaatgagaagattgcgtgctatgtcactgttagaggcgacaaggcaatgcagcttttggagagcggtttgaaggtgaaggaatatgaactgctgaggagaaatttcagtgatactgggtgttttggcttcggtattcaggagcatattgatttgggaatcaagtatgatccttctactggtatttatggaatggatttctatgttgtcttggagcgccctggttatcgtgtgggacgtcgtcgtcggtgcaaggctcgtgttggaatccagcaccgcgtcacaaaggaggatgccatgaagtggttccaagttaaatatgaaggtgtgatcctaaacaagtcccagaatattgtttagatcagagactatttttcaagtgcgagttctaaattttgttgattgtagtttgatgtttcttgaatcagtagcttaaatttctgccttggtatgaatattactttcagtttttgtaagctttttgttgactccccccgccccg

SEQ ID NO: 4665 - DNA, 744 bp, Glycyrrhiza uralensis
aaactcaccccttcaatattagtacctcactctgctgccgcaaccgcgcctctctgtttctcactgtgactctctgtggaattccaaatccaattccaaatggcttcggagaagaaactgtcgaatccgatgagggagatcaaagtgcagaagcttgtcctcaacatctccgtcggtgaaagcggagatcgtctcaccagagccgccaaggtcctcgaacagcttagtggacaaactcctgttttctccaaagctagatacactgtccgttcctttggtatcagaaggaatgagaagattgcttgctatgtcactgttaggggcgacaaggcaatgcagcttttggagagcggtttgaaggtgaaggaatatgaactgctgaggaggaatttcagtgataccgggtgttttggcttcggcattcaggagcatattgatttgggaatcaagtatgatccttctactggtatttatggaatggatttctatgttgtcttggagcgccctggttatcgtgtgggacgtcgtcgccggtgcaaggctcgtgttggaatccagcaccgcgtcacaaaggaggatgccatgaagtggttccaagttaaatatgaaggtgtgatcctaaacaagtcccagaacattgtttagatcagactatttctcaagtgctagttctgaattttgttgattgtagtttgatgtttcttgaattagtagcttaaatttctgcgttggtatgaatattac

SEQ ID NO: 4666 - DNA, 1069 bp, Arachis hypogaea
accccttttattcagcagtctaactcacgcactctcaattcccttagcagccaaactgcgcaacatcgtccctccccaaagctcttccaccaatggcttcggagaagaaactttcgaaccctatgagggagattaaggttcagaagctcgttctcaacatctccgtcggtgagagtggcgatcgtctcactagagccgctaaggtgctcgagcaactcagtggtcaaacccctgtcttttccaaagcaaggtacactgtccgttcctttgggattagaagaaatgagaagattgcttgctacgtcaccgttagaggcgacaaggcgatgcagcttctggagagtggtttgaaagtgaaggaatatgagctcttgagaagaaacttcagtgatactgggtgctttggctttggcattcaggagcacatcgatttgggaatcaagtatgatccatcaactggtatttatggaatggatttcttcgttgttctagagcgcgctggatatcgtgtgggacgtcgccgcaggtgcaagtcacgagttggtattcagcaccgtgtcacaaaggaggatgccatgaaatggttccaggtcaaatacgaaggagtgatcctcaacaaggcccagactattgtttagttttccttgttttacttagctatttcagatctttttgtgtgtccctccttttgcttagagcctcttttactcagttaccttgtttcgtttcattttatttactatatggctttgtttttggcacctggaacactcatggggtcccaagagatatttccaaaagcgtgggtactttatctattgaagaagctagaaaggttaatattagtaagaggtgcaatgatagctaacttagtaatgatgtataattataaggactaactatatttgtttaatgacattgaaggaagatagtggtgcagttgaagatggttttagatctttagttactaatgctatcaaatcctcaaatgttaccagtaagcaactacaccactatcttcgatgaatgtgattatgtccacgggagaattgatcagggttacggaact

SEQ ID NO: 4667 - DNA, 1133 bp, Trigonella foenum-graecum
aaagcttcagatttaggggtttattcatataactcgtaatccctaacccttcttcatctctgccgccgcaacacttcaatccaatggcttccgagaagaaacttgcgaacccaatgagggagattaaggttcagaagctcgttctcaacatctccgtcggtgagagtggagatcgtctcaccagagccgccaaggtgctggaacaacttagtggccaaaccccagtgttctcaaaagctaggtacactgttcgttcttttggaatcagaagaaatgagaagattgcatgctatgtgactgttagaggtgacaaggcaatgcaacttttggagagtggtttgaaggtgaaggagtatgaacttctgaggaggaacttcagtgatactgggtgcttcggatttggtattcaggagcatattgatttgggaatcaagtatgacccctcaactggtatttatggaatggatttctttgttgttctggaacgtcctggttatcgtgtgggtcgtcgccgcagatgcaaggcccgtgttggaattcaacaccgtgtcaccaaggatgatgcaatgaagtggttccaggtgaaatatgagggagttatccttaacaagtcccaggcaattgtttagtcaaaccgagttctcttaggagtatgttactgtttttggcaactatagtttggtctctcttggacgatgtcttaattctcaagagtatgttactgttttttgcaactatagtttggtctctcttggacaatgtcttaattttcaggccgattttaaatcactgtttttatgatatttttatttttatgttttatgatgaagcacatgttaaatgaaacctccagtaaaacaaggcaacaattggtgttatttttgtggcttccaagtttataattctggacatcccctccgtcctgcgttgaaaacagttattcaagcaaaactagtcttgtaaaattgtttaccaaatctaccaataatttgctcatctttgttagtaaccgtgtgatttaaggttagaaattgtttttcctctgttattggacttttgtaatctttttgtttttgggtggctctaatttaattgtaaaaacaacttctgcacttgaaatgtttgtgactagt

SEQ ID NO: 4668 - DNA, 986 bp, Citrus clementina
caaaagccctaaatcgctcaccgagtctatcttagctgctgcctctgttcttgtcatcagcccctccgcgctcagcaagcagcaatggcgtcagacaagaagctgtcgaatccaatgagagaaataaaagtgcaaaagctggtcctcaacatctccgtcggtgaaagtggcgatcgtctcacacgtgcggccaaggtcctcgagcaactcagtggacaaacccccgtcttctccaaggcgagatacactgtgaggtcattcggaatcaggcgtaacgagaagattgcctgttacgttacggttagaggagacaaggcaatgcagcttctggagagcggtttgaaggtcaaggagtacgagctcctgcggcgtaacttcagcgataccggctgcttcggcttcggtattcaggagcacatcgatctcggaatcaagtacgacccctccacaggtatttatggcatggacttctttgttgtccttgaacgccctggataccgtgttggtcgtcgccgcagatgcaagtctcgcgttggcatccaacatagagttacaaaggaggatgccatgaaatggtttcaagtgaaatatgaaggagttatccttaacaagtcccaaaacattggtgcttaaggcgatctttgaaacctgttgagtttttttttcccccttaagttttgggcggctgcccgatttttgtttattagaatctatattttcctttagagttttgagttggtggattttttaagtacaaattgccgtggttgccctgttcttttattagaataatggtaaaggcaatgatttttcttttgaaaatttcatttaagttcttttacccagtacaatgacctgttattgcaaatggcttgtttgtcatcagcggtagcattctagcagttgttgctaaaatccttaacaataaaactctttgcactaataaattttcatgttctgtcatttaaatataaagacaagtagac

SEQ ID NO: 4669 - DNA, 727 bp, Trifolium pratense
ttcactactgccgcagccgcaacaattccaaatccaatggcttccgagaagaaacttgcgaacccaatgagggagattaaggttcagaagctcgtcctcaatatctccgtcggtgagagtggagatcgcctcaccagagccgccaaggtccttgagcaacttagtggccaaactccagttttctccaaagcaaggtacacggttcggtcctttgggattagaagaaatgagaagattgcatgctatgtcactgttagaggtgacaaggcaatgcaactcttggagagtggtttgaaggtgaaggagtacgaacttctcaggaggaacttcagtgataccggatgtttcggctttggaattcaggagcacattgatttgggaatcaagtatgatccttcaactggtatttatggaatggatttctttgttgttctggagcgccctggctatcgtgtgggtcgtcgccgcagatgcaaggcccgcattggaattcaacaccgtgtcacaaaggatgacgcgatgaagtggttccaggtcaagtatgagggtgtcatacttaataaatcccaggcaattgtttagttaaaccgagttatcttaggagtatgttaccgtttttggcaacaatagtttggtttcttctggacaatgtcttaattttcaggcaggttttgaatcactgtttttatgatattttatgttgttttattaagcacacggattacct

SEQ ID NO: 4670 - DNA, 767 bp, Liriodendron tulipifera
cttcgttccaacctcctgcccgtcgaaaagctgttctgcccttaccttcagagaaagacatggcttcggagaagaagttgttgaatccgatgagggagataaaggtgcagaagctggtcctcaacatctccgtcggagagagcggagatcgtcttaccagagctgctaaggtcttggaacagctgagtgggcaaacaccagtgttctccaaggcaaggtacactgttcgatcctttggcatcaggcgtaatgaaaagattgcatgttatgtcactgttaggggggacaaggcaatgcaactattggagagcgggttgaaggtgaaagaatatgaactgttgcgaaggaacttcagtgatactgggtgttttggctttggtatccaggaacatattgatcttggaatcaagtatgatccttcaacgggcatttatggtatggacttctttgtagttcttgaacggccagggtaccgtgtgggccgccgccgcaggtgcaagtctcgtgttgggattcagcaccgtgtcacaaaggaggatgccatgaagtggttccaagtcaaatacgagggcgtcatccttaacaagtcccaaaatatcaccggctagatgtcacgactctccagcccaatcttgagtcgtgcagctccatttttgcttttttcttcttccgtgcagactaggacctggaattcacttctttatcgttttcagataatcttgatatcatctgtgctgctggcagtatagctattttcatggtttcgt

SEQ ID NO: 4671 - DNA, 977 bp, Citrus sinensis
caaaagccctaaatcgctcaccgagtctatcttagctgcctctattcttgtcatcagcccctctgcgctcagcaagcagcaatggcgtcagacaagaagctgtcgaatccaatgagagaaataaaagtgcaaaagctggtcctcaacatctccgtcggtgaaagtggcgatcgtctcacacgtgcggccaaggtcctcgagcaactcagtggacaaacccccgtcttctccaaggcgagatacactgtgaggtcattcggaatcaggcgtaacgagaagattgcttgttacgttacggttagaggagacaaggcaatgcagcttctggagagcggtttgaaggtcaaggagtacgagctcctgcggcgtaacttcagcgataccggctgcttcggctttggcattcaggagcacatcgatctcggaatcaagtatgacccttccacaggtatttatggcatggacttctttgttgtccttgaacgccctggataccgtgttggtcgtcgccgcagatgcaagtctcgcgttggcatccaacatagagttacaaaggaggatgccatgaaatggtttcaagtgaaatatgaaggagttatccttaacaagtcccaaaacattggtgcttaaggcgatctttgaaacctgttgagttttttttttcccttaagttttgggcagctgcccgatttttgtttattagaatctatattttcctttggagttttgagttggtggatttttttaagcacaatttgccgtggttgccctgttcttttattagaataatggtaaaggcaattatttttcttttgaaaatttcatttaagttcttttaccctgtacgctgacctgttattgcaaatggcttgtttatcatcagctgtagcattctaccacctgttgctaaaatccttaacaataaaactctttgcactaataaattttcatgtgctgtcatttaaatataaagacaa

SEQ ID NO: 4672 - DNA, 912 bp, Plantago ovata
cggccgggggcttctatatcgcaccaaaacccctctccccttgagctgctgccgccgcaacctcaccgcaatggcctccgagaagaaattgtcgaaccctatgagggagattaaggtacagaagcttgttcttaacatctccgtcggagagagcggagatcgtctcaccagagccgctaaggttttggaacagctcagtggccaaactcctgttttctccaaggcacgatacactgttcgttcttttggaattaggcgtaacgaaaaaattgcatgctatgtaactgtaaggggtgagaaggcaatgcagctccttgaaagtggattgaaggtcaaggagtatgaactgttgaggaggaacttcagtgatactggctgctttggatttggcatccaggagcacattgatcttggaatcaagtatgatccatccactggtatctatgggatggatttctttgttgttttggagcgcccgggctacagagtgggacgtcgccgtaggtgcaagtcccgtgtgggaatccaacacagagtgaccaaggaagattcaatgaaatggtttcaggttaagtacgagggagtaatcctgaacaagtcatccaacattggagcttagagtgttagttgaatcttgttgaactcttatgcatcttgctgtgctagattcattgctttttgaccttgaggattttggtcctttggactattttgttatacatcacttgtaccctcttcatgtgatcattttggatcctagtttttctgtttagtatctctcattatttaatttaccaatgccatactattaatatctgcttattatgaagttatcatcatcgaatatcttgaaaagatttgactacttatggataaaagtaaaacactcgagagatccatttgttctagtcg

SEQ ID NO: 4673 - DNA, 875 bp, Platanus occidentalis
cctctccgcttcccccaaatcccccacccaacctccatagcagacagccatggcttcggagaagaagctgtccaacccaatgagagagatcaaggtacagaagctcgtgctcaacatctccgtcggagaaagcggagatcgtcttaccagagccgccaaggtgttggagcagctgagtggccaaacccccgtgttctcgaaagctaggtacactgttcgatcgttcggtatcagacgtaatgaaaagattgcgtgctatgttaccgtcagaggtgacaaggcgatgcagcttctggagagcggattgaaggtgaaggagtacgagctcttgaggaggaacttcagtgataccggctgctttggcttcggcattcaggaacatattgatctcggaatcaagtatgatccttcgactggcatttacggtatggacttttatgtcgttctggaacgtccagggtaccgtgttggtcgtcgacgcaggtgcaagtctcgcgttgggatccagcacagggtcacaaaagaggatgcaatgaagtggttccaggtcaaatacgagggtgtgatcctcaacaaatcccagaacatcacaggttgagagattccttaggccagtttcaagttttggcaagttcaagttactgttttttgttgttctctgtagacgtggagtcataatttcctttttgttttttcaattattttgagctatagcagtattagtttcactggttgtgatcatgttatgacatctttaagttgattttagctgtgaggaactgagaatggatgtttgttattttatacctggggttaatatgtacctgaagctcgagcttaaatttcgagtactcatatcacatgaatgtcatcac

SEQ ID NO: 4674 - DNA, 740 bp, Platanus occidentalis
caacctccggccattccctctctctagtctctattgctcactggcaatatggcttcagagaagaagctatctaacccaatgagggagattaaggtgcagaagctcgtcctcaacatctccgttggagagagcggagatcgtctcaccagagccgccaaggtcttggagcaattaagtggccaaacaccagtgttctcaaaggcaaggtacactgttcgatcatttggcatcagacgtaacgaaaagattgcctgttacgtcactgtcaggggtgataaagcaatgcagcttctggagagtggattgaaggtgaaggaatacgagcttctgaggaggaatttcagtgatactggctgctttggcttcggtattcaggaacacattgatctcggaatcaagtatgacccttcgactggcatctacggtatggacttctacgttgttctggaacgcccaggttaccgtgtgggccgtcgccggaggtgcaaatctcgtgttgggatccagcacagggtcacaaaggaggatgccatgaagtggttccaggtcaaatatgagggtgtgattcttaacaaatcccagacaatcacaggttagagagatccgatacatccttaggccaattttaagtttgacaagctcaggttactattaggttgtttcaagccgaagaggagtcatgacactaattttttcccaagaattttgaggaataccagtagcatttatgttttaacagt

SEQ ID NO: 4675 - DNA, 992 bp, Primula obconica
gccgataaaatcgccggcgaaacaaatagactaagaggtggtatttgggaaagaggggaatctcaacttctgaagagtttcattttcttttcggccgtaatgaccattacggccgaaaatatacagttagctcgccccttcactctcatagatacagaaatggcgtcggagaagaagctatcgaacccaatgagagagattaaagttcagaaactcgttctcaacatctccgtcggtgagagcggcgatcgtctcacccgcgccgccaaggttttggagcaactcagtggccagaccccagttttctccaaggctaggtacactgttagatcctttggcattaggcgtaatgagaagattgcttgttacgtgactgtgagaggtgacaaagcaatgcagcttctagaaagtgggctgaaagtgaaggagtatgagctgctgagacgtaacttcagcgacactggctgctttggatttggtattcaggagcacatcgatcttggcatcaagtatgatccgtcaactggtatttacggaatggacttttatgtggtgcttgaacgtccaggataccgtgtgggccgtcgccgtaggtgcaaagcacgtgtcgggatccaacacagagttaccaaggaagattccatgaagtggttccaagtcaagtacgaaggagttatccttaacaaggctcaaaccatcggttgatcaggaacaatcccacctttcagtgtgtaattttttaagttttaacatgagaaatgttgttgcccttttttttttaaacctggatctatattttgcagtttcgaaggggtcttggaaactagattttgttaattaagtttttatgtttgagacatctgctagctttttactcaactttaagtcgcctgatttggcattttgaattcatgtcttaatatgggtttcgattgatttctatcttttcctgaatggaaaatcaatgtattgttattaaagtcttacaaact

SEQ ID NO: 4676 - DNA, 947 bp, Fragaria vesca
acactgagccacccttatatttacacaccatctctgagcttcggctgctctgcctcctctaccaaccaacccaagccttcaccaatggcgtcggagaagaagctcgcgaaccccatgagggaaatcaaggtccagaagctcgtcctcaacatctccgtcggcgagagcggcgatcgcctcaccagggccgccaaggtcttggagcaactcagcggccagacccctgttttctccaaagcgcggtacactgtgaggtctttcgggatcaggcgtaacgagaagattgcgtgctatgtgactgttaggggagataaggcaatgcaactgttggagagtgggttgaaggtcaaggagtatgagcttttgcgtaagaacttcagtgacactggatgctttggatttggtatccaggagcatatcgatcttggaattaagtatgacccttccaccggtatctacggtatggacttctttgttgttcttgagcgcccagggtaccgtgttggccgtcgtcgcagatgcaaggcccgcgttggaattcagcacagagttacaaaggatgatgcaatgaagtggttccaagtgaaatatgagggagtcatccttaacaagtcccaagcaattgtttaggcagatcccgtaatcttggagatattttgttttggttttggcaagctgttactttcttccagtttcagtgtatcagacgttatttccttttctttaagactatgtaagagtatttttgatcttaagaacttggtgaccttgcgtgtttcaactgttgtgacatacgaggaagcagataatatttatcttagtttcatttttagaaccagcttttgtcaaatgtggttgctttatgatctgatggttgttacaccagataccactttgctaccgaacatgtgtttgtgaatctactctcatctggtgagcatggatgc

SEQ ID NO: 4677 - DNA, 1004 bp, Panax ginseng
gccttgcctcccacgactcgttattttacttattccgtgaatcggaagcggggcactgccctctttttagaccaaaggctcgcttgcggccgatccgggcggaagacattgtcagtgggagaacctataaaatttattatttgttatatttgaggatgtataggcaagtgctcaaagcctgaactggattctaaaactaccatagaatgccaaacacagttacacaattaataagcaagccagtacatagtacagcagaaattatcctaaaatcgctgtgaaaaaaacatccgcctctagagaaaacatgactgcatctattcaaaacatgacttaatatgcattgctggtctaaaaagcacaaaacttggcttgtaattatccaatctgatcccacaacattcaattaacccccaatattctgggacttgttaaggatcacaccctcgtatttgacttggaaccacttcattgcatcctcctttgtgaccctgtgctggattccaacacgagatttgcatctacgacgacgtcccacacggtaaccaggacgttcaagtacaacaaagaaatccataccataaatgccagttgaagggtcatacttaattccgagatcaatgtgctcctggataccgaaaccaaagcagccagtatcactgaagttcctcctcagcaattcgtattccttcaccttcaacccgctctccagaagctgcattgccttgtctcccctcactgtgacgtagcaggcaatcttctcattacgcctgatcccaaaagacctcacagtataccttgctttggagaaaacaggggtctgaccactgagttgttccaggaccttagaggctctagtgagtcgatctccactctcccccacagaaatgttgagtacgagtttctggaccttgatctctctcatcgggttcaatagttttttctctgaagccatggcgatttcccgggtggtaaagttggcagctgcaaggggtgggaaaatg

SEQ ID NO: 4678 - DNA, 899 bp, Panax ginseng
aaagcagtggtatcaacgcagagtacatggggcattttcccaccccttgcagctgccaactttaccatccgggaaatcgccatggcttcagagaaaaaactattgaacccgatgagagagatcaaggtccagaaactcgtactcaacatttctgtgggggagagtggagatcgactcactagagcctctaaggtcctggaacaactcagtggtcagacccctgttttctccaaagcaaggtatactgtgaggtcttttgggatcaggcgtaatgagaagattgcctgctacgtcacagtgaggggagacaaggcaatgcaacttctggagagcgggttgaaggtgaaggaatacgaattgctgaggaggaacttcagtgatactggctgctttggtttcggtatccaggagcacattgatctcggaattaagtatgacccttcaactggcatttatggtatggatttctttgttgtacttgaacgtcctggttaccgtgtgggacgtcgtcgtagatgcaaatctcgtgttggaatccagcacagggtcacaaaggaggatgcaatgaagtggttccaagtcaaatacgagggcgtgatccttaacaagtcccagaatattgggggttaattgaatgctgtgggatcagattggataattacaagcctagttttgtgctttttagaccagcaatgcatatttagtcatgttttgaatttttgcagtcatgttttctctagaggcggatgtttttttcacagctattttcggataatttctgctttactatgtactggcttgcttattaattgtgtttggcattctatggtggttttagaatacagttcaggctttgagcacttgcctatacatcctgaaaataacaaataaataaaatt

SEQ ID NO: 4679 - DNA, 731 bp, Acacia harpophylla
gggtttctgactttctgtactcctctcattctgtctctcggccgctgcaattcctatcagggtccaattccaatggcttcagagaagaaattgtcgaacccaatgagggaaatcaaggtccagaagctagttctcaacatctcagtcggtgagagtggagaccgtctcacccgtgctgccaaggtgcttgagcaactcagtggccaatccccagtattctcgaaagcaaggtatactgttagatcctttgggattagaagaaatgagaaaattgcatgctatgttactgttagaggtgacaaagcaatgcagcttttggagagtggtctgaaggtgaaggaatacgagcttctaaggcgaaactttagtgaaactgggtgttttggctttggcattcaggagcacattgacttgggaatcaagtatgatccttcaacaggtatctatggtatggacttttttgttgtactggaacggcctggttatcgcgttggccgccgtcgtaggtgcaaggctcgtgttagtattcagcatcgtgtcacaaaggaagatgccatgaagtggtttcaggtgaaatatgaaggtgtgatccttaacaaatcccaggccattgttggttagacctgagactcaagaattcatcacagtgagtcaagttttgtttattgcagtctattattgatattacttggactatcagccgaagttactattaggacgagaattaatca

SEQ ID NO: 4680 - DNA, 781 bp, Persea americana
gctagggtttctttcttctctcccggcttctttcagtcagcttttccataagcagagcgagcaatggcggcagagaagaagctctcgaatccgatgagggagatgaaggtgcagaagctggtcctcaacatctccgtcggggagagcggagatcgcctcaccagagccgccaaggtcttggaacaactgagtgggcaaactccagtattctccaaggctaggtatactgtccgatcttttgggatccgacgtaatgaaaagatagcttgttatgtcacggtaagaggtgacaaggcaatgcaactcctggaaagtgggctgaaggtgaaagagtatgagttgctgcgaaggaatttcagcgatacggggtgctttggctttggtattcaggagcatatcgatcttggaatcaagtatgatccttcaacgggtatttatggcatggatttttatgttgttctggagcgccctggttatcgggtgggccggcgccgccgttgcaaatcccgtgttgggattcaacacagggtcacaaaggaggatgccatgaagtggttccaggtcaagtacgagggtgttatcctgaacaaggctcagaatattggagcgtagaatctccaacgttagtggtttctctctgctgtgttgctttcccccccagttagtgtggaccataaattttgcctgtctttttctgttaagatttggtttatggtgcttttgtaccttaatgttgaatgatcttttacgggttatttgcagatagaaagctgcatttaga

SEQ ID NO: 4681 - DNA, 1335 bp, Cannabis sativa
gtgaaaatttcttttttttgctaaggcagaggagagtgctttagatcagcccaataaggctcaattatagcccaaagagtattacagcccaaaacaataagatgacatattcctcccttaaatgacgattttgcccaccctacttgaagtggcccatcaaaaccctagctccatatcatagtatacataatacacatattagggtttctctcatctctaacttcttctccctctctttccagttcaccctcctcgccgctgcaacttcagagacaccgaaatggcctcggagaagaagttatcgaaccccatgagggaaatcaaggtccagaagctcgtcctcaacatttcagttggtgagagtggagatcgtctcaccagagctgctaaggttttggagcaactcagtggacaatcaccagttttctccaaggcaaggtacactgttagatcatttggaatcaggcgtaatgaaaagatcgcatgctatgttacagtcaggggtgacaaggcaatgcagcttttggaaagtgggttgaaggttaaggagtatgagcttcttaggaggaacttcagtgatactggatgctttggtttcggtatccaggagcacattgatcttggaatcaagtatgatccttccactggtatttatggaatggatttctttgttgtcttggagcgtcctggttaccgtgtgggccgtcgtcgccgatgcaagtcacgtgttggaatccagcaccgtgtcaccaaggatgatgccatgaaatggttccaggtcaaatatgagggtgtgatccttaacaagtctcagaatatcaccggttaaataggcctttagtgttgtggaacttgcttttatgtatttgagatattagataatgttttgtttaccattttattgcaattttgagtttggcaaaactagaagttatgatttcaggacgaaatggtaatttttttgttgttcttgcagtataatttactcttgacaatcttttaaacaaatagtttttcttttttaattaaatgcccattgaatttttatggtgagtataagctgccagattagaactcgtggttccttcatttccttgtgattttagtaagtaagaccttagtaataatagcattctaaggttgataatttgggtttgtttaaactacaagagtttgatgagttcgtcttctgtttttgttgacattttcaaaaaacatatttatcgttttttttaatagaaaattaccatttgttgaaccaatacaattggaaccaagacgatataactagatagagctgcattagaaatcaaaaatcatacccaacaacattaa

SEQ ID NO: 4682 - DNA, 1063 bp, Ricinus communis
tttttttccattttattaaacaaaattgacacttatttctatttctcagcgtaagggtattactgtaattttcaaccacataccagcctcgcgttacaaaaccctagcccctgctcgtattaaagaaccctaacacttgttacacctttctttacccactcttctcttcgctccgtgcaaatcgccgccaccaaccagcaacaatggcttcggaaaagaagctatcaaaccctatgagagagattaaggttcagaagctggttctcaatatctccgtcggtgaaagtggtgatcgtctcactcgtgccgccaaggtgctcgagcaacttagtggtcaaaccccagtcttctccaaggctaggtacactgttagatcttttggtataaggcgtaatgaaaagattgcttgctatgttaccgtaagaggagacaaagctatgcagctccttgagagtggtttgaaggttaaggaatacgagcttttgaggaggaactttagtgacactggttgctttggttttggtatccaagaacacattgatcttggtatcaagtatgacccttctactggtatctatggtatggacttctacgttgttctggagcgcccaggttaccgggtgggccgtcgccgtagatgcaagtcacgtgttggaattcagcacagggttaccaaggaagatgccatgaagtggtttcaggtaaaatatgaaggtgtcatcctgaacaaggcccaaacaattggagcttagagtttgttggttatgttcaagttttggcgagttatatttggcaggacccttttttttcttttttatgttctttgggttgtaactgttgaagggaatttttgaattggtagaatttggattacttttttgctcatcttactattataacagtttatgctttaattatatatttcactagtagattaacataaagtccttgcagtattttcaacctatttcaattgtgaaatatagctttggcagtaccgtagcttgctgttttcatttgattattgcaattgccaacttagtagaagatgcatgcgggtcgg

SEQ ID NO: 4683 - DNA, 849 bp, Castanea mollissima
cacaagtgctcctcttgccttcctctctcgtctgccgcttcaatctcttctcaactacacaaatggcttccgagaagaaactgagtaacccaatgagggaaatcaaagtgcaaaagcttgtcctcaacatctccgttggtgagagtggtgatcgtctcaccagggccgccaaggtcttggagcagctcagtggccaaaatccagttttctcaaaagcaaggtacactgtgaggtcctttggtatcagacgtaatgaaaagattgcatgctatgtcactgttaggggtgagaaggcaatgcaacttttggagagcggtttgaaggtgaaggaatatgagctgctgcgaaggaactttagtgatactggatgttttgggtttggtattcaggagcacattgatttgggaatcaagtatgatccttcaaccggtatttacgggatggacttctttgttgtactggagcgccctggttaccgtgttggccgtcgtcgcaggtgcaagtctcgtgttgggatccagcacagggtcacaaaggaggatgccatgaaatggttccaggtcaaatatgagggtgtgatcctcaacaagtctcagaatatcacaggttaataggcatggaagattttgacgtaggttgttatgtagaccagtgtttactattattatctttctttttccagttttgggagagcttgggataatgttttctgggacaaaatctgttaattttttgctcctttatatattttcagcagtttcagctgacatctgaatcactatcaagatagttatgttcagacaattagtttttctatgataatgagtattttgtgttttggcttttaaa

SEQ ID NO: 4684 - DNA, 937 bp, Gossypium hirsutum
agtacataggggagataaaccctagaaagccctaaattcttctcttttaaactcgcatctataacgcagctgccattttcgtaactctacccccgctgctctcaaccccttccgcttcgccatggcatcagagaagaagctttcgaacccaatgagggagatcaaagtccagaaacttgtcctcaacatctccgtcggtgagagcggcgatcgtcttacacgtgccgccaaggtcttggaacagctcagtggtcaaaccccagtcttctccaaggctagatacactgtgagatcttttggaattcggcgtaatgagaagattgcttgttatgtgactgtgaggggggagaaagctatgcagcttcttgagagtggtttgaaggttaaggaatatgagcttttgaggaggaacttcagtgatactggctgctttggattcggtatccaagagcacattgatcttggtatcaagtatgacccttcaactggtatctatggtatggacttctatgttgttctcgaacgagctgggtaccgtgtgggtcgtcgtcgcaggtgcaagtcacgtgtcggtattcagcaccgagtcaccaaggaggattccatgaagtggttccaagtcaaatatgaaggtgttatccttaacaagtctcaaaatatcggggcataggaatagccaggtaaacaagatcaatcgagttgtttttaagatttttgctacttgatattggttttaagtttgtgtatcagttgtagtttggctgaagagatttgtgaaatgctaaagtaattttgctgttggattaaatggcttcatttaatatagcacttggaaaatacaatgtctattcaaataatttgagctagtgttaaaaataaagtcataacatttgagagagccaaaaaaaaaacaaacgacccacgagcacaggaggag

SEQ ID NO: 4685 - DNA, 726 bp, Cyamopsis tetragonoloba
cattgttctgccgccgcatcggagctacctgttaccctccaattccaatggcttcagagaagaaactttcgaaccctatgagggagatcaaagttcaaaagctcgtcctcaacatctccgtcggtgaaagtggtgatcgtctcaccagagccgccaaggtgctggagcaacttagtggccaatccccagtgttctccaaagcaaggtacactgtgcgttcctttgggattagacgtaatgaaaagattgcttgctatgtgactgttagaggtgacaaggcaatgcaacttctggaaagtggtttgaaggtcaaggagtacgaacttcttagaaggaacttcagtgatactggatgcttcggctttggcattcaggagcatattgatttgggaatcaagtatgatccttcaactggcatttacggtatggatttctatgttgttctggagcgccctggttatcgtgtgggacgtcgccgaagatgcaagtcccgtgtgggaattcagcacagggtgacaaaggaggatgccatgaagtggttccaggtgaaatacgagggagtgatcctcaacaaggcccaaacaatagttggttaggccgagttccctttaggagtgtattaccagttttatcaactgtttgatctttctgagataggatcttattctcgaacatattttgattcttaccttcttatcatttcagttgtgatgaagcatatggatt

SEQ ID NO: 4686 - DNA, 945 bp, Eucalyptus grandis
ttggccttctctcgagcgctctcacctccccgccgccgccgccgccgcccctcgcttctgctgccgccgctgccgccgctgtgtgacgttccaatggctgcggagaagaagctgtcgaaccccatgagggaaatcaaggtccagaagctcgttctcaacatctccgtcggcgagagcggagatcgcctcaccagagccgccaaggtgttggagcagctcagcggccagagccctgtcttctccaaagctaggtacaccgttcgttcttttggaatcaggcgtaatgagaagatcgcatgttatgtgactgtaaggggtgaaaaagcaatgcagcttctggagagtggtttgaaggttaaggaatatgagctgctgcgaaggaacttcagtgacactggttgcttcggttttggtatccaggagcacattgatcttggtatcaagtatgacccttcgactggtatttatggtatggacttctatgttgtgctggaacgacctggttatagagttggccgtcgtcggaggtgcaagtcccgtgttgggatccagcacagggtcaccaaggaggacgccatgaagtggttccaggttaaatacgaaggtgttatccttaacaagtcccagaatatcaccggctaagttcttagattctaagaagtctgttcgccttccctttatatgttgaagtcctaaattaggatattgccttcatttttgctcgggaacaggtgttttaatgtatcggttttgcttgggaagactttgtttttgtgtcacctcttttcattgtttgacacacatttatgttgtagtccttgtcgctccatgtccaagaggatctcttttcgcaaaagtagaacctgtagctgtgggaaaaaaggccgaacgagctatttttgcatcgggttctgctagtatttcttagtccacgggcgtgctaag

SEQ ID NO: 4687 - DNA, 880 bp, Fraxinus spp
gatagtaatcaggcttttatatattcttcctccaccgctactttcattttgccaccttaactaatcaaccagcgccgccgtcatctacccgccactccaccgctatggcgtcagagaagaagctgtcgaatcccatgagagagatcaaggtacagaaactcgttctcaacatttccgtcggcgagagtggagatcgtctcaccagagccgctaaggtcctcgaacagctcagtggccaatcccctgttttctccaaggcaagatatactgtgaggtccttcgggatcagacgtaacgaaaagattgcatgctatgtcacagtcaggggtgacaaagcaatgcaactccttgagagtgggttaaaggtcaaggaatatgaactgttgagaagaaactttagcgacactggctgttttggctttggtattcaagagcacattgatcttggaatcaagtatgacccttcaactggtatctatggtatggacttctttgtagtcttggagcgccctggttaccgcgtggggcgtcgtcgtaggtgcaagtcacgtgttggaatccagcacagggtcacaaaggaggatgcaatgaagtggttccaggtgaaatatgaaggtgttattctcaacaagtcctccaacattgcaagttagtttgatagcactgttggactatcctatcaaagctttatagtcttcatttcctagaccaggatttgttactttttgagcaaaaacttttggagaactacttttgtgtgttttgcagacgagttgattttttctcggaggttaatttagttgtattattatcagtgaaaatggcttttaaatgtgatggcaatggcaatcactggcatgctttgagcttaacgaaaccg

SEQ ID NO: 4688 - DNA, 953 bp, Gossypium raimondii
tttttatttaaaaaataaaggacaaagttgtaaaatcggagctgagataaaaccctagaaaaccctaaattcttctcttttaaactcgcatctataacgcagctgccattttcgtaactctacccccgctgctctcaaccccttccgcttcgccatggcatcagagaagaagctttcgaacccaatgagggagatcaaagtccagaaacttgtcctcaacatctccgtcggtgagagcggcgatcgtcttacacgtgccgccaaggtcttggaacagctcagtggtcaaaccccagtcttctccaaggctagatacactgtgagatcttttggaattcggcgtaatgagaagattgcttgttatgtgactgtgaggggggagaaagctatgcagcttcttgagagtggtttgaaggttaaggaatatgagcttttgaggaggaacttcagtgatactggctgctttggattcggtatccaagagcacattgatcttggtatcaagtatgacccttcaactggtatctatggtatggacttctatgttgttctcgaacgagctgggtaccgtgtgggtcgtcgtcgcaggtgcaagtcacgtgtcggtattcagcaccgagtcaccaaggaggattccatgaagtggttccaagtcaaatatgaaggtgttatccttaacaagtctcaaaatatcggggcataggaatagccaggtaaacaagatcaatcgagttgtttttaagatttttgctacttgatattggttttaagtttgtgtatcagttgtagtttggctgaagagatttgtgaaatgctaaagtaattttgctgttggattaaatggcttcatttaatatagcacttggaaaatacaatgtctattcaaataatttgagctagtgttaaaaataaagtcataacatttgagagagccattataatggtttggttaa

SEQ ID NO: 4689 - DNA, 862 bp, Humulus lupulus
gcctccatatcatagtatacataatacacatattagggtttctcccatctcgaacttcttcttcctttcatttcagttcaccctcactgcggctgcatcctcagagacaccgaaatggcctcggagaagaagttatcgaaccccatgagggaaatcaaggtccagaagctcgtcctcaacatttcagttggtgagagtggagatcgtctgaccagagctgctaaggtgttggaacaactcagtggccaatcaccggttttctccaaggcaaggtacaccgtgagatcctttggaatcaggcgtaatgaaaagattgcatgctatgttaccgtcagaggtgacaaagcaatgcaacttttggaaagtgggttgaaggttaaggagtatgagcttcttaggaggaacttcagtgataccggatgctttggtttcggtatccaggagcacattgatcttggaatcaagtatgatccttctactggtatttacggaatggacttctttgttgtcttggagcgccctggttaccgtgtgggtcgtcgtcgccgatgcaagtcacgtgttggaatccagcaccgtgtcaccaaggatgatgccatgaaatggttccaggtcaaatatgagggtgtgatccttaacaagtcacagaatatcaccggttaaataggccttcagtatttgtggaactagttttatggatttgagatattagataacgttttgtttaccattttattgcaattttgagttttgggaaaactagaagtaatgttgatgatttcaggacgaaatggtaattttttttgttgttcttgcaatataatttacgcttgacaatctttatgaaatagttaccctttct

SEQ ID NO: 4690 - DNA, 880 bp, Humulus lupulus
cctccagggcctcatcatcattctcaactagacacctcacttccccagattcatagcaatcacatgcccaatcagccaatatcatttgagcatcatcctctacattttcttcaacattcttcctgcaacatatcaactccaacaacagaatgccatagctgtatacatccacctttgctgttacagccaagtttctaaaccattcaggggctacatatcctttggttcctctaattccatcattacggccgaaatatctcgaacttcttcttcctctcatttcagttcaccctcactgcggctgcaacctcagagacaccgaaatggcctcggagaagaagttatcgaaccccatgagggaaatcaaggtccagaagctcgtcctcaacatttcagttggtgagagtggagatcgtctgaccagagctgccaaggtgttggaacaactcagtggccaatcaccggttttctccaaggcaaggtacactgtgagatccttcggaatcaggcgtaatgaaaagattgcatgctatgttaccgtcagaggtgacaaagcaatgcaacttttggaaagtgggttgaaggttaaggagtatgagcttcttaggaggaacttcagtgataccggatgctttggtttcggtatccaggagcacattgatcttggaatcaagtatgatccttctactggtatttacggaatggacttctttgttgtcttggagcgccctggttaccgtgtgggtcgtcgtcgccgatgcaagtcacgtgttggaatccagcaccgtgtcaccaaggatgatgccatgaaatggttccaggtcaaatatgagggtgtgatccttaacaagtcacagaatatcaccggttaaataggcct

SEQ ID NO: 4691 - DNA, 844 bp, Humulus lupulus
ataatacacatattagggtttctcccatctcgaacttcttcttcctctcatttcagttcaccctcactgcggctgcaacctcagagacaccgaaatggcctcggagaagaagttatcgaaccccatgagggaaatcaaggtccagaagctcgtcctcaacatttcagttggtgagagtggagatcgtctgaccagagctgctaaggtgttggaacaactcagtggccaatcaccggttttctccaaggcaaggtacactgtgagatccttcggaatcaggcgtaatgaaaagattgcatgctatgttaccgtcagaggtgacaaagcaatgcaacttttggaaagtgggttgaaggttaaggagtatgagcttcttaggaggaacttcagtgataccggatgctttggtttcggtatccaggagcacattgatcttggaatcaagtatgatccttctactggtatttacggaatggacttcttcgttgtcttggagcgccctggttaccgtgtgggtcgtcgtcgccgatgcaagtcacgtgttggaatccagcaccgtgtcaccaaggatgatgccatgaaatggttccaggtcaagtatgagggtgtgatccttaacaagtcacagaatatcaccggttaaataggccttcagtgtttgtggaactagttttatggatttgagatattagataacgttttgtttaccattttattgcaattttgagttttgggaaaactagaagtgatgttgatgatttcaggacgaaatggtaattttttttgttgttcttgcaatataatttacgcttgacaatctttatgaaatagttaccctttctaa

SEQ ID NO: 4692 - DNA, 1207 bp, Actinidia deliciosa
tcgccgcccgcattgttcttctcctccaacccaaaaggctcttcggaatcagcaatggcgtcggagaagaagctgtcgaacccaatgagggagatcaaggttcagaagctggttctcaacatctccgttggcgagagcggagatcgtctcacccgcgccgccaaggttttggagcaactgagtggccaaacccccgtcttctccaaggcaaggtacactgttcggtcctttggcattaggcgtaatgagaagattgcatgctatgtgacggtcaggggtgaaaaagcaatgcagcttcttgagagtgggttgaaggtgaaggaatatgagctcttgcgccgtaacttcagcgacactggctgcttcgggttcggtattcaggaacacatcgatcttggcatcaagtatgacccttcaactggtatttatgggatggacttctatgttgtgctagaacgccctgggtaccgtgtgggtcgtcgccgtagatgcaagtcccgtgttggaatccagcatagagttacgaaggaggattcgatgaagtggttccaggtcaaatacgagggagtgatcctcaacaaagctcaaaacattggagcttgaagaatccttttcatcctttgattggtacttcaaagttttggcaacctggtttttcatttgctgttttctaaattgggagtggtatcgcatatttatgccttggtttagttcattcacgtctgcaaacttgtagctttctaacattggattaaagatgatcattttctggtttcagttgttgatttggttcatttgattccagtagctggctgctgatttatatcttttgcgtctgtagcatgacactgctcactgtacaatgcaaacactagtgccagaaatattacaaccaccaatgacattatagaactaattgatggcagaatcgccaagaacaatctgattcaactgaccttttacaacagccttaatggatttgtatgaagttactacgtcacaataacatgcacacaaacaccaactctgtgtgcgtgcgtgtatcattttccatgataccaattgaaggttagcataacaagggcaaaaattggaaacaaccattcatttcattttcgtcctttttgtacatcccaaaaagcaaaactcataaaagtacaaactctcttacatttttatagtgctgcagattctttgatctttctct

SEQ ID NO: 4693 - DNA, 913 bp, Momordica charantia
tgtcctattacggccgggggagaagcagtagcaggaacagcgcaacagccgcagccgcccgctaggattccccaatggcttcggagaagaagttatcgaaccccatgagggacattaaggtgcagaagctcgtcctcaatatctcagtcggcgagagcggagatcggcttacaagagccgcaaaggtgctcgagcaactcagtggacagagccccgtgttctccaaagcgagatacactgtacgatcttttggaatcaggcgtaatgagaagattgcttgctatgtcaccgttagaggtgagaaggcgatgcagcttttggaaagtgggctgaaggttaaggagtacgagttgttgcgaaggaacttcagtgacactggatgctttggctttggtattcaggagcacattgatcttggaatcaagtatgatccctccaccggtatctatggtatggacttctttgttgttttggagcgaccggggtaccgtgttggccgccgtaggaggtgcaagtctcgcgttgggatccagcacagagtcacaaaggaggatgccatgaagtggttccaggtgaaatatgagggtgtgattcttaacaagtcgcaggcaatcactggttaagccctagagggatttcccaaatagtttgagagctatttgtgtgcaagttataaaattttgtgcttttgaaattagcctgactgaagctccttgttttcttttcttgaatatttttggggtttaatggagattattagtttcaatttggacaactttttttaagccgtcggtagtcatgttttagtaattatatccttcaatactctgagatatcaatcttcttcgttcttattccttaaagcatcagcttcaagcaccgtttgtctgtgacattcttattgctgatatta

SEQ ID NO: 4694 - DNA, 781 bp, Momordica charantia
gaaaagccctgaaaccctcatctcctttccttcgtctgctgtggccgtcactctacctcggcagattcaaccgacgatggcttcggagaagaagctttcgaaccccatgcgcgatattaaagtccagaagctggttcttaacatttccgtcggcgaaagcggcgatcgtctcaccagagccgccaaggtgcttgaacaactaagtggccaaacccccgtcttctcgaaagcccgttacaccgttcggtcttttgggatcaggcgtaatgagaagatcgcgtgccatgtgacagtgaggggcgaaaaggcaatgcaacttcttgaaagtggtttgaaggttaaggaatacgaactcttgcgcaggaacttcagtgatactggctgctttggttttggtattcaggagcatattgatctcggaatcaagtatgacccttctactggtatatatggtatggacttctttgttgttctagaacgtccaggttaccgtgtagggcgtcgacgtcgatgcaagtcacgtgttggaattcagcatagagtcaccaaagaggattcaatgaagtggtttcaagttaaatatgaaggtgtcatccttaataagtctcaaaacattactggctagattaccctcaactttggtggctttacaggtttttgtagtctctttgtttttttattggaatttactttaaggttgaagacattgattattttttacctgtattcttgagactgaaaaaaaaaacttcattctaatggaaattttattatcttgcga

SEQ ID NO: 4695 - DNA, 953 bp, Mimulus guttatus
gcccaaaacaaaaccctagcacccctcacaattcttcatcacttcatatagggtttgcatctcatttccccaagaccctccgccgctgcgtctccgccgtcaaccaccgccaactaccgctccgccatggcgtcagagaagaaattgtcgaacccgatgagggagatcaaggttcagaagctggttctcaacatctccgtcggtgaaagcggcgatcgtctcaccagagctgctaaggtgttggagcaactgagtgggcaaacccctgttttctccaaggcacgatacactgttcgatcattcggtatcaggcgtaacgaaaagattgcatgctacgtcacagtcagaggtgacaaggcaatgcagcttctcgaaagcggcttgaaggtgaaggaatacgaattgctgaggcgcaatttcagcgatactggatgttttggtttcggtatccaggagcatattgatctcggaatcaagtacgacccttctacgggtatctatggtatggatttctatgttgtcttggagcgacctggttatcgcgtgggccgccgccgtaggtgcaagtctagagttggaatccaacaccgtgtcactaaggaagactcgatgaagtggtttcaggtgaaatacgaaggtgttattctcaacaaggcaaccaacatcggaacttaatttccttattatttatatatattttttccaacggtccgaatttttccgctcgaagttttgtagaattctattggttgttcttgagcgacaattttatttgcgtgctgtgacgatctttgaatttttggcaggactaatattttgttgttctttttattcgattaaagtagctattgaattctactgtggtgttcgtcatgataatggtgattgattttattagtcgaacgtttataattattcgtagaaggtcaatttaattaaaaattttatcaaca

SEQ ID NO: 4696 - DNA, 961 bp, Mimulus guttatus
cgcctctattctcattttctctgagaaaccctcactcaatcagccggcggccggacctcccacaacctcgacaccatggcatcggagaagaaactctctaacccaatgagagaaatcaaggttcagaagctcgtcctcaatatctccgtcggcgagagcggcgatcgtctcaccagagccgctaaggttttggaacagcttagtggccaaacccctgttttctccaaagcgaggtacactgtgcgttcttttgggatcaggcgtaacgaaaaaattgcatgctacgtcacagtgaggggtgacaaggcaatgcagctcctggagagtggactgaaggtgaaggagtatgaactattacgaagaaacttcagcgatactggttgctttggttttggtatccaagagcatattgatctcggaattaagtatgacccttcgacgggtatctatggtatggacttctatgtggtgttggaaaggccaggttacagagtcggaaggcgccgtaggtgcaagtctcgtgtcgggatacaacacagggtcacaaaggaagattcgatgaagtggttccaggttaaatacgaaggtgttatcctcaacaaagccacaaacatcggcacttaatttaatgttgcattttatcctcgttcggcacaccatatcagcttatttagttatagaccgaccttcttgcattacattatatggatatgccttttagtactacttttttgtttttacctcaactgttttctgaacgagttgttataactattttaaggggtttaatttggatttactggcaatttttatccctatgttaccgaaattgtttgcgattgcggttgatgctcaatctttacgaagaatttgattctggtttttgaatcagttgtttctgtgtttgtctgaagattcaagaatgaaggttactttgatcttgaaataggtctcaagttgc

SEQ ID NO: 4697 - DNA, 876 bp, Elaeis guineensis
ctcccttccgccgagagccgcccgccctccatccatagagcttcgccgctgctttcagtgcgatggcgtcggagaagaagctatcgaacccgatgagggagatcaaggtccagaagctggtgctcaacatctccgtcggagaaagcggcgatcgcctcacccgcgcggccaaggtgttggaacaactgagtgggcaaactcctgtgttctctaaagccaggtatactgttcggtcttttgggatccggcgcaatgaaaagattgcttgttatgtcactgttagaggtgagaaggcaatgcaactgcttgagagtgggttgaaagtgaaggaatatgagttgctgagaagaaattttagtgatactggatgtttcggctttggaattcaggagcacattgacctgggaatcaagtatgatccttccacgggcatatatgggatggatttcttcgtggtattggagcgtcctggctacagagttggtcgccgccgccgctgcaagtctcgtgtgggaattcagcacagggttacaaaggaggatgccatgaagtggttccaagtgaaatatgaaggtgtcatccttaacaaggcccaggcgaccactcaatagatatatcgtttaatagactttttgaaggatccatctatttcctgcctttctagcttggctgtttgaattagtgattttgctaggtggcttctttttgaggacgttgttgttggtataacactatttttgagtcagttacataggaatgacatggattaagagtaatattttctgggctgtagtgaaaaaagagattgttctggattataaaaaaaaaactaagtagacgtagccaacggacgacacaacgggaggtagcgccccc

SEQ ID NO: 4698 - DNA, 967 bp, Citrullus lanatus
ggctacttcaacccatattagggtttcttcgcccctccctctgattgagtagcagcaccaacaccagcaacacccaagccgcagccacccgccagaacactccaatggcttcggagaagaagttatcgaacccaatgagggatattaaggtgcagaaactcgtcctcaatatctcagttggtgagagtggagatcggctcaccagagctgctaaggtgctcgaacaacttagcggccagagccctgtgttctctaaagcaagatacactgtacgatcgttcggaatcagacgtaatgagaagattgcttgctatgtcaccgttagaggagacaaggcgatgcagctcttggaaagtgggttgaaggttaaggagtacgagttgcttcgtaggaactttagcgatactggatgctttggctttggtattcaggagcacattgatcttgggatcaagtatgatccatccaccggtatctatggtatggacttctttgttgtcttggagcgaccaggataccgtgttggacgtcgcaggaggtgcaagtctcgcgttgggatccagcacagagtcacaaaggaggatgccatgaagtggttccaggtgaaatatgagggtgtgattcttaacaaatcacagcaaatcactggttaagcttccgagggttttcccaaatagtcttgagagttatttgcgtgcaagttataaaattttgtgcttttgaaattagcctgactgaagctctttgttttattattttctttgaatatttttggagtttaatggagattattaggatcaatttgaagaactctttaagctgttggtagtcatatgttttattaattaaatccttcgtgacttgaaaaaagaattaagacatcaatctttactttgtttttctttgtttaagcatcagtttcaagcccttttttttgtttgaattgattgtcacgttaggaacttaa

SEQ ID NO: 4699 - DNA, 870 bp, Panax ginseng
catagatggcctgattcgctaagcacataaccaaaaccctatttatacttccacttagggtttctcccttcccattttcccaccccttgcagctgccaactttaccacccgggaaatcgccatggcttcagagaaaaaactattgaacccgatgagagagatcaaggtccagaaactcgtactcaacatttctgtgggggagagtggagatcgactcactagagcctctaaggtcctggaacaactcagtagtcagacccctgttttctccaaagcaaggtatactgtgaggtcttttgggatcaggcgtaatgagaagattgcctgctacgtcacagtgaggggagacaaggcaatgcagcttctggagagcgggttgaaggtgaaggaatacgaattgctgaggaggaacttcagtgatactggctgctttggattcggtatccaggagcacattgatctcggaattaagtatgacccttcaactggctatttatggtatggatttctttgttgtacttgaacgtcctggttaccgtgtgggacgtcgtcgtagatgcaaatctcgtgttggaatccagcacagggtcacaaaggaggatgcaatgaagtggttccaagtcaaatacgagggtgtgatccttaacaagtcccagaatattgggggttaattgaatgttgtgggatcagattggataattacaagccaagttttgtgctttttagaccagcaatgcatattaagtcatgttttgaatagatgcagtcatgttttctctagaggcggatgtttttttcacagcgattttaggataatttctgctgtactatgtactggcttgcttattaattgtgtaactgtttggcatt

SEQ ID NO: 4700 - DNA, 657 bp, Fraxinus spp
attggttaagggttattcacttcatcattttcccactcgtccggcggccctgaacctcctcaccaccactgcaccgccatggcgtcagagaagaagctgtcgaacccaatgagagagattaaaagtacagaagctcgtcctcaacatctccgtcggtgagagtggagatcgtcttaccagagccgctaaggtcttagagcaactcagtggccaatcgcctgttttctctaaggcaagatacaccgtgaggtcctttgggatcaggcgtaatgaaaagatcgcatgctacgtcacagtcaggggtgacaaagcaatgcagcttcttgagagtggcttgaaggtcaaggaatatgagttgttgagaaggaatttcagcgatactggatgttttggctttggcattcaggaacacattgatcttggaatcaagtatgacccatcaactggaatttatggtatggatttctacgtcgttttggagcgcccaggttaccgtgtgggccgtcgtcgtagatgcaagtctcgtgttggaatccagcacagggtcacaaaagaggatgcaatgaagtggttccaggttaaatatgagggagttatcctcaataagtcgtcaaacattaccaattagtttgaattcagtactagacatgtttgaga

SEQ ID NO: 4701 - DNA, 9398 bp, Vitis vinifera
gtttcttcatctccagtttcgctgcggctgcgtcctcacagctcagtactccgatggtctcgctctttagatttcaaagtctcttccttgtgttggattgtgttgtttttttttttttttcttcatctggaatgggggcgggcttcagagaagaaacactcaaacccaatgagggacatcaaggaccagaagctcgtccctcaacatctccatcggataaggtggagatagtctcaccagagctaccaagataccttttttccccctcggtcttgtttcgttctacgtcgtttcccttcttgaaatgtcatcttcttggttcccttttttcttttttttttttcgtttttacagatcctggaacaactcagtggctaaaccactgttttctctaaagactagacgaattgattattgtttgggaaattgctaatcaccataaagttatcgaggatactcttgtgatatattttgcccatctaaaacaaggattaatgttcaagtgttgacaattttggggttttgtaggattaatgttcaaggggatggggaaggcgatggtggttgagaaaaggtgcagaagattcgtccggcaagcactacatgcactgcatttgcagcatctgagggatggaagtcatcccaaaacgcatactagtcaagaattgctgcatagctttgagtgaggcaaaacatattgagattattgtttgaagaaattgatttatgtgtgatatttgatgataatatcatgtgcaccaataaaaaatatgaattagcgttttgggattgtaagaagcaaaatttgatcgcactatctattgtggaagtcaagtacattgccactagattgtgtcgtgtacaaattgtttagatgaaacaaattttaagtgattttgggttgttgtttgctcttgtgcatataaaatgtgataatacaagtgccattaatatctctaaaaatatggttcaatattctagaactaagtacattgagagaagatatcattttcttagagatcatgtatgaaagggagacattaccttagaatttgtaggtagtaaagatcatttgaataatatttttgcaaaacatctaagtgaaatcattttattgaaactaggagagaattagggtaattaagctttgaattggtatggatcatatgccttctttgtattgataatatgatatctatcattatgtctatgaatgttaattttaatttcttatgcctcattataggatctactttaattcataattgcatttttataagtcattcatagcaaggtcaacttttgacggaaattaaaatccctaaggcaatttaacatcaaaattagggataaattattaacaaataggcaagcgcaggtcgtttgacaaaaacctaagaattttcaaggagttaattgattttgactcaatagtcgagccaacaacctaattgatcgatcaattcgttgaatggttagatattaaaagttaaaaccctcctgtgatcattcatcttccttccattcctcattctttctccaaggtaaaccctattcgcttattccccatcgtgttccatctctaaatccctctgcctttcatttttttcaagccctaatcgcacaccctcttcccctcactctcatttctcatcccttgttccttttcttgagcttttattgtgaccagccctcatgactccaaggagagcgactataaagagaagcatccaactgagactaactaaggtggtgtttgtttttttggctttgtgctgaaagcaatttagttttagaatttaggttgtttgtttttctactttttcatgacttattataaactttttattaaaaagaaaaaaccaaaatatgtaactttttttaaatagaaaaaataacatattgatttttttactttttaatacttaatagaaataaaatactacaaaaacaaataacctaatatttaatattattaagcattaaagttctatttagaattaagtaaaaaaacaaacaccacctaagactaaggcatggaggaaagccaggtttgacacctagagcttcaaattttgtaaaggactaccaaaaatttacaatagttttcttgtctcaaaaagtgattccagggagagagatcaattttcactagctttcctactttcatttgagaaccagtcttctatttgtttaataaccataaaaaatagtttcctaatttaaaaagaaaaactaaaacaaaaaaataaaaaataaaaaatctaattacaattgataatcagattttctaacgtataaaatttcagggcaagtgacctattggcaatcataaacatcataaataaagggaaacaaataatattatttttcctcaagttattataaaaaatcattgtttctttttgtaaaaaaatttatgggagtcttcaaaatataaaattttatttttaaaaaatagaggatatttttatgaagacaaactttaacatttagaaaaataggatagaggtttttttttttttttaaaattaatttcgagagtatattattttataaataagaaattaattgactattaattattatttggtatcttgattgagagtatttttaatataaaaaattaaatttttattaattattaaagctcccatatatatatatatatatatatatatatatatatatatatataaattgttattaaaaatgaaaattataaaccaatcatttgatttgatatttcatagttataaaaaatgtaaaattccaatagtaaaatataacttcgctatataagagtaagagtatttttaagggaaaagtgggttttgggctttgacggagcaatgatacgtagaaaagtagttaaaaacttaaaactaatggaaattataaagaggaaaatataagcaaaatatttggttgtgaatatttttataaccaagaaaaattaaggttgagagagtaaatatgacaatgtgataagtttttttgggcatctctcccgtcctgaatgagacaaatttaaaatttaaataaacatgttagagacggatttaagattttttttttaaaaattacggcgagtttattgtttatatataaaattaatttaatttaaattttcttttcctatttgtaatatataatcataataataataataataatacttttcaataaaataatttataaaaactaaaatattttaattatttagaaaatatatttattctaatataattaaaaaatttttaaaataattttaaaaaatttaaaaacagttaaacaggctagtattagaaatttgcatattcatttgtcatctatttaatttttttaatgagaccgagataagaattattttaaataaataggatgaattttagatgaaaattattttgaatagataggagagttaggatgatgacaagtcgttttgaacttgtcatccctatgagagggtgcatccaacatattattagagaattttagtaaatatattatttaaatttttttataaaatgtataaaatatatattaaagaataaaaaataaaataataaatttttttgaaaaaaataaaattttactaaatatattatttattttcataaaaaaatgaattaaaataaagaaatagaggataagaatgtttaggaaataaatgattgaaaatgggatatatattaagaatttttaatatatgaaacgatgttttatgaaaaaattctaataggatagttgtagaatgtaaaaaaaataattttttaataatattttttttttaaaataactttgtttttaataatatctattttaaaataaatttttaataacatctttttaaaaataacttctttttttatttatcccaataggttaaaaaggtaaataaatagaaagggcattatagtctttttgatgatccaccatcaaaaccctagcaactgagagagccttccctaaatattagggtttcttccttctccatttctctcctacccagcggctgcatctccacagcagagtcttccaatggcttcagagaagaaactctcaaacccaatgagagacatcaaggtccagaagctcgtcctcaacatctccgttggagaaagtggagatcgcctcaccagagccgctaaggtgttggaacaactcagtggccaaacccctgttttctctaaagcaagatacactgttcgatcctttgggatcaggcgtaatgagaagattgcttgctacgtcactgtcaggggcgagaaagcaatgcagcttcttgagagtggtttaaaggtcaaggaatatgagttgctgaggaggaactttagcgatactggctgttttggttttggtatccaggagcacattgatcttggaatcaaatatgatccctcaactggaatttatggtatggacttctttgttgttttggagcgcccgggttaccgtgttggccgtcgtagaaggtgcaagtctcgtgttggaatccagcacagggtcacaaaagatgattctatgaagtggttccaggtgaaatacgagggtgtgatccttaacaaggcccagacaatagctggatcttaggtctgaggaagcccgacagttttaggtttttgcaatttttggttcacaagttttggtaatatttgaggttgtggacaaaaatttgtgacccctttttatttgctgttctacaatttcagagataattcttcatcattactatttcaatattttggtggatcatcatgtttggacaaaattccagtgagaatggatattctacccctgtttttgaatttgtcatttgtcatatccattcatgcattttaacatttgagaaagtgagtgaatttctttgtggcaatgctgttttagaggactttttactgtcaaataactattattaattaatttgtttttaattcagcatgctcgtgcagatgatgttatgttatcaagacttgaatatgcaagtttccaaatatttgctgcaggctatggttgttctctgggtttttttttgtacttttgaagttttaacaattagatttggagatgtgaaacatttctatatataatactcaactggcattcaggacatttgaagctcaaaccaggacagaccaaagtgaaaccccacttcctatcatcactaacacattgaatccatgattgcagaaaaatattaagtatttatcgattttttatggagggattgggaggatacgaatgatgatgcaaaggaataagacaggaagctagagtacaaaagaatgagaggatacaaataaatgatagagacacatgagatgggtacaaaagaatgggaaaggaagtcatgaaaatacgaaggaatgagaacggaataaataagattgggatataaaactatagggtctggtcggatctgtttggatgcgaatcgaaaaaggtactatattaggacccttggaaccatagagctattgatcatgtgcgccacaacttaatagtctcttagctgtaccccatggctgagttgaaattggaaagtttactgggaaatggaaggaaaaatggataagaaaatataccaataaatatcgaaaccaactgtgcaccaatgctgttacaatcatacacgggcggtcacttcgcttcagttgactttcctacgccaatgtcacctacagaacttctacgttcgtaccttaaaattcttgagagtggtttaaaagtcaagccatagattggttatactttgaaattcacagggctgtcattttctccacattaattcgaaggtttttatttcaaattgtcaattaattagctataaagtatggggcttcatgccgtctcttacaaagaccaaatgggtgcttcaagctctgcaatatttttaccttttgtaagccttgtggttttagtttcatgggcaacttcaagttcaatccatgaaaactttctgcaatgtctttcccttaattctaaccacacaacacccatctcaaatgtcctgtacaccccaaaaaatttgtcttattcagccatattggaatccaccatagagaacctcagattctcatcctctgctaccccaaaacccctgcttatacttaccccactgcatgtctcccacatccaagcagctgttatttgttccaagaaatatggcatgaacatcagagtccgaagtggcggccatgactatgagggtctctcttatgtatctgaaatccctttcatcattattgatttggtggaacttcgatccatcaatattagcatcgaagatggcactgcttgggtagaggctggagcaactgtcggtgaagtttattatagaattgcccaaaaaagtaggacctatggcttcccagcaggcagctgtcctactgtaggagtgggtgggcacttcagcggtgggggttatgggactttgatgagaaagtatggcctatcagctgataatataattgatgcttacattgttgttagtgatggcagagttctcaacagagaatcgatgggagaagacttgttttgggctattagagggggtggaggagcaagttttggaatcatcttgtcatggaaaatcaaactagttcctgttccgcctattgtgaccgtcttcactgttggcaggaccttggaacaaggtgcactcaaggtctttcttaaatggcaacaagttggtagtagactccaggaagatatcttcatcggagccacctttggggctgtcagtggcagccaagaaggggagagaacaatagaagtttcattcaaaagtctatttcttggtaatactagtcaactgttatcactgatgaaaaagagcttccctgagctgggcttggaggccaaggactgtcttgaaatgagttggatagagtccgtgctttattacacagacctttctggagaaccagtaaatgttttgctcaacaggattcctcaatttaaaaactacttcaaggcaaaatcagactatgtgcaggagccaatttctgaaactgggttacaaggtgtatggaagatgctttaccaggaagaggcagggataatgatcttaagtccttatggtggaaggatgaacgagatttcagagactgaagttcctttcccgcatagaaaggggaacttgtataaaattcaatacttggtcagctgggatgaagaaggggatagagtgtcacagaagcgcataaattggataagaaagctttatgcatacatggctccatatgtttccaagttccccagggctgcatatctcaattatagggatcttgacttgggaataaacaagctcaaaggtaacacaagctatgcacaggccagcatttggggcattaagtacttcagctgcaatttcaatagattggttcatgtgaaaaccaaagtggatccaagtaatttcttcaggaatgaacagagcatcccatctctttccccatggtggaagaactgagatttgaggaattgttggcagcttgccactgccctatattcctggttggacttttccttgtcaaaacaataccaagtggctttatcataactaaataaacagataaatatatgtaatgatggtcttatcttgatcagtaatgagcatggtctatttctcaatttaaatcttctgttctttcttgtttgtcattgcagtcgatttaattatactactctgctagattggactgcacatggttcatgactgctaaagacatgtttaatttggcttattgcagcaagcagctgaccaattgagcagtttacagtaacatgcctccatccataataacaaaccatcttggaaatcaagcgcacagtttttcggtatggtatcatttttctttttctactattctatggtaaatcaaataagagaatttgagattccttgctataatttttccttttctttttcatctcttttgaggtgatacaggacacccaagaaagagatttaagtcacatttttaatgctttccaaggtccagttcaagggagagctaggcatattaagccagacaattgaccttaagctacatgaaaaataaattatgagttaagtaaactatgagcttttgaacccatgctgaattatagcattcagacgaaagatactgtttaatgcactcgtagtttaacaattaaccctaatatgagcacatatcctgatagtcacatctggtttaacgtggaaattaaggagggatattgttaatctttagtggtctgataaatggatcggtccattgtataacaatttaagctcttaaattaaaatgatagttttaatagacatcctgtgtagattttagtggacactctcctcatatttaggtggttgcaggtccatcagagagtcaaaagcctagtaaggttcttctccccctggtaacagctgattgatgtccatgtaaccagcaaaattcactacatgaaattgtaattactatgccaaaatcctatcattcaattgtattgctatcacaagaaccttcctatttaatcagctgtacccccaaggaagctgaaacaagaatgtttttgcattcttgctgctgccaaaaagagaagtaattatatagaactgtgaatatatatgctctggagtttattgaactgaaatcaaagtggcagcaactgtgatgatatggtagggacaccataagctgtggtcaagacactggtgggacaaaatgatattagcaatgtgaagtgttggtctgcagattatttggaaaaggtgatagtaatgctcgtgcgacatggtaataaatcaacatgggccttattttcctgcatgctctgctgcctacaagtctaagaaatctgctaaagtggaatatgtcaaactactagtcccttttattttttattttttatttcctgagaaagcgtaattatgtggcttttaaggagaacttggtgagaatttaaggggttgagctttgagggacataacctagatttaaatgatgacagtagcatgcacatatgatcgtaatgatgcaagaaaaaaagaaaagatgcagtgctatgcatttttttaaaaataaatattctttgacttgcttgttctagaagagagtgcatagattttccaaagttctgcaaaaaataaaccatataccatttgagaagcaattcaaagaattttttttttttcaaggaaaaataattttcctgacagaaaaattgaagattgaagttgaacagaatgaacacgttgcttgattttttattttttatttttaaaatttatttcttacaaatcaatacaatacattattacagagagcagcatgtgtttatttagtatgcatcaagctgcttattaccgcctgttttgccaatgagatactatacagggatactgaccaagg

SEQ ID NO: 4702 - DNA, 953 bp, Gossypium hirsutum
cgactgaaatgcgaaaagatcatcggaagttgacctagtttcgaactgggtcttttccttacatctccatcagcatcaacaagcatagatatagaaagccattttccaaatgctatatcaaaatgtaattaaaccaaaagaagaaaaaaaaaggtagttacgcctgtagagttagtcataaatctcttcaagaaaacgagaaccgagacagaaactagcaaaaagctgagtacccaaaactcgaaacaaactcaacttagcttgtaacaactactactcttaagctccgatgttttgcgacttgttaaggatgacaccttcgtatttgacttggaaccatttcatggcatcttcctttgtaactctgtgctgaatgccgacacgtgacttgcacctgcgacgacgacctacacggtatccagctcgttcgagaacaacatagaaatccataccgtagataccagttgaaggatcatacttgatgccaagatcaatgtgttcttggataccgaatccgaagcagccagtatcgctaaagttcctccttaaaagctcgtattccttaaccttcaaaccactctcgagaagttgcattgccttctctcccctcaccgtaacgtagcaagcaattttctcattacgcctaattccgaaagatctcacggtatatctcgccttagagaaaacaggggtttgaccactgagttgttccaagaccttggcggcgcgtgtgagacgatcgccactttcgccgacggagatattgaggacgagcttttgaactttgatttccctcattgggttcgacaatttcttctctgatgccatggcgacttgaaagacttggagagcagctgaggcagatctaacaaattaatatactgaaatttactttttaggattagggtttttagggttcatatacgagtggcaactgtgaagtgatacccttt

SEQ ID NO: 4703 - DNA, 863 bp, Arachis hypogaea
gctgaagcactgcaactgcgcatctcggcaactattcgccactggtcctgtactctgccgccttcatattagctcaaatccaaatccaaatccaatggcttcggagaagaaacttgcgaatccaatgagagagatcaaggtgcagaagctcgttctcaacatctccgtgggtgagagtggagatcgtctcactagagccgctaaggtgctagagcaacttagtggccaaaccccagtgttttccaaagcaagatacactgtccgttcctttggaattagaaggaatgagaagattgcatgctatgtcactgttcgaggtgacaaggcaatgcagcttttggagagtggtttgaaggttaaagaatacgaacttttgagaagaaacttttctgagactggctgctttggctttggtattcaggagcatatcgatttgggaatcaagtatgatccttccactggtatctatggtatggacttcttcgttgttttggagcgaccaggataccgagttggaaggcgcaggagacagaagtcccgtgttggaattcagcacagggttaccaaagaggacgccatgaaatggttccaagtgaagtatgagggagttattctgaacaagtcccaacaaatctcttaatattttaatagattggtaggattcagcctttggttgtctaggtgtcacccaatgattggccgttccaattttccctccattttgattctaatggttatgcccattctctaaggatgttaagatatgctattgttgtaatccttttagacaattctggtataaagattttatagtttctatcgagcacagtgaacttgcattgttgaatactatgttggtgaca

SEQ ID NO: 4704 - DNA, 841 bp, Tripterygium wilfordii
attgcaaaaccctagtccctcttctttgcttttcgtaccgtgcagcgccctcagcctacccgtccacttcgcttcagcgcctccgcatcacaatggcttccgagaagaagctgtcgaacccaatgagagaaatcaaagtgcagaagctcgttctcaacatctcagttggtgagagtggcgatcgtctcacccgtgctgctaaggtcttggagcaactcagtggccaaacccccgtttattccaaggcgaggtacacggttaggtcgtttggaatcaggcgtaatgagaagatagcatgctacgtgactgtgagaggtgaaaaggccatgcagttattggagagcggcctgaaggtgaaggagtatgagcttttgaggaggaacttcagtgacactggttgcttcgggtttggcatccaggagcacattgatctgggtatcaagtatgatccttcaactggtatttatggtatggacttttatgttgttttggagcgtccagggtacagagtgggtcgtcgccgcagatgcaagtcacgtgtaggaattcagcacagagtgactaaagaggatgcaatgaagtggttccaagtaaaatatgaaggagttatcctgaacaagtctcagaacatagcttagtagagagatgcctttaccatctatgttagtttttggaagttttggttggctgttatgttggttgaatttgcgtaacttgagttacaattttaattgatgtttatgacttggtagaatctaagtccctaattattttcttttctggtttatgtgataatatctcgtgtctttcatatttattgccaagacttttctctttgtcc

SEQ ID NO: 4705 - DNA, 830 bp, Citrullus lanatus
ctctctcgcatctttacctcccgagcttcgttttctactctgaacttcgatacggcaaaaatggcttcagagaagaagctatctaatcctatgcgcgatatcaaagtccaaaaacttgttctcaacatctccgttggtgaaagtggtgaccgtcttaccagagccgccaaggtgctcgaacaactcagtggccaatctccagtcttctccaaggctcggtacaccgttcggtcgtttgggatccggcgtaacgaaaaaattgcatgttatgtgaccgtgaggggtgataaagcaatgcaacttcttgagagtggtttgaaggttaaggaatatgagcttttgcgccgtaacttcagcgatactggctgctttggatttggaattcaggagcatattgatcttggaattaagtatgatccttctacgggtatttatggcatggatttctttgttgttctggaacgaccaggttaccgtgtaggtcgccgccgtaggtgcaaatcaagtgttggaattcagcatagagtcactaaagaggatgccatgaagtggttccaagtcaaatatgaaggagttattctcaataagtctcaaaatatatcctagaaaaggttcttctactatctttgatgacatgttcaaattttggtttacttatttaagattcgtctatcagaacttcactttctttttgaaggtgcattttaccctttcttattttatagtgtactttgttaaaactcatttgaccgcttttgaagttaatattcaatttttttggctgatacaatgcggttttgttataaaatcattacacaagcaaattgtcc

SEQ ID NO: 4706 - DNA, 822 bp, Panax ginseng
accccttgcagctgccaactttaccacccgggaaatcgccatggcttcagagaaaaaactattgaacccgatgagagagatcaaggtccagaaactcgtactcaacatttctgtgggggagagtggagatcgactcactagagcctctaaggtcctggaacaactcagtagtcagacccctgttttctccaaagcaaggtatactgtgaggtcttttgggatcaggcgtaatgagaagattgcctgctacgtcacagtgaggggagacaaggcaatgcagcttctggagagcgggttgaaggtgaaggaatacgaattgctgaggaggaacttcagtgatactggctgctttggtttcggtatccaggagcacattgatcttggaattaagtatgacccttcaactggcatttatggtatggatttctttgttgtacttgaacgtcctggttaccgtgtgggacgtcgtcgtagatgcaaatctcgtgttggaatccagcacagggtcacaaaggaggatgcaatgaagtggttccaagtcaaatacgagggcgtgatccttaacaagtcccagaatattgggggttaattgaatgctgtgggatcagattggataattacaagcctagttttgtgctttttagaccagcaatgcataataagtcatgttttgaatttttgcagtcatgttttctctaaaggcggatgttttttcacagctattttcggataatttctgctttactatgtactggcttgcttattaattgtgtttggcattctatggtggttttagaatacagttcaggctttgagcacttg

SEQ ID NO: 4707 - DNA, 879 bp, Panax ginseng
agttagggttttatctcacctctccatttcccccgtcttctcattactcgcagctgcgaccttcaccaccgggaacatggcttcagagaaaaagttattgaacccaatgagagagatcaaagtccagaagctggtcctcaacatttctgttggggagagtggagatcggctcaccagggcctctaaggtattggaacaactcagtggtcaaacccctgttttctccaaagcaaggtatactgtgaggtcatttggtatcaggcgtaatgagaagattgcctgctatgtcacagtgaggggtgacaaggcaatgcagcttctagagagtgggttgaaggttaaggaatatgagttgctgaggaggaatttcagtgatactggctgtttcggcttcggtatccaggagcacattgatcttggaattaagtatgacccttcaactggcatttatggaatggatttctatgttgtacttgaacgcccgggttaccgtgtgggacgtcgtcgtagatgcaaatctcgcgttggaatccaacacagggttacaaaggaggatgcaatgaaatggttccaggtcaaatacgagggtgtgatcctcaacaaatcccagaatattgggggttaatagagaagtattaacaagcctaggtttatgcttttcagactaggtgttactatgaaatgctaaattttgaattgttgtagtagactcatttatctatatttcacatgtttttcgagagaatttttcatctgtagtatggttctagcttacatggctatcttctttgacattgaatgattcattataagaatccagttgaggtttgagctattgtcaattcatcctgaacacaccatgatggcgactccaagtcg

SEQ ID NO: 4708 - DNA, 770 bp, Arachis hypogaea
cgcgctgctgcatttcacttcctcacaaagcgccatggcatcggagaagaagcttgcgaaccctatgagggaaatcaaagtgcagaagcttgtcctcaacatctccgtcggcgagagcggcgatcgtctcaccagagcttccaaggtcttggaacagctcagcggccaaacccctgtcttctccaaggctaggtacactgtgcgttcatttggaataaggcgtaatgaaaagattgcttgctatgtcaccgttaggggagacaaggccatgcaactccttgagagtgggttgaaggtcaaggagtatgagctgcttaggaggaatttcagcgatactggctgctttggttttggaatccaggagcacattgatctcgggatcaagtatgatccttctactgggatctacggcatggatttctttgtcgtcttagagcgtgctggataccgtgtgggtaggcggaggagacgaaagtcccgtgttggaattcaacacagggtcaccaaagaagatgcaatgaagtggtttcaagttaagtacgaaggagttattcttaacaagtcccaacaaattgtatcctagacagcactattttagtttttttttttggactggtagtcagcaacatgcaactattttatttggttttcttcaagttttgatgggatttttcccagttttatgaagcaagatatttgtttcattttgagttcaatacaatgccggtattgtttttatttaatttcgggtgtcatttcctgaagggcgt

SEQ ID NO: 4709 - DNA, 831 bp, Arachis hypogaea
cggaagctgaagcactgcaactgcgcatctcggcaactattcgccactggtcctgtactctgccgccttcatattagctcaaatccaaatccaaatccaatggcttcggagaagaaacttgcgaatccaatgagagagatcaaggtgcagaagctcgttctcaacatctccgtgggtgagagtggagatcgtctcactagagccgctaaggtgctagagcaacttagtggccaaaccccagtgttttccaaagcaagatacactgtccgttcctttggaattagaaggaatgagaagattgcatgctatgtcactgttcgaggtgacaaggcaatgcagcttttggagagtggtttgaaggttaaagaatacgaacttttgaggagaaacttttctgagactggatgctttggctttggtattcaggagcatatcgatttgggaatcaagtatgatccttccactggtatctatggtatggacttcttcattgttttggagcgaccaggataccgagttggaaggcgcaggagacagaagtcccgtgttggaattcagcacagggttaccaaagaggacgctatgaaatggttccaagtgaagtatgagggagttattctgaacaagtcccaacaaatctcttaatattttaatagattggtaggattcagcctttggttgtctagttgtcacccaatgattggccgttccaatttccccaccattttgattctaatggttatgcccattctctaaggatgttaagatatgctattgttgtaatccttttagacaattctggtataaagattttatagtttctattgagca

SEQ ID NO: 4710 - DNA, 720 bp, Abies balsamea
aagtctaggttaggtcgtgttgcagcgggcgggatcgggtttgacgcggagggtagaggtggcagcagaaacagcagtcggcacacctgcgaaggagaaatggcagcagagaaaaaactgagcaaccccatgagggaaattaaggtgcagaagttggtgcttaacatatcagttggtgagagtggtgatcgactcactcgagcttccaaggtgttggagcagctgagtggccagaccccggttttttcgaaggcaaggtatactgtgaggtcctttggaatcaggcgaaatgaaaagattgcctgctacgttactgttagaggagaaaaggctcttcagcttttggagagtgggctaaaagtgaaggaatatgagttgctccgaaggaactttagtgacacaggttgctttggttttgggattcaggagcacattgatctgggaatcaagtatgatccttcaactggtatttatggtatggacttctttgtagtcctagagcgccctggatacagagtcgggaggagaaagagagcccaatcccgtgttggcattcagcacagggttaccaaggaagattcgatgaagtggttccaagttaaatatgaaggagtcatccttaacaagtcacaaaatatttaaattagttctcttatgttccttggtaagagtagtcttgacttggtttgctatttttgttaaattataaaggaaggaatt

SEQ ID NO: 4711 - DNA, 962 bp, Amorphophallus konjac
ccgacggagcgcagggagacacagagagagagctctcgccatggcgtcggagaagaagctgtcgaacccgatgcgggagatcaaggtgcagaagctcgtcctcaacatctgtgttggggagagcggggatcgtctcaccagggctgcaaaggtgttagaacaattgagtggacaaactccagttttctccaaggccaggtatactgttcgatcctttgggatcaggcgtaatgaaaagattgcatgttacgttacggtcagaggtgagaaggcaatgcaactcttggaaagtggtctaaaggtgaaagaatatgaactgctgagaaggaacttcagtgaaactggatgctttggctttggcatccaggagcacattgatcttgggatcaagtacgacccttccacgggcatatatggaatggacttcttcgtggtgctggagcgccctggctacagagtggggcgccgccgccgctgcaagtcccgcgtgggaatccagcaccgagtcacaaaggaggacgccatgaagtggttccaagtcaagtacgagggcgtcatcctgaacaaggcccaggctggtggctaataatttctttaaaagtcggttggttgcttgccggacaaccctcaggaattattggcttgcccagttgccatcaagctttgctcatttgtggtgtttagctatcaatttttgttctgcattgacctgccctgattgacgctctcttttttcatcagcatttagcagggaatttacctttctttggatagaaaagtggacgacgattgttcttgatttttgttgtgtagaaacccctcgtgcagtgcgcgtctgcaactgttgtgactcgagagaaagtcgactctatccatccaattttctgaatattgttattcgtgttttacttgtagttgtggtcaccgcaacctcgtttgatatggaagtccgccgcgaggag

SEQ ID NO: 4712 - DNA, 764 bp, Amsonia hubrichtii
aactctcaactcagtctccgccgcagcttctccattttttccgagttccctacgtattcatacttcaaaccctaaatcctattttaactcgcggcggcacttgcagctcttcgacgttcgtaatcatggcttccgaaaagaaattgagcaatccaatgagagaaatcaaagtgcagaagctcgttcttaacatttctgttggtgaaagcggcgatcgtctcacccgtgcagccaaggtgttggaacaactcagtggtcaaactcctgtcttctctaaggcaaggtatactgtacgatcatttggaattcggcgtaatgagaagattgcatgctatgttactgttagaggtgataaggcaatgcaactcttggagagtggcctaaaagtcaaggagtacgagttgctaaggcgtaacttcagccaaactggatgctttggttttggtattcaagagcacattgatcttggcatcaagtatgatccttctactggtatttatggaatggactttttcgttgttctagagcgcccaggttaccgtgtagctcgtcgaagaaggtgcaaagctcgtgttggaatccagcatagggttacaaaggaggacgctatgaagtggttccaggtcaaatatgagggggtgatccttaacaaatctcaaacaattgcatcttagattgtctaattacctggataatggaattctagttaaaaattttaattttggttttgttacggttactgttcactatgctatacgtaggtg

SEQ ID NO: 4713 - DNA, 1079 bp, Aquilegia formosa
atgacaatgtgggaggttttgtcgttcttccaacttccaacaaagcctatctttgaagtcaaatcaaatcaaaggaatgcaacattgcaaatacgctgcagaatggattcctcaccatccattaatcttcacttgagggcaatagaacgaaagaaagaaggagaaggagttgaagcggcagatcaattcgtaatggcgtcggagaagaagctttcgaatccaatgagagatatcaaagttcagaaacttgtcctcaacatctccgttggtgagagtggtgatcgtctcaccagagctgctaaggtcttggaacagctgagtgggcaaagtccagtcttttcgaaagctagatacactgttcgttcctttggtattcgacgtaatgaaaagatagcttgctatgtcactgtcaggggtgacaaagccatgcaactcttggagagtgggttgaaggtgaaggaatatgagctgttaaggaggaacttcagtgatactggatgttttggatttggtatccaggagcacattgaccttggtatcaagtatgatccttcaacagggatttatggcatggacttttatgtcgtgttagagcgtcctggttatcgggttgggcgtcgccgccgctgcaagtctagagttggtattcagcacagagttacaaaggatgattccatgaaatggtttcaagtcaagtacgagggtgtcatcctcaacaagtcccagaacatcactggttaaaggatgtgcatacaggatttataggttatattaagttgtcaatttatctatcttttatcagggagatcagcagttggttagcttaagaggtagaattttttgagtttttgctttgagggatttttggatattgctctgtgagttccagtcgccataagtagtggaccatattgttggtataattttgaatgaactttactattctatttatggtttcttgatggattatgctatgttgtgttgtattgatggaagattaacaatttaacaccagaggtgaggttatagaggtgaatgcatgtcatcatggtcgaatgcatttatcgttttttgtgttt

SEQ ID NO: 4714 - DNA, 954 bp, Aristolochia fimbriata
tgtcattacagtcatacaaacctgacccggatccgacgagaataagggcaagaaaaccagaagggcaattttgacacttgactcgcttgcctacacgaataaaaccctagcaaacctcagctccgtcgtttagggtttctttcatcgcctctcccccccccattgtgctgctactctcgctagctaaggagagcaatgggttccgagaagaagctctcaaatccgatgagggagattaaggttcagaagctggttctgaacatttccgttggagaaagcggagatcgtcttaccagagctgcaaaggtgttggaacaattgagtggtcaaacaccagtgtactccaaggcaagatacactgtcagatcctttggtatcaggcgaaatgaaaaaattgcttgctatgtaactgtgagaggtgacaaagcgatgcagcttttggagagtggcttgaaggtgaaggaatatgagctcttgaggaggaactttagtgacacaggatgtttcggttttggtattcaggaacacattgatcttggaattaagtatgatccttcaaccggtatttatggcatggacttttttgtggttttggaacgtcctggataccgtgttgggcgtcgccgccggtgcaagtcacgtgttggtatccagcacagggtcactaaggacgatgccatgaagtggtttcaggtcaaatacgagggagtgatcctcaacaagtcccaatcaacatgatcttagagaaagatagagacactttgaatgaaacttttgttttgttgatttaaactagttatgttactggtgagagctgaattttgttttcttttgttcaagagataatttatctttaaatttgttttagcaatcagcacatttagtgtttacaactttggatgtgggcaattgtctggatcttcttgtagcgaaattatccgtttcgttttttca

SEQ ID NO: 4715 - DNA, 896 bp, Persea americana
accattccttactcttctccccttcccgttcaagctctgtgtttttttcgctcatctccacacactgagagagagagagagagagagagagtcatggcttcggagaagaagctgtcgaatccgatgagggagataaaggtccagaagctcgtactcaacatctccgttggagaaagcggagatcgtcttaccagagccgctaaggttttggatcagttgagtggacaaacgccagtgttctccaaggcgagatacactgttcgatcctttggcattaggcgtaatgaaaagattgcttgctatgtcactgttagaggtgacaaggcaatgcagcttctggagagtggtttaaaggtgaaagaatatgagctgctgaggaggaactttagtgacactggatgttttggatttggaatccaagagcatattgatctcggaatcaagtatgacccatccactggtatttatggtatggacttctatgtggttctggagcgccctggataccgtgttggtcgtcgtcggaggtgcaaatctcgagttgggattcagcacagggtcaccaaggaggatgccatgaaatggttccaggtcaagtacgagggagtcatccttaacaaggcacaaaacattggtgcttaatagagatgaatccctctctccacccaatttgactttgaagcttggttttgtgtttgtttttccagacaactagctttcctcttacttttttttccagtgaaatgagttttgatatatataatagtaggtgccacaatgcagagtaagatccttcagttttaattattctgttctacgtatctgtattctgtagttgcttcttaaatatcattcccccgcttaatggataaccatttgctaccaatgggaattgc

SEQ ID NO: 4716 - DNA, 949 bp, Musa acuminata
atggccacagcaagaaggatgcacaaaatagattggctgttgggactccatttagactttcctcccctccccgtcgctactctgcccgagactccaaacttgccttccgaccctcgccgatctcccgccatggcttccgagaagaagctgtcgaacccgatgagggagatcaaggtccagaagctcgtccttaacatatccgtcggtgagagcggtgaccgccttacaagggccgccaaggtcttggagcagctaagcgggcagacaccggtgttctcaaaggcacgatacactgtgaggtcctttgggatcaggcgtaacgaaaagattgcttgctatgtcacggtcaggggtgacaaggcgatgcagctcctggagagtggactgaaggtgaaggagtacgagctgctgaggagaaacttcagcgatactggctgttttggttttggtatacaggagcatatcgatcttggaatcaagtatgatccctcgaccggtatctacgggatggatttctttgtggtcttggaacgcgcaggttaccgggtagctcgtcgtcgccgatgcaagtcacgtgtaggaattcagcatagggttaccaaggaggacgcaatgaagtggttccaggtcaagtatgagggtgtcatcctcaacaagtcccagacaaccactggttaagattcatgatagcccagaacattatctttgatcttgcctttgccagcagagtttagtggttccatcgaactcaattgcttttacaatttgcaatctctactcgagtattttgatcctgaaggagttggcaaacttcattttagttcagtaattaatggaattgcttcaagtctgtaatcttactatatcaaactggaatgttagcgtggtcagtaattattggcttgattgaaagttgctaaaaccaataagtgtcaatttcggatattag

SEQ ID NO: 4717 - DNA, 752 bp, Musa acuminata
gccgcgcgagctgttcctggtcggctaggccgtggttcccgctcctgatctctcgttcgcaatggcttccgagaagaagctgtcgaacccgatgagggagatcaaggtccagaagctcgtcctcaacatctcggtcggggagagcggtgatcgtctcaccagggccgctaaggttctggagcagctgagtggacagacaccagttttctctaaggcgaggtacactgtccggtcctttggaatcaggcgtaatgagaagatcgcgtgctatgtcacggtcagaggtgacaaggcaatgcaacttctggaaagtggactaaaagtgaaggaatacgagctgttgaggagaaatttcagtgacactggctgcttcggttttggaattcaagagcatattgatcttggaattaagtatgacccctcaactggtatctatggtatggatttctttgttgtcttggagcgtgctggttatcgtgtgagccgtcgtcgcagatgcaagtcccgtgttggcattcagcaccgcgtcaccaaggaggatgcaatgaagtggttccaagtgaaatatgagggtgtcatcctcaacaagtctcagacaaccacgggttagggtttggtacaactgaaactttgaacttgttctaagccaaattagctctcatctgtttttttttttttctttttcattgttccaattttgtgtttggagaaaattttatgctatttcctatatgttgctattagtgttgaaa

SEQ ID NO: 4718 - DNA, 876 bp, Fagus grandifolia
atggcttcggagaagaaattatcgaatccaatgagggagatcaaggtccagaaactcgtcctcaacatctccgtcggtgagagcggcgatcgtctcaccagagccgccaaggtcttggagcaactcagtggccaaaaccctgtcttctccaaggctaggtacaccgttaggtctttcgggatcaggcgtaacgagaagatagcgtgttacgtgacggtgagaggcgagaaggcaatgcagcttctggagagtgggctcaaggtcaaggagtatgagctcttgaggagaaacttcagcgataccggctgcttcggtttcggtattcaggaacacatcgatctcggaatcaagtatgatccttcgactggtatctatggtatggacttttttgttgttttggagagaccaggataccgtgtgggtcgtcgtcgtagatgcaagtcacgtgttggaattcagcacagagttacaaaggaggattcaatgaagtggttccagatgaaatatgagggagtgatccttaacaagtctcaatcaaatacagcttagagagatctttataacattggataaagttctaagttttggcaaagctgttaccttttccattgatttgtttaccaggatttaaattttgtttgaagagatttttgagttacattagtttcaagtactttctggtgatttaatgttttaactcttgaatatatgggagtatgatattgtttcatttctctctatttccgggttcaatatgatccatcactggttgtggctcatttgtgcttgggtcttgtactgcattgagtttgtttctttagcttgacggttcattatctttaaactgagtattcataggtgctaattacactggct

SEQ ID NO: 4719 - DNA, 1387 bp, Ricinus communis
ggaatctaaaaactgtcgatgtttccaaaatctaattgatttcagctcttaccgccggacgaacccgagttccatttacaacacagggctcttttgcttttgtctccaattcggcccgattcggcccaattctacagaagttgtaccaatcattacaaaaccctaaccccttcaacatagccgctctttcctttactctgcggccgagctttgcctcctcgaaactgcaacaatggcgtcagagaagaagctatcgaacccaatgagagaaataaaagtgcagaaactcgtactcaacatctccgtcggcgaaagcggcgatcgtcttacacgtgccgccaaggtgctcgagcaactcagtggtcaaaccccagtcttttctaaggctagatatactgttagatcttttggcattaggcgtaatgaaaagattgcttgctatgtgactgtgaggggagacaaggcaatgcagctgcttgagagtgggttgaaagtgaaggaatacgagctcttgaggaggaactttagcgacactggttgctttggctttggtatccaggagcatattgatcttggcattaagtatgatccttcaactggcatttatggtatggacttctacgtcgttttggagcgcccaggctaccgcgttggtcgccgccgaagatgcaagtcgcgtgttggaattcaacacagggttacgaaggatgatgcaatgaaatggtttcaggtgaaatatgaaggtgttatcctcaacaaggcccaaaatattggatcttagatcttgtttggttataattaagttatgcaagtttaatgtgtaggggaatttccttttctgctgttggaattatagcttcccttcatgtgaattttgaaaggatagaagttggacctctattttgttattttgattttctagtgtggttctttataaatcctggggagcagttatgcaaaatcctgcattctctttagccaaataagtgtggttcgattacgaaaagtatcaggctgttcatgcgtcatgcatggtaatttgaatatagcaattgcctgatcccaaagttcagaatttagcagctcgaaatattgtggctccattgtgagcaaaggttcagcgatgctgtcattctcaaacaatgtggagggagattactgtcgatattgtccagatgctaaccatggcttgtgcaggcctaggtctccgcagttctagttccagttgaaattggctttcacctgtgttttttattttgctttcttaacaatgcttttacatgtgtttacgcccctttcccccgccctccttttcctcgcttcgtattcttggggcagaactttgtgctaggcaggcctctaccacagcgtttgggttcattcaaaa

SEQ ID NO: 4720 - DNA, 781 bp, Castanea mollissima
tcttcgctcagcttctcagccatttcgcctcagcactctgctcctccacatccacgcaacaatggcttcggagaagaaactaagcaacccaatgagggagatcaaggtccagaagctggtcctcaacatctccgttggtgagagcggtgatcgtctcaccagagccgccaaggtgttggagcaactcagtggccaaaaccctgtcttctccaaagctaggtacaccgttaggtcgttcgggattaggcgtaatgagaagattgcgtgctacgtgacggtgagaggcgagaaggcaatgcagcttctggagagtggcctcaaggtcaaggagtacgagcttttgaggagaaacttcagcgatactggctgcttcggattcggtattcaggagcacatcgatctcggaatcaagtatgacccttcaactggtatctatggtatggactttttcgttgttttggagagagcaggataccgtgtgggtcgtcgtcgtagatgcaagtcccgtgttggaattcagcacagagttaccaaggaagatgcaatgaagtggttccagatgaaatatgaaggagtgatccttaacaagtcccaaaacatatcttagagagatctcctttatagtcttcgataaattaaagttttggcgagctgttacctttggtttctttaccaggatttatattttgtctgaagagattatgagttacattagtttaagtactttccagtgatttatttttttaactcttgatgcattaatatatgggagtttgatatc

SEQ ID NO: 4721 - DNA, 1737 bp, Cirsium arvense
gggggggttgcgttgcggccttatttttacgataaaaccctttttttccgtctcaccgccgttatcatcatcttcatcttcatcagcagcaatggcttcagagaggaagcaatcgaatccaatgagagagattaaggttcaaaaactcgtcctcaacatctccgtcggtgagagcggagatcgtctcactcgcgctgccaaggttttggagcaattgagtggccagtcccccgtcttttccaaggcaaggtacaccgtgaggtcatttggtatcaggcgtaacgagaaaattgcatgctatgtgaccgttaggggagacaaagccatgcaacttctagaaagcggactgaaagtgaaggaatacgagcttctaagacgcaactttagcgatactggctgctttggatttggtattcaagaacatattgatctgggtatcaagtatgatccatctactggtatttatggtatggatttctttgtggtattggaacgaccgggttatcgtgttggtcgtagacgcaggtgcaaggctcgtgttggtatccaacatagagttacaaaggaggattcaatgaagtggtttcaggtgaaatatgagggagtaattctcaacaaatctcaacaaattggagcataactagtcttcttttttggttaaatcaggtaacttttaaatttgtactgcaccccaagatatttttattactgttgttttgttttgtttctgtctgttgaattatcatcttaattagtggaaaaaaacactagtcttttttgtattaacttcgtaaatgatgtatttacgaattaaattatcatcatacgatcaattatttttattatttgatcaaactactaacccattgttgtagtacaatagttagatggttccctttaccttgttccctccctcaattgatggggaaatctggctgcttttcaggcatggcatcttggatagcaggtatcttcttgtatgcctctgccaatctcgaaagaagagggaactcactcatgtcaaagttgtacatttgtagataaccaacgatatatggagccagaagcacatcagccagaaaaatttcatcaccagttgcgtacttcccagcatgatattttagtaacttctccagcgcggcaaagccttttccaacatgcttattaacccatggaatttgttcatcaagaccaacattttgtccgatgtatctcaaaattggtctccttataagaggttgtatgcttgaacaaacaatgcttgcagcctgataatttattgccttcttcgtaaggtcacgaggtaacaaaagatgctgagggtacttctcctcaaggtacaatatgattgcaaaggaatcagcaagcaccagatcaccattcacgagtgcaggcacgaacccaataggattgatctttaaaaactctggtcgactctgctcatttttggacagattaatggctttgtattcataatcaagtccttttaggttgagagcaatacgaacactaaaggcgggagggctcatgaaaaaagaataaagttgcagcttctttggcaactcttcaccattagctgtggtcataaatgccaaatgccaatactgctaaaaaccaggaggaagatgatatgcagatttcgagcaaaagacgacagcggtgaagttttgtcaacgagttggtgatcactgattgtctaattctacaagaaaacgcccttttatttgcaaatcactg

SEQ ID NO: 4722 - DNA, 787 bp, Gossypium hirsutum
aaccctagagtgaggaattagacccagctgcctctttgtcacttgtcagtacaacgctgctctcagcctccatttcccatatcatggcatcggagaagaagctgtcgaacccaatgagggagattaaagttcaaaaacttgtcctcaacatctccgtcggtgaaagtggcgatcgtctcacccgtgccgccaaggtcttggaacaactcagtggtcaaacccccgtcttctccaaagctaggtacactgtgagatctttcggaattcggcgtaatgagaagattgcttgctacgtgactgtgaggggagagaaagctatgcagcttcttgagagtgggttgaaggttaaggagtatgaacttttgaggaggaacttcagtgataccggctgcttcggattcggtatccaggaacacattgatcttggcatcaagtacgatccttcaactggtatctacggcatggacttctacgttgttctggaacgagctggttatcgcgttggccgtcgtcgccgatgcaagtcacgtgttggtattcagcacagagttactaaggaagatgccatgaagtggttccaggtcaaatatgaaggtgtcatccttaacaagtcccaaaatattggagcttaagaaatagcagtaacgagctcagtttgagttgttttcagttttggctacttgattttgactagtttgtgtatcagtttctctctttttcctgaatagatttatgcttgagactttcctgttggttttatatttattcttcaatttttagtaaccct

SEQ ID NO: 4723 - DNA, 792 bp, Gossypium hirsutum
actctcaacgccgctgccttctttgtttctgcgccgctgctctcaaccttccttcggtttacccaatggcatcggaaaagaagctgtcgaacccaatgagggagattaaagttcaaaaacttgtcctcaacatctctgtcggtgaaagcggtgatcgtctcacccgtgccgctaaggtcttggaacaactcagtggtcaaacccctgtcttctccaaggctaggtacactgtgagatcttttggaatcaggcgtaatgaaaagattgcttgctacgtgacggtgaggggagagaaggctatgcaacttctcgagagcggtttgaaggttaaggagtatgaacttttgaggagaaacttcagtgatactggatgcttcggatttggcatccaggagcacattgatcttggcatcaagtacgacccttcaactggtatctacggtatggacttttatgttgtcctggaacgagctgggtaccgcgttggtcgtcgtcgcaggtgcaagtcacgtgttggtattcagcacagagtaactaaggaggatgccatgaaatggttccaggtcaaatatgaaggtgtcatccttaacaagtctcaaaatattggagcttaggggtagcatttcaagttcagttgagttgtttgaagttttggttatttgattttgactatttaccgtatctggttttttgttttaccggagagatatatgattgacttgaaattccaaagtaccttccttgttggtttattacattatcaatatttatacaattggagaatgcctttct

SEQ ID NO: 4724 - DNA, 830 bp, Gossypium hirsutum
ccccatctattcacgcagctgccccttcatcactctgccaccgctgtattcaacctccgtcgcctcgccatggcatcagagaagaagctgtcgaacccaatgagggaaattaaagttcaaaagcttgtcctcaatatctctgttggtgaaagtggtgatcgtctcacccgtgctgccaaggttttggaacaactcagtggtcaaacccctgtcttctccaaagctaggtacactgtgagatctttcggaatcaggcgtaatgagaagattgcttgctacgtgacagtgaggggagagaaggctatgcagcttcttgagagcggtttgaaggtcaaggaatatgagcttttgaggaggaacttcagtgatactggctgctttggattcggcatccaggagcacatcgatcttggaatcaagtatgacccttcgaccggtatctacggtatggatttctatgttgttcttgaacgagctgggtaccgtgttggccgtcgtcgcagatgcaagtcacgtgttggtattcagcacagagttacaaaggaggatgccatgaagtggttccaggtcaaatatgaaggtgtcatccttaacaagtcccaaaatattggagcttagaagtagcagtatgagattgtttttagttttgagtacctgattttggctagtttatatttatcagatagtattttcctgaacaaatttattttatgttttagggtggaatcctaagtttttctttttgttggtttagtttattaatatatttacaatcggaagaaaattttttgtctcgcgggggggtgtctcgtggagcgaaccattattta

SEQ ID NO: 4725 - DNA, 996 bp, Cucumis sativus
agcaccaacagcagcaacacctaagccgcagccacctgccacagaacactccaatggcttcggagaagaagttatcgaaccccatgagggatattaaggtgcagaaactcgtcctcaatatctctgttggtgagagtggagatcgcctcaccagagctgccaaggtgcttgaacaacttagcggccagagccctgtcttctctaaagcgagatacactgtaagatcgtttggaatcagacgtaatgagaagattgcttgctatgtcaccgttagaggagagaaggcgatgcagcttttggaaagtggattaaaggtgaaggagtacgagttgcttcgtaggaactttagtgatactggatgctttggctttggtattcaggagcacattgatcttgggatcaagtacgatccatccaccggtatctatggtatggacttcttcgtcgttttggagcgaccgggataccgtgttggacgtcgcaggaggtgcaagtctcgtgtcgggatccagcacagagtcacaaaggaggatgccatgaagtggttccaggtgaaatatgagggtgtgattcttaacaagtcccagcaaatcactggttaaacttctaggatttttccgaaatggtgttgagagatatttgcgttcaagttataaaattttgtgcctttgaaattagcctgactgaagccctgtgttatttcatttggatatttttggagtttaatggggattattaggatcaattcgaagaactctttaagctgttgctagtcatcatatgttttattaattatattcttcagcgacttatgaaaactaagattactttggttttattcgtttaagcatcaacttcaagcctttttttttgtttgaatagattcttattgataggaggagttattaatcgtgatcgatttgtttcattgattgctatgaaaattaaaatttaaacttcgatcctgaagcgatggataatgttttatggtgttaa

SEQ ID NO: 4726 - DNA, 821 bp, Cucumis sativus
tttctcacatctttacccgccggagcttcgttttctgctctcaacttcgatacggcaaaaatggcttcagagaagaagctgtctaatcctatgcgcgatatcaaagtccaaaaacttgtcctcaacatctccgttggcgaaagtggcgatcgtcttaccagagccgctaaggtgctcgaacaactcagtggccaatctccagtcttctcaaaggctcggtacaccgttcggtcgtttgggatccgtcgtaacgaaaagattgcgtgttatgtgaccgtcaggggcgacaaagcaatgcagcttcttgagagtggtttgaaggttaaggagtatgagcttttgcgccgtaacttcagtgatactggctgctttggttttggaattcaggagcacattgatcttggaattaaatatgatccttctactggtatttacggcatggatttctacgttgttctggaaagaccaggttaccgtgtaggtcggcgccgtagatgcaaatcaactgttggaattcagcatagagtcactaaagaggatgccatgaagtggttccaagtcaaatatgaaggagttatcctcaacaagtctcaaaatatatcctagaaaaggttctctactatctttgatagcatgttcaaattttggcaatatgttttcttgttttaagatttttgtctatcagaacttcaatttcttgtttaaggagcgttttagcttttcttattttatagtgtgcttcgtttcaactcttttgaccgcattgaaagttaatattcactttttgttagctgatacaatgtcagtcagttgttttgtta

SEQ ID NO: 4727 - DNA, 768 bp, Cucurbita pepo
ctcgcacttgtctccttcccgagcttcgttttctgctctgaacttcgagacggcaaaaatggcgtcagagaagaagctatctaatcctatgcgcgatatcaaagtccaaaaactcgttctcaacatctctgttggtgaaagtggtgatcgtcttaccagagccgcaaaggtgctcgagcagctcagtggccaatctccagtcttttccaaggctcggtataccgttcgatcgtttgggatcaggcgtaacgaaaagatcgcgtgttatgtgaccgtgaggggtgataaagcaatgcagcttcttgagagtggtttgaaggttaaggagtatgagctattgcgccggaactttagcgatactggttgctttggtttcggaattcaggagcatattgatctcggaattaagtatgatccttctacgggtatttatggtatggacttctatgttgttctggaacgaccaggttaccgtgtaggtcgtcgccgtagatgcaaatcaagtgttggaattcagcatagagtcactaaagaggatgccatgaagtggttccaagtcaaatatgaaggagttattctgaacaagtctcaaaatatatcctagaaaaggttctctactatctttgatggcatgttcaaattttggcaatgtgtttagtactttaagatttgtctgtcagagctatttctttttaaggagagtttaagcatttcttattctatagtgtactttgtttcaactcagtatacaattttttggttgatagg

SEQ ID NO: 4728 - DNA, 758 bp, Cyamopsis tetragonoloba
ctctttcactacctctgtagattccatttccaatggcttcggaaaagaaactcgccaacccaatgagggaaatcaaggtgcagaagctcgtcctgaacatctccgttggtgagagtggcgatcgtctcactagagctgccaaggtgctggagcagctcagcggccaaacccctgtgttctctaaagcgagatacactgtacgatcctttggtatcagaagaaatgaaaagattgcttgctatgtcactgttagaggtgacaaggcaatgcagcttctggagagtggtttaaaggttaaggaatatgaacttctgcgaagaaacttcagtgatactggatgttttggcttcggtattcaggaacacattgatttaggaatcaagtacgatccctcaaccggtatttatgggatggacttctatgttgttttggagcgcccaggttaccgtgttggacgtcgtcgcagatgcaaggctcgtgtagggatccaacaccgtgtcaccaaggaggatgccatgaagtggtttcaggtgaaatacgaaggtgtgatcctcaacaaggcacaaacaattgttggttagattggactagtgttctgagaagttttaatagttctgctaattttaattttgtacttttatcgaagaactagcaaaatttgtggagtactgttgcaactggttatatgagctgtttttaggtattatttttttcttgtcattagtttcggcaactaaattgatatcatgcttttgaaa

SEQ ID NO: 4729 - DNA, 585 bp, Eschscholzia californica
gatagagagagagaaagttagagatggcgtcggacaagaaactctcaaaccctatgagggacatcaaagttcaaaagctcgtcctcaacatttctgttggagaaagcggtgatcgacttaccagagctgctaaggtcctggagcagttgagtggacaaaccccagttttctcgaaggctaggtacactgtgaggtcctttggtatcagacgtaacgagaagattgcttgctatgttaccgttagaggtgagaaggccatgcaactcctagaaagcgggttgaaggtgaaggagtatgagttgttgagaagaaactttagtgacactggatgttttggatttggtatccaagaacacattgatcttggaatcaagtatgatccttctactggtatttacggaatggacttctatgttgtcttggaacgacctggttatcgtgtgggccgaagaagaaggtgcaagtctcgtgttgggattcagcacagagtcacaaaagaggattccatgaagtggttccaagttaagtatgaaggtgtcatcctcaacaagtctcagaacatcactggttgataagttagaaact

SEQ ID NO: 4730 - DNA, 885 bp, Euonymus alatus
tcttcccttttcgttatcccctgcaccgcccccaccctacatcctccacttcgactcggcgcctacgcatcaaaatggcttccgagaagaagctgtcgaaccctatgagggaaatcaaagtgcagaagcttgttctcaacatctcggttggtgagagtggcgatcgtctcacccgtgctgctaaggtcctggaacaactcagcggccaaacccccgtctactcgaaggcgaggtacactgttaggtcgtttggaatcaggcgtaatgagaagatagcttgctacgtgactgtgagaggcgaaaaggccatgcagctattggagagcggcctgaaggtgaaggagtatgagcttttgaggaggaacttcagtgacactggttgcttcgggtttggcatccaagagcacattgatctcggcatcaagtatgatccttcaactggtatttatggtatggacttctatgtcgttttggagcgtccaggatacagagtgggtcgtcgccgcagatgcaagtcacgtgtcggaattcagcacagagtgactaaggaggatgcaatgaagtggttccaagttaaatatgaaggagttatcctgaacaagtctcagaatattggagcttaggaagatgcctttgctatctatgttagtttttatccagttttgtttggctgaattcttgtaacttgagttacaattttacttgatgtttatgacttggtaagttggtagcatctaagttactatttcgttgattttcttttttagttcttttctggtttatgtgagaatatgtgatgctcgtgtctttcatgttatagtctgagccgaaagactcgggttttcattattattgttgttgttggctactgccctgttactgtgg

SEQ ID NO: 4731 - DNA, 599 bp, Euonymus alatus
gcctgcaccgcccctgcaccgccctcaccctaccccttcgcttcagcgcatcggcatcgcaatggcttccgagaagaagctgtcgaacccaatgagagaaatcaaagtgcagaagctcgttctcaacatctccgttggtgagagtggtgatcgtctcacccgtgctgctaaggtcctggaacaactcagcggccaaacccccgtctactccaaggcgaggtacacggttaggtcgtttggaatcaggcgtaatgagaagatagcatgctacgtgactgtgagaggcgaaaaggccatgcagctattggagagcggcctgaaggtgaaggagtatgagcttttgaggaggaacttcagtgatactggttgcttcgggtttggcatccaagagcacattgatctgggtatcaagtatgatccttcaactggtatttatggtatggacttttatgtcgttctggagcgtccagggtacagagtgggtcgtcgccgtagatgcaagtcccgtgttggaattcagcacagagtgactaaagaggatgcaatgaagtggttccaagtcaaatatgaaggagttatcctcaacaagtctcagaata

SEQ ID NO: 4732 - DNA, 774 bp, Fraxinus spp
tttgtcgcttcaccaaattccccaatcatccggcggctgagaacctcatcaccaccactgctccgccatggcgtcagagaagaagctgtcgaatccaatgagagagatcaaagtacagaagctcgtcctcaacatctccgtcggcgagagtggagatcgtcttaccagagccgctaaggtgctagagcaactcagtggccaatctcctgttttctccaaggcaagatacaccgtgaggtcctttgggatcaggcgtaatgaaaagatcgcatgctatgtaacagtcagaggtgataaagcaatgcagcttcttgagagtgggttgaaggtcaaggaatatgagttgttgagaaggaatttcagcgacactggctgttttggctttggcattcaggagcacattgatcttggaatcaagtatgatccatcaactggaatttatggtatggatttctatgttgttttggagcgccctggctaccgtgtgggccgtcgtcgtagatgtaaatctcgagttggaattcagcacagggtcacaaaggaggatgcaatgaagtggttccaggttaaatatgaaggagttatcctcaataagtcgtctaacattacaaattagtttgaaagcagtactagacatgtttgagatctatgcattttgtagaccatcttctgttacttttgagctcaaagttttagatatttaatgtttgttgcaggcaagtttattttatatcactttattacttttttatcaagtaaatagtttatcctttt

SEQ ID NO: 4733 - DNA, 961 bp, Gossypium raimondii
caaaacccatagaccagaagcccaaaactcaaggatgcgactttggcactcattcatgaacaaggaagcgacttttaacactcatacatacaacctgacaaccctagagtgaggaattagacccagctgcctctttgtcacttgtcagtacaacgctgctctcagcctccatttcccatatcatggcatcggagaagaagctgtcgaacccaatgagggagattaaagttcaaaaacttgtcctcaacatctccgtcggtgaaagcggcgatcgtctcacccgtgccgccaaggtcttggaacaactcagtggtcaaacccccgtcttctccaaagctaggtacactgtgagatctttcggaattcggcgtaatgagaagattgcttgctacgtgactgtgaggggagagaaagctatgcagcttcttgagagtgggttgaaggttaaggagtatgaacttttgaggaggaacttcagtgataccggctgcttcggattcggtatccaggaacacattgatcttggcatcaagtacgatccttcaactggtatctacggcatggacttctacgttgttctggaacgagctggttatcgcgttggccgtcgtcgccgatgcaagtcacgtgttggtattcagcacagagttactaaggaagatgccatgaagtggttccaggtcaaatatgaaggtgtcatccttaacaagtcccaaaatattggagcttaagaaatagcagtaacgagctcagcttgagttgttttcagttttggctacttgattttgactagtttgtgtatcagtttctctctttttcctgaatagatttatgcttgagactttcctgttggttttatatttattcttcaatttttagtaacccttgtttcctctggcatttgcttgttctttcaaccctgcaagtttcaattcggtaaaaaatatgaaaaccaatttaa

SEQ ID NO: 4734 - DNA, 1262 bp, Gossypium raimondii
aattaattcaattaatcaaaacaatttataattattaaattctttacctcgttacccaccctcaaaagggtatcacttcgcagttgacactcgtatatgaaccctaaaaaccctaatcctaaaaagtaaatttcagtatattaatttgttagatctgtctcagctgctctccaagtctttcaagtcgccatggcatcagagaagaaattgtcgaacccaatgagggaaatcaaagttcaaaagctcgtcctcaatatctccgtcggcgaaagtggcgatcgtctcacacgcgccgccaaggtcttggaacaactcagtggtcaaacccctgttttctctaaggcgagatataccgtgagatctttcggaattaggcgtaatgagaaaattgcttgctacgttacggtgaggggagagaaggcaatgcaacttctcgagagtggtttgaaggttaaggaatacgagcttttaaggaggaactttagcgatactggctgcttcggattcggtatccaagaacacattgatcttggcatcaagtatgatccttcaactggtatctacggtatggatttctatgttgttctcgaacgagctggataccgtgtaggtcgtcgtcgcaggtgcaagtcacgtgtcggcattcagcacagagttacaaaggaagatgccatgaaatggttccaagtcaaatacgaaggtgtcatccttaacaagtcgcaaaacatcggagcttaagagtagtagttgttacaagctaagttgagtttgtttcgagttttgggtactcagccttttgctagtttctgttgtctcggttctcgttttctcgaagagatttatgactaactctacggtcgtaactacctttttttttcttcttttggtttaattacattttgatatagcatttggaaaatggctttctctatctatgcttgttgatgttgatggagatgtaaggaaaagacccagtttgaaactagccatcggcttccaacgatcttttcgcatttcagtcgaaacatttcttttcaaatcgaagttgttctagtaatttggtaagctttgtacgccgtaaagttacgacctcaccgacgaggcgcatggtaccggttagtgctctagatattgcgactaggattccttgaagctattcttaagatagtttcctaaaaatattttgttaaaaatttcttatgaaaaaatttaggtgatgatgaccaaagctgggatacgttatcaagtgtagggactaatgt

SEQ ID NO: 4735 - DNA, 1175 bp, Gossypium raimondii
tttagtttgggctttgcagctgggtctcactgtgtccctgtttatatcggatcaaaggggcaatgtagtaaattaaaacagggataaaaccctagccctaaactcatttcttttaaaactccccatctattcacgcaggcgccccttcatcactctgccaccgctctattcaacctccgtcgcttcgccatggcatcagagaagaagctgtcgaacccaatgagggaaattaaagttcaaaagcttgtcctcaatatctctgttggtgaaagtggtgatcgtctcacccgtgctgccaaggttttggaacaactcagtggtcaaacccctgtcttctccaaagctaggtacactgtgagatctttcggaatcaggcgtaatgagaagattgcttgctacgtgacagtgaggggagagaaggctatgcagcttcttgagagcggtttgaaggtcaaggaatatgagcttttgaggaggaacttcagtgatactggctgctttggattcggcatccaggagcacatagatcttggaatcaagtatgacccttcgaccggtatctacggtatggatttctatgttgttcttgaacgagctgggtaccgtgttggccgtcgtcgcagatgcaagtcacgtgttggtattcagcacagagttacaaaggaggatgccatgaagtggttccaggtcaaatatgaaggtgtcatccttaacaagtcccaaaatattggagcttagaagtagcagtatgagattgtttttagttttgagtacctgattttggctagtttatatttatcagatagtattttcctgaacaaatttattttatgttttagggtggaatcctaagtttttctttttgttggtttagtttattaatatatttacaatcggaagaaagttttttgtttcttttcaatttagtattttgattactcaattgtcctgagagatatcctcaatggccaccaggcaggctcttgcaagactgttcatcagaggaggagaaagactgcacgtgcaggttggccccaaattatgggcttcacatgatttgtcttacagaaagcctttgcttgttttcaaattaatcgattttttcgatttgaaattttattaaatcaagaaatatttaaaaaatatgataaagctaaattatatctgatatgaaa

SEQ ID NO: 4736 - DNA, 1408 bp, Gossypium raimondii
ggaaagtatggagaaaaacgtgcgttttaactggccgagaaattgagaaaataaaatgcaaaaagaaaaaaaaaagagagaatggattgggtcggggttcaagtaaaattaaaagtagctattgggatatttgaagcctaagacatttctgggcccaaaaggcaaagcgcatttgaaacagaaataaaaccctagccctaatctctctcacctctactctcaaacgccgctgccttctttgtttctgcgccgctgctctacaccttccttcggttcacccaatggcatcggaaaagaagctgtcgaacccaatgagggagattaaagttcaaaaacttgtcctcaacatctctgtcggtgaaagcggtgatcgtctcacccgtgccgctaaggtcttggaacaactcagtggtcaaacccctgtcttctccaaggctaggtacactgtgagatcttttggaatcaggcgtaatgaaaagattgcttgctacgtgacggtgaggggagagaaggctatgcaacttctcgagagcggtttgaaggttaaggagtatgaacttttgaggagaaacttcagtgatactggatgcttcggatttggcatccaggagcacattgatcttggcatcaagtacgacccttcaactggtatctacggtatggacttttatgttgtcctggaacgagctgggtaccgcgttggtcgtcgtcgcaggtgcaagtcacgtgttggtattcagcacagagtaactaaggaggatgccatgaaatggttccaggtcaaatatgaaggtgtcatccttaacaagtctcaaaacattggagcttaggggtagcatttcaagttcagttgagttgtttgaagttttggttatttgattttgactatttactgtatctggttttttgttttaccggagagatatatgattgacttgaaattccaaagtaccttccttgttggtttattacattatcaatatcaatatttatacaattggagaatgcctttctctgttcaagtattttgaattggagctgcggaaataagagtaaagcttagcatttgctattacagaaaaagggtagggggttctgtctccttatgacatcaacaattgaagaagttcagtcttcctcaatctggagtaacccttgattcctctggcttttgctagttctttcaactcagaaagttttagtttctccatgtttgccaactctgagcccttcccgtcggtggacaccacttcattgttcctctcaggggtctttgttctgtgtgctgttgggtgtggtattggcgacctctttataaaattagatggtggccttgataaattgaactcctcggtttctgcagtagctttcttctccactttacttttcttagagatgctacttctcc

SEQ ID NO: 4737 - DNA, 1214 bp, Jatropha curcas
atgcagaatcaatatccatgatttattcattgtttattccgacatttccacaattttataaacagacgtttctagcacagtttgattaaacggcagatttccgttgtgttgtgttgattcacgtgatcgataaaataatcgacttcctgttgaacgaattcaatgcatgcatcctgagagcgagctcgtttgcacaagtatttcaccaagtatccaatgtgctcctcgacggtctgatcttcgagcattttctttattacatccatcgtgttcgtgcataaattacataggtcaatgtcgaattttttttgctttgatggcacatcaaagcttgcgaaagttactgccgccagcattaacacgaacagtgggttcatgatttgcggatgggtgttctctctgtctacaaggatctccttcaaacaacaaaaatggcttcggagaagaagctctcaaacccaatgagagagattaaggtacagaagcttgtactaaatatatccgtcggagaaagcggtgataggctcactcgtgctgctaaggtgctcgagcaacttagcggtcagactcctgtcttctctaaggctaggtacactgttcgatcttttggtatcaggcgtaatgaaaagattgcttgctatgtgaccgtgaggggggacaaagctatgcagctacttgaaagtggtttgaaagtgaaggaatacgagctgttgagaagaaacttcagtgacactggttgctttggatttggaatccaggagcacattgatcttggcatcaagtatgatccttcaactggtatttatggtatggatttctatgttgttttggagcgtccaggctatcgcgttggtcgtcgcagaagatgcaagtcaaaggtcggtattcagcaccgggttaccaaggaggatgcaatgaagtggtttcaggtgaaatatgaaggtgtcatcctcaacaaggcccagaatattacatcgtagaaagtgttggtttttcaagtaatattttgcagaatgtctttttattttgttgggagttatgtaacttctgaagagaattttggatttggtagaatcttgtttactataattttggattggttagaatctgaaatactatttctggtcatcattctattttaattgtgcgtgctttacttatatgtgagtatatcattgctttacttacataattgctaaaattcgatttggccc

SEQ ID NO: 4738 - DNA, 797 bp, Liriodendron tulipifera
  misc_feature (516)..(516): n is a, c, g, or t
gcggaatatagggtttcttccattccttctgccctctttcctttccacagctgttgccccttctccgatagaacagatcaatggcatcggagaagaagctcttgaacccgatgagggagataaaggtccagaagctggttctcaacatctctgtcggtgaaagcggagatcgtctcacccgagccgctaaggttttggaacagctgagcggacaaacaccggtgttctctaaggcgagatacaccgttcgatcttttgggatcaggcgtaatgaaaagattgcttgctatgtcactgttagaggggacaaagctatgcaacttttggagagcggtttgaaagtgaaagaatatgaacttttgagaaggaacttcagtgatactgggtgcttcggctttggtattcaggagcacattgatcttggaatcaagtatgatccatcgacaggcatttacggcatggacttctatgtcgtattggaacgaccagggtaccgcgtgggccgtcgccggaggngcaagtctcgtgttgggatccagcatcgggtggtcaaggaggatgccatgaaatggttccaggtcaaatatgagggtgttatccttaacaagtcgcaaaacatagcttagaaatcgaccaattttattttgaattttgcaagttttgcttacatgatgccgacaaggagatggaactcttgcactctcttttcttctctttttgtgtgttctttgcggggatttagatcaggccaagttgtttttgcagttgctcagttggaattagttctagtttacttt

SEQ ID NO: 4739 - DNA, 775 bp, Lotus japonicus
acttctcttcacctagccgccgctgcaaccctaccaccctccagatccaatggcttcagagaagaaactcgcgaaccctatgagggagatcaaggtccagaagctcgtcctcaacatctccgtcggtgagagtggtgatcgtctcaccagagccgccaaggtgctggagcaacttagtggccaaaccccagtgttttctaaggccagatacactgttcgatcctttggaatcagaagaaatgaaaagattgcatgctatgtcactgttagaggcgacaaggcaatgcaacttttggagagtggattgaaggtgaaagaatatgaacttcttagaaagaactttagtgatactgggtgctttggctttggtattcaggagcacattgacttgggaatcaagtatgatccatccactggaatttacggtatggatttctttgttgttttggagcgccctggttaccgtgtgggacgtcgccgtaggtgcaagtcccgtgttgggattcaacaccgtgtcacaaaggatgatgctatgaagtggttccaggtgaaatatgagggagtgatccttaacaaggctcaggcagtgttttaattcaaccatgttcactttaggagagtatgttatgtttgccaactatagtttgatctttttcagatagtatgttaagtttcaggcagttttggcatccctcaggtgtccttgtagggcatcaggcaaattttcaatgaatacttttgtttgtcaattttgttgttttatgacgaaagctca

SEQ ID NO: 4740 - DNA, 774 bp, Lotus japonicus
ggctagccagtcgtcttcctctgctgctccgccactgttgctcagattccattcgcaatggcttccgagaagaaattggcgaaccccatgagggaaatcaaggtgcagaagctcgtcctcaacatctccgttggtgagagtggcgatcgtctcacaagagccgctaaggtgttggagcagctcagtggccaaacccctgtgttttccaaagctaggtacactgtccgttcttttggtattagaagaaatgaaaagattgcatgctatgttactgttagaggtgacaaggcaatgcagcttttggagagtggtttgaaggtgaaggaatatgaacttctgcgaaaaaacttcagtgatactgggtgctttggctttggtattcaagagcatattgatctgggaataaagtatgatccttccactggtatttacggcatggatttctttgttgttctggagcgccctggttaccgtgttggacgtcgtcgtcggtgcaagtctcgtgttgggatccaacatcgtgtcacaaaagatgatgctatgaagtggttccaggtgaaatatgaaggtgtgatcctcaacaaggcgcaagcggttttctagaccgagctatattgtctatggaatttgcaagttttgttaattataacttgatgtttattgaactaagtagcttaaatttctagaatattaatgtgtctggttatgaacttttgtatggagtttatttctgatcaatttatttttggttgattcattcaccatcccaaaaaa

SEQ ID NO: 4741 - DNA, 872 bp, Medicago truncatula
cggtcatcacttgaaggcaaaagcttcagattttagggtaggggtttattcattccattcatctctgccgccgcaacacatcaatggcttccgacaagaaactggcgaacccaatgagggatatgaaggttcagaagctcgtcctcaacatctccgtcggtgagagtggagatcgtctcaccagagctgccaaggtgctggaacaacttagtggtcaaaccccagtgttctccaaagcgaggtacactgtgcgatcctttggaatcagaagaaacgagaagattgcatgctatgttactgtcagaggcgacaaggcaatgcagcttttggaaagtggtttaaaggtgaaggagtatgaactgttgaggaggaacttcagtgatactgggtgctttggatttggtattcaggagcatattgatttgggaatcaagtatgacccttctactggtatttatggaatggatttctttgtggttctggaacgccctggctatcgtgtgggtcgtcgccgtagatgcaaggcccgtgttggaattcaacaccgtgtcaccaaggatgacgccatgaagtggttccaggtgaaatatgagggagtgatccttaacaaatctcaggcaattgtttagttaaactgagttcttttagaagtatgttactgtttttggcaactatagtttggtctctcttggacaatgtcttaattatcagacagattttggatcactgttcttatgattttgttatgtttttatgatgaagcacatggattacctacagctgtgttaaatactcctatgctaaattaaaacaaggcaataatttgcgttatacttttggctcgaaatgaaaaatgagaacgacgtggagaa

SEQ ID NO: 4742 - DNA, 990 bp, Cucumis melo
agcaccaacatcagcaacgcctaagccgcagccacctgccacagaacactccaatggcttcggagaagaagttatcgaaccccatgagggatattaaggtgcagaaactcgtcctcaacatctctgttggtgagagtggagatcgcctcaccagagctgccaaggtgcttgaacaacttagcggccagagccctgttttctctaaagcgagatacactgtaagatcgtttggaatcagacgtaatgagaagattgcttgctatgtcactgttagaggagagaaggcgatgcaacttttggaaagtggattaaaggtgaaggagtacgagttgcttcgtaggaactttagtgatactggatgctttggctttggtattcaggagcacattgatcttgggatcaagtacgatccatccaccggtatctatggtatggacttcttcgttgttttggagcgaccgggataccgtgttggacgtcgcaggaggtgcaagtctcgtgttgggatccagcacagagtcacaaaggaggatgccatgaagtggttccaggtgaaatatgagggtgtgattcttaacaagtcccagcaaatcactggttaaacttcatagggtttttccctaatggtgttgagagatatttgcgttcaagttataaaattttgtgcctttgaaattagcctgactgaagctctgtgttattttatttggatatttttggagtttaatggagattattaggatcaattcgaacaactcttttaaagctgttgctagtcatatgttttattaattatattcttcagctacttatgaaaactaagattactttggttttatttctttttaagcatcaagttcgagccctttttttgtttgaatagatttttatggaaaggagtaattattattagtgatcgatttgtttcattgattgttaaggaatattgaaactttgattatgaagcgatggataatgttttttaaaaaa

SEQ ID NO: 4743 - DNA, 804 bp, Cucumis melo
gccttgcctatcccctgttgcgtgtctcaggccgagcttcgttttctgctctgaacttcgatacggcaaaaatggcttcagagaagaagctatctaatcctatgcgcgatatcaaggtccaaaaacttgtcctcaacatctccgttggcgaaagtggcgatcgtcttaccagagccgccaaggtgctcgaacaactcagtggccaatctccagtcttctcaaaggcacggtacaccgttcggtcgtttgggatccgtcgtaacgaaaagattgcgtgttatgtgaccgtcaggggcgacaaagcaatgcagcttcttgagagtggtttgaaggttaaggagtatgagcttttgcgtcgtaacttcagtgatactggctgctttggttttggaattcaggagcatattgatctcggaattaagtacgatccttctactggtatttatggcatggatttctatgttgttctggaaagaccaggttaccgtgtaggtcggcgccgtagatgcaaatcaactgttggaattcagcatagagtcactaaagaggatgccatgaagtggttccaagtcaaatatgaaggagtcatcctcaacaagtctcaaaatatatcctagaaaaggttctctactttctttgatagcatgttcaaattttggcaatatgtttacttgttttaagatttttgtttatcagaacttcaatatcttgtttaaggagcgttttagcctttcttattttatagagtgcttcgtttcaactcttttgaccgcattgaaagttaatacactttttgttagctga

SEQ ID NO: 4744 - DNA, 984 bp, Quercus alba
aagcagtgtatcaacgcagagtacatggggcttttatattttatacaagtgctcctcttgccctcctctctcgtctgccgctgcaatctcttctcaacttcacaaatggcttccgagaagaaactgagtaacccaatgagggaaatcaaggtccaaaaacttgtcctcaacatctccgttggtgagagtggtgatcgtctcaccagggccgccaaggtgttggagcagctcagtggccaaaatccagttttctcaaaagcaaggtacactgtgcggtcctttggtatcagacgtaatgaaaagattgcatgctatgtcactgttaggggtgagaaggcaatgcagcttttggagagcggtttgaaggtgaaggaatatgagctgctgcgaaggaactttagtgatactggatgttttgggtttggtattcaggagcacattgatttgggaatcaagtatgatccttcaaccggtatttacgggatggacttctttgttgtgctggagcgccctggttaccgtgttggccgtcgtcgcaggtgcaagtctcgtgttgggatccagcacagggtcacaaaggatgatgccatgaaatggttccaggtcaaatatgagggtgtgatcctcaacaagtctcagaatatcacaggttaataggcatggaagattttgacttaggttgttatgtagaccagtgttctttactattattatctttctttttccagttttgggagagcttgggataatgttttctgggacaaaatctgttaattttttgctcctttatatattttcagcagtttcagctgacatctgaatcactatcatgatagttatcttcagacaattagtttttctatgataatgagtattttgtgttttggctttcaatgcatttagcattttgcctctgccttgtctatatcatgttccaattaccttgagctatccaatggatgataaggtcacaaagtctggtga

SEQ ID NO: 4745 - DNA, 1134 bp, Quercus alba
caaaaaccctagctctaagcaaaccctactcctattataccctcaaatatctctctctctcgctcagcttctcagccatttcgcctcagtactctgctcctccacatccacacaacaatggcttcggagaagaaactaagcaacccaatgagggagatcaaggtccagaagctcgtcctcaacatctccgttggtgagagcggtgatcgtctcaccagagccgccaaggtgttggagcaactcagtggccaaaaccctgtcttctccaaagctaggtacacggttaggtcgttcgggattaggcgtaatgaaaagattgcgtgctacgtgacggtgagaggcgagaaggcaatgcagcttctggagagtggcctcaaggtcaaggagtacgagcttttgaggagaaacttcagcgatactggctgcttcggattcggtattcaggagcacatcgatctcggaatcaagtatgacccttcaactggtatctatggtatggactttttcgttgttttggagagagcaggatatcgtgtgggtcgtcgtcgtagatgcaagtcccgtgttggaattcagcacagagttaccaaggaagatgcaatgaagtggttccagatgaaatatgaaggggtgatccttaacaagtcccaaaacatatcttagctaaatctcctttatagcctttgataaattaaagttttggcgagctgttaccttcctttggtttctttaccaggatttatattttgtctgaagagattatgagttacattagtttaagtactttccggtgatttaattttttaactctcgatgctttaatatatgggagtttgatatcatttctgcctctgctctcaatttctgtacgttaggttcaatatgaattgcattgctggttgggtcttgtactgccttgtatttgttttgttcacctgatggttcattatctctaaactgactcaactgagtactcaaagctgctaattacactggccgctaaccttctggcttgatatgtcactgcctcttcagtatgatggtccagttatctgatagctgcttaatagtgttgtggttggttgctggctcacgggctgtattttggagtatacatgataccaactcttgaca

SEQ ID NO: 4746 - DNA, 791 bp, Carica papaya
gcagtcgccgctccatctcacttcttctgatttcttcttcgtagtcctgcaccggggggaaactgcaatggcgtcagagaagaagctttcaaacccaatgagggagataaaggtgcagaagcttgtactcaatatctccgtcggtgagagcggggatcgtctcactcgtgcggcaaaggtcttggaacaactaagtggccaaactccagttttctccaaggcgaggtacactgttaggtcttttgggatcaggcgtaatgagaagattgcttgctacgtgacggtgaggggagagaaagcgatgcagcttttggagagtggtttgaaggtgaaggagtacgagttgttaagaaggaactttagtgacactggctgcttcgggtttggtattcaggagcacattgatctgggtatcaagtatgacccttcaactggtatctatggtatggatttctatgtggtgctggaacgcccaggataccgtgtaggtcgccgccgccgttgcaagtctcgtgttggaattcagcacagagttaccaaggaagatgcaatgaagtggttccaggtcaagtatgaaggtgtcatcctaaacaagtcccaaacaattgctggctcttagagagttgtttttcttaccttttttgttactagtttgttgtctctttgccttttggatggtttctactactgggttgttacaatttccttgaagagatttcccgatgagttgcttgaatctgaagcgctgtttatgatttctgttatatgataaaagatttatctcttgatta

SEQ ID NO: 4747 - DNA, 1008 bp, Arachis hypogaea
tatcaacgcagagtacgggggaagtccgaagctgaagcactgcaactgcgcatctcggcaactattcgccactggtcctgtactctgccgccttcatattagctcaaatccaaatccaaatccaatggcttcggagaagaaacttgcgaatccaatgagagagattaaggtgcagaagctcgttctcaacatctccgtgggtgagagtggagatcgtctcactagagccgctaaggtgctagagcaacttagtggccaaaccccagtgttttccaaagcaagatacactgtccgttcctttggaattagaaggaatgagaagattgcatgctatgtcactgttcgaggtgacaaggcaatgcagcttttggagagtggtttgaaggttaaagaatacgaacttttgaggagaaacttttctgagactggctgctttggctttggtattcaggagcatatcgatttgggaatcaagtatgatccttccactggtatctatggtatggacttcttcattgttttggagcgaccaggataccgagttggaaggcgcaggagacagaagtcccgtgttggaattcagcacagggttaccaaagaggacgccatgaaatggttccaagtgaagtatgagggagttattctgaacaagtcccaacaaatctcttaatattttaatagattggtaggattcagcctttggttgtctaggtgtcacccaatgattggccgttccaattttccctccattttgattctaatggttatgcccattctctaaggatgttaagatatgctattgttgtaatccttttagacaattctggtataaagattttatagtttctattgagcacagtgaacttgcattgttgaatactatgttggtgacatacattctcacatggtattacatttaccagatacttttgctcctcaaaagaaaaaacaccctaaacactggaacgaacaaagtatttctgtcagcgttatgatttacaaaatagt

SEQ ID NO: 4748 - DNA, 968 bp, Arachis hypogaea
ctatacctcgtcgtgccgtcggtcgacgtcgtcagaagacagcggtagtcaacgcagagtacgggggagtccgaagctgaagcactgcaactgcgcatctcggcaactattcgccactggtcctgtactctgccgccttcatattagctcaaatccaaatccaaatccaatggcttcggagaagaaacttgcgaatccaatgagagagattaaggtgcagaagctcgttctcaacatctccgtgggtgagagtggagatcgtctcactagagccgctaaggtgctagagcaacttagtggccaaaccccagtgttttccaaagcaagatacactgtccgttcctttggaattagaaggaatgagaagattgcatgctatgtcactgttcgaggtgacaaggcaatgcagcttttggagagtggtttgaaggttaaagaatacgaacttttgaggagaaacttttctgagactggatgctttggctttggtattcaggagcatatcgatttgggaatcaagtatgatccttccactggtatctatggtatggacttcttcattgttttggagcgaccaggataccgagttggaaggcgcaggagacagaagtcccgtgttggaattcagcacagggttaccaaagaggacgctatgaaatggttccaagtgaagtatgagggagttattctgaacaagtcccaacaaatctcttaatattttaatagattggtaggattcagcctttggttgtctagttgtcacccaatgattggccgttccaattttcccaccattttgattctaatggttatgcccattctctaaggatgttaagatatgctattgttgtaatccttttagacaattctggtataaagattttatagtttctattgagcacagtgaacttgcattgttgaatactatgttggtgacatacattctcacatggtattacttttaccag

SEQ ID NO: 4749 - DNA, 939 bp, Arachis hypogaea
caacgcagagtacgggggattcctgttgctgccgcgctgctgcatttcacttcctcacaaagcgccatggcatcggagaagaagcttgcgaaccctatgagggaaatcaaagtgcagaagcttgtcctcaacatctccgtcggcgagagcggcgatcgtctcaccagagcttccaaggtcttggaacagctcagcggccaaacccctgtcttctccaaggctaggtacactgtgcgttcatttggaataaggcgtaatgaaaagattgcttgctatgtcaccgttaggggagacaaggccatgcaacttcttgagagtgggttgaaggtcaaggagtatgagctgcttaggaggaatttcagcgatactggctgctttggttttggaatccaggagcacattgatctcgggatcaagtatgatccttctactgggatctacggcatggatttctttgtcgtcttagagcgtgctggataccgtgtgggtaggcggaggagacgaaagtcccgtgttggaattcaacacagggtcaccaaagaagatgcaatgaagtggtttcaagttaagtacgaaggagttattcttaacaagtcccaacaaattgtatcctagacagcactattttagttttttttttggactggtagtcagcaacatgcaactatttcatttggttttcttcaagttttgatgggatttttcccagttttatgaagcaagatatttgtttcattttgagttcaatacaatgccggtattgtttttatttaatttagggtgtcatttcctgaagggacgtaacttaatattgttaatgttgggtattgcatgtgtttgttgttatgtctattaacgcctgtttgaaccgttcgatgatttctggcgattcagcataccatgttgatttgcataaattctatgaaatctgagtttcaa

SEQ ID NO: 4750 - DNA, 1009 bp, Populus trichocarpa
cttgagtgagcaccctaaaccaggcaggcaagcagatcatagcacaaaaccctagtggttgtccctcacttatatttaatcttcttgtagaaacaaattccacagcctttcctcctcctcctctgcctccatcgaaccagccaagctcacacaccatcacaatggcttcagagaagaagctatcaaacccaatgagagaaatcaaggtccagaagctggtcctcaacatctccgtcggtgaaagcggagacaggctcactcgtgccgccaaggtgctcgaacaactcagtgggcaaaccccggtgttctcgaaagctaggtatactgtgagatcttttgggattaggcgtaatgagaagattgcttgctatgtgactgtgaggggagacaaggctatgcagttgcttgagagtgggttgaaggtgaaggagtatgagcttttgaggaggaacttcagtgacactggttgctttggtttcggcatccaggagcacattgatcttggaatcaagtatgatccttccactggtatttacggcatggacttctatgtcgttttggaacgtcctgggtaccgtgttggtcgtcgtcgcaggtgcaagtcacgcgttggcattcatcagagagttacaaaggatgacgcgatgaaatggttccaggtcaaatatgaaggagtcatccttaacaaatcccaaaatatttgatcttagatcttttcctgacttcttcaagtttaaattttggcaattcgttgaccctgggcagggatttatgtacctggagttgtagttttcatctagaatttcttgaattggtagataatctgaagttctatgtatttttgtgttcttgtttcactgcttgtgcttttattaatataatgctgttcgtttatgctgatatcatgcatccagtattcccaatcaaaatcagtgtggcttgtttgtccataatcaaaatcggtgtggcacccaacaaagcaggggacataatttcccgtaactaccat

SEQ ID NO: 4751 - DNA, 1080 bp, Populus trichocarpa
tttcctgccccagtccctcccgcctcccgcctcccgcagcccgcagcccgcagcaatggcttcagagaagaaactatcgaacccaatgagagagatcaaggtccagaagttggtcctcaacatctctgtcggggagagtggtgatcgcctcacccgtgccgccaaggtccttgaacagcttagtggtcaaacaccagtcttctcgaaggctaggtatactgtgagatcttttgggatcaggcgtaacgagaagattgcttgctatgtcactgtgaggggagacaaggctatgcagttgctggaaagtgggttgaaggtgaaggagtatgagcttttgagaaggaacttcagtgatactggttgcttcggattcggtattcaggagcacattgatcttggcatcaagtacgacccttctacaggtatttatggcatggacttctacgttgttttggaacgtcctggataccgtgttggccgtcgtcgtaggtgcaagagtcgtgttggaattcaccagagagttacaaaggacgacgcaatgaagtggttccaagtcaaatatgaaggagtcatacttaacaagtcccaaaatatttgatcctagttcttttcccttggttgagttaaaagttttcactagttacatttggcaggattgtgcatctgaatttaaaattttgttgatgagatttttgaattggtagcgtctgttacaccctacttggttttcttgctcgccatttatgctaactggagtagattgtgcaagttctttgcctgaaccatggtttgttatttgagctgggcttgcatgattgttgtttatgcatgctgggctgcatgatctcaaaatctataaagggagaaattgcagatgctggtcaacagttgaagctggattccctcattcagtgaaaaacggttggcagtgtattgaactgctatggcctcttatagggtgttagtgattcgtgtaagaataacagaatataatggctggcagattcaagtaagcatcactaatttacagtgacttttttcccttggggtttttttgtttaattatttcatattttataa

SEQ ID NO: 4752 - DNA, 1084 bp, Populus trichocarpa
ggcaggcaagcagatcatagcacaaaaccctagtggttgtccctcacttatatttaatcttcttgtagaaacaaattccacagcctttcctcctcctcctctgcctccatcgaaccagccaagctcacacaccatcacaatggcttcagagaagaagctatcaaacccaatgagagaaatcaaggtccagaagctggtcctcaacatctccgtcggtgaaagcggagacaggctcacccgtgccgccaaggtgctcgaacaactcagtgggcaaaccccggtgttctcgaaagctaggtatactgtgagatcttttgggattaggcgtaatgagaagattgcttgctatgtgactgtgaggggagacaaggctatgcagttgcttgagagtgggttgaaggtgaaggagtatgagcttttgaggaggaacttcagtgacactggttgctttggtttcggcatccaggagcacattgatcttggaatcaagtatgatccttccactggtatttacggcatggacttctatgtcgttttggaacgtcctgggtaccgtgttggtcgtcgtcgcaggtgcaagtcacgtgttggcattcatcagagagttacaaaggatgacgcgatgaaatggttccaggtcaaatatgaaggagtcatccttaacaaatcccaaaatatttgatcttagatcttttcctgacttttttaagtttaaagcttgggaagtcgttaacctttggcaggtttttatgtacctggagttataattttcatctagaatttcttgaagtggtagagaatctgaagttctatgtttttgtgttcttgtttcactgcttgtgtttttatcaatataattctgttcgattatgcagatatcaagtatccagtattcccaatcaaaatcaatgtggtttgtttgtctataataattgtgaactgagcacttgtagatgccttgtaggccttaccatttggatttggaatgcaatcgagttgaattgggtatgcaaatgtttatgttttggtcttacctgggaagaattttattgataatgatattgaaattgtcttctggattggg

SEQ ID NO: 4753 - DNA, 774 bp, Rosa hybrid cultivar
ctcgcaacccttataacttcatctctgagcttcggctgctctgcctcctcctcctcctcctcaacaccacaacccttgagcaatggcgtcggagaagaagctcgcgaaccccatgagggaaatcaaggtccagaagctcgtcctcaacatctccgtcggcgagagcggcgatcgtctcaccagggccgccaaggtcttggagcaactcagcggccagacccctgttttctccaaagctcggtacactgtgaggtctttcggaatcaggcgtaatgagaagatcgcttgctatgttactgttaggggagataaggcaatgtcactgttggagagtggcctcaaggtgaaggagtatgagcttttgcgtaagaacttcagtgacactggctgctttggattcggtattcaggagcatatcgatcttggaattaagtatgacccttccaccggtatctacggtatggacttctatgttgttcttgagcgcccagggtaccgtgttggccgtcgtcgcaggtgcaaggcccgcgttggaattcagcacagagttacaaaggatgatgcaatgaagtggttccaagtgaaatacgagggagtcatccttaacaagtcccaagcaattgtttagacagatccaccataatcttggagatattttgttttggttttggcaagctgttactttctaccagtttcagtgtatcagatgttatttctttttctttaagactatgtaagagtatttttgagcttaagaacttggtgacctccctt

SEQ ID NO: 4754 - DNA, 789 bp, Salvia sclarea
ctactagaccttggctgtcactcaggtaatccctaaaaccctctcatcagcagctgcacctccgcgcctccctaccttacagccatggcatcggagaagaagctctcgaacccaatgagggaaatcaaggttcagaagctcgtcctcaacatctctgtcggtgagagcggagatcgtctcaccagagccgctaaggttttggaacagcttagcggtcagacccctgttttctccaaggcaaggtacactgtgcgttcgtttgggatcagacgtaacgagaaaattgcatgctatgtgacagtacggggtgataaggcaatgcagctccttgagagtggactgaaggtcaaggagtatgaactgttgagaagaaactttagtgaaactggttgttttggatttggtattcaggagcatattgatcttggaatcaagtatgacccgtctactggtatttatggtatggacttctacgttgtcctcgagcgccctggttaccgggtgggccgccgccgtaggtgcaaggctcgcgttggcatccaacacagagtcaccaaggaggattcaatgaagtggttccaagtaaaatatgaaggtgttatcctcaacaaggcctccaacattgcttaatttggatctggagcagcttagttatactagggacatttggcataaaaacttgttatatttgcatttcaaccaacattttagtattgacattgagatttgtctgttttctgaagaaattttttcacattacatggtacttttgttggcaagatcacattg

SEQ ID NO: 4755 - DNA, 809 bp, Sarracenia psittacina
tctcttcatattgccccatcccaccatctgcagcctcacgcgccagatcaccatggcttcggagaagaagctttctaatccgatgagagagatcaaggttcagaagcttgttctcaacatctccgtcggcgaaagtggggatcgccttaccagagccgctaaggtcttggaacaactcagtggccagactcctgtattctccaaagcgagatacactgtgcgatcctttggtatcaggcgtaatgagaagattgcctgctatgtcacggtcagaggtgagaaggcaatgcagcttctggagagtggattgaaagtgaaggaatatgagctgctgagaaagaacttcagtgatactggctgtttcggctttggtattcaggagcacattgatcttggaatcaagtatgatccttcaacaggcatttatggtatggatttctttgtcgtcttggagcgcccgggataccgtgtcgggcgtcgtcgtaggtgcaagtctcgtgttggaattcagcaccgggtcaccaaggacgatgccatgaagtggttccaggtcaaatacgagggcgtgatcctgaacaaatcccagaatatcggaggctaaatcccacaaaatataggaggctctcaggtctcgagcattttagcaccagttctaacttttggtgagcttattaaggtttatatgctttatgcggaacaatttcgatttcccttagttttctaagcttcaattgcctttttctgtagacaaatgaatttttatatctattttctttgagataaatgttcagcagtactagttgcttgtt

SEQ ID NO: 4756 - DNA, 821 bp, Sarracenia psittacina
gttgccgcccttttctgcttctcctccaactcgctctcactgcgcctccggattaacaatggccgcggagaagaagctctcgaacccaatgagagagatcaaagtccagaagctcgtcctcaacatctccgtcggcgaaagcggcgatcgcctcacacgtgccgccaaggtcttggaacaactgagtggccaaacccccgtcttctccaaggcgaggtacacggttcggtccttcggcatcaggcgcaacgagaagattgcgtgctacgtcacggtcaggggcgagaaagcgatgcagcttctggagagtgggttgaaggtgaaggagtacgagctgttgcgaaggaatttcagtgacactggctgttttgggttcggtattcaggaacacattgatcttggcatcaagtacgacccttcgactggcatttatggcatggacttctatgtcattttagaacgcccagggtaccgtgttggacgtcgccgaagatgcaagtcgcgtgttggaatccaacatagagttacgaaggacgatgctatgaagtggttccaggttaaatatgagggagtgatcctcaacaaatcccaagcaattggagcttcttaaagaattcctccgcatcccttgataactgcaattccaagtttttgacaggcagagttttcatttgcgatcacattttttttgaggagtttagatctaaatactatttctagcttctttttcttttcatgtctggactgttatagatttttctattggggagagtagaaaatgtcatttccggatcagtagttgatttgcttcatgtttctag

SEQ ID NO: 4757 - DNA, 769 bp, Tripterygium wilfordii
gcccccaccctaccccttccacttcgactcagcgccgacgcatcacaatggcttccgagaagaagctgtcgaaccctatgagggaaatcaaagtgcagaagctcgttctcaatatctccgttggtgagagtggcgatcgtctaacccgtgctgctaaggtcctggaacaactcagcggccaaacccccgtctactcaaaggcgaggtacacggttaggtcgtttggaatcaggcgtaatgagaagatcgcatgctacgtgactgtgagaggcgaaaaggccatgcagctattggagagcggcctgaaggtgaaggagtatgagcttctgaggaggaacttcagtgacactggttgcttcgggtttggcatccaagagcacattgatctcggtatcaagtatgatccttcaactggtatttatggtatggacttctatgttgttctggagcgtccaggatacagagtgggtcgtcgccgcagatgcaagtcacgcgttggaattcagcacagagtgactaaagatgatgcaatgaagtggttccaagtcaaatatgaaggagttatcctgaacaagtctcagaatattgcctgaacaagtctcagaatagtgagagcttcttaggaagatgcctttactatgttggtttttggaagttttggttggctgaattcgtgctttttgagttacaattttacttgatgtttaagacttggtagaatcaaagttactatttggttgattttatgtgatttcacaatatatataac

SEQ ID NO: 4758 - DNA, 823 bp, Tripterygium wilfordii
actgcattcaccctaccccccttcccttcagcgcctccgcatcacaatggcttccgagaagaagctgtcgaatccaatgagagaaatcaaagtgcagaagctggttctcaacatctccgttggtgagagtggtgatcgtctcacccgtgctgcgaaggtcctggaacaactcagcggccaaacccctgtctactccaaggcgaggtataccgttaggtcgtttggaatcaggcgtaatgagaagatcgcatgctacgtgactgtgagaggcgaaaaggctatgcagctattggagagtggcttgaaggtgaaggagtatgagcttttgaggaggaatttcagtgacactggttgcttcgggtttggcatccaagagcacattgatctgggtatcaagtatgatccttcaactggtatttatggtatggacttttatgttgttctggagcgtccagggtacagagtgggtcgtcgccgcagatgcaagtcacgtgtcggaattcagcacagagtgactaaagaggatgcaatgaagtggttccaagtcaaatatgaaggagttatcctgaacaagtctcagaatattggagcttaggaagatgcctttactatctatgttagtttttgaaaattgttgttggctgaattttgtgcaaaactgtaacttgagttacaatttgacttgatgtttatgaattggtagaatctaaattactattttgttgattctgtagtggttattgtgataaaccagccgggtgctacattaagcaattccatttgcatctctatattggttggtttgtggtgtttgaaagaaaaa

SEQ ID NO: 4759 - DNA, 3805 bp, Musa acuminata
cggcggtgtcctatccctctctcccggcttcattaaagcgctccccatcaagtcatcaatcacaagcttcaatccgatcaaatcagacggcgtcaatgggtttccccacttaagaaaccgcttgcgagcgacacaccaaatcgcatctcctccggtcgccgaagaaagaagccaatatttctcctctccgccctgtcgtcgcgaattctccgacccccacgggttcattgcgctgcctcgtgatatcctacgatcttatcgcccggaagctcggaactcatcggggttcggtgtcggtggaggagatcctccgaccctggatgatcctccagctgtggccgtggctacatatatcctcctcccgcagcatcgacgccctgaagatcccctcgccgagcattcgccggatggagattaatgaatcttgaggcgtccgctacctgttcgacaaaatgcggtagaggtggatcgcaggaaatagggatctgctcttattcaaaatcgacttaagcgggcttgtaatacgtaaataagtaaatctcaatccaacaattcaaagttttccttttgatattaatatatggacgaattgagttccaacaatgaacgaatataaatattattttgattggattttccatttggggtcaatctcaggcaaccagaattcccaaaatcgatccaacccaaagggtcgatcgggttagtcaggtcgggttcggcttcgcagaatggatcattattccacctaattcggtatgtcactcgtgttttggtgtcatgctataatatgcatggttgtgcggccgtcgtaattagcattgcctcggaatggcggagcctcactcgggaggcgaaagccgagctgcttcgatcaatccatcgacgcaagaaataggcggaacccagcagatgaatccgagacgattgaagggccacaaagccgccgccacctgctgcgtcgcctcccgcctccggcccggcgtcatcgcttcttccggcgaggatggttgcatttgcttgtttgatttgcgttgtaaagatgttctctttaccattgatgtgggggaggaacctgtctcttctttatgtttcaaaacaggaaatgatgatattctgtatgcctcttcgggaacaaaagtctcgtgttttgacatccagatggcatcttcttggaagccactggaaacctacagctacaacaaggatgagataaaccagatttctttcagtacaaagtcaaatttccttgctgctgcagatgatagtggtgaagttaagatcattgacagttgccagcaaagcctgtacagaacattgagaatggttcatactagtatttgcagttgtgtacaatttgttccttggaagccctggacagctattacaggtggtctggacttaaagcttgcaatttgggatttctcaaaagggaggccacataatgtcattgattacggaatggctgaacctgacagcaatatcacaaatgggaatgcaggacaatgtttcaatcctgcatttgttcattcgatagcagtacctgaagtagatatgttaccgggtctgaacaaggtatgtgctgctgcaaggggtgatggtgtaattgatgtgattgatttggaagttgaactagctaacacgaagtcaaaaagctcatctatagccaagggttctcaaccaagatctagaaaagctgatgctcaatctgcaaagacaatgggtcaagttctaagaaagcgcacacgactggattatagtttgggagggcatactgctggtgtatcctgtgtgtccttttccttgttcggggagcgtggaaagtttctaatttcaggtggaaatgatgcatcagtgaagttgtgggattggtctaaatgttcctatcctgaacaagcaagctgcagcactcatttaagtttgactgttaacatgaacagaaaggtcaattggctgtgtactactccgactgactcagaaaaccttgttgtgtgtgacacatcaaaaatactgaaaatttacacagttgcatagaaaaaactggctaaatggatggaagtcagttatggaagagttgaagctagatacaagattttgaaactgagcttttgaaggacccgtcaggtgatgcatatagtcatagaaacttgtagctgcaccaccgcactgctcatctctgctaacacgggtgtcgtcaaaggtgtaggctcattcaatgggtggctggtaaggctgtagatttctttaatatgcagattaagtgagacatcactcatgttatggtagaagtcatgctgaaaccattcatattttgcttaaaaatatttgggagtttgctgaatacatttccttaccatgaacatccattcttcttccataattgcttcggttgcgttgcatcggtgctaatggatgacacggcgaccttcttcggggagaagaccgcaattccaaatgccaactcgctccgtggcttcgacgtggtcaacgacatcaagtccgaagtggagaaggtttgccccggcacggtctcctgtgccgacgtcctcgcgctcgccgcgcgtgatggtgtggttctgctcggtggcccatcatggtccgtgccgctgggacgcagggacgccaccaccgccagcaaggacgcgtctgagatagacctcccggccctcgactccagcctcgccgagctcatctccgccttatccgcgaagggcttgagcgctcgcgacctgaccgcgctctccggcgcgcacaccatcggccagacgcgattcctcaacttccgctaccacgtctacaacgataccaacatcgacgccggcttcgcgacgctgcgctgggcttcgttggtggcatttccgtcatttcgagctctcgcctacatcaaacaaaagccgctcgcgctcccctatttagggtttctcgttcctgtcgatctctccgccgcgcgagctgctgcgactccgacgccgcctctccactcggccgatctccctgtagcaatggcttccgagaagaagctgtcgaacccgatgagagagatcaaggtccagaagctcgtactcaacatctccgtcggcgagagcggtgatcgcctcaccagggccgctaaggttttggagcagttgagtgggcagacacctgttttctcaaaggctaggtacactgtccggtcctttgggatcaggcgtaatgagaagattgcgtgctatgtcacagtcagaggtgacaaggcaatgcaacttctggaaagtggattgaaggtgaaggaatatgagctgctgaggagaaacttcagtgatactggctgctttgggtttggcatacaagagcatattgatcttggaattaagtacgatccatcgacgggtatctatggcatggatttctatgttgtcctagagcgtgccggatatcgagtgagccgtcgccgccgatgcaagtcccgtgttggcattcagcaccgagtgaccaaggaggattcaatgaagtggtttcaggtgaaatacgagggtgtcatccttaacaaggctcagggaaccacatcataggttctggtatgactgaactttggaacttcttttgtggtcggatcagctcccatcagtgttttttttcttcatcagagtagttctttaagaaaactgttctatttttccaattttgagacccagacaattttgtgattctagtagtaaagattgttatttttctgccgtcgtgatttttgtggacattgaatatcaacagctttgttaattgtccacagcttaacctacaagaaattttaagaggtatattctat

SEQ ID NO: 4760 - DNA, 837 bp, Momordica charantia
ggccgattacggccgggggcgtttcccgcatctttactattcctaagtctttcgttttcctgctccgagcttcgaactgcaaaaatggcttcagagaagaagctgtcaaatcctatgcgcgatatcaaagtccaaaagctggttctcaacatctctgttggtgaaagtggtgatcgtcttaccagagccgccaaggtgctagaacaactcagtggccaatctccagtcttctccaaggctcgctataccgttcgatcgtttgggattcggcgtaacgaaaagattgcgtgttatgtgaccgttaggggtgacaaagcgatgcagctccttgagagtggtttgaaggttaaggagtatgagcttttgcgccggaacttcagcgacactggctgctttggtttttggaattcaggagcacattgatctcggaattaagtatgacccttctacgggtatttatggcatggacttctatgttgtcctagaacgcccaggttaccgtgtaggtcgccgccgtaggtgcaaatcaagtgttggaattcagcatagagtcactaaagaggatgccatgaagtggttccaagtcaaatatgaaggagttattctcaacaagtcccaaaatatatcttagaaaaggttctctactatctttgacggcatgttcaaattttggcaatatgttttctcatttaagattcgtctatcacgacttctatttcatttcaaggagcattttaaagcctttcttatttaatagtgtaagttgtttcaacgcttttggctgcgttagaatcagtattcatttttttggtgataatagtgcctattgcgttaagt

SEQ ID NO: 4761 - DNA, 711 bp, Theobroma cacao
cgcagctgcgcctgtgtcactcaaccgctgctctcaacctccttcacttcgccatggcatcagagaagaagctgtcgaacccaatgagggagattaaagttcaaaaacttgtcctcaacatttccgtcggtgaaagcggtgatcgtctcacccgtgccgccaaggtcttggaacaactcagtggccaatcccctgtcttctccaaggctaggtacactgtgagatcttttggcatcaggcgtaatgagaagattgcttgctacgtgacggtgaggggagagaaggctatgcagcttctggagagcggtttgaaggttaaggagtatgagcttttgaggaggaacttcagtgatactggatgctttggattcggtatccaggagcacattgatcttggtatcaagtatgacccttcaactggtatctatggtatggacttctatgttgttctggaacgagctgggtaccgtgtgggtcgccgtcgcagatgcaagtcacgtgttggcattcaacatagagttactaaggaggatgccatgaagtggttccaagtcaaatatgaaggtgtcatcctcaacaagtcccaaaatattggagcttaggaatctcagttacaagcttagttgagttgttttgagttttgctacttgattttgactcctttctgtgtatcagtttttgttttcctgaagatattcataattgagttta

SEQ ID NO: 4762 - DNA, 797 bp, Theobroma cacao
gaaagctgttttgctttaccctccattttcattcccaggcggcggactcagcttcagcatcagtcctaacaagttaaatggcgtcggagcagaaactatcgaacccaatgagggaaatcaaggtacagaagcttgtccttaacatctccgtcggtgaaagtggagatcgtctcaccagggctgccaaggtgttggagcaactcagcggccaaacacccgttttctcaaaagccaggtacactgtccggtcctttggaattagacgtaatgagaagattgcgtgctatgtcactgttaggggagagaaggcgatgcaacttttggagagtgggttgaaggttaaggaatatgagctgttgcgaaggaactttagcgataccggttgctttggatttggtattcaggagcatattgatctgggaattaaatatgacccatccaccggtatttatggtatggacttctatgttgttctggagcgtgccggctatcgtgtgggtcgtcgccgtaggtgcaagtcccgtgttgggattcagcacagggttaccaaggaggatgcaatgaagtggttccaggtcaaatatgaaggtgtgatcctcaacaagtcccagaatataggttcataagcccatacgaagagcgatagaaccagatgaagtttttgcacacctaggttgatatttctgtagaccagaatcaattaatcttcttatttatcaagttttggcaaagctttggtttctgtctttgtggactaaagttttaatttcacttatctcaattggtttatttaccca

SEQ ID NO: 4763 - DNA, 782 bp, Centaurea maculosa
ataaaccctctcccaccgatctccaccgccgttatcgttctcattctcagaatcaaaaatggcttcagagaagaagctagcgaatccaatgagagagattaaggttcaaaaacttgtcctcaacatctccgtcggtgagagcggagatcgtctcactcgagctgccaaggttttggagcaacttagcggccagtcccctgtcttttccaaggcaaggtacactgtgaggtcattcggtatcaggcgtaacgagaagattgcatgctacgtgaccgttaggggagacaaggctatgcagcttctagagagcgggttgaaggtgaaggagtacgagcttctaagacgcaactttagtgacactggctgctttggattcggtattcaggaacacatcgatctgggtatcaagtatgatccttctactggtatttatggtatggatttctttgtggttctggaacggccaggataccgtgttggccgtagacgcaggtgcaaggctcgtgttggtatccaacatagagttacaaaggatgatgccatgaagtggtttcaggtgaaatatgagggagtaatcctcaacaaatctcaacaaattggagcataacttgttttctattttttggtcaattattcaggtaactgttaagtttgtactgcaattaagtggcccagttattattgctttgtttcttgtttctgttgaattatcttattagtgaaaaccatgtctttttggaaccactttggtgaatttgtttaagtgtggctatgacttcttt

SEQ ID NO: 4764 - DNA, 967 bp, Vitis vinifera
ctaaatattagggtttcttccttctccatttctctcctacccagcggctgcatctccacagcagagtcttccaatggcttcagagaagaaactctcaaacccaatgagagacatcaaggtccagaagctcgtcctcaacatctccgttggagaaagtggagatcgcctcaccagagccgctaaggtgttggaacaactcagtggccaaacccctgttttctctaaagcaagatacactgttcgatcctttgggatcaggcgtaatgagaagattgcttgctacgtcactgtcaggggcgagaaagcaatgcagcttcttgagagtggtttaaaggtcaaggaatatgagttgctgaggaggaactttagcgatactggctgttttggttttggtatccaggagcacattgatcttggaatcaaatatgatccctcaactggaatttatggtatggacttctttgttgttttggagcgcccgggttaccgtgttggccgtcgtagaaggtgcaagtctcgtgttggaatccagcacagggtcacaaaagatgattctatgaagtggttccaggtgaaatacgagggtgtgatccttaacaaggcccagacaatagctggatcttaggtctgaggaagcccgacagttttaggtttttgcaatttttggttcacaagttttggtaatatttgaggttgtggacaaaaatttgtgacccctttttatttgctgttctacaatttcagagataattcttcatcattactatttcaatattttggtggatcatcatgtttggacaaaattccagtgagaatggatattctacccctgtttttgaatttgtcatttgtcatatccattcatgcattttaacatttgagaaagtgagtgaatttctttgtggcaatgctgttttagaggactttttactgtcaaataactattattaattaatttgtttttaat

SEQ ID NO: 4765 - DNA, 743 bp, Amsonia hubrichtii
gttccaccaattgcagccgtcgtcgccaccaattgcagcgccatggcatcagagaagaaactgaacaacccaatgagggagatcaaggtccagaagctggtcctcaacatctccgtcggagagagtggtgatcgtctcaccagagctgccaaggtcttggaacaactcagtggccaaaccccggttttctccaaggctagatacactgtgaggtccttcggaatcaggcgtaatgagaagattgcatgctatgtcactgtgagaggtgacaaggcaatgcagctcctggagagtgggctgaaggttaaggaatatgagctcttgaggagaaactttagtgacactggctgctttggttttggtattcaggagcacattgatcttggaatcaagtacgacccttcaactggtatttatggtatggatttttttgtggtcttggagcgccctggttaccgggtagcacgtcgccgcaggtgcaaggcccgtgttggaattcagcacagagtcacaaaagaggatgccatgaaatggttccaggtcaagtatgaaggtgtcatccttaacaagtctcagaatatccaaactgcttagattgggaactctgtagtaacctgctagttttagacgttacttagaaagttaagtttccgctgtttgtagaccaatccaatcctactgatgagttcaaaattttggggatttgctttgttgttatcgaaccttgatatatttactttttt

SEQ ID NO: 4766 - DNA, 851 bp, Amsonia hubrichtii
attttaactctcaacttcagtctccacctcgcggcggcacttgcagctcttcgacattcgtagtcatggcttccgaaaagaagttgagcaatccaatgagagaaatcaaagtgcagaagctcgttcttaacatctctgttggtgaaagcggcgatcgcctgacccgtgcagccaaggtgttggaacaactcagtggtcaaactcctgtcttctctaaggcaaggtatactgtacgatcctttggaatccggcgtaatgagaagattgcatgctatgttactgttagaggtgataaggcaatgcaactcttggagagtggcctcaaagtcaaagagtatgagttgctaaggcgtaatttcagccaaactggatgctttggttttggtattcaagagcacattgatcttggcatcaagtatgatccttctactggtatttatggaatggacttcttcgttgttctagagcgcccaggttaccgggtagctcgtcgacgaaggtgcaaagctcgtgttggaatccagcatagggttacaaaggacgacgctatgaagtggttccaggtcaaatacgagggggtgatcctcaacaaatctcaaacaattgcatcttagattgcctacatacctggataatggacttctagggtgttttgaacctgtttcacaattgctttcctatgggaattgaatatgctgtggatttttgtttaactgatatgccagcattctgttttctgccaccagcaagctcggttgctggatagaaaaatagttatatatctcgatagcaactggccatcttgattctttgtgccaactatactcataaagaataaatctatgccattc

SEQ ID NO: 4767 - DNA, 660 bp, Amsonia hubrichtii
cagccgtagtcccgtcgtcgcagcttgcaacgccatggcatcagagaagaaattaaacaatccaatgagggagatcaaggtccagaagctggtcctcaacatctccgtcggagagagcggtgatcgtctcactagagctgccaaggtcttggaacaactcagtggccaaaccccagttttctccaaggctagatacactgtgaggtccttcggaatcaggcgtaatgagaagattgcatgctatgtgactgtgagaggtgacaaggcaatgcaactcctggagagtgggctgaaggttaaggaatatgagctcttaaggagaaactttagtgatactggctgttttggttttggtattcaggagcatattgatcttggaatcaagtatgacccttcaaccggtatttatggtatggatttctatgtggtcttggagcgccctggttaccgagtagcacgtcggcgtaggtgcaaggcccgtgttggaattcagcacagagtcacaaaagaggatgccatgaaatggttccaagtcaagtatgaaggtgtcatccttaacaagtctcagaatatcactgcttagattgggcactatttagaaatctttagaaagtttatgcattttgtagaccaatcctatcgatgatgagttcaaaattt

SEQ ID NO: 4768 - DNA, 995 bp, Musa acuminata
tcagtcgaccccctaaaatagccagcgaaaaccctaaatctacgatcaccgttggcgaacaccatttagggggttcgtgccttcttccaccgagcctggacttagcagccgccgccgccatacgcctctcaatctcttgccatggcctcggagaagaagctgtcgaacccaatgagggagatcaaggttcagaagctcgtcctcaacatttccgtcggtgagagcggtgaccgcctcactagggccgccaaggtgttagagcaattgagcgggcaaacaccggtgttctcgaaggcacgatacactgttaggtcatttgggatcaggcgcaacgaaaagattgcgtgctatgtcaccgtcaggggtgacaaggcgatgcagctcctggagagtggactgaaagtgaaggaatatgagcttctgagaagaaacttcagtgacactggttgttttggtttcggcatacaagaacacattgatcttggaatcaagtacgacccgtccacaggtatctatggcatggatttctttgtggtcttggaacgtgctggttatcgtgtggcccgtcgccgccgatgcaagtcgcgtgttggaatccagcatagggttaccaaggatgatgccatgaagtggttccaggtcaaatacgaaggcgttattcttaacaagtcccaaacaaccactggttaagattcctaattatcttagaatcaattcttccaacttgctttgcctgttccttccagcgagagttccgttgatccatggaccttatttgcttttccaaattttctacctgtttctgagcattctcatccacaaggaactagtaaaactacattttggttctataagttgcattagttcctagtaatcttagatggcaaatacaacttgtgtttcgtagtggttggcaatgaattcagtctaattctaatcgtcctattgcacgatgcaccgactgcacattagatatttaggcgcctcggtatctt

SEQ ID NO: 4769 - DNA, 873 bp, Fagus grandifolia
ctggaccttggctgtcattcagttgcctctccatattatactctcctccttcccatctctgtctctcgtctgccgcttgctgcaaactcaaactcttccaaatggcttcagagaagaaattgagtaacccaatgagggaaatcaaggtccagaagctcgtcctcaacatctccgttggtgagagtggtgatcgtctcaccagggccgccaaggtgttggagcagctcagtggtcaaaatccagttttctccaaggcaaggtacactgtgcgatcctttggtattaggcgtaatgaaaagattgcatgctatgtcactgttaggggtgagaaggcaatgcagcttttggagagtggtttgaaggtgaaggaatatgagctgctgcggaggaacttcagtgatactggatgttttggctttggtatccaggagcacattgatttgggaatcaagtatgatccttccaccggtatttatgggatggacttctttgttgtgctggagcgccctggttaccgtgttggccgtcgtcgcaggtgcaagtctcgtgttgggatccagcacagggtcacaaaggatgatgccatgaaatggttccaggtcaaatatgaaggtgtgatcctcaacaagtctcaaaacaccacaagttaatcctggaagattttgatttaggttgatgttctgtagaccagtgtcttttactattatttctttttcaagttttgggagagcttgggataatgtttttggggccaaaatctgttaatttattggtcctccatatattttcagcagtttcagcagatctgaatcactatcatcatagtttatgtttagacaattagtctttctatgataatgactgttttgtgtt

SEQ ID NO: 4770 - DNA, 1152 bp, Theobroma cacao
tcgaagaaagtgggcagggtgcttcaatctcacatcgagcaatgagagttttctaagaagcttatgagcatggctattgcacaatttattaggctagtttttttaggaaggggtaatggtttcgtaataaagtggtattagaccggatctaacttagacttgatctatgtcaactctctccaaaaggaggtaggtaggatgatcgacaacgatgagagcatcactagattgggtgaaagataatgtcacatcacaagttttaaaagaagcaagcatgatgcttgagcaaatgggggatcttgagaaggacaaagtagtaaattggagtagagataaaaccctagccagccctaaactcctctcttttaaactcccatcgaccacgcagctgcgcctgtgtcactcaaccgctgctctcaacctccttcacttcgccatggcatcagagaagaagctgtcgaacccaatgagggagattaaagttcaaaaacttgtcctcaacatttccgtcggtgaaagcggtgatcgtctcacccgtgccgccaaggtcttggaacaactcagtggccaatcccctgtcttctccaaggctaggtacactgtgagatcttttggcatcaggcgtaatgagaagattgcttgctacgtgacggtgaggggagagaaggctatgcagcttctggagagcggtttgaaggttaaggagtatgagcttttgaggaggaacttcagtgatactggatgctttggattcggtatccaggagcacattgatcttggtatcaagtatgacccttcaactggtatctatggtatggacttctatgttgttctggaacgagctgggtaccgtgtgggtcgccgtcgcagatgcaagtcacgtgttggcattcaacatagagttactaaggaggatgccatgaagtggttccaagtcaaatatgaaggtgtcatcctcaacaagtcccaaaatattggagcttaggaatctcagttacaagcttagttgagttgttttgagttttgctacttgattttgactcctttctgtgtatcagtttttgttttcctgaagatattcataattgagtttaaaatcctaaatactttttctgttggtttcgttactttattaatatatatgcatttgga

SEQ ID NO: 4771 - DNA, 1069 bp, Theobroma cacao
tcacaagcataagcacttgtaaataaagaaaaaatatgaggggtattatggtcatttaagaaaccagatttgtctaaaccctagtataactctgtcgtgccatatttagggttagttgaaagctgttttgctttaccctccattttcattcccaggcggcggactcagcttcagcatcagtcctaacaagttaaatggcgtcggagcagaaactatcgaacccaatgagggaaatcaaggtacagaagcttgtccttaacatctccgtcggtgaaagtggagatcgtctcaccagggctgccaaggtgttggagcaactcagcggccaaacacccgttttctcaaaagccaggtacactgtccggtcctttggaattagacgtaatgagaagattgcgtgctatgtcactgttaggggagagaaggcgatgcaacttttggagagtgggttgaaggttaaggaatatgagctgttgcgaaggaactttagcgataccggttgctttggatttggtattcaggagcatattgatctgggaattaaatatgacccatccaccggtatttatggtatggacttctatgttgttctggagcgtgccggctatcgtgtgggtcgtcgccgtaggtgcaagtcccgtgttgggattcagcacagggttaccaaggaggatgcaatgaagtggttccaggtcaaatatgaaggtgtgatcctcaacaagtcccagaatataggttcataagcccatacgaagagcgatagaaccagatgaagtttttgcacacctaggttgatatttctgtagaccagaatcaattaatcttcttatttatcaagttttggcaaagctttggtttctgtctttgtggactaaagttttaatttcacttatctcaattggtttatttacccagatgcacctatgttttgagtgttttatgttaaagatttgaatattcacaattttgcatctctagtgcataattacaaggctctgcattatttaaaatgaaaaggtatgtatacacacttagctgagctctgttacagtgttagggccagttgacc

SEQ ID NO: 4772 - DNA, 844 bp, Centaurea maculosa
attggcggggggctcctttttcgataaccctctcccaccgatctccaccgccgttatcgttctcattctcagaatcaaaaatggcttcagagaagaagctagcgaatccaatgagagagattaaggttcaaaaactcgtcctcaacatctccgtcggtgagagcggagatcgtctcactcgagctgccaaggttttggagcaacttagcggccagtcccctgtcttttccaaggcaaggtacactgtgaggtcattcggtatcaggcgtaacgagaagattgcatgctacgtgaccgttaggggagacaaggctatgcagcttctagagagcgggttgaaggtgaaggagtacgagcttctaagacgcaactttagtgacactggctgctttggattcggtattcaggaacacatcgatctgggtatcaagtatgatccttctactggtatttatggtatggatttctttgtggttctggaacggccaggataccgtgttggccgtagacgcaggtgcaaggctcgtgttggtatccaacatagagttacaaaggatgatgccatgaagtggtttcaggtgaaatatgagggagtaatcctcaacaaatctcaacaaattggagcataacttgttttctattttttggtcaattattcaggtaactgttaagtttgtactgcaattaagtggcccagttattattgctttgtttcttgtttctgttgaattatcttattagtgaaaaccatgtctttttggaaccactttggtgaatttgtttaagtgtggctatgacttcttttagaaagcactttggagtagcattactttggcttttggtg

SEQ ID NO: 4773 - DNA, 795 bp, Centaurea maculosa
ggctcttttttcataaactctctctcccaccaatctccaccgccgttatcgttctcattctcagcagcaacaatggcttcagagaagaagctagccaatccaatgagagagattaaggttcaaaaactcgttctcaacatctccgttggtgagagcggagatcgtctcactcgagctgccaaggttttggagcaacttagcggccagtcccctgtcttttccaaggcaaggtacactgtgaggtcattcggtatcaggcgtaatgagaagattgcatgctacgtgaccgttaggggagacaaggctatgcagcttttagagagcgggttgaaggtgaaggagtacgagcttctaagacgcaactttagcgacactggctgctttggatttggtattcaggaacacatcgatctgggtatcaagtatgatccttctactggtatctatggtatggatttctttgtggttctagaacggccaggatatcgtgttggacgtagacgcaggtgcaaggctcgtgttggaatccaacatagagttacaaaggatgatgcaatgaagtggtttcaggtgaaatatgagggagtaatcctcaacaagtctcaacaaattggaggataacttgtttacctttttttggtcaattcaggtaactgttaaatttgtactgcactcaagtgccccagttattattgctttgtttcttgtttctgttgaattatcttattagtgaaaaacatgtctttttggaaccactttggtgaatttgtttaagtgtggctatgacttctttta

SEQ ID NO: 4774 - DNA, 662 bp, Cirsium arvense
ccctctctcccaccaatctccaccgccgttatcgttctcattctcagcagcaacaatggcttcagagaagaagctagccaatccaatgagagagattaaggttcaaaaactcgttctcaacatctccgttggtgagagcggagatcgtctcactcgagctgccaaggttttggagcaacttagcggccagtcccctgtcttttccaaggcaaggtacactgtgagatcattcggtatcaggcgtaatgagaagattgcatgctacgtgaccgttaggggagacaaggctatgcagcttttagagagcgggttgaaggtgaaggagtacgagcttctaagacgcaactttagcgacactggctgctttggatttggtattcaggaacacatcgatctgggtatcaagtatgatccttctactggtatctatggtatggatttctttgtggttctagaacggccaggatatcgtgttggacgtagacgcaggtgcaaggctcgtgttggcatccaacatagagttacaaaggatgatgcaatgaagtggtttcaggtgaaatatgagggagtaatcctcaacaaatctcaacaaattggaggataacttgtttacctttttttggtcaattcaggtaactgttaaatttgtactgcactcaagt

SEQ ID NO: 4775 - DNA, 924 bp, Eucalyptus grandis
tccatccccgatcgccactcctgcttgctccctgttctgcaccgtcatggcgtcggagaagaagctgtccaacccgatgcgggagatcaaagtccagaagctggtcctcaacatctccgtcggcgagagcggcgatcgcctcacccgcgcggccaaggtcttggagcagctcagcggccagagtcccgtcttttccaaagcgaggtacacggtgaggtcattcgggattaggcgtaacgagaagattgcttgctatgtcacggtgaggggagagaaggcgatgcagctgctcgagagtggtttgaaggtgaaggaatatgagctcttgaggaggaacttcagtgacactggctgtttcgggttcggcattcaggagcacatcgatcttggaatcaagtatgacccttcaactggtatttatggcatggacttctatgtggtcttggagcgccctgggtaccgtgttggtcgcaggaggagatgcaaatctcgtgttggaattcggcacagggttacaaaagaggatgccatgaaatggttccaagttaagtatgaaggtgtgatccttaacaagtctcaaaacatcacgggttagggataccgtatgttgaaggatttgttgggttttttttaactgtttcttacctggtaatacttttgtattgggatctatatgtcctctgtagggttgtttgagatggattataggtggaggttctgataatttattgttagactctcatgtagactaccttttggtcttttcatattcttagcaaacggtgtgtgtcagattttatttttgccctttcatgccacttctgccctgtgaaagtatgtataagtagtcccttcagctgaagtgtcacccttcaaataattaacgaaataccatgtaccaaagctgttcggattacagagaat

SEQ ID NO: 4776 - DNA, 805 bp, Euonymus alatus
cactctagcctttgacttcgcttcagcgcctccgcatcacaatggcttccgagaagaagctgtcgaacccaatgagagaaatcaaagtgcagaagctcgttctcaacatctcagttggtgagagtggcgatcgtcttacccgtgctgctaaggttctggaacaactcagcggccaaacccccgtctattctaaggcgaggtacacggttaggtcgtttggaatcaggcgtaatgagaagatcgcatgttacgtgactgtgagaggcgaaaaggccatgcagctattggagagcggcttgaaggtgaaggagtatgagcttttgaggaggaacttcagtgacactggttgcttcgggtttggcatccaagagcacattgatctgggtatcaagtatgatccttcaactggtatttatggtatggacttttatgttgttctggagcgtcctgggtacagagtgggtcgtcgccgcagatgcaagtcacgtgttggaattcagcacagagtgactaaagatgatgcaatgaagtggttccaagtcaaatatgaaggagttattctgaacaagtctcagaatattggagcttagtaggaagaatattgcctttactgtctattttaagtttttggaagttttggttggctgttatgttggctgaatttgtgtaacttgagttgcaattttatttgatgtttatgacctggtagaatctaagtcattattcatttgattttctttttctagttattttctggtttatgtgagaatatctcgtggttttatctgatagtatgagttgaaag

SEQ ID NO: 4777 - DNA, 863 bp, Euonymus alatus
gactcttaaataaaacttcgtcttccatttttcactcgcaagcgcccgtagcagtcattcaataagctctaattcccatggcatcggagaagaagttgtcgaacccaatgagggaaatcagggtccaaaagttggtcctgaatatctcagtcggtgaaagcggagatcgcctcaccagagcagccaaggtgctagaacaactcagtggccagtcaccggtcttctccaaggcaaggtacactgtccggtcgtttgggatcaggcgtaatgagaaaattgcttgctatgttactgtgaggggtgaaaaggcaatgcaactgttggagagcgggttgaaggttaaggaatatgagttgctgcgtagaaactttagtgatactggctgctttggctttggtattcaggagcatattgatctgggaatcaaatatgatccttctactggaatttatggaatggacttctacgtagttcttgaacgaccaggataccgcgtaggccgccgccataggtgcaagtctcgtgttgggattcaacatcgggtgacaaaggaggactccatgaaatggtttcaggtgaaatatgaaggtgtcatccttaacaagtctaatgcaatcacaaattagaggccccaagcaagaggttatgttttttgcagtcctattttatgtttgtgttgcccatttggcattcattctcaattccaaagttttagcaagctcctctgttggatattttgagttgagtaagatctgtttcttgtttaaaatttctgatagcaatatctggcttgtccatatcggatttttaattttttttattatgttgtcgatttggaagccaaatgattgcttttatcggtc

SEQ ID NO: 4778 - DNA, 977 bp, Vitis vinifera
agagccttccctaaatattagggtttcttccttctccatttctctcctacccagcggctgcatctccacagcagagtcttccaatggcttcagagaagaaactctcaaacccaatgagagacatcaaggtccagaagctcgtcctcaacatctccgttggagaaagtggagatcgcctcaccagagccgctaaggtgttggaacaactcagtggccaaacccctgttttctctaaagcaagatacactgttcgatcctttgggatcaggcgtaatgagaagattgcttgctacgtcactgtcaggggcgagaaagcaatgcagcttcttgagagtggtttaaaggtcaaggaatatgagttgctgaggaggaactttagcgatactggctgttttggttttggtatccaggagcacattgatcttggaatcaaatatgatccctcaactggaatttatggtatggacttctttgttgttttggagcgcccgggttaccgtgttggccgtcgtagaaggtgcaagtctcgtgttggaatccagcacagggtcacaaaagatgattctatgaagtggttccaggtgaaatacgagggtgtgatccttaacaaggcccagacaatagctggatcttaggtctgaggaagcccgacagttttaggtttttgcaatttttggttcacaagttttggtaatatttgaggttgtggacaaaaatttgtgacccctttttatttgctgttctacaatttcagagataattcttcatcattactatttcaatattttggtggatcatcatgtttggacaaaattccagtgagaatggatattctacccctgtttttgaatttgtcatttgtcatatccattcatgcattttaacatttgagaaagtgagtgaatttctttgtggcaatgctgttttagaggactttttactgtcaaataactattattaattaatttgtttttaat

SEQ ID NO: 4779 - DNA, 1493 bp, Zea mays
ccggctgactgaccggcccttgctttaccgccgcggcgaaagggcggcgcatgtcctgccggatatgccgtttccggcatggtataagtaggcgacgcccaccgttcctcctatcaccaccatcccccgatccgacccaaaacggcaggcatgcatacgtgcactaaagcaagtagtaacgatgtatctattccatccttgatcatgcatgtgtttgtggagtgtggaggtccattgcagggcaaccccccgttggcaggtgcgacggcgacgtacccctaccctgccaaaggggatttgcccggcgatgcgcctgcacacacagtggttctttctactctacctctccggctcaaggtaggagaagacgatgctccatccggctggccggttacatccggcctttcttcagcccatcggataggagcccaatatctgatcgactgatccgtcttggattggacaaaagccctaaagcccaccacaggatcctcaacagcctaaataggcccatgaaaagcctctcacagctccgagctagacccccacctccccgcctagacctagggttgcttccttccttttaacctcgcgccgccatccgacgcccatctgctccaccctccacccagccgccgccgccgccgcctaaggagaagagggtccggccgtctccttgccccgatggcgtccgagaagaagcagtccaacccgatgcgggagatcaaggtgcagaagctggtcctcaacatatccgtaggggagagcggcgaccgcctcacccgcgccgccaaggtgctggagcagctcagcggccagacccccgtcttctccaaggcgaggtacacggtgcgctcgttcggcatccggcgtaacgagaagatcgcctgctacgtcacggtcaggggcgacaaggccatgcagctgcttgagagcggcctcaaggtcaaggagtacgagctgctcaggaggaacttcagcgacaccggctgcttcgggttcggcatccaggagcacatcgaccttggtatcaagtatgatccatcaacaggcatctatgggatggacttctacgtcgtgcttgagcgtgctggctaccgcgtcgcgcgccgcaggaggtgcaagtcccgtgttgggattcagcatagggtgaccaaggaggactccatgaagtggttccaggtcaagtatgaaggtgtcatcctcaacaaggctcaggccagcacgatttaaacctcacctgtggggcaaaacagctctcgcttcatctccatgtgaacgcaagatcaccttccaaggtttttgtttgagttgtatcctctggcctgactttttagtctactagcagagctataatcactatatgaattattttttgtgcccttaccatactctgctgttgcttgagaatatgttattagtctgtcctagctcttctttggttacatgctttgtttaccgcatctgcgtttaagtttttgttgactagttac

SEQ ID NO: 4780 - DNA, 1123 bp, Zea mays
actgtccccagagcccaaacaagccagctagggttgctcccttttaacctcgcgccgccacccccttatacctcaacgcacatctccaccgtcgtccgccgccgccgaaggacggaaggagaagagggtacggccgtctcctcgcccccatggcccacgagaagaagctgtccaacccgatgcgggagatcaaggtgcagaagctcgtcctcaatatctccgtcggggagagcggcgaccgtctcacccgcgccgcaaaggtgctcgagcagctcagcggccagacccccgtcttctccaaggcgaggtacacggtgcggtcgttcggcatccggcgtaacgagaagatcgcctgctacgtcacggtgaggggcgagaaggccatgcagctgcttgagagcggcctcaaggtcaaggagtacgagctgctcaggaggaacttcagcgacaccgggtgctttggtttcggcatccaggagcacatcgaccttggtatcaagtacgatccttcaacaggcatctacggaatggacttctacgtcgtgctggagcgtgcgggctaccgtgtggcacgccgcaggaggtgcaagtcccgcgtcgggattcagcacagggtgaccaaggaggactccatgaagtggttccaggtcaagtacgaaggcgtcatcctcaacaaggctcaggccaacacgttgtaaacctcacctgtgggcaaaacagctctctggtctcttctcctcctccgtgtcaacgcaagaccaccacccacctcgccaggcttttttgggtttaatttgtgttctcagccctgatgtttagtctgctagcactctgtgggtgctgttgtcgcaagatcaccaccatgtcaattatttccgtgcccttgtcgcactctgtgtgctgttgcttgaaaacatgctagtttgatctccctagcgcagcttgtgatctggcttttttgtttggttatatgcttttatctgccacctgcgttttagttcttgatggattaccatctcccggtctggaaaatagagggtgacctaaagcatctccaccagaatgagaattctcttttactgaaatattggtataggagattgagaaaaacaaaactatagaa

SEQ ID NO: 4781 - DNA, 1313 bp, Zea mays
aacgcacatctccaccgtcgtccgccgccgccgaaggacggaaggagaagagggtacggccgtctcctcgcccccatggcccacgagaagaagctgtccaacccgatgcgggagatcaaggtgcagaagctcgtcctcaatatctccgtcggggagagcggcgaccgtctcacccgcgccgcaaaggtgctcgagcagctcagcggccagacccccgtcttctccaaggcgaggtacacggtgcggtcgttcggcatccggcgtaacgagaagatcgcctgctacgtcacggtgaggggcgagaaggccatgcagctgcttgagagcggcctcaaggtcaaggagtacgagctgctcaggaggaacttcagcgacaccgggtgctttggtttcggcatccaggagcacatcgaccttggtatcaagtacgatccttcaacaggcatctacggaatggacttctacgtcgtgctggagcgtgcgggctaccgtgtggcacgccgcaggaggtgcaagtcccgcgtcgggattcagcacagggtgaccaaggaggactccatgaagtggttccaggtcaagtacgaaggcgtcatcctcaacaaggctcaggccaacacgttgtaaacctcacctgtgggcaaaacagctctctggtctcttctcctcctccgtgtcaacgcaagaccaccacccacctcgccaggcttttttgggtttaatttgtgttctcagccctgatgtttagtctgctagcactctgtgggtgctgttgtcgcaagatcaccaccatgtcaattatttccgtgcccttgtcgcactctgtgtgctgttgcttgaaaacatgctagtttgatctccctagcgcagcttgtgatctggcttttttgtttggttatatgcttttatctgccacctgcgttttagttcttgatggattaccatctcccggtctggaaaatagagggtgacctaaagcatctccaccagaatgagaattctcttttactgaaatattggtataggagattgagaaaaacaaaactatagaagggcagtggagatgctctacggcagattgacaattcagctatccttttcctatctactgtcgcatcgcatgggaacattagacttagactatctccaacggaataaccaatacaatacacatacacaaattgcctggctttgtagcactagcgcttgggaaatgctttcaatggatgcaaactaaatacacatctagtcgacccttcggcacctaaaactgagtcatccccacccacggctcaaaccttggcaaaccaactgtc

SEQ ID NO: 4782 - DNA, 935 bp, Mimulus guttatus
ggtttcctaactgattatcccacaaactatcccgccgccgcgcctccatctccgaccaccgtatcgccatggctgcagagaagaagttatcgaaccccatgagggagatcaaggttcagaagctcgttctgaacatctccgtcggagaaagtggtgatcgtctcaccagagctgctaaggtgttggaacaactcagtggacaatcccctgttttctcgaaggcaagatacactgtacgatcttttggtatcaggcgtaatgaaaaaattgcttgctacgtcacggtcagaggtgacaaggcaatgcaactcctcgagagtggcttgaaggtcaaggagtacgaactgttgagaaggaatttcagtgacacaggctgctttggtttcggtattcaggagcacattgatcttggaattaagtatgacccatcgaccggtatttacggtatggatttctacgttgtgttggagcgacccggttaccgtgtgggtcgtcgtcgtaggtgcaagtctcgtgttggaatccagcacagggtaaccaaggatgatgcgatgaagtggttccaggtgaaatacgaaggtgttatcctcaacaaggccaccaacattggaacttaggttcaaatcttacctttatgaactattatgtggttttgttcgtttattgtctcttttttacccagagtttttgtagaattttcgaaccttagacaagtctgtttgcttccatattttataattttaatgagacgaattttgttgtgttttttgatgttattggtgctagtagtcactttaaatggtgtgtgccattttcttagtaccattattttatgatcagaaattgttttaccatgattagggtttagatttcaaattaatgattgcaaactgtttgaatttatggatagttagtcaaaattcaatattaattac

SEQ ID NO: 4783 - DNA, 1014 bp, Elaeis guineensis
ggcacactccaacaagagttatcagttagcgccggtgctcgtacgttagggttttccttattctcctgcttgcaggactgagttcgtcctgtgcagatcctccgcccctttcccctcagagttctttctcgatggcttcggagaagaagatgtcgaacccgatgagagagatcaaggtgcagaagcttgtcctaaacatctccgtcggtgagagcggtgatcgtctcaccagagccgctaaggtgttggagcagttgagtggacagacaccagttttctcaaaggcaagatataccgttcggtcctttggaatcaggcgtaatgaaaagattgcgtgctatgtcactgtcagaggagaaaaggcaatgcagcttttggagagcggtttgaaagtgaaggaatatgagttgttgagaagaaacttcagtgatactgggtgttttggttttggcattcaagaacatattgatctgggcattaagtatgatccctcgacaggtatttatggcatggatttttatgttgttctggagaggcctggttatcgtgttggccgtcgccgcaggtgcaagtctcgtgttggaatacagcacagggtcaccaaggaggatgccatgaagtggttccaggtcaaatatgagggtgttatcctcaacaaggcccaggcaaccactggttaagatttcttatgtcgaatgtcccccaagacgtcaacttttttctgtagctcaagttaggcttcttctattctccatcagtgtagcgcgtttgtgaaaactctgtttcgtttttgtttttgttcctgagaaattgactgaagctacttgaatttattttgttgccttttgtgctctgttaaatcttcctgtttataagggcagtgggaatattctctattggtaactggggttgacaggtgacctagtgctgggtaggtagttccatgttagtctcgtggcaacttttagatgttttctgactctattcagagcggtttggaatgggattattctt

SEQ ID NO: 4784 - DNA, 905 bp, Elaeis guineensis
gcggtacgcgggggcacaaaagagcggccaaccccccagtggccagggtgtgcgccatctttagggtttctttcttcgttcccgcccagcggcgcgagtccgtcttcgttctgtgccgactcccgttcacctctctttccatggcttcggagaagaaaatgtcgaacccgatgagggagatcaaggtgcagaagctcgtcctcaacatctccgtcggtgagagcggtgatcgtctcaccagagccgctaaggttttggagcaattgagtgggcaaaccccagttttctcaaaggcaagatacactgtccggtcctttggaatcaggcgtaatgaaaagattgcatgctatgttactgtcagaggtgaaaaggcaatgcagcttttggagagtggtttaaaagtgaaggaatatgaattactaagaagaaactttagtgatactgggtgtttcggttttggcatccaagagcatattgatctgggtattaagtatgatccctcaacaggtatttatggcatggatttttatgttgttctggaaaggcctggttatcgtgttggacgtcgccgtcggtgcaagtctcgtgttggaatacagcacagggtcaccaaggaggatgccatgaagtggttccaggtcaaatatgagggtgttatcctcaacaaggcccaggcaaccactggttaagcttttcatgtcaaagtatcaaagccttcaacctttttttctctagtttaattgaagcttcatctgttatccatcagagtaactggttcatggaagaattttgcttcaattttgtcattgttcctgagaagttatatctgaaagtacttgattttatattgtttctttcatgtgctctgttttttcttcctgaccgtggatattatatttgaagtc

SEQ ID NO: 4785 - DNA, 733 bp, Olea europaea
tttgtcacttcatcatattccccagtcgtccggcggccgagaacctcatcacaaccacggctccgctatggcgtcagagaagaagctgtcgaacccaatgagagagatcaaagtacagaagcttgtcctcaacatctccgttggcgagagtggagatcgtcttaccagagccgctaaggttttagaacaactcagtagccaatctcctgttttctctaaggcaagatacactgtgaggtcctttgggatcaggcgtaatgaaaagatcgcgtgctatgtaacagtcagaggtgacaaagcaatgcagcttcttgagagtgggttgaaggtcaaggaatatgagttgttgagaaggaatttcagtgacaccggctgttttggctttggcattcaggagcacattgatcttggaatcaagtatgacccatcaactggaatttatggcatggatttctacgttgttttggagcgccctggttaccgtgtgggccgtcgtcgtagatgcaaatctcgtgttggaattcagcacagggtcacaaaggaggatgcaatgaagtggttccaggttaaatatgaaggagttatcctcaataagtcgtccaacattacaaattaatttgaaagcagtactagaaatgtttgagatctaagcattttgtagacaatcatctgttatttttgagctcaaagttttagatattttcattaatgtgtgttgaaggcaagtttattt

SEQ ID NO: 4786 - DNA, 950 bp, Olea europaea
ttttgccactgtaactatcgagcagcgctgccgtcatctacccgccactccaccgccatggcgtcagagaagaaactgtcgaatccgatgagagagatcaaggttcagaaactcgttctcaacatttccgtcggcgagagcggagatcgtctcaccagagccgctaaggtcctcgaacagctcagtggacaatcccctgttttctcgaaggcaagatacaccgtgcggtcctttggtatcagacgtaatgaaaagattgcgtgctatgtcacagttaggggcgataaggcaatgcagctccttgagagtgggttaaaggtcaaggaatatgaactgttgagaagaaacttcagtgaaactggctgttttggctttggtatccaagagcacattgatcttggcatcaagtatgacccttcaactggtatctatggtatggatttctatgttgtcttggagcgccctggttatcgtgtggggcgtcgtcgtaggtgcaagtcacgcgttggaatccagcacagggtcacaaaggaagatgcaatgaagtggttccaggtgaaatatgaaggtgttattctcaacaagtcctccaacattgcaagttagtttgatagcaccgttgggactatcctatcaaagctttaaagtctgcatttttctcgaccgagatttgttactttttgagcccaaatttttggagaactacttttacgtgttttgcagaagagttgatcttttctctgaggttaatttagttgtattattatcagttaatatggcttttgaatgtgacgtcaatggcgatcactggcatgctttgaccttatgatgaaacctttgatttttcgtttccaaacacgggtgacatgatgagctaatgtgtcctaaagtaagaatcaatcttaacattcttggagttgcactagaactggaatgccttgaataatgcg

SEQ ID NO: 4787 - DNA, 778 bp, Orobanche aegyptiaca
tcgcaatttatttccccgtaaaactgctgccgccacgcacccaccatcaaccaccgcagtcagtcaaatggcgtcagagaagaaattatcgaacccgatgagagagatcaaggtgcagaagctggttctcaacatctccgtcggcgaaagcggagatcgtctcactagagcctctaaggtgttggagcaactcagtggccaaacccctgttttctccaaagctcgttacactgtacgatcctttggcattcggcgtaatgagaaaattgcatgctatgtcacggtcagaggtgacaaggctatgcaactacttgaaagtgggttgaaggtcaaggaatatgaactgttgaggcgtaatttcagtgatactggctgctttggttttggaatccaggagcacattgatcttggaattaagtatgacccgtcgactggtatttatggaatggacttctatgttgtcttggaacgccccggatatcgcgtgggccgtcgtcgtaggtgcaagtcccgtgttggaatccagcacagagtgactaaggaggacgcaatgaagtggttccaggtgaaatatgaaggtgtcatcctgaacaaggcatccaatattggagcttagtttaagtgcaggatttgattgaacaatttgtgtttttatctgtttctgtctcttttgtctaagttttgtagtagttcatttatagacaagtctatttcaacaatattttataattttcgtggatatgaatcaagttctgttcttctactaaaaaaaaaaaaa

SEQ ID NO: 4788 - DNA, 762 bp, Plantago ovata
gccgttcctcttcgttaaccaccaccgcaatcgtcgtcatggcttcagacaggaaattggcgaatccaatgagagagatcaaggttcaaaagctcgttctgaacatctccgttggtgaaagtggagatcgtctgaccagagctgctaaggtgttggagcaactcagtggacaaactcctgtcttctctaaggctagatacactgttcgttcttttgggatcagacgtaatgaaaagattgcttgttatgtcactgtcagaggagagaaagcaatgcagctccttgagagtggcttaaaggtgaaggagtatgaattgctcaggaggaatttcagtgacactggctgctttggttttggtatccaggaacacatcgatcttggaatcaagtatgacccctcaaccggtatctatggtatggatttctttgttgtattggagcgccctggttatcgtgtgggccgtcgccgtagatgcaagtctcgtgttggaattcagcacagggtcaccaaggaagattcaatgaagtggttccaggtgaaatatgaaggtgttatcttgaacaaatcttcaaacatcggcgcctaggagctcgtatcttatcttatgatctatgtttctgattatcctgtttgcttccccaagttttatagaattttagtccttttaatatcttcaaacatgtgttactatggatatttcgtgttcttaattagctgttctagttgtgctgtgaaactaattattggataatgtactttct

SEQ ID NO: 4789 - DNA, 998 bp, Prunus mume
aaaaaaaaaaaccactcgcatcaaaaccctagctccatatcccctcgtcatatttagggttcttgcctctatttccctctctatctgccgctctcataccagaccccgactgcggctgcaactcaaaatcccaaatggcttcagagaagaagttagcgaaccccatgagggagatcaaggtccagaagctggtcctaaacatctctgttggtgagagtggagatcgactcaccagagccgcgaaggtgttggagcaactcagtggacaaacacccgttttctccaaagcaaggtacactgttcgatccttcggtatcaggcgtaatgagaagattgcctgctatgtcactgttaggggtgacaaggccatgcaacttttggagagtggattgaaggtgaaggaatatgagttgctaagaaggaactttagtgatactggttgttttggatttggtatccaggagcacattgatttgggaatcaagtacgatccttcaactggtatttatgggatggatttctttgttgttttggagcgtccgggttatcgtgttggccgtcgtcgtagatgcaagtctcgtgttgggatccagcacagggtcaccaaggatgatgccatgaaatggttccaggtcaaatatgagggtgtgatccttaacaagtcccagcagctctcagcttcctagttccttaggattgtgaaattagtttgatcagtctctatgacctgcatatttcaattttaagttttgtcaaagcttgagttaatgtttggtggaccaaattctgttaatttgttgttttttgaattataagtttttggaagtaccctttaagcttttgtagttacggcatatgatgagttcctgagttgtcacgaattttgagtgctcagtacttcacactttgctttgagccttaaaaacaaaatcttgagcctgaaaagttgttaaattgaaagttattgatggaaggtaaagagggataaacagatggca

SEQ ID NO: 4790 - DNA, 967 bp, Prunus persica
ctcgcatcaaaaccctagctccatatctcctcgtcatatttagggttcttgcctctctttccctctctatctgccgctctcataccagacccttactgcggctgcaactcaaaatcccaaatggcttcagagaagaagttagcgaaccccatgagggagatcaaggtccagaagctggtcctaaacatctctgttggtgagagtggagatcgactcaccagagccgcgaaggtgttggagcaactcagcggacaaacacccgttttctccaaagcacggtacactgttcgatccttcggtatcaggcgtaatgagaagattgcctgctatgtcactgttaggggtgacaaggccatgcaacttttggagagtggattgaaggtgaaggaatatgagttgctaagaaggaactttagtgatactggttgttttggatttggtatccaggagcacattgatttgggaatcaagtacgatccttcaactggtatttatgggatggatttctttgttgttttggagcgtccgggttatcgtgttggccgtcgtcgtagatgcaagtctcgtgttgggatccagcacagggtcaccaaggatgatgccatgaaatggttccaggtcaaatatgagggtgtgatccttaacaagtcccagcagctttcagcttcctagttccttaggattgtgaaattagtttgatcagtctctatgacctgcatatttcaattttaagttttgtcgaagcttgagttaatgtttggtggaccaaattctgttaatttgttgttttttgaattataagtttttggaagtaccctttaagcttttgtagttatggcatataatgagttcccgagttgtctcgaattttgagtgctcggtacttcacactttgctttgagccttaaaaacaaaatctttgagcctgaaaaattgttaaattgaaagttattgatgcaaggtaaag

SEQ ID NO: 4791 - DNA, 582 bp, Scabiosa columbaria
ccttcattccttccttgatacagaaactgcaatggcttcagagagaaaattatccaatccgatgcgggagatcaaggtccagaagctcgttctcaatatctccgtcggcgagagcggagatcgactcaccagagctgctaaggtgttggagcaactcagtggacaatcgcctgtgttttccaaagctagatacactgtgaggtcctttgggatcagacgtaatgagaagattgcttgctacgtcactgtgaggggtgacaaagcaatgcagctcctagagagtggactgaaggtcaaggaatacgagcttctcagaagaaactttagtgataccggttgctttggattcggtattcaggaacatattgatcttggaatcaagtatgatccatctactggaatttatggtatggatttctttgtggtgttggagcgcccgggataccgtgtgggccgtcgccgtagatgcaaggctcgtgttggaattcaacacagggtcaccaaggatgatgcgatgaaatggttccaagtgaaatatgagggtgttatcctgaacaaatcccaaaacatcactggttaaat

SEQ ID NO: 4792 - DNA, 957 bp, Citrullus lanatus
taggcataagttgagcgacatcggagaaaaaccctaaaccctgcctcctccacttcgtctgctgcacccgtccgctcctctgccttggctgcttcatccgacaatggcttcagagaagaagctctcgaaccctatgcgagatattaaagtccagaagcttgttcttaacatctccgtcggtgaaagcggcgatcgtctcaccagagccgccaaggtgcttgaacaactcagtggccaatcgcccgtcttctccaaagcccgttacaccgttcggtcttttgggatcaggcgtaacgagaagattgcctgctatgtcaccgtgaggggggaaaaggcaatgcaacttcttgaaagtggtttgaaggttaaggaatatgaactcttgcgcaggaacttcagtgatacaggctgctttggttttggtattcaggagcatattgatcttggaatcaagtatgacccttcgactggtatatatggtatggacttctttgttgttttagaacgtccaggctatcgtgttggtcgtcgacgtcgatgcaaatcaagcgttgggattcaacatagagtcaccaaagaggatgcaatgaaatggtttcaagttaagtatgaaggtgtcatccttaataagtctcagaacattacaggctagatcaatccctcaattttggtggcttctacaggtttttgtagtcttcttatttttgtatctgaattttatttttaaggtctgaagacattcattaatttttcctgtattttaacttcagacggggaaaaaaggttttccttctaatgagaaattttgttatttgttgctgaaattgaagttcccattttgcgtttttaatagatgtactttaaggttgcctatcattcgcatcctgattttttgcatctaagtttgaaatgcaagctgattgcactgcagtggtaactgtcaagcaagatgactag

SEQ ID NO: 4793 - DNA, 851 bp, Zea mays
ctcgcgccgccatccgacgcccatctgctccaccctccacccagccgccgccgccgccgcctaaggagaagagggtccggccgtctccttgccccgatggcgtccgagaagaagcagtccaacccgatgcgggagatcaaggtgcagaagctggtcctcaacatatccgtaggggagagcggcgaccgcctcacccgcgccgccaaggtgctggagcagctcagcggccagacccccgtcttctccaaggcgaggtacacggtgcgctcgttcggcatccggcgtaacgagaagatcgcctgctacgtcacggtcaggggcgacaaggccatgcagctgcttgagagcggcctcaaggtcaaggagtacgagctgctcaggaggaacttcagcgacaccggctgcttcgggttcggcatccaggagcacatcgaccttggtatcaagtatgatccatcaacaggcatctatgggatggacttctacgtcgtgctcgagcgtgctggctaccgcgtcgcgcgccgcaggaggtgcaagtcccgtgttgggattcagcatagggtgaccaaggaggactccatgaagtggttccaggtcaagtatgaaggtgtcatcctcaacaaggctcaggccagcacgatttaaacctcacctgtggggcaaaacagctctcgcttcatctccatgtgaacgcaagatcaccttccaaggtttttgtttgagttgtatcctctggcctgactttttagtctactagcagagctataatcactatatgaattattttttgtgcccttaccatactctgctgttgcttgagaatatgttattagtctgtcctagctcttctt

SEQ ID NO: 4794 - DNA, 933 bp, Centaurea maculosa
ctctctcccaccaatctccaccgccgttatcgttctcattctcattctcagcagcaacaatggcttcagagaagaagctagccaatccaatgagagagattaaggttcaaaaactcgttctcaacatctccgttggtgagagcggagatcgtctcactcgagctgccaaggttttggagcaacttagcggccagtcccctgtcttttccaaggcaaggtacactgtgaggtcattcggtatcaggcgtaatgagaagattgcatgctacgtgaccgttaggggagacaaggctatgcagcttttagagagcgggttgaaggtgaaggagtacgagcttttaagacgcaactttagcgacactggctgctttggatttggtattcaggaacacatcgatctgggtatcaagtatgatccttctactggtatctatggtatggatttctttgtggttctagaacggccaggatatcgtgttggacgtagacgcaggtgcaaggctcgtgttggcatccaacatagagttacaaaggatgatgcaatgaagtggtttcaggtgaaatatgagggagtaatcctcaacaagtctcaacaaattggaggataacttgtttacctttttttggtcaattcaggtaactgttaaatttgtactgcactcaagtgccccagttattattgctttgtttcttgtttctgttgaattatcttattagtgaaaaacatgtctttttggaaccactttggtgaatttgtttaagtgtggctatgacttcttttagaaagcactttggagtagcattactttggcttttggtgctttagaaaatatttctgaacatcacattctaaatggatttataaaagcaccttttataggtcacattttatattcaattattgccaacatattttattttgctcttttttta

SEQ ID NO: 4795 - DNA, 706 bp, Cynara scolymus
  misc_feature (438)..(438): n is a, c, g, or t
cgtttgcagcagcagcagcaatggcttcagagaggaagccatcgaatccaatgagagagattaaggttcaaaaactcgtcctcaatatctccgtcggtgagagcggagatcgtcttactcgcgctgccaaggttttggagcaactgagtggccagtcccccgtcttttccaaggcaaggtacaccgtgaggtcatttgggatcaggcgtatgagaagatcgcatgctatgtgaccgttaggggagacaaggctatgcagcttctagagagcgggttgaaggtgaaggagtacgagcttctaagacgcaactttagtgacactggctgctttggatttggtattcaggaacatattgatctgggtatcaagtacgatccatcgactggtatttatggtatggatttctttgtggtactagaacggccaggatatcgtgntggtcgtaggcgcaggtgcaaggctcgtgttggtatccaacatagagttacaaaggaggattcaatgaagtggtttcaggtgaaatatgagggagtaattctgaacaaatctcagcaaattggggcatagctagttttttttttggtcaattcaggtaaccgttgaatttgtattgcacccaagtgattcagatcatcttattactgttgctttgttttgtttgtatctgttgaatcatctttaattagcgaagtctttttgagatct

SEQ ID NO: 4796 - DNA, 759 bp, Lippia dulcis
agcagccgcggctaacctcccaccatcatggcatcggagaagaaactatcgaacccaatgagggaaatcaaggttcagaagctcgtcctcaacatctccgttggcgagagcggagatcgtctcaccagagccgctaaggtcttggaacagctcagtggccagagccctgttttctccaaagcaaggtacacggtgcggttcatttgggattcggcgtaatgaaaaaattgcttgctacgtcactgtcagaggagacaaggcaatgcagcttcttgagagtgggctgaaggtgaaggaatatgaactattgaggaggaatttcagtgaaactggttgttttggctttggtatacaagagcacattgatcttggaatcaagtatgacccctcaactggtatttatggtatggacttctatgttgtcctggaacgccctggttacagagttgggcgtcgccgcagatgcaagtctcgtgttgggatccaacacagggtcacaaaggaagatgctatgaagtggttccaagtcaaatatgaaggtgttatcctcaacaaggcctccaacatcggagcatagatattacagtttggccttattctcggaatatcagtgcaggggcttagtctttagttctagttggacttcattgcatacagcatataatatatgcaatttctgtcccaagttttgttacattttaacctcaaagaaatctgttttcagaactagcttgttatatgcaatgtacccttatgatg

SEQ ID NO: 4797 - DNA, 787 bp, Cedrus atlantica
cctaattgaattttactgatatagtgtaagaggaaagtacgaaagttaagggtagtagttagacaagaagggtaggggaatacgggtttgagacggagggagaggcagaggcggcagcagaaacagcagtcggcggaacctgcaaaggagaaatggcggccgagaagaaactgagcaaccccatgcgggagattaaagtgcagaagttggtgctcaacatatcagttggtgagagtggcgatcgactcactcgagcttccaaggtgctggagcagctgagtggccagactccggttttttccaaggcaaggtatactgtgaggtcctttggaataaggcgaaatgagaagattgcttgctacgttactgttagaggagaaaaggctcttcagctcttggagagtgggctgaaagtgaaggaatatgagttgctccgaaggaactttagcgacactgggtgctttggttttggtattcaggagcacattgatctgggaatcaagtatgatccttcaactggtatctatggtatggacttctttgtagtcctagagcgccctggatacagagttggcaggagaaagagagcccaatcccgtgttggcattcagcacagggttaccaaggatgattctatgaagtggttccaagttaaatatgaaggagtcatcctcaacaagtcacaaaatatttaaatgagtagttttcgtctgttccttggcttggcttgccacttctgtggacacctagatgaaggaatattttcccctttgttataggtgcacat

SEQ ID NO: 4798 - DNA, 791 bp, Cucurbita pepo
catctttacgtctcgagcttgttaccgctcgcaacttcgactctgcaaaaatggcttcagagaagaagctatcaaatcctatgcgggatatcaaagtccaaaagcttgttcttaacatctctgttggtgaaagtggtgatcgtcttaccagagcctctaaggtgctcgaacaactcagtggccaatctccggtcttctccaaggcacggtacaccgttcgatcatttgggatccgacgtaacgaaaagattgcgtgttatgtgaccgtgaggggcgacaaagccatgcagcttcttgagagtggtttgaaggttaaggagtatgagctgttgcgccggaacttcagcgacactggctgctttggttttggaattcaggagcatattgatctcggaattaagtatgacccttccacgggtatttacggcatggacttctatgttgttcttgaacgtccaggttaccgtgtaggtcgccgccgtagatgcaaatcaactgttggaattcagcatagagtcaccaaagaggatgccatgaagtggttccaagtcaaatatgaaggagttattctcaacaaatctcaaaatatatcctagaaaggttctctgctatctttgctgtcatgttcaaattttggcaatatgttaactcatttaagatttgtccatcagaacttctaatttctttttatggagcgttcaagcctttcttattttattgtattctctgtttcaactctttttgccgcgttggaaatcaatattcaatttttttggttacacagttgaccg

SEQ ID NO: 4799 - DNA, 834 bp, Carpinus betulus
tttcaggcctccttcctctctctcaatttcggctaccgcaagctctcctcaactactcagaatggcttcggagaggaaattgagtaacccaatgagggaaatcaaggtacaaaaactcgtcctcaacatctcagtcggcgagagcggtgatcgtctcaccagggcctctaaggtgttggagcagctcagcggccaaactccagtgttttccaaggcaaggtacactgtgcggtcctttggtatcagacgtaatgaaaagattgcatgctatgtcactgttaggggtgagaaggcaatgcagcttttggagagtggtttgaaggtgaaggaatatgagctgctgcggaggaactttagtgatactggatgttttggctttggtattcaggagcacattgatttgggaatcaagtatgatccttcgactggaatttatggaatggatttctatgttgtgctggagcgccctggttaccgtgttggccgtcgtcgtaggtgcaaggctcgtgttgggatccagcatagggtcacaaaagaggatgccatgaaatggttccaggtcaaatatgaaggtgtgattcttaacaagtcccagaatatctcttaaggcctggaagattcttgggaagatgccataagttttgatttaggctgatgttatgtagaccaacaatcctttactatttatccttgttttttaagtattgggagagcctgggatatgttttctggaccaaaatctgttaatttattttgttcctttctattatttttggctatcactgattagctattgtgatagttttagacggttgataatgattcatgaatgtt

SEQ ID NO: 4800 - DNA, 1002 bp, Ipomoea batatas
ttacggccgggggttacacattaggatttcttcctccgctcaacactgcatctctccccggagccggtctgcagccgcaacttcagcagtttaggcgatatggcgtcagagaagaaacttaacaacccaatgagggaaatcaaggttcagaagctcgtcctcaacatctccgtcggcgagagcggagatcgtttgaccagagcggctaaggtgttggagcaacttagtggccaaacccctgttttctcaaaggcaagatataccgtgaggtccttcggtatcaggcgtaatgagaagattgcatgctatgtcacagtaaggggtgataaggcaatgcagctccttgagagtgggttgaaggtgaaggaatatgaattgctgcgaaggaacttcagtgacactgggtgctttgggtttggtattcaggagcacattgatcttgggattaagtatgacccctctactggtatttatggtatggatttcttcgttgtcctggagcgccctggttaccgtgtagctcgtcgccggagatgcaaggccagagttggtatccaacacagggtcaccaaggaggatgccatgaagtggttccaggtcaaatatgaaggggttatcctcaacaaggcctcaaacatctaataagtccaatcttagtttgagagaattttcaatcagtttttatctcctagcaattttgtgtatttacctttttatagacctactacatcatactcggagttattgagtttttggtaccaggatttgttggtaagtttatcaaggccatcatgacatctttgctgtctaatttgattgtgtgtttgatacttgggatctaaatggttctgtagttctgtgtaatgttatattgctttctattaaatacaaatacaatgtccttagccatcaaatacaggtataaactgagtagaactgcattacatgtcatgttttttttgttgtatgtgccaattttcattaaataatagtgtttattgc

SEQ ID NO: 4801 - DNA, 933 bp, Lotus japonicus
gctccttcgctattacacactcacttctctttaccctggccgtgaaccctaccacccacctcctgatccaatggcttccgaaaagaaactggcgaaccctatgagggagatcaaggtccagaagctcgtcctcaacatctccgtcggtgagagtggagatcgtctcaccagagcagccaaggtgctggagcaacttagtggtcaaaccccagtgttttctaaggccagatacactgttcgatcctttggaatcagaagaaatgaaaagattgcatgctatgttactgttagaggtgacaaggcaatgcaacttttggagagtggattgaaggttaaggaatatgaacttcttagaaagaactttagtgatactgggtgctttggctttggtattcaggagcacattgatttgggaatcaagtatgatccatccactggaatttacggtatggatttctatgttgttctggagcgccctggttaccgtgtgggacgtcgccgtaggtgcaagtcccgtgttgggattcaacaccgtgtcacaaaggatgatgctatgaagtggttccaggtgaaatatgagggagtgatcctcaacaaggctcaggcagtgttttaattcaaccaagtccactttaggagagtatcttatgtttcccaactatagtttgatctttttcagatagtatgctaagtttcagacagaattttttggcatccctcaggtgtccttgtaggggcatcaggcaaattttcaatgaatacttttgtttgtcatttttgttgttttatgatgaaagctcatggatttactattgtgctgttaaatgttacttgtgctaagtcctgtaatgcattgcaacagtttacaatggtttttttgcaaccaaatgttacttgtttttctatgcaaaacagacctcgacattatctgtc

SEQ ID NO: 4802 - DNA, 855 bp, Olea europaea
agcaacgccgctgtctactacccgccactccaccgccatggcgtcagagaagaagctgtcgaatccgatgagagagatcaaggtacagaaacttgttctcaacatttctgtcggcgagagcggagatcgtctcaccagagctgctaaggtactcgaacagctcagtagccaatcccctgttttctccaaggcaagatacactgtgaggtcctttgggatcagacgtaatgaaaagatcgcgtgctatgtcacagtcaggggtgataaggcaatgcagctcctcgagagtgggttgaaggtcaaggaatatgaactgttgagaagaaactttagtgacactggctgttttggctttggtatccaggagcacattgatcttggaatcaagtatgacccttctactggtatctatgggatggatttctatgttgtcttggagcgccccggttatcgtgtgggccgccgtcgtagatgcaagtcgcgtgttggaatccagcaccgggtcacaaaggaggatgcaatgaagtggttccaggtgaaatatgaaggtgttattctcaacaagtcctccaatacttagtttgagagcacaggaggactatcctgtcaaagttttatattttgcattttatagacctggattttacttcctgagcctgaagttttggagaactggttttatgtgttttgcagacgagttcattttcgctgaggtttaatttagttgtatttttatcagttcatatggcaacttctaaatgtgatcattccggtctgttactgcacgagttactcaacagctctttggcccccaaatcgttgccccgatatttatacatcatagaatttagaatg

SEQ ID NO: 4803 - DNA, 930 bp, Nicotiana tabacum
  misc_feature (5)..(5): n is a, c, g, or t
  misc_feature (18)..(18): n is a, c, g, or t
  misc_feature (25)..(25): n is a, c, g, or t
  misc_feature (35)..(35): n is a, c, g, or t
  misc_feature (47)..(47): n is a, c, g, or t
  misc_feature (75)..(75): n is a, c, g, or t
  misc_feature (887)..(887): n is a, c, g, or t
ggttnagaaagctaacancagcgcngctccattanacgcacatatanatactgggattgaactagggtttctcanactctccccttccccttccccttccctgtgtaccctaactacctgccctgtagctacaaacgaagcgcaatggcttcagagaagaaattgagcaatccgatgagggagattaaagtccagaagctcgttctcaacatctctgtcggtgaaagcggagatcgtctcaccagagccgccaaggtcttggagcaactcagtggccaatcccctgttttctccaaggcaaggtatactgtgcgatccttcggaatcagacgtaatgaaaagattgcctgctacgtcactgtcagaggggataaagctatgcagctccttgagagtggattgaaggtcaaggagtatgagttgttgagaaggaacttcagtgagactggctgctttggatttggtattcaggagcacattgatcttggaattaagtatgacccttcgactggtatctatggtatggatttctatgttgtcctagaacgcccaggataccgtgttgccagacgtcgtaggtgcaagtctcgggttggaatccagcacagggttacaaaggaagacgccatgaagtggttccaggtcaaatatgaaggtgttatccttaacaagtcctctaacattcagtaagctgagtaagctgagagctagttgagagctgtctgctggatcaatttgttcagtagcaagtttatgttcatgcattttgtagaccaacatctaattactcccagagttaaatagtttttgagagttactgttatttgtcatattatgttttcattttggctatgcgatcaactcaatcttactatatcgttttgtgntagttttctgtcgtgcatttctagtagtttgcttctcttgggg

SEQ ID NO: 4804 - DNA, 829 bp, Phaseolus vulgaris
ctgtttggggttttcgttattaattcttctcttccctctgccgccgcaacggtgcaccctaatagcctctaacaatggcttcagagaagaaactgtcgaaccctatgagggagataaaggtgcagaagctcgtcctaaatatctctgttggcgagagtggagatcgccttaccagggcagcaaaggtgttggaacaactgagtggccaaaccccagtgttctccaaagcaaggtacactgttcgttcttttgggattagaagaaacgagaagattgcttgttatgtcactgttagaggtgacaaggcaatgcaacttttggagagtggtttgaaggtgaaggaatatgaacttctcagaaggaacttcagcgatactggctgctttggctttggcattcaagagcatattgatttgggaatcaagtatgatccttcaactggtatttatggaatggatttctttgttgttttggagcgtcctggctaccgagttggccgtcgccgaaggtgcaagtcccgtgttggaattcagcaccgtgtcacaaaagaggattctatgaagtggttccaggtgaaatatgagggagtgatccttaacaagtcgcaggcaattgtttagattgagttcactttgggagtgtgttatcagttttgtcaactatagttccatctttctatgataggatcttaattttgaagcaggttttgaatccatgtttgtcatttaagtttttgcagcacatgtattaacaatagcactgttaaatgacactttattgcgaagttgtgaacccctcgttatgcaattttgcttagtaacgatttagt

SEQ ID NO: 4805 - DNA, 827 bp, Phaseolus vulgaris
actctgttctctgtccccatacccactaccattgcatcttgccgctgcaactctcttccttctcttcagcttccattcgcaatggcttcggagaagaaactatccaaccccatgcgggaaatcaaggtccagaagctcgtcctcaacatctccgtcggagagagcggagatcgtctcaccagagccgcaaaggtgttggaacagcttagtggccaaaccccagtgttttccaaagcaagatacactgtccgttcttttggtatcagaagaaatgaaaagattgcatgctatgtcactgttagaggtgacaaggcaatgcagcttctggagagtggattgaaggtgaaggaatatgaacttctgcgaagaaacttcagtgatactgggtgctttggatttggtattcaggagcatattgacttgggaatcaagtatgatccctcaactggtatttatgggatggacttctttgttgttctggaacgccctggctatcgtgtcggccgccgccgccgctgcaagtctcgtgttgggatccagcatcgtgttaccaaggaggattctatgaagtggttccaggtgaaatacgaaggtgtgatcctcaacaagtcacaggcaattgtttagttaaattagctagttgttttgaggagtttaaaagttttgttgttttaaattcgatgcttcttcatttaaatagcttgaattactggaatattgaaggtacttgtttttgacatccatattaatacgccttgacccttaattggatgttctatattttgcctttcctctagccgttgtgtttgaagaacatattcattcat

SEQ ID NO: 4806 - DNA, 882 bp, Echinacea purpurea
atccccattctctcccctcattttgctcctaccttacaaccctgcgccgccatactcctctgcaacaccaatggcatcagaaaggaagcaagcgaatccgatgagagagatcaaggttcagaaacttgttctcaacatctccgttggtgaaagtggcgatcgtctcactcgtgctgccaaggttttggaacaacttagtggccagtcccctgtgttttccaaggcaaggtacactgtgaggtcttttggaattaggcgtaacgaaaagattgcatgctatgtcactgttaggggagacaaggcaatgcagctcttggaaagtggcttgaaggttaaggaatacgagcttttgaggcgtaacttcagtgacactggatgctttggttttggtattcaggagcacattgatcttggtatcaagtatgatccatctactggtatctatggtatggacttcttcgtggttctagaacgtccaggttaccgtgtgggtcgcagacgtaggtgcaaggcccgtgttggtatccagcacagagttaccaaggaagacgcaatgaagtggttccaggtgaagtatgaaggagtcattctcaacaagtctcaacagatcggagcatagaagacattgtaagttttcttggggcggttaacgtatgatttggctcaccaggattttcattacatcaatttttgtcatcagtttcttgcattttgactagtttgttgttactctcatgttatagtggctgtttttcggatggaatttatttgactctgttatgataagatgtttttctttattactatatttaagacatgctgtttttattttgttgttgtcattgtttacagtgacttgaactatttccatatgatgctttt

SEQ ID NO: 4807 - DNA, 883 bp, Echinacea purpurea
ctgcaatctgctcattcaacaatggcttcagagaggaaacaggcgaacccaatgagggaaatcaaggttcagaaactcgttctcaacatttcagtcggcgaaagcggtgatcgtctcactcgtgccgctaaggttttggagcaactgagcggccaatctcctgttttttcaaaggcaaggtacaccgtgaggtcttttggtatcagacgtaatgagaagattgcgtgttatgtcactgttagaggagacaaggctatgcagcttttggagagcggtttgaaggtgaaggaatatgagctgttgaggcgcaacttcagtgacacgggatgctttgggtttggtattcaagagcacattgatcttggtatcaagtatgatccatccacgggcatctacggtatggatttctttgtggttctggaacgccctggttaccgtgtgggacgtcgtcgccgatgcaaggctcgagtcggaatccaacacagggtcaccaaggaggatgctatgaagtggtttcaagtgaaatatgagggtgttatccttaacaagtcccaacaaattggagcttagattgttggttttgtgtaatttttcttgagggttttgtagttttaccagcaaggtatttgggtagacttgtgttttggaccctgttagatcccagtaccatggttaaattttatttggaggtttttcatatatgcaaatgttttctatcaactatccatgcattttgttatgcattcgaaaatgtttcaaatagttgactctggttcagtcaaaacaaaattggcatatggatagttcttgatcatttattaagaaacaatgtgtttaaatgttattttagcacaaccataataataagtactaatatttagac

SEQ ID NO: 4808 - DNA, 894 bp, Panax ginseng
aagcagtggtatcaacgcagagtacatgggaaaataacagaaaaacctaaaaggggtcttttactctagacttattagttagggttttatctcgcttctccatttccccatcttcccattactcgcagctgcgaccttcaacgccgggaaattgccatggcttcagagaaaaagttattgaacccaatgagagagatcaaagtccagaagctggtcctcaacatttctgttggggagagtggagatcggctcaccagggcctctaaggtattggaacaactcagtggtcaaagccctgtgttccccaaagcaaggtatactgtgaggtcatttggtatcaggcgtaatgagaagattgcctgctacgtcacagtgaggggtgacaaggcaatgcagcttctagagagtgggttgaaggttaaggaatatgagttgctgaggaggaatttcagtgatactggctgtttcggctttggtatccaggagcacattgatcttggaattaagtatgacccttcaactggcatttatggaatggatttctatgttgtacttgaacgtccgggttaccgtgtgggacgtcgtcgtagatgcaaatctcgcgttggaatccaacacagggttacaaaggaggatgcaatgaaatggttccaggtcaaatacgagggtgtgatcctcaacaaatcccagaatattgggggttaatagagaagtattaacaagcctaggtttatgcttttcagactagtggttgctatgaagtgccaaaatttggattgttgtagtagactcatttatctatatttcacatgtttttcgagagaatttcacatcttctttgacattgaatgattcattacaagaatccagttgaggtttgagctattgccaaaa

SEQ ID NO: 4809 - DNA, 764 bp, Ambrosia trifida
acggcctttcgatctttcatagtttctgcatatctctgctcattcaacaatggcatcagagaggaaacaagcgaacccaatgagagaaataaaggtccagaagctcgttctcaacatttctgtcggagaaagcggtgatcgtctcactcgtgccgctaaggttttagagcaactcagtggccaatctcctgtcttttctaaggcaaggtacactgtgaggtcttttggcatcaggcgtaatgagaagattgcgtgttatgtcactgttagaggggacaaggctatgcagcttttggagagtggtttgaaggtgaaggaatatgagttgttgaggcgcaactttagtgacacaggatgctttgggtttggtattcaggagcacattgatcttggtatcaagtatgacccatctactggtatctacggtatggatttctttgtggttctagaacgccctggttaccgtgtggggcgtcgccgccgatgcaaggctcgtgtcgggatccaacacagggtcaccaaggaggatgccatgaagtggtttcaagtgaaatatgagggtgtcatccttaacaagtcccaacaaattggagcttagattgttggatttgtaaaattttctacttgagggttttatagttttatcagcaaggatatttggaagacttatgctttggaccattttggattccagtaccattaatgtttttaaggaggtttctttttatatatgcaaatgttttatattaactagcgtgtatttg

SEQ ID NO: 4810 - DNA, 622 bp, Ambrosia trifida
caccacctccaccgtttccccaatctgtctgctaatccaacaatggcctcagagaggaagcaggcaaacccaatgagggaaatcaaggttcagaagcttgttctcaacatctctgttggagaaagcggcgatcgtctcactcgtgccgctaaggttttggagcaattgagtggtcaatcacctgtcttctcaaaggcaaggtatactgtgaggtcttttggtattaggcgtaatgaaaagattgcatgctatgtcactgttagaggagacaaggccatgcagcttttggagagcggcttgaaggtgaaagaatacgagttgttgaggcgcaattttagcgacacagggtgcttcgggtttggtattcaagaacacattgatcttggtatcaagtatgatccttccactggtatctatggtatggatttctttgttgttctggaacgacctgggtaccgtgttggtcgccgccgccgatgcaaggctcgtgttgggatccaacatcgggttaccaaggaggacgcgatgaaatggtttcaagtgaaatacgagggtgttattcttaacaagtcgcaacaaattggagcttagttagatgtgttttgatgttttgtaaaatttt

SEQ ID NO: 4811 - DNA, 777 bp, Ambrosia trifida
gcgccgccctactcctctgcatctccaatggcatcagaaaggaagcaagcgaacccaatgagggagatcaaggttcagaaactcgttctcaacatctctgttggtgaaagtggcgatcgtctcactcgtgctgcaaaggttttggaacaacttagtggccagtcccctgtgttttccaaggcaaggtacactgtgaggtcgtttggcattaggcgtaacgaaaagattgcttgctatgtcactgttaggggtgacaaggcaatgcagcttttggaaagtggtttgaaggttaaggaatacgagcttttgagacgcaactttagtgacaccggttgctttggttttggtattcaggagcacattgatcttggtatcaagtatgatccatccactggtatctatggtatggacttctttgtggttctagaacgcccgggctaccgtgtgggtcgcagacgtaggtgcaaggcccgtgttggtatccagcatagagttaccaaggaagacgcaatgaagtggttccaggttaagtatgaaggagttatcctcaacaagtcccaacagatcggagcatagaagacgttgtaagtttctttggcggttaacttatgaagtggctcctcagagtttttattacatcaattttgtctttcagtctcttgcattttgactagttatgttgttactctcttgttatagtggatgtttttaggatggaatttattcaactttggtttgatcagatgtcttctttattactatatttgagacatgctg

SEQ ID NO: 4812 - DNA, 1306 bp, Aristolochia fimbriata
gaagcgtcaagcgtgtgggaatacggctcgtgttttgtggtcgtgtaaccgagtctagggtttaccgggggtttttatattcagttccggagaaaatatccgctctcttctgagtgactggggggagtgcgaagatggcgtcggagaagaagttatcgaatcccatgagggagattaaagttcagaagcttgtactcaacatctcagtgggtgagagcggtgatcgactcactagagctgctaaggttttggaacaattgagtgggcagactccggtgtattccaaggcaaggtacactgttcgatctttcggaattaggcgtaatgagaagatagcttgttatgtcactgtccgaggtgacaaggctatgcagcttctagagagcggattgaaggttaaggaatacgagttactgagaaagaacttcagtgatacgggatgctttggatttggcatccaagaacatattgaccttggaatcaagtacgatccctcgacgggtatttacggcatggacttctacatagttttggagcgccctggctatcgtgtaggacggcgaaggaggtgcaagtctcgtgtaggaatccggcatagggtgaccaaggaagacgccatgaaatggttccaagtcaagtacgaaggtgttatcctcaacaaatcgcaagctttgacaggttaatatatgggtaggagggctacgtaagctcctcctccattggtaccaccgagtttgtagtaagagatttccaccaagagttatttcctggctgatggtgtactttttggtttgcatggtagaatgacgacggttctttttcagcttttggaagaatgattgcttccagctttaatatattttggaaattgcttactgtgatgaatatgtaccacagacgtggctgagttgacttgaagttttggatcgctgcgtcgagttagggtgagacgtgttcgttttttaatgtgacaaaacccatctggccgagtcaagttgactctgaaagacctgagtcaggctcgaatcggactagtttagatgggttttggcatgataaatgcttttatttgggggagagttttgcattgacagcagagttttaaaaatcggaccggactggccggtctgaccctgttgaactggaactggaggcgagcacggttctaggttttaaaacattggccaggtaattcaaagtatcaaagtactaaatattattatcaagattttatattttattttctacttataattttatgagaacgtatgttgagaacaatgtatttattaccttgaaatcttgg

SEQ ID NO: 4813 - DNA, 782 bp, Arnica chamissonis
gccaccgttatcctccgcaacgtcaatggcttcagaaaggaagcaagcgaatccaatgagggagattaaggttcagaaactggttctgaacatctccgtcggtgaaagtggcgatcgcctcactcgcgctgctaaggttttggagcaactgagtggccaatcccctgtgttttccaaggcgcggtacactgtgagatcttttggcattaggcgtaacgaaaagattgcatgctatgtcactgttaggggagacaaggcaatgcagctcttggagagtggcttgaaggtcaaggaatacgagcttttgaggcgcaactttagtgacaccggctgctttggttttggtattcaggaacacattgatcttggtatcaagtatgacccgtcaactggtatctatggtatggacttctttgtggttctagaaaggccagggtaccgtgtgggccgcagacgaaggtgcaaggctcgtgttggtatccagcatagagttacaaaggaggatgcaatgaagtggttccaggtgaagtatgaaggagttatcctcaacaaatcccaacaaataggagcatagaagaatccatctttacagtaagtttctttgggctgttaaccgcgaatcgggtcactattaagtccttttttgtcgtttcgtttcatttattccgaatcgtagtcgtgtgctattatcttgttacagtagtttttaggatggagattatggaactcccaatgttttgcgcagatgcttttttattactatctatgaaacatcttttgat

SEQ ID NO: 4814 - DNA, 837 bp, Artemisia annua
aaccctaagcagcagacatatctcagccgcaacaaacaaatggcatcagaaaggaagcaagcgaacccaatgagggagatcaaggttcagaaacttgttctcaatatctctgttggtgagagtggtgatcgtcttactcgtgctgccaaggttttggagcaactcagtggacagtcaccagtgttctccaaggctaggtacactgtgaggtcttttggtatcaggcgtaatgaaaagattgcatgctacgtgactgttaggggtgacaaagcaatgcagcttttggaaagtggcttgaaggttaaggaatacgagcttttgagacgtaacttcagtgacaccggctgctttggttttggtattcaggagcacatcgatcttggtatcaagtacgatccatctactggtatctatggtatggacttctttgttgttctagaacgcccaggttaccgtgttggtcgtcgccgtaggtgcaaggcccgtgttggtatccagcacagagttacaaaggaggatgccatgaagtggttccaggttaagtatgaaggagttattctcaacaaatcccaacaaatcggagcatagacatcttttcagtaaccttctttcgggtggttgcctgtcacttgtcttacctgatattttatatccatttttgtttttcgatctctttgaatccgactagtaagttgttcttaggcaggagtttatggaaccacctttgtttgctcagattttattagtacctttaagacatgctgttttgattttgtgggtgtcgtattgtctgtgttactatgagaaaaaagcagttacaaacttgtttaattgctt

SEQ ID NO: 4815 - DNA, 952 bp, Phaseolus vulgaris
caactcataaagacccttctgtttggggttttcgttattaattcttctcttccctctgccgccgcaacggtgcaccctaatagcctccaacaatggggcttcagagaagaaactgtcgaaccctatgagggagataaaggtgcagaagctcgtcctaaatatctctgttggcgagagtggagatcgccttaccagggcagcaaaggtgttggaacaactgagtggccaaaccccagtgttctccaaagcaaggtacactgttcgttcttttgggattagaagaaacgagaagattgcttgttatgtcactgttagaggtgacaaggcaatgcaacttttggagagtggtttgaaggtgaaggaatatgaacttctcagaaggaacttcagcgatactggctgctttggctttggcattcaagagcatattgatttgggaatcaagtatgatccttcaactggtatttatggaatggatttctttgttgttttggagcgtcctggctaccgagttggccgtcgccgaaggtgcaagtcccgtgttggaattcagcaccgtgtcacaaaagaggattctatgaagtggttccaggtgaaatatgagggagtgatccttaacaagtcgcaggcaattgtttagattgagttcactttgggagtgtgttatcagttttgtcaactatagttccatctttctatgataggatcttaattttgaagcaggttttgaatccatgtttgtcatttaagtttttgcagcacatgtattaacaatagcactgttaaatgacactttattgcgaagttgtgaacccctcgttatgcaattttgcttagtaacgatttagtttctttattttgtaatgatgcctgtctgcatcatttccctcacttccaaaacatgtcaaaccactagagtgaaatcacgccatcagcattcatcgatggacac

SEQ ID NO: 4816 - DNA, 993 bp, Vaccinium corymbosum
aaccctagttcactccctcgggccgccttctcccatattagggtttcttcttcttcctctcctcttcattttcccccacccgtcgcataacctgcagccgctgcaccgaccaacggacagtcatggcctcggagaagaagctgtcgaacccgatgagggagatcaaggttcagaagctggtcctcaacatctccgtcggtgaaagtggagatcgactcacaagagcctctaaggtcttggagcaactcagtggacaaacccctgtgttctccaaagcgaggtatactgtgcggtcatttgggatcaggcgtaatgagaagattgcttgctatgtcactgtcagaggtgagaaagcaatgcagcttctggagagtggattaaaggtcaaggaatatgagctgctgcgaaggaacttcagtgatactggctgttttggctttggtattcaggaacacattgatcttgggattaagtatgatccttctactggcatttatggtatggatttctatgttgtgttggagcgccctggctaccgtgttgggcgtcgccgcagatgcaaggcgcgtgttgggattcagcacagggtcacaaaggatgatgcgatgaagtggttccaagtcaagtacgagggtgtgatcctgaacaagtcccagaatattactggttaatttggtcttgagcatctcaaagtgttcaaattttgggaagttgtgcttttgtgttttggtagacaatgatatactctactgtttttaatcttctttgcgatcaatgatcagttgtactatttgctttcttgacatgtttgagccagttactgttagtcgccagaatgggttgttgagatcaattggtcttttttgtctttggacacttccaattttcaatcttggtattcccggatctcaacgagtgacaaactgctctctgttttgggagcttagtatggaacagaatttactgaggtcaatgatgtgttgaattttagat

SEQ ID NO: 4817 - DNA, 849 bp, Vaccinium corymbosum
aaatccttcctctgttgccgccttattctccttcttcacctccattccaacctcgctccctgccgctccagattcacaatggcatcggagaagaagttgtcgaatcccatgagagagatcaaagtccagaagctcgtcctcaacatctccgtcggcgaaagcggcgatcgtctcacccgcgcctccaaggttttggaacaactgagtggccaaacccccgtcttctccaaagcgaggtacacggttcggtcctttggcatcaggcgtaatgagaagattgcatgctatgttactgtcagaggtgagaaagcaatgcagcttcttgagagtgggttgaaggtgaaggagtatgagcttttgcgtcggaacttcagtgacactggctgctttgggttcggtattcaagaacacattgatcttggcatcaagtacgacccttcaactggcatttatgggatggacttctatgttgttctcgaacgaccagggtaccgtgtgggtcgtcgccgtagatgcaaggcacgtgttggaatccagcatagagttacgaaggatgacgcaatgaagtggttccaggttaaatatgagggagtgatcctgaacaaatctcaaaatattggagcttagaattcctacaggcatttgagtaatgtacttccgagttttggcaaaccgcactttcatttgctgtttcctgaaccaggatgtttttgtttgttagatctatatttctatttctagtgttattcatgtctggacttttagtatcttttctaagatgggagtagagaatatcattttctggtttcagttgtagatttgttccaagcttaatggcatttatggttt

SEQ ID NO: 4818 - DNA, 864 bp, Vaccinium corymbosum
accctagttcactccctcggccccccttctcccatattagggtttcttcttcttcctctcctcttcattttccgccacccgtcgcataacctgcagccgctgcaccgaccaacggacagtcatggcctcggagaagaagctgtcgaacccgatgagggagatcaaggttcagaagctggtcctcaacatctccgtcggtgaaagtggagatcgactcacaagagcctctaaggtcttggagcaactcagtggacaaacccctgttttctccaaagcgaggtatactgtgcggtcatttgggatcaggcgtaatgagaagattgcttgctatgtcactgtcagaggtgagaaagcaatgcagcttctggagagtggattaaaggtcaaggaatatgagctgctgcgaaggaacttcagtgatactggctgttttggctttggtattcaggaacacattgatcttgggattaagtatgatccttctactggcatttatggtatggatttctatgttgtgttggagcgccctggctaccgtgttgggcgtcgccgcagatgcaaggctcgtgttgggattcagcacagggtcacaaaggatgatgcgatgaagtggttccaagtcaagtatgagggtgtgatcctgaacaagtcccagaatattactggttaatttggtcttgagcatctcaaagtgttcaaattttgggaagttgtgtttttgtgttttgttagacaatgatatactactattttgaatcttctttgggatcaatgatcagttgtattatttgctttcttaacatatttgagccagttactgttagttgccagaatggttgttgagatcaattggtcttttttgtc

SEQ ID NO: 4819 - DNA, 766 bp, Cleome gynandra
actttccgcttcattctaagtccgtctgctaatcttttttgctcctcttactcgactcgatcctctgagatggcgtcggagaagaagctctcgaaccccatgagggacattaaggttcagaagcttgtcctcaacatctccgtcggtgagagtggagatcgtctcacccgtgccgccaaggtcttggaacaactcagcggtcaaacccctgtcttctccaaggcgaggtacactgtgaggtctttcggtatcaggcgtaatgaaaagattgcctgttacgtcaccgtgaggggtgagaaggcaatgcagctgcttgagagtggcttgaaagtgaaagagtatgagttgctgaggaggaactttagtgacactggttgctttggctttggtattcaggaacacatcgatcttggaatcaagtatgacccgtcgacaggtatctatggaatggacttctacgtggttctggaacgtccaggataccgtgtggcccgtcgtcgtagatgcaaagcccgtgttggaattcagcacagagtgaccaaagaggatgcaatgaagtggttccaagttaagtatgaaggtgttatcctcaacaagtctcagaacatcactggttaaacctagtttactcattttgttgttctacctgttttacttttactattctggatgttaaagattttaacttttgtggtgagtggttttttttactatcttctggtagaatcctcaagaacaatttttgtaattaattgttaccattctc

SEQ ID NO: 4820 - DNA, 690 bp, Cleome spinosa
actcgtatcgatctttagagatggcgtcggagaagaagctctcaaaccccatgagggacattaaggttcagaagctcgtcctcaacatctccgtcggtgagagtggagatcgtctcacccgtgccgccaaggtcctggagcaactcagtggtcaaaccccagtcttctccaaggcgaggtacactgtgagatcattcggtataaggcgtaatgagaagattgcgtgctatgtgactgtgaggggtgagaaggcgatgcagctccttgagagtggcttgaaagtgaaggagtacgagttgctgaggaggaacttcagtgacactggctgcttcgggttcggtatccaggaacatattgatctcgggatcaagtatgatccctcaaccggaatctacggtatggatttctacgtggttctggaacgtccaggataccgtgtggcccgtcgccggagatgcaaggctcgtgtgggaatccagcacagagtgacaaaggaggatgccatgaaatggttccaagtcaagtatgaaggtgttatcctcaacaagtctcagaacatcactggttaaactcggtttcctttttcattttgctctctagctgttgcctgttttactttttactgaatctggattttagaaatttctgttttactttttgtaacatcagttggctgaatctcaagttttt

SEQ ID NO: 4821 - DNA, 746 bp, Cleome spinosa
ctcgctttccgctccattccaagtccgtctctcactcttttgctcctcctcctgctcgactcgatctcctcagatggcgtcggagaagaagctctcgaaccccatgagggacataaaggttcagaagctcgtcctcaacatctccgttggtgagagtggagatcgtctcactcgcgccgccaaggtcctggaacaactcagtggtcaaacccctgtcttctcaaaggcgaggtacactgtgaggtctttcggtattaggcgtaatgaaaagattgcgtgctatgttaccgtgaggggtgagaaggcaatgcagctccttgagagtggattgaaagtgaaggagtatgagttgctgaggaggaacttcagcgacactggctgctttgggttcggtattcaagagcacatcgatctcggaatcaagtatgatccctcgaccggtatctatggtatggacttctacgtggttctggaacgcccggggtaccgtgtagcccgtcgccgcagatgcaaggcccgtgttggaattcagcacagagtgacaaaggaggatgccatgaaatggttccaagtcaagtatgaaggtgttatcctcaacaagtctcagaacatcactggttaaacctttattctagctgttgccggttttgcttttaagattctggatgttttcttcttgtggtgagtgttttttctacatcagttggtaaaaaatcctcaaagttctttgaaatattaaagatttt

SEQ ID NO: 4822 - DNA, 692 bp, Cleome spinosa
gagttcgtccgccatccgcccttttcctccagctcctcgtatcgatcttctgagatggcgtcggagaagaaactctcgaaccccatgagggacattaaggttcagaagctcgtcctcaacatctccgtcggtgagagtggtgatcgcctcacccgtgccgccaaggtcttggaacaactcagtggtcaaacccctgtcttctccaaggcgaggtacactgtgaggtcttttggtatcagacgtaatgaaaagattgcgtgctatgtcacggtgaggggggaaaaagcgatgcagctccttgagagtggtttgaaagtgaaggagtacgagcttctgaggaggaatttcagcgacactggttgcttcgggttcggtattcaggagcatattgatcttggaatcaagtatgacccgtcgaccggtatctatggtatggacttctacgtggttctggaacggccgggataccgtgtggcccgtcgccgcagatgcaaggcccgtgtcggaattcagcacagagtgaccaaggaagacgccatgaagtggttccaagtcaagtacgaaggtgttatcctcaacaagtctcagaacatcactggttaaaccttttttacctcacattttgttttggttctagctgttgctggctttaccttagaattctggatcttaagaatttcatattgcagttc

SEQ ID NO: 4823 - DNA, 939 bp, Cucumis sativus
atccgcaataagcgtaagttgagtgacatcggagacaaaccctaaaaccctgcctcctccacttcgtctgctgtgaccgtccctccctctgcctcggctacctcatccgacaatggcttcagagaagaagctctcgaaccccatgcgagatattaaagtccagaagctggttcttaacatctccgtcggtgaaagcggcgatcgtctcaccagagccgccaaggtgctcgaacaactcagtggccaatcccccgtcttctccaaagcccgttacaccgttcggtcttttgggatcaggcgtaacgagaagatcgcctgctacgtcactgtgaggggcgaaaaggcaatgcaacttcttgaaagtggtttgaaggttaaggaatacgaactcttgcgcaggaacttcagtgatacaggctgctttggttttggtattcaggagcatattgatcttggaatcaagtatgacccttcaactggtatatatggtatggacttctatgttgttctagaacgtccaggctatcgtgttggtcgacgacgtcgatgcaagtcaagtgttggaattcaacatagggtcaccaaagaggatgcaatgaagtggtttcaagttaagtatgaaggtgtcatccttaataagtctcagaacattacaggctagattaatccctcaattttggtggcttctacaggtttttgtagttttcccatttttgtatcagaattttattttcaaggtttgaagacatttattgattttcctgtattttatcttcaaatggaagaaaaaggatttcctcctaatgagaaaatttgttattttgtgacttgagtggaagttcccgtttgtaatagatgtactataaggttgcctatcgatcctggcatctaaatttgaaatgcaagcagtggtaactgtcagtcgagcaagattactag

SEQ ID NO: 4824 - DNA, 784 bp, Taraxacum officinale
ccctcatttctgctcctaatcgacaccccttcgccgccgcactcatcagctacaatggcttcagagagaaagctagcgaatccaatgagggagatcaaggttcagaaactggttctgaacatctccgttggtgaaagtggtgatcgtctcactcgtgctgccaaggtcttggagcaattgagtggccaagctcccgtgttttccaaggcaaggtacactgtgaggtcgtttgggatcaggcgtaatgaaaagattgcatgctatgtgactgtcaggggtgacaaggcaatgcaacttttggagagtggattgaaggtcaaggaatacgaacttttgaggaggaactttagtgacactggctgctttggttttggtatccaggaacacatcgatcttggaatcaagtatgatccatcaacaggtatttatggaatggacttctttgtggttctagaaaggcccggataccgtgtgggaaggcgtcgtaggtgtaaggcgcgtgttggaatccaacatagggttacaaaagatgatgccatgaagtggttccaggttaagtatgaaggagtcattcttaacaaatcacaacaaattggaaattagagagattgttacaatttacaccctttgatcttttttttttgtcgttttggtccctttgaatctgactagctgtggcgttatttctttttatgggaattgttttaggcaggaatttatggagatgtttttgttttggttaaatgtttgttacatgatttttgacatgctgttttggttttgg

SEQ ID NO: 4825 - DNA, 739 bp, Eschscholzia californica
tgctccaaacttcatcgaggacgccatggccgcagagaagaagctcttaaacccaatgagggacatcaaagtccagaagctcgtcctcaatatctctgtcggtgaaagcggagatcgtctcaccagagccgccaaggtcttggaacaattgagtggtcaaagccctgtattttctaaagctaggtacaccgttaggtcctttggaatcaggcgtaacgaaaagattgcttgctatgttactgttaggggtgaaaaagcaatgcaacttcttgagagtggtttgaaggttaaggaatatgagcttttgaggaggaacttcagtgatactggttgtttcggtttcggaattcaggagcacattgatcttggaattaagtatgatccatcaactggtatctatggtatggacttctacgtggtattagaacgtccaggataccgtgttggtcgtcgccgtaggtgcaagtcaagagttggtattcaacacagggtgacaaaggatgatgcaatgaagtggttccaggtcaaatacgaaggagtcattctcaacaagtcgcaaaatatcactggttaattgcaagacttgtaactatttcaccttttttgaaactcacactgactatttgatcggttgtagtaggcaagtaaactaccttttctatctcgtttggaattttgagttatagtattagttatgctgcgtggtttaatagtaaatttggaatgtttgttatggaaa

SEQ ID NO: 4826 - DNA, 869 bp, Eucalyptus grandis
gaagagctgaattagggttcctggccattctcagacgccgtcttgctctccccttcccctccattccccttcgcttgccgccgccgccgccgccggtgtgacgttccaatggcgtcggagaagaagctgtcgaaccccatgagggaaatcaaggtccagaagctcgtcctcaacatctccgtcggcgagagcggagatcgcctcaccagggcggccaaggtgttggagcagctcagcggccagagccctgtcttctccaaagctaggtacactgttcgttcttttggaatcaggcgtaatgagaagattgcatgctacgtcactgtcaggggtgaaaaggcgatgcagcttctggagagtggtttgaaggtgaaggaatatgagctcctgcgaaggaactttagtgacactggttgcttcggttttggtatccaggagcacattgatcttggtattaagtatgacccttcgactggtatttatggaatggatttctacattgtgctggaacggcctggttacagagttggccgtcgtcggaggtgcaaggctcgtgtcgggatccagcacagggtcaccaaggaggacgccatgaagtggttccaggttaaatacgaaggtgtcatccttaacaagtcccagaacatcaccggctaggctcttagattctgagaaatctcctcgccccgcttttatttgtttgagctgcaaattaggatctcatcttcagttttgctcaggaacaggttttttttacatgtatcagttttgctcatgaagaacatgtttttgtgcccacctctttcattgcttcatgctctgttttcgatggtctaagtggatctctttgcgcaaaactgcaacccgtg

SEQ ID NO: 4827 - DNA, 774 bp, Euonymus alatus
cagcccctgcaccgccctcaccctaccccttcgcttcagcgcatcggcatcggcatcggcatcgcaatggcttccgagaagaagctggcgaacccaatgagagaaatcaaagtgcagaagctcgttctcaacatctccgtcggtgagagtggtgatcgtctcacccgtgctgctaaggtcctggaacaactcagcggccaaacccccgtctactccaaggcgaggtacacggttaggtcgtttggaatcaggcgtaataagaagatagcatgctacgtgactgtgagaggcgaaaaggccatgcagctattggagagcggcctgaaggtgaaggagtatgagcttttgaggaggaacttcagtgatactggttgcttcgggtttggcatccaagagcacattgatctgggtatcaagtatgatccttcaactggtatttatggtatggacttttatgtcgttctggagcgtccagggtacagagtgggtcgtcgccgtagatgcaagtcccgtgttggaattcagcacagagtgactaaagaggatgcaatgaagtggttccaagtcaaatatgaaggagttatcctcaacaagtctcagaatattggagcttagagagatgccttaaccagaaaggtcttgcctcatgtagacttcataatctcattttacttgtgtgcacaaatgctattatcgcatttcaggatccttttttagacattcctcttgttctatcatatgcaatctaaatttaataagacaaaaaaaaaaaac

SEQ ID NO: 4828 - DNA, 749 bp, Euphorbia peplus
cagcaatggcgtcggagaggaagctatcgaaccctatgagagagatcaaagttcagaagctcgttctcaacatttccgtcggcgagagcggcgatcgtctcacccgtgcatccaaggtgttagagcaactcagtggccaaacaccagtgttctctaaagctagatacactgttaggtctttcggaatcaggcgtaatgagaagattgcttgctatgtgactgttaggggagataaggcaatgcagctgctagagagtggtttgaaggtgaaggagtatgaacttctgaggaggaacttcagtgataccggttgctttggatttggtatccaggagcacattgatcttggaatcaagtatgatccatctaccggtatctatggtatggacttctttgttgtactggaacgacccggatatagagtgggccgccgcaggagatgcaagtcccgtgttggaattcaccagagggtcactaaggaggatgccatgaagtggtttcaggtgaaatatgaaggtgttatccttaataaggcacaaaatattggtgcttagtttcgttatatttaagttgcggtgagttatatgtctaggacttcactttttacatttttggagttcagaaattttgttgaagtcttgaatttaagtactttaacgttggattacattttagttatgcctctttatttctgtattgctatcgttgcgtgatttattttaagatttatatacttaacctttagtccc

SEQ ID NO: 4829 - DNA, 744 bp, Euphorbia peplus
ggcacgaggtgcctccgtcagagctccgcctccaatcccctaaaaatggcttcagagaggaagctatcgaaccctatgagggaaatcaaggtgcagaagctcgtcctcaacatttccgtcggtgaatccggcgatcgtctcacccgtgcttccaaggttctcgagcaactcagtgggcagacacccgtcttctcgaaagctaggtatactgttaggtctttcgggatcagacgtaacgagaagattgcttgctatgttactgtgaggggtgataaggctatgcagctgctcgagagtggtttaaaggttaaggagtatgagcttttgaggaggaactttagtgatactggctgctttgggtttggtatccaggagcacattgatctcggaatcaagtatgacccttccaccggtatctatggtatggatttctttgttgtccttgagcgtccaggttaccgtgtgggtcgccgcagacgatgcaagtcacgtgttggaattcatcaaagggtgacaaaggaggacgcaatgaaatggtttcaagtgaaatatgaaggtgtcatccttaacaaggcccagaatatcggagcttaaaactttagcattgtgtttaagttttgaagttttatattttgcataaccttttttgttcttttacaatgttgctgttagaaccgggccagaagaatttttgaatttgtagaatttggaattcttagtttgctctttaagttgttaagctat

SEQ ID NO: 4830 - DNA, 706 bp, Euphorbia peplus
cgcaatagtttaccatctctcctctgcgtacaaactcgccttcaacagcaacaatggcgtcggagaggaagctatccaaccctatgagagagatcaaagtgcagaagctcgtactcaacatttccgtcggtgaaagcggcgatcgtctcacccgtgccgccaaggtgcttgagcaactcagcggccaaacaccagtattctctaaagctaggtacactgttagatcttttggaatcaggcgtaatgagaagattgcttgctatgtgactgttaggggagacaaggctatgcagctacttgagagcgggttgaaagtgaaggaatatgaacttttgaggaggaacttcagcgatactggttgttttggatttggtatccaggagcatattgatcttggaatcaagtatgatccttctactggtatctatggtatggatttctacgttgtactggaacgacctgggtaccgggtgggtcgccgcaggagatgcaaatcacgagttggaattcaccagagggttaccaaggaggatgcgatgaagtggtttcaggtgaaatatgaaggtgttatccttaacaaagcacaaaatattggagcttagtttggttacatttaagttgcggtgagttaatgtgtaggactatgcattttatattgatggaactcataaattttgttgaagacttgaaaattgtagaattctca

SEQ ID NO: 4831 - DNA, 806 bp, Euphorbia peplus
atcctccagccccgccacatttatcttcctcttctctgtgaacgaacgaaatcgccttcaacagcagcaatggcgtcggaaaggaagctatcgaaccctatgcgcgagatcaaagtccagaagctcgttctcaacatttccgtcggcgaaagcggcgatcgtctcacccgcgcctccaaggtgttagagcaactcagcggccaaacaccggtgttctctaaagctaggtacactgttaggtcttttggaatcaggcgtaacgagaagattgcgtgctatgtgactgttaggggagataaggcaatgcagctgcttgagagtgggttgaaggtgaaggagtatgaacttctcaggaggaactttagtgatactggttgctttggattcggtatccaggagcacattgatcttggcatcaagtatgatccatccactggtatctatgggatggacttctttgtcgttctcgaacgacctggatatagagtgggccgccgcaggagatgcaagtcacgtgttggaatccaccagagggttactaaggaggacgccatgaagtggtttcaggtgaaatatgaaggggttatccttaacaaggcacaaaacattggagcttagtttggttatttttaagttgcggtaagttaaatgtgtaggactttgtgttttacatttttggagttcagaaattttgttgaagtcttgaatttaaatactatgatgttggattacattttagttatggttttttgtttctatattgcttcggagattgaagcatcttttgcaatatttgttaacaaatg

SEQ ID NO: 4832 - DNA, 814 bp, Flaveria ramosissima
ttctactccggcaaccctccgccgccgtccttctccgccaccgacctcctccgccacatcaatggcttcagaaaggaagcaagcgaatccgatgagggagatcaaggttcagaagcttgttctcaacatctccgtcggtgaaagcggcgatcgcctcactcgcgccgctaaggtgttggagcaactcagtggtcaatcccctgtgttttccaaggcaaggtacacggtgagatcttttggcattaggcgtaatgaaaagatcgcatgctatgtaactgttaggggagacaaggcaatgcagctcttggagagtggcttgaaggtcaaggagtacgagcttttgaggcgcaatttcagtgacactggctgctttggttttggtattcaggagcacattgatcttggtatcaagtatgacccgtcaacgggtatctatggtatggacttctttgtggttttagaaaggccagggtaccgtgtgggtcgtagacgcaggtgcaaggcgcgtgttggtatccagcatcgagttacaaaggaggatgcaatgaagtggttccaggtgaagtatgaaggagttattctcaacaaatcccaacaaattggggcttagaagaaacctatctttaatgtgagtttttttacggatgttaattgttatgcgcttgcttctaaatccatttttgtctttttgattttgactagtgttcgcctttgggtttttctcttgttatagtagttgtttttagggtgaaagttatggagacccctctgtttcgcttgaatgttttcttaataccatctatgaaacatatac

SEQ ID NO: 4833 - DNA, 712 bp, Flaveria ramosissima
atggcatcagaaaggaagcaagcgaaccccatgagggagattaaggttcagaagctcgttctcaacatctccgttggtgaaagtggcgatcgtctcactcgtgctgccaaggttttggagcaacttagtgggcaatctcctgtgttttccaaggcaaggtacactgtgagatcctttggcattaggcgtaatgaaaagattgcatgctatgtcaccgttaggggagacaaggcaatgcagctcttggaaagtggcctcaaggtcaaggaatacgagcttttgagacgcaacttcagtgacactggctgctttggttttggtattcaggagcacattgatcttggtatcaagtatgatccttctactggtatctatggtatggacttctttgtggttctagaacgcccaggctaccgtgtgggtcgtagacgtaggtgcaaggctcgtgttggtatccagcacagagttacaaaggaggatgcaatgaagtggttccaggtgaagtatgaaggagttattctcaacaaatcccagcagatcggagcatagaagactcgcatcaagttttctcttggcggttaaggaatcccggttttcttatatcagtttttgctttcagtctattgcatttcgatagttttgttgttatttgcttgttatagtagatttttaaggtggaaattattgaactttgttttgcacacatttttgt

SEQ ID NO: 4834 - DNA, 732 bp, Flaveria ramosissima
caatggcttcggaaaggaagcaagcgaatcccatgagggagatcaaggttcagaagcttgttctcaacatctccgtcggtgaaagcggcgatcgcctcactcgcgccgctaaggtcttggagcaactgagtggtcaatcccctgtgttttccaaggcaaggtacacggtgagatcttttggcattaggcgtaacgaaaagatcgcatgctatgtaaccgttaggggagacaaggcaatgcagctcttggagagtggcttgaaggtcaaggagtacgagcttttgaggcgcaatttcagtgacaccggctgctttggttttggtattcaggaacacattgatcttggtatcaagtatgacccgtcaacgggtatctatggtatggacttctttgtggttctagaaaggccggggtaccgtgtgggtcgcagacgcaggtgcaaggcgcgtgttggcatccagcatcgagttacaaaggaggatgcaatgaagtggttccaggtgaagtatgaaggagttatcctcaacaaatcccaacaaattggagcttagaagaaacctatccttaatgtaagtttttacggatgttactcgttactccgcttgctactaaatccatttttgtctttttaatttcgactagtattcgccttcgggttattctcttgttatagtagttgtttttaggatgaaagttatggagccccctctgttttgcttgaatgttttctta

SEQ ID NO: 4835 - DNA, 738 bp, Fraxinus spp
gccgtcatctacccgccattccactgccatggcgtcagagaagaagctgtcgaatccgatgagagagatcaaggtacagaaactcgttctcaacatttccgtcggcgagagcggagatcgtctcaccagagccgctaaggtcctcgaacagctcagtggccaatcccctgttttctcgaaggcaagatacactgtgcggtcctttgggatcagacgtaacgaaaagattgcatgctatgtcacagtcaggggtgataaggcaatgcagctccttgagagtgggttgaaggttaaggaatatgaactgttgagaagaaactttagcgacactggctgttttggctttggtatccaggagcacattgatcttggaatcaagtatgatccttcaaccggtatctatggtatggatttctatgttgtctgggagcgccccggttatcgtgtgggccgtcgacgtagatgcaagtcccgtgttggaattcagcaccgggtcacaaaggatgatgcaatgaagtggttccaggtgaaatacgaaggtgttattcttaacaagtcttccaatattgcaacttagttcgagagcacaagtggaatatcctgtcaaagatttatattctgcattttatagacccggttttgttactttttaagcccaaaagttttggagaactgcttttatgtgttttgcagatgagttcattttctcttgaggtttaatttagttgtatttttatg

SEQ ID NO: 4836 - DNA, 746 bp, Guizotia abyssinica
gccgccgcaacgtcaatggcttcagaaaggaagcaagcgaatccgatgagggagattaaggttcagaagcttgttctgaacatctccgtcggtgaaagtggcgatcgtctcactcgtgctgcgaaagttttggaacaattgagtggccaatctcctgtgttttccaaggcaaggtacacggttagatcttttggaattaggcgtaacgaaaagattgcatgctatgtaactgttaggggagacaaggcaatgcaactcttggagagtggcttgaaggtcaaagaatacgagcttttgagacgcaatttcagtgacaccggctgctttggttttggtattcaggagcacattgatcttggtatcaagtatgacccgtcaacgggtatctatggtatggacttctttgtggttctagaacgcccgggataccgtgtcggacgcagacgtagatgcaaggcccgtgttggcatccagcatagagttacaaaggaggatgccatgaagtggttccaggttaagtatgaaggagttatcctcaacaaatcccagcaaatcggcgcatagaataaatctttttttaaagtaagttcttttgggaagttaatcgtgacctgtctcgcttttaaacccatttgtcttctgatctattgaagtttcgactattagtcgccaatcgggttatgctcttgtttagtagttgttattaggatggaaattatggaactctctgttttgttcagattcta

SEQ ID NO: 4837 - DNA, 801 bp, Carpinus betulus
ttccactccagcctctctgcctccgctcctgcacacagcacaccacaatggctgcggagaggaaactaagcaacccaatgcgggagatcaaggtccaaaagctcgtcctcaacatctccgttggcgagagcggtgatcgtctaaccagagcctccaaggtgttggagcaactgagtggccagaccccagtcttctcaaaggctaggtacacggtgagatcgttcgggattaggcgtaacgagaagatagcgtgctacgtaacggtgaggggggagaaggcgatgcagcttctggagagtgggttgaaggtgaaggagtacgagcttctgcgtaggaacttcagcgataccggctgcttcggctttggtattcaggaacacatcgatctcggaatcaagtatgacccttcaactggtatctatggtatggatttttatgttgttttggagagagcaggataccgtgtgggtcgtcgtcgtagatgcaagtcccgtgttggaatccagcacagagttactaaagaggatgcaatgaagtggttccagatgaagtatgaaggagttatccttaacaagtctcagaatacttagagagatctcctatgtaatgtaggatttgtttttgttttggcgagctgttatcgttcagctttgtttatcaggattaatattttgtttgaatgagattttatgagttactttatcttttaagtactttctggtgaatttcatgttccgactcttgtcattattttctcatgttcaatccgatttaatgtttatggttggttattactaaacg

SEQ ID NO: 4838 - DNA, 936 bp, Lactuca sativa
aaaaatgtcatttcgctttcaacattttgttgaacgaaaccctaacaggccttaagtttctaataaaacccttttcatctcccttcgccctcatttctgctcttacatcgacacccctacgccgccgcactcttccgcaactacaatggcgtcagagaggaagctagctaatccaatgagggagattaaggttcagaaactggttctgaacatctccgttggtgaaagtggtgatcgtctcactcgtgctgctaaggttttggagcaactcagtggccaatcccctgtcttttccaaggcaaggtacactgtgagatcttttgggatcaggcgtaatgaaaagattgcatgctatgtaactgttagaggagacaaagcaatgcagcttttggagagtggattgaaggttaaggaatatgaacttttgaggcgcaatttcagtgacactggttgctttggatttggtatccaggagcacattgatcttggtatcaaatatgatccctcaactggaatctatggaatggatttctttgtggttcttgaaaggccaggataccgtgtgggaagacgccgaaggtgcaaggcgcgtgttgggatccaacacagagttacaaaggacgatgcaatgaagtggtttcaggttaagtatgaaggagttatcctcaacaaatcccaacaaattggagcataagagattttgttatgtccattttgtctttttcaatccagactagttatggtgttgtttttgatttgtttatgttatggtagtagttcttttaggcaggaagttatgcaaactccttttcattttgctcaaatgttttctacaagattcttgagataatgtttttgttttggtatctttaacagaaaaatgctttgtttgatggtttttttgttcattttgaatagtaagcagtcttaatttat

SEQ ID NO: 4839 - DNA, 885 bp, Lactuca sativa
ttatgggcctcttctacataaaacacaatctcaaacaaaaccctagcaatatttacagataaagctttacgccatttcgattcttgccaccgtttctgcaacctgctcatctaacaatggcctcagaaaggaagcttgcgaacccaatgagggaaattaaggttcagaaactcgtcctcaacatttcagtcggagaaagcggcgatcgtctcacccgtgctgccaaggttttggagcaactgagcggccaatcccctgttttctcaaaggcaaggtacactgtgaggtcatttgggatcaggcgtaatgaaaagattgcatgttatgtcactgttagaggagacaaggccatgcaacttttggaaagtggtttgaaggtgaaggaatacgagttgttgaggcgcaactttagtgacactggatgctttggatttggtattcaagagcacatcgatcttggtatcaagtatgatccgtccacgggtatctatggtatggatttctttgtggttctagaacgtcccggataccgtgttggccgtcgtcgtaggtgcaaggcgcgtgttgggatccaacaccgagtgacaaaggatgatgcaatgaaatggtttcaagtgaaatacgagggtgtcattctcaacaaatctcaacaaattggagcttagatttattattattattattattattattattgtcttctttttgtaaaattttggagtttggtttttgaaagttttactattgaggattatgattaatgtgagttttgttttgttttggacctttttgaatcttggtacaagtgcgtaactacttttgatctttttaaagactacaaagttgcaggaaatatgaattttatttagtcttgcttttgattta

SEQ ID NO: 4840 - DNA, 864 bp, Lactuca sativa
gtaaatacggcattctcaaattccatcctttataccacaaaccctagcagatctgttggcagccttacttttctaataaaacccttctccccatcccctctcctctgcttcctctgcctccaacctccaatctccaccgccgtaatcgttccctgcagcaatggcgtcagagaggaagctagcaaatccaatgagggagattaaggttcagaaactcgtcctcaacatctccgtcggtgagagcggcgatcgtctcactcgcgctgccaaggttttggagcaactaagtggccaatcccccgtcttttccaaggcaaggtacactgtgaggtcatttgggattaggcgtaatgagaagattgcttgttatgttactgttagaggagacaaggcaatgcagcttcttgagagtggattgaaagtgaaggagtatgagcttctcagacgtaactttagtgacactggttgctttggatttggtattcaggaacatattgatcttggaatcaagtatgatccctccactggtatttatggtatggacttctttgtggttctagagcggccgggttaccgtgtgggccgtaggcgtaggtgcaaggcacgagttggaatccagcatagagttacaaaggatgatgcaatgaagtggtttcaagtgaaatatgagggagttattctcaacaaatctcaacagattggggcataattgtcttttttatttagtagtcttttttggttatattgtattgtgccagagatttaattattattgcttttgtgttttgtacttgctgagtctttatagtagtgagaatatgaaacccaccaagttttggttttgattggatttgttttggactt

SEQ ID NO: 4841 - DNA, 904 bp, Marchantia polymorpha
ctccctcccctttctttcgaccgaacgcggggtgtcgtaattttggatcgtcctgctgttgcaatggcttccgagaagaaaatgcagaattgcatgcgagaaatcaaggttcagaagctcgtgctgaacatttccgttggagaaagtggggatcgtctcactcgcgctgccaaggtgttggagcagctcagcgggcaatcacctgtgttctccaaggctaggtacactgtgaggtccttcggtatccgacgtaacgagaagatcgcatgctatgttaccgtgcgaggcgagaaggctatgcagttgttggagagtggcttgaaggtgaaggagtacgaactcctccgcagaaacttttctgacaccggctgcttcggtttcggtatccaggagcacattgatcttggtatcaagtacgacccctccaccggaatttacggtatggacttctacgtcgtgttggaacgacccggatacagagttggcaggagaaggagagcgaagtctagagttggaatccagcacagagtcaccaaggaggactcaatgaagtggttccaggttaaatacgagggagttatcttgaacaagtcaactcaaattgtttgatcacggtaaattccaaattagacgaagggttttaggagcggagtagacctatttttcatcgtcacgcggacttcagtgtatacaatctcaaatgcaacgcctgttgtggacgagcacgcagattcggatagaacagtggtaatttgtccaatgcctgcaggcgaaaagaaatggcctttgttgcatacctgtgtaccaagttctgtaagtcaacctagatacaacctaaattgtagatgttatgacgcattatgggaaacgttaattcaccagttttgttatgagatattatgag

SEQ ID NO: 4842 - DNA, 891 bp, Cucumis melo
tcatttttttaatgatcatccgcaataaggcgtaagttgagtgacatcggagaaaaaccctaaaaccctgcctcctccacttcgtctgctgtgaccgtccctccctctgcctcgcctgcctcatccgacaatggcttcagagaagaagctctcgaaccccatgcgagatattaaagttcagaagctggttcttaacatctccgtcggtgaaagtggcgatcgtctcaccagagccgccaaggtgcttgaacaactcagtggccaatccccggtcttctccaaagcccgttatactgttcggtcttttgggatcaggcgtaacgagaagatcgcctgctacgtcactgtgaggggcgaaaaggcaatgcaacttcttgaaagtggtttgaaggttaaggaatacgaactcttgcgcaggaacttcagtgatacaggctgctttggttttggtattcaggagcatattgatcttggaatcaagtatgacccttcaactggtatatatggtatggacttctatgttgttctagaacgtccaggctatcgtgttggtcgtcgacgtcgatgcaagtcaagtgttggaattcaacatagggtcaccaaagaggatgcaatgaagtggtttcaagttaagtatgaaggtgtcatccttaataagtctcagaacattacaggctagattaatccctcaattttggtggcttctacaggtttttgtagccttcctatttttgtatcagaattttattttaaaggtttgaagacatttattgatttttcctgtattttatcttcgaatggaagaaaaaggatttcctcctaatgagaaaatttgttattttgtgacttgagttgaagttcccgtttttaatagatgtactataaggttgc

SEQ ID NO: 4843 - DNA, 930 bp, Nicotiana benthamiana
ggttcagaaagctaacagcagcgcagctccgttacacgcacatatatatactgggattgaactagggtttctcgcactctcccttcccccttcccttcccgtataccctaaactacctgccctgtagctgcaaacgaagcgcaatggcttcagagaagaaattgagcaatccaatgagggagattaaagtccagaagctcgttctgaacatctccgtcggtgaaagcggagatcgtctcaccagagccgccaaggtcttggagcaactcagtggccaatcccctgttttctccaaggcaaggtatactgtccgatccttcggaattagacgtaatgaaaagattgcctgctatgtcactgtcagaggggaaaaagctatgcagctcctcgagagtggattgaaggtcaaggagtatgagttgttgagaaggaacttcagtgaaactggctgctttggttttggtattcaggagcacattgatcttggaattaagtatgacccttcgactggtatctatggtatggatttctatgttgtcctagaacgcccaggataccgtgttgccagacgtcgtaggtgcaagtctcgggttgggatccagcacagggttacaaaggaagatgccatgaagtggttccaggtcaaatatgaaggtgttatccttaacaagtcctctaacattcagtaagatgagagctgtctgctggatcaatttgttcagtagcaagtttatgtttatgcattttgtagaccaacatctaattactccccgagttgaatagtttttgagagttgctgttatttggcatattatgttttcattttggctatgcgatcaactcaatcatactatgtcgttttgtgttagttttctgtcgtgcaattctagtagtttgctcctcttggcgacaaacttatctgattttaaa

SEQ ID NO: 4844 - DNA, 923 bp, Nicotiana benthamiana
ccgccatctcagtacccaacgactcttccagctactgctgctataacatcttccagcggaagcgccatggcgtcagagaagaaattgagcaaccccatgagagaaattaaggtccagaagctcgttctcaatatctccgtcggtgagagcggagatcgtctcaccagagcagctaaggtcttggagcagcttagcggccaatcccctgttttctccaaggcaaggtatactgtgcggtcttttggaatcaggcgtaatgaaaagatagcttgctatgtaactgtcagaggggagaaagctatgcagctacttgagagtggattgaaagttaaggaatacgagttgttgagaaggaacttcagtgagaccggctgctttgggtttggtattcaggagcacattgatcttggaattaaatatgatccgtcaactggtatttatggcatggacttctatgttgtattggagcgtcctggataccgtgttgcccgtcggcgcaggtgcaagtctcgagttgggattcagcacagagtcacaaaggaggatgcgatgaagtggttccaggtcaaatatgaaggtgttatccttaacaagtcctcaaacattcagtgataagcttagaaagccaacttctggatcagtctgtctcctcgcaagtttatgtttatgtattttgttgacctgcatctatatcactcgtagagggaagttttggagagtttctagtagtggcgtatgaggatgttttagttctcattttggctatcagatcaattcaatctttttttggtcattttcttttgttccaattaaatcagattcattgaactccacaatctagtacaatagatgctttgaatacctgatttgtatgctattgtggtaacaaagtaatccactgtttagtgtttaagcgtgttgtt

SEQ ID NO: 4845 - DNA, 720 bp, Orobanche aegyptiaca
tgctgccgccacgcacccaccgtcgaccaccgcagtcagtcaaatggcgtcagagaagaaattatcgaacccgatgagagagatcaaggtgcagaagctcgttctcaacatctccgtcggcgaaagcggagaccgtctcaccagagcctctaaggtgttggagcaactcagtggccaaacccctgttttctccaaagctcgttacactgtacgatcctttggcatccggcgtaatgaaaaaattgcatgctacgtcacggtcagaggtgacaaggctatgcaactacttgagagtggtttgaaggtcaaggaatatgaactgttgagacgtaatttcagtgatactggctgctttggttttggaatccaggagcacattgatcttggaattaagtatgacccctcgactggtatttatggaatggacttctatgttgtcttggaacgccccggatatcgcgtgggccgtcgtcgtaggtgcaagtcccgtgttggaatccagcatagagtgactaaggacgatgcaatgaagtggttccaggtgaaatatgaaggtgtcatcctgaacaaggcatccaatatcggagcttagtttaagtgcaggatttgactgaacaatttgtgtttttatctgtttccgtctaagttttgtagtagttcatttatagacaagtctatttcaacaatatttcataattttcgtggatattaatcaagttc

SEQ ID NO: 4846 - DNA, 879 bp, Orobanche aegyptiaca
ccagaactaaaaccctaattatcccccctacttattctgtctcccattttcccctgtgcgtctcatttcccccccaaacccctcctgccgcctcgcctccgccgacaaccaccggaccgtcatggcgttagagaagaaattgtcgaatccaatgagagagatcaaggttcagaaactggttctcaacatctccgttggtgaaagtggagatcgtctcaccagagcttccaaggttttggagcaactcagtggacaaacacctgtcttctcaaaagccaggtacactgtccgctcctttgggatccgtcgtaatgaaaagattgcgtgccatgtaaccgtcagaggtgataaggcgatgcaacttcttgagagtggcttgaaagtgaaggaatacgaattgctgagaaggaatttcagtgatacgggctgttttggttttggtattcaggagcacattgatcttggaattaagtacgacccgtcaacgggtatctacggtatggatttctatgtcgtgttggagcgccctggttaccgtgtgggccgccgccgtaggtgcaagtctcgtgtcggcatccagcacagggtcactaaggaggacgcgatgaagtggttccaggtcaaatacgaaggtgttattctgaacaaggcttccaatattggagcttgaaaaggtccctaccgtatatcgactttttgaatttgtcaggattatttttgcctgaggtcttgtagaatttttgttgtttcttacgacaatttttgttgttcttacgacaatttttgctagacttgtgacaatttttgtggtgcttgtgacaatttctgttggcttatgatcgcttgcaatggcaggactatttttgttcgtctttttaa

SEQ ID NO: 4847 - DNA, 688 bp, Parthenium argentatum
acactccaatggcatctgaaaggaagcaagcgaacccaatgagggagattaaggttcagaaacttgttctcaacatctccgtcggtgagagtggcgatcgtctcactcgcgctgctaaggttttggaacagcttagtggccagtctcctgtgttttccaaggcaaggtacactgtgagatcatttggcattaggcgtaacgaaaagattgcatgctatgtcactgttaggggtgacaaggcaatgcagctcttggaaagtggcttgaaggttaaggaatacgagcttttgaggcgcaacttcagtgacactggttgctttggttttggtattcaggagcacattgatcttggtatcaagtatgatccatctactggtatctatggtatggacttctttgtggttctagaacgcccgggttaccgtgtgggtcgcagacgtaggtgcaaggcccgtgttggtatccaacatagagttaccaaggaagacgcaatgaagtggttccaggtgaagtatgaaggagttatccttaacaaatcccaacagatcggagcatagaagacgttgtaagttttcttttggcggttaagtatgacgtggctcaccagagtttttattacatcagtttttgtctttcagtatcttgcattttgactagttatgttgttattctcttgttatagtggctg

SEQ ID NO: 4848 - DNA, 618 bp, Capsicum annuum
ctcttccctttacttcgcagaaaccctaatttcccagccgctcgatccaatggcgtcggagaagaagttgtcgaacccgatgagggagataaaggtgcagaagctggtcctcaacatctccgtcggcgagagcggcgatcgtctcacgcgcgccgccaaggtcctcgagcagctcagcggccagtcccccgttttttccaaggcgaggtacactgttaggtcgttcggtattaggcgtaacgagaagatcgcttgctatgttaccgtgaggggtgagaaggcgatgcagcttctcgagagtggcctcaaggttaaggagtacgagctgttgaggaggaactttagtgataccggctgctttgggttcggtatccaggagcacattgatctcgggatcaagtatgacccatccactggtatctatggtatggatttctatgttgttttggagcgccctgggtatcgtgttggtcgtcgccgcaggtgcaagtctcgtgttggtattcagcaccgtgtcaccaaggatgatgccatgaaatggttccagatgaagtatgaaggtgtcatcctcaacaaggcatcccaacttgcagtttaaatgtgctcgactactctggt

SEQ ID NO: 4849 - DNA, 905 bp, Lippia dulcis
tcctccagccgtcgcgcctccgcaccgaccaccggatcgccatggcgtcagagaagaagttgtcgaatccgatgagagagatcaaggttcagaagttggtcctcaacatctccgtcggtgaaagtggagatcgtctcactagagctgctaaggtgttggagcaactcagtgggcaaagccccgttttctcgaaagcgagatacaccgtgcgatcttttgggatcaggcgtaatgaaaagattgcatgctatgtgaccgtcagaggtgataaggccatgcagcttcttgagagtggattgaaggtcaaggaatatgaactgctgagacggaacttcagtgagactggatgttttggtttcggtattcaagagcacattgatcttggaattaagtacgacccttcaaccggtatctatggtatggatttctatgttgtcttggagcgccccggttatcgtgtgggccgtcgccgtaggtgcaaatcccgtgttggaatccagcacagagtgaccaaggaagatgcgatgaagtggttccaggtcaaatatgaaggtgttattcttaacaaagcatccaacattggagcttaggttcacagcctcccttgttttgtttttcattgattgagatttttatgcaaaagttttgtaagaattcaagttctgtcggaaacgatggctttactttcattacatctgtctctcttttttatattttcaataggagtactggtttcattagttcctataatttcatagcttcataattcttgtgttgaacttattctattgccattggcatttgtttggagtgtccttactgcacaaaattcaattcaatagagctgcataacgggccgacccggttcaagttcaattgatcctgttcgagtttgtgagctcttt

SEQ ID NO: 4850 - DNA, 849 bp, Papaver somniferum
gtttctctctacttttccttcctctcctcctaaaggccgaactgtactaaccttcattgcaggcagccatggcagcagagaagaaacttacgaacccaatgagggacatcaaagtccaaaagcttgtccttaacatttctgttggtgaatctggagatcgtctcaccagagccgctaaggttttggaacaattgagtggtcaagccccagtcttctccaaggctaggtacactgttagatcatttggaatcaggcgtaatgaaaagattgcttgttatgttaccgtgagaggtgagaaagctatgcagcttcttgaaagtggattgaaggttaaggaatacgagctcttgaggagaaacttcagtgatactggatgttttggattcggtattcaggagcatattgatcttggaattaagtatgatccttcaaccggtatttatggaatggacttctacgttgttttagaacgcccaggataccgtgttggacgtcgtcgtaggtgcaagtcaagagttggtattcaacacagggttaccaaggatgatgctatgaagtggttccaggtcaaatatgagggagtcattctcaacaagtctcagaatatcactggttaattggagtcattcacaacaagtcacagaatattactggttaattggaagggctaggttttgttttcttgctatgtgaaaaaccatcttgcttgttagcttttcatgtaggcagccaaactctgttttttcaattttatggtctagagaattttgagttaatagtagttgtcacaatatatttttgatgtttcgttatgaaattggattgtgtttgttatatgtttctattttt

SEQ ID NO: 4851 - DNA, 750 bp, Papaver somniferum
tttttgggtgctagggttcatctattaggtcacacacttgcagtcccattaccgaggctaaaatggcgtcggagaagaagctaacgaatccaatgagagacatcaaagttcagaaacttgtcctcaacatctctgttggtgagagtggtgatcgtctcactagagccgccaaggttctggagcaactaagtggacaagccccagtgttctctaaggctagatacactgttcgatcttttggtatcaggcgtaatgagaagattgcttgctatgttactgttaggggagagaaggcaatgcaattgctagagagtggattgaaggtgaaggagtatgaactgttgaggaggaattttagcgatactggttgttttggctttggtattcaggaacatattgatcttggaatcaagtatgacccatctacgggtatctatggaatggacttctatgttgttttggagcgtcctggttaccgtgttggtcgtagacgacgttgcaagtctcgtgttgggatccaacaccgagtcacaaaggaggatgctatgaagtggttccaagtcaagtatgaaggtgtcatcctcaacaagtcccagaacatcactggttaataacaacaagggaagagggaaactcattccaatttaaattgtttttttttcacattagttttctctttgttctttcgatttcgaactagaacgccttgtccacttgacttttgaatgaatatagcactagaagcttaat

SEQ ID NO: 4852 - DNA, 710 bp, Papaver somniferum
ctaaccttcattgcaggcagccatggcagcagagaagaaacttacgaacccaatgagggacatcaaagtccaaaagcttgtccttaacatttctgttggtgaatctggagatcgtctcaccagagccgctaaggttttggaacaattgagtggtcaagccccagtcttctccaaggctaggtacactgttagatcttttggaatcaggcgtaatgaaaagattgcttgttacgttaccgtgagaggtgagaaagctatgcagcttcttgaaagtggattgaaggttaaggaatacgagctcttgaggagaaacttcagtgatactggatgttttggattcggtattcaggagcatattgatcttggaattaagtatgatccttcaaccggtatttatggaatggacttctacgttgttttagaacgcccaggataccgtgttggacgtcgtcgtaggtgcaagtcaagagttggtattcaacacagggttactaaggatgatgccatgaagtggttccaggtcaaatacgagggagtcattctcaacaagtctcagaatatcactggttaattggagtcattcacaacaagtcgcagaatattactggttaattggaagggctaggttttgttttcatgctatgtgaaaaaccatgtcacttgttagcttttcatgtaggcaatcaactctgttttttaatttttatggt

SEQ ID NO: 4853 - DNA, 765 bp, Solanum tuberosum
ctcttcagaacggaatccaatggcgtcagagaagaaattgagcaacccaatgagggatatcaaggttcagaagctagtcctcaacatctctgtcggtgagagcggagataggcttaccagggcggccaaggtcttggagcaactaagcggtcaatcccctgttttctccaaagctaggtatactgtgcgatccttcggaatcaggcgtaatgagaagatagcttgctatgtcaccgtgagaggagagaaagctatgcagctccttgagagtggattgaaagtcaaggagtacgagttgttgagaagaaacttcagtgaaactggctgctttggttttggtatccaggagcacatcgatcttggaattaagtatgatccttcaaccggtatctacggtatggatttctatgttgtgctagagcgcccaggataccgtgttgctcgtcgtcgtagatgcaagtctcgagttggaattcaacacagggtcacaaaagaggactcaatgaagtggttccaggtcaaatatgaaggtgttatccttaacaaatcttcaaacattcagtaagtttgaaatcccagtgttggatcagtttgtttcctcatcaagtgttatgttttttatccattttgtagaccaacaattactattactctctgaggagttgaaaagttttggtgagttaatgttatttggcatatctggatatgttagtttgttttcatttttggctatgcttttttaatgttttgccatgctttctataa

SEQ ID NO: 4854 - DNA, 1014 bp, Pseudotsuga menziesii
taggtaaagccgtgtagcaggcgagatcgggtttgaggcatagccataagcggcagcagagacggcagtcggcgggaaccagcaaaggagaaatggcagcggagaagaaacttaacaaccccatgcgggaaattaaggtgcagaagttggtgctaaacatatcagttggtgagagtggtgatcgacttactcgagcatccaaggtgttggagcaactgagtggccagactccggtgttttccaaggcaaggtatactgtgaggtcctttggaattaggcgaaatgagaagattgcctgttacgtgacggttagaggagaaaaggctcttcagcttttggagagtggactgaaagtgaaggaatacgagttgcttcgaaggaactttagcgacacagggtgcttcggttttgggattcaggagcacattgatctgggaatcaagtacgatccttcaactggtatttatggtatggacttttttgtagtcctagagcgtcctggttacagagtcggcaggagaaagagagctcaatcccgtgttggcattcagcacagggttaccaaggaagatgccatgaagtggtttcaagttaaatatgaaggagtcatccttaacaagtcacaaaatatttaaacgagcagtcttggtatgtttttttagagtagtcttggtttggtttaatatatgggcgaaacattccatcatgtagccttggcaagagtagtgtcagcttggtgcaccatttctgctgacagcgaaaggaaccaactttctacctcatatagattcatctcatttaaagagattttggagtgctgattaattttacttccgtatttttttgtagtttgtgcttggatcaccttgtttctaaaagttcaagacatgcactcttaattgaacgtgtgcattggattttgaacagagagattattacctatgtgtttaatggatggatgtaatattccttgccgtttatcaaaatttatgtgggtgtgctacccaatggccc

SEQ ID NO: 4855 - DNA, 730 bp, Sesamum indicum
gggtttgcatcatattttccccaaacactctgcagccgcgcctccgcctccaaccaccgtaccgtcatggcgtccgagaagaaattgtcgaatccgatgagagagatcaaggttcagaagctggttctcaatatctccgtcggtgaaagcggtgatcgcctcaccagagctgctaaggtgttggagcaactcagtgggcagactcctgtattctccaaggcgagatacactgtgcgatcctttgggatcaggcgcaatgaaaagattgcctgctatgtcactgtcaggggtgagaaggcaatgcagcttcttgagagtggcttgaaggtcaaggaatatgaattgctgagacgaaacttcagtgagactggctgttttggtttcggtattcaggagcatattgatctgggaataaaatatgatccttcaaccggtatctacggtatggatttctatgttgtattggagcgccctggttatcgtgtgggtcgtcgccgaaggtgcaagtcccgtgttggaattcagcacagagtcactaaggaggactccatgaagtggttccaggtgaagtatgaaggtgttattctgaacaaggcatccaacattggagcttcttaggttccctatgctctgtgtcctttcatccgtccgtctaaatttttgctcaaagttttgtagaattattggtttgtcagaagcgacgattttgttttcttacatcttcagcagg

SEQ ID NO: 4856 - DNA, 948 bp, Solanum phureja
caccatcttcttcgtgcctcaggttcagtactcttcaacactccctgctgctgcaatttcgtccagcaatggcttcagagaagaaattgagtaaccctatgagggacattaaggttcagaagcttgttctcaatatctccgtcggtgagagtggagatcgactcaccagagcagcaaaggtcttggagcaacttagcggccaatcacctgttttctccaaggcaaggtatactgtgcggtcctttggaatcaggcgtaatgaaaagatagcttgctacgtgactgtcagaggggagaaagccatgcagctacttgagagtggattgaaggttaaggaatacgagttgctgagaaggaacttcagtgaaaccggctgctttgggtttggtattcaggagcacattgatcttggaattaagtatgacccttcaactggtatttatggtatggatttctatgttgtcttggagcgtcctggataccgtgttgctcgtcgccgcaggtgcaagtctcgtgtcgggatccagcacagggtcacaaaggaagattcaatgaagtggttccaggtcaaatatgaaggtgttatccttaacaagtccgcaaacattcagtgataagctgagaaccagcttagcaagtttatgcattgtgtagactgatatctatattatccattcctagaggaaagttttggtgcgttactgttagttggtgtatgagggaggatgtgttagttcccatttggctatcaatgaactctaaatctttttcttttgttgaaaaatcatagtagaaccagtgatctagtattacgaaagacgttatgaatacctaattggtttccaattgtggtaatgaatggtgttgtttaaacatttttatcaaattggatttggggtgttggatgtttcatgtttggcatggagtgcaattatgcaacctaatata

SEQ ID NO: 4857 - DNA, 783 bp, Solanum phureja
tcactcttctcttcttcctctctgtgtgtgtgaaccctaaactcctgccgccatggcttcagagaagaaattgagcaatccaatgagggatatcaaagtccagaagctcgtactcaacatctccgttggtgaaagtggagatcgtctcactagagccgcaaaggtattggagcaactcagtggccaaagtcctgttttctccaaagcaaggtatactgtccgatcctttggaatcagacgtaatgaaaagattgcctgttacgtcactgtcagaggagaaaaagctatgcaactccttgagagtggattgaaggtcaaggagtatgagttgttgaggaggaacttcagtgaaactggatgctttggatttggtattcaggagcacattgatcttggaatcaagtatgatccttcaactggtatctacggtatggatttctatgttgtcctggaacgcccaggataccgtgttgccagacgtcgtaggtgcaagtctcgggttgggatccaacacagggtcacaaaggaggactcaatgaagtggttccaggtcaaatatgaaggtgttatccttaacaagtccgcaaacatccagtaagccgagagccgactgcggatcagtttatctgatagcaagtttatgtttatgcattttgtagaccaacatctaattactcctagagttgaatagttttcaagagttgctgttatttggcacagtatgcttgttttcattttggtttatgagacccaattcaatcttaatatatcctttttatgtta

SEQ ID NO: 4858 - DNA, 857 bp, Solanum phureja
ccctacttcgccgcttcttcatcttcttctgcaggaaaaaaaaagctcttcagaacggaatccaatggcgtcagagaagaaattgagcaacccaatgagggatatcaaggttcagaagctagtcctcaacatctctgtcggtgagagcggagataggcttaccagggcggccaaggtcttggagcaactaagcggtcaatcccctgttttctccaaagctaggtatactgtgcgatccttcggaatcaggcgtaatgagaagatagcttgctatgtcaccgtgagaggagagaaagctatgcagctccttgagagtggattgaaagtcaaggagtacgagttgttgagaagaaacttcagtgaaactggctgctttggttttggtatccaggagcacatcgatcttggaattaagtacgatccttcaaccggtatctacggtatggatttctatgttgtgctagagcgcccaggataccgtgttgctcgtcgtcgtagatgcaagtctcgagttggaattcaacacagggtcacaaaagaggactcaatgaagtggttccaggtcaaatatgaaggtgttatccttaacaaatcttcaaacattcagtaagttggaaatcccagtgttggatcagtttgtttcctcatcaagtgttatgttttttatccattttgtagaccaacaattactattactctctgaggagtttaaaagttttggtgagttaaaatgttaatttggcatatttggatgttagtttgttttcatttttggctatgtttttttaatgttttgccatgctttctataatattttgttgcgacttctttacttgcgctaatctttttacttgtgt

SEQ ID NO: 4859 - DNA, 1004 bp, Picea glauca
aggaagtttaggttagggtgtgtttcagcaggcgtgttcgggtttgaggcagaggcggttgcagaaagagcagtcggcgggaaccagcgaaggagaaatggcagcggagaagaaactgaacaaccccatgcgggatattaaggtgcagaagttagtgctcaacatatcagtcggtgagagtggtgatcgactcactcgagcttctaaggtgttggagcagcttagtggccagactccggttttttcgaaggcaaggtatactgtgaggtcctttggaattaggcgaaatgaaaagattgcctgctacgttactgttagaggagaaaaggctcttcaacttttggagagtgggctgaaagtgaaagaatacgagttgctccgaaggaactttagcgacacagggtgctttggttttgggattcaggagcacattgatctgggaatcaagtatgatccttcaactggtatttatggtatggacttctttgtagtcctagagcgccctggatacagagtcggcaggagaaagagagcccaatcccgtgttggcattcagcacagggttaccaaggaagattctatgaagtggttccaagttaaatatgaaggagtcatccttaacaagtcacaaaatatttgaatgagaagttttggtatgttccttaataagaagtagtcttggcttggtttgccacttctgttgatacctaaaggaaggaattttttcccggttataggttcacatttgtcttttgaagagattttggaagggcggattatttttatttgcaggaaactattgtactttttttatagtgtttagatcatttgttggtgcgaagttcaaggccatgcttccttgttaagtacaaggacatgttctctgatttgaaaatttgttgtcaattctcaaatggaagagattaatatcaatgttggatttgaactaaaatagagtaatacatgattttaatggatggatgtaactttccattccatttgtt

SEQ ID NO: 4860 - DNA, 749 bp, Euphorbia esula
  misc_feature (308)..(308): n is a, c, g, or t
cagcaatggcgtcggagaggaagctatcgaaccctatgagagagatcaaagttcagaagctcgttctcaacatttccgtcggcgagagcggcgatcgtctcacccgtgcatccaaggtgttagagcaactcagtggccaaacaccagtgttctctaaagctagatacactgttaggtctttcggaatcaggcgtaatgagaagattgcttgctatgtgactgttaggggagataaggcaatgcagctgctagagagtggtttgaaggtgaaggagtatgaacttctgaggaggaacttcagtgatacnggttgctttggatttggtatccaggagcacattgatcttggaatcaagtatgatccatctaccggtatctatggtatggacttctttgttgtactggaacgacccggatatagagtgggccgccgcaggagatgcaagtcccgtgttggaattcaccagagggtcactaaggaggatgccatgaagtggtttcaggtgaaatatgaaggtgttatccttaataaggcacaaaatattggtgcttagtttcgttatatttaagttgcggtgagttatatgtctaggacttcactttttacatttttggagttcagaaattttgttgaagtcttgaatttaagtactttaacgttggattacattttagttatgcctctttatttctgtattgctatcgttgcgtgatttattttaagatttatatacttaacctttagtccc

SEQ ID NO: 4861 - DNA, 759 bp, Helianthus annuus
cagcagccgttatcgttctccgcagcaatggcttcagagaggaagcaagcgaatccaatgagggagatcaaggttcagaaactcgttctcaacatctccgtcggtgagagtggagatcgtcttactcgtgctgctaaggttttggagcaattgagtggccagtcccctgttttttccaaggcaaggtacactgtgaggtcatttggaatcaggcgtaatgaaaagattgcatgctatgtaaccgttaggggtgacaaagcaatgcagcttctggagagcgggttgaaggtcaaagaatacgagctgctgagacgcaactttagtgacactggctgctttggattcggtattcaagaacacattgatctgggtatcaagtatgatccatccaccggtatctacggtatggactttttcgtggttctagaacgcccggggtaccgtgttggccgtagacgcaggtgcaaggctcgtgttggtatccagcacagagttacaaaggaagatgcaatgaagtggtttcaggtgaaatatgaaggagtaattctcaacaagtctcaacaaattggagcttagtttgaggtgacttttaactttgttctctttccagatattatatttctatttctttgtcatttatgcctttgaattctaccagttttattacaatatgggattttctcagttttatgacaagatgttatttagcatcttttttgacacatgttgtgattccttcaagggaagttattattactt

SEQ ID NO: 4862 - DNA, 834 bp, Helianthus annuus
ggctagtgaataggtagtttgtgtactttttgatgtggcaagaagggtaaatacgtcattgtagttcttccattgaacaaaaccctatctatatattttccaacaaaacccccgttcttgtttcgccaccgccgtaaccgtccgcggcagcagcaatggcttcagaaagaaaacaagcaaacccaatgagagagatcaaggttcagaaactcgtccttaacatctccgttggtgagagcggcgatcgtctcactcgagctgccaaggttttggagcaattgagtggccaatctcctgtgttttcaaaggctaggtacaccgtgagatcatttggcatcaggcgtaacgagaaaattgcttgctacgtaaccgttaggggcgacaaagcaatgcaacttctggaaagcgggttgaaggtcaaagaatacgagttgttgagacgcaactttagtgacacaggctgctttggatttggtatccaggaacatattgatttgggtatcaaatatgatccttctactggtatctatggtatggactttttcgtggttttggaacgccctggttaccgtgtgggtcgtagacgcaggtgcaaggcgcgtgttggtattcaacatagagttacaaaggaagatgcaatgaagtggtttcaggtgaaatatgaaggagtaattctcaacaagtctcaacaaattggagcttagtttgaggtgacttttaactttgttctctttccggatattatatttctatttctttgtcatttatgcctttgaattctaccagttttattacaatatgggattttctcagttttatgacaagatgttattt

SEQ ID NO: 4863 - DNA, 854 bp, Helianthus annuus
cccaaacaaaaccctagcaaccgtttaacaacaaacctctacggccttgcatctttctgcaatctgcggattcacaatggcttcagagaggaaacaggcgaacccaatgagggaaatcaaggttcagaaactcgttctcaacatttctgtcggagaaagcggtgatcgtctcactcgtgctgctaaggttttggagcaactcagtggccagtctcctgtcttttcaaaggcaaggtacactgtgaggtcttttggtatcaggcgtaacgagaagatcgcgtgttatgtcactgttagaggagacaaggctatgcagcttctggagagtggtttgaaggtgaaggaatatgagttgttgaggcgcaactttagtgacacgggatgctttgggtttggtattcaggagcacattgatcttggtatcaagtatgacccatctacgggtatctatggtatggatttctttgtggttctagaacgccctggttaccgtgtggggcgtcgccgccggtgcaaggctcgtgtcggtattcaacacagggtcaccaaggaggatgctatgaagtggtttcaagtgaaatatgagggtgtcatccttaacaagtcccaacaaattggatcttaacttgcttgttttgtataattttctacttgagggtttaacggttttaccagcaaggatatttggtagatttatgttttgaacccttttggattccagtaccgtattatggagaatgttttcttttaactagcatgcatatagttatgcatttgaaaatgttttaaattgttactttgattcagtcaaaacaaatctgacatgagaaaaattcaggtcatatttaacagcc

SEQ ID NO: 4864 - DNA, 857 bp, Helianthus annuus
tcgccctcattttgctccgccgtcagccaccgtaatcctccgcatcgtcaatggcttcagaacggaagcaagcgaatccgatgagggagattaaggttcagaaactggttctcaacatctccgtcggtgaaagtggtgatcgtcttactcgtgctgctaaggttttggagcaattgagtggccaatctcctgtgttttccaaggcaaggtacacggtgagatctttcggtatcaggcgtaacgaaaagattgcgtgctatgtcactgttaggggagacaaggcaatgcagctcttggaaagtggcttgaaagtcaaggaatacgagcttttgagacgcaacttcagtgacaccggttgctttggttttggtattcaggaacacattgatcttggtatcaagtatgacccgtcaactggtatctatggtatggacttctttgtggttctagagaggccagggtaccgtgtgggccgcagacgtaggtgcaaggcccgtgttggcattcagcatagagttacaaaggaggatgcaatgaagtggttccaggtgaagtatgaaggagttatcctcaacaaatcccaacaaatcggagcatagaaaaacttatatttactgtaagtttcgttgggtggttaattgtcactcggctcgtattaatccatttttgtcttttggttctattttcgactagtaatcgccaatcgggttatattatcttgttacaatagttgtttttaggatggaaatcatggaaacgcctttgtttttctcaaatgctttcttattaccatgtttgaaaaatgctattttgattatacttggctcaagtgagatttttctctgcgggtcgggtat

SEQ ID NO: 4865 - DNA, 792 bp, Helianthus annuus
ccgtttctccactctgctcatccaacaatggcctcagagaggaagcaggcgaacccaatgcgggaaatcaaggttcagaagctcgttctcaacatctcagtcggagaaagcggcgatcgtctcactcgtgctgctaaggttttggagcaattgagcggccaatctcctgtcttctcaaaagcaaggtatactgtgaggtcttttggtatcaggcgtaatgagaagattgcatgctatgttaccgttagaggagataaggccatgcagctcttggagagcggtttgaaggtgaaagagtacgagttgctgaggcgcaatttcagcgacacgggatgctttgggtttggtattcaagaacacatcgatcttggaatcaagtatgatccttcaacgggtatctacggtatggatttctttgtagttctagaacggcctggttaccgtgttggccgtcgccgccgatgcaaggcccgtgttgggattcaacatcgggtgaccaaggaggatgcgatgaaatggtttcaagtgaaatacgagggtgttattcttaacaaatctcaacaaatcggagcttagatgtgttttcattttgtaaaattttggacttgagttttataatttttaccattaaggatcttatcagtgtttggtgtgatttggatcttcttgagcatatgtattttaagtttttatttatcttgttaagcttaagcatgcatgaaaatgtgatttgaactttaaaaaatgttttaggttcttttcgagcatctaatttacaactttgttttcctg

SEQ ID NO: 4866 - DNA, 790 bp, Helianthus annuus
agcaatggcttcagagaggaagcaagcgaatccaatgagggagatcaaggttcagaaactcgttctcaacatctccgtcggtgagagtggagatcgtctcactcgtgctgctaaggttttggagcaattgagtggccagtcccctgttttttccaaggcaaggtacactgtgaggtcatttggaatcaggcgtaatgaaaagattgcatgctatgtaaccgttaggggtgacaaagcaatgcaacttctggagagcgggttgaaggtcaaagaatacgagctgctgagacgcaactttagtgacactggctgctttggattcggtattcaagaacacattgatctgggtatcaagtatgatccatccaccggtatctacggtatggactttttcgtggttctagaacgcccggggtaccgtgttggccgtagacgcaggtgcaaggctcgtgttggtatccagcacagagttacaaaggaagatgcaatgaagtggtttcaggtgaaatatgaaggagtaattctcaacaagtctcaacaaattggagcttagtttgaggtgacttttaactttgttctctttccagatattatatttctatttctttgtcatttatgcctttgaattctaccagttttattacaatatggaattttctcagttttatgacaagatgttatttagcatcttttttgacacatgtcgcgaacccttcaaaggaagttattattaccttccggctttgagcatcggtgagtaaacaaataatacatatacaggggcttggac

SEQ ID NO: 4867 - DNA, 963 bp, Nicotiana tabacum
ggtttagggttttcttttttggatcttcttcgcgccatcagtagtaccgtacaactctccctgcagctgcaacatcttccagcagaaacgccatggcttcagagaagaaactgagcaatcccatgagggaaatcaaggttcagaagcttgtcctcaacatctccgttggtgagagtggagatcgactcaccagagctgcaaaggtgttggagcaacttagtggtcaatcacctgttttctccaaggcaaggtacactgtgaggtccttcggaatcaggcgtaatgaaaagatagcttgctatgtgactgtcagaggggaaaaagctatgcagctacttgagagtggattgaaagttaaggaatatgaattgttgagaaggaacttcagtgaaaccggctgttttgggtttggtattcaggagcacattgatcttggaatcaaatatgacccttcaactggtatttatggtatggatttctacgttgtattggagcgccctggataccgtgttgctcgtcgtcgtaggtgcaagtctcgagttgggatccagcacagggtcacaaaggaggacgcaatgaagtggttccaggttaaatatgaaggtgttattcttaacaagtcctcaaacattcagtgataagctgagagccggcttcttgatcagtttgtctcctagcaagtttatgtttatgtattttgtagacagacatctacattactcctagaggaaagttttggaaagtttttattagttggtgtacgaggatgtgttagttctcattttggcatcagatgaattcaatccatttttgtggtcatgttcttttgttgcaatctaccagtatgttattagtgttttactgtaactggtctttaactatgctggatctagagattctgatcgtgtgctgatgaagcagttacttgacagctgcatctggagacggtgttggagatggttt

SEQ ID NO: 4868 - DNA, 859 bp, Nicotiana tabacum
  misc_feature (780)..(780): n is a, c, g, or t
  misc_feature (854)..(854): n is a, c, g, or t
gaccgccatctcagtacccaacaactctccctgctactgctgctgtaacatcttccagcggaagcgccatggcttcagagaagaaattgagcaaccccatgagagaaattaaggtccagaagctcgtcctcaacatatccgtcggtgagagcggagatcgtctcaccagagcagctaaggtcttggagcagctcagcggccaatcccctgttttctccaaggcaaggtatactgtgcggtctttcggaatcaggcgtaatgaaaagatagcttgctatgtaactgtcagaggggagaaagctatgcagctacttgagagtggattgaaagttaaggaatatgagttgttgagaaggaacttcagtgagaccggctgctttgggtttggtattcaggagcacattgatcttggaattaaatatgatccttcaactggtatttatggcatggacttctatgttgtattggagcgtcctggataccgtgttgcccgtcgccgcaggtgcaagtctcgagttgggattcagcacagagtcacaaaggaggatgccatgaagtggttccaggtcaaatatgaaggagttatccttaacaagtcctcaaacattcagtgataagcttataaagccaacttctggatcagtctgtctcctctcaagtttatgtttatgtattttgtagacctgcatctatatcactcgtagaggaaagttttggagagtttctagtagtggcgtatgaggatgttttagttctcattttggctatcagatcaattcnatctttttttggtcattttcttttgttccaattaaatcagaatcattcaactccacaatctagtacaatagacnctttg

SEQ ID NO: 4869 - DNA, 910 bp, Solanum lycopersicum
gtttattacgacaatttccgccctctcagagtctcagtaccccttcaactctgctgccgcagctgaaacatcttcccgtggaagcgccatggcttcagagaagaaattgagcaatcccatgagggatatcaaggtccagaagcttgtcctcaatatctccgtcggtgagagtggagatcgactcaccagagcagcgaaagtcttggagcaactcagcggtcaatcccctgttttctctaaggcaaggtatactgtgcggtcctttggaatcaggcgtaatgaaaagatagcttgctatgtgactgtcagaggggagaaagctatgcagcttcttgagagtggattgaaagttaaggaatacgagttgttgagaaggaacttcagtgagaccggctgctttgggtttggtattcaggagcacattgatcttggaattaaatatgatccttcaactggtatttatggaatggatttctatgttgtattggagcgccctggctaccgtgttgcccgtcgtcgcaggtgcaagtctcgagtcgggattcagcacagggtcactaaggaggattcaatgaagtggttccaggtcaaatatgaaggtgttatccttaacaagtcctcaaacattcagtgataagctgagtgccaacttttggatcagcttgtctcctggcaagtttatttttatgtatttttgtagacagccatcgatattactattaaaggaatgttttggagagattctagttggcaaattagtatgttttacttctcattttggcaatcagatgaattcaaatctttgtgatggtcattttcagttgttgcaatttaagtaggaattattcaactacacaattgtgttactgcaatgcttaagcgtttcaagtaaatcaggtttggggctgga

SEQ ID NO: 4870 - DNA, 1044 bp, Solanum lycopersicum
cccgactccagctacggcccatatgtcgtaccatttataaagtaaactacgattagggtttattacgacaatttccgccctctcagagtctcagtaccccttcaactctgctgccgcagctgaaacatcttcccgcagaagcgccatggcttcagagaagaaattgagcaatcccatgagggatatcaaggtccagaagcttgtcctcaatatctccgtcggtgagagtggagatcgactcaccagagcagcgaaagtcttggagcaactcagcggtcaatcccctgttttctctaaggcaaggtatactgtgcggtcctttggaatcaggcgtaatgaaaagatagcttgctatgtgactgtcagaggggagaaagctatgcagcttcttgagagtggattgaaagttaaggaatacgagttgttgagaaggaacttcagtgagaccggctgctttgggtttggtattcaggagcacattgatcttggaattaaatatgatccttcaactggtatttatggaatggatttctatgttgtattggagcgccctggctaccgtgttgcccgtcgtcgcaggtgcaagtctcgagtcgggattcagcacagggtcactaaggaggattcaatgaagtggttccaggtcaaatatgaaggtgttatccttaacaagtcctcaaacattcagtgataagctgagtgccaacttttggatcagcttgtctcctggcaagtttatttttatgtatttttgtagacagccatcgatattactattaaaggaatgttttggagagattctagttggcaaattagtatgttttacttctcattttggcaatcagatgaattcaaatctttgtgatggtaattttcagtttttgcaatttaagtaggaattattcaactacacaattgtgttactgcaatgcttaagcgtttcaagtaaatcaggtttggggctggatgtttggcatagaatgcatacaagtacatcattggtgtttgcgtttagtctctcctctttctctaaacatcttgtca

SEQ ID NO: 4871 - DNA, 937 bp, Solanum lycopersicum
cattaggctcagtattcttcaactcacttgctgctgctgctgcaatttcgtccagcaatggcttcagagaagaaattgagcaaccccatgagggacatcaaggttcagaagcttgtcctcaatatctccgtcggtgagagtggagatcggcttacaagagcagcaaaggtcttggagcaacttagcggccaatcacctgttttctccaaagcaaggtatactgtgcggtcctttggtatcaggcgtaatgaaaaaatagcttgctacgtgactgtcagaggtgagaaagctatgcagctgcttgagagtggactgaaagttaaggaatatgagttgttgagaaggaacttcagtgaaaccggctgctttgggtttggtattcaggagcacattgatcttggaattaagtatgacccttcaactggtatttatggtatggatttctatgttgtcttggagcgtcctggataccgtgttgctcgtcgccgcaggtgcaagtctcgtgtcgggatccagcacagggtcacaaaggaggattcaatgaagtggttccaggtcaaatatgaaggtgttatccttaacaagtcctcaaacattcagtgataagttgagaaccagcttagcaagtttatgcattttgtagactgatatctatatcactcctagagggaagttttggggaatttctattagttggtgtatgagggaggatgtgttagttcccattttgtctatcagatgaactcaaatctttttttttttttgttgcaatcatagtagaaccatcaatctagtatcacaagagatgttatgaatacctaattggtttcaattgtggtgatgaatggtgttgttttcaacattttttttcaaattgtatttgggtgttggatgttccatctttggcatgaagtgcaattatgcaacccaatatact

SEQ ID NO: 4872 - DNA, 925 bp, Solanum lycopersicum
atcttcttcattaggctcagtattcttcaactcacttgctgctgctgctgcaatttcgtccagcaatggcttcagagaagaaattgagcaaccccatgagggacatcaaggttcagaagcttgtcctcaatatctccgtcggtgagagtggagatcggcttacaagagcagcaaaggtcttggagcaacttagcggccaatcacctgttttctccaaagcaaggtatactgtgcggtcctttggtatcaggcgtaatgaaaaaatagcttgctacgtgactgtcagaggtgagaaagctatgcagctgcttgagagtggactgaaagttaaggaatatgagttgttgagaaggaacttcagtgaaaccggctgctttgggtttggtattcaggagcacattgatcttggaattaagtatgacccttcaactggtatttatggtatggatttctatgttgtcttggagcgtcctggataccgtgttgctcgtcgccgcaggtgcaagtctcgtgtcgggatccagcacagggtcacaaaggaggattcaatgaagtggttccaggtcaaatatgaaggtgttatccttaacaagtcctcaaacattcagtgataagttgagaaccagcttagcaagtttatgcattttgtagactgatatctatatcactcctagagggaagttttggggaatttctattagttggtgtatgagggaggatgtgttagttcccattttgtctatcagatgaactcaaatctttttttttttgtgttgcaatcatagtagaaccattaatctagcatcacaagagatgttacgaatacctaattggtttcaattgtggtgatgaatggtgttgttttcaacattttttttcaaattgtatttgggtgttggatgttccatctttggcatgaagtgca

SEQ ID NO: 4873 - DNA, 805 bp, Solanum lycopersicum
atcaaactagggtttctctcactcttctcttcttcatctctctgtgtgtgaaccctaaactccggccgccatggcttcagagaagaaattgagcaatccaatgagggatatcaaagtccagaagctcgtactcaatatctccgttggtgaaagtggagatcgtctcaccagagctgcaaaggtattggagcaactcagtggccaaagtcctgttttctccaaagctaggtatactgtccgttcctttggaatcagacgtaatgaaaagatcgcctgttacgtcactgtcagaggggaaaaagctatgcagctccttgagagtggattgaaggtcaaggagtatgagttgttgagaaggaacttcagtgaaactggatgctttggatttggtattcaggagcacattgatcttggaatcaagtatgatccttcaactggtatctatggtatggatttctatgttgtcctggaacgcccaggataccgtgttgctagacgtcgtaggtgcaagtctcgggttgggatccaacacagggtcacaaaggaggactcaatgaagtggtttcaggtcaaatatgaaggtgttatccttaacaagtcctcaaacatccagtaagtcgagagccgactgctggatcagtttatctgatagcaagttttatgtttatgcattttgtagaccgaagtctagttacttctagaattgaatagttttcaagagttgctgttatttggcacagtatgcttgttttcatttttggtttatgagaccaattcaatctttaatataatcctttttgtgtta

SEQ ID NO: 4874 - DNA, 878 bp, Solanum lycopersicum
ctctcactcttctcttcttcctctctctgtgtgtgaaccctaaactcctgccgccatggcttcagagaagaaattgagcaatccaatgagggatatcaaagtccagaagctcgtactcaatatctccgttggtgaaagtggagatcgtctcaccagagctgcaaaggtattggagcaactcagtggccaaagtcctgttttctccaaagctaggtatactgtccgttcctttggaatcagacgtaatgaaaagattgcctgttacgtcactgtcagaggggaaaaagctatgcagctccttgagagtggattgaaggtcaaggagtatgagttgttgagaaggaacttcagtgaaactggatgctttggatttggtattcaggagcacattgatcttggaatcaagtatgatccttcaactggtatctatggtatggatttctatgttgtcctggaacgcccaggataccgtgttgctagacgtcgtaggtgcaagtctcgggttgggatccaacacagggtcacaaaggaggactcaatgaagtggtttcaggtcaaatatgaaggtgttatccttaacaagtcctcaaacatccagtaagtcgagagccgactgctggatcagtttatctgatagcaagttttttgtttatgcattttgtagaccgaagtctagttacttctagaattgaatagttttcaagagttgctgttatttggcacagtatgcttgttttcatttttggtttatgagaccaattcaatctttaatataatcctttttgtgttagtttcctgttgtgcaattctataagaagcagaaaacatcagtttttctcaagtctgaactaatcaaactaataaaaatattatagttg

SEQ ID NO: 4875 - DNA, 747 bp, Solanum lycopersicum
ccctaattcgccgcttcttcatcttcttctgcagaaaaaaaaagctcttcagaacagaatccaatggcgtcagagaagaaattgagcaacccaatgagggatatcaaggttcagaagctagtcctcaacatctctgtcggtgagagcggagatagacttaccagagcggccaaggttttggagcaactaagcggtcaatcccctgttttctccaaagctaggtatactgtgcgatccttcggaatcaggcgtaatgagaagatagcttgctatgtcaccgtgagaggagagaaggctatgcagctccttgagagtggattgaaagtcaaggaatacgagttgttgagaagaaacttcagtgagactggctgctttggttttggtatccaggagcacatcgatcttggaattaagtatgatccttcaaccggtatctacggtatggatttctatgttgttctagagcgcccaggataccgtgttgctcgtcgtcgtaggtgcaagtctcgagttggaattcaacacagggtcacaaaagaggactcaatgaagtggttccaggtcaaatatgaaggtgttatccttaacaaatcttcaaacattcagtaagttggaatttccaggttggatcagtttgtttccccagcaagtgttatgttttttacccattttgtagaccaacaattattactattactctttgaggagttgaaaagttttggtgaattaatgttatttggcatatct

SEQ ID NO: 4876 - DNA, 887 bp, Solanum lycopersicum
ttcgccgcttcttcatcttcttctgcagaaaaaaaaagctcttcagaacagaatccaatggcgtcagagaagaaattgagcaacccaatgagggatatcaaggttcagaagctagtcctcaacatctctgttggtgagagcggagatagacttaccagagcggccaaggttttggagcaactaagcggtcaatcccctgttttctccaaagctaggtatactgtgcgatccttcggaattaggcgtaatgagaagatagcttgctatgtcaccgtgagaggagagaaggctatgcagctccttgagagtggattgaaagtcaaggaatacgagttgttgagaagaaacttcagtgagactggctgctttggttttggtatccaggagcacatcgatcttggaattaagtatgatccttcaaccggtatctacggtatggatttctatgttgttctagagcgcccaggataccgtgttgctcgtcgtcgtaggtgcaagtctcgagttggaattcaacacagggtcacaaaagaggactcaatgaagtggttccaggtcaaatatgaaggtgttatccttaacaaatcttcaaacattcagtaagttggaatttccagtgttggatcagtttgtttccccaacaagtgttatgttttttacccattttgtagaccaacaattattactattactctttgaggagttgaaaagttttggtgaattaatgttatttggcatatctggatatgttagtttgttttcatttgttttgccatgctttctataatattttgttaagacttctttacttgtgctaatttttttacttgtgtcggggagtatccgatacaacctctatgtaagattatacaaagttaacttttgga

SEQ ID NO: 4877 - DNA, 841 bp, Tripterygium wilfordii
cactcccaagcggccccagcagcttagcagcccttcaatcagcattaattcccatggcatcggagaagaagctttcgaacccaatgagggagatcagggtccaaaagttggtcctgaatatctcagttggtgaaagtggagatcgcctcaccagagcagccaaggtgctagaacaactcagtggccagtcaccggtcttctccaaggcaaggtacactgtccgctcctttgggatcaggcgtaatgagaaaattgcttgctatgttactgtgaggggtgaaaaggcaatgcaactgctggagagcgggttgaaggttaaggaatacgagttgctgcgtagaaactttagtgatactggctgctttggctttggtattcaggagcacattgatcttggaatcaaatacgatccttctactggaatttatggaatggacttctacatagttcttgaacgcccaggataccgtgtaggccgtcgccataggtgcaagtctcgtgttgggattcaacatcgggtgacaaaggaggactccatgaaatggtttcaggtgaaatatgaaggtgtcatccttaacaagtctaacgcaatcacaaattaagagccccaagcaagaagtaactccgcttttttgtatgtttgtgttgtccatttatctttcattcccaattccaaaattttggcaatccttcgtctgactgatattttgagttgagtaagatctgtttcctgtttcaaatttctgatagcaatatccgtttcttcgtaattgatgaagctgtctgtggtattcaacaatttgaggtttctttcatcaacctggacttgtttggtgcactt

SEQ ID NO: 4878 - DNA, 799 bp, Valeriana officinalis
cattaataggttttcacaacacctttctctctttcccaccttcctttgcagccgctgcgtctataagccgaccgccatggcttcagagaaaaagttagccaaccccatgagggagatcaaagtccagaagcttgtactcaatatctccgtcggtgagagtggagatcgactcaccagagccgctaaggtgttggaacaactcagtggtcaaactccagtgttctccaaagctaggtatactgtgaggtcattcggaattaggcgtaatgagaagattgcttgttacgtaacagtaagaggtgacaaggcaatgcaacttttggagagtggattgaaggttaaggaatacgaattgctgaagaagaatttcagcgacactggctgctttggatttggtattcaggaacatatcgatcttggaatcaagtatgatccgtcgactggaatctatggaatggatttctttgtggttttggagcgcccgggttaccgcgtgggacgtcgccgtagatgcaaggctcgcgttggaatccaacacagagtcaccaaggatgacgccatgaagtggtttcaagtgaagtatgagggagttattctcaataaatcccagaacatcacaggctaaatcttattgcggtctttttgttttgcaacttttgttagttttgtgttttcatctctataaagaccttgtttcaagcctttattcaaagttttggatacttctctatcagactggaacagagttgaactaaatatctgtaattttttttgagaggttttaatttgattagttatg

SEQ ID NO: 4879 - DNA, 764 bp, Vinca minor
actctcacacctccacagccgccacaatcgccgcagccatggcttcagaaaagaagttgaacaacccaatgagagaaatcaaggttcagaagcttgttcttaacatttctgttggtgagagcggcgatcgtctcactcgtgctgctaaggtgttggaacaactcagtggtcaatctcctgtcttctctaaggctagatacacggtccggtcatttggaatcaggcgtaatgagaagattgcctgctatgttactgttagaggtgacaaggcaatgcaacttttggagagtggtctaaaagttaaagagtacgaattgctaaggagaaacttcagcgacactggatgctttggttttggtattcaagagcacatcgatcttggaatcaagtatgatccttctactggtatttatggaatggacttctatgttgttctagagcgcccaggttaccgtgtaggtcgtcgcagaaggtgcaagtctcgtgttggaatccaccagagggttacaaaggatgacgcaatgaagtggttccaggtcaaatatgagggtgtgatcctcaacaagtctcaagcaattacaaattagaagtctgatgtttctagcttaccagtagctttaaaatattattagctttacttctacgtctttgcttatggttttctagaccctattttgcaatttttgctttcctcttgggaattgaaagtgccaacatctgtttagcaaaaactgcttctccttaacctgctcttggtagctttc

SEQ ID NO: 4880 - DNA, 959 bp, Glycine max
ttattcaacttcctctcgtccccatactagtgtccttcactctgccgcggcagaaaacactcaactcgcgttccagtttctctctgcgcgggtttctgctccactccgtcacaaatggcctccgaaaagaaactggcgaacccaatgcgagaaatcaaagtccagaaactcgtcctcaacatctccgtcggcgagagcggggatcgtctcacccgcgccgccaaggtgctcgaacaactcagtggccaaacccctgttttctccaaaggtacactgtgcgttcgtttgggattaggaggaacgagaagatcgcgtgtcatgtgacagtgagaggggacaaggcgatgcagcttctggagagtggcttgaaggtgaaggagtatgaattgctcaggaggaacttcagcgacaccggctgcttcggatttggcattcaggagcacattgatttgggaatcaagtatgatccttcgactggcatttacggaatggatttctttgtcgttctggagcgccctggctaccgtgtgggacgacgctgtcggtgcaaggctcgtgttagaattcagcatcgtgtcacgaaggaggatgccatgaagtggttccaagttaaatacgaaggtgtcatcctaaacaagtcccaagcactcgtttaaatcagaccattcttaagcgcaacttcctagctctgtttatcatagtttgatgcttcttttcttgaattattgcggatactacttttacaggtcacttgagctgtttcttgacaatttattttaatatcatgaaattttgtcatcgatatcactgagtcgaatgctctacatgtatttctggtgtttatctactttctacttgcgtgaaattgaattacatggacaatatagttcaacgtttttgcttcgtatgatcaatgtgttagtaagatagttgatgtttgatattttgtagaagaaaat

SEQ ID NO: 4881 - DNA, 807 bp, Arnica chamissonis
acaaccctgcgccgccatactcctccaccacgtcaatggcttcagaaaggaagcaagcgaatccaatgagggagattaaggttcagaaactggttttgaacatctccgtcggtgaaagtggcgatcgtctcactcgcgctgccaaggttttggaacaacttagtggacaatcccctgtgttttccaaggcaaggtacacagtggagatcgtttggtattaggcgtaacgaaaagattgcttgttatgtcacggtcaggggagacaaggcaatgcagctcttggaaagtggcctgaaggtcaaggagtacgagcttttgagacgcaacttcagtgacaccggctgctttggttttggtattcaggagcacattgatcttggtatcaagtatgatccatctactggtatctatggtatggacttctttgtggtgctagaacgcccgggctaccgtgtgggccgcagacgtaggtgcaaggcccgtgttggtatccagcatagagttacaaaggatgatgcaatgaagtggtttcaggttaagtatgaaggagttatcctcaacaaatcccagcagatcggagcgtagaagacacacagtaagttttcttttggcggttaacgtttgatgtggcttcctagaattttattacatccagttttgattttcagactcttgcatttcaactagttttgttgttattctcttgttatagtagttttcattatggaaattactgaacttgttttgcttagtaactttttagcatggaaattattgaagttgttttattgagacatggtgttttga

SEQ ID NO: 4882 - DNA, 4579 bp, Brassica rapa
ttgcaccaacgcatccggcgctgttcttctcccactctctttgctcatctccctcgattttgcatcccttaatcctcagagatggcgtcagagaagaagctctcgaacccaatgagggacatcaaggttcagaagctcgttctcaacatctctgttggtgagagtggtgatcgtctcacccgtgcctccaaggtgttggaacagctcagtggtcaaacacctgtcttctccaaggcgaggtacactgtgaggtctttcggtattaggcgtaatgaaaagattgcgtgctacgtcaccgtgagaggagacaaggcaatgcagcttcttgagagtggtttgaaagtcaaggagtacgagctgttgaggaggaacttcagcgacactggctgtttcggattcggtatccaggagcacattgatcttggtatcaagtatgatccttctactggtatctatggaatggacttctacgttgttcttgagcgtccggggtaccgtgttgcacgtcgccgtaggtgcaagactcgcgttgggattcagcatagagtgacaaaggatgatgccatgaagtggttccaagttaagtacgaaggtgttatcctcaacaagtctcagaacatcactggttgaagagttggtctctttttgttttgtggtgttggctctttttataattctggatgataaggctttgttgttgtggtggtagaatccttaagtaccctcgagatatgaacaattttttggaggttatcgttatcaattttaaactctatctactttaaacaaactccaagccgtatctgttgtttctaatttacatatcagagagaatgtggactgaaaatttaaaatcaggaggatctgagtagctccagaatctcactcttctttagctttgagtatcctttgagtcctttgttctttgcaacttctttgagctctgcaagtttcatagtttcaatcaatggaggtttatcttccttctctgtctcttccatagtgctctttgttattggaagcttacctcttggaccagaagcagatggtctagtaggagatctcttggcaaaactagtcggtggccaagctacttgtctcttaggtggctcttttcttacaccagcatctcctacattttgcagaagtcaattatattgtgcaagaatggatttgtgattcaactcaaacacgtttagattaccttcagttttctctcttggtttctcaagaacgtcaagaatagctttactcagcgactcattcccagaagtcgcgtgtccgttcttctcatcagctccctgagactcctcacctttggagatggaagcttgaatccgtctaaagagagaaatgatctcctcttgtttggctttactctggtctgagctctgttcatctgacggattcttgcaacaaacaacatatcctttcttggatctcctgcttaaagtttctccaggccttgttcttctatcaccatcaaacgctgttcttgaaaaactctgcccaaagctgggcgaaagagaatctgcaaatcagtctaaattcagttaagctgcacaggaaaattgcttctctcagctcctcatgttctctctttaagatagctacaacagctggcattgcaacaactcattatctactgtcgcaagattatgatgttgaatcggttacctcgaacaggaagaagacttgctctcgtgaatccttgtttcattaacgaaggaaaatgaagagccaagtccatagctttagctgagaaatcttcttaagcctattatctcagaccaactttcccgcggtttctcatctcatgagcagagtcagataagacatggcgatgttgtcggcgaatttgtcttcctcaagcttcagtttcgttccctctcgccgctcccaaacccacaaggagaccgcaagcgtcaccagagttcgaaaagattcgatttttaacaaagcatcgttgagaactgcctctatcgaacacagagatcctcctcaaaccttaaccgacgcgaacactcgattacgcagactctgcgaatcaggcgacctagagaacatcgcgaaactcctccgcgtatcccaaaagtacgatatcgacccgagaacgctatgctctgttcttcagctctgcgcagacacgagatcgctcaaacacggcaaagaagtcgattcctttatccgccgcaacggggtcgtcgtcgattccaacatgggttcgaaactcgcgctcatgtacacgaactgcggagatctgagagaagcgagacgagtgttcgatcaggtcaggatcgagaaggctctgttctggaacatcttgatgaacgagcttgctaaagctggtgactttagcgggagtattgagctgttcgagaagatgatgggctctggtgttgagatggatagctatactttctcttgcgtttcgaaaagtttttcgtctttgagaagcgttgacggaggagagcagcttcatgggtatgttctgaagttagggtttggagagtgtagctcggtggggaactctctgttggcgttttacttgaagaatgggagagttgagagcgcgcggaaggtgttcgatgaaatgactgaacgagatgttatttcttggaactctatgataaatggatatgtatcaaccggtttgacggaacaagggttgtatctgtttgtagagatgttatgttcggggattgagtttgatttagctaccgtagttagcgttttcgcaggctgtgctgattcttgtttagtgtctttaggtagagctgtccatggaattgggctgaaagcttgtatgagtagagaagatcggttttgtaatactctgcttgatatgtactcgaaatgcagtgatctagactctgctaaagctgtgtttaccaagatgagtgatagaagtgttgtctcgtatacttccatgattgctggttacgctagggaaggtttggctggtgaagctgtgaagctatttgcagagatggaagaagaaggtattagtcctgatgtttacactgtcactgcggttttaaactgttgtgcacgtaatcggttgttagaggaaggtaagcgagtccatgagtggataaaggagaacgatatggggtttgatatctttttatcgaatgctctgatggacatgtatgccaaatgtggaagcatgggagaggcggagatagtattctctgagatgcctgtgagagatatcatctcgtggaacactatcattggtggctactcaaagaactgttacgccaacgaagctctaagccttttcaatctgctattagaagagaaacggtttgttcctgatgagagaactgtggtgtgtgtgcttccggcttgtgcgagtctctctgcttttgacaaaggcagagagatccacggttacatcatgagaaacgggttcttcagagacaggcacgttgctaactcccttgtggacatgtacgcgaaatgtggagcgttgttgctcgcacgtttgctctttgacgagattgcttccaaggatcttgtctcttggaccgtgatgatagctggatatgggatgcacgggtttggcaaagaagcgatcgctctcttcgatcaaaagagacgagaaggtatagagcctgacgaaatctcattcgtctctgtgctgtacgcttgtagccactcgggactagtggacgaagggtggagattctttaacatcatgaggcacgaatgcaagatcgagccgacgctagaacactacgcttgtgttgtcgacatgctcgcaagaaccggagagttgtcaaaagcttaccggttcatcgagagcatgccgattcctccagacgctacgatatggggagcgttgctgtgtgggtgcaggatacatcacgatgttaagctggcagagagagttgcagagagggtctttgagcttgaacctgagaacacagggtactatgtactgatggcgaatatctacgctgaagctgagaaatgggaagaagtgaagaggctaagaaagaggataggccaacgcgggttgaggaagaatcctggatgcagctggatagagataaaggggagagttaacatctttgtagctggagatagttcacatcctgaaacagaaaacattgaggctcttttgaggagggtaagagctaggatgagagaagaagggtactcgccgcagactaagtacgcgttgatagatgcggaagagatggagaaggaagaagctttgtgtggtcacagtgagaagctagcaatggggttggggatactcacctctggacatggaaagatcataagagttaccaagaatctaagagtgtgtggagattgtcatgaaatggccaagttcatgtctaagttaaccggaagagagattgtcttgagagattcaaatcggtttcatcattttaaagatggacattgttcttgcagaggcttctggtgaaaacttcatgtaataataaattgttcttatttagcccgttgatttaatgattgaaaaactgaagcaatagaacatgaacaggctggatcttttgttggagccatacttgttcatgatggtatcattgcttcaaag

SEQ ID NO: 4883 - DNA, 773 bp, Brassica napus
tagtttaaagcatagagattgtttaaaattgataatgataaacctctaaaaattgttgatatctcgagggtactcagattctaaaccaactgaagttaaaaaaaagatacaaaaaaacaagaaatcccaaggcgatgttctgagacaagagctaacaccacaaaacaaaatagaaacaaactcttcaaccagtgatgttctgagacttgttgaggataacaccttcgtacttcacttggaaccacttcatggcatcatcctttgtgactctatgttgaatcccaacgcgagtcttgcacctacggcgacgagcaacacggtaccccgggcgttcaagaacaacatagaagtccattccatagataccagtggaaggatcgtacttgattccaagatcaatgtgctcctggataccgaacccaaagcagccagtgtcactgaagttcctcctcaggagctcgtactccttcactttcaatccgctctcaagaagctgcatcgccttgtctcccctcacggtgacgtagcaagcaatcttctcgttacgcctgattccgaaagacctcacagtgtacctcgccttggagaagacaggtgtttgaccactgagctgttccaacaccttggaggcacgagtgagacgatcaccactctcaccaacagagatgttgagaacgagcttctggaccttgatgtccctcatagggttcgagagcttcttctctgacgccattttgggattaagggattcaagattgagggtggagatgagc

SEQ ID NO: 4884 - DNA, 585 bp, Euphorbia peplus
agagcccgccttaacccctaaaaatggcttcggagaggaagctatcgaacccaatgagggagatcaaggctgcagaagctcgttctcaacatctccgttggtgaaagcggtgatcgtctcacccgtgccgccaaggtgcttgagcaactaagtggtcagaccccagtcttctcaaaagctagatatactgttagatcttttgggatcagacgtaatgaaaagattgcttgctatgtcactgttaggggtgacaaagctatgcagctgctcgagagcggattgaaggtgaaggagtatgagcttttaagaaggaacttcagtgatactggttgctttggatttggcatacaagagcacattgatcttggaatcaagtatgacccttcaaccggtatctatggtatggatttctatgttgttcttgaacgtccaggttatcgcgtgggtcgtcgcaggagatgcaaatctcgtgttggaattcaccagagggtcacaaaggaggatgcaatgaaatggtttcaagtgaaatatgaaggtgtcatccttaacaaggcccaaaatattggagcttaaggtttctctttg

SEQ ID NO: 4885 - DNA, 1078 bp, Glycine max
ttattcaacttcctctcgtccccatactagtgtccttcactctgccgcggcagaaaacactcaactcgcgttccagtttctctctgcgcgggtttctgctccactccgtcacaaatggcctccgaaaagaaactggcgaacccaatgcgagaaatcaaagtccagaaactcgtcctcaacatctccgtcggcgagagcggggatcgtctcacccgcgccgccaaggtgctcgaacaactcagtggccaaacccctgttttctccaaaggtacactgtgcgttcgtttgggattaggaggaacgagaagatcgcgtgtcatgtgacagtgagaggggacaaggcgatgcagcttctggagagtggcttgaaggtgaaggagtatgaattgctcaggaggaacttcagcgacaccggctgcttcggatttggcattcaggagcacattgatttgggaatcaagtatgatccttcgactggcatttacggaatggatttctttgtcgttctggagcgccctggctaccgtgtgggacgacgctgtcggtgcaaggctcgtgttagaattcagcatcgtgtcacgaaggaggatgccatgaagtggttccaagttaaatacgaaggtgtcatcctaaacaagtcccaagcactcgtttaaatcagaccattcttaagcgcaacttcctagctctgtttatcatagtttgatgcttcttttcttgaattattgcggatactacttttacaggtcacttgagctgtttcttgacaatttattttaatatcatgaaattttgtcatcgatatcactgagtcgaatgctctacatgtatttctggtgtttatctactttctacttgcgtgaaattgaattacatggacaatatagttcaacgtttttgcttcgtatgatcaatgtgttagtaagatagttgatgtttgatattttgtagaagaaaatttgaaggtaaaaaataataactgctattttagttttgtgcatgtgtgtttgcagcagagatttttgaataatgccacatttccatttttctttgattggctactctttatagcagaata

SEQ ID NO: 4886 - DNA, 906 bp, Picea glauca
tgagggttgggcggctgtatcagcagaagcaggcgcaggagtagcagagcatcatccaaaatggcagcggagaagaagctgaacaaccccatgagggaaattaaggtgcagaagttggtgctcaacatatcagttggtgagagtggtgatcgactcactcgagcttcaaaggtgttggagcagcttagtgggcagactccggttttttccaaggcaaggtatactgtgaggtcctttggaattaggcgaaatgaaagattgcctgctacgttactgttagaggagaaaaggctcttcaacttttggagagtgggctgaaagtgaaagaatacgagttgctccgaaggaactttagcgacacagggtgctttggttttgggattcaggagcacattgatctgggaatcaagtatgatccttcaactggtatttatggtatggacttctttgtagtcctagagcgccctggatacagagtcggcaggagaaagagagcccaatcccgtgttggcattcagcacagggttaccaaggaagattctatgaagtggttccaagttaaatatgaaggagtcatccttaacaagtcacaaaatatttgaatgagaagttttggtatggtccttaataagaagtagtcttggcttggtttgccacttctgttgatacctaaaggaaggaatttttcccggttataggttcacatttgtcttttgaagagattttggaagggcggattatttttatttgcaggaaactattgtacttttttatagtgtttagatcatttgttggtgcgaagttcaaggccatgcttccttgttaagtacaaggacatgttctctgatttgaaaatttgttgtcaattctcaaatggaagagattaatatcaatgttggatttgaa

SEQ ID NO: 4887 - DNA, 933 bp, Picea glauca
tgtatttaaatagtcatgttagggttttgaatggttgtgtgagggttgggcggcagtatcagcagaagcaggcgcaggagtagcagagcatcatccaaaatggcagcggagaagaagctgaacaaccccatgagggaaattaaggtgcagaagttggtgctcaacatatcagttggtgagagtggtgatcgactcactcgagcttcaaaggtgttggagcaactcagtgggcagactccagtttttccaaggcaaggtacactgtaaggtcctttggaatcaggcgaaatgaaaagattgcctgctatgttactgttaggggagagaaggctcttcagcttttggagagtgggctgaaagtgaaggaatacgagttactcagaaggaacttcagtgatacaggttgctttggttttggaattcaggagcacattgatctgggaatcaagtatgatccttcaactggtatttatggtatggacttctttgtagtcctagagcgccctggatacagagtcggcaggagaaagagagcccaatcccgtgttggcattcagcacagggttaccaaggaagattctatgaagtggttccaagttaaatatgaaggagtcatccttaacaagtcacaaaatatttgaatgagaagttttggtatgttccttaataagaagtagtcttggcttggtttgccacttctgttgatacctaaaggaaggaattttttcccggttataggttcacatttgtcttttgaagagattttggaagggtggattatttttatttgcaggaaactattgtactttttttatagtgtttagatcatttgttggtgcgaagtttaaggccatgcttccttgttaagtacaaggacatgttctctgatttgaaaatttgttgtcaattctcaaatggaagagattaatatca

SEQ ID NO: 4888 - DNA, 754 bp, Centaurea maculosa
gcaccaaaagctcgatccatattcgtttctgttctaccaccgtttctgcaaatctgttcatccaacaatggcttcagagaggaaacaggcgaatccaatgagggaaatcaaggttcagaagctcgttctcaacatttcggttggagaaagtggagatcgtctcactcgtgctgctaaggttttggagcaactcagtggccaatctccagttttctccaaggcaagatacactgtgaggtcattcgggatcaggcgtaatgaaaagatcgcttgttatgtcaccgttagaggagacaaggctatgcagcttttggagagtggtttgaaggtgaaggagtatgagttgttgaggcgcaatttcagtgacactggatgctttggctttggtatccaggagcacatcgatcttggtatcaagtatgatccttccaccggtatctacggtatggatttctttgtggttttggaacgtcccggttaccgtgttggacgtcgccgtaggtgcaaggctcgtgtcgggatccaacacagagtgaccaaggacgacgccatgaagtggtttcaagtgaagtacgagggtgtcatcctcaacaaatctcaacaaatcggaggctaagtatgtgggtttgtttttgtagaattttggagttgagtttaaaggtttttacttgccatcaaggattatgagatgaaattgttttgttgtgttttggaccatttgaagaatactagtagtaccagtgtttttttaagt

SEQ ID NO: 4889 - DNA, 811 bp, Centaurea maculosa
cgcggggggccttcattttgctcccgctttcacatccctcccgccgccgtcgtcgccgccgtactcctccgcaaccgcaatggcttcagagaggaagcaagcgaatccaatgagggagattaaggttcagaagctcgttctcaacatctccgtcggagaatccggtgatcgtcttactcgcgctgccaaggttttggagcaactcagtggacagtctcctgtcttttccaaggcaaggtacactgtgaggtcgttcgggattaggcgtaatgaaaagattgcatgctatgtcaccgttaggggagacaaggcaatgcagcttttggagagtggtttgaaggtcaaggaatacgagcttttgaggcgtaacttcagtgataccggatgctttggttttggtattcaggagcacatcgatcttggtatcaagtatgatccatccaccggtatctatggtatggacttctttgtcgttctagaacgcccaggataccgtgttggtcgccgccgtaggtgcaaggcccgtgttggtatccaacatagagtgacaaaggatgacgcaatgaaatggttccaggtcaagtatgaaggagttatcctcaacaaatctcaacaaattggaggctagacatctttacggtaagcgttattgggtggtttttaattttgaatcagtatctttgttaggctcaccggagatatttacatccattttgttttccggtctctttgttatagtagcttttaggcaagatatcatggaactttctctgtttttggtcagatgttttctattattattacaagcaga

SEQ ID NO: 4890 - DNA, 983 bp, Echinacea purpurea
gggggaaataagcaaatcccaaataccctcttaattcacattttttcttccaacaaaacaaaaccctagctgatctgatagcgcccttattattccaataaaatcctcatcgtcttctccatcccatccccgcagccgttatcgttccctgcaacaatggcttcagagaggaagcaagcaaatccaatgagggagatcaaggttcagaaacttgtgctcaacatctccgttggtgagagtggagatcgtctcactcgcgctgctaaggttttggagcaactgagtggccagtctcctgtgttttccaaggcaaggtacactgtgaggtcttttggaattaggcgtaacgaaaagattgcatgctatgtcactgttaggggagacaaggcaatgcagctcttggaaagtggcttgaaggttaaggaatacgagcttttgaggcgtaacttcagtgacactggatgctttggttttggtattcaggagcacattgatcttggtattaagtatgatccatctactggtatctatggtatggacttctttgtggttctagaacgtccaggttaccgtgtgggtcgcagacgtaggtgcaaggcccgtgttggtatccagcacagagttaccaaggatgacgcaatgaagtggttccaggtgaagtatgaaggagtcattctcaacaaatctcaacagatcggagcatagaagacattgtgagttttcttgaggtggttaacgtatgatttggctcaccagggtttttattacatcaatttttgtcatcagtttcttgcattttgactagtaatgttgttactctcatgttatagtggctgtttttaggatggaatttattcgactttattttgataagatgtttttctttattacaatatttaagacatgctgttttgattttgttggtgtcattgtttacagtgattcgagcatgtattttgcatcccttacctgtgttataaccc

SEQ ID NO: 4891 - DNA, 1093 bp, Sorghum bicolor
acctagggtttctcccttttaacctcgcgccgccacccccttcgtctctcgacgcccatctcctcctcaagccgccgccgccgccgccgaaggagaaggaggagaagaggatccggccgtctcatcgccccaatggcgtccgagaagaagcagtcgaacccgatgcgggagatcaaggtgcagaagctcgtcctcaacatctccgtaggggagagcggcgaccgcctcacccgcgccgccaaggtgctcgagcagctcagcggccagacccctgtcttctccaaggcgaggtacacggtgcggtcgttcggcatccggcgtaacgagaagatcgcctgctacgtcactgtcaggggcgagaaggctatgcagctgcttgagagcggcctcaaggtcaaggagtacgagctgctcaggaggaacttcagcgacaccgggtgcttcggattcggcatccaggagcacatcgaccttggtatcaagtacgatccatcaacaggcatctatggaatggacttttatgtcgtgctcgagcgtgctggctaccgtgttgcacgccgcaggaggtgcaaggcccgtgttgggatccagcacagggtgaccaaggaggactcgatgaagtggttccaggtcaagtacgaaggtgtcatcctcaacaaggctcaggccaacacggtgtaaaccttagtttgtctaagctccatgcagacgcaagatgttttagtctactatagcagagctataaaccgccgaatgaattatttcagtgcccgtatcatactctgtgctgttgcttaaaaacatgctagtctgatctcctagcgcagcttgtgatctggctcttctttggttacattgctttatctgccacctgcgttttgagtttttgttgacgaattactgtcacctggtctggaaaattgaagcggactaagggaaggtttctattgtttgtaatgggtatcagcaaacatttgtgtactgtggtctggtttagatccaaattttttttggattttgacactgtagtacttttgtttgtatttggcaattattgtctaacgactaattagtcataaaagattcatctcgt

SEQ ID NO: 4892 - DNA, 809 bp, Sorghum bicolor
ctcgacgcccatctcctcctccagccgtcgccgccgccgccgaaggagaagaggatccggccgtctattcgccccaatggcgtccgagaagaagcagtcaaacccgatgcgggagatcaaggtgcagaagctcgtcctcaacatctccgtcggggagagcggcgaccgcctcacccgcgccgccaaggtgctcgagcagctcagtggccagacccctgtcttctccaaggcgaggtacacggtgcggtcgttcggcatccggcgtaacgagaagatcgcctgctacgtcactgtcaggggcgagaaggctatgcagctgcttgagagcggcctcaaggttaaggagtacgagctgctcaggaggaacttcagcgacaccgggtgcttcggattcggcatccaggagcacatcgaccttggtatcaagtatgatccatcaacaggcatctatggaatggacttctatgtcgtgctcgagcgtgctggctaccgtgttgcgcgccgcaggaggtgcaaggcccgtgttgggatccagcacagggtgaccaaggaggactcgatgaagtggttccaggtcaagtacgaaggtgtcatcctcaacaaggctcaggccaacacggtgtaaactttagtttgtctaagctccgtgcagacgcaagatcaccttgcaaggtttttgttcacattgtattctctggcctgatgttttagtctactatagcagagctataaaacgccgtatgaattatttcagtgcccgtatcatactctgttctgttgcttgaaaacatgctagtctgatctcccag

SEQ ID NO: 4893 - DNA, 759 bp, Eutrema halophilum
tctgccactctttttgcttatctccctcggttttgaaacactaaatcctgagatggcgtcggagaagaagctctcgaaccctatgagggatattaaggttcagaagctcgttcttaacatctctgtcggtgagagtggtgatcgtctcactcgtgcatccaaggtgttggaacagctcagtggtcaaacccctgtcttctccaaggcgaggtacactgtgaggtctttcggtatcaggcgtaatgaaaagattgcttgctatgtcaccgtgagaggcgacaaggcaatgcagcttcttgagagtggcttgaaagtgaaggaatacgagctgttgagaaggaacttcagtgacactggctgctttggattcggtatccaggagcacattgatcttggaatcaagtacgatccttctactggtatctatggaatggacttctatgtggttcttgaacgccctggataccgtgtggcccgtcgccgtagatgcaaggctcgtgttgggatccaacatagagttacaaaggatgatgccatgaagtggttccaagttaagtatgaaggtgttatcctcaacaagtcccagaacatcaccggttgaaaagctttttttcgttttgttttgtggtgtttagctctgttttaagttcttacatttacgattctggatgataaagatttcttgttgtggtgacctttttgacttgagctggtttagaatccttaagtaccctcgagatatgaacaatttttggagtt

SEQ ID NO: 4894 - DNA, 1325 bp, Eutrema parvulum
acttcgcagccgacgctattcgtctgccactctttttgctcatctccctcgattttgaatccctcaatcctgagatggcgtcggagaagaagctctcgaaccctatgagggatattaaggttcagaagctcgttcttaacatctctgtcggtgagagtggtgatcgtctcactcgtgcatccaaggtgttggaacagctcagtggtcaaacccctgtcttctccaaggcgaggtacactgtgaggtctttcggtatcaggcgtaatgaaaagattgcttgctatgtcaccgtgagaggcgacaaggcaatgcagcttcttgagagtggcttgaaagtgaaggaatacgagctgttgagaaggaacttcagtgacactggctgctttggattcggtatccaggagcacattgatcttggaatcaagtacgatccttctactggtatctatggaatggacttctatgtggttcttgaacgccctggataccgtgtggcccgtcgccgtagatgcaaggctcgtgttgggatccaacatagagttacaaaggatgatgccatgaagtggttccaagttaagtatgaaggtgttatcctcaacaagtcccagaacatcaccggttgaaaagcttccattaattttgttttgtggtgttagctctgtttcaagttcttacatttacgattctggatgataaagatttcttgttgtggtaacctttttgacttcagttggtttagaatcctcaagtaccctcgagatatgaacaatttttggagtttatcgttatcaattttattctctctatctaatttaaacaactccaagccatatctctgtctctgatttgcatgtcagaaagattgtggactgaaaattaaaatcagaacgatctgagtagatccagtatctcactcttcttcaaccttgagtatcctttgagtcctctcttctttgcaacttccttgagctctctaggacctgaagcagaaggtctactaggagatctcttggcataactagatggtgcccgaactacttgactctttggtggctccttcacaccagtattaccctcagttttctttcttggtttctcaagcacgtcaagaatagctttactcagtggctctctctcagaagacacatcacggttcttctcctcagctttggagatggaagattgaatccgtctgaagagagaaatgatctcctcttgctttgatttactcgggcttgagctccgttcatcagacggtctcgtgcaacatagagatcctttcttggatctcttgccaaagcctggtgaaggagaatctgaaatct

SEQ ID NO: 4895 - DNA, 821 bp, Eutrema parvulum
actcgacgcagctttcgtttccgcaactctctttgcttcctcacttagctcgattttgatccttaagaatggcgtcggagaagaagctgtcgaaccccatgagggacattaaggtccagaaactcgttcttaacatctccgttggtgagagtggtgatcgtctcactcgtgcctctaaggtgttggaacagctcagtggtcaaacccctgtcttctccaaggcgaggtacactgtgaggtcttttggaattaggcgtaacgaaaagattgcgtgctatgtcaccgtgagaggtgataaggcaatgcagcttcttgagagcggtttgaaagttaaggagtatgagcttcttaggaggaactttagtgacactggttgctttggtttcggtattcaagagcacattgatcttggaatcaagtacgatccttcgaccggtatctacggaatggacttctacgttgttcttgaacgcccaggataccgtgtggctcgtcgccgtagatgcaaggctcgcgttggtatccaacacagagtgactaaggatgatgcaatgaaatggttccaagttaagtacgaaggagttattctcaacaagtctcagaacatcactggttaaaaaaaaaaagtttaaatcttcagagacttttggttattttagcaatttgtttcaagctgttatctttactatttctgtatctctttttagacatcagttcggtagaatctaaattttccaagaaccttgagatatggttttgttttttctcgaatttgtcgtcttcatcaaaactaaaattaatcaaagcagtttctttgattt

SEQ ID NO: 4896 - DNA, 812 bp, Triphysaria pusilla
ggcaggttgccgccgccccataccgtcgaccaccgtctcgcaatggcgtccgagaagaaattatcgaacccgatgagggagattaaggttcagaagctcgttctcaacatctccgttggagaaagtggagatcgtctgactagagcttccaaggtgctggagcaactaagtggacaaactccagttttctccaaggctcgttataccgttagatcctttggcatccgacgtaacgaaaagattgcttgctacgtcacggtcagaggtgacaaggcaatgcaactccttgagagtgggttgaaggtcaaggagtatgagctgttaagaaggaatttcagcgagacgggctgttttggtttcggtattcaggagcacatcgatcttggaatcaagtatgacccgtcgactggtatttatgggatggacttttacgttgttttggagcgacctggataccgtgttggccgtcgccgtaggtgcaaggctcgtgttggaatccaacacagggtcaccaaggatgatgctatgaagtggttccaggtgaaatacgaaggtgtcattctgaacaagtcatccaacattggagcttaatagatttgagagcagtatctgactggattggttatgtggttttcttatgtcttcttgttgcttcagttaaattttgtaggaatctatcctttgacaacgtggtttttatccatattttggtttttgcttgatgatgaattatatttctgctttgttcgagtggctaatgtatgaataatgcgattgccagtaatatttattatttatcagtgaaaaaaaaa

SEQ ID NO: 4897 - DNA, 693 bp, Triphysaria pusilla
tccgtcgaccaccgtctcgcaatggcgtctgagaagaaattatcgaacccgatgagggagattaaggttcaaaagctcgttctcaacatctccgtcggagaaagtggagatcgtctcacaagagcttccaaggtgctggagcaactaagtggccaaactccagttttctccaaggcgaggtatacggttagatcgtttggtatccgacgtaatgaaaaaattgcttgctacgtgacggtcagaggtgacaaggcaatgcaactccttgagagtgggttgaaggtcaaggagtatgagctgttgagaaggaatttcagtgagactggatgtttcggttttggtatccaggagcacattgatcttggaattaagtatgacccgtcgactggtatttatgggatggacttttacgttgttttggagcgccctggataccgtgttggccgtcgccgtaggtgcaaggctcgtgttgggatccagcacagggtcaccaaggatgatgctatgaagtggtttcaagtgaaatacgaaggtgtcattctgaacaagtcatccaacattggagcttaatagatttgagagcagtatctgactgaattggttatgtggttttcttatgtctttttgttgctttcggttaaattttgtaggattctatcctttgacagttctttttatccatattttgatttt

SEQ ID NO: 4898 - DNA, 1029 bp, Amorphophallus konjac
ccgctattttagggtttccgccgtctcttacagttggggtctccacctgcggcatctccaaccccccttccaccaaagagggagcgatggcgtcggagaagaagctctcgaatccgatgcgggagatcaaggtgcagaagctcgtcctgaacatctgcgtcggggaaagtggagatcggctcaccagggcggcgaaggtcttggaacagttgagtggacagactccagtcttctcgaaagcaaggtacactgttcgatcatttggaatcaggcgtaatgaaaagattgcttgttatgttacggttagaggtgaaaaggccatgcagcttcttgagagtgggctcaaggtgaaggagtatgagcttttgagaaggaatttcagtgattcaggttgctttggttttggcattcaagagcatatcgatcttggtatcaagtatgatccgtcaactggaatttacggtatggacttctatgttgttctggaacgtcctgggtaccgtgttggtcgtcgcagaaggtgcaagtcccgtgtgggcattcagcacagggtcaccaaggacgacgccatgaagtggttccaggttaaatatgagggtgtcatccttaacaaagcacaagctggcccacaataataagctctttaaatacctcggacttcacctgctagcgttcagttttaccttgctgtgaaagacgcgttcatgtaacatctcctgaagatgttacctagttttgaatcttgttgtcctttagttagctgttgcttcttcagtcactttatgtcgtcgtcttatagtgtacgcttttttgtctgtggaatgaaatttttgccaagataaaagaatagtgcatctccgtggggccacgctttcaggatggatttagcaaagtcccctaggtgtgtgggcgaaacttctgggtgaaaaacggctatgccccagtgtatatattgtttccccgggacaacaaacttggtttcttgacgcgccccacggatttccctcgttatttttaagttcatttcgt

SEQ ID NO: 4899 - DNA, 759 bp, Aquilegia formosa
agttagggtttatcatttatattcatcactttctcgtctccttttttctttcttcttgcttctccatccatctacagccatggcatcagaacagaaactagcgaacccaatgagggaaatcaaagttcagaaacttgttctcaatatctcagtcggagaaagtggagatcgtctcaccagagcagctaaggtgttagaacagttgagtggacaatcaccagttttctccaaagctaggtacactgtaagatcttttggaatcaggcgtaatgagaagattgcttgttatgtcactgttagaggtgataaagctatgcagcttttggaaagtggattgaaggtcaaggaatatgagttgttgagaaggaacttcagtgatactggctgctttggtttcggtatccaggagcacattgacttggggattaagtatgatccttcaactggtatctatggtatggatttctatgttgtcttggaacgtcctggataccgtgtgggacgtcgtcgtaggtgcaagtctcgcattgggatccaacatcgtgtgacaaaggacgatgccatgaagtggttccaggtgaagtacgagggtgtgattctcaacaagtcccagaatatcacagggtagtagaaagtttgcattaggtggatttgtaacttttgaaggttaagattactctgttgtttttgctagactagtattatccttattgtaaattttgacttgtgatgataatggttgttttatttgactggtct

SEQ ID NO: 4900 - DNA, 795 bp, Aquilegia formosa
ttagggtttatcatttatattcatcactttctcgtctccttttttctttcttcttgcttctccatccatctacagccatggcatcagaacagaaactagcgaacccaatgagggaaatcaaagttcagaaacttgttctcaacatctcagtcggagaaagtggagatcgtctcaccagagcagctaaggtgttagaacagttgagtggacaatcaccagttttctccaaagctagatacactgtgaggtcttttggaatcaggcgtaatgagaagattgcttgttatgtcactgttagaggtgataaagctatgcagcttttggaaagtggattgaaggtcaaggaatatgagttgttgagaaggaacttcagtgatactggttgctttggtttcggtatccaggagcacattgacttggggattaagtatgatccttcaactggtatctatggtatggatttctatgttgtcttggaacgtcctggataccgtgtgggacgtcgtcgtaggtgcaagtctcgcattgggatccaacatcgtgtgacaaaggacgatgccatgaagtggttccaggtgaagtacgagggtgtgattctcaacaagtcccagaatatcacagggtagtagaaagtttgcattaggtggatttgtaacttttgaaggttaagattactctgttgtttttgctagactagtattatccttattgcaaattttgacttgtgatgataatggttgttttatttgactggtctacattttctgttaaaatgaaagattttcttcttacttt

SEQ ID NO: 4901 - DNA, 823 bp, Arnica chamissonis
cttcttctcccacccatctctgccgccgttatcgttccctgcaacaatggcttcagagaggaagcaagcgaatccaatgagagagatcaaggttcagaaactcgtcctcaacatctccgtcggtgagagcggagatcggctcactcgcgctgcgaaggttttggagcaactgagtggccagtctcccgtcttttccaaggcaaggtacaccgtgaggtcatttgggattaggcgtaatgaaaagattgcatgctatgtaaccgttaggggagacaaggcaatgcagcttcttgagagcgggttgaaggtcaaagaatacgagctgctgagacgcaacttcagtgacacaggttgctttggatttggtattcaggaacatattgatctgggtatcaagtatgatccgtcaactggtatctacggtatggactttttcgtggttctagaacgcccaggctaccgtgttggccgtagacgcaggtgcaaggctcgtgtcggtatccaacatagagttacaaaggatgatgcaatgaagtggtttcaggtgaaatatgaaggagtaattctcaacaagtctcaacaaattggagcatagtttgaggtgacttttaaatttgttctgcttgccagacattatcatgtttctatttccgtctttttgtgcctttgaatcctactagtagtgaaaatttaagatgcatttagcatcttctttgacatctgctgtgatttcttcaaaagaagtgattataacttcccggttttgaaaattgttgcgaaaggataacagtggtcggttgattcttatctaggtggtctttat

SEQ ID NO: 4902 - DNA, 615 bp, Brassica juncea
tcggggctcccactctctttgctcatctccctcaatcttgaatcccttaatcgtaaagaatggcgtcggagaagaaactctcgaaccctatgagggacatcaaggttcagaagctcgttcttaacatctctgttggtgagagtggtgatcgtctcactcgtgcctccaaggtgttggaacagctcagtggtcaaacccctgtcttctccaaggctagatacactgtgaggtctttcggaatcaggcgtaacgagaagattgcttgctatgtcaccgtgagaggagacaaggctatgcagcttcttgagagcggcttgaaagtgaaggagtacgagctgttgaggaggaacttcagtgacactggctgctttgggttcggtatccaggagcacattgatcttggaatcaagtatgatccttccactggtatctatggaatggacttctatgttgttcttgaacgtcctggataccgtgttgcacgtcgccgtaggtgcaagactcgcgttgggattcaacatagagttacaaaggatgatgccatgaagtggttccaagttaagtatgaaggtgttatcctcaacaagtctcagaacatcactggttgaagagttt

SEQ ID NO: 4903 - DNA, 611 bp, Brassica juncea
gtccacactctctttgctcatctccctcgtttttgcatcccttaatcctgagatggcgtcagagaagaagctctcgaacccaatgagggatatcaaggttcagaagctcgttcttaacatctctgttggtgagagtggtgatcgtctcacccgtgcctccaaggtgttggaacagctcagtggtcaaacccctgtcttctctaaggcgaggtacactgttaggtctttcggtattaggcgtaatgaaaagattgcttgctatgtcaccgtgagaggagacaaggcaatgcagcttcttgagagtggcttgaaagttaaggagtatgagcttcttaggaggaactttagtgacactggttgctttggattcggtatccaagagcacattgatcttggaatcaagtatgatccatctactggtatctacggaatggacttctatgttgttcttgaacgtccaggataccgtgtggcacgtcgacgtagatgcaaggctcgtgttggtatccaacaccgagtgactaaggatgatgctatgaaatggttccaagtcaagtatgaaggagttatcctcaacaagtcacagaacatcaccggctaaaaaaaatcta

SEQ ID NO: 4904 - DNA, 1540 bp, Brassica juncea
actctctttgctcatctccctcgtttttgcatcactgaatcctgagatggcgtcagagaagaagctgtcgaacccaatgagggatatcaaggttcagaagctcgttcttaacatctctgttggtgagagtggtgatcgtctcacccgtgcctccaaggtgttggaacagctcagtggtcaaacccctgtcttctccaaggcgaggtacactgtgaggtctttcggtattaggcgtaatgaaaagattgcttgctacgtcaccgtgagaggagacaaggcaatgcagcttcttgagagtggcttgaaagtgaaggagtacgagctgttgaggaggaacttcagtgacactggctgtttcggattcggtatccaggagcacattgatctcggaatcaagtacgatccttctaccggtatctatggaatggacttctatgttgttcttgagcgcccgggataccgtgttgctcgtcgccgtaggtgcaagactcgcgttgggattcaacatagagttacaaaggatgatgccatgaagtggttccaggttaagtacgaaggtgttatcctcaacaagtctcagaacatcactggttgaagagttctgttttgttttgtggtgttggctctgtttcaagttcttataatttgcggttctggatgataaggctttcttgttgttgtagaatcctcaagtaccctcgagatatgaaaacaatttttggaggttatctttatcagttttaatctctatctactttaaacaacgtcaatccatatctgtgtttctaatttacatattagagagaatatggactgagaaataaaatcaggaggacctgagtagctccagaatctcacttttctttagctttgagtatcctttgagtcctttgttctttgcaacttctttgagctctgcaagtttcatagtttcaatcaatggaggtttctcttccttctctgtttcttccatactgctctttgttattgtaagcttaccttttggatctgaagcagattgtctagtaggagatctcttgataaatttagacggtggccgagccacttgtctcttagatggctctttccttacaccagcatctccctcagtttttgttcttggtttctcaagaacgtcgagaatagctttactcagcgacccattcccagaagactcattgctgttcttcccatctgctccctgagattctcctttggagatggaagcttgaatccggctgaagagagaaatgatctcctcttgcttggatttactcaggcctgagctctgttcatcagatggatttttgcaacaaacaacagatcctttcttgaatctcccagttgaaaaggaggaagaagaagctttctctcgaggccggcttcttctatcaccatcaaatgatgttcttggagaatctcgaatatgaagatgattggctctcccgaatccttgtttgatcaacgaaggaaaaggaagagccaagtccatagctttagtctttcctcgtgaaaagctgagaaatcttcttatcaaacg

SEQ ID NO: 4905 - DNA, 785 bp, Brassica juncea
aactctctttgcttcctctctcccagctcgattgttgatctccttcaaatggcgtcggagaagaagctgtcgaacccaatgagggacattaaggtccagaaacttgttctcaacatctccgttggtgagagtggtgatcgtctcactcgtgcctccaaggttttggaacagctaagcggacaaacccctgttttctcaaaggcgaggtacactgtgaggtcttttggtatcaggcgtaacgaaaagattgcgtgctacgtcactgtgagaggtgacaaggcaatgcagcttcttgaaagtggtttgaaagttaaggagtatgagcttcttaggaggaactttagtgacactggttgctttggattcggtatccaagagcacattgatcttggtatcaagtatgatccatctaccggtatctatggaatggacttctatgtagttcttgaacgtccaggataccgtgttgctcgtcgccgtagatgcaaggctcgtgttggtatccaacaccgagtgactaaggatgatgcaatgaaatggttccaagttaagtatgaaggagttatcctcaacaagtctcagaacatcactggctgaattgtacttgaatcttcatagatttttgttgattctagcttttgtttttcaagttatcatctttacttttctggatattgaagaatcgcttgttctagtaaaacctctttttgacgtcagtgtggtagaaactaaatttccaagttgtatgagttactgtttttgttttttttacaattatcaaaacc

SEQ ID NO: 4906 - DNA, 879 bp, Brassica juncea
gtctccgttatctcttttcgattccagctttcccgtccgccggagttttctcgcaacccgaatcccaaatggcgtcggagaagaagctatcgaacccaatgagggacatcaaagtgcagaagctggtgctcaacatctccgtcggcgagagtggagatcgtctcacaagagcctccaaggtcttggaacagttgagtggccagactcctgttttctccaaggcacggtacactgttcgttcttttggtatcagacgtaacgagaagattgcttgctacgttaccgtcaggggagataaggcaatgcagctcctcgagagtggactcaaggttaaagagtatgagctcttgaggaggaacttcagcgacactggttgcttcggtttcggtatccaggagcacattgatttgggtatcaagtatgacccgtcgactggaatctacggtatggacttctatgttgttcttgagcgtcctggttaccgtgtggcacgtcgcagaagatgcaaggctcgtgttggaatccagcacagagtcacgaaagatgatgccatgaaatggttccaagttaaatacgaaggagtcattctcaacaagtctcagaacattacgggctaaaaaccatccgtctcaaacatataatctgtgtgtgttttccccggtttgaatcgtgttttcttttagactttggtttaacgcttaaaaacaacgtgaaattatcgaacaaacgcgaaaacgcgtttctactttcggtttgcttacattatttatcataaagaatctttgactatgcggtctattttaatactttacaagacgtgtcgactgtaaattaccttgtacttgtacatcaatataatatagcaacatctaaaacatt

SEQ ID NO: 4907 - DNA, 729 bp, Brassica juncea
atggcgtcagagaagaagctctcgaaccctatgagggacatcaaggtccagaagctcgttctcaacatctctgttggtgagagcggtgatcgtctcactcgtgcctccaaggtgttggaacagctcagtggtcaaacccctgtcttctccaaggcgaggtacactgtgaggtctttcgggatcaggcgtaacgagaagattgcttgctacgtcaccgtgaggggagacaaggccatgcagcttcttgagagcggattgaaagtgaaggagtacgagctcctgaggaggaacttcagtgacactggctgctttgggttcggtatccaggagcacattgatcttggaatcaagtacgatccttccactggtatctatggaatggacttctatgttgttcttgaacgtccggggtaccgtgttgctcgtcgccgtaggtgcaagactcgcgttgggattcaacatagagtcacaaaggatgatgccatgaagtggttccaggttaagtacgaaggtgttatcctcaacaagtctcagaacatcactggttgaagagtttgtttctattttgttttgtgctgttagctcttgtctcagaacatcgccttgggatctcttgttttttgtatctttttttaacttcagttggtttagaatctgagtaccctcgagatatcaacaatttttggaggtttatcgttatcaattttaaacaatctctatgctttaaaa

SEQ ID NO: 4908 - DNA, 832 bp, Brassica juncea
cgtccgccggagttttctcgcaacccgaatcccaaatggcgtcggagaagaagctatcgaacccaatgagggacatcaaagtgcagaagctggtgcttaacatctccgtcggtgagagtggagatcgtctcaccagagcctccaaggtcctggaacagttgagtggccagactcctgttttctccaaagcaagatacactgttcgttcctttggtatcagacgtaacgagaagattgcttgctacgttaccgtcaggggagataaagcaatgcagctccttgaaagtggactcaaggttaaagagtatgagctcttgaggaggaactttagcgacactggttgcttcggtttcggtatccaggagcacattgatttgggtatcaagtatgacccgtcgactggaatctacggtatggacttctatgttgttctcgagcgtcctggttaccgtgtggcgcgtcgcagaagatgtaaggctcgtgttggtatccagcacagagtcaccaaagatgatgccatgaaatggttccaagtgaagtatgaaggagtcatcctcaacaagtctcagaacattactggttgaaaccatctgtctcgaacagagatctataaactgtgtttttgtttgtccccttggttcgaatcttgttttgttttgcttttatgttctctatacatttgaatatcattattgctgctttcatggctctacagagttttgattatgaagacagaaatcattttaaccggattagagttcggtttaacgcataaaatgatcgaacaaacgtgaaaacgcttttttactatgcttacattatttatcttaac

SEQ ID NO: 4909 - DNA, 872 bp, Brassica juncea
agcttttgtttgccgcaactctctttgcttccctcgactttgatttccttacaatggcgtcggagaagaagctgtcgaaccccatgagggacattaaggtccagaaactcgttctcaacatctccgttggtgagagtggagatcgtctcactcgtgcctccaaggttttggaacagctcagtggacaaacccctgtcttctcaaaggcgagatacactgtgaggtctttcggtatcaggcgtaacgaaaagattgcgtgctatgtcaccgtgaggggtgacaaggcaatgcagcttcttgagagtggtttgaaagtcaaggagtatgagcttcttaggaggaactttagtgacactggttgctttggtttcggtatccaagagcacattgatcttggtatcaagtatgatccatctactggtatctacggaatggacttctacgtagttctcgaacgtccaggataccgtgtggctcgtcgacgcaggtgcaaggctcgtgttggtatccaacacagagtgactaaggatgatgcaatgaaatggttccaagttaagtatgaaggagttattctcaacaagtctcagaacatcactggctaaaactaaaacttgaatcttcattagattttttgttgagtctactagctttgttttttttaaagttgtcatctttacgatttctggatattgaagaatcgcttgttctagtaaaacctctttttgacgtcagtgtggtagaaactaaatttccaagttgtatgagttactgtttttgttttttttacaattatcaaaaccttggacttcaatgttcttgagttctgcaaactatcctcaaacaagtactttgaagtccaaggttttgataat

SEQ ID NO: 4910 - DNA, 746 bp, Brassica juncea
actctctttgctcatctccctcgtttttgcatcactgaatcctgagatggcgtcagagaagaagctgtcgaacccaatgagggatatcaaggttcagaagctcgttcttaacatctctgttggtgagagtggtgatcgtctcactcgtgcctccaaggttttggaacagctcagtggacaaacccctgttttctcaaaggcaaggtacactgtgaggtcttttggtataaggcgtaatgaaaagattgcgtgctatgttactgtaagaggtgacaaggcaatgcagcttcttgaaagtggtttgaaagttaaggagtatgagcttcttaggaggaactttagtgacactggttgctttggattcggtatccaagagcacattgatcttggtatcaagtatgatccttccactggtatctatggaatggacttctatgttgttcttgaacgtccgggataccgtgttgcacgtcgccgtaggtgcaagactcgcgttgggattcagcatagagttacaaaggatgatgccatgaagtggttccaagttaagtatgaaggtgttatcctcaacaagtctcagaacatcactggttgaagagttcgtttcttttctttttgttttgtggtgttggctctctttataattctggatgataaggctttgttgttgtggtggtagaatccttaagtaccctcgagatatgaacaattttttttggaggttatcgttatcaattttaaactag

SEQ ID NO: 4911 - DNA, 724 bp, Brassica juncea
gacagcggtcgctgccactcttctttgctcatctccctcaatcttgaatcccttaatcgtaaagaatggcgtcggagaagaaactctcgaaccctatgagggacatcaaggttcagaagctcgttctcaacatctctgttggtgagagcggtgatcgtctcactcgtgcctccaaggtgttggaacagctcagtggtcaaacccctgtcttctccaaggcgaggtacactgtgaggtctttcggtattaggcgtaatgaaaagattgcttgctacgtcaccgtgagaggagacaaggcaatgcagcttcttgagagtggtttgaaagtcaaggagtatgagcttcttaggaggaactttagtgacactggttgctttggattcggtatccaagagcacattgatcttggtatcaagtatgatccatctactggtatctacggaatggacttctatgtagttcttgaacgtccaggataccgtgtggctcgtcgccgcaggtgcaaggctcgtgttggtatccaacacagagtgactaaggatgatgcaatgaaatggttccaagttaagtatgaaggagttatcctcaacaagtctcagaacatcactggctaaactaaacttgaatcttcttagattttttgttgagtctattagctttgtttttttttaagttgtcatctttacgatttctggatattgaagaatcgcttgttctagtaaaa

SEQ ID NO: 4912 - DNA, 607 bp, Brassica oleracea
  misc_feature (592)..(592): n is a, c, g, or t
gctctttgctcatctccctctgactttgcatcccttaatcctcagaatggcgtcagagaagaagctctcgaacccaatgagggatatcaaggttcagaagctcgttctcaacatctccgttggtgagagtggtgatcgtctcacccgtgcctccaaggttttggaacagctcagtggtcaaacacctgtcttctccaaggcgaggtacactgtgaggtctttcggtattagacgtaatgaaaagattgcgtgctacgtcaccgtgagaggagacaaggcaatgcagcttcttgagagtggcttgaaagtcaaggagtacgagctgttgaggaggaacttcagtgacactggctgttttggattcggtatccaggagcacattgatcttggaatcaagtacgatccttctacgggtatctatggaatggacttctatgttgttcttgaacgcccgggataccgtgttgcacgtcgccgtaggtgcaagactcgcgttgggattcagcatagagttaccaaggatgatgccatgaagtggttccaagttaagtacgaaggtgttatcctcaacaagtctcagaacatcactggntgaagagtttgtttc

SEQ ID NO: 4913 - DNA, 648 bp, Brassica oleracea
  misc_feature (635)..(635): n is a, c, g, or t
ggacgcagttttgtctccgcaactctcttctactccttgaattaaaatggcgtcagagaagaagctctcgaaccccatgagggacataaaggtccagaagcttgttctaaacatctccgttggtgaaagtggtgatcgtctcacccgtgcctcaaaggttttggaacagctcagtggacaaacccctgttttctcaaaggcgaggtacactgtgaggtcttttggtattaggcgtaacgaaaagattgcgtgctacgtcactgttagaggtgacaaggcaatgcaacttcttgagagtggcttgaaagtcaaggagtatgagcttcttaggaggaactttagtgacactggttgctttggattcggtatccaagagcacattgatcttggtatcaagtatgatccatctactggtatctacggaatggacttctatgttgttcttgaacgtccaggataccgtgtggcacgtcgacgtagatgcaaggctcgtgttggtatccaacacagagtgactaaggatgatgcaatgaaatggttccaagtcaagtatgaaggagttatcctcaacaagtctcagaacatcaccggctaaaaaaatctttatagatttttgttgattttagctttgtttngagtttatctttt

SEQ ID NO: 4914 - DNA, 812 bp, Brassica oleracea
  misc_feature (76)..(76): n is a, c, g, or t
  misc_feature (78)..(78): n is a, c, g, or t
  misc_feature (84)..(84): n is a, c, g, or t
  misc_feature (89)..(90): n is a, c, g, or t
  misc_feature (92)..(92): n is a, c, g, or t
  misc_feature (96)..(96): n is a, c, g, or t
ggtaattttgcattttagaaccctagacacgctagggtttatatacttcgccgcggcgtcctccgttatctctttngnttccanctttnncntccnccggagttttctcgcagcccgaatcccaaatggcgtcggagaagaagctatcgaacccaatgagggacatcaaagtgcagaagctggtcctcaacatctccgtcggtgagagtggagatcgtctcaccagagcctccaaggtcttggaacagttgagtggccaaactcctgtcttctccaaagcgagatacactgttcgttctttcggtatcagacgtaacgagaagattgcttgctacgtcaccgtcaggggagacaaggcaatgcaactccttgaaagtggactcaaggttaaagagtatgagctcttgagaaggaactttagcgacactggttgcttcggttttggtattcaggagcacattgatttgggtatcaagtatgatccttcgactggaatctacggtatggacttctatgttgttcttgagcgtcctggttaccgtgtggcgcgtcgcagaagatgcaaggctcgtgttggtatccagcacagagtcaccaaagatgatgccatgaaatggttccaagttaagtacgaaggagtcatcctcaacaagtctcagaacattactggttgaaaccatctgtctcgaacagagatctataaactgtgtttttgtttgtcccctcggtttcgaatcgtgttttgttttgcttttatgttttcttctatacatttgaatatcattattgcctatctacaatgctttcatgac

SEQ ID NO: 4915 - DNA, 628 bp, Brassica oleracea
gactcctcttagcccatctccctcgagtctttaatcccaaagatggcgtcagagaagaagctctcgaaccctatgagggacatcaaggtccagaagctcgttctcaacatctctgttggtgagagtggtgatcgtctcactcgtgcctccaaggtgttggaacagctcagtggtcaaacccctgtcttctccaaggcgaggtacactgtgaggtctttcggaatcaggcgtaacgagaagattgcttgctacgtcaccgtgaggggagacaaggccatgcagcttcttgagagtggattgaaagtgaaggagtacgagctcctgaggaggaacttcagtgacactggctgctttgggttcggtatccaggagcacattgatcttggaatcaagtacgatccttccactggtatctatggaatggacttctatgttgttcttgaacgtcctggataccgtgttgctcgtcgccgtaggtgcaagactcgcgttgggattcaacatagagttacaaaggatgatgccatgaagtggttccaagttaagtatgaaggtgttatcctcaacaagtcccagaacatcactggttaaagagtttgtttctagtttgttttgtggtgttagctct

SEQ ID NO: 4916 - DNA, 762 bp, Brassica oleracea
agctttcgtttccgcaactctctttgcttctcttctcttcttttctaactcgactttgatctccttacaatggcgtcggagaagaagctgtctaacccaatgagggacattaaggtccagaaacttgttctcaacatctccgttggtgagagtggtgatcgtctcactcgtgcctccaaggttttggaacagctcagtggacaaacccctgttttctccaaggcgagatacactgtgaggtcttttggtatcaggcgtaacgaaaagattgcgtgctatgtcactgtgagaggtgacaaggcaatgcagcttctcgagagtggtttgaaagttaaggagtatgagcttcttaggaggaacttcagtgacactggttgctttggattcggtatccaagagcacattgatcttggtatcaagtacgatccatctaccggtatctacggaatggatttctatgttgttctcgaacgtccaggataccgtgtggctcgtcgccgtagatgcaaggctcgtgttggtatccaacacagagtgaccaaggatgatgcaatgaaatggttccaagtcaagtatgaaggagttatcctcaacaagtctcagaacatcactggctaaaaccaaacttcaatctttattgatttttgtttattttagctttatttcaaagtttcagttttcacgattttctggatgttaaagaatttcttgttgtagtaaaaccttttttgacatcagcatggtataatctaaatttccaag

SEQ ID NO: 4917 - DNA, 895 bp, Brassica rapa
atagttccaagaaagaaaccctagttccgtcccatataactcatttcacttcccactcgacgcagctttcgtttccgcaactctctttgcttcttctctcctaactcgactttgatctccttacaatggcgtcggagaagaagctctcgaacccaatgagggacattaaggtccagaaacttgttctcaacatctccgttggtgagagtggtgatcgtctcactcgtgcctccaaggttttggaacagctcagtggacaaacccctgttttctccaaggcgagatacactgtgaggtcttttggtatcaggcgtaacgaaaagattgcgtgctacgtcactgtgaggggtgacaaggcaatgcagcttcttgagagtggtttgaaagttaaggagtatgagcttcttaggaggaactttagtgacactggttgctttggtttcggtatccaagagcacattgatcttggtatcaagtacgatccatctactggtatctacggaatggacttctatgttgttctcgaacgtccaggataccgtgtggctcgtcgccgtagatgcaagactcgtgttggtatccaacacagagtgaccaaggatgatgcaatgaaatggttccaagtcaagtatgaaggagttatcctcaacaagtctcagaacatcactggctaaaccaaacttcaatctttattgatttttgtttattttagctttgtttcaaagtttcagtttttactattttctggatgttaaagaatttcttgttgtagtaaaaccttttttgacatcagcatggtataatctaaatttccaagaacgttggaagtgttttttcttcttcgaatttaatgtcttcatttacaataaaatcgaagcagctcccttgactgaaa

SEQ ID NO: 4918 - DNA, 910 bp, Brassica rapa
gtcattacatctagaacaaaccctaaagcgtctctcatataataccagactttgcagccgtcactgccactcttctctgctcatctacctaaacctgaatcccttaatcccaaaatggcgtcagagaagaagctctcgaaccctatgagggacatcaaggtccagaagctcgttctcaacatctctgttggtgagagtggtgatcgtctcactcgcgcctccaaggtgttggaacagctcagtggtcaaacccctgtcttctccaaggcgaggtacactgtgaggtctttcggaatcaggcgtaacgagaagattgcttgctacgtcaccgtgaggggagacaaggccatgcagcttcttgagagcggcttgaaagtgaaggagtacgagctcctgaggaggaactttagtgacactggctgctttgggttcggtatccaggagcacattgatcttggaatcaagtacgatccttccactggtatctatggaatggacttctatgttgttcttgaacgtccggggtaccgtgttgctcgtcgccgtaggtgcaagactcgcgttgggattcaacatagagtcacaaaggatgatgccatgaagtggttccaggttaagtacgaaggtgttatcctcaacaagtctcagaacatcactggttgaagagtttgtttctattttgttttgtgctgttagctcttgtctcagaacatcgccttgggatctcttgttttttgtatctttttttaacttcagttggtttagaatctgagtaccctcgagatatcaacaatttttggaggtttatcgttatcaattttaaacaatctctatgctttaaactactccaatccagaatcttactcttctttagcttttagttctgcaagtttcatagtttcaatcaatg

SEQ ID NO: 4919 - DNA, 862 bp, Brassica rapa
atgagatctagggcttatatattttgctgccgcttcttcgctctctctttcgcttccagctttaaccgttcgtccgccggagttttctcgcaaccggaatcccaaatggcgtcggagaagaagctatcgaacccaatgagggacatcaaagtgcagaagctggtgcttaacatctccgtcggtgagagcggagatcgtctcaccagagcctccaaggtgctggaacagttgagtggccagactcctgttttctccaaagcaagatacactgttcgttcctttggtatcagacgtaacgagaagattgcttgctacgttaccgtaaggggagacaaggcaatgcagctccttgagagtggactcaaggttaaagagtatgagctcttgaggaggaacttcagcgacactggttgcttcggtttcggtatccaggagcacattgatttgggtatcaagtatgacccgtcgactggaatctacggtatggacttctatgttgttcttgagcgtcctggttaccgtgtggctcgtcgcagaagatgcaaggctcgtgttggaatccagcacagagtgacgaaggatgatgccatgaagtggttccaagttaaatacgaaggagtcattctcaacaagtctcagaacattactggttagacaacaaaagatgtctcaaacagatatttgtgttttgtccacctggttcgaatcgtattttatcagttttgtttttgcttttttgttcttcagacatttgagttttatttatagacattacctatctacaatgattgccattaaaacaggtatagagagctaaaacacattcatctaatcgtttattttgaaactagttatatgaatg

SEQ ID NO: 4920 - DNA, 1223 bp, Brassica rapa
ggcctaataataaatgaattttctacatttgatgatctagagggctaatcctagcctctctgggctacaaatccaagctcactagcatatttgacccgaaccggatataaaccgaagttaagaaccgattctcgtcacgtgaggaggaacgtgggctttgttggaggaaggagggtagagtcgtcattccactactcttaattttgcatttttgaaccctagacacgctagggtttatatacttcgccgcggcgcctccgttatctcttttcgattccagctttcccgtcccgccggagttttctcgcaaccccgaatcccaaatggcgtcggagaagaagctatcgaacccaatgagggacatcaaagtgcagaagcttgtcctcaacatctccgtcggtgagagtggagatcgtctcaccagagcctccaaggtcttggaacagttgagtggccaaactcctgttttctccaaagcgagatacactgttcgttcgttcggtatcagacgtaacgagaagattgcttgctacgtcaccgtcaggggagacaaggctatgcaactccttgaaagtggactgaaagttaaagagtatgagctcttgagaaggaactttagcgacactggttgcttcggttttggtattcaggagcacattgatttgggtatcaagtatgacccgtcgactggaatctacggtatggacttctatgttgttctcgagcgtcctggttaccgtgtggcgcgtcgcagaagatgtaaggctcgtgttggtatccagcacagagtcaccaaagatgatgccatgaaatggttccaagtgaagtatgaaggagtcatcctcaacaagtctcagaacattactggttgaaaccatctgtctcgaacagagatctataaactgtgtttttgtttgtccccttggttcgaatcttgttttgttttgcttttatgttctctatacatttgaatatcattattgctgctttcatggctctacagagttttgattatgaagacagaaatcattttaaccggattagagttcggtttaacgcataaaatgatcgaacaaacgtgaaaacgcttttttactatgcttacattatttatcttaacgaatctttgactatgggtctattttaatactctttacaagacgtgtcgattgtaaattaccttgtacttgtacatcattataatatagcaacatcaataacat

SEQ ID NO: 4921 - DNA, 978 bp, Brassica rapa
atagtttaaagaaaccctagttccgtcccttataactcatttctcttcccccactcgacgcagcttcgcttccgcaactctctttgcttcctatctctcagctcgattgtcgatctccttcaaatggcgtcggagaagaagctgtcaaacccaatgagggacattaaggtccagaaacttgttctcaacatctccgttggtgagagtggtgatcgtctcacccgtgcctccaaggttttggaacagctaagcggacaaacccctgttttctcaaaggcgaggtacacagtgaggtcttttggtatcaggcgtaacgaaaagattgcctgctatgtcactgtgagaggtgacaaggcaatgcagcttcttgaaagtggtttgaaagttaaggagtatgagcttcttaggaggaactttagtgacactggttgctttggattcggtatccaagagcacattgatcttggtatcaagtatgatccatctaccggtatctatggaatggacttctatgtagttcttgaacgtccaggataccgtgttgctcgtcgccgtagatgcaaggctcgtgttggtatccaacacagagtgactaaggatgatgcaatgaaatggttccaagttaagtatgaaggagttatcctcaacaagtctcagaacatcactggctgaattgtacttgaatcttcatagatttttgttgattctagcttttgtttttcaagttatcatctttacttttctggaaattgaagaatcgcttgttctagtaaaacctctttttgacgtcagtgtggtagaaactaaatttccaagttgtatgagttactgtttttgttttttttacaattatcaaaaccttggacttcaatgttcttgagttctgcaaactatcctcaaacaagtacttttcgggtttctttggttttcacttttcagtagtaacagtctctaacttctggatcaagcgaccgcttg

SEQ ID NO: 4922 - DNA, 757 bp, Brassica napus
ctttcgattccagctttcccttcccggccggagttttctcgcagcccgaatcccaaatggcgtcggagaagaagctatcgaacccaatgagggacatcaaagtgcagaagctggtcctcaacatctccgtcggtgagagtggagatcgtctcaccagagcctccaaggtcttggaacagttgagtggccagactcctgtcttctccaaagcgagatacactgttcgttctttcggtatcagacgtaacgagaagatcgcttgctacgtcaccgtcaggggagacaaggcaatgcaactccttgaaagtggactcaaggttaaagagtatgagctcttgagaaggaactttagcgacactggttgcttcggttttggtattcaggagcacattgatttgggtatcaagtatgatccttcgactggaatctacggtatggacttctatgttgttcttgagcgtcctggttaccgtgtggcgcgtcgcagaagatgcaaggctcgtgttggtatccagcacagagtcaccaaagatgatgccatgaaatggttccaagttaagtacgaaggagtcatcctcaacaagtctcagaatattactggttgaaaccatctgtctcgaacagagatctataaactgtgtttttgtttgtcccctcggtttcgaatcgtgttttgttttgcttttatgttctcttctatacatttgaatatcattattgcctatctacaatgctttcatggctctccagagttttt

SEQ ID NO: 4923 - DNA, 822 bp, Brassica napus
gagggcttatatattttgctgccgcttcttcgctctctctttcgcttccagctttaaccgttcgtccgccggagttttctcgcaaccggaatcccaaatggcgtcggagaagaagctatcgaacccaatgagggacatcaaagtgcagaagctggtgcttaacatctccgtcggtgagagcggagatcgtctcaccagagcctccaaggtgctggaacagttgagtggccagactcctgttttctccaaagcaagatacactgttcgttcctttggtatcagacgtaacgagaagattgcttgctacgttaccgtcaggggagataaagcaatgcagctccttgagagtggactcaaggttaaagagtatgagctcttgaggaggaacttcagcgacactggttgcttcggtttcggtatccaggagcacattgatttgggtatcaagtatgacccgtcgactggaatctacggtatggacttctatgttgttcttgagcgtcctggttaccgtgtggctcgtcgcagaagatgcaaggctcgtgttggaatccagcacagagtgacgaaggatgatgccatgaagtggttccaagttaaatacgaaggagtcattctcaacaagtctcagaacattactggttagacaacaaaagatgtctcaaacagagatttgtgttttgtccacctggttcgaatcgtattttatcagttttgtttttgcttttttgttcttcagacatttgagttttatttatagacattacctatctacaatgattgccattaaaacaggtatagagagctaaaacacattcatct

SEQ ID NO: 4924 - DNA, 784 bp, Brassica napus
tcagttgctcatctccctctgactttgcatcccttaatcctcagaatggcgtcagagaagaagctctcgaacccaatgagggatatcaaggttcagaagctcgttctcaacatctccgttggtgagagtggtgatcgtctcacccgtgcctccaaggttttggaacagctcagtggtcaaacacctgtcttctccaaggcgaggtacactgtgaggtctttcggtattagacgtaatgaaaagattgcgtgctacgtcaccgtgagaggagacaaggcaatgcagcttcttgagagtggcttgaaagtcaaggagtacgagctgttgaggaggaacttcagtgacactggctgttttggattcggtatccaggagcacattgatcttggaatcaagtacgatccttctacgggtatctatggaatggacttctatgttgttcttgaacgcccgggataccgtgttgcacgtcgccgtaggtgcaagactcgcgttgggattcagcatagagttaccaaggatgatgccatgaagtggttccaagttaagtacgaaggtgttatcctcaacaagtctcagaacatcactggttgaagagtttgtttcttttcattttgttttgtggtgttggctcttttttataatttgcggttctggatgataaggctttgttgttgtggtggtagaatcctcaagtaccctcgagatatgaacaatttttttggaggttattctttattcagtttaaacttacgaaaaaaaaactaaaatgacagtcacgacg

SEQ ID NO: 4925 - DNA, 833 bp, Brassica napus
gagaacaaaccctaaagcgtctctcatataattaccagacttcgcggccgtcactgccactcttcttagccaatctccctcaagtcttgaatcccaaagatggcgtcagagaagaagctctcgaaccctatgagggacatcaaggtccaaaagctcgttctcaacatctctgttggtgagagtggtgatcgtctcactcgtgcctccaaggtgttggaacagctcagtggtcaaacccctgtcttctccaaggcgaggtacactgtgaggtctttcggaatcaggcgtaacgagaagattgcttgctacgtcaccgtgaggggagacaaggcgatgcagcttcttgagagcggattgaaagtgaaggagtacgagctcctgaggaggaacttcagtgacactggctgctttgggttcggtatccaggagcacattgatcttggaatcaagtacgatccttccactggtatctatggtatggacttctatgttgttcttgaacgtcctggataccgtgttgctcgtcgccgtaggtgcaagactcgcgttgggattcaacatagagtcacaaaggatgatgccatgaagtggttccaagttaagtatgaaggtgttatcctcaacaagtcccagaacatcactggttaaagagtttgttttgtggtgttagctctgtctcagaacatcgcgttgggatctcttgttttttttattctttttttacttcagttggtttagaatctgagtaccctcgagatatcaacaatttttggaggttatctttatcaattttaaacaatctctatgctttatagttttgcaagtcgaaaaaa

SEQ ID NO: 4926 - DNA, 785 bp, Brassica napus
gtcccatataattcatttcacttcccactcgacgcagctttcgtttccgcaactctctttgcttctcttctcttcttttctaactcgactttgatctccttacaatggcgtcggagaagaagctgtcgaacccaatgagggacattaaggtccagaaacttgttctcaacatctccgttggtgagagtggtgatcgtctcactcgtgcctccaaggttttggaacagctcagtggacaaacccctgttttctccaaggcgagatacactgtgaggtcttttggtatcaggcgtaacgaaaagattgcgtgctatgtcactgtgagaggtgacaaggcaatgcagcttctcgagagtggtttgaaagttaaggagtatgagcttcttaggaggaacttcagtgacactggttgctttggattcggtatccaagagcacattgatcttggtatcaagtacgatccatctaccggtatctacggaatggatttctatgttgttctcgaacgtccaggataccgtgtggctcgtcgccgtagatgcaaggctcgtgttggtatccaacacagagtgaccaaggatgatgcaatgaaatggttccaagtcaagtatgaaggagttatcctcaacaagtctcagaacatcactggctaaaaccaaacttcaatctttattgatttttgtttatttatttcaaagtttcagttttcacgattttctggatgttaaagaatttcttgttgtagtaaaaccttttttgacatcagcatggtataatctaaattt

SEQ ID NO: 4927 - DNA, 1311 bp, Brassica napus
ctccctcgattttgcatcccttaatcctcagagatggcgtcagagaagaagctctcgaacccaatgagggacatcaaggttcagaagctcgttctcaacatctccgttggtgagagtggtgatcgtctcacccgtgcctccaaggtgttggaacagctcagtggtcaaacacctgtcttctccaaggcgaggtacactgtgaggtctttcggtattaggcgtaatgaaaagattgcgtgctacgtcaccgtgagaggagacaaggcaatgcagcttcttgagagtggtttgaaagttaaggaatacgagctgttgaggaggaacttcagtgacactggctgtttcggattcggtatccaggagcacattgatcttggaatcaagtatgatccttctactggtatctatggaatggacttctacgttgttcttgagcgtccggggtaccgtgttgcacgtcgccgtaggtgcaagactcgcgttgggattcagcatagagtgacaaaggatgatgccatgaagtggttccaagttaagtacgaaggtgttatcctcaacaagtctcagaacatcactggttgaagagttggtctctttttgttttgtggtgttggctctttttataattctggatgataaggctttgttgttgtggtggtagaatccttaagtaccctcgagatatgaacaattttttggaggttatcgttatcaattttaaactctatctactttaaacaaactccaagccgtatctgttgtttctaatttacatatcagagagaatgtggactgaaaatttaaaatcaggaggatctgagtagctccagaatctcactcttctttagctttgagtatcctttgagtcctttgttctttgcaacttctttgagctctgcaagtttcatagtttcaatcaatggaggtttatcttccttctctgtctcttccatagtgctctttgttattggaagcttacctctttgacctgaagcagatggtctagtaggagatctcttggcaaaactagactgtggccgagctacttgtctcttaggtggctcttttcttacaccagcatctccttcagttttagctcttggtttctcaagaacgtcaagaatagctttactcagtgactcattcccagaagacacacgtccgttcttctcatttactccctgagactcctcacctttggaaatggaagcttgaatccgtctgaagagagaaatgatctcctcttgcttggctttactcgggtctgagctctgttcatcagacggattcttgcaacaaacaacatatcct

SEQ ID NO: 4928 - DNA, 1028 bp, Brassica napus
gactcgtaattttgcattttagaaccctagacacgctagggtttatatacttcggcgcggcgtctccgttatctcttttcgattccagctttcccttcccggccggagttctctcgcaacccgaatcccaaatggcgtcggagaagaagctatcgaatccaatgagggacatcaaagtgcagaagcttgtcctcaacatctccgtcggtgagagtggagatcgtctcaccagagcctccaaggtcttggaacagttgagtggccagactcctgttttctccaaagcgagatacactgttcgttctttcggtatcagacgtaacgagaagattgcttgctacgtcaccgtcaggggagacaaggcaatgcaactccttgaaagtggactcaaggttaaagagtatgagctcttgagaaggaactttagcgacactggttgcttcggtttcggtattcaggagcacattgatttgggtatcaagtatgacccgtcgactggaatctacggtatggatttctatgttgttcttgagcgtcctggttaccgtgtggcgcgtcgcagaagatgcaaggctcgtgttggtatccagcacagagtcaccaaagatgatgccatgaaatggttccaagttaagtatgaaggagtcatcctcaacaagtctcagaacattactggttgaaaccatctgtctcgaacagagatctataaactgtgtttttgtttgtcccctcggctcgaatcttgttttgttttgcttttatgttctctatacatttgaatatcattcttgcctctatctacaatgctttcatggctctccagagtttttgattatgaagacagaaatcattttaaccggattagagttcggtttaacgcataaaatgatcgaacaaacgtgaaaacgcgtttttactatgcttacattatttatcataacgaatctttgactatgggtctattttaatactctttacaagacgtgtcgattgtaaattaccttgtacttgtacatcattataatata

SEQ ID NO: 4929 - DNA, 790 bp, Brassica napus
ctttggtacacctgcaggtacccggtccggattcccgggtcgacccacgcgtccgaactctcttctgctccttgaattaaaatggcgtcagagaagaagctctcgaaccccatgagggacataaaggtccagaagcttgttctaaacatctccgttggtgaaagtggtgatcgtctcacccgtgcctcaaaggttttggaacagctcagtggacaaacccctgttttctcaaaggcgaggtacactgtgaggtcttttggtattaggcgtaacgaaaagattgcgtgctacgtcactgttagaggtgacaaggcaatgcaacttcttgagagtggcttgaaagtcaaggagtatgagcttcttaggaggaactttagtgacactggttgctttggattcggtatccaagagcacattgatcttggtatcaagtatgatccatctactggtatctacggaatggacttctatgttgttcttgaacgtccaggataccgtgtggcacgtcgacgtagatgcaaggctcgtgttggtatccaacacagagtgactaaggatgatgcaatgaaatggttccaagtcaagtatgaaggagttatcctcaacaagtctcagaacatcaccggctaaagaaatctttatagatttttgttgattttagctttgtttcgagtttatcttttaaagatttctggatgttaaagacctctttgttgtagtaaaaccttttgtgacgtgtgtggtagaatctataaaatcttcgaaagaaccttggtgaataaaaaaaaaa

SEQ ID NO: 4930 - DNA, 772 bp, Brassica napus
tttatcgcaaccggaatcccaaatggcgtcggagaagaagttatcgaacccaatgagggacataaaagtgcagaagctggtgctcaacatctccgtcggtgagagtggagatcgtctcaccagagcctccaaggtcttggaacagttgagtggccagactcctgttttctccaaagcaagatacactgttcgttcctttggtatcagacgtaacgagaagattgcttgctacgttaccgtcaggggagataaagcaatgcagctccttgaaagtggactcaaggttaaagagtatgagctcttgaggaggaactttagcgacactggttgcttcggtttcggtattcaggagcacattgatttgggtatcaagtatgacccgtcgactggaatctacggtatggacttctatgttgttcttgagcgtcctggttaccgtgtggcacgtcgcagaagatgcaaggctcgtgttgggatccagcatagagtcaccaaagatgatgccatgaagtggttccaagttaaatacgaaggtgtcattctcaataagtctcagaacattactggttagacaacaaaagaaaagatgtctcaaacagagatctttaatctgtgtgttttgtccacctggttcgaatcgtatttcatcagttttgtttttgcttctttgttcttcagacatttgagttttatttatagacctttcttatcttcagtgattgccatcaaaacaggtatagagctaaaacacattccacgatctaatcattta

SEQ ID NO: 4931 - DNA, 761 bp, Brassica napus
gtttccgcaactctctttgcttcttctctcctaactcgactttgatctccttacaatggcgtcggagaagaagctgtcgaacccaatgagggacattaaggtccagaaacttgttctcaacatctccgttggtgagagtggtgatcgtctcactcgtgcctccaaggttttggaacagctcagtggacaaacccctgttttctccaaggcgagatacactgtgaggtcttttggtatcaggcgtaacgaaaagattgcgtgctatgtgactgtgagaggtgacaaggcaatgcagcttcttgagagtggtttgaaagttaaggagtatgagcttcttaggaggaactttagtgacactggttgctttggtttcggtatccaagagcacattgatcttggtatcaagtacgatccatctactggtatctacggaatggacttctatgttgttctcgaacgtccaggataccgtgtggctcgtcgccgtagatgcaagactcgtgttggtatccaacacagagtgaccaaggatgatgcaatgaaatggttccaagtcaagtatgaaggagttatcctcaacaagtctcagaacatcactggctaaaccaaacttcaatctttattgatttttgtttattttagctttgtttcaaagtttcagtttttactattttctggatgttaaagaatttcttgttgtagtaaaaccttttttgacatcagcatggtataatctaaatttccaagaacgttggaagtgt

SEQ ID NO: 4932 - DNA, 829 bp, Centaurea maculosa
cttggcgggggactcattttttgtttctacaccgtttctgcaaatctgttcatccaacaatggcttcagagaggaaacaggcgaatccaatgagggaaatcaaggttcagaagctcgttctcaacatttcggttggagaaagtggagatcgtctcactcgtgctgctaaggttttggagcaactcagtggccaatctccagttttctccaaggcaagatacactgtgaggtcattcgggatcaggcgtaatgaaaagatcgcttgttatgtcaccgttagaggagacaaggctatgcagcttttggagagtggtttgaaggtgaaggagtatgagttgttgaggcgcaatttcagtgacactggatgctttggctttggtatccaggagcacatcgatcttggtatcaagtatgatccttccaccggtatctacggtatggatttctttgtggttttggaacgtcccggttaccgtgttggacgtcgccgtaggtgcaaggctcgtgtcgggatccaacacagagtgaccaaggacgatgccatgaagtggtttcaagtgaagtacgagggtgtcatcctcaacaaatctcaacaaatcggaggctaagtatgtgggtttgtttttgtaaaattttggagttgagtttaaaggtttttacttgccatcaaggattatgagatgaaattgttttgttgtgttttggaccatttgaagaatactagtagtaccagtgtttttttaagtatctatgaagttgtcttttaagattgggaatcacatgccataaaagtagtgagctttgtatggatttacattgattttattgg

SEQ ID NO: 4933 - DNA, 647 bp, Chelidonium majus
ttttcggacctccagttgcaggcagtcatggccgcagagaagaagctctcgaacccaatgagggaaatcaaagttcagaagctcgtcctcaacatctctgtaggtgaaagtggagatcgtctcaccagagcagctaaggtcttggaacaattgagtggtcagtcccctgtattttctaaggctaggtacactgttaggtctttcggaatcaggcgtaacgaaaagattgcttgctatgttaccgtgaggggtgagaaggcgatgcagcttcttgagagtggattgaaggttaaggaatacgagcttttgaggaagaacttcagtgatactggttgctttggattcggtattcaggagcacattgatcttggaattaagtatgatccttcgacaggtatttatggtatggatttctatgtggttttggaacgtcctggatatcgtgtgggtcgtcgccgtaggtgcaaggcgaaggttggtattcaacacagggtcacaaaggatgatgcaatgaagtggttccaggttaaatatgagggtgtcattctcaacaagtcccaaaacatcactggttaattcatagttgtaagacttatatcatttttcaagttgtttgaagcttcaggtgattttttagttgtttttca

SEQ ID NO: 4934 - DNA, 805 bp, Cichorium intybus
tggcgggggccacgtttctgcatctgctcatcaacaatggcttcagagaggaaacaggcgaaccccatgagggaaattaaggttcagaaactcgtcctcaacatttcagtcggagaaagcggcgatcgtctcactcgtgctgccaaggttttggagcaactgagcggccaatcccctgtcttctcaaaggcaaggtacaccgtgaggtcatttggaatcaggcgtaatgaaaaaattgcatgttatgtgaccgttagaggagacaaagccatgcaactattggagagtggtttgaaggtgaaggaatacgaattgttaaggcgcaactttagtgacaccggatgctttgggtttggtattcaagagcacattgatcttggtatcaagtatgatccgtctactggtatctatggtatggatttctttgtggttctagaacgtcccggataccgtgttgggcgtcgccgtaggtgcaaggcgcgtgttgggattcaacaccgtgtgactaaggatgatgcgatgaagtggtttcaagtgaagtatgagggtgtgattcttaacaaatctcaacaaattggaggctagataaaatcttatgtctttttttttgtaaaattttggagtttgcttttaaggttttactatcaaggattatgaggaatgtttgttttgttgtgttttggaccgttttgaaccttagtacaagtttatggtggttttgatcttgttaagactataagttgcagggaatacgaattttattcttgctttcagtataggcaatatacttttcctatatttttgt

SEQ ID NO: 4935 - DNA, 662 bp, Cirsium arvense
agcatcttgtcgccgtaatccttcgcagcaaccaacaatggcttcagagaggaagcaagcgaatccaatgagagagattaaggttcaaaaacttgttctcaatatctccgttggtgaaagtggcgatcgtcttactcgtgctgctaaggttttggagcaattgagtggccaatcgcctgttttttccaaggcaaggtacactgtgcgatcatttgggattaggcgtaacgaaaagattgcatgctatgttactgttaggggagataaagcaatgcaacttttggagagtggtttgaaggttaaggaatacgagttattaagacgtaacttcagtgacaccggctgctttggatttggtattcaggagcacattgatcttggaatcaagtacgatccttcaaccggtatctatggtatggacttctttgttgtcctagaacgccctggttaccgtgttggtcgccgcaggaggtgcaaggctcgtgttggtatccaacatcgagttacaaaggatgatgcaatgaagtggttccaggtgaaatatgagggagtaatcctcaataaatctcaacaaattggagcataaaagtagtagtagccttcagttttcgagtttaacttatgaatttgtactattaatggatgtggctaagatttgattg

SEQ ID NO: 4936 - DNA, 642 bp, Cirsium arvense
ggactccatttcgcttcctaccaccgtttctgcaatctacgcatccaacaatggcttcagagaggaagcaggcgaatccaatgagggaaatcaaggttcagaaacttgttctgaacatttccgttggagaaagcggagatcgtctcactcgtgctgctaaggttttggagcaactgagtggccaatctcctgttttctcaaaagcaagatacactgtgaggtcatttgggatcaggcgtaatgaaaagattgcttgttatgtgaccgttagaggagacaaggctatgcaactattggagagtggtttgaaggtgaaggaatatgagttattgaggcgcaactttagtgacaccggatgctttgggtttggtattcaggagcacatcgatcttggtatcaagtatgatccttctaccggtatctacggtatggatttctttgtggttcttgaacgtcctggataccgtgtgggccgtcgtcgtaggtgcaaggctcgtgttggaattcaacacagagtgacaaaagatgatgcaatgaaatggtttcaagtgaaatatgagggtgtcattctcaacaaatctcaacaaattggaaactaggggggtctctctcttttctttgtgtgtcttcttttttgtaaaa

SEQ ID NO: 4937 - DNA, 686 bp, Cleome gynandra
cagccggagttgtttcgcaaacctaatcccaaatggcttcggagaaaaagctctcgaatccgatgagggacatcaaagtgcagaagctggttctcaatatctccgttggtgaaagcggtgatcgtctcaccagagccgccaaggtgttggaacaattgagcggtcagactcctgttttctccaaggctagatacactgttcgttcttttggtattagacgtaatgagaagatcgcatgctatgtgaccgtaaggggtgagaaggcaatgcaactcctagagagtggactgaaggtgaaggagtatgaacttctgagaaggaactttagcgacaccggttgctttggctttggcattcaggagcacatcgatttgggcatcaagtacgacccatcaacgggaatctacggaatggacttttacgtggttcttgagcggcctggttaccgtgtggcaaggcgtagaaggtgcaaggctcgccttgggatccaacacagagtgacaaaggaggatgccatgaaatggttccaggtcaaatacgaaggtgtcatcctcaacaagtcccagaatatcaccggctaaactcctcacctttaccatcaccgccaatgatgaacctttccattccatttataattatgtgctctttagagttgttctttggtgatttattataaattacaatgc

SEQ ID NO: 4938 - DNA, 927 bp, Cucurbita pepo
tgctcgtggggtcgcaagagagggtagtgacacgcagagacgggggggagcagcagtagcaccaccagcaacacacaagccgcagccgcgtagccacccgccagaacacttcaatggcttcggagaggaagttatcgaacaccatgagggatattaaggtgcagaagctcgttctcaatatctcagtcggtgagagtggagatcggcttacaagagctgccaaggtgctcgaacaactaagcggccagagccctgtgttctctaaggcgagatacactgtgcgttcatttggaatcagacgtaatgagaagattgcttgctatgtcaccgttagaggcgagaaggctatgcagcttttggaaagtgggttgaaggttaaggagtacgagttgcttcgcaggaacttcagtgacactggatgctttggctttggtattcaagaacacattgatcttggaatcaagtacgatccatccaccggtatctacggtatggacttcttcgttgtcttggagcgaccaggataccgtgtggggcgtcgcaggaggtgcaagtctcgtgtcgggatccagcaccgggtcacgaaggaggacgccatgaagtggttccaggtgaaatacgagggagttattcttaacaagtctcagcaactcactggttaagtttcagagggatttctcaaatagatggagagttatttagtgtgcaagttataaaattttgtgcttttaccattagcctgactgaagctctttattattgtttttttctttggatatttttcggctttaatgaaagattattagaatcaatttgagagacaaaaaaaaaaaagaaaaaaaagtaactactagtcgtgatacactgcttactgagactgaccgaaggacacacgacgggagtagggtggtagctaggtagtgtacg

SEQ ID NO: 4939 - DNA, 819 bp, Cynara scolymus
  misc_feature (796)..(797): n is a, c, g, or t
  misc_feature (809)..(809): n is a, c, g, or t
  misc_feature (817)..(817): n is a, c, g, or t
ggggaccatttcgcttccccaccgtttctgcaatctgctcatccacaatggcttcagagaggaagcaggcgaatccaatgagggaaatcaaggttcagaaacttgtgctgaacatttcggtgggagaaagcggagatcgtctcactcgtgctgctaaggttttggagcagctgagcggccaatcccctgttttctcgaaggcaagatacactgtgaggtcatttgggatcaggcgtaatgaaaagatcgcttgttatgtcactgttagaggtgacaaggctatgcagctcttggagagtggtttgaaggtgaaggagtacgagttgttgaggcgcaattttagtgacacaggatgctttggctttggtattcaggagcacatcgatcttggtatcaagtatgatccatctacgggtatctacggtatggatttctttgtggttctggaacgtcctggttaccgtgttggacgtcgccgtaggtgcaaggctcgtgttgggattcaacacagagtgaccaaggatgatgcaatgaaatggtttcaggtgaaatacgagggtgtgatcctcaacaaatctcaacaaattggagcctaggtgtgtgttctttttgtaaaattttggagttgagtttttaaaattttaccaacaaggatcatgatgatattgttttgttgtgttttggaccattttgaatactagtagtaccagtgtttttaagttcttatggtgtttgtgttttacacaaagagttattgttgactcataaagtagtatgcttatatatcagtatgatnntagcatacatcngtctgatnca

SEQ ID NO: 4940 - DNA, 743 bp, Cynara scolymus
  misc_feature (22)..(23): n is a, c, g, or t
  misc_feature (77)..(77): n is a, c, g, or t
  misc_feature (79)..(79): n is a, c, g, or t
  misc_feature (698)..(698): n is a, c, g, or t
  misc_feature (712)..(712): n is a, c, g, or t
gcggggcgtaaccttccagcannatggcttcagagaggaagcaatccaatccaatgagagagattaaggttcaaaancntgttctcaacatctccgtcggtgaaagtggcgatcgtctcactcgtgccgccaaggttttggagcaattgagtggtcaatcgcctgttttttctaaggcaaggtacaccgtacggtcatttgggattaggcgtaatgagaagattgcatgctatgttactgttaggggagataaagcaatgcaacttttggagagtggtttgaaagtgaaggaatacgagctattaagacgtaacttcagtgacaccggctgctttggatttggtattcaagagcacatcgatcttggaatcaagtatgatccttcaacaggtatctatggtatggacttctttgttgtcctagaacgtcctggctaccgtgttggtcgtcgccgcaggtgcaaggcccgtgttggtatccagcatcgagttacaaaggacgatgcaatgaagtggttccaggtgaaatacgagggagtaatcctcaataaatctcaacaaattggaggatagaagtagtagccttcatttttcgactcgacttatgaatttgtactatgaatggatgtggctgagattcgattgggtcgtctttttcggtgtaatcggaatattattttttttaaacaattttgctgntagcttggttgtangtgcaacccgttaaggaccgatgagtttgat

SEQ ID NO: 4941 - DNA, 950 bp, Cynara scolymus
  misc_feature (9)..(9): n is a, c, g, or t
  misc_feature (15)..(15): n is a, c, g, or t
  misc_feature (47)..(47): n is a, c, g, or t
  misc_feature (219)..(219): n is a, c, g, or t
  misc_feature (831)..(831): n is a, c, g, or t
  misc_feature (858)..(858): n is a, c, g, or t
  misc_feature (872)..(873): n is a, c, g, or t
  misc_feature (882)..(882): n is a, c, g, or t
cggggcctnattttnctcctgcttttcatatccctcccgccgccgtnctcatccgtaactacgatggcttcagagaggaagcaagcgaatccaatgagggagattaaggttcagaaactggttctcaacatctccgttggtgaaagtggtgatcgtcttacccgcgctgccaaggttttggagcaactgagtggccagtcccctgtgttttccaaggcnaggtacactgtgaggtcgtttgggattaggcgtaatgaaaagattgcatgctatgtcactgttagaggggataaggcaatgcagctcttggagagtggtttgaaggtcaaggaatacgagcttttgaggcgcaactttagtgataccggctgctttggttttgggattcaggagcacatcgatcttggtatcaagtatgatccatcgaccggtatctatggtatggacttctttgtcgttctagaacgcccaggataccgtgttggccgccgccgtaggtgcaaggcccgtgttggtatccaacatagagttacaaaggatgacgcaatgaaatggttccaggtgaagtatgaaggagttatcctcaacaaatcccaacaaattggagcatagacttctttacggtaagcgttttctagcggtcttaactttgaatccgtatcttgattaggctcaccggagatttttacattcattttgttttcgctggtgatcttctcttgttatagtagtttttttaggcaagatatcatggaaccttctctgtttttggtcagatgttttttattagtatcttttgacatgcagatatgattttgttggtgttatatnttgcatcatgatatgagagatacgatnttaccctacctgcnngtgtgatanacaccgagatagagcccgtttgtcttcccaaaacatgtgaaataattgtacttaattttttttttaaa

SEQ ID NO: 4942 - DNA, 859 bp, Cynodon dactylon
caaaaccctgcccccacttctgctgcctctccgccgccgtctctgctcgctggatccgccatggcgtcagagaagaagcagtccaaccccatgcgggagatcaaggtgcagaagctcgtgctcaacatctccgtcggcgagagcggagatcgcctcacccgtgccgctaaggtgttggagcagctgagtgggcagtccccagttttttccaaggcgaggtacactgtgaggtccttcggcatcaggcgtaatgagaagatcgcatgctacgtcaccgtcaggggagagaaggcgatgcagcttcttgagagtgggctgaaagtgaaggagtacgagctgctgaggaggaacttcagtgatactggatgctttgggtttggtatccaggagcacattgaccttggcatcaagtatgacccatcaactggtatttatggtatggacttctatgttgttcttgagcgtgctggataccgtgttgctcgccggcgcaggtgcaagtcccgggtgggcatccagcacagggttaccaaggaagatgccatgaagtggttccaggtcaagtatgagggtgtcatcctcaacaagtcccaagcaaacaccacataatcatcgagagcaaacctttgtgctttagatctcctgttaagtttaatccactccatggaattgtatgtttgtgggataccatatgcacttttgccgctgttggaattgatcttctgcatctgtaattccatcttatctcagacaagaatctatcagacagctagcatttccttctcccactgttagccagaactatggaaagggtatattatggttagaaaatggtggggggtgaaagttacaaaaaaaa

SEQ ID NO: 4943 - DNA, 821 bp, Cynodon dactylon
ccggggggccgccatctcattcgcctgccgccgcagccgccgccgccgccgccgatgaagaagagggtccgggcgtctcctgccatggcgtccgagaagaagcagtcgaacccgatgcgggagattaaggtgcagaagctcgtcctcaacatctctgtcggcgagagcggtgaccgcctcacccgcgccgccaaggtgctggagcagctcagcggccagtccccggtgttctccaaggcgaggtacacggtgcggtccttcggcatcaggcgtaacgagaagatcgcgtgctacgtgaccgtgaggggcgagaaggcgatgcagctgcttgagagcggcctcaaggtcaaggagtacgagctgctcaggaggaacttcagcgatactggatgcttcggtttcggcatccaggagcacattgacctcggcattaagtacgacccatcgacaggtatctatggaatggatttctacgttgtacttgagcgcgctggctaccgtgtcgcacgtcgcaggaggtgcaagtcccgtgttggtatccagcacagggtaaccaaggaggatgccatgaagtggttccaggtgaagtacgagggagtcatcctcaacaagtcccaggctaacacatcttaaaatcttgcagctgtgttagaaccctgtgttccatgtgaaagcaagatcaccttgcaagtttttgttcattttgtactctctgagcagatgtttagccagtgttacaaagcatgacctgaattcatattttgttgctcttgccgtgatctttgctgttgtgtgaaaaaaagcatgattagtctgattaa

SEQ ID NO: 4944 - DNA, 711 bp, Taraxacum officinale
gggggctctgcttcttttccaccatctccaccgccggtcattctcagcagcaatggcttcagagaggaagcaagcgaatccaatgagagagatcaaggttcagaaactcgtcctcaacatctccgtcggcgagagcggagatcgtctcactcgcgctgccaaggtgttggagcaactcagtggccagtcccccgtcttttccaaggcaaggtacacagtgaggtcatttggaattaggcgtaatgagaagattgcatgctacgtaactgttagaggagacaaagcaatgcagcttttagagagtggattgaaagtgaaggagtatgaacttctcagacgcaactttagtgacactggttgctttggatttggtattcaggaacatatcgatcttggtatcaagtatgatccctcgactggtatttatggtatggacttttttgtggttcttgagcgcccgggttaccgtgtgggccgtaggcgtaggtgcaaggcccgtgttgggatccaacatagagttacaaaagatgatgcaatgaagtggtttcaggtcaaatacgagggagttattctcaacaaatctcaacagattggaggataatttcttctttttggttttattttgtattgttgagtttaattactattgtatgtgcttgacgaatcttaatattgctcagaatatcaaacttttaggcaacaaaatcgatg

SEQ ID NO: 4945 - DNA, 739 bp, Taraxacum officinale
cgtttctgcatccgctcatccaacaatggcgtcagaaaggaagcaggcgaacccaatgagggaaattaaggttcagaaactcgtcctcaacatctcagtcggagaaagtggcgatcgtctcacccgtgctgccaaggttttggagcaactgagcggccaatcccctgtcttctcaaaggcaaggtacactgtgaggtcatttggaatcaggcgtaatgagaaaatcgcatgttacgtgactgttagaggagacaaagctatgcaactattggaaagtggattgaaggtgaaggaatacgagttgttgaggcgcaactttagtgacactggatgctttggattcggtatccaagagcacatcgatcttggtatcaagtatgatccgtctactggtatctatggaatggatttctttgtggttctagaacgtcccggataccgtgttgggcgtcgccgtaggtgcaaggcccgtgtcgggatccaacaccgtgtcactaaagatgatgccatgaaatggttccaagtgaaatatgagggtgtcattctcaacaaatctcagcaaattggaggctagatttattatgtcttcttctctttgtaaaattttggagtttggtttattaagatttactgttgaggattattatgattaatttttgttttgttgtgttttggaccctttttaatatcagtgcaagtttttaatcttattcggtatgtttgctacaaaaaaaaaaaa

SEQ ID NO: 4946 - DNA, 846 bp, Epimedium sagittatum
ctacaaagcaaacagaaccctacttctcattttctagggttttcattctccttctctgtcttccgcttcctctctcaaccatccccaactgagaagccatggcatcagagaagaagctcgcaaacccaatgagggacatcaaagtccagaagctcgttctcaatatctccgtgggcgagagcggagatcgacttaccagagcctctaaggtgttggaacagctcagtggacaagccccagtgttctcaaaagctaggtacactgtgcgatcttttggaatcaggcgtaatgagaagattgcttgctacgttactgtcagaggtgataaggcaatgcaacttcttgagagtgggttgaaggtgaaggagtatgaactgttgaggaggaactttagtgagactggatgtttcggttttggtattcaggagcacatcgatcttggaatcaagtatgacccttcaacaggcatttacggtatggacttctatgtcgttcttgagcgccctggataccgtgttggtcgtcgtcgtaggtgcaagtctcgtgttgggatccagcacagagtcaccaaggaggatgcaatgaaatggtttcaggtcaaatatgagggtgtcatcctcaacaagtcccagaacatcacaggatagaaataggaatttcctgtttatcgttgcagttgtctaagttttgaactggtaaacctagtgttcaatttttgtttttattatctagaaatggatttggtgttatattttttatctgaaggcaaatttggcacaagtagttgtagaattatattttgtttgataaattaaaggttgtgtgatctatattgatgcgaaaaaa

SEQ ID NO: 4947 - DNA, 783 bp, Eschscholzia californica
cttcacttccattgcaaaccctaactgctgcaaccttcgtcgacgacagccatggcttcagagaagaagctcttaaaccctatgagagacatcaaagtccagaagcttgttcttaacatttccgttggtgaaagtggagatcgtctcacaagagccgccaaggttttggaacaattgagtggtcaaagccctgtattttccaaagctaggtacactgttagatcttttgggattaggcgtaatgaaaagattgcttgctatgttactgttagaggtgagaaagcaatgcaacttcttgaaagtggattgaaggttaaggaatacgagctcttgagaaggaacttcagtgacactggttgtttcggattcggtatccaggaacacattgatcttggaattaagtatgatccttcaacaggtatttatggtatggacttctatgttgttttggaacgtcctggttaccgtgttggtcgtcgccgtaggtgcaagtcaagagttggaattcagcacagagtcactaaagatgatgcaatgaagtggttccaagtcaaatatgagggagtcatcctcaacaaatctcaaaacatcaccggttaatcgtatgaccggtgtatctgtttcaagttaatgagagttcggatgacattttagttgtttactgtaggcgcttcagactttttcttttttcctatttttcttcaagagaatttcgagattttggtgttcatctgatgatggttgactataaagttagattatttgtcatgaaatgaatttgct

SEQ ID NO: 4948 - DNA, 918 bp, Linum usitatissimum
ccgaaactcagcaacggtggcagctctcagatttctcctccagaagcagcatccgtgaagaagctctccaatggcggccgagaggaagcttagtaaccctatgagggaaatcaaggtccagaagctggtcctcaacatatccgtcggcgagagcggcgatcgcctcaccagagctgctaaggtgttggaacaactcagtggacagacccctgtcttctccaaagcaaggtacactgttaggtcctttggtatcaggcgtaatgagaagattgcctgctatgtcactgtgagaggagacaaggcgatgcaactgttggaaagtggattgaaggtgaaggagtacgaactcctcaggaggaactttagcgatactggatgctttgggttcggtattcaggagcacattgatttgggtatcaagtacgatccttccactggtatttacggaatggacttctttgtcgtcctcgagcgacctgggtaccgtgttgcccgtcgccgtaggtgcaaggcccgcgttggtattcaccagagggtaaccaaggatgatgccatgaagtggttccaggtcaaatatgaaggagttatcctcaacaaggctcagaacattactggttaaattcaaagctgctagttgaaccccttttatttagcttaaaccccgagaccctaaattttgagacttgttatgtttgtatgaaattgtgtttcaacttggttgtgtgatcattccccgtcagttttcatttgattgaagggaacttgttcgatctttgcttcatctctgtgatgctgagtttcggtcttctttcgagcacttgtttagtaataattagcgttaaagtagttaatctgtactaatacaaacatggagcggcttgcctcgaaagtccgcaaggacccgactatgtcgatgtt

SEQ ID NO: 4949 - DNA, 809 bp, Linum usitatissimum
gatcaccgaaactcagcaacggcggcagctctaagatttctcctacagaagcagtataagctcttccaatggcggccgagaggaagcttagtaaccctatgagggaaatcaaggtccagaagctggtcctcaacatatccgtcggcgagagcggcgatcgcctcaccagagctgctaaggtgttggaacaactcagtggacagacccctgtcttctccaaagcaaggtacactgttaggtccttcggtatcaggcgtaatgagaagattgcttgctatgtcactgtgagaggagacaaggccatgcaactgttggaaagtggattgaaggtgaaggagtacgaactcctcaggaggaactttagcgatactggttgcttcgggttcggtattcaggagcacattgatttgggtatcaagtatgatccttccaccggtatctatggtatggacttctttgtcgttctcgagcgacctgggtatcgcgttgcccgtcgccgtaggtgcaaggcccgcgttggtattcaccagagggtaaccaaggatgatgccatgaagtggttccaggtcaaatatgaaggagttatcctcaataaggctcagaacattactggttaaattcaaagcctgctagtagaacccccttttatttagcttaaaccccgagaccctaaattttgagacttggttaagtttgtatgaaattgtgttttgacttggttgtgatcattccctgtttgctttcattttgatagaagggaacttgttcgatcttgccttccatctctgtgatgccgagttttcatctcc

SEQ ID NO: 4950 - DNA, 850 bp, Linum usitatissimum
acagagcggcggcaaggagcaaaatcgcctcttctccagtcatcctcaccaagaagctccccaatggcggcagaaaggaagctgagtaaccccatgagggaaattaaggtccagaagctcgtcctcaacatctccgtcggtgagagcggcgatcgtctcaccagagccgccaaggtgttggaacagctcagtggacagacccctgtcttctctaaagctaggtacactgttaggtcttttggtatcaggcgtaacgaaaagattgcttgctatgtcactgtgagaggtgagaaggcaatgcaactcttggagagtggattgaaggttaaggagtacgaattgctcagaaagaacttcagtgacactggctgctttgggttcggtatccaggagcacattgatcttggcatcaagtacgatccctccactggtatctacgggatggacttctttgtcgtgcttgagcgtcctggataccgtgttgccaggcgccgtaggtgcaaggcccgtgtcggaattcaccagagggttacaaaggaggattccatgaagtggttccaggtcaagtacgagggtgttatccttaacaaggcccagaacatcactggttaagtactgcctgctagagtttgggcgaacctggatcttcttttttggtttctgttacttagagacggattctgttagctgtagtagtaaaacttcgaattctcgatatactgcttgttcggttcgtgtcatcgttggtagcattgcagactatgctatcctgtttttgtttaattggaatcagaatttttattagtttacgttctttgtgctttcctgttatgtaaattggtggtgatgt

SEQ ID NO: 4951 - DNA, 877 bp, Linum usitatissimum
gactctgaacgcacatagcggcgacaaggagcaaaatcacctcttctccagtcaccctcacacagaagctccccaatggcggcagaaaggaagctcagtaaccccatgagggaaattaaggtccagaagttggtcctcaacatctccgtcggtgagagcggtgatcgtcttaccagagcagccaaggtgttggaacagctcagtggacagacccctgtcttctctaaagctaggtacactgttaggtcttttggtatcaggcgtaacgaaaagattgcttgctatgtcactgtgagaggtgagaaggcaatgcaactcctggagagtggattgaaggttaaggagtatgaattgctaagaaagaacttcagtgacactggctgcttcgggtttggtatccaggagcacattgatcttggcatcaagtacgatccctccactggtatctacgggatggactttttcgtcgtgcttgagcgtcctggataccgtgttgccaggcgccgtaggtgcaaggcccgtgtcggaattcaccagagggttacaaaggaggattccatgaaatggttccaggtcaaatacgagggtgttatcctgaacaaggcccagaacatcactggttaagtcctgctgccagagtttggccaaacccggatctttttttcttggttgctgttatgtagaccgattctgttagctgtagtagtaaaacttcaaattttcgatatactccttgtttggtttgtgttatcgttggtagcattgcagactatgctatcctgtttttgtttaattggaatcagaatttttattagtttacgttctttgtgctttcctgttttgtatcgaaatataacccggagccccgacttttttt

SEQ ID NO: 4952 - DNA, 612 bp, Actinidia deliciosa
  misc_feature (47)..(47): n is a, c, g, or t
  misc_feature (452)..(452): n is a, c, g, or t
attttctctcacctgtcgcactgcccacacctgcagcttcagcctcntccaacgaacagccatggcatcggagaagaagctattgaacccgatgagagagatcaaggtccagaagctcgtcctcaacatctccgtcggtgagagtggagatcgcctcacaagagccgctaaggtgttggagcaactcagtggccaaacccctgtattctccaaagcgaggtatactgtgcgatcatttgggatcaggcgtaatgagaagattgcttgctatgtcactgtcagaggtgagaaggcaatgcaacttctggagagtggattgaaggtgaaggaatatgagctgctccgaaggaacttcagtgataccggctgctttggctttggtattcaggagcacattgatctcggaattaagtatgatccttcaactggcatttatggtatggatttctacnttgtcttggagcgccccggctaccgtgttggacgtcgccgtaggtgcaagtcccgtgttggaattcagcacagggtcaccaaggaggatgccatgaagtggttccaggtcaaatatgaaggtgtgatcctgaacaaggcccagaatcttacatcttaggt

SEQ ID NO: 4953 - DNA, 672 bp, Parthenium argentatum
ggcttcagaaagaaaacaagcaaacccaatgagagagatcaaggttcagaaacttgttcttaacatctctgttggtgagagtggagatcgtctcacccgagctgccaaggttttggagcaattgagtggtcagtcccctgttttctccaaggcaaggtacaccgtgagatcatttggcatcaggcgtaacgagaaaattgcttgctatgtaaccgttagaggtgacaaagcaatgcagcttctggaaagcgggttgaaagtgaaagaatacgagttgctgagacgtaactttagtgacacaggctgctttggatttggtatccaagaacatattgatcttggtatcaaatatgatccttctactggtatttatggtatggactttttcgtggtactagaacgccctggttaccgtgtgggtcgtagacgcaggtgcaaggcgcgtgttggtattcaacatagagttacaaaggaagacgcaatgaagtggtttcaggtgaagtatgagggagtcattcttaacaaatctcaacaaatcggagcttaaaaatagtttttgattagctgaggtgactctgaagtttgtgcggggtgtgagtgcgtgttcaggatattatttctattactctgtcttttgtgcgtgtcgaactatattagcagtgaaaaaatatg

SEQ ID NO: 4954 - DNA, 979 bp, Phalaenopsis aphrodite
tttcccctcccaatctcactccacccaatcaatgggcagccacaacaccaacgccgatggccctagcgacgacgaggccgcctgcctctacgcgatgcagctcatcagcttctccgtactccccatgaccctcaaagccgccatcgaactcaaacttttggaaaccatcacccttgccggccccggtgctctgctctccccagccgaaatcgcctgtttcgttcgctcttctctccttcgaaattcagcaatggcatcggagaaaaagctttccaatcccatgcgagagatcaaagtgcagaagctcgtgctgaacatctcagtgggggagagcggtgatcgtctcacgagagctgcgaaggtgctcgaacaattaagtggacaaattcctgtgttctctaaagcaaggtacactgttcgatcatttggaatccgtcgcaatgaaaaaattgcgtgctatgtcactgttagaggtgaaaaggcaatgcaactccttgagagcggtttgaaggttaaggagtacgaacttttgaggaggaacttcagtgatactggatgctttggatttggcattcaggagcacatcgatcttggaattaagtatgatccttcaactggcatttatggtatggacttttatgtcgtgctggagcgacctggttaccgagtgagccgtcgacgccgctgtaagtcacgactcggcgttcagcaccgagttactaaagaagatgccatgaaatggtttcaggtcaagtatgagggtgtcatcctcaacaagtctcaagccatcaccaatgcttgataagatattattctctttgcctcttaagtttccctctgcttatttcataaaactggagcgaagttagttaaatggatggttttgtttttggattttattcgtcagcttttttcatgtcgtctgaagctgtcttttttttcattcttcttcattgttttcaacttgttgggtgatttt

SEQ ID NO: 4955 - DNA, 781 bp, Raphanus sativus
ggagctttcgtttccgcaactctctttacttcttctcttctacctcgactctgatctctttacaatggcgtcggagaagaagctgtcgaaccccatgagggacattaaggtccagaaacttgttctcaacatctctgtgggtgagagtggtgatcgtctcactcgtgcctccaaggttttggaacagctcagtggacaaacccctgttttctccaaggcgagatacactgtgaggtcttttggtatcaggcgtaacgaaaagattgcgtgctatgtcactgtgagaggtgacaaggctatgcagcttcttgagagtggtttgaaagttaaggagtatgagcttcttagaaggaactttagtgacactggttgctttggattcggtatccaagagcacattgatcttggtatcaagtatgatccatctactggtatctacggaatggacttctatgttgttctcgaacgtccaggataccgtgtggctcgtcgccgtaggtgtaaggctcgtgttggtatccaacacagagtgaccaaggatgatgcaatgaaatggttccaagtcaagtatgaaggagttatcctcaacaagtctcagaacatcactggctaaaccaaacttcaatctttattgatttttgtttattttagttttatttcaagtttcaatctttacgactttctggatgttaaagaattttttgttgtactaaaacctttgttgacatcagcatggtataatctgaatttcccagaacgttggcagtgtttttaccttttc

SEQ ID NO: 4956 - DNA, 774 bp, Raphanus sativus
actcttctttgctcacctccctcaattttgaatcccttaatcgcaaagatggcgtcagagaagaagctgtcgaaccctatgagggacatcaaggttcagaagctcgttctcaacatctctgttggtgagagcggtgatcgtctcacccgtgcctccaaggtgttggaacagctcagtggtcaaacccctgtcttctccaaggcgaggtacactgtgaggtctttcggaatcaggcgtaacgagaagattgcttgctacgtcaccgtgagaggagacaaggcgatgcagcttctcgagagcggcttgaaagtcaaggagtacgagctgttgaggaggaacttcagtgacactggctgctttgggttcggtatccaggagcacattgatcttggaatcaagtacgatccttccaccggtatctatggaatggacttctacgttgttcttgaacgtcctgggtaccgtgtcgcacgtcgccgtaggtgcaagactcgcgttgggattcaacatagagttacaaaggatgatgccatgaagtggttccaagttaagtacgaaggagttatcctcaacaagtctcagaacatcactggctgaagaagtttgtttctattttgttttgttttgtggtgttagcctctctctctcagaccatcgctgttgggatctcttgttttttttttgtacttcagttggtttagaatctacgtatccagcatgaaccaatttttggaggttatcgttatcaatttcaaacaatctctctgctttaaa

SEQ ID NO: 4957 - DNA, 756 bp, Raphanus sativus
ggctccctcctcgacgcagtcttgtctccgcaactctcttatagctccttgaaatggcgtcagagaagaagctgtcgaaccccatgagggacattaaggtccagaagcttgttctcaacatctccgttggtgaaagtggtgatcgtctcacccgtgcctcaaaggttttggaacagctcagtggacaaacccctgttttctcaaaggcgaggtacactgtgaggtcttttggtatcaggcgtaacgaaaagattgcgtgctacgtcactgttagaggtgacaaggcaatgcagcttctcgagagtggcttgaaagttaaggagtatgagcttcttaggaggaactttagtgacactggttgctttggattcggtatccaagagcacattgatctcggaatcaagtatgatccatctactggtatctacggaatggatttctatgttgttcttgaacgtccaggataccgtgtggcacgtagacgtagatgcaaggcccgtgttggcatccaacacagagtgactaaggatgatgcaatgaaatggttccaagtcaagtatgaaggagttatcctcaacaagtcacagaacatcaccggttaaaaaaaaatcttgttgattttagctttgtttcgtgttcttttatcttttatgatttctggatgttaaagaatttcttgttgtagtaaaacctttttttgacatgtggtagaatctaaaatcttccaagaacgttgacagtgtttttaccttttca

SEQ ID NO: 4958 - DNA, 723 bp, Raphanus sativus
  misc_feature (121)..(121): n is a, c, g, or t
actctctttgctgatcagctccctcgttttctcgcatcccctgaatcctgagatggcgtcagagaagaagctgtcgaacccaatgagggatatcaaggttcagaagctcgtccttaacatntctgttggtgagagtggtgatcgtctcacccgtgcttccaaggtgttggaacagctcagtggtcaaactcctgtcttctccaaggcaaggtacactgtgaggtcattcggtattaggcgtaacgaaaagattgcgtgctacgtcaccgtgagaggagacaaggcaatgcagcttcttgagagtggtttgaaagttaaggagtacgagctgttgaggaggaacttcagtgacactggctgttttggtttcggtatccaggagcacattgatcttggtatcaagtacgatccttctacgggtatctatggaatggacttctatgttgttcttgagcgtcctggataccgtgttgcacgtcgtcgtaggtgcaagactcgcgttgggattcaacatagggttacaaaggatgatgccatgaagtggttccaagttaagtatgaaggtgttatcctcaacaagtctcagaacatcactggttgaagagttttgttttgttttgtcgtgtttggctctgtttaagttgttataatttgcgattctggatttcttgttgtgggaatccttttaagtactctcgagatatgaacaatttttggaggtta

SEQ ID NO: 4959 - DNA, 776 bp, Raphanus sativus
gggactcttctctgctcacctccctcgttgttgaatccattaaccccaaagatggcgtcagagaagaagctgtcgaaccctatgagggacatcaaggttcagaagctcgttcttaacatctctgttggtgagagcggtgatcgtctcactcgtgcctccaaggtgttggaacagctcagtggtcaaacccctgtcttctccaaggcgaggtacactgtgaggtctttcggaatcaggcgtaacgaaaagattgcttgctacgtcaccgtgagaggagacaaggcgatgcagcttctcgagagcggattgaaagtcaaggagtacgagctgttgaggaggaacttcagtgacactggctgctttgggttcggtatccaggagcacattgatcttggaatcaagtacgatccttccaccggtatctatggaatggacttctacgttgttctcgaacgtcctgggtaccgtgtcgctcgtcgccgtaggtgcaagactcgcgttgggattcagcatagagttacgaaggatgatgccatgaagtggttccaagttaagtacgaaggagttatcctcaacaagtctcagaacatcactggttgaacaagtttgtttctattttgttttgttttgtggtgttagcctctgtctcagaccatcgctgttgggatctcttgtttttttttttgtacttcagttggtttagaatctacgtatccagcatgaaccaatttttggaggttatcgttatcaatttcaaacaatctctatgctttaaa

SEQ ID NO: 4960 - DNA, 817 bp, Raphanus sativus
ggactcgcaaccggccgttattagtctgccactcactcgctttgctcagctccctcgttttctcgcatccctgaatcctgagatggcgtcagagaagaagctctcgaacccaatgagggatatcaaggttcagaagctcgtccttaacatctctgttggtgagagtggtgatcgtctcacccgtgcctccaaggtgttggaacagctcagtggtcaaacccctgtcttctccaaggcgaggtacactgtgaggtcgttcggtattaggcgtaacgaaaagattgcgtgctacgtcaccgtgagaggagacaaggcaatgcagcttcttgagagtggtttgaaagtgaaggagtacgagctgttgaggaggaacttcagtgacactggctgttttggattcggtatccaggagcacattgatcttggtatcaagtacgatccttccactggtatctatggaatggacttctatgtggttcttgagcgtcctggataccgtgttgcacgtcgccgtaggtgcaagactcgcgttgggattcaacatagagttacaaaggatgatgccatgaagtggttccaagttaagtatgaaggtgttatcctcaacaagtctcagaacatcaccggttgaagagtttcattttgttttgtggtgttttggctctgtttcaagttgttataatttgcgaatctggatgataaggctttgttgttgtggtagaatccttttaagtactctcgagatatgaacaatttttggaggttatcgttttcaattttagaattctttatctattttaaaaacaagtccaagcca

SEQ ID NO: 4961 - DNA, 835 bp, Raphanus sativus
  misc_feature (193)..(193): n is a, c, g, or t
ggccgcggcgtctccgttatctcttcccgattccacttttcccgtccgtcggagatttcaagcaacccgaatcccaaaaatggcgtcggagaagaagctatcgaacccaatgagagacatcaaagtgcagaagctggtgctcaacatctccgtaggtgagagtggagatcgtctcaccagagcctccaaggtnctggagcagttgagtggtcagactcctgttttctccaaggcaagatacactgttcgttctttcggtatcagacgtaacgagaagattgcttgctacgtgaccgtcaggggagacaaggctatgcaactccttgaaagtggactcaaagttaaagagtatgagctcttgagaaggaacttcagcgacactggttgcttcggtttcggtattcaggagcatattgatttgggtatcaagtatgacccgtcgactggaatctacggtatggacttctatgttgttcttgagcgtcctggttatcgtgtggcgcgtcgcagaaggtgcaaggctcgtgttggtatccagcacagagtcaccaaagatgatgccatgaaatggttccaagtgaagtatgaaggagtcattctcaacaagtctcagaacattactggctaagaccatcctctcaaacagaaggatctataatcatataaatctgtgtgttaatcgtgttttcttagttttgctatttcgtttatcagacacttgggtatcattacctattctacaatgattgcacggattagactttgtgaaattatccaacaaacgcgtttttactttggtttgcttagattatttatcgtaaagaatctttgacca

SEQ ID NO: 4962 - DNA, 809 bp, Raphanus sativus
cgcagcttcgtttccgcaactctctgttagttcgattgttgatctacttcaaatggcgtcggagaagaagctgtcgaaccccatgagggacattaaggtccaaaaacttgttcttaacatctccgttggtgagagtggtgatcgtctcactcgtgcctccaaggttttggaacagctcagtggacaaacccctgttttctcaaaggcgaggtacactgtgaggtcttttggtatcaggcgtaacgaaaagattgcgtgctatgttactgtgagaggtgacaaggcaatgcagcttcttgagagtggtttgaaagttaaggagtatgagcttctcaggaggaactttagtgacactggttgctttggattcggtatccaagagcacattgatcttggtatcaagtatgatccttctacgggtatctacggaatggacttctatgtagttcttgaacgtccaggataccgtgtggctcgtcgccgtaggtgcaaggctcgtgttggtatccaacacagagtgactaaggatgatgcaatgaaatggttccaagttaagtatgaaggagttatcctcaacaagtctcagaacatcactggctaaactaaaacttgaatcttcatagattttttgttgattctagcttttgtttttttttaagttgtcatctttacgatttctggatgtttaagaatcgcttgttctagtaaaacctctttttgaagtcagtggggtagaaattatatttccagaaccttcttttatgtttaccatctatgtcatttaaatttccaagaaccttcttaatcga

SEQ ID NO: 4963 - DNA, 826 bp, Raphanus sativus
ggacttggccgcggcgtctccgttatctctttcgagtccagctttcccgtccgtcggagatttctttctcgcaaccggaatccgaaaatggcgtcggagaagaagctatcgaacccaatgagggacatcaaagtgcagaagctagtcctcaacatctcagtcggtgagagtggagatcgtctcaccagagcctctaaggtgttggaacagttgagtggccagactcctgttttctccaaggcacgatacactgttcgttctttcggtatcagacgtaacgagaagattgcttgctacgtgaccgtcaggggagacaaggcaatgcaactcctcgaaagtggactcaaagttaaagagtatgaactcttgagaaggaactttagcgacactggctgcttcggtttcggtattcaggagcacattgatttgggtatcaagtatgacccgtcgaccggaatctacggtatggatttctatgttgttcttgagcgtcctggttaccgtgtggcgcgtcgcagaaggtgcaaggctcgtgttggaatccagcacagagtcaccaaagatgatgccatgaaatggttccaagtgaagtatgaaggagtcattctcaacaagtctcagaacattactggctaaacaccaaccctctcaaacagaacgatctataatcatattaatctgtgtttttccccggttcgaatcgtgtttttttttagtttttgctatttcgtttatcagacatttgaatatcattgcctaatctacaatgattgcatggatcagactttgtgaaattatccaacaaacgcgtttttactttggtttg

SEQ ID NO: 4964 - DNA, 803 bp, Raphanus sativus
  misc_feature (26)..(27): n is a, c, g, or t
  misc_feature (247)..(247): n is a, c, g, or t
  misc_feature (463)..(463): n is a, c, g, or t
  misc_feature (532)..(532): n is a, c, g, or t
ggccgcggcgtctccgttatctcttnncgattccagttttcccgtccgtcggagatttcaagcaacccgaatcccaaaaatggcgtcggagaagaagctatcgaacccaatgagagatatcaaagtgcagaagctggtgctcaacatctccgtcggtgagagtggagatcgtctcaccagagcctccaaggtgctggagcagttgagtggccagactcctgttttctccaaggcaagatacactgtncgttctttcggtatcagacgtaacgagaagattgcttgctacgtgaccgtcaggggagacaaagctatgcaactccttgaaagtggactgaaagttaaagagtatgagctcttgagaaggaacttcagcgacactggttgcttcggtttcggtattcaggagcacattgatttgggtatcaagtatgacccgtcgactggaatctacggtatgganttctatgttgttcttgagcgccctggttaccgtgtggcgcgtcgcagaaggtgcaaggctcgtgttggnatccagcacagagtcaccaaagatgatgccatgaaatggttccaagtgaagtatgaaggagtcatcctcaacaagtctcagaacattactggctaaaaccatccctctcaaacagaaggatctataatcatataaatctgtgtgttaatcgtgttttcttagttttgctatttcgtttatcagacacttgggtatcattgcctattctacaatgattgcacggattacagactttgtgaaattatccaacaaacgcgtttttactttggtt

SEQ ID NO: 4965 - DNA, 786 bp, Raphanus sativus
caaccggccgttattagtctgccacactctttgctcagctccctcgtttttctcgcatcccctgaatcctgagatggcgtcagagaagaagctgtcgaacccaatgagggatatcaaggttcagaagctcgtccttaacatctctgttggtgagagtggtgatcgtctcacccgtgcctccaaggtgttggaacagctcagtggtcaaacccctgtcttctccaaggcaaggtacactgtgaggtcgttcggtattaggcgtaacgaaaagattgcgtgctacgtcaccgtgagaggagacaaggcaatgcagcttcttgagagtggtttgaaagtgaaggagtacgagcttttgaggaggaacttcagtgacactggctgttttggattcggtatccaggagcacattgatctcggaatcaagtacgatccttctacgggtatctatggaatggacttctatgttgttcttgagcgtcctggataccgtgttgcacgtcgccgtaggtgcaagactcgcgttgggattcaacatagagttacaaaggatgatgccatgaagtggttccaagttaagtatgaaggtgttatcctcaacaagtctcagaacatcactggttgaagagttttgttttgttttgtcgtgttttggctctgtttcaagttgttataatttgcgattctggatgataaggctttcttgttgtggtagaatccttttaagtactctcgagatatgaacaatttttggaggttatcgttttcaattttagaactctttatcta

SEQ ID NO: 4966 - DNA, 790 bp, Raphanus sativus
ggagggtttatatattttgcggcgggcgtctccgttatctctttcagttccaatctttcccgtcggccggagttttatcacaatccgaatcccaaatggcgtcggagaagaagctatcgaacccaatgagggacataaaagtgcagaagctggttctcaacatctccgtcggtgagagtggagatcgtctcaccagagcctccaaggtgttggaacaattgagtggccagactcctgttttctccaaggcacggtacactgttcgttctttcggtatcagacgtaacgaaaagattgcttgctacgttaccgtcaggggagacaaggcaatgcagctccttgagagtggactcaaggttaaagagtatgagctcttgagaaggaactttagcgacactggttgctttggttttggtatccaggagcatattgatttgggtattaagtatgacccgtcgactggaatctacggtatggacttctatgttgttcttgagcgtcctggttaccgtgtggcacgtcgtagaagatgcaaggctcgtgttggaatccagcatagagtgaccaaagatgatgccatgaaatggttccaagttaaatatgaaggagtcattctcaacaagtctcagaacattactggctaaagaaatattgtctgaaacatatatatattgttcgaaccgggttttctcagttttgttttcttctttgaacattttagttttctttatagattttgcctatctacaatgattaccatcaataaatatgattctgcaaaaaaaaaaaa

SEQ ID NO: 4967 - DNA, 753 bp, Raphanus sativus
  misc_feature (737)..(737): n is a, c, g, or t
gggcgtctccgttatcttctctttcagttccaatctttcccgtcggtcggagttttatcgcaatacgaatccaaatggcgtcggagaagaagctatcgaacccaatgagggacataaaagtgcagaagctggtgctcaacatctccgtcggtgagagtggagatcgtctcaccagagcctccaaggtgttggaacaattgagtggccagactcctgttttctccaaggcacggtacactgttcgttctttcggtatcagacgtaacgaaaagattgcttgctacgttactgtcaggggagacaaggcaatgcagctccttgagagtggactcaaggttaaagagtatgagctcttgagaagaaactttagcgacactggttgcttcggttttggtattcaggagcatattgatttgggtattaagtatgacccgtcgactggaatctacggtatggatttctatgttgttcttgagcgtcctggttaccgtgtggcacgtcgtagaagatgcaaggctcgtgttggaatccagcacagagtgactaaagatgatgctatgaaatggtttcaagtgaaatatgaaggagtcattctcaacaagtctcagaacattactggctaaagaaatattgtctgaaacatatatgctcgaaccgggttttctcagttttgttttgttctttagacatttgaattttctttatagatattgcctatctacaatgattaccatcantaaatatgattctaca

SEQ ID NO: 4968 - DNA, 821 bp, Carthamus tinctorius
  misc_feature (770)..(770): n is a, c, g, or t
ggggacattttcgtttctccccgtttctgcatctcttcatccacaatggcttcagagaggaaacaggcgaatccaatgagggaaatcaaggttcagaagctcgttctcaacatttcggttggagaaagtggagatcgtctcactcgtgctgctaaggttttggagcaactcagcggccaatctcccgttttctccaaggcaagatacacggtgaggtcatttgggatcaggcgtaatgaaaagatcgcttgttatgtcaccgttagaggagacaaggctatgcagctcttggagagtggtttgaaggtgaaggagtatgagttgttgaggcgcaattttagtgacactggatgctttggctttggtattcaggagcacatcgatcttggtatcaagtatgatccttccaccggtatctacggtatggatttctttgtggttttggaacgccctggttaccgtgttggacgtcgtcgtaggtgcaaggctcgtgtcgggatccaacacagagtgacgaaggatgatgccatgaagtggtttcaggtgaagtacgagggtgtcatcctcaacaaatctcaacaaattggagcctaagtatgggtttgtttttgtaaaattttggagttgagtttaaagttttacttaccatcaaggattatgagatgatattgttttgttgtgttttggaccatttgaagaatactagtagtaccaatgttttttaagtttctatgcagttgtcttttgaggttgggaattacattccatanaagaaaaacatggtttttgcatggaatcaccttcccacaataaccaaaaag

SEQ ID NO: 4969 - DNA, 846 bp, Carthamus tinctorius
  misc_feature (14)..(14): n is a, c, g, or t
gcggggatcgcctnattttgctcctgcttccatacccccctaccgccgccgtcgccgccatcgccatctccgccgtactcctccgcaaccgcaatggcttcagagaggaagcaagcaaatccaatgagggagattaaggttcagaaactggtgctcaacatctccgtcggagaaagcggtgatcgtcttactcgcgctgccaaggttttggagcaactcagtgggcagtcccctgtcttttccaaggcaaggtacaccgtgaggtcgtttgggattaggcgtaatgaaaagattgcatgctatgtcactgttaggggagacaaggcaatgcagctcttggagagtggtttgaaggtcaaggaatacgagcttttgaggcgcaacttcagtgataccggatgctttggtttcggtattcaggagcacatcgatcttggaatcaagtatgatccatccactggtatctatggtatggacttctttgtggttctagaacgcccgggataccgtgttggacgccgccgtaggtgcaaggcccgtgttggtatccaacatagagtgacaaaggatgatgcgatgaaatggttccaggtcaagtatgaaggagttatcctcaacaaatcccaacaaattggagcctagacatctttacggtaagcgttattgggtgatttttaacgttgaatcagttatcttaattaggctcaccggagatatttacatccattttgttttccggtctctttgttatagtagcttttaggcaaagatatcatggaactctctctgtttttggtcagatgttttctattactattacatgcagatttgattttgttggtgtta

SEQ ID NO: 4970 - DNA, 808 bp, Carthamus tinctorius
  misc_feature (504)..(504): n is a, c, g, or t
  misc_feature (665)..(665): n is a, c, g, or t
ggcgggggggcctcctttttcataaaccctctcctcccaccaatctccaccgccgttatcattctcagcagcaaaaatggcttcagagaagaagctagccaatccaatgagagagattaaggttcaaaaactcgtcctcaacatctccgtcggtgagagcggagatcgtctcactcgagctgccaaggttttggagcaactgagcggccagtcccccgtcttttccaaggcaaggtacactgtgaggtcattcggtatcaggcgtaatgagaagattgcatgctacgtgaccgtgaggggagacaaggctatgcagcttctggagagcgggttgaaggtgaaggagtacgagcttctaagacgcaactttagtgacactggctgctttggatttggtattcaggaacacatcgatctgggtatcaagtatgatccttctactggtatttatggtatggatttctttgtggtgctagaaaggccgggatatcgtgttggtcgtanacgcacgtgcaaggctcgtgttggcatccaacatagagttacaaaggatgatgcaatgaagtggtttcaggtgaaatatgagggagtaatcctcaacaaatctcaacaaattggagcataacttgttttcttctttttggtcaaattcaggtaactgttanaattgtactgcactcaagtgccccagatattttgctttgtttcttgcttctgttgaatcatcttattagtgaaaaacatgtcttttttgaaccactttggtaatttgttttaagtgtggctatgacttcttttgcaaaaaaaa

SEQ ID NO: 4971 - DNA, 723 bp, Salvia sclarea
ctactagaccttggctgtcactcacctgctgttgccgccgtgctctccaccgccatccattccaccgcatcgcaatggccgccgagaagaaattgtcgaaccccatgagggagatcaaggtgcagaagctggtgctcaacatctccgtcggagagagcggagatcgtctcaccagagctgctaaggtgttggagcaactcagtggccaaagtcctgttttctccaaggctagatacacagtccgatctttcgggatcaggcgtaatgaaaagattgcttgctacgtcaccgtgagaggtgataaggcaatgcaactccttgagagtggcttgaaggtcaaggagtacgagctgttgaggaggaacttcagtgaaactggctgcttcgggttcggtatccaagagcacatcgatcttggaattaagtatgacccgtctactggtatctacggtatggacttctacgtcgtcttggaacgccccggttaccgcgtgggtcgccgccgtaggtgcaaggcccgcgttgggatccaacacagggtcaccaaggacgacgcgatgaagtggttccaggtgaaatacgaaggtgtgatcctgaacaaggcctccaacattggagcttagactgagatatcactcctctgaccccttttggatctttatggtttcgtttgtttttatcttttgtttctcaaagttttgtagaatttatcagcagacaggt

SEQ ID NO: 4972 - DNA, 1017 bp, Silene vulgaris
cgagttcgagcatcagcagaaggaactcgaaggagtctgcaacccgatcatcacgaagctctaccagtccgctggcggagccccgccgcccggcggccccggtgcccagggtggagccggcggcggtggcggccagggaccgacgatcgaggaggtcgactaagctcttctctctttgtgctcgcgactctctcctttatccctcctccctcctccatcggcgataacttccaatctcacagaaatggcgtcggagaagaagctagcaaacccaatgagggaaatcaaggtacagaagctggtcctcaacatctctgttggtgaatctggagatcgtctcacccgagctgccaaggtgttggaacaactcagcggacaaactcctgttttctccaaggctaggtacactgtgaggtcttttggtatcaggcgtaatgagaagattgcctgctatgtgactgtaagaggtgagaaggctatgcagcttcttgagagtggtttgaaggttaaggagtatgagctccttagaaggaacttcagtgacactggctgctttggtttcggtatccaagagcatattgatctcggaatcaagtatgatccttccactggtatttatgggatggatttcttcgttgtccttgagcgacctggttaccgtgttggacgtcgcagaaggtgcaaggctcgtgttggtatccagcacagagtgacaaaggatgatgccatgaagtggttccaagtcaaatacgagggtgttatcttgaacaaggctcagaacgtcggttcttaggttagctgcatttgttcttgtctttttagtcttgagtgttgtacctctggttcattggaaaggtaaagactgcactagttgtttgacttatttctctggagattttgtagttttgttccttcgtaattttggatttaacgggattagaattttctctattgttgtgtctgattactgttgatctattattatatattttcccggtgaattttctgttgagtttg

SEQ ID NO: 4973 - DNA, 792 bp, Silene vulgaris
tcgccgctgcttgtaaactctcaaaaatggcgtcggaaaagaagctcgcaaacccaatgagggaaatcaaggttcagaaacttgtcctcaacatttccgttggtgaaagtggagatcgtcttactagagctgccaaggtgctggaacaactcagtggacaaacccctgtcttctccaaggctaggtacactgtgaggtctttcggtatcaggcgtaatgaaaagattgcttgctatgtgactgtaaggggtgagaaggccatgcagctccttgaaagtggattgaaggtgaaagagtatgagttgctaaggaggaatttcagtgacaccggctgctttggatttggtatccaagaacacattgatctcggaatcaagtatgatccttctactggtatttatggtatggacttcttcgttgtcctggagaggcctggctaccgtgttggtcgtcgcagaaggtgcaaggccagagttggtatccaacacagagtgaccaaggatgatgccatgaaatggttccaagtcaaatatgaaggtgtcatcttgaacaaagcacagaacgtcggtgcttaagcttattgcttttcgtctgatctctttgttttcagtatcatagcgttttgtcctcagaagagtcaaactgcttatagctaagaacttgtttttcgacggttttgtagtctatttcactttaccctggattaatggttctacaactttcttcttgtcttagaatggtgttcgtgtatcttggctattcagttgtgtcaattgaaggcgcttcatttta

SEQ ID NO: 4974 - DNA, 932 bp, Sorghum bicolor
ctccaccatccgccgccgccgccgagaacgaggagaagaggatccggccgtttcctcgcccccatggcgtccgagaagaagcagtcgaacccgatgcgggagatcaaggtgcagaagctcgtcctcaacatctccgtcggggagagcggtgaccgcctcacccgcgccgccaaggtgctcgagcagctcagcggccagacccctgtcttctccaaggcgaggtacacggtgcggtcgttcggcatccggcgcaacgagaagatcgcctgctacgtcactgtcaggggcgagaaggccatgcagctgcttgagagcggcctcaaggtcaaggagtacgagctgctcaggaggaacttcagcgacaccgggtgcttcggattcggcatccaggagcacatcgaccttggtatcaagtatgatccatcaacgggcatctatggaatggacttctatgtcgtgctggagcgtgctggctaccgtgttgcgcgccgcaggaggtgcaaggcccgcgttgggatccagcacagggtgaccaaggaggactcgatgaagtggttccaggtcaagtacgaaggtgtcatcctcaacaaggctcaggccaacacggtgtaaaccttagtttgtctaagctccatgcagacgcaagatcaccatgcaaggtttttgttcacattgtattctctgacctgatggtttagtctactactatagcagagctataaaacgccatatgaattatttcagtgcccgtatcatacattcatactctgttctgttgcttgaaaacatgctagtctgatctcctagcgcagcttgtgatctggctcttctttggttagattgctttatttatctgccacacctggtttttgttggcgaatagctgtcacccgatcttgaaaattgaagcgaactgaggggaaggtttctaa

SEQ ID NO: 4975 - DNA, 1004 bp, Sorghum bicolor
aactagggttgctccctttcaacctcgcgccgccaccccccttcatctctcgacgcccatctcctccaccatccgccgccgccgccgagaacgaggagaagaggatccggccgtttcctcgcccccatggcgtccgagaagaagcagtcgaacccgatgcgggagatcaaggtgcagaagctcgtcctcaacatctccgtcggggagagcggtgaccgcctcacccgcgccgccaaggtgctcgagcagctcagcggccagacccctgtcttctccaaggcgaggtacacggtgcggtcgttcggcatccggcgcaacgagaagatcgcctgctacgtcactgtcaggggcgagaaggccatgcagctgcttgagagcggcctcaaggtcaaggagtacgagctgctcaggaggaacttcagcgacaccgggtgcttcggattcggcatccaggagcacatcgaccttggtatcaagtatgatccatcaacgggcatctatggaatggacttctatgtcgtgctggagcgtgctggctaccgtgttgcgcgccgcaggaggtgcaaggcccgcgttgggatccagcacagggtgaccaaggaggactcgatgaagtggttccaggtcaagtacgaaggtgtcatcctcaacaaggctcaggccaacacggtgtaaaccttagtttgtctaagctccatgcagacgcaagatcaccatgcaaggtttttgttcacattgtattctctgacctgatggtttagtctactactatagcagagctataaaacgccatatgaattatttcagtgcccgtaccatacattcatactctgttctgttgcttgaaaacatgctagtctgatctcctagcgcagcttgtgatctggctcttctttggttagattgctttatttatctgccacacctggtttttgttgacgaatagctgtcacccgatcttgaaaattgaagcgaactgaggggaaggtttctaatgtttgtat

SEQ ID NO: 4976 - DNA, 1225 bp, Sorghum bicolor
atcagacagaagcccaaatattcggcttgggttgaacaaagcgcaaaacccatcacatggtcccaaaagcccaaaaaggccaatgaaaagcctatcccagctcccaccaccaccccacctagggtttctcccttttaacctcgcgccgccacccccttcgtctctcgacgcccatctcctcctcaagccgccgccgccgccgccgaaggagaaggaggagaagaggatccggccgtctcatcgccccaatggcgtccgagaagaagcagtcgaacccgatgcgggagatcaaggtgcagaagctcgtcctcaacatctccgtaggggagagcggcgaccgcctcacccgcgccgccaaggtgctcgagcagctcagcggccagacccctgtcttctccaaggcgaggtacacggtgcggtcgttcggcatccggcgtaacgagaagatcgcctgctacgtcactgtcaggggcgagaaggctatgcagctgcttgagagcggcctcaaggtcaaggagtacgagctgctcaggaggaacttcagcgacaccgggtgcttcggattcggcatccaggagcacatcgaccttggtatcaagtatgatccatcaacaggcatctatggaatggacttctatgtcgtgctcgagcgtgctggctaccgagttgcacgccgcaggaggtgcaaggcccgtgttgggatccagcacagggtgaccaaggaggactcgatgaagtggttccaggtcaagtacgaaggtgtcatcctcaacaaggctcaggccaacacggtgtaaaccttagtttgtctaagctccatgcagacgcaagatgttttagtctactatagcagagctataaactgccgaatgaattatttcagtgcccgtatcatactctgtgctgttgcttaaaaacatgctagtctgatctcctagcgcagcttgtgatctggctcttctttggttacattgctttatctgccgcctgcgttttgtgtttttgttgacgaattactgtcacctggtctggaaaattgaagcggactaagggaaggtttctattgtttgtaatgggtatcagcaagcatttgtgtactgtggtctggtttagatcaaattttttttggattttgacattgtagtatttttgtttgtatttggcaattattgtctaacgactaattagtcataaaagattcatctcgtaaattatagacaaattg

SEQ ID NO: 4977 - DNA, 1021 bp, Saccharum officinarum
cttttaacctggcgccgccacccacttcatctctcgacgcccatctcctccaccatccgccgccgccgccgagggagaaggagaagaggatccggccgtctcctcgcccccatggcgtccgagaagaagcagtccaacccgatgcgggagatcaaggtgcagaagctcgtcctcaacatctccgtcggggagagcggcgaccgtctcacccgcgccgccaaggtgctcgagcagctcagcggccagacccccgtcttctccaaggcgaggtacacagtgcggtcgttcggcatccggcgtaacgagaagatcgcctgctacgtcaccgtgaggggcgagaaggccatgcagctgcttgagagcggactcaaggtcaaggagtacgagctgctcaggaggaacttcagcgagaccgggtgcttcggattcggcatccaggagcacatcgaccttggtatcaagtatgatccatcaacaggcatctatggaatggacttctacgtcgtgctcgagcgtgctggctaccgtgttgcgcgccgcaggaggtgcaagtcccgtgtcgggattcagcacagggtgaccaaggaggactcgatgaagtggttccaggtcaagtacgaaggtgtcatcctcaacaaggctcaggccaacacgtcgtaaacctcacctgtgggcaaaacagctgtttgtctcagctccatgcggacgcaagatcaccttgcaaggtttttgttcaatttgtatcctctggcctgatgtttagtgtactagcagagctgaaatcaccttatgaattatttcagtgcccgttgcatactctgtgctgttgcttgaaaacatgttagtctgatctcctagcgcagcttgtgatctggcttttctttggttacatgctttatctgccacctgcgtctcagtttttgttgacgaattactgtcacgtggtctggaaaaatgaatttgaatgagggaacgtttctaaaaaaaaacaccaagaaagggcgtctgctttagaggattc

SEQ ID NO: 4978 - DNA, 752 bp, Helianthus annuus
cgccgccgtactcctccgcatctccaatggcatcagaaaggaagcaagcgaatccaatgagggagattaaggttcagaaactggttctcaatatctccgttggtgaaagtggtgatcgtctcactcgcgctgctaaggttttggaacaacttagtggccagtctcctgtgttctccaaggcaaggtacactgtgagatcttttggcattaggcgtaacgaaaagattgcgtgctatgtcactgttaggggtgacaaggcaatgcagctcttggaaagtggcttgaaggttaaggaatacgagcttttgagacgcaacttcagcgacactggctgctttggttttggtattcaggagcacattgatcttggtatcaagtatgatccatctactggtatctatggtatggacttctttgtggttcttgaacgcccgggttaccgtgtgggtcgcagacgtaggtgcaaggctcgtgttggtatccagcacagagttacaaaggacgacgcaatgaagtggttccaggtgaagtatgaaggagttatcctcaacaaatcccaacagattggagcttagaagacatcgtaagttttcttttggcggttaacgtttgatgtggcttaccagaagttctattacatcaatttttgtgttttcagtcttgcattttgactagttatgttgttattctcttgttatagtggctgtttttaggatggaatttattcaactttgttttgatcagatgtcttt

SEQ ID NO: 4979 - DNA, 792 bp, Tabernaemontana elegans
gttccagctctctccctcgctcgcagtcatggcttccgaaaagaaattgaacaatccaatgagagaaatcaaagtgcagaagctcgtcctaaacatttctgttggtgaaagcggcgatcgtctcacccgtgcagccaaggtgttggaacaattaagtggccaaactcctgtcttctctaaggcaaggtatactgtgcgatcatttggaatcaggcgtaatgagaagattgcatgctatgttaccgtcagaggtgaaaaggcaatgcaacttttggagagtggattgaaagttaaagagtatgaattgctaaggcgaaacttcagcgacactggatgctttggttttggtattcaagagcacatcgatcttgggatcaagtacgatccttctactggtatttatggaatggatttctatgttgttctagagcgtgcaggttaccgggtagctcgtcgcagaaggtgcaaatctcgtgttggaatccagcatagggttacaaaggaggacgcaatgaagtggttccaggtcaagtacgagggggtgatcctcaacaaagctcaaacaattgcatcttagactgtctacatggctggatactggaatactagtttaaaagtttttattttagttttacttgtgtcagagggcagagggttgtctggacctttttcacaaatggttctccctaggaattgaaaatgctgtgaatttttgtttaactaatgatgtgccagcctcttatttctaattcctgcccactgcctcggtggctgagtagctaagattgcatc

SEQ ID NO: 4980 - DNA, 757 bp, Camellia sinensis
tattagggtttcttcctcattttgcctcaccccgtcgcattacccacatctgcctctgcaacctcaacctcaagccatggcttcggagaggaagctatcgaacccgatgagggagatcaaggtccagaagctcgtcctcaacatctccgttggcgaaagtggagatcgcctcaccagagccgctaaggtgttggagcaacttagtgggcaagcccctgttttctccaaagcgagatatactgtaaggtcctttgggatcaggcgtaatgagaagattgcttgctatgtcacagtcagaggtgagaaggcaatgcaactcctggagagtggattgaaggtgaaggaatatgagctgctgcgaaggaacttcagtgaaactggctgttttggctttggtattcaggagcacattgatctcggaattaagtatgatccttccactggcatttatggaatggatttctatgttgtcttagaacgcccgggctatcgtgttgggcgtcgccgtaggtgcaagtctcgtgttggaattcagcacagggtcacaaaggacgatgccatgaagtggttccaggtcaaatatgagggtgtgatcctcaacaagtcccagaatattgggggttagtcttaaacatgtggcatcagttgagttctaagttttgaagtaacctagttttaagtttttggaagttgtgggtatgtttttctgtagactacatgatatattttaccattttcaagagatctgtttcagttg

SEQ ID NO: 4981 - DNA, 736 bp, Thalictrum flavum
tccttcttgcgtctccatcgatcgatctacagccatggcatcagaacagaaactggcaaacccaatgagggatatcaaagttcagaaacttgttctcaatatctctgttggtgaaagtggagatcgtcttactagagccgctaaggtgttagaacagttgagtggacaagcacctgttttctctaaagctaggtacactgttagatcttttggaatcaggcgtaatgagaagattgcttgctatgttactgttagaggtgataaagctatgcagcttttggagagtggattgaaggtcaaagagtatgagctgttgaggaggaactttagtgatactggctgctttggttttggaatccaggaacacatcgatttggggattaagtatgatccttcgactggaatttatggtatggatttctttgttgtcttggaacgtcctggataccgtgtgggacgtcgtcgtaggtgcaagtctcgcattgggatccaacatcgagtgacaaaggatgatgccatgaagtggttccaggtgaagtacgagggtgtgattctcaacaagtcccagaatatcacagggtagtagaaagtttgcaactgtagccatttgtatcttttgcagattaagattactctgttgtttttgctagactagtattatcattattgcaaattttgacttgtgatgataatggctgttttattttacaagactacattgtctgttaaagtgaat

SEQ ID NO: 4982 - DNA, 832 bp, Eutrema halophilum
agaaccctagacgctttattagatctagggtttatatattttttgctgcggcttcaccgttttctctgttgattcgtgctttcccgtcggccggagttttatcgcaacccgaatcccaaatggcgtcggagaagaagctatcgaacccaatgagggacattaaagtgcagaagcttgttctcaacatctccgtcggtgagagtggagatcgtctcaccagagcctccaaggtgttggaacaattgagtggccagactcctgttttctccaaggcacgatacactgttcgttcttttggtatcaggcgtaacgagaagattgcttgctacgtgactgtcaggggagataaggcaatgcaactcctggagagtggactgaaagttaaagaatacgaactcttgagaaggaactttagcgacactggttgcttcggttttggtattcaagagcatatcgatttgggtatcaagtatgacccgtcgaccggaatctacggtatggacttctacgttgttcttgagcgtccgggttaccgtgtggcacgtcgcagaagatgcaaggctcgtgttggaatccagcacagagtgacgaaagatgatgccatgaaatggttccaagtgaaatacgaaggagtcattctcaacaagtctcagaacattactggctaaaaaaatgtctcaaacagagatctattttattatctgttctttttttcccgtttcaaacgtattttatcagttttgtttttgtttctctgatcttcagacatttgaattttctttatagatatattgcctatctacaataattgccatcaacaaatataatttct

SEQ ID NO: 4983 - DNA, 845 bp, Eutrema halophilum
actcgttcatttgcttagaaccctagacgctttattagatctagggtttatatattttttgctgcggcttcaccgttttctctgttgattcgtgctttcccgtcggccggagttttatcgcaacccgaatcccaaatggcgtcggagaagaagctatcgaacccaatgagggacattaaagtgcagaagcttgttctcaacatctccgtcggtgagagtggagatcgtctcaccagagcctccaaggtgttggaacaattgagtggccagactcctgttttctccaaggcacgatacactgttcgttcttttggtatcaggcgtaacgagaagattgcttgctacgtgactgtcaggggagataaggcaatgcaactcctggagagtggactgaaagttaaagaatacgaactcttgagaaggaactttagcgacactggttgcttcggttttggtattcaagagcatatcgatttgggtatcaagtatgacccgtcgaccggaatctacggtatggacttctacgttgttcttgagcgtccgggttaccgtgtggcacgtcgcagaagatgcaaggctcgtgttggaatccagcacagagtgacgaaagatgatgccatgaaatggttccaagtgaaatacgaaggagtcattctcaacaagtctcagaacattactggctaaaaaaatgtctcaaacagagatctattttattatctgttctttttttcccgtttcaaacgtattttatcagttttgtttttgtttctctgatcttcagacatttgaattttctttatagatatattgcctatctacaataattgccatcaacaaatataatt

SEQ ID NO: 4984 - DNA, 872 bp, Eutrema halophilum
gaaaccctagtaccgtcccatataagtcctttcacttcccacttgacgcagtttcggtttcgcaactctctttgcttcctcacttagctcgattttgatccttaagaatggcgtcggagaagaagctgtcgaaccccatgagggacattaaggtccagaaactcgttcttaacatctccgttggtgagagtggtgatcgtctcactcgtgcctctaaggtgttggaacagctcagtggtcaaacccctgtcttctccaaggcgaggtacactgtgaggtcttttggaattaggcgtaacgaaaagattgcgtgctatgtcaccgtgagaggtgataaggcaatgcagcttcttgagagcggtttgaaagttaaggagtatgagcttcttaggaggaactttagtgacactggttgctttggtttcggtattcaagagcacattgatcttggaatcaagtacgatccttcgaccggtatctacggaatggacttctacgttgttcttgaacgcccaggataccgtgtggctcgtcgccgtagatgcaaggctcgcgttggtatccaacacagagtgactaaggatgatgcaatgaaatggttccaagttaagtacgaaggagttattctcaacaagtctcagaacatcactggataaaaaaaaaaaaagtttaaatcttcagagatttttgggtattttagcaattcgtttcaagctgttatctttactatttctgtatctctttttagacatcagttcggtagaatctaaattttccaagaaccttgagatatggttttgttttttctcgaatttgtcgtcttcatcaaaactaaaattaatcaaagcagtttctttgatttttatgttctt

SEQ ID NO: 4985 - DNA, 811 bp, Eutrema halophilum
gtttcggtttcgcaactctctttgcttcctcacttagctcgattttgatccttaagaatggcgtcggagaagaagctgtcgaaccccatgagggacattaaggtccagaaactcgttcttaacatctccgttggtgagagtggtgatcgtctcactcgtgcctctaaggtgttggaacagctcagtggtcaaacccctgtcttctccaaggcgaggtacactgtgaggtcttttggaattaggcgtaacgaaaagattgcgtgctatgtcaccgtgagaggtgataaggcaatgcagcttcttgagagcggtttgaaagttaaggagtatgagcttcttaggaggaactttagtgacactggttgctttggtttcggtattcaagagcacattgatcttggaatcaagtacgatccttcgaccggtatctacggaatggacttctacgttgttcttgaacgcccaggataccgtgtggctcgtcgccgtagatgcaaggctcgcgttggtatccaacacagagtgactaaggatgatgcaatgaaatggttccaagttaagtacgaaggagttattctcaacaagtctcagaacatcactggttaaaaaaaaaaagtttaaatcttcagagacttttggttattttagcaatttgtttcaagctgttatctttactatttctgtatctctttttagacatcagttcggtagaatctaaattttccaagaaccttgagatatggttttgttttttctcgaatttgtcgtcttcatcaaaactaaaattaatcaaagcagtttctttgatttt

SEQ ID NO: 4986 - DNA, 925 bp, Eutrema parvulum
tcgtaaatttgcttagaaccctagacgcttattaagatcagatctagggtttatatatttttgctgcggcaactccgtttcctctttcgattctagctttcccgtccgccggagttttctcgcaactcgaatctcaaatggcgtcggagaagaagctatcgaacccaatgagggacataaaagtgcagaagctggtgctcaacatctccgtcggtgagagtggagatcgtcttaccagagcctctaaggtgttggaacaattgagtggccagactcctgttttctcaaaggcacgatacactgttcgttcttttggtatcagacgtaacgaaaagattgcttgctacgtgactgtcaggggagataaggcaatgcaactccttgaaagtggactgaaggttaaagagtatgaactcttgagaaggaactttagcgacactggttgcttcggtttcggaattcaggagcacattgatttgggtatcaagtatgacccgtcgaccggaatctacggtatggacttctatgttgttcttgagcgtcctggttaccgggtggcacgtcgcagaagatgcaaggctcgtgttggaatccagcacagagtgacgaaagatgatgccatgaaatggttccaagtgaaatatgaaggagtcatcctcaacaagtctcagaacattactggctaggggacaaaaaaagtctcaaacagcgatctataatataatctgtgtttttttttccgggttcaaatcgtattttctcagttttgttttgcttctttgttcttcagacatttgagttctttttatagatattgcctatctacaataattgccatcaacaaatagaagctgagcctaaaaaacatattccatgatgatctaatcatttctcttgtaatcctgaatcggttagatccatcgat

SEQ ID NO: 4987 - DNA, 1085 bp, Eutrema parvulum
tcgtaaatttgcttagaaccctagacgcttattaagatcagatctagggtttatatatttttgctgcggcaactccgtttcctctttcgattctagctttcccgtccgccggagttttctcgcaactcgaatctcaaatggcgtcggagaagaagctatcgaacccaatgagggacataaaagtgcagaagctggtgctcaacatctccgtcggtgagagtggagatcgtcttaccagagcctctaaggtgttggaacaattgagtggccagactcctgttttctcaaaggcacgatacactgttcgttcttttggtatcagacgtaacgaaaagattgcttgctacgtgactgtcaggggagataaggcaatgcaactccttgaaagtggactgaaggttaaagagtatgaactcttgagaaggaactttagcgacactggttgcttcggtttcggaattcaggagcacattgatttgggtatcaagtatgacccgtcgaccggaatctacggtatggacttctatgttgttcttgagcgtcctggttaccgggtggcacgtcgcagaagatgcaaggctcgtgttggaatccagcacagagtgacgaaagatgatgccatgaaatggttccaagtgaaatatgaaggagtcatcctcaacaagtctcagaacattactggctaggggacaaaaaaagtctcaaacagcgatctataatataatctgtgtttttttttccgggttcaaatcgtattttctcagttttgttttgcttctttgttcttcagacatttgagttctttttatagatattgcctatctacaataattgccatcaacaaatagaagctgagcctaaaaaacatattccatgatgatctaatcatttctcttgtaatcctgaatcggttagatccatcgatgttccgacacgatacactgttcgtttttttttgagtttactctgtttttttctttttaacgaataagagttaactatattggaatgtgatccaactggatattacatttaacttataaagagtacgtgaaaattattgaacaaaggcgaaaagcattttt

SEQ ID NO: 4988 - DNA, 1051 bp, Eutrema parvulum
ccattagacttcaagaaaccctagttccgtcccatataactcatttcacttcccaactcgacgcagctttcgtttccgcaactctctttgctctctcctctcttttagctcgattttgatctccttaaaatggcgtcggagaagaagctctcgaaccccatgagggacattaaggtccagaaacttgttctgaacatctccgttggtgagagtggtgatcgtctcactcgtgcctccaaggttttggaacagctcagtggccaaacacctgttttctccaaggcaaggtacactgtgaggtcctttggtattaggcgtaacgaaaagattgcgtgctatgtcactgttagaggtgataaggcaatgcagctacttgagagtggcttgaaagttaaggagtatgagcttcttaggaggaactttagtgacactggttgctttggattcggtatccaagagcacattgatcttggaatcaagtatgatccttctaccggtatctacggaatggacttctacgttgttctcgaacgtccaggatatcgtgtggctcgtcgccgtagatgcaaggcccgtgttggtatccaacacagagtgactaaggatgatgcaatgaaatggttccaagtcaagtatgaaggagttatcctcaacaagtctcagaacatcactggctaaatataactttaaatccttcaaagatttttgttgattttagctttgtttcaagttgttatctttacgatttctggatgttaaagagtttcttgttgtagtcaaacctttttttgatatcagtatggtagaatctaaatttccaagaaccttggagatatgatttttctttttctcgaatttactgtcttcatttaccattaatcaaagcagctcctttgacttgtatgttctttgagctctgcaacttaattatctccacagcgagaagttacaattgtcctgagagatttgagaattggttttcacaattgttcttttagtgagttattttggtggattgattgttgaacattcgagcattcgagagacttga

SEQ ID NO: 4989 - DNA, 747 bp, Tragopogon dubius
gtttctgcaatctgctcatccaacaatggcttcagagaggaagcaggcgaacccaatgagggaaattaaggttcagaaactcgtcctcaacatttcagtcggagaaagcggcgatcgtctcactcgtgcagccaaggttttggagcaactgagcggtcagtcacctgtcttctcaaaggcaaggtacaccgtgaggtcatttgggatcagacgtaatgagaagattgcgtgctatgtgaccgttagaggagacaaggctatgcaacttttggagagcggtttaaaggtgaaagaatacgagttgttgaggcgcaattttagtgacactggatgctttgggtttggtattcaggagcacattgatcttggaatcaagtatgatccatcgacaggtatttacggtatggatttctttgtggtgttggagcgtccggggtaccgtgttgggcgtcgtcgtaggtgcaaggctcgtgttgggatccaacaccgagtcacgaaggacgatgcaatgaaatggtttcaggtcaaatatgaaggtgttatcctcaacaaatctcaacaaattggagcttaagatatgtttatttatgtgtctctttttgtaaaattttggaatttagttttaaaatttcatcattttggatatttctagtatttgttttgttgtgatttggaccgttttgaatacttttaccagtttttttacaagttttattatagttaatgaaggtaacaacttttctattt

SEQ ID NO: 4990 - DNA, 741 bp, Tragopogon dubius
tcgggggatttctgctcctccattgacatccttgcgccgccgtattcttcagaaactacaatggcttcagagaggaagcaagcgaacccaatgagggaaatcaaggttcagaaactggttctcaacatctccgtcggagaaagtggtgatcgtcttactcgtgctgccaaggttttggagcagctgagcggccaatcccctgtcttttccaaggcaaggtacactgtgaggtcattcgggatcaggcgtaacgaaaagattgcatgctatgtcaccgttaggggagacaaagcaatgcagctcttggaaagtggtttgaaggtcaaggaatatgaacttttgaggcgcaactttagtgacactggttgctttggctttggtattcaagagcacatcgatcttggtatcaagtatgatccgtctacgggtatttatggaatggacttttttgtggttttggaaaggccagggtaccgtgtgggtaggcgccgtaggtgcaaggcgcgtgttggaatccaacatagggttacaaaagatgatgccatgaagtggttccaggtgaagtatgaaggagttatcctcaacaagtctcaacaaattggagcatagagattttgttattctctttgttatagtagttttgttttaggcaggaaattatggaactccctttgtttttgctcgaatcttttctataacatgatgttttggttttggtatacaaaaaaaaaaaaaaaaagg

SEQ ID NO: 4991 - DNA, 800 bp, Triphysaria pusilla
ctgctgccgccgccccacaccgtcgaccaccgtctcgcaatggcgtccgagaagaaattgtcgaacccgatgagggagattaaggttcagaagctcgttctcaacatctccgttggagaaagtggagatcgtctcacaagagcttccaaggtgctggagcaactaagtggccaaactccagttttctccaaggctcgttatacggttagatcctttggtatccgacgtaacgaaaaaattgcttgctacgtgactgtgagaggtgacaaggcaatgcaactccttgagagtgggttgaaggtcaaggagtatgagctgttgagaaggaatttcagtgagactggatgtttcggtttcggtatccaggagcacattgatcttggaattaagtatgacccgtcgactggtatttatgggatggacttttacgttgttttggagcgccctggataccgtgttggccgtcgccgtaggtgcaaggctcgtgttggaatccaacacagggtcaccaaggatgatgctatgaagtggttccaggtgaaatacgaaggtgttattctaaacaagtcatccaacattggagcttaatagatttgagagcagtatctgactgaattggttatgtgggtttcttatgcctttttgtcgctttcggttaaattttgtaggaatctatcctttgacaaagtcctttttatccatattttgatttttgcttgatgatgaattatatttatgctatgttcgagtggcaaatgtatgaataatgcgattgccagtaatatttattatttatcagt

SEQ ID NO: 4992 - DNA, 775 bp, Triphysaria pusilla
ccccacaccgtcgaccaccgtctcgcaatggcgtccgagaagaaattgtcgaacccgatgagggagattaaggttcagaagctcgttctcaacatctccgttggagaaagtggagatcgtctcacaagagcttccaaggtgctggagcaactaagtggccaaaccccagttttctcgaaggctcgttatacggttagatcctttgggatccgacgtaatgaaaaaattgcttgctacgtgactgtgagaggtgacaaggcaatgcaactccttgagagtgggttgaaggtcaaggagtatgagctgttgagaaggaatttcagtgagactggatgtttcggtttcggtatccaggagcacattgatcttggaattaagtatgacccgtcgactggtatttatgggatggacttttacgttgttttggagcgccctggataccgtgttggccgtcgccgtaggtgcaaggctcgtgttggaatccagcacagggtcaccaaggatgatgctatgaagtggttccaggtgaaatacgaaggtgttattctaaacaagtcatccaacattggagcttaatagatttgagagcagtatctgactgaattggttatgtgggtttcttatgcctttttgtcgctttcggttaaattttgtaggaatctatcgtttgacagttctttttatccatattttgatttttgcttgatgatgaattaaatttgtgctatgttcgagtggctgatcaatgaataatgcgattgccagtaatatttat

SEQ ID NO: 4993 - DNA, 793 bp, Triphysaria pusilla
ccgctttatcgcgccgccgacataatggcttcagagaagaaattatcgaatccgatgagagagatcaaagttcagaagctggttctgaacatctccgttggcgaaagtggcgatcgtctcactagagcttccaaggtgctggagcaactcagtggacaaacacctgtcttctccaaggcacggtataccgtgagatcatttgggatcaggcgtaacgaaaagattgcttgctatgtcactgtcagaggtgacaaggcaatgcaacttcttgaaagtggcttgaaggtcaaggagtatgaattgcttaggaggaatttcagtgagacaggctgttttggatttggtatccaggagcatattgatctcggaatcaagtatgacccttccactggtatctacggtatggatttctatgtcgtgttggagcggcctggttaccgtgtgggccgacgccgtaggtgcaaggcccgtgttggcatccagcacagggtcactaaggatgatgctatgaaatggttccaagtcaagtatgaaggtgttattctcaacaaatcttccaacattggagcttaagtgttctaatgatatatagtgtatgcttccaaatatttttcagactcgaagtttttttacaattttgttgttttctgacggtattgattttgcctttgatgataacatctatagcaggatgaatttggttgtgtttcttaacatttttttcaactggcttgcttatttactgtgtttttaaattataaacctccaagcaaattacaaacaacttttatcg

SEQ ID NO: 4994 - DNA, 813 bp, Triphysaria pusilla
tctcatttctcccccaacactaccgctttatcgcgccgccgacataatggcttcagagaagaaattatcgaatccgatgagagagatcaaagttcagaagctggttctgaacatctccgttggcgaaagtggcgatcgtctcactagagcttccaaggtgctggagcaactcagtggacaaacacctgtcttctccaaggcacggtataccgtgagatcatttgggatcaggcgtaacgaaaagattgcttgctatgtcactgtcagaggtgacaaggcaatgcaacttcttgaaagtggcttgaaggtcaaggagtatgaattgcttaggaggaatttcagtgagacaggctgttttggatttggtatccaggagcatattgatctcggaatcaagtatgacccttccactggtatctacggtatggatttctatgtcgtgttggagcggcctggttaccgtgtgggccgacgccgtaggtgcaaggcccgtgttggcatccagcacagggtcactaaggatgatgctatgaaatggttccaagtcaagtatgaaggtgttattctcaacaaatcttccaacattggagcttaagtgttctaatgatatagtgtatgcttccaaatatttttcagactcgaagtttttttacaattttgttgttttctgacggtattgattttgcctttgatgataacatctatagcaggatgaatttggttgtgtttcttaacatttttttcaactggcttgcttatttactgtgtttttaaattataaacctccaagcaaattacaaacaacttttatcg

SEQ ID NO: 4995 - DNA, 852 bp, Triphysaria pusilla
aaaaccatagctcaaagttaattccccacaaatctgctgccgccgcccccacaccgtcgaccaccgtctcgcaatggcgtctgagaagaaattatcgaacccgatgagggagattaaggttcagaagctcgttctcaacatctccgtcggagaaagtggagatcgtctcacgagagcttccaaggtgctggagcaactaagtggccaaactccagttttctccaaggctcgttataccgttagatcctttggcatccgacgtaacgaaaagattgcttgctacgtgacggtcagaggtgacaaggcaatgcaactccttgagagtgggttgaaggtgaaggagtatgagctgctgagaaggaatttcagtgagactggctgttttggttttggtattcaggagcacattgatcttggaattaagtatgacccgtcgactggtatttatgggatggacttttacgttgttttggagcgccctggataccgtgttggccgtcgccgtaggtgcaaggctcgtgttggaatccagcacagggtcaccaaggatgatgctatgaagtggttccaagtgaaatacgaaggtgtcattctgaacaagtcatccaacattggagcttaatagatttgagagcagtatctgactgaattggttatgtggtttgcttgtgtctttttgttgcttcagttaaattttgtaggaatctatcatttgacaaagtgctttttatccatattttggtttttgcttgatgatgaattatatttctgctatgttcgagtggctaatgtatgaataatgcgattgccagtaatatttatcatttatcagcaaaaaaaaaaaaaaaaaaa

SEQ ID NO: 4996 - DNA, 820 bp, Triphysaria pusilla
aaaaccatagctcaaagttaattccccacaaatctgctgccgccgcccccacaccgtcgaccaccgtctcgcaatggcgtctgagaagaaattatcgaacccgatgagggagattaaggttcagaagctcgttctcaacatctccgtcggagaaagtggagatcgtctcacgagagcttccaaggtgctggagcaactaagtggccaaactccagttttctccaaggctcgttataccgttagatcctttggcatccgacgtaacgaaaagattgcttgctacgtgacggtcagaggtgacaaggcaatgcaactccttgagagtgggttgaaggtgaaggagtatgagctgctgagaaggaatttcagtgagactggctgttttggttttggtattcaggagcacattgatcttggaattaagtatgacccgtcgactggtatttatgggatggacttttacgttgttttggagcgccctggataccgtgttggccgtcgccgtaggtgcaaggctcgtgttggaatccagcacagggtcaccaaggatgatgctatgaagtggttccaagtgaaatacgaaggtgtcattctgaacaagtcatccaacattggagcttaatagatttgagagcagtatctgactgaattggttatgtggtttgcttgtgtctttttgttgcttcagttaaattttgtaggaatctatcatttgacaaagtgctttttatccatattttggtttttgcttgatgatgaattatatttctgctatgttcgagtgtctaatgtatgaataatgcgattgccagtaatattt

SEQ ID NO: 4997 - DNA, 789 bp, Vinca minor
cactctcacaccgtcgccgctcttctcattcgcagccatggcatcagaaaagaagttgaacaatccgatgagggaaatcaaagttcagaagcttgtacttaacatttctgtcggtgaaagtggtgatcgtcttactcgtgctgctaaggtgttggaacaactcagtggccaatctcctgtcttctctaaggcaagatacactgtccgatcatttggaattaggcgtaatgagaagattgcctgctatgttactgttagaggtgataaggcaatgcaacttttggagagtggtctaaaagttaaagagtatgaattgctaaggagaaacttcagcgataccggatgctttggtttcggtattcaagagcacatcgatcttggaatcaagtatgacccttctactggtatttatggtatggacttctacgttgttctagagcgccctggttaccgtgtaggacgtcgcagaaggtgcaaatctcgtgttggaatccaccagagggttacaaaggacgacgcaatgaagtggttccaggtcaaatacgagggtgtgatcctcaacaaatctcaaaatatcacaaattagaagtttgacgtgtctggctacattgattatgaaattcgttgctttaaaatattatgtttacttctacatctgtgcctatggttttctagaccctgttttgccattgctttccctttaggacttgattttttttgttccaattatctgtttagcaaacattcctttcctttgatcatttatgtactggacacttcttcttaaac

SEQ ID NO: 4998 - DNA, 877 bp, Ocimum basilicum
cgctattgtttatctcccacacactagctgctgccgccgcgcctccaccgtcatccgccgtcgccatggcttccgagaagaaattgtcgaacccgatgagagagattaaggtgcagaagctcgtcctcaacatctccgtcggcgaaagcggagatcgtctcaccagagctgctaaggtgttggagcaactcagtggccaaagtcctgttttctcgaaggcaagatacacagtccggtcctttgggatcagacgtaatgaaaaaatcgcctgctatgtcacggtcagaggtgaaaaggcgatgcaacttcttgagagtggcttgaaggtaaaggaatatgaactgttgaggcgaaacttcagtgagactggctgctttggtttcggtattcaggagcacattgatcttggaatcaagtatgacccttctacgggtatttatggtatggatttctatgttgtcttggaacgccctggataccgtgttggtcgtcgccgtaggtgcaagtcccgtgtcggaatccaacacagagtcaccaaggaagatgccatgaaatggttccaggtcaaatatgaaggtgttatcctgaacaaggcatccaacattggagcttgatggagaccactatgttttggggctggaggcctttttggctttgttggttttataagttttgtagaatttcatcagcaggcagacttttgaatttaacattttacatattatgttatgaatgttgctgcaatcttgttcttaagttgcttgacaatactttggtgatttcagattggttttgtcattttagaagttgttttatgcaaaagcagatggatgactgagttagttttttgtgggaaatgtggtttggttttattttt

SEQ ID NO: 4999 - DNA, 771 bp, Triphysaria pusilla
ccccacaccgtcgaccaccgtctcgcaatggcgtctgagaagaagttatcgaacccgatgagggagattaaggttcagaagctcgttctcaacatctcctcggagaaagtggagatcgtctcacaagagcttccaaggtgctggagcaactaagtggccaaactccagttttctccaaggctcgttataccgttagatcctttggcatccgacgtaacgaaaagattgcttgctacgtcacggtcagaggtgacaaggcaatgcaactccttgagagtgggttgaaggtcaaggagtatgagctgttgagaaggaatttcagcgagacgggctgttttggtttcggtattcaggagcacatcgatcttggaattaagtatgacccgtcgactggtatttatgggatggacttttacgttgttttggagcgccctggataccgtgttggccgtcgtcgtaggtgcaaggctcgtgttggaatccagcacagggtcaccaaggatgatgctatgaagtggttccaagtgaaatacgaaggtgtcattctgaacaagtcatccaacattggagcttaatagatttgagagcagtatctgactgaattggttatgtggtttccttttgttgcttcagttaaattttgtaggaatctatcatttgacaaagtgcttttttatccatattttggtttttgcttgatgatgaattatatttctgctatgttcgagtggctaatgtatgaataatgcgattgacagtattatttatcat

SEQ ID NO: 5000 - DNA, 891 bp, Triphysaria pusilla
ccgtcgaccaccgtctcgcaatggcgtccgagaagaaattgtcgaatccgatgagggagattaaggttcagaagctcgttctcaacatctccgttggagaaagtggagatcgtctcacaagagcttccaaggtgctggagcaactaagtggccaaactccagttttctccaaggctcgttatacggttagatcctttggtatccgacgtaacgaaaaattgcttgctacgtgactgtgagaggtgacaaggcaatgcaactccttgagagtgggttgaaggtcaaggagtatgagctgttgagaaggaatttcagtgagacgggctgttttggttttcggtattcaggagcacatcgatcttggaattaagtatgacccgtcgactggtatttatgggatggacttttacgttgttttggagcgccctggataccgtgttggccgtcgccgtaggtgcaaggctcgtgttggaatccaacacagggtcaccaaggatgatgctatgaagtggttccaagtgaaatacgaaggtgtcattctgaacaagtcatccaacattggagcttaatagatttaagagcagtatctgactgaattggttatgtggttttcttatgtctttttgttgctttcggttaaattttgtaggattctatccttagacaaagtcctttttatccatattttgatttttgctgatgaattatatttgtgaaatgttcgatgtggctaatgtatgaataatgcgattgccagtaatatttatcatttaaaaaaaaaaaaaaaacaaaaaaaaaaaaaaaacaaaaaaaaaaaaaaaaacacaaaaaaaaaaaacaacaaaaaaaaaaaaaaacaaaaaaaaaaacaaaaaaaacaaaaaacaaacg

SEQ ID NO: 5001 - DNA, 791 bp, Ambrosia trifida
ctagcagatattaacattaacaataaatctctaccccatttggatcaccaccaccgtttctcctctgctcatcaaacaatggcctcagagaggaagcaggcaaacccaatgagggaaatcaaggttcagaagcttgttctcaacatcccagttggagaaagcggcgatcgtcttactcgtgccgctaaggttttggagcaactgagtggccaatcacctgtcttctcaaaggcaaggtatactgtgaggtcttttggtatcaggcgtaacgagaagattgcatgctatgtcactgttagaggagacaaggccatgcagcttttggagagcggcttgaaggtgaaagaatacgagttgttgaggcgcaattttagcgacacagggtgctttgggtttggtattcaagaacacatcgatcttggtatcaagtatgatccttccactggtatctatggtatggatttctttgtggttctagaacgacctgggtaccgtgttggtcgccgccgctgatgcaaggctcgtgtggggattcaacatcgagttaccaaggaggacgcaatgaaatggtttcaagtgaaatatgagggtgttattcttaacaaatcgcaacaaattggagcttagttagatgtgttttgtaaaattttggacttagcgttttccaatgtttgttatcaaggatcttatcggtgttatgttgtgttttgggtgaatgtattagactgttttcaagcttcctttgtcttattaagcgcaagaatgagtgcgtagtttatttcaaaaaagaa

SEQ ID NO: 5002 - DNA, 842 bp, Valeriana officinalis
cttgtatatctatcagtttcctcgtttcctactttcctctgcggcaatctcatttggagttgtaatcgatttccacaacaatggcttcagaaaggaaactggcaaacccgatgagggagatcaaagtacagaagctcgtactcaatatctccgttggtgaaagcggagatcgactcaccagagctgctaaggtcttggaacaactcagcggccagatgcctgtgttctccaaagcaaggtacactgtgaggtcgtttggaatcagacgtaatgagaagattgcttgctacgtaactgttaggggtgacaaggcaatgcaacttttggaaagtggtttgaaggtcaaggagtacgagctacttaaaaaagaatttcagtgacactggctgtttcggctttggcattcaagagcacattgatcttggaatcaagtatgatccttcgaccggaatctacggtatggatttctttgtggtgctagaacgtccaggataccgtgtgggacgtcgtcgcagatgcaaggcacgtgttggtatccagcatagggttactaaggatgatgccatgaagtggtttcaggtcaagtatgaaggagttatcctcaacaaatctcaaaacattacaggctaaaatcttaatatttatgcaagtgtaggtttacttgtttcaaatgtactgggtttacttttttggagcagtagtgttggtatactttctcagatcaaaacttatttcggtatttgttttttgagagtttggtttggttctcagtttaaaccctagcattacaattggtgattgttaattagtgtgtgcaagagcaaaagtaattgtttgcatgc

SEQ ID NO: 5003 - DNA, 1085 bp, Picea glauca
ggtttgaggcagaggcggtagcagaaagagcagtcggcgggaaccagcgaaggagaaatggcagcggagaagaaactgaacaaccccatgcgggatattaaggtgcagaagttagtgctcaacatatcagtcggtgagagtggtgatcgactcactcgagcttctaaggtgttggagcagcttagtggccagactccggtttttcgaaggcaaggtatactgtgaggtcctttggaattaggcgaaatgaaaagattgcctgctacgttactgttagaggagaaaaggctcttcagcttttggagagtgggctgaaagtgaaagaatacgagttgctccgaaggaactttagcgacacagggtgctttggttttgggattcaggagcacattgatctgggaatcaagtatgatccttcaactggtatttatggtatggacttctttgtagtcctagagcgccctggatacagagtcggcaggagaaagagagcccaatcccgtgttggcattcagcacagggttaccaaggaagattctatgaagtggttccaagttaaatatgaaggagtcatccttaacaagtcacaaaatatttgaatgagaagttttggtatgttccttaataagaagtagtcttggcttggtttgccacttctgttgatacctaaaggaaggaatttttttccggttataggtccacatttgtcttttgaagagattttggaagggcggattatttttatttgcaggaaactattgtacttttttttatagtgtttagatcatttgttggtgcgaagttcaaggccatgcttccttgttaagtacaaggacatgttctctgatttgaaaatttgttgtcaattctcaaatggaagagattaatatcaatgttggatttgaactaaaatagagtaatacatgatttaatggatggatgtaacttcctattctacttgtaacaaaaaaaaaaaaacaaaaaaaagtaaactactagacgttagaataaccctaacttacgacgtttaccttaggtaacgtacgttacgtacccgtaacggacccaacgaaccgaagggggta

SEQ ID NO: 5004 - DNA, 973 bp, Picea glauca
gggcggcagtatcagcagaagcaggcgcaggagtagcagagcatcatccaaaatggcagcggagaagaagctgaacaacccatgagggaaattaaggtgcagaagttggtgctcaacatatcagttggtgagagtggtgatcgactcactcgagcttcaaaggtgttggagcaactcagtgggcagactccagtttttccaaggcaaggtatactgtaaggtcctttggaatcaggcgtaatgaaaagattgcctgctatgttactgttaggggagagaaggctcttcagcttttggagagtgggctgaaagtgaaagaatacgagttactccgaaggaactttagcgacacagggtgctttggttttgggattcaggagcacattgatctgggaatcaagtatgatccttcaactggtatttatggtatggacttctttgtagtcctagagcgccctggatacagagtcggcaggagaaagagagcccaatcccgtgttggcattcagcacagggttaccaaggaagattctatgaagtggttccaagttaaatatgaaggagtcatccttaacaagtcacaaaatatttgaatgagaagttttggtatgttccttaataagaagtagtcttggcttggtttgccacttctgttgatacctaaaggaaggaattttttcccggttataggttcacatttgtcttttgaagagattttggaagggtggattatttttatttgcaggaaactattgtacttttttttatagtgtttagatcatttgttggtgcgaagtttaaggccatgcttccttgttaagtacaaggacatgttctctgatttgaaaatttgttgtcaattctcaaatggaagagattaatatcaatgttggatttgaactaaaatagagtaatacatgattttaatggatggatgtaactttccattccatttgttaaaatattaggttga

SEQ ID NO: 5005 - DNA, 817 bp, Solanum melongena
acattttccgccctctgagtacccctgctactctgctgccgctgctgtaacatcttcccgcggaaacgccatggcttcagagaagaaattgagcaatcccatgagggatatcaaggtccagaagcttgtactcaacatctccgtcggtgagagtggagatcgactcaccagagcggcaaaagtgttggagcaacttagcggccaatcccctgttttctctaaggcaaggtatactgtgcggtccttcggaatcaggcgtaatgaaaagatagcttgctatgtgactgtaagaggggaaaaagctatgcagctacttgagagtggattgaaagttaaggaatatgagttgttgagaaggaacttcagtgagaccggctgctttgggtttggtattcaggagcatattgatcttggaattaaatatgatccttcaactggtatctatggaatggatttctatgttgtattggagcggcctggctaccgtgttgcacgtcgtcgcaggtgcaagtctcgagttggaattcagcacagggtcacaaaggaggatgcgatgaagtggttccaggtcaaatatgaaggtgttatccttaacaagtcctcaaacattcagtgataagctgagagccaacttctggatcagcgagctcatctcctggcaaatttatttttatgtatttttgtagacagccaactatatcacttttaaaagggatgtttgggagagttagttggcaaatcagtatgttttactcgttttggctatcagatgaattcatatatttttattgccattttacgttattgcaattgaagg

SEQ ID NO: 5006 - DNA, 779 bp, Solanum melongena
tttcactcttctcctcttcctctctgtgtgcgccctaaagttctgcccccatggcttcagagaagaaattgagcaatccaatgagggatatcaaagtccagaagctcgtcctcaatatctctgtcggtgaaagtggagatcgtctcaccagagccgccaaggttttggagcaactcagtggccaaagccctgttttctccaaagctaggtatactgtacgttcctttggaatcagacgtaatgaaaagattgcctgctacgtcactgtcagaggagaaaaagctatgcagctccttgagagtggattgaaggtcaaggagtatgagttgttgagaaggaacttcagtgaaactggatgctttggatttggtattcaggagcacatcgatcttggaatcaagtatgacccttcaaccggtatctatggcatggatttctatgttgtcctagaacgcccaggataccgtgtcgccagacgtcgtaggtgcaagtctcgtgttgggatccaacacagggttacaaaagaggacgcaatgaaatggttccaggtcaaatatgaaggtgttatccttaacaagtcctcgaacattcagtaagctgagagctgactgctggatcagtctatcgggtagcaggtttatgtttatgcattttgtagaccaacatctaattactcctagagttgagtagtttcctagagtttgctgttatttggcttagtatattttgtttcattctgctttatgagatgaattcaatcttaatataacctttttggc

SEQ ID NO: 5007 - DNA, 1066 bp, Setaria italica
tttagggtttctcttcgtctacttataaagtttcctcgtccgccgccgccgccccgcacagcactgcagaacccatctcacctccctcgccgtcgcctcccagatcttccccatggcgtcggagaagaagcagtctaacccgatgcgggagatcaaggtccagaagctcgtgctcaacatctccgtcggcgagagcggtgatcgcctcactcgcgccgccaaggtgctcgagcagctgagtgggcagtcaccggtgttctccaaggcgaggtacactgtgaggtcgttcggcatcaggcgtaatgagaagattgcgtgctatgtgacggtgaggggagagaaggcgatgcagcttctggagagtggcctgaaggtcaaggagtacgagctgctgaggaggaacttcagtgacaccggctgcttcgggtttggtatccaggagcacattgatcttggcatcaagtatgacccatctaccggtatctacggcatggacttctacgtcgtccttgagcgtgctgggtaccgtgttgcccgccgccgcaggtgcaagtcccgtgttggtatccagcacagggtcaccaaggaggacgccatgaagtggttccaggtcaagtacgagggtgtgatcctcaacaaggcccaagccaactaactcttaagcatcacaagaagagcttagcccctctttagagctcgagctatttaagtctatctggtggttggatttgaactagaagaaaccagaatgttttgtcagttttgcctgtactgttgcagttggatccttttctgggcgccctatactttcatcttaattctgcttgtgttttacccccattggcaccgacagcaatagtagatgtctggcttattctgtcgagtatcgttttgttttgttttgtttcgttcttggaaaatcctgagctccaacgtttgctacaaaatttgtgctaaattagacctgaacttaattgcgtttctagtaaatgtttacaatcgaaactgaacctgagctcagttgtgcactgagctaaattgaaacttgacgccatgtgaaataagc

SEQ ID NO: 5008 - DNA, 723 bp, Ipomoea batatas
cgggggcctcccagtctcccaaatctgcaaatctgcaacctcaccgggaagccatggcctcagagaagaaattgaacaacccaatgagggatatcaaggtccagaagctggtcctcaacatctccgttggtgagagcggcgatcgtctcaccagagcctctaaggttttggagcaactgagtggacagacccccgttttctccaaagcaaggtacactgtgaggtcctttggtatcaggcgtaatgaaaagattgcatgctatgtcacggtgaggggagacaaggcaatgcagcttctcgagagtgggttgaaagttaaggaatatgaattgctaaggaggaacttcagtgacactgggtgctttggttttggtatccaggaacacattgatcttgggattaagtatgacccctcaactggtatttatggtatggacttctttgttgtcttggaacgccccggttacagagttgctcgccgccgtaggtgcaaggctagggttggaatccagcacagggtcactaaggaggatgcaatgaagtggttccaagtcaaatatgaaggtgttatcctcaacaaggcctcaaatatttaatgatttcaatcctaggttgattgtgttgaaacagcatgtttcctagaaattttatgtttttgcagttgtagactaatgactatcatcctttttatttgaatcacaaagttttgacattctgaacaaa

SEQ ID NO: 5009 - DNA, 868 bp, Ipomoea nil
tcatcgatcagttcacctcgcgcttcccttcccttcccgccgtctctccgtctcctcgtcagccgaaagccatggcatcagagaaaaaattgaacaacccaatgagggagatcaaggtccagaagcttgtcctcaacatctccgtcggtgagagcggcgatcgtctcaccagagctgcgaaggtgttggagcagctcagtggccaaacccctgttttctcaaaggctaggtacactgtgaggtcatttggtatcaggcgtaatgagaaaattgcgtgctatgtcactgtcaggggtgataaggcgatgcaactccttgagagtggattgaaggtgaaggaatatgagctgctaagaaggaatttcagtgatactgggtgctttggttttggtattcaggagcacattgatctcgggattaagtatgacccatcaactggtatttacggtatggatttctacgttgttttggaacgccctgggtaccgcgttgctcgccgacgcaggtgcaaggctcgtgttggaatccagcacagggtgactaaggatgatgcaatgaagtggttccaggttaaatatgaaggtgtcatcctcaacaaggcatccaatatttaataatttggggggttgaggaatgtgattgaatcagtttgcattttggttttgttgtagacttgagattatattattactgagttacaagttttgagtacaaggctctatgttagctaattggtcattttctcataagatgaattatctattttgttggcttgtatacttagtttttgtattgaaattttctactttgagccatacatttggtttgaatttgctgttgcccaaagaaacaatccctatctaaaaaa

SEQ ID NO: 5010 - DNA, 888 bp, Ipomoea nil
ggttacatattaggatttcttcctccgctcaacactgcatctttccccggagccggtctgcagccgcaacctcagcagtgaagcgatatggcgtcagagaagaaactgaacaacccaatgagggaaatcaaggttcagaagctcgtcctcaacatctccgtcggtgagagcggagatcgtttgaccagagcggctaaggtgttggagcaacttagtggccaaacccctgttttctcaaaggcaaggtataccgtgaggtccttcggtatcaggcgtaatgagaagattgcatgctatgtcacagtaaggggtgacaaggcaatgcagctcctcgagagtgggttgaaggtgaaggaatatgaattgctgcgaaggaacttcagtgacactggttgctttgggtttggtattcaggagcacattgatcttgggattaagtatgacccctctactggtatttatggtatggatttctacgttgtcctggagcgcccgggttaccgtgttgctcgtcgccggagatgcaaagccagagttggtatccaacacagggtcaccaaggatgatgccatgaagtggttccaggtcaaatatgaaggggttatcctcaacaaggcctcaaacatctcataagtccaatcttagtttgagagaattttcaatcagtttgtatctcctagcaattttgtgtatttgccttattatagacctacatcttactcagagttactgagttttgggtaccaggatttgttggtaagtttatcaaggttatcatgacatctttgctgtctaatttgattgtgtgatttatacttgggatctaaatggttctgtagttcttctgtctaatgttatattgctttctattaaacccaaatacaagta

SEQ ID NO: 5011 - DNA, 719 bp, Ipomoea nil
ggctgcctcccagtctcccaaatctgcaaatctgcaacctcaccgggaagccatggcatcagagaagaagttgaacaacccaatgagggagatcaaggtccagaagctggtcctcaacatctccgtcggtgagagcggcgatcgtctcaccagagccgctaaggttttggagcaactgagtggacaaacccccgttttctccaaagcaaggtacactgtgaggtcctttggtatcaggcgtaatgaaaagattgcgtgctatgtcacggtcaggggagataaggcgatgcagcttctcgagagtgggttgaaagttaaggaatatgaattgctaaggaggaacttcagtgacactgggtgctttggttttggtatccaggaacacattgatcttgggattaagtatgacccttcaactggtatttatggtatggacttctatgttgtcttggaacgccccggttacagagttgctcgccgccgtaggtgcaaggctagggttggaatccagcacagggtcactaaggatgatgcaatgaagtggttccaagtcaaatatgaaggtgttatcctcaacaaggcctcaaatatttcatgatttcaatcctaggttgaatgtgttgaaccaacatgtttcctagaaattttatgtttttgcagttgtagactaaggactatcatcctttttatttgaatcatgaagttttgacattctgatc

SEQ ID NO: 5012 - DNA, 976 bp, Marchantia polymorpha
cctgctcgtggcagggctctctcgaccttcaagtccttagggtttcgattttcgtcgttcgttttccatcggggctcaatggcgtccgaaaagaagcagcagaattgcatgcgcgagatcaaagttcaaaagttagttttgaacatttccgtcggagagagtggagatcgactcactcgtgctgccaaggtgttggagcagctcagcggtcagtcgcccgtgttctccaaagctcgctacaccgtccggtctttcggaatcagacgtaacgagaagattgcatgctatgtcaccgtcaggggcgagaaggctatgcagttattggagtctggtttaaaggtcaaggagtacgagcttctccggagaaatttctccgacaccgggtgtttcggattcggtatccaggagcacatcgatctcggtattaagtacgatccttccaccggtatttatggtatggacttctacgtggtgttggagcgcccgggatacagagttggcaggagaaggagggccaagtccagagtcggaatccagcaccgtgtgacgaaggaagattccatgaagtggttccaggtcaagtacgagggagtgatcttgaacaagtctacacaaatcgcttaaatgggctgagcatcaggcatttaggcagcgatgattacagtggaagtgccaattttttgtaagtgtgggttcctgctttaggatgacgggtattgattcgggctcctgcacgtagtaaccaggctatgggggggaagtccaggtgaaatagcaggaagttatctcgatcaagtattctgtaatctcttgagctcattaccagccacaaccagtggcaaggtgaatgtagggtttctgcggtcttctgctaaatgtctgggctgcaaaaaatctacgtggaaaattttgatgagttctctgtccagtttttggagattaatacagttgttttccttccagtcgaaaaaaaaaa

SEQ ID NO: 5013 - DNA, 1414 bp, Pinus pinaster
atggggagcaggaattatgctagtttatgattttatgatttagtatttccttatgtcaaatatcaaacctagccttttcacaaaagaataggaaaggtaagaagctaccctatatcgaaaacacacacagcaagaaaaccctaattgaaatgattgataaaatagaggaagtttaggttaggtgtcttgcagcaggcgggattgggttctgaggcaggggcagcagcagaaacagcagtcggcgggaaccagcgtaggagaaatggcagcggagaagaaactgagcaaccccatgcgggaaattaaggtgcagaagttggtgcttaacatatcagttggtgagagtggcgatcgactcactcgagcttccaaggtgctggagcagctgagtggccagactccggttttttctaaggcaaggtatactgtgaggtcctttggaattaggcgaaatgaaaagattgcctgctacgttactgttagaggagagaaggctcttcagcttttggagagtgggctgaaagtgaaagaatatgagttgctccgaaggaactttagcgacacagggtgctttggttttgggattcaggagcacattgatctgggaatcaagtacgatccttcaactggtatttatggtatggacttctttgtagtcctagagcgccctggatacagaattggcagaagaaagagagcccaatcccgtgttggcattcagcacagggttaccaaggatgatgctatgaagtggttccaagttaaatatgaaggagtcatcctcaacaaatcacaaaatatttaaatgagaagttttagtatgttcctttctaagagtagtgttgttttgattttgccacttaagttgacacaacctaaaggaaggaaattttcttcgggttataggctcacatttgtctttcgaagagatattggaagggcggattatttttttttgcaggaaacttttgtacctttttaatagtatttagatcattttgttgcatgcaaagtttacggccatgcctccttgtgaagttcaaggacatactctcttatttgaaaatttgttttcgattttgaagtggaagagattgacatcattgttggatttgaactaagtagagcaatatatgattttaatggatggatgtatcattccattcaatctgttaaaatccaaggtcaatgtattttctgaatgccccggcttgggaaagtgttctgctttgtgacatttctttttgggtcatcttcgtctttgtgtgaacataaaggacacacatcttcatttcaagggtgtttgattttatttataattcttatcagtactatctgtatggaggtcatgttctactctggattgaaatttaggttgcagtgctttttgaagtctgtaatgcatggatggtgg

SEQ ID NO: 5014 - DNA, 805 bp, Nicotiana benthamiana
gccgctttgcttctcttcatctctttttgcagcaaagctcctcagaccgaatcgaaatggcttcagagaagaagttgagcaacccaatgagggaaatcaaggttcagaagctagtccttaacatctctgttggtgaaagcggagataggctcaccagagcagccaaggtcttggagcaactcagtggccaatcccctgttttctctaaggctaggtatactgtgcggtccttcggaattaggcgtaatgagaagattgcttgctatgtcactgtcagaggagacaaagctatgcagctccttgagagtgggttgaaagtcaaggaatacgagttgttgagaagaaacttcagtgagactggctgctttggttttggcattcaggagcacattgatcttggaatcaagtatgacccttcaaccggtatctatggtatggatttctatgttgtgctcgagcgcccaggataccgtgttgctcgtcgtaggaggtgcaaggcccgagttggaattcagcacagggtcacaaaggatgacgctatgaagtggttccaagtcaaatatgaaggtgttatccttaacaaatcctcaaacattcagtaagttgatatccactttggatcagtttttcccccggcgagtttatgtttttatgcattttgtagaccaacatttaatactcctagagttcaaaggttttgaagagttgctgttatttggcatatcaggatattatagtttgtttacatttttgctatctgatgaatttgattttattatccatcttcgattggttgggttttcaa

SEQ ID NO: 5015 - DNA, 936 bp, Nicotiana benthamiana
gtttagggttttctttttggatcttcttcgcgccatcagtaccctacaactctccctgcagctgcaacatcttccagcagaattgcgatggcttcagaaaagaaactgagcaatcccatgagggaaatcaaggttcagaagcttgtccttaacatctccgttggtgagagtggagatcgacttactagagctgcaaaggtgttggagcaacttagtggtcaatcacctgttttttctaaggcaaggtacactgtgaggtccttcggaatcaggcgtaatgaaaagatagcttgctatgtgactgtcagaggggagaaagccacgcagctacttgagagtggattgaaagtcaaggaatatgagttgttgagaaggaacttcagtgaaaccggctgttttgggtttggtattcaggagcacattgatcttgggatcaaatatgacccttcaactggtatttatggtatggatttctatgttgtattggagcgccctggataccgtgttgctcgtcgtcgtaggtgcaagtctcgagttgggatccagcacagggtcacgaaggaggatgcaatgaagtggttccaggtcaaatatgaaggtgttattcttaacaagtcctcaaacattcagtgacaggctgagagccggcttctggactagcaagtttatatctatgtattttttagacctagaggaaagttttggaaagtttccattagttggtgtatgaggatgtgtaagttctcattttggctatcagatgaattcagtcattttttgtggtcattttcttttgctgcattcaaagtagaatcgacaatgtagtcttacaacagatgttatgaatacctaattggttgcctattgtggtaatgagttgatcactgtttgattgtttttattaaatctgctttgaagagcttgatgtttggcatg

SEQ ID NO: 5016 - DNA, 886 bp, Capsicum annuum
gcacgaggcatctcagtgccctacagctctcgccgctgctgctgcaacatcttccgccatggcttcagagaagaaattgagcaacccgatgagggatatcaaggtgcagaagcttgtcctcaacatctccgttggtgaaagtggagatcgtctcaccagagctgctaaagtcttggagcaacttagcggccaatcccctgttttctccaaggcaaggtacactgttcgttcattcggaatcaggcgtaatgaaaagatagcttgttatgtgactgtcagaggggagaaagctatgcagctacttgagagtggattgaaagttaaggaatacgagttgttgagaaggaacttcagtgagactggttgctttgggtttgggattcaggagcacattgatcttggaattaaatatgatccttcaactggtatttatggaatggatttctatgttgtattggagcgccctggatatcgtgttgcccgtcgtcgcaggtgcaagtctcgagttgggattcagcacagggtcactaaggaggatgcaatgaagtggttccaggtcaaatatgaaggtgttatcctcaacaagtcttcaaacatccagtgataagctgagagccaacttctggatcagcttgtctcctggcaagtttatttttatgtatttttgtaggcggccatctatagtgtactattaatggaatgttttggagtgattctagttggcaaatcaatgtgttttacttctcattttggcaatcagatgaattcaaatcttttttgttttgtcattttcctttgttgcaattgaaggtaggattattcaacaacccaatcagtaaaacactctttggataccataatgaaatggtgcaatgtttaagtgtgt

SEQ ID NO: 5017 - DNA, 744 bp, Capsicum annuum
tcagcatagtagtgcaaaaaatatccaatggcgtcagagaagaaactgagcaaccctatgagggatatcaaggttcagaagctagtcctcaacatctccgtcggtgagagcggagatagacttaccagggcggccaaggtcttggaacaactcagcggccaatcccctgttttctccaaagctaggtataccgtgcggtccttcggaatcaggcgtaatgagaagatagcttgctacgtcactgtcagaggagagaaagctatgcagctccttgagagtggattgaaagtcaaggaatacgagttgttgagaagaaacttcagtgagactggctgctttggttttggtatccaggagcacatcgaccttggaatcaaatatgacccttcaacgggtatctacggtatggatttctacgttgtgctagagcgcccaggataccgtgttgcacgtcgtcgtagatgcaagtccagagttggaattcagcaccgggtcacaaaggaggacgcaatgaagtggttccaggtcaaatatgaaggtgttatccttaacaaatcctcaaacattcagtaagttgaaatccaaatccactggtggatttctcagcaagtgtttttatgttatttaagaattttgtagaccaacatttaatactcttggtagagttgatgatgttattttggtggaggatatatgttagtttgttttcattttggccatttttcggaatgctttgcctcgtgc

SEQ ID NO: 5018 - DNA, 1545 bp, Pinus taeda
gaagctaccctatatcgaaacacactcgcaaaaacctacttgaatgactgactaacagagagtttaggttaggacgtcttgcagcaggatttatgctagttttatgattttttgatttagtatttccttacgtcaaatatcaaacctagccttttcacaaaagaataggaaaggtaagaagctaccctatatcgaaaacacactcggcaaaaaaaccctaattgaaatgattgataaaatagaggaagtttagattaggcgtcttgcagcaggcgggattgggttctgaggcaggggcagtagcagaaacagcagtcggcgggaaccagcgtaggagaaatggcagcggagaagaaactgagcaaccccatgcgggaaattaaggtgcagaagttggtgcttaacatatcagttggtgagagtggcgatcgactcactcgagcttccaaggtgctggagcagctgagtggccagactccggttttttctaaggctaggtatactgtgaggtcctttggaattaggcgaaatgaaaagattgcctgctacgttactgttagaggagagaaggctcttcagcttttggagagtgggctgaaagtgaaagaatatgagttgctccgaaggaactttagcgacacagggtgctttggttttgggattcaggagcacattgatctgggaatcaagtacgatccttcaactggtatttatggtatggacttctttgtagtcctagagcgccctggatacagaattggcagaagaaagagagcccaatcccgtgttggcattcagcacagggttaccaaggacgatgctatgaagtggttccaagttaaatatgaaggagtcatcctcaacaaatcacaaaatatttaaatgagaagttttagtatgttcctttctaagagtagtgttgtcttgattttgccacttaagttgacacaacctaaaggaaggaaattttcttcaggtataggctcacatttgtctttcgaagagattttggaagggcggattatttttatttgcaggaaacttttgtacctttttaatagtatttagatcattttgttgcatgcaaagttgacggccatgcctccttgtgaagttcacggacatactcttatttgaaaatttgttttcgattttgaagtggaagagattgacatcattgttggatttgaactaagtagagcaatatatgattttaatggatggatgtatcattccattcaatctgttaaaatccaaggtcaatgtattttctgaatgccccggcttgggaaagtgttctgctttgtgacatttctttttgggtcatcttcgtctttgtgtgaacataaatgacacacatcttcatatcaagcgtgtttgatttttaggagtatttataattcttatcagtactatctgtatggaggtcatgttctactctgtattgaaatttaggttgcagtgctttttaaagtctgtaatgcatggatggtggaagcactgttctttgcacctttttcacatattctctatatctgtagttgg

SEQ ID NO: 5019 - DNA, 895 bp, Solanum phureja
acgacaatttccgccatctcagtacccctccaactctgctgccgcagctgtaacatcttcccgcggaagcgccatggcttcagagaagaaattgagcaaccccatgagggatatcaaggtccagaagcttgtcctcaacatctccgtcggtgagagtggagatcgactcaccagagcagcaaaagtcttggagcaacttagcggccaatcccctgttttctctaaagcaaggtatactgtgcggtcctttggaatcaggcgtaatgaaaagatagcttgctatgtgactgtcagaggggagaaagctatgcagcttcttgagagtggattgaaagttaaggaatacgagttgttgagaaggaacttcagtgagaccggctgcttggggtttggtattcaggagcacattgatcttggaatcaaatatgatccttcaactggtatttatggaatggatttctatgttgtattggagcgccctggctaccgtgttgcccgtcgtcgcaggtgcaaatctcgagtcgggattcagcacagggtcactaaggaggattcaatgaagtggttccaggtcaaatatgaaggtgttatccttaacaagtcctcaaacattcagtgataagctgagtgccaacttttggatcagcttgtctcctggcaagtttatttttatgtatttttgtagacagccatcgatattactattaaaggaatgttttggagagattctagtgggcaaatcagtatgttttatttctcattttggcaatcagatgaattcaaatctttgttatggtcattgtcagttgttgcaatttaagtaggaattattcaaccacacaattgtgttactgcaatgcctaagcgtttcaagtaaatcaggtttggagctgga

SEQ ID NO: 5020 - DNA, 907 bp, Nicotiana tabacum
gccgctttgcttctcttcatctctttctgcagcaaagctcctcagacggaatcaaaatggcgtcagagaagaagttgagcaacccaatgagggaaatcaaggttcagaagctagtccttaacatctccgttggtgaaagcggagataggctcaccagagcagccaaggtcttggagcaactcagcggccaatcccctgttttctctaaggctaggtatactgtgcggtccttcggaattaggcgtaatgagaagattgcttgctatgtcactgtcagaggagacaaagctatgcagctccttgagagtggattgaaagtcaaggaatacgagttgttgagaagaaacttcagtgagactggctgctttggttttggcattcaggagcacattgatcttggaatcaagtatgacccttcaaccggtatctatggtatggatttctatgttgtgctcgagcgcccaggataccgtgttgctcgtcgtaggaggtgcaaggcccgagttggaattcagcacagggtcacaaaggatgacgctatgaagtggttccaagtcaaatatgaaggtgttatccttaacaaatcctcaaacattcagtaagttgatatccactgttggatcagtttgtcccccagcaaggtgttatgttttctatgcattttgtagaccaacatctaatactcctagagttcaaaggttttgaagagttgctgttatttggcatatcaggatattatagtttgtttgcatttttgctatctgatgaatttaattttattatccttcttgattggttgagtttcaaatgttgcaagcaaagcagaattattctcacgactatggctccgatttgtaagaacgatgtctttattggactgcgttacctaatatgatcttttacgtaa

SEQ ID NO: 5021 - DNA, 928 bp, Nicotiana tabacum
  misc_feature (887)..(887): n is a, c, g, or t
agtaccctacaactctccctgcagctgcaacatcttccagccgcatcgccatggcttcagagaagaaactgagcaatcccatgagggaaatcaaggttcagaagcttgtcctcaacatctccgttggtgagagtggagatcgacttactagagctgcaaaggtgttggagcaacttagtggtcaatcacctgttttctccaaggcaaggtacactgtgaggtccttcggaatcaggcgtaatgaaaagatagcttgctatgtgactgtcagaggggagaaagccatgcagctacttgagagtggattgaaagtcaaggaatatgagttgttgagaaggaacttcagtgaaaccggctgttttgggtttggtattcaggagcacattgatcttggaatcaaatatgacccttcaactggtatttatggtatggatttctatgttgtattggagcgccctggataccgtgttgctcgtcgtcgtaggtgcaagtctcgagttgggatccagcacagggtcacaaaggaggacgcaatgaagtggttccaggtcaaatatgaaggtgttattcttaacaagtcctcaaaccttcagtgataagctgagagccggcttctggactagcaagtttatatctatgtattttttagacctagaggaaagtttttgaaagtttctattagttggtgtatgaggatgtgtaagttctcattttggctatcagatgaattcaatcctttttttgtggtcattttctttttctgcaatcaaagtagaatcgacaatgtagtcttacaacagaaattatgaatacctaattggttgcctattgtggtaatgtgttgatcactgtttgattgtttttattaaatctgctttgaagagctngatgtttgagcggccgcataaggggtacctgtcctctccaa

SEQ ID NO: 5022 - DNA, 833 bp, Arabidopsis lyrata
acactacgcagccgacgcaattcgtctgccactcttttttactcatctccttcgatttcgaactcctaatcttcagatggcgtcggagaagaagctctcgaaccctatgagggatattaaggttcagaagctagttcttaacatctctgttggtgagagtggtgatcgtctcactcgtgcctccaaggtgttggaacagctcagtggtcaaacccctgtcttctctaaggcgaggtacactgtgaggtctttcggtatcaggcgtaatgaaaagattgcgtgttatgtcaccgttagaggtgagaaggcaatgcagcttcttgagagtggcttgaaagtgaaggaatacgagctcttgaggaggaacttcagtgacactggctgctttggattcggtatccaggagcacattgatcttggaatcaagtatgatccttctactggtatctacggtatggatttctacgttgttcttgaacgcccgggataccgtgttgcccgtcgccgtagatgcaaggctcgcgttggtattcaacatagagttaccaaggatgatgccatgaagtggttccaagttaagtatgaaggagttatcctcaacaagtctcagaacatcactggttgaagagtttttttcattttgttttgtggtgttagctctgtttcaagttattccgattctggatagtaaggattttcttgttgtggtaacctttttgacttcagttggttaagaatcttcaagtgccttctaaatatgaaccatttttgggagttttaatgttaccaatttaaaactttttcagaatttagtttgaccacaggcaagaaat

SEQ ID NO: 5023 - DNA, 717 bp, Arabidopsis thaliana
gcttcatctccgtttcttctttccgattcgtgttttcccgtcggccggagatatatcgcaaccctaatccgaaatggcgtcggagaagaagctatcgaacccaatgagggacattaaagtgcagaagctggttctcaacatctccgttggtgagagtggagatcgtctcaccagagcctccaaggtgttggaacaattgagtggtcagactcctgttttctccaaggctcgatacactgttcgttcttttggtataagacgtaatgagaagattgcttgctatgtgactgtcaggggagagaaggcaatgcagctccttgagagtggattgaaagttaaagaatacgaactcttgagaaggaacttcagcgacactggttgctttggttttggtattcaagagcacattgatttgggtatcaagtatgatccatcgactggaatctacggcatggacttctatgttgttcttgagcgaccaggttaccgtgttgcgcgccgcagaagatgcaagactcgtgttggaatccagcatagagtgacgaaagatgatgccatgaaatggttccaggtgaaatatgaaggagtcattctcaacaagtctcagaacatcactggttaaacaaatgtgtcaaacaaatagctatcatctgttttgttttttttgggttcaaatcgtattttctcagttttgttttgcttctctgttcttcagac

SEQ ID NO: 5024 - DNA, 791 bp, Cenchrus ciliaris
cactacagaacccatctcacccacctcgccgtcgcctctcagatcttccccatggcgtcggagaagaagcagtcgaacccgatgcgggagatcaaggtccagaagctcgtgctcaacatatccgtcggcgagagcggtgatcgcctcactcgcgccgccaaggtgctcgagcagctgagtgggcagtcaccagtgttctccaaggcgaggtacactgtgaggtcgttcggcatcaggcgtaatgagaagattgcgtgctatgtgacggtcaggggagagaaggcaatgcagcttctggagagtggcctgaaggtcaaggagtacgagcttctgcggaggaacttcagtgagaccggctgcttcgggtttggtatccaggagcacattgatcttggcatcaagtatgacccatctaccggtatctacggcatggacttctacgtcgtccttgagcgtgcagggtaccgtgtcgcacgccgccgcaggtgcaagtcccgcgtcggtatccagcacagggtcaccaaggaggacgccatgaagtggttccaggtcaagtacgagggtgtgatcctcaacaaggcccaagccaactcctaagcatatcgcaagaagagcttagccccgctttagatctcgcgctatttaagcctatctggtggttggatttgaactagaagaaaaccagaatgttttgtcagttttgcctgtactactgcagttggatccttttctgggcgccctatactttcatcttaattctgcttgtgttttacccccatttgcactggcag

SEQ ID NO: 5025 - DNA, 883 bp, Echinacea purpurea
gccggggggatatttaggggttgtagctcattcactcacaaacccctgctgccgccgcgcctacacacatccatccaccgtcatccatccgccgaattgccatggcttcagagaagaaattgtcgaacccgatgagggagatcaaggtgcagaagctggtgctcaacatctccgtcggagagagcggagatcgtctcaccagagctgctaaggtgttggagcaactcagtggccaaagtcccgttttctcgaaggcaagatacactgtgcgatcttttgggatcagacgtaatgaaaaaattgcctgctatgtcaccgtgcgaggtgataaggcaatgcaacttcttgagagtggcttgaaggtcaaggagtatgaactgttgaggaggaacttcagtgaaactggctgctttggttttggtatacaggagcacatcgatcttggaattaagtatgacccgtctactggtatttatggtatggacttttacgttgttctggaacgccctggataccgtgtgggtcgccgccgtaggtgcaaggcccgagttggaatccaacacagagtcaccaaggacgatgctatgaagtggttccaggtgaaatacgagggtgttatcctgaacaaggcctctaacattggagcttagactgagatcactctctgacccgaatcttcatggttttgtttgtttttatctcttacgctcaaagttttgtagaattttatcagcagacaggtcttactttcatgttttatattctatgttgagatatgaaattttattgttggtgttattgctccaagtgtcctattactagtatcagatatgctcatgaatgttggtactgcgttacaagttgccttagcttgacttaaaat

SEQ ID NO: 5026 - DNA, 862 bp, Zea mays
gcagccacaccccaacatcaaaaccctcccatctcttcccctccgccgccgtctctgctctcaagatcgccatggcgtcagaaaagaagcagtcgaacccgatgcgggagatcaaggtgcagaagctcgtgctcaatatctccgttggagagagtggagatcgactcacccgcgccgccaaggtgttggagcagttgagtgggcagtctccggttttctccaaggcaaggtatactgtgaggtctttcggtattcgtcgtaatgagaagattgcatgctacgttacggtcaggggtgagaaggcaatgcagcttcttgagagtggcctcaaggtgaaggagtatgagcttctgaggaggaacttcagtgatactggctgctttggttttggtattcaggagcacattgatcttggaatcaagtatgacccgtctactggtatttatggcatggacttttacgtcgttctggaacgagctggttatcgtgttgcacgtcggcgcaggtgcaagtcccgcgttggcatccagcacagggtgaccaaagaagacgccatgaagtggttccaggtgaagtacgagggtgtcatcctcaacaaggcccaaaacacctcgtaatcattgatagtcatcaaacgacttgccctttagcactccagttctgtgtactatgaacaaaacaccccgtgtttggttcaagtataatctgtgtactatgaattctgtgtttgttggataccaaatgcactgccagttttgcgtctgtgcccataattccatcttgataatcagactagcagttaggaacaaataactgttgttttgattgtgttaatgtgagctcgccagcaaaatctaaggaa

SEQ ID NO: 5027 - DNA, 755 bp, Acacia harpophylla
ggcctctcccgcggtaaatcttcgcacagttcccattccaatggcttcagagaagaagctgttgaaccctatgagggaaatcaaagtccagaagctcgttctcaatatctcagtgggcgagagtggagatcgtctcaccagagctgctaaggtgttggagcagcttagtggccagaccccagttttctctaaagcaagatatactgttcgttcctttgggatcagaaggaatgaaaagattgcatgctatgtcacagttagaggtgaaaaggcaatgcagcttctggagagtggtctgaaggtgaaggaatatgaactgctgagaagaaacttcagtgataccgggtgctttggctttggcattcaggagcatattgatttaggaattaagtatgatccgtctactggcatttatggaatggacttctatgttgttttggagcgccctggttaccgtgtgggacgccgccgccggtgcaagtcacatgttgggatccagcaccgcctatcgaaggaggatgccatgaagtggttccaagtgaaatacgaaggagtgatcctgaacaaggcccaggcaacctttggttagattgtaatattgatagttgcagcaagtttcagttttcttattttagtttcaggtagacttgtgtgtgtttggtttgagagtaaagattgcaatgcaaaagaaaagggaaaaaattggcaagagactcatccggtatcgttgaaaagcattttcttattctctgaaa

SEQ ID NO: 5028 - DNA, 716 bp, Malus domestica
ggggtgtgggaaatgcaggctgaagagaagaagttagcgaaccccatgagggagatcaaggtccagaagctggtgctcaacatctccgtcggtgagagcggagatagactcacgagagccgccaaggtgttggagcaactcagtggccaaacacccgttttctccaaagcgaggtacactgttcgatcctttggtatcaggcgcaatgagaagattgcctgttatgtcaccgtgaggggcgacaaggcgatgcaacttttggagagtggattgaaggtcaaggaatatgagttgctacgaaggaacttcagtgacactggttgttttggatttggcatccaggagcacattgatttgggaatcaagtacgatccttctactggtatctatggaatggatttctacgttgttttggagcgtccaggttaccgtgtgggtcgtcgtcgcaggtgcaagtctcgcgtggggatccggcacagggtcacaaaggatgatgccatgaaatggttccaggtcaagtatgagggtgtgattcttaacaagtcacagcagctcacagcttaggccccaacttttgtcgaattagtttgttcagtctctatgaccagcttctgttaaatttcagttttgtcaaagcttgagttaaggtttagaacagagtatgttaatttgtttttcgaatgatatccttctggatatacctctaaaaattttgt

SEQ ID NO: 5029 - DNA, 739 bp, Arabidopsis lyrata
agatctagggtttatatattttgccgcctcatctccgttttcccgtcggccggagtttaatcgcaaccttaatcagaaatggcgtcggagaagaagctatcgaacccaatgagggacattaaagtgcagaaactggttcttaacatctccgtcggtgagagtggagatcgtctcaccagagcctccaaggtgttggaacaattgagtggtcagactcctgttttctccaaggcccgatacactgttcgttcttttggtatcagacgtaatgagaagattgcttgctatgtgactgtcaggggagagaaggcaatgcagctccttgagagtggactgaaagttaaagaatacgaactcttgagaaggaactttagcgacactggttgctttggttttggtattcaagagcacattgatttgggtatcaagtatgatccatcgactggaatctacggtatggacttctatgttgttcttgagcgacctggttaccgtgtggcacgtcgcagaagatgcaaagctcgtgttggaatccagcatagagtaacgaaagatgatgccatgaaatggttccaggtgaaatatgaaggagtcattctcaacaagtctcagaacattactggctaaaaaagtgtgtcaaacaaatatctataatctgttttttctgttgggttcaaatcttactttctcagttttgttttgtttctctgttcttcagacatttgaattttccttatat

SEQ ID NO: 5030 - DNA, 734 bp, Arabidopsis lyrata
ttgccgcctcatctccgttttcccgtcggccggagtttaatcgcaaccttaatcagaaatggcgtcggagaagaagctatcgaacccaatgagggacattaaagtgcagaaactggttcttaacatctccgtcggtgagagtggagatcgtctcaccagagcctccaaggtgttggaacaattgagtggtcagactcctgttttctccaaggcccgatacactgttcgttcttttggtatcagacgtaatgagaagattgcttgctatgtgactgtcaggggagagaaggcaatgcagctccttgagagtggactgaaagttaaagaatacgaactcttgagaaggaactttagcgacactggttgctttggttttggtattcaagagcacattgatttgggtatcaagtatgatccatcgactggaatctacggtatggacttctatgttgttcttgagcgacctggttaccgtgtggcacgtcgcagaagatgcaaagctcgtgttggaatccagcatagagtaacgaaagatgatgccatgaaatggttccaggtgaaatatgaaggagtcattctcaacaagtctcagaacattactggctaaaaaagtgtgtcaaacaaatatctataatctgttttttctgttgggttcaaatcttactttctcagttttgttttgtttctctgttcttcagacatttgaattttccttatatttgcctatctctact

SEQ ID NO: 5031 - DNA, 814 bp, Arabidopsis lyrata
acactacgcagccgacgcaattcgtctgccactcttttttactcatctccttcgatttcgaactcctaatcttcagatggcgtcggagaagaagctctcgaaccctatgagggatattaaggttcagaagctagttcttaacatctctgttggtgagagtggtgatcgtctcactcgtgcctccaaggtgttggaacagctcagtggtcaaacccctgtcttctctaaggcgaggtacactgtgaggtctttcggtatcaggcgtaatgaaaagattgcgtgttatgtcaccgttagaggtgagaaggcaatgcagcttcttgagagtggcttgaaagtgaaggaatacgagctcttgaggaggaacttcagtgacactggctgctttggattcggtatccaggagcacattgatcttggaatcaagtatgatccttctactggtatctacggtatggatttctacgttgttcttgaacgcccgggataccgtgttgcccgtcgccgtagatgcaaggctcgcgttggtattcaacatagagttaccaaggatgatgccatgaagtggttccaagttaagtatgaaggagttatcctcaacaagtctcagaacatcactggttgaagagtttttttcattttgttttgtggtgttagctctctgtctcagaacatcgctcttgggatctcttgttttttgtatctttttttaacttcagttggtttagaatctaagtaccctcgagatatgaacaatttttggaggttatcgttatcaattttaaactctatctactttaaacaaaaaaaaaaa

SEQ ID NO: 5032 - DNA, 816 bp, Arabidopsis lyrata
gcacgcaacgcagtttcgttttcgcaaactctacattgcttcctctcttagctcgactttgatctccttaaaatggcgtcggagaagaagctctcgaatcccatgagggacattaaggttcagaaacttgttctcaacatttccgttggtgagagtggtgatcgtctcactcgtgcctcaaaggtgttggaacagctcagtggtcaaacccctgtcttctccaaagcgaggtacactgtgaggtcttttggtattaggcgtaatgagaagattgcgtgttatgtgactgtgagaggtgagaaggcaatgcagcttcttgagagtggtttgaaagttaaggagtatgagcttcttaggaggaactttagtgacactggttgctttggattcggtatccaagagcacattgatcttggaatcaagtatgatccttccactggtatctacggaatggacttctacgttgtccttgaacgcccaggataccgtgtggctcgtcgccgaagatgcaaggctcgtgttggtattcagcacagagtaactaaggacgatgcaatgaaatggttccaggtcaagtatgaaggagttattctcaacaagtctcagaacatcactggttaaaaagtcttttgatctttaaagatttttgttgattctagcttatttcaagttgttatctttggatgttaaagagtttcttgttgtagtaaaacctttttgacgtgagtttggtagaatctgaatcttccaagaaccttggagatatgttttttatttattcattgtcatcatcaaaacttaaatcaatcaaaagca

SEQ ID NO: 5033 - DNA, 803 bp, Arabidopsis lyrata
tttcgttttcgcaaactctacattgcttcctctcttagctcgactttgatctccttaaaatggcgtcggagaagaagctctcgaatcccatgagggacattaaggttcagaaacttgttctcaacatttccgttggtgagagtggtgatcgtctcactcgtgcctcaaaggtgttggaacagctcagtggtcaaacccctgtcttctccaaagcgaggtacactgtgaggtcttttggtattaggcgtaatgagaagattgcgtgttatgtgactgtgagaggtgagaaggcaatgcagcttcttgagagtggtttgaaagttaaggagtatgagcttcttaggaggaactttagtgacactggttgctttggattcggtatccaagagcacattgatcttggaatcaagtatgatccttccactggtatctacggaatggacttctacgttgtccttgaacgcccaggataccgtgtggctcgtcgccgaagatgcaaggctcgtgttggtattcagcacagagtaactaaggacgatgcaatgaaatggttccaggtcaagtatgaaggagttattctcaacaagtctcagaacatcactggttaaaaagtcttttgatctttaaagatttttgttgattctagcttatttcaagttgttatctttggatgttaaagagtttcttgttgtagtaaaacctttttgacgtgagtttggtagaatctgaatcttccaagaaccttggagatatgttttttatttattcattgtcatcatcaaaacttaaatcaatcaaaagca

SEQ ID NO: 5034 - DNA, 749 bp, Arabidopsis thaliana
agtcgttcgttctccgtctctcctttcccgtcggccggtgataatttcgcaacccaaattccaaatggcgtcggagaagaagctatcgaacccaatgagggacattaaagtgcagaagctggttctcaacatctccgttggtgagagtggagatcgtctcaccagagcctccaaggttttggaacaattgagtggtcagactcctgttttctccaaagctagatacactgttcgttcttttggtatcagacgtaacgagaagatcgcatgctatgtaaccgtcagaggtgagaaggcaatgcaactacttgaaagtggattgaaagtcaaggaatacgaacttctcagaagaaacttcagtgacactggttgcttcggttttggtattcaagaacacattgatttgggtatcaagtacgatccatcaactggaatctatggtatggacttctatgtggtcctagaacgtcctggctaccgtgtagcacgtcgcagaaggtgcaaggctcgtgttggtatccaacacagagtaactaaagacgatgcaatgaaatggttccaggtgaaatacgaaggagtcattctcaacaagtcccagaacatcactggctaaaacaattcctcctaactctttcttctgttttagaaaaccctgtctcagttttgtttacttgtctgaatcttaatctttgtactttatatgcattattggctttagtttcagttatttaagtatctaatttcgtgtg

SEQ ID NO: 5035 - DNA, 730 bp, Arabidopsis thaliana
gtcgtttcgttctccgtctctcctttcccgtcggccggtgataatttcgcaacccaaattccaaatggcgtcggagaagaagctatcgaacccaatgagggacattaaagtgcagaagctggttctcaacatctccgttggtgagagtggagatcgtctcaccagagcctccaaggttttggaacaattgagtggtcagactcctgttttctccaaagctagatacactgttcgttcttttggtatcagacgtaacgagaagatcgcatgctatgtaaccgtcagaggtgagaaggcaatgcaactacttgaaagtggattgaaagtcaaggaatacgaacttctcagaagaaacttcagtgacactggttgcttcggttttggtattcaagaacacattgatttgggtatcaagtacgatccatcaactggaatctatggtatggacttctatgtggtcctagaacgtcctggctaccgtgtagcacgtcgcagaaggtgcaaggctcgtgttggtatccaacacagagtaactaaagacgatgcaatgaaatggttccaggtgaaatacgaaggagtcattctcaacaagtcccagaacatcactggctaaaacaattcctcctaactctttcttctgttttagaaaaccctgtctcagttttgtttacttgtctgaatcttaatctttgtactttatatgcattattggctttagtttcagttattt

SEQ ID NO: 5036 - DNA, 822 bp, Arabidopsis thaliana
tagaactagggtttatatagtttgccgcttcatctccgtttcttctttccgattcgtgttttcccgtcggccggagatatatcgcaaccctaatccgaaatggcgtcggagaagaagctatcgaacccaatgagggacattaaagtgcagaagctggttctcaacatctccgttggtgagagtggagatcgtctcaccagagcctccaaggtgttggaacaattgagtggtcagactcctgttttctccaaggctcgatacactgttcgttcttttggtataagacgtaatgagaagattgcttgctatgtgactgtcaggggagagaaggcaatgcagctccttgagagtggattgaaagttaaagaatacgaactcttgagaaggaacttcagcgacactggttgctttggttttggtattcaagagcacattgatttgggtatcaagtatgatccatcgactggaatctacggcatggacttctatgttgttcttgagcgaccaggttaccgtgttgcgcgccgcagaagatgcaagactcgtgttggaatccagcatagagtgacgaaagatgatgccatgaaatggttccaggtgaaatatgaaggagtcattctcaacaagtctcagaacatcactggttaaacaaatgtgtcaaacaaatagctatcatctgttttgttttttttgggttcaaatcgtattttctcagttttgttttgcttctctgttcttcagacattttgattttcctttatatattttgcgtatctactactccgacaaaagctgactaaaggtctaaaacacatttccgaa

SEQ ID NO: 5037 - DNA, 800 bp, Arabidopsis thaliana
acactacgcagccgacgcaattcgtgtgccactctatttgctcatctccttcgatttcgaacccctaatcttgagatggcatcggagaagaagctctcgaaccctatgagggatattaaggtccagaagctagttcttaacatctctgttggtgagagtggtgatcgtctcactcgtgcctccaaggtgttggaacagctcagtggtcaaacccctgtcttctctaaggcgaggtacactgtgaggtctttcggtatcaggcgtaatgaaaagattgcgtgttatgtcactgttagaggtgagaaggcaatgcagcttcttgagagtggcttgaaagtgaaggaatacgagctgttgaggaggaacttcagtgacactggctgcttcggattcggtatccaggagcacattgatcttggaatcaagtatgatccttctaccggtatctacggtatggatttctacgttgttcttgaacgtccaggataccgtgtggcccgtcgccgtagatgcaagactcgcgttggtattcaacatagagttaccaaggatgatgccatgaagtggttccaagttaagtatgaaggagttatcctcaacaagtctcagaacatcactggttgaagagcttttttttgtcattttgttttgtttcaagttcttatatttaagattctggatagtaaggatttcgtgttgtggtaacctttttgacttaagttggttaagaatcttcaagtaccttctaaatatgaaaccatttttgggggtttttgtttaccaattctaaaccttttcag

SEQ ID NO: 5038 - DNA, 749 bp, Arabidopsis thaliana
cgtgtgccactctatttgctcatctccttcgatttcgaacccctaatcttgagatggcatcggagaagaagctctcgaaccctatgagggatattaaggtccagaagctagttcttaacatctctgttggtgagagtggtgatcgtctcactcgtgcctccaaggtgttggaacagctcagtggtcagactcctgtcttctctaaggcgaggtacactgtgaggtctttcggtatcaggcgtaatgaaaagattgcgtgctatgtcaccgtgagaggtgagaaggcaatgcagcttcttgagagtggcttgaaagtgaaggaatacgagctgttgaggaggaacttcagtgacactggctgcttcggattcggtatccaggagcacattgatcttggaatcaagtatgatccttctaccggtatctacggtatggatttctacgttgttcttgaacgtccaggataccgtgtggcccgtcgccgtagatgcaagactcgcgttggtattcaacatagagttaccaaggatgatgccatgaagtggttccaagttaagtatgaaggagttatcctcaacaagtctcagaacatcactggttgaagagcttttttttgtcattttgttttgtttcaagttcttatatttaagattctggatagtaaggatttcgtgttgtggtaacctttttgacttaagttggttaagaatcttcaagtaccttctaaatatgaaaccatttttgggggt

SEQ ID NO: 5039 - DNA, 842 bp, Arabidopsis thaliana
gcactcgacgcagttttgggctttgcaaactctacactgcttcgtctcttagctcgacattgatctccttaaaatggcgtcggagaagaagctctcgaaccccatgagggacattaaggttcagaaacttgttctcaacatttccgttggtgagagtggtgatcgtctcactcgtgcctccaaggtgttggagcagctcagtggacaaacccctgtcttctctaaggcgaggtacactgtgaggtcttttggtatcaggcgtaatgagaagattgcgtgttatgtgactgtgagaggtgagaaggcaatgcagcttcttgagagtggtttgaaagttaaggagtatgagcttcttaggaggaacttcagtgacactggttgctttggatttggtatccaagagcacattgatcttggaatcaagtacgatccttccactggtatctacggaatggacttttacgttgtccttgaacgcccaggatatcgtgtggctcgccgccgtagatgcaagactcgtgttggtattcaacacagagtaaccaaggatgatgcaatgaaatggttccaggtcaagtatgaaggagttatcctcaacaagtctcagaacatcactggttaaaaagtgttttgatctttaaagatttttgttgattctagcttattttaagttgttatctttggatgttaaagaatttcttgttgtagtaaatcttttgacatcagtttggtagaatctaaatcttccaagaaccttggagatatgtttcttattttattcaatgtcatcatcaaaactaaaatcaatcaaaagcagctcctttgatttcattgtccttata

SEQ ID NO: 5040 - DNA, 759 bp, Arabidopsis thaliana
gttttgggctttgcaaactctacactgcttcgtctcttagctcgacattgatctccttaaaatggcgtcggagaagaagctctcgaaccccatgagggacattaaggttcagaaacttgttctcaacatttccgttggtgagagtggtgatcgtctcactcgtgcctccaaggtgttggagcagctcagtggacaaacccctgtcttctctaaggcgaggtacactgtgaggtcttttggtatcaggcgtaatgagaagattgcgtgttatgtgactgtgagaggtgagaaggcaatgcagcttcttgagagtggtttgaaagttaaggagtatgagcttcttaggaggaacttcagtgacactggttgctttggatttggtatccaagagcacattgatcttggaatcaagtacgatccttccactggtatctacggaatggacttttacgttgtccttgaacgcccaggatatcgtgtggctcgccgccgtagatgcaagactcgtgttggtattcaacacagagtaaccaaggatgatgcaatgaaatggttccaggtcaagtatgaaggagttatcctcaacaagtctcagaacatcactggttaaaaagtgttttgatctttaaagatttttgttgattctagcttattttaagttgttatctttggatgttaaagaatttcttgttgtagtaaatcttttgacatcagtttggtagaatctaaatcttccaagaaccttggagatatgtttct

SEQ ID NO: 5041 - DNA, 763 bp, Brassica juncea
atggcgtcagagaagaagctctcgaaccctatgagggacatcaaggttcagaagctcgttcttaacatctctgttggtgagagtggtgatcgtctcacccgtgcctccaaggtgttggaacagctcagtggtcaaacccctgtcttctccaaggctagatacactgtgaggtcttttggaatcaggcgtaacgaaaagattgcttgctatgtcaccgtgagaggagacaaggctatgcagcttcttgagagtggattgaaagtgaaggagtacgagcttttgaggaagaacttcagtgacactggctgttttggattcggtatccaggagcacattgatcttggaatcaagtatgatccttccactggtatctatggaatggacttctatgttgttcttgaacgtcctggataccgtgtggcccgtcgccgtaggtgcaagactcgcgttgggattcaacatagagttacaaaggatgatgccatgaagtggttccaagttaagtacgaaggtgttatcctcaacaagtctcagaacatcactggttgaagcgttttgtttctattttgttttttttttgtggtgctgttagctcgtctcagaacatcgcgttaagatctcttgttttgtatctgttttttttttcttacttcagtcctacgtacccgacatgaacaattttttggaggttatcgttatcaattttaaacaatctctctgctttaaattactccaagcaatatctcttatctctgtttcgcac

SEQ ID NO: 5042 - DNA, 786 bp, Brassica oleracea
gccactcgacgcagcttcgcttccgcaactctctttgcttcctctctctccgctcgattgtcgatctccttcaaatggcgtcggagaagaagctgtcaaacccaatgagggacattaaggtccagaaacttgttctcaacatctccgttggtgagagtggtgatcgcctcactcgtgcctccaaggttttggaacagctaagcggacaaacccctgttttctcaaaggcgaggtacacagtgaggtcttttggtatcaggcgtaacgaaaagattgcctgctatgtcactgtgagaggtgacaaggcaatgcagcttcttgaaagtggtttgaaagttaaggagtatgagcttcttaggaagaactttagtgacactggttgctttggtttcggtatccaagaacacattgatcttggtatcaagtatgatccatctaccggtatctatggaatggacttctatgtagttcttgaacgtccaggataccgtgttgctcgtcgccgtagatgcaaggctcgtgttggtatccaacacagagtgactaaggatgatgcaatgaaatggttccaagttaagtatgaaggagttatcctcaacaagtctcagaacatcactggctaaattgtacttgaatcttcatagatttttgttgattctagcttttgtttttcaagttatcatctttactttttctggatattgaagccagtgtggtagaaactaaatttccaagtgtatgagttactgtttttgtttttttacaattatcaaaaccttggacttc

SEQ ID NO: 5043 - DNA, 582 bp, Bupleurum chinense
tcgccattcccctcaccgcactgccattttcaccaactgcaagatcgccatggcctccgataggaaattagcgaatccgatgagagagatcaaggttcagaagcttgttctcaatatatctgttggagagagtggagatcgacttaccagagcctccaaggtcttggaacaactaagtggacaaatgcctgttttctctaaagcaaggtatactgtgaggtcctttggtatcaggcgtaatgagaagattgcatgttacgtaacagtgaggggtgacaaggccatgcaactccttgagagtgggttgaaagtcaaggaatacgaactgctcagaaagaatttcagtgataccgggtgttttggctttggtatccaggaacacattgatcttggaattaagtatgatccctccactggtatttatggtatggatttctttgttgtgcttgagcgtcctggttatcgagttggacgtcgtcgcagatgcaaatctcgtgttggaatccagcacagagttacaaaggaggatgcaatgaaatggtttcaagtcaagtacgagggtgtgatcctcaacaagtccca

SEQ ID NO: 5044 - DNA, 785 bp, Bupleurum chinense
tcttcctcatttttgctcttattgcagaagctaacgtcaaccaaccgagaaatcgcaatggcttcagataggaaactagcgaacccgatgagggaaatcaaggttcagaaacttgttctcaacatatctgttggagagagtggagatagactcactagagcctcaaaggtgttggagcaactctctggacagatccctgttttctcaaaagcaaggtacactgtaagatctttcggaatcaggagaaatgagaagattgcttgctatgtcactgtgagaggtgacaaggcaatgcagcttttggagagtggattgaaggtcaaggaatacgagttgctgaggaagaacttcagtgatactggatgttttggctttggtatccaggagcatattgatcttggaattaagtatgacccttctactggtatttatggtatggacttctatgttgtacttgaacgtcccggttaccgtgttgggcgtcgtcgaagatgcaaatctcgtgttggaatccagcacagagttacaaaggaggatgcaatgaagtggttccaagtcaagtacgagggtgtcatccttaacaagtcacagaatattggaaattgagagtttacatgatgagtgtttctagactagcaatgcatttttctttcagtgttttgaacagaaacagtaatgttttttacccatgtcagatgtattttaacagctgttttcttgctataatctcaagttccttccataccctgcaagatcactaatgttggaagacttatatatatgcc

SEQ ID NO: 5045 - DNA, 1068 bp, Brassica napus
ctttgcttcctatctctcagctcgattgtcgatctccttcaaatggcgtcggagaagaagctgtcaaacccaatgagggacattaaggtccagaaacttgttctcaacatctccgttggtgagagtggtgatcgtctcactcgtgcctccaaggttttggaacagctaagcggacaaacccctgttttctcaaaggcgaggtacacagtgaggtcttttggtatcaggcgtaacgaaaagattgcctgctatgtcactgtgagaggtgacaaggcaatgcagcttcttgaaagtggtttgaaagttaaggagtatgagcttcttaggaagaactttagtgacactggttgctttggtttcggtatccaagagcacattgatcttggtatcaagtatgatccatctaccggtatctatggaatggacttctatgtagttcttgaacgtccaggataccgtgttgctcgtcgccgtagatgcaaggctcgtgttggtatccaacacagagtgactaaggatgatgcaatgaaatggttccaagttaagtatgaaggagttatcctcaacaagtctcagaacatcactggctaaattgtacttgaatcttcatagatttttgttgattctagcttttgtttttcaagttatcatctttacttttctggatattgaagaatcgcttgttctagtaaaacctctttttgacgccagtgtggtagaaactaaatttccaagttgtatgagttactgtttttgttttttacaattatcaaaaccttggacttcaatgttcttcgatttctgcaaactacccttaaacaagtacttttcgggtttctttggttttcacttttcagtagtaacagtctctaacttctggatcaagcgaccgcttgaaaaaaatcgattaataaacaatgcgctattacatgaatctcctagtaacgaagtgaagagtaagagcagtacacactgtacaatcaagagactgagtagaccttaactactcttgatgtatcacagaccataatatactcagaccaatgagagcttttaatcaccttattg

SEQ ID NO: 5046 - DNA, 882 bp, Cenchrus ciliaris
ccgaactgccctgcagaacccatctcacccacctcgccgtcgcctctcagatcttccccatggcgtcggagaagaagcagtcgaacccgatgcgggagatcaaggtccagaagctcgtgctcaacatatccgtcggcgagagcggtgatcgcctcactcgcgccgccaaggtgctcgagcagctgagtgggcagtcaccagtgttctccaaggcgaggtacactgtgaggtcgttcggcatcaggcgtaatgagaagattgcgtgctatgtgacggtcaggggagagaaggcaatgcagcttctggagagtggcctgaaggtcaaggagtacgagcttctgcggaggaacttcagtgagaccggctgcttcgggtttggtatccaggagcacattgatcttggcatcaagtatgacccatctaccggtatctacggcatggacttctacgtcgtccttgagcgtgcagggtaccgtgtcgcacgccgccgcaggtgcaagtcccgcgtcggtatccagcacagggtcaccaaggaggacgccatgaagtggttccaggtcaagtacgagggtgtgatcctcaacaaggcccaagccaactcctaagcatatcgcaagaagagcttagcccctctttagatctcgcgctatttaagcctatctggtggttggatttgaactagaagaaaaccagaatgttttgtcagttttgcctgtactactgcagttggatccttttctgggcgccgtatacttttcgtgttaatttctgcttgtgttttacccccatttgcactggcagcaatagtagatgtcttttctaagtatcgtcttgttctattttgttccgttcttggaaattcctgagcgccaacgtttgcta

SEQ ID NO: 5047 - DNA, 828 bp, Solanum melongena
ttcttcatctccttctgcagaaaaaaaaagctcgtcagaatggcgtcagagaagaaaatgagcaacccaatgagggatatcaaggttcagaagctagtcctcaacatctccgtcggtgagagcggagatagacttaccagggcagctaaggtcttggagcaactaagtggtcaatcccctgttttctccaaagctaggtatactgtgcgatcctttggaatcaggcgtaatgagaagatagcttgctatgtcactgtgagaggagagaaagctatgcagctccttgagagtggattgaaggtcaaggaatacgagttgttgagacgaaacttcagtgagactggctgctttggttttggtatccaggagcacatcgatcttggaattaagtatgacccttcaactggtatctacggtatggatttctatgttgtgctagagcgcccaggataccgtgttgctcgtcgccgtaggtgcaagtctcgagttggaattcagcacagggtcacaaaagaggacgcaatgaagtggttccaggtcaaatatgaaggtgtcatcctcaacaaatcctcaaacattcagtaagttggaaaatccatttttggatcagttcatctcccagcaagtgttttatgcattttgtagaccagcatttacttctctttgaggagttgaaaatttttggagagtttatgttatttggtatatctggctatgctagtttgttttcattttggctatcaaatgtttttcattttgtgctctttcttaatggtgagtttcaaatgttgcaacctgttgatttattattatagttttttttagttg

SEQ ID NO: 5048 - DNA, 951 bp, Solanum melongena
aacaacggcccataatcaatatcatttgtaaaagctagcattagggtttttcaccatcttcttcctcccttacaactttcccagctgctgcaatttcgcccagcaatggcttcagagaagaaaatgagcaaccctatgagggacatcaaggtgcagaagctcgtcctcaatatttccgtcggtgagagtggagatcgactcaccagagcagcaaaggtgttagagcaacttagcggacaatcacctgttttctccaaggcaaggtatactgtgcggtcctttggtatcaggcgtaatgaaaagatagcttgttacgtgactgtcagaggtgagaaggccatgcagctacttgagagcggattgaaggttaaggaatatgagttgttgagaaggaatttcagtgaaaccggctgctttgggtttggtattcaggagcacattgatcttggaattaaatatgatccttcaactggtatttatggtatggatttctatgttgtcttggagcgtcctggataccgtgttgctcgtcgccgcaggtgcaagtctcgcgtcgggatccagcacagggtgacaaaggaggacgcaatgaagtggttccaggttaaatatgaaggtgttatccttaacaagtcctcaaacattcagtgataagctgagagcctgcttagcaagtttatgcattttgttagactgatatctatatcactcctagatgaaagttttggtgagtttttggtgtatgaagatgtgttaaaagttcccattttggctaccaggtgaattcaatcttttttttttttgtggcaattacagtagaaccagtaatttagtattacaagagatattatgaatacctaattggtttccaattgtggtaatgaattggtgttgtttaaacatttttatcaaatttactttggggagttggatgtttcatgtttggcatgg

SEQ ID NO: 5049 - DNA, 731 bp, Zingiber officinale
  misc_feature (92)..(93): n is a, c, g, or t
gctagctgctgcctccgctcctctgctctctcgcaatggcctccgagaagaagcttgcgaatcccatgagggatattaaggtacagaagctnnttctcaatatctccgtcggcgagagtggcgatcgtcttaccagggcggcgaaggttttggaacagttgagtgggcagaccccagttttctctaaagcaagatatactgtacgttcctttggaatcaggcgtaatgagaagattgcatgctatgttacagtcagaggtgacaaagccatgcagctacttgaaagtggactgaaagtgaaggaatatgagttgttgagaagaaacttcagtgatactggctgctttggttttggtatacaagagcatatcgatcttggaataaagtatgatccctcaactggtatatatggcatggatttttatgtagtattagagcgacctggttatcgcgtgagccgccgccgcaggtgcaagtcgcgtgttggcattcatcagcgagtcacaaaagaggatgcaatgaaatggttccaggtgaaatatgagggtgtcatcctcaacaagtctcaggcgaccacttcatagagtttgatatgtccgaatcatgaaatttctttccaacagctgaacccatttgtttttatcagatcctttggagacaagaacttccatatctttcaattttgtatcagagaatattgtgctttagcagttaaattcttttgcttcggg

SEQ ID NO: 5050 - DNA, 646 bp, Panax ginseng
gcagctgcgaccttcaacgccgggaaattgccatggcttcagagaaaaagttattgaacccaatgagagagatcaaagtccagaagctggtcctcaacatttctgttggggagagtggagatcggctcaccagggcctctaaggtattggaacaactcagtggtcaaagccctgtgttctccaaagcaaggtatactgtgaggtcatttggtatcaggcgtaatgagaagattgcctgctacgtcacagtgaggggtgacaaggcaatgcagcttctagagagtgggttgaaggttaaggaatatgagttgctgaggaggaatttcagcgatactggctgtttcggctttggtatccaggagcacattgatcttggaattaagtatgacccttcaactggcattcatggaatggattcctatgttgtacttgaacgtccgggttaccgcgtgggacgtcgtcgtagatgcaaatctcgcgttggaatccaacacagggttacaaaggaggatgcaatgaaatggttccaggtcaaatacgagggtgtgatcctcaacaaatcccagaattttgggggttaatagagaagtattaaccagcctaaggtttatgctttttcaaactaacgggttgctcttgaagtggc

SEQ ID NO: 5051 - DNA, 946 bp, Eragrostis curvula
ggggccccgcttcccttgcgaccctccaccccctcctcactctccgccgccgtcgggttgcgtcgccgtcgccgccgccgccgcttcatccatggcgtccgagaagaagcagtcgaacccgatgagggatatcaaggtgcagaagctcgtcctcaacatctccgttggagagagcggggatcgcctcacccgtgccgctaaggtcctggagcaactgagtggacagtcaccagtgttttcaaaggctagatacactgtccgttcttttggtatcagacgtaatgagaagattgcatgctatgtgactgtgaggggcgagaaggcaatgcagcttttggagagtggattgaaggtcaaggaatatgaactgcttaggaggaacttcagtgacacagggtgctttggttttggaattcaggagcatattgatcttggcatcaagtatgatccttcaacaggtatttatggaatggacttctatgtcgtccttgagcgcgcgggataccgtgttgctcgtcgtcgcaggtgcaagtcccgtgttggaatccagcacagagtgaccaaggaggatgcgatgaagtggttccaggtgaagtacgaaggtgtcatcctcaacaagtcgcaggctaacgcttcttagaacctgatgtgtaggctcagccgttagagatgttatggccacaagttacactcctatgaatgttttagtccgctttgtgcaatctcagatcatgttatttacaaagtcttgtcacttgagccagtttttgactgaggaagctaaaatcatggatacattttgtcaaaaaaaaaaaaaaaaaaaaaaaaaaaattactcggcgttgataccccggtttaaccaatttcccgcggcccccttgggggcgggaacaaggcaactccgggcccattcccccaataggagtccaataaatttcctgccccc

SEQ ID NO: 5052 - DNA, 993 bp, Zea mays
accgcagccacaccccaacatcaaaaccctcccatctcttcccctccgccgccgtctctgctctcaagatcgccatggcgtcagaaaagaagcagtcgaacccgatgcgggagatcaaggtgcagaagctcgtgctcaatatctccgttggagagagtggagatcgactcacccgcgccgccaaggtgttggagcagttgagtgggcagtctccggttttctccaaggcaaggtatactgtgaggtctttcggtattcgtcgtaatgagaagattgcatgctacgttacggtcaggggtgagaaggcaatgcagcttcttgagagtggcctcaaggtgaaggagtatgagcttctgaggaggaacttcagtgatactggctgctttggttttggtattcaggagcacattgatcttggaatcaagtatgacccgtctactggtatttatggcatggacttttacgtcgttctggaacgagctggttatcgtgttgcacgtcggcgcaggtgcaagtcccgtgttggcatccagcacagggtgaccaaagaagacgccatgaagtggttccaggtgaagtacgagggtgtcatcctcaacaaggcccaaaacacctcgtaatcattgatagtcatcaaacgacttgcccttaattctgtgtactatgaacaaaacaccccgtgtttggttcaagtataatctgtgtactatgaattctgtgtttgttggataccaaatgcactgccagttttgcgtctgtgcccataattccatcttgataatcagactagcagttaggaacaaataactgttgttttgattgtgttaatttgagctcgccagcaaaatctaaggaacatctatcaggtacttcgttcacagttatgttgtgtgctgtcttgggttcaacgcctgtcaacagtatggacggttggtactgatttgttggtgcttctataaccgaagcttctgcttaaacttttgtttatccata

SEQ ID NO: 5053 - DNA, 760 bp, Pennisetum glaucum
cagaattccgccgccgccgccgccccttcccggcaccgcgctgcagaacctcgctcgccgtcgcctcccagacctcgcaatggcgtcggagaagaagcagtcgaacccgatgcgggagatcaaggtccagaagctcgtgctcaacatctccgtcggcgagagcggcgatcgcctcacccgcgccgccaaggtgctcgagcagctgagtgggcagtcaccggtgttctccaaggcgaggtatactgtgaggtcatttggcatcaggcgtaatgagaagattgcgtgctacgtgacggtgaggggagagaaggcgatgcaacttctggagagtggtctgaaggtcaaggagtacgagctgctccggaggaacttcagtgagaccggctgctttgggtttggtatccaggagcacattgaccttggcatcaagtatgacccatctaccggcatctacggcatggacttctacgtcgtccttgagcgggccgggtaccgtgtagcccgccgccgcaggtgcaagtcccgtgttggtatccagcacagggtcaccaaggaggacgctatgaagtggttccaggtcaagtatgagggtgtgatcctcaacaaggcccaggccacctcctaagcatcgcaagaagagcttagccgtctttagagcttggttaattaagtctatcaggtggttgggtttgtactagaattaaccaaaatccaattaaccaaaatcctttgtcagttttgcatgtactgggttggacct

SEQ ID NO: 5054 - DNA, 813 bp, Nuphar advena
ccgcggtggcggccgctcgtcactagtgggactccgggctgcaggatccgctggctggagggggagggcgaggcgaggcttcagagggcaggcaagaagatggcagcggagaagaaattgtcgaaccctatgagggagatcaaggttcagaagctcgtccttaacatctccgtcggagagagcggtgatcgattgacccgtgccgccaaggtcttggagcaattgagcggacagacgccggtgtactcaaaagctcggtacactgttaggtctttcggtatcagacgtaatgaaaagattgcttgctatgtcaccgttaggggcgagaaggcaatgcagcttttggagagtgggctgaaggtgaaggagtatgagttgctgaggaggaacttcagtgatactgggtgcttcgggtttgggatccaggagcatattgatcttggaataaagtacgatccctcaactgggatttacggtatggacttctatgtggttttggaacgtgctggataccgtgtgagccgtcgccgccgatgcaagtcacgacttggcattcatcatagggtaacaaaagaggatgccatgaagtggtttcaagttaaatatgagggtgtcatccttaacaagtctcaaactactgcttcctagttttcttctgtttctgttctaaggatttcagattcaattatgcttttattgagtttctgtctgcagataggaattaacacttgttgctttctatggaaagaatagtcttaagttgtattgggaaaagacattttgttcttagtttgtcagtatttttggaaggtg

SEQ ID NO: 5055 - DNA, 1152 bp, Pinus taeda
ttttgttttaaatattactcttaaattaatatcgtgagacggtgtcatgttcttaaattaatttactcttatattttgttttattaagtgcctagggtttatcaggtatttaaagtcatgctagggttttgaatggttattcgaggcagtgggaggcggtatcagcggaagcaggggcaggagtagcagagcatccgaaatggcagcggagaagaaactgagcaacaccatgagggaaattaaggtgcagaagttggtgctcaacatatcagttggtgagagtggtgatcggctcactcgagcctcgaaggtgttggagcaactcagtgggcaaactccagttttttccaaggcaaggtatactgtgaggtccttcggaatcaggcgaaatgaaaagattgcctgctatgttactgtgaggggagagaaggctcttcagcttttggagagtgggctgaaagtgaaggaatatgagttgctcaggaggaactttagcgatacaggttgttttggttttggaattcaggagcacattgatctgggaatcaagtatgatccttcaactggaatttatggtatggacttctttgtagtcctagaacgtcctggatacagaatcggcaggagaaagagagctcaatcccgtgttggcattcagcacagggttacaaaggacgatgccatgaagtggtttcaagttaaatatgaaggagtcattcttaacaagtcacaaaatatttaaacaagcagccttgataggtttgttattaagagtagtcttggtgggaatccacatttgtggacacaaggaatttgtcttgtcttggtttaatagatggatggaagactccatcatgtagccttagagtagtctcagcttggtgtaccagttctgttgacagcaaaaggatgaactttctatcttatatagtcatctcttttaaagagattttgaagtactgatttctttgtaattgagaattttttggtaggttgtgttgagatcatattgttccttaaagatcaagccatgcacttcttaattgaatacgtgcgtttgaacagagagattattaactatgtgtttaatggatgatataacattcctcctgtttatcaatattttaggtggttgtcaaatatttcacgctc

SEQ ID NO: 5056 - DNA, 836 bp, Raphanus sativus
ggtgtgtgtgctttgtagctcatgatcttactggacagaagactgtgatggacaagttcactcggatcgaaggtgattacaaggcgatcgtccagaatccaaacccgctgatccctcccatatttggtaccgacgagttcggttggtgcacggagtggaatccagcgatgtcaaagttaaccggtttgaagcgagaggaagtgatggacaagatgctgttaggagaagtgttcgggactcttctttgctcacctccctcaattttgaatcccttaatcgcaaagatggcgtcagagaagaagctgtcgaaccctatgagggacatcaaggttcagaagctcgttctcaacatctctgttggtgagagcggtgatcgtctcacccgtgcctccaaggtgttggaacagctcagtggtcaaacccctgtcttctccaaggcgaggtacactgtgaggtctttcggaatcaggcgtaacgagaagattgcttgctacgtcaccgtgagaggagacaaggcgatgcagcttctcgagagcggcttgaaagtcaaggagtacgagctgttgaggaggaacttcagtgacactggctgctttgggttcggtatccaggagcacattgatcttggaatcaagtacgatccttccaccggtatctatggaatggacttctacgttgttctcgaacgtcctgggtaccgtgttgcacgtcgccgtaggtgcaagactcgcgttgggattcagcatagagttacaaaggatgatgccatgaagtggttccaagttaagtacgaacgagttatcctcaacaagtctcagaacatcactggttgaaga

SEQ ID NO: 5057 - DNA, 871 bp, Raphanus sativus
ggctttcgctcccagcttttgccttctgtcggagtgttctcgcaaccttaaccgcaaatggcgtcggagaagaagctaacgaacccaatgagggacataaaagtgcagaagctggtgctcaacatctccgtcggcgagagtggagatcgtctcaccagagcctccaaggtcttggaacagttgagtggccagactcctgttttctccaaagcaaggtacactgttcgttcttttggtatcagacgtaacgagaagattgcttgctacgttaccgtcaggggagataaagctatgcagctccttgaaagtggactcaaggttaaagagtatgagctcttgagaaggaactttagcgacactggttgctttggtttcggtatccaggagcacattgatcttggtatcaagtatgacccgtcgactggaatctacggtatggacttctatgttgttcttgagcgtcctggttaccgtgtggcgcgtcgcagaagatgcaagactcgtgttggaatccagcacagagtcacgaaggatgatgccatgaagtggttccaagttaaatacgaaggagtcattctcaacaagtctcagaacattactggttaaacaacaaaattgtctcagttagagatctgtaatctgtgtgttttgtccacccctggtttgagtcgtattttatcagttttgttttttgcttctttgttcttcagacatttgagttttctttttagacattgcctatctacaattattgccatcaaaacaggtgtaagctgaggtaaaacacagtccaggatctaattatttcttttcgaactagttccatggatataaggtaatgaacattctttagatgtaatcaagttaacta

SEQ ID NO: 5058 - DNA, 1044 bp, Oryza sativa
cgctgtcgttcaaaaggccacttaccacaattgggcccatccagaaacctcttggtcgcagccaccgcctagggttgcgctctctcttttatcccagcgccgccacgccaccttccctcctccctcctcgccgccgacgaactcccggccatctccgccatggcgtcggagaagaagcagtcgaacccgatgcgggagatcaaggtgcagaagctcgtcctcaacatctccgtcggcgagagcggcgaccgcctaacccgcgcctccaaggtgctggagcagctcagcgggcagaccccggtgttctccaaggcgaggtacaccgtgcggtcgttcggaatcaggcgtaacgagaagatcgcgtgctacgtgacggtgagaggggagaaggcgatgcagctgctggagagcgggctcaaggtcaaggagtacgagctgctcaggaggaacttcagtgacaccggatgcttcggcttcggtatccaggagcacattgatcttggcatcaagtacgacccctcaacaggtatctatggaatggacttctatgttgtgcttgagcgtgctggctaccgtgttgcccgtcgtcggaggtgcaagtctcgcgttgggatccagcaccgggtgaccaaggaggatgccatgaagtggttccaggtcaagtatgaaggagtcatcctcaacaaggcccaggcgaatacctcttaaaacattttcacctgtaggctcagctgttagaaaagcttttcccttgttgggcagaagttcaccttccaagttttatgttacttgatgaattttccggccagatgtttttgtcaattacctgaaagctaagagcatgatctgatcttacatcatcttgtccaatgtcacacttgtgcttttgcatggaaacatgtagctacctctgaatctgatcacctacttacaattgcaagttcaggaaggtagtcccttctagattagatattttcaagagattggcgttttttttttcaaatactaccattctttttccctactgctctagctggcctgtcg

SEQ ID NO: 5059 - DNA, 1039 bp, Oryza sativa
cagaaacctcttggtcgcagccaccgcctagggttgcgctctctcttttatcccagcgccgccacgccaccttccctcctccctcctcgccgccgacgaactcccggccatctccgccatggcgtcggagaagaagcagtcgaacccgatgcgggagatcaaggtgcagaagctcgtcctcaacatctccgtcggcgagagcggcgaccgcctcacccgcgcctccaaggtgctggagcagctcagcgggcagaccccggtgttctccaaggcgaggtacaccgtgcggtcgttcggaatcaggcgtaacgagaagatcgcgtgctacgtgacggtgagaggggagaaggcgatgcagctgctggagagcgggctcaaggtcaaggagtacgagctgctcaggaggaacttcagtgacaccggatgcttcggcttcggtatccaggagcacattgatcttggcatcaagtacgacccctcaacaggtatctatggaatggacttctatgttgtgcttgagcgtgctggctaccgtgttgcccgtcgtcggaggtgcaagtctcgcgttgggatccagcaccgggtgaccaaggaggatgccatgaagtggttccaggtcaagtatgaaggagtcatcctcaacaaggcccaggcgaatacctcttaaaacattttcacctgtaggctcagctgttagaaaagcttttcccttgttgggcagaagttcaccttccaagttttatgttacttgatgaattttccggccagatgtttttgtcaattacctgaaagctaagagcatgatctgatcttacatcatcttgtccaatgtcacacttgtgcttttgcatggaaacatgtagctacctctgaatctgatcacctacttacaattgcaagttcaggaaggtagtcccttctagattagatattttcaagagattggcgttttttttttcaaatactaccattctttttccctactgctctagctggcctgtcgaaatcattcgtgacctgagttatcgttgaaagcttg

SEQ ID NO: 5060 - DNA, 758 bp, Senecio madagascariensis
agcggtggtcgagcggccgcccgggcaggtacgcgggggccgccgtaatttgttaacagcaacatcaatagcaatggcttcagagaggaaacaagcgaatccaatgagggaaatcaaggttcagaaacttgttcttaacatctctgtcggtgaaagcggtgatcgtctcactcgtgctgccaaggttttggagcaacttagcggccagtctcccgtcttttccaaggcaaggtacactgtgaggtcattcggaattaggcgtaatgagaagattgcatgttatgtaaccgttaggggagacaaagcaatgcagcttttggaaagtggcttgaaagtcaaggagtacgagctgctaagacgtaactttagtgacactggctgctttggatttggtattcaggaacacattgatctgggtatcaagtacgatccatctactggtatctacggcatggactttttcgtggttcttgaacgcccaggataccgtattggccgtcgtcgccgttgcaagtcccgtgttggtatccaacatagagttacaaaagaagacgccatgaagttctttcaggcgaaatatgagggtgttattctcaacaagtctcaacaaattggagcatagttggtatttacgagtcttttttggccaattgagataactcttaaatttgtattcagatattgtttgtcttctgtttgttgaatcttactagtagtgggtaatatggaactttctaagttttatgagcatatttatt

SEQ ID NO: 5061 - DNA, 1043 bp, Picea glauca
gtatttaaagagtcatgttagggttttgaatggttgtgtgagggttgggcggcagtatcagcagaagcaggcgcaggagtagcagagaatcatccaaaatggcagcggagaagaagctgaacaaccccatgagggaaattaaggtgcagaagttggtgctcaacatatcagttggtgagagtggtgatcgactcactcgagcttcaaaggtgttggagcaactcagtgggcagactccagttttttccaaggcaaggtatactgtaaggtcctttggaatcaggcgaaatgaaaagattgcctgctatgttactgttaggggagagaaggctcttcagcttttggagagtgggctgaaagtgaaggaatacgagttactcagaaggaactttagtgatacaggttgctttggttttggaattcaggagcacattgatctgggaatcaagtatgatccttctactggtatttatggtatggacttctttgttgtcctagagcgtcctggatacagaatcggcaggagaaagagagctcagtcccgcgttggcattcagcacagggttaccaaggacgatgccatgaagtggtttcaagttaaatatgaaggtgtcattcttaacaagtcacaaaatatttaaactagtagtcttggtatattccttattaagagtagtcttggcgtggatccacttctgttgacacagggattttgtcttggcttggtttaatagatgggtggaacattccatcatgtagccttagtaagagtagtctcaacttagtgtaccatttctgctgatagctaaaggaatgaactttttatctcatatagattcatctcttttaaagagattttggaagtgttgattatttttactcgagatttttttggtagtttgtgttgaaatcaccttgtttcttaattgaatatatgcattggattttgaacagagattattacctatgcgtttaatggatggttgtaacattccatatgtctatcaaaattttaggtggttgtgctacctgacattcattac

SEQ ID NO: 5062 - DNA, 1070 bp, Picea glauca
atgtatttaaagagtcatgttagggttttgaatggttgtgtgagggttgggcggctgtatcagcagaagcaggcgcaggagtagcagagcatcatccaaaatggcagcggagaagaagctgaacaaccccatgagggaaattaaggtgcagaagttggtgctcaacatatcagttggtgagagtggtgatcgactcactcgagcttcaaaggtgttggagcaactcagtgggcagactccagttttttccaaggcaaggtatactgtaaggtcctttggaatcaggcgaaatgaaaagattgcctgctatgttactgttaggggagagaaggctcttcagcttttggagagtgggctgaaagtgaaggaatacgagttactcagaaggaacttcagtgatacaggttgctttggttttggaattcaggagcacattgatctgggaatcaagtatgatccttctactggtatttacggtatggacttctttgttgtcctagagcgtcctggatacagaatcggcaggagaaagagagctcagtcccgtgttggcattcagcacagggttaccaaggacgatgccatgaagtggtttcaagttaaatatgaaggagtcattcttaacaagtcacaaaatatttaaactagtagtcttggtatattccttattaagagtagtcttggcgtggatccacttctgttgacacagggattttgtcttggcttggtttaatagatgggtggaacattccatcatgtagccttagtaagagtagtctcgaattagtgtaccatttctgctgacagctaaaggaatgaactttctatctcgtagatttatctcttttaaagagattttggaagtgttgattatttttacttgagaattttttggtagtttgtgtgttgagatcaccttgtttcttaattgaatatatgcgttggattttgaacagagattactacctatgcgtttaatggatggttgtaacattccgtatgtctatcaaaattttaggtggttgtgctacggctaccggcattcattttacgtgtgcaagtgttcttgc

SEQ ID NO: 5063 - DNA, 1199 bp, Picea glauca
ttttattaaaagttcctagggtttattattcctatgtattcaaagagtcatgttagggtttattattcatatgtatttaaagagtcatgttagggttttgaatggttgtgtgagggttgggcggcagtatcagcagaagcaggcgcaggagtagcagagcatcatccaaaatggcagcggagaagaagctgaacaaccccatgagggaaattaaggtgcagaagttggtgctcaacatatcagttggtgagagtggtgatcgactcactcgagcttcaaaggtgttggagcaactcagtgggcagactccagttttttccaaggcaaggtatactgtaaggtcctttggaatcaggcgtaatgaaaagattgcctgctatgttactgttaggggagagaaggctcttcagcttttggagagtgggctgaaagtgaaggaatacgagttactcagaaggaactttagtgatacaggttgctttggttttggaattcaggagcacattgatctgggaatcaagtatgatccttctactggtatttatggtatggacttctttgttgtcctagagcgtcctggatacagaatcggcaggagaaagagagctcagtcccgcgttggcattcagcacagggttaccaaggacgatgccatgaagtggtttcaagttaaatatgaaggtgtcattcttaacaagtcacaaaatatttaaactagtagttttggtatattccttattaagagtagtcttggcgtggatccacttctgttgacacagggattttgtcttggcttggtttaatagatgggtggaacattccatcatgtagccttagtaagagtagtctcaacttagtgtaccatttctgctgatagctaaaggaatgaactttttatctcatatagattcatctcttttaaagagattttggaagtgttgattatttttactcgagatttttttggtagtttgtgttgaaatcaccttgtttcttaattgaatatatgcattggattttgaacagagattattacctatgcgtttaatggatggttgtaacattccatatgtctatcaaaattttaggtggttgtgctacctgacattcattttatgtgcgcaagtgttcttgctttgggacatattcgtttttggttatctctgtgtcaatggttaaccttgaagatacgcttctta

SEQ ID NO: 5064 - DNA, 1031 bp, Picea glauca
ggatgtatttaaagagtcatgttagggttttgaatggttgtgtgagggttgggcggcagtatcagcagaagcaggcgcaggagtagcagagaatcatccaaaatggcagcggagaagaagctgaacaaccccatgagggaaattaaggtgcagaagttggtgctcaacatatcagttggtgagagtggtgatcgactcactcgagcttcaaaggtgttggagcaactcagtgggcagactccagttttttccaaggcaaggtatactgtaaggtcctttggaatcaggcgaaatgaaaagattgcctgctatgttactgttaggggagagaaggctcttcagcttttggagagtgggctgaaagtgaaggaatatgagttactcagaaggaactttagtgatacaggttgctttggttttggaattcaggagcacattgatctgggaatcaagtatgatccttctactggtatttatggtatggacttctttgttgtcctagagcgtcctggatacagaatcggcaggagaaagagagctcagtcccgcgttggcattcagcacagggttaccaaggacgatgccatgaagtggtttcaagttaaatatgaaggtgtcattcttaacaagtcacaaaatatttaaactagtagtcttggtatattccttattaagagtagtcttggcgtggatccacttctgttgacacagggattttgtcttggcttggtttaatagatgggtggaacattccatcatgtagccttagtaagagtagtctcaacttagtgtaccatttctgctgatagctaaaggaatgaactttttatctcatatagattcatctcttttaaagagattttggaagtgttgattatttttacttgagatttttttggtagtttgtgtgttgagatcaccttgtttcttaattgaatatatgcgttggattttgaacagagattattacctatgcgtttaatggatggttgtaacattccgtatgtctatcaaaattttaggtggttgtg

SEQ ID NO: 5065 - DNA, 946 bp, Picea glauca
gtgtgagggttgggcggctgtatcagcagaagcaggcgcaggagtagcagagcatcatccaaaatggcagcggagaagaagctgaacaaccccatgagggaaattaaggtgcagaagttggtgctcaacatatcagttggtgagagtggtgatcgactcactcgagcttcaaaggtgttggagcaactcagtgggcagactccagttttttccaaggcaaggtatactgtaaggtcctttggaatcaggcgaaatgaaaagattgcctgctatgttactgttaggggagagaaggctcttcagcttttggagagtgggctgaaagtgaaggaatacgagttactcagaaggaactttagtgatacaggttgctttggttttggaattcaggagcacattgatctgggaatcaagtatgatccttctactggtatttatggtatggacttctttgttgtcctagagcgtcctggatacagaatcggcaggagaaagagagctcagtcccgcgttggcattcagcacagggttaccaaggacgatgccatgaagtggtttcaagttaaatatgaaggagtcattcttaacaagtcacaaaatatttaaactagtagtcttggtatattccttattaagagtagtcttggcgtggatccacttctgttgacacagggattttgtcttggcttggtttaatagatgggtggaacattccatcatgtagccttagtaagagtagtctcaaattagtgtaccatttctgctgacagctaaaggaatgaactttctatctcgtagatttatctcttttaaagagattttggaagtgttgattatttttacttgagaattttttggtagtttgtgtgttgagatcaccttgtttcttaattgaatgtatgcgttggattttgaacagagattactacctatgcgtttaatggat

SEQ ID NO: 5066 - DNA, 995 bp, Picea glauca
tgtgagggttgggcggctgtatcagcagaagcaggcgcaggagtagcagagcatcatccaaaatggcagcggagaagaagctgaacaaccccatgagggaaattaaggtgcagaagttggtgctcaacatatcagttggtgagagtggtgatcgactcactcgagcttcaaaggtgttggagcaactcagtgggcagactccagttttttccaaggcaaggtacactgtaaggtcctttggaatcaggcgaaatgaaaagattgcctgctatgttactgttaggggagagaaggctcttcagcttttggagagtgggctgaaagtgaaggaatacgagttactcagaaggaacttcagtgatacaggttgctttggttttggaattcaggagcacattgatctgggaatcaagtatgatccttctactggtatttacggtatggacttctttgttgtcctagagcgtcctggatacagaatcggcaggagaaagagagctcagtcccgtgttggcattcagcacagggttaccaaggacgatgccatgaagtggtttcaagttaaatatgaaggtgtcattcttaacaagtcacaaaatatttaaactagtagttttggtatattccttattaagagtagtcttggcgtggatccacttctgttgacacagggattttgtcttggcttggtttaatagatgggtggaacattccatcatgtagccttagtaagagtagtctcaacttagtgtaccatttctgctgatagctaaaggaatgaactttttatctcatatagattcatctcttttaaagagattttggaagtgttgattatttttacttgagatttttttggtagtttgtgtgttgagatcaccttgtttcttaattgaatatatgcgttggattttgaacagagattattacctatgcgtttaattggatggttgtaacattccgtatgtctatcaaaattttaggtggttgtgacc

SEQ ID NO: 5067 - DNA, 1617 bp, Panicum virgatum
aaagtttcctcgaccgccgccgccgccgccgccccgcacaggcacagcactgcacaaccatctcacctccctcgccgtcgcctcccagatcttcacatggcgtcggagaagaagcagtcgaacccgatgcgggagatcaaggtccagaagctcgtgctcaacatctccgtcggcgagagcggtgatcgcctcacccgtgccgccaaggtgctcgagcagctgagtgggcagtcaccggtgttctccaaggcgaggtacactgtgaggtcgttcggcattaggcgtaatgagaagattgcgtgctacgtgacggtgaggggagagaaggcgatgcagctgctggagagtggcctgaaggtcaaggagtatgagctgctgaggaggaacttcagtgagaccggctgttttgggttcggtatccaggagcacattgatcttggcatcaagtatgacccatctactggtatctacggcatggacttctatgttgtccttgagcgtgctgggtaccgcgtggcgcgccgccgcaggtgcaagtcccgtgttggtattcagcacagggtcaccaaggaggacgccatgaagtggttccaggtcaagtacgagggtgtgatcctcaacaaggcccaagcctcctaggcatcacaagaagagcttttccaggcattagagcttgtgttacttaagtttatctggtggttgggtttttactagaagaaacagaaatgctgtcagttttgcctgtactgcagttggatccttttctgggtgcctgtactttcatcttaattctcacttgtgttttaccctcattggcagcaatagtagataactggcttaattctctaaagtagcgttttgttttgtttcgttcttggaaatcctgagcaccaaggttcgctacaaaatcgtggtaaattagacctgaacttgagatagtaaatatacacaatcgaaactgaacctgaactcgtctaccgtcctaaattgaacttgacgccatgtcagtcaattcttcccctgcacatttcgacctcttctctgtgctcgttaacaaactcctgcatagaaactagataacctctaaacgcttgaattgctaacgaaggtggcgtttgcttttattccctacagacgtttttcactcccaagttaaattaatactccaaatactcttttttgcgaggaaatttaactctttttaggcccatagctacatcattcaacttgcttaaaccctttttaggcccaaagcgttgtcgtcggaggcccaattagccttttcaagtcagcagcaaaatttcacgtgggctagacctaacaacctgggcctgcagcggacaggggttactgacatgtgagcccgctcccacgtgtcaatgttcagggtggacgtcagggagacgcgtggcagcgtgtgcgcaatagacgacgctgcctgaacccctgccgacgagcggtggtacttcctgtagcatacggagtacatgtcgtgcctggcgtgctggaacgacgacatcgtgcccttcgtgccagccgccggcgacgagctgccggacggaggtgaccggcgcccggaggaccgtcaggcatgcaagccttctgctagacctaatc

SEQ ID NO: 5068 - DNA, 869 bp, Triphysaria pusilla
aagacctactgcctctttgctccgccgacaacacagctcgtcatggcttcagagaagaaattgtcgaatccgatgagggagatcaaagtacagaagctggttctgaacatatccgtcggcgaaagcggcgatcgtctcaccagagcttcaaaggttctggagcaactcagtggacaaacacctgtcttctcgaaggccaggtatactgtccggtcctttgggatccggcgtaatgagaagattgcttgccatgtcactgtcagaggtgaaaaggcaatgcaacttcttgaaagtggcttgaaggtcaaggaatatgaattgctaaggaggaatttcagtgagacaggctgtttcgggtttggtatccaggagcacattgatcttggaatcaagtatgacccttcaactggaatctatggaatggacttttatgtcgtgttggagcgccctggttaccgtgtaggccgacgtcgtaggtgcaagtcccgtgttggaatccaacacagggtcaccaaggacgactcaatgaagtggttccagcagaagtacgaaggtgttatcctcaacaagtcttcaaacattggagcttaaaggtgttatcctcaacaagtcttcaaacattgaagcttaagtttcctatgttttatagtatgctttcagttatttgccagactcgaagttttgtagaattttgtttttctcggacggtttttattttgcttgtggtccattacattgagagcaggatgattcttgttgtgttttttgatatttgtttaactagcttgtttatttcacggtgttctcagttataaacaaacaaattatgagcaatttctcaactaattgaaagaactggtaaaactaaa

SEQ ID NO: 5069 - DNA, 900 bp, Triphysaria pusilla
atttattctgcacccttcgtcatttctcccccaagacctactgcctctttgctccgccgacaacacagctcgtcatggcttcagagaagaaattgtcgaatccgatgagggagatcaaagtacagaagctggttctgaacatatccgtcggcgaaagcggcgatcgtctcaccagagcttcaaaggttctggagcaactcagtggacaaacacctgtcttctcgaaggccaggtatactgtccggtcctttgggatccggcgtaatgagaagattgcttgccatgtcactgtcagaggtgaaaaggcaatgcaacttcttgaaagtggcttgaaggtcaaggaatatgaattgctaaggaggaatttcagtgagacaggctgtttcgggtttggtatccaggagcacattgatcttggaatcaagtatgacccttcaactggaatctatggaatggacttttatgtcgtgttggagcgccctggttaccgtgtaggccgacgtcgtaggtgcaagtcccgtgttggaatccaacacagggtcaccaaggacgactcaatgaagtggttccagcagaagtacgaaggtgttatcctcaacaagtcttcaaacattggagcttaaaggtgttatcctcaacaagtcttcaaacattgaagcttaagtttcctatgttttatagtatgctttcagttatttgccagactcgaagttttgtagaattttgtttttctcggacggtttttattttgcttgtggtccattacattgagagcaggatgattcttgttgtgttttttgatatttgtttaactagcttgtttatttcacggtgttctcagttataaacaaacaaattatgagcaatttctcaactaattgaaagaactggtaaaactaa

SEQ ID NO: 5070 - DNA, 745 bp, Triphysaria pusilla
ctgccgccgccgccccactccgtcgaccaccgtctcgcaatggcgtctgagaagaaattatcgaacccgatgagggagattaaggttcaaaagctcgttctcaacatctccgtcggagaaagtggagatcgtctcacaagagcttccaaggtgctggagcaactaagtggccaaactccagttttctccaaggctcgttatacggttagatcctttggtatccgacgtaacgaaaaaattgcttgctacgtgacggtcagaggtgacaaggcaatgcaactccttgagagtgggttgaaggtgaaggagtatgagctgttgagaaggaatttcagcgagactggatgtttcggtttcggtattcaggagcacatcgatcttggaattaagtatgacccgtcgactggtatttatgggatggacttttacgttgttttggggcgccctggataccgtgttggccgtcgccgtaggtgcaaggctcgtgttggaatccaacacagggtcaccaaggatgacgctatgaagtggttccaggtgaaatatgaaggtgtcattttgaacaagtcatccaacattggagcttaatagatttgagagcagtatctgggagcagtatctgactgaattggttatgtggttttcttatgtctttttgttactttcggttaaattttgtaggattctatcctttgacaaaatcctttttatccatattttgatttttgcttgatgatgaattata

SEQ ID NO: 5071 - DNA, 732 bp, Triphysaria pusilla
cgtcgaccaccgtctcgcaatggcgtccgagaagaaattgtcgaacccgatgagggagattaaggttcaaaagctcgttctcaacatctccgtcggagaaagtggagatcgtctcacaagagcttccaaggtgctggagcaactaagtggccaaaccccagttttctccaaggctcgttatacggttagatcctttggtatccgacgtaacgaaaaaattgcttgctacgtgacggtcagaggtgacaaggcaatgcaactccttgagagtgggttgaaggtgaaggagtatgagctgttgagaaggaatttcagcgagactggatgtttcggtttcggtattcaggagcacatcgatcttggaattaagtatgacccgtcgactggtatttatgggatggacttttacgttgttttggggcgccctggataccgtgttggccgtcgccgtaggtgcaaggctcgtgttggaatccaacacagggtcaccaaggatgacgctatgaagtggttccaggtgaaatatgaaggtgtcattttgaacaagtcatccaacattggagcttaatagatttgagagcagtatctgggagcagtatctgactgaattggttatgtggttttcttatgtctttttgttactttcggttaaattttgtaggattctatcctttgacaaaatcctttttatccatattttgatttttgcttgatgatgaattatatttgtga

SEQ ID NO: 5072 - DNA, 752 bp, Vinca minor
attaaaatctaagcagggtttcttttagtttgtttcttggcatttctctaaacccttcctccaaactgctccaccatcgctccgtcgtcgcagttcgcagcgccatggcatcagagaaaaaattgaacaacccaatgagggaaatcaaggtccagaagttggtactcaacatctccgtcggagagagcggtgatcgtctcaccagagctgccaaggttttggaacaactcagtggccaaacccctgttttctccaaggctaggtacactgttaggtcctttggaatcaggcgtaatgaaaagattgcctgctatgtgactgtgagaggcgataaggcaatgcagctcctggagagtgggttgaaggttaaggaatacgagctcttgaggaggaactttagtgacacaggctgcttcggttttggtattcaagagcacatcgatcttggaatcaaatatgacccatcaactggtatttatggtatggatttctttgtggtcttggagcgccctggttaccgagtagctcgtcgccgtaggtgcaaggcccgtgttggaattcaccagagagtgaccaaggaggacgccatgaagtggttccaggtcaagtatgaaggtgttatccttaacaaggcacaaaatattggaactgcttagagagtgggtgcagtgtagtaaaccattttaaattttagaaagtttataaagttgatgctttttgtagaccagatttactgatgagttcaaaatttt

SEQ ID NO: 5073 - DNA, 892 bp, Brassica rapa
accctcgacgcagttttgactccgcaacactcttctactccttgaaatggcgtcagagaagaagctctcgaaccccatgagggacattaaggtccagaagcttgttctaaacatctccgttggtgaaagtggtgatcgtctcacccgtgcctcaaaggttttggaacagctcagtggacaaacccctgttttctcaaaggcgaggtacactgtgaggtcttttggtattaggcgtaacgaaaagattgcgtgctacgtcactgtgaggggtgacaaggcaatgcagcttcttgagagtggcttgaaagtcaaggagtatgagcttcttaggaggaactttagtgacactggttgctttggattcggtatcccatagcacattgatcttggtatcaagtatgatccatctactggtatctacggaatggacttctatgttgttcttgaacgtccaggataccgtgtggcacgtcgtcgtagatgcaaggctcgtgttggtatccaacacagagtgactaaggatgatgcaatgaaatggttccaagtcaagtatgaaggagttatcctcaacaagtctcagaacatcaccggctaaaaagatttttgttgattttagctttgtttcgagttgtttatcttttaaagagttctggatgctaaagacctctttgttgtagtaaaaccttttgtgacgtctgtggtagtatctaaaatcttcgaaagaaccttggtgatatgattttttttgttttttcttttcttgaatttttatgttttaattacaaccatctcctttgactttatgctgaacaatccccacagcaaaataaacaattactttcgatcttgtcgaaatttttcaaggatgtctctttaagcatctttaagctgt

SEQ ID NO: 5074 - DNA, 886 bp, Zea mays
gatttagggtttccttaccttacaagctttttcttccgccgccgcctcagccctcgccccgcgctgctgtactctctcacctccttcgccgttgtctaccagatcatcccatggcgtcggagaagaagcagtcgaacccgatgcgggagatgaaggtccagaagctcgtgctcaacatctccgtcggcgagagcggtgatcgcctcacccgcgccgccaaggtactggagcagctgagtggtcagtcaccggtattctccaaggcaaggtacactgtgaggtcgtttgggatccggcgcaatgagaagatcgcatgctatgtgacggtgcggggtgagaaggcaatgcagctgctggagagtggcttgaaggtgaaggagtacgagctgctgaggaggaacttcagtgacactggctgctttggatttggcatccaagagcacattgatcttggcatcaagtatgatccatctactggtatctacggcatggacttctacgtcgtccttgagcgtgctgggtaccgtgtcgcccgtcgccgcaggtgcaagtcccgtgttgggatccagcatagggtcactaaggaagacgccatgaagtggttccaggtcaagtacgagggtgtgatcctcaacaaggcccaagccaacacctcctaagcctaagcgtcaccataagatattagaccctcttggtctcttctagtgcttcgagttaatggagtatatctggcggtgggatttgtattagaagaaaatcagatgcattatcatttttgcctgtactggtcctactggagttagttggatccatgtttttgtgtgtgtcgaatacattgatgttactactgttctacctcgacagcagtctgggctattctttgttc

SEQ ID NO: 5075 - DNA, 799 bp, Sorghum bicolor
ccgccgcacgccccgcgctgctggaccctctcacctccttcgccgtcgtctaacagatcttcccatggcgtcggagaagaagcagtcgaacccgatgcgggagatcaaggtccagaagctcgtgctcaacatctccgtcggcgagagcggtgatcgcctcacccgtgccgccaaggtgctggagcagctgagtggccagtcaccggtgttctccaaggcaaggtacactgtgaggtcgtttgggatccggcgtaatgagaagatcgcgtgctatgtgacggtgcggggtgagaaggcaatgcagctgctggagagtggcctgaaggtgaaggagtacgagctgctgaggaggaacttcagtgagactggctgctttggatttggtatccaagagcacattgatcttggcatcaagtatgacccatctactggtatctacggcatggacttctacgtcgtccttgagcgtgccgggtaccgtgtcgcacgtcgccgcaggtgcaagtcccgtgttgggatccagcacagggtcaccaaggaggatgccatgaagtggttccaggtcaagtacgagggtgtgatcctcaacaaggcccaagccaacacctcctaagcatcaccataagatattagaccctctttttagtgcttcgtgttaatgaagtgtttgtggcagtgggatttgtattagaagaaaaatcggatgcattatcagttttgccctgtactggtcctactggagttggatccatgtttttgtgtgcgccctatcttaaaaacttttattgaacagtttggc

SEQ ID NO: 5076 - DNA, 660 bp, Arabidopsis lyrata
ctccgtctctcctttcccgtcggccggtgataaattcgcaacccaaatccctaatggcgtcggagaagaagctatcgaacccaatgagggacattaaagtgcagaagctggttctcaacatctccgttggtgagagtggagatcgtctcaccagagcttccaaggttttggaacaattgagtggtcagactcctgttttctccaaagctagatacactgttcgttcttttggtaccagacgtaacgagaagatcgcatgctatgttactgtcagaggtgagaaggcaatgcaactacttgaaagtggattgaaagtcaaggaatacgaacttctcagaagaaacttcagtgacactggttgcttcggttttggtattcaagaacacattgatttgggtatcaagtacgatccatcaactggaatctacggtatggacttctatgtagtccttgaacgtcctggttaccgtgtggcacgtcgcagaagatgcaaggctcgtgttggtatccaacacagagtaactaaagacgatgcaatgaaatggttccaagtgaaatacgaaggagtcattctcaacaagtcccagaacatcactggctaaaaaagtcctcgaaactcttccttctattttagaaaacacttgtctcagttttgtttac

SEQ ID NO: 5077 - DNA, 713 bp, Arabidopsis lyrata
tccttcgtttccacctccgtctctcctttcccgtcggccggtgataaattcgcaacccaaatccctaatggcgtcggagaagaagctatcgaacccaatgagggacattaaagtgcagaagctggttctcaacatctccgttggtgagagtggagatcgtctcaccagagcttccaaggttttggaacaattgagtggtcagactcctgttttctccaaagctagatacactgttcgttcttttggtaccagacgtaacgagaagatcgcatgctatgttactgtcagaggtgagaaggcaatgcaactacttgaaagtggattgaaagtcaaggaatacgaacttctcagaagaaacttcagtgacactggttgcttcggttttggtattcaagaacacattgatttgggtatcaagtacgatccatcaactggaatctacggtatggacttctatgtagtccttgaacgtcctggttaccgtgtggcacgtcgcagaagatgcaaggctcgtgttggtatccaacacagagtaactaaagacgatgcaatgaaatggttccaagtgaaatacgaaggagtcattctcaacaagtcccagaacatcactggctaaaaaagtcctcgaaactcttccttctattttagaaaacacttgtctcagttttgtttacctctaaatcttaatccttgaagtacatgcatttttggct

SEQ ID NO: 5078 - DNA, 785 bp, Ocimum basilicum
tcatccgccgtcgccatggcttccgagaagaaattgtcgaacccgatgagagagattaaggtgcagaagctcgtcctcaacatctccgtcggcgaaagcggagatcgtctcaccagagctgctaaggtgttggagcaactcagtggccaaagtcctgttttctcaaaggcaagatacactgtccggtcctttgggatcagacgtaatgaaaaaatcgcctgctatgtcacggtcagaggtgaaaaggcgatgcaacttcttgagagtggcttgaaggtaaaggaatatgaactgttgaggcgaaacttcagtgagactggctgccctggtttcggtattcaggagcacattgatcttggaatcaagtatgacccttctacgggtatttatggtatggatttctatgttgtcttggaacgccctggataccgtgttggtcgtcgccgtaggtgcaagtcccgtgtcggaatccaacacagagtcaccaaggaagatgccatgaaatggttccaggtcaaatatgaaggtgttatcccgaacaaggcatccaacattggagcttgatggagaccactaggttttggagctggaggccgttttggctttgttggttttataagttttgtagaatttcatcagcaggcagacttttgaatttaacattttacatattatgttatgagtgttgctgcaatcttgttcttaagttgcttgacaatactttggtgatttcagattggttgtcatttaagaaatgtatgcgaaagcagatggatgactgagtt

SEQ ID NO: 5079 - DNA, 784 bp, Curcuma longa
ctcgtgccgaattcggcacgagggcttgatcctctttgccggcggcgattctcttctcttcaatggcttccgagaagaagctgtccaatccgatgagggagatcaaggttcagaagctcgtcctcaatatttccgttggcgagagcggcgatcgtctgaccagagctgctaaggttctcgagcaacttagtggacaaataccagttttctctaaagcaaggtacactgtccggtcctttggaattcggcgcaatgagaagattgcatgctatgtcacagttagaggtgacaaggcaatgcagcttttggaaagtggtttgaaagtgaaggaatacgagttgttgagaagaaacttcagtgatactggatgctttggttttggcatacaagagcacatcgatcttggaattaagtacgacccttccacaggtatctatggcatggacttctatgtcatcttggagcgtcctggctatcgtgtgagtcgtcgccgtcgctgcaaatcaagagttggcatccaccaacgtgtcaccaaggaggatgctatgaagtggttccaagttaagtatgagggagtcatcctcaacaaagcccagggaacaactaattaattaggattcgacacaactgaacctcgctacttgttctagagctgaattaaagctcatctatctactattttcccaaagtattatttttgcttgtaaaccgctcttatttgtggttaatccaaaccaagatctatgcttttggtaattgtcattctattttggtgccaaaaaaa

SEQ ID NO: 5080 - DNA, 881 bp, Fagopyrum esculentum
gaatatatatcgaagcaagatcttcactagccttggccgctccctgcaaaaacctagaactcgaagagaagtcgaaatggcgaccaaggacaagaaactgtcgaaccccatgcgtgacatcaaggttcagaagcttgttctgaatatctccgtaggagaaagtggagatcgtctcacccgtgcttctaaggttttggagcaactcagtggtcaaaccccagtgttctccaaggcgaggtacactgttcgatctttcggtatcaggcgtaatgagaagattgcttgctatgtcaccgttaggggagacaaggcaatgcagctacttgagagtggtttaaaggtcaaggaatacgagttgttgaggcgtaacttcagtgacactggttgctttggatttggtatccaggagcacattgatttgggtatcaagtacgatccatctaccggtatctatggtatggacttctatgtggtgttggagcgcccaggttaccgtgttgctcgcagacgtcgatgcaagtcccgtgttggaattcagcacagagttacaaaagatgatgccatgaagtggttccagatgaaatatgaaggtgtcatcctcaacaaatcacaaaacattactggttaagtctgaagaatttctttaggacagcgttgtagcctgagtgattttattttcctgatgaattttggaatatacatggtcatttcctttgaacgatacaagatcttgtatggaactagttgtttgtttgcttttgagaatgaatcctactttcaaaatgttttgattttccgatttcgaaagaaaaaaaaaacgaaaaacaaaaactaaactcgtgtgtatactacctacgtcgttcttcgtaggaacgtacgtc

SEQ ID NO: 5081 - DNA, 834 bp, Fagopyrum esculentum
atatcgaagcaaaacagtcttcactatccttcgccgcttcctgcaaaaaacctagaactcgaagagaagggcgaaatggcgaccaaggacaagaagctgtcgaaccccatgcgtgacatcaaggttcagaagcttgttctcaatatttccgtaggagaaagtggagatcgtctcacccgtgcttccaaggttttggagcaactcagtggtcaaacccctgtattctccaaagcgaggtacactgttcgatctttcggtatcagacgtaatgaaaagattgcttgctatgtcaccgttaggggagacaaggcaatgcagcttcttgagagtggtttgaaggtcaaggaatacgagttattgaggcgtaacttcagtgacaccggctgctttggatttggtatccaggaacacattgatttgggcatcaagtatgatccatctactggtatctatggtatggacttctacgtggtgttggagcgcccaggttaccgtgttgctcgtagacgcagatgcaagtcccgtgttggtattcagcacagagttaccaaggatgatgccatgaaatggtttcagatgaaatacgaaggtgtcatcctcaacaagtcacaaaacattactggttaagtctgaagtatatctttaggagcctaaaattttgaacgtgttgcttgtttgctttgaggatgtatctctgttttcttttagtgttggatttcatttccaatttctatttgataatctctcaatttaacttttagaacattatgaatcccaattttccaatgtttgccttctgattcgatcatcatctactttgctcgcctcttctgc

SEQ ID NO: 5082 - DNA, 763 bp, Fagopyrum esculentum
cagaaaaaacctagaactcgaatagaagtgcgaaatggcgaccaaggacaagaagctgtcaaaccccatgcgtgacatcaaggttcagaagcttgttctgaatatttcagtaggagaaagtggagatcgtctcacccgtgcttctaaggttttggagcaactcagtggtcaaacccctgttttctccaaggcgaggtacactgttcgatctttcggtatcagacgtaatgagaagattgcttgctatgtcaccgttaggggagacaaggcaatgcagcttcttgagagtggtttgaaggtcaaggaatacgagttgttgagacgtaacttcagtgacactggctgctttggatttggtatccaggaacacattgatctgggtatcaagtatgatccatctactggtatctatggtatggacttctacgtggtgttggagcgcccaggttaccgtgttgctcgcagacgccgatgcaagtcccgtgttggtattcagcacagagttaccaaggatgatgccatgaaatggtttcagatgaaatacgaaggtgtcatcctcaacaagtcacaaaacattactggttaagtctgaagtatatctttaggagcctaaaattttgaacgtgttgcttgtttgctttgaggatgtatctctgttttcttttaatgttggatttcatttccaatttctacttgataatctctctttatttaactcttagaacattttcctttgaggatgaatccctgatttcaaatattt

SEQ ID NO: 5083 - DNA, 707 bp, Fagopyrum esculentum
tctcttcttcgccgcactacagtcatctagagagtttaggttgagtgggcgaagatggccaccaaggacaagaagctttctaatcccatgagggacatcaaggttcagaagcttgttcttaacatttccgttggtgaaagcggagatcgtcttactcgtgcatccaaggtgttggagcaactcagtggacaaacccctgttttctcaaaggcaaggtacacggttagatcattcggtatcagacgtaatgagaaaatcgcttgttacgtaactgtgaggggcgacaaggcaatgcaactacttgagagtggtttgaaggtcaaggagtatgaattgctaagacgtaacttcagtgataccggctgctttggatttggtatccaggaacatattgatcttggaatcaagtatgatccttctactggtatctatggtatggatttctatgtggtgttggagcgccctggataccgtgttgctcgtcgccgcagatgcaagtcccgtgttggaatccagcaccgagtcaccaaggacgatgccatgaagtggttccagatgaaatacgaaggtgtcatcctcaacaagtcccaaaatatcacaggctaagcttatatttggattctggttcttaaactttgtttggtagcttttaggtgagccttcttcaccttgacaaattttgggcaatgttgttactcgaatctaca

SEQ ID NO: 5084 - DNA, 728 bp, Gerbera hybrid cultivar
gcttctctccctccatctccgccgtcgtaactgttcgcgacagccatggcttcagagaggaaacaatcgaatcccatgagagagatcaaggttcagaaactcgttctcaacatctccgtcggtgaaagcggagatcggctcactcgcgccgctcaggttttggagcaactgagtggccaatcccctgtcttttccaaggcaagttacactgtgaggtcattcggaattaggcgtaatgagaagattgcatgctatgtgactgttagaggagataaagcaatgcaacttttggagagtggtttgaaggtgaaggaatacgagttgcttagacgcaactttagtgatactggctgctttggattcggtattcaagaacacattgatctgggtatcaagtacgatccatcgacgggaatctacggaatggacttctatgtggttctagaacgtcccggttaccgtgtgggacgtcgccgcaggtgcaaggcccgtgttggcatccaacatagagttacaaaggatgatgcaatgaagtggtttcaggtcaaatacgagggagttattcttaacaaatctcaacaaatcggagcatgatttactgttttttttgctttgttcaggtaacttttttttatttgtaccagatgttttattattgctttcttttttggttgaaaaatatggaactcctaagttttaatgagagatttttggtagcttctttgaaa

SEQ ID NO: 5085 - DNA, 941 bp, Gnetum gnemon
aaaaattttttgatccagagcctcggttcagacaagcctgctggtgattgaagagcggaagatcaatctgccgttcgcgatggcgtccgagagaaagcaggacaatccgatgagggaaatcaaggttcagaaattagttctcaacatctcagttggtgaaagcggcgatcgtcttactcgcgctgccaaggttttagagcagttaagtgggcagactcctgttttttccaaggctagatataccgttagatcatttggaattaggaggaatgaaaaaattgcttgttatgtcactgtgagaggagagaaggctctccagcttctagagagtgggctgaaggtgaaagaatatgaacttttgaggaggaatttcagcgataccggctgttttggatttggaattcaggaacacattgatctgggaataaagtacgatccttccacaggtatttatggtatggacttctatgttgtactagagcgtcctggatacagagtaggcagaagaaagagagcaaagagtcgtgtcggtattcagcacagagttacaaaggaagaagcgatgaagtggtttcaggttaaatatgaaggtgttattcttaacaagtcacaagcaattgcccaataagcagagtttcttgaaatcactgtcaatttattcttaatattttgtttgagttttctctaattttttgactttctggctattatttgggcttctcgagtgcatttttatttgacaaacggtattcaaagatcaattaacagcaatattcttaatacactataaagaggaccttaaaaaccatttatcctgctttttcaactacatgttcatgccaatttttaactgtggttggtcaaactaaatgtacttctttgtgcatctaaggtactcatttattctgaaacatttttaaacagtgctatcaacacattcc

SEQ ID NO: 5086 - DNA, 719 bp, Guizotia abyssinica
gtttctcaagtctgctcattcaacaatggcttcagagaggaagcaggcgaacccaatgagggaaatcaaggttcagaagctcgtcctcaacatctcagtcggagaaagcggtgatcgtctcacccgtgctgctaaggttttggagcaactgagtggccaatctccagtcttctcaaaggcaaggtatactgtcaggtcattcggtatcaggcgtaatgagaagattgcatgctatgttaccgttagaggagataaggccatgcagcttttagagagcggtttgaaggtgaaggaatatgagttgttgcgtcgcaatttcagtgacaccggatgcttcggtttcggtattcaagaacacatcgattttggtatcaagtatgatccttctactggtatctatggtatggatttctttgtggttctggaacgacccggttatcgtgttgggcgccgccgccgatgcaaggctcgtgtcagtatccagcatcgggtcacgaaggacgatgccatgaaatggtttcaagtgaaatatgagggtgttattcttaacaaatcacaacaaattggagcttagtcagatgggttttcatggtttgtaaacttttggacttggagttttcaaattttagcatcaaggatgttatcagttatttggtgttatgttacgtttttaacactcatgtattagactgttttatggttgtcattaacctaagaat

SEQ ID NO: 5087 - DNA, 803 bp, Actinidia deliciosa
  misc_feature (694)..(694): n is a, c, g, or t
gcattttctctcacccgtcgcactgcccgcacctgcagcttcagcctcatacgacgagcaaccatggcatcggagaagaagctattgaacccgatgagagagatcaaggtccagaaactcgtcctcaacatctccgtcggcgagagtggagatcgcctcactcgagccgctaaggtcttggagcaactcagtggccaaacccctgttttctcgaaagcgaggtatactgtgcggtcctttgggatcaggcgtaatgagaagattgcttgctatgtcactgtcagaggtgagaaggcaatgcagcttctggagagtgggttgaaggtgaaggaatacgagctgctgcgaaggaacttcagtgataccggctgctttggctttggtattcaggagcacattgatctcggaattaagtatgatccttcaactggcatctacggtatggatttctatattgtcttggagcgccccggctaccgtgttgggcgtcgccgtaggtgcaaggcccgcgttggaattcagcacagggtcaccaaggatgatgccatgaagtggttccaggtcaaatatgagggtgtgatcctgaacaaggcccagaatcttacatcttaggtcttgaacatcgaagcatcagtttatgtttccagagagcttagcttttaatggtttatctgaccgtcatctattgcttacncagtttcaagttttggaagttctgtttgtgttttttggcagaccatgatatatatgttactgtttccaattttaagtagaactacttagttttgttcgcaaaaaaaaaa

SEQ ID NO: 5088 - DNA, 878 bp, Zea mays
ctgtctctagggtttccctcttttaattcccccgccgccgcccctcgccacgctccgccagccgctgccactcgccacgttccaccagccggcgccccttttccttctcactccgctggcgccggcgccgcgttatccatggcgtcggagaagaagcaatccaacccgatgagggagatcaaggtgcagaagctggtgctcaacatctccgtcggagagagtggggatcgcctcacccgcgccgccaaggtcctggagcaactgagtggccagtcaccagtgttctctaaggctaggtacactgtccgttcctttggtatcaggcgtaatgagaagattgcctgctatgttactgtaaggggtgagaaggcaatgcagcttctggagagtggacttaaggtcaaggaatatgaactgctaaggaggaacttcagtgacacagggtgctttggtttcggaatccaggagcacattgatcttggcatcaagtatgatccttcaaccggtatctacggaatggatttctacgtcgtccttgagcgcgctgggtaccgtgtcgcccgacgccgaaggtgcaagtcccgtgttgggatccagcacagggtgaccaaggaggatgctatgaaatggttccaggtcaagtacgagggtgtcatcctcaacaaggctcagggcaacacttcttagggacgcacatgttacagcccagccgttagacatgtttaccagtagcaacagagttttcacctctactgaagttttgtcgatctcggatgatattatttgccaagactgtttggacagaggagcttatgatctctatactttgaaagctgaatgcgccgattcatttggttctgcaatgtgcttcgttcgat

SEQ ID NO: 5089 - DNA, 792 bp, Zea mays
gctccgccagccgctgccactcgccacgttccaccagccggcgccccttttccttctcactccgctggcgccggcgccgccttatccatggcgtcggagaagaagcaatccaacccgatgagggagatcaaggtgcagaagctggtgctcaacatctccgtcggagagagtggggatcgcctcacccgcgccgccaaggtcctggagcaactgagtggccagtcaccagtgttctctaaggctaggtacactgtccgttcctttggtatcaggcgtaatgagaagattgcctgctatgttactgtaaggggtgagaaggcaatgcagcttctggagagtggacttaaggtcaaggaatatgaactgctaaggaggaacttcagtgacacagggtgctttggtttcggaatccaggagcacattgatcttggcatcaagtatgatccttcaaccggtatctacggaatggatttctacgtcgtccttgagcgcgctgggtaccgtgtcgcccgacgccgcaggtgcaagtcccgtgttgggatccagcacagggtgaccaaggaggatgctatgaagtggttccaggtcaagtacgagggtgtcatcctcaacaaggctcagggcaacacttcttagggacgcacatgttacagcccagccgttagacatgtttaccagtagcaacagagttttcacctctactgaagttttgtcgatctcggatgatattatttgccaagactgtttggacagaggagcttatgatctctatactttgaaagctgaatgcgc

SEQ ID NO: 5090 - DNA, 1026 bp, Zea mays
acgtacgtaattgtacacaagcaagcatagtacgatttagggtttccttaccttacaagctttttcttccgccgccgcctcagccctcgccccgcgctgctgtactctctcacctccttcgccgttgtctaccagatcatcccatggcgtcggagaagaagcagtcgaacccgatgcgggagatgaaggtccagaagctcgtgctcaacatctccgtcggcgagagcggtgatcgcctcacccgcgccgccaaggtactggagcagctgagtggtcagtcaccggtattctccaaggcaaggtacactgtgaggtcgtttgggatccggcgcaatgagaagatcgcatgctatgtgacggtgcggggtgagaaggcaatgcagctgctggagagtggcttgaaggtgaaggagtacgagctgctgaggaggaacttcagtgacactggctgctttggatttggcatccaagagcacattgatcttggcatcaagtatgatccatctactggtatctacggcatggacttctacgtcgtccttgagcgtgctgggtaccgtgtcgcccgtcgccgcaggtgcaagtcccgtgttgggatccagcatagggtcactaaggaagacgccatgaagtggttccaggtcaagtacgagggtgtgatcctcaacaaggcccaagccaacacctcctaagcctaagcgtcaccataagatattagaccctcttggtctcttctagtgcttcgagttaatggagtatatctggcggtgggatttgtattagaagaaaatcagatgcattatcatttttgcctgtactggtcctactggagttagttggatccatgtttttgtgtgtgtcgaatacattgatgttactactgttctacctcgacagcagtctgggctattctttgttctgttattgaatcgtgagatctcggcggcaaggcaatggcagtgcaatttgtacaccgtttctgacggccacctttgccttgacaagcttatcgcctgctttgttcca

SEQ ID NO: 5091 - DNA, 744 bp, Nuphar advena
aagatggcatcagagaagaaattgtcgaacccgatgagggagatcaaggtgcagaagctcgtccttaacatctccgtcggagagagcggtgaccgattgacccgtgccgccaaggtcttggagcaattgagcggacagacgccagtgtactcaaaagctcggtacactgttaggtctttcggtatcaggcgtaacgaaaagattgcttgctatgtcaccgttaggggcgagaaggcgatgcagcttttggagagtgggctgaaggtgaaggagtatgagttgttgaggaggaacttcagtgatactgggtgcttcggatttgggatccaggagcatattgatcttggaatcaagtacgatccctcaactgggatttacggtatggacttctatgtggttttggaacgtgctggataccgtgtgagccgtcgccgccgatgcaagtcacgactgggcattcatcatagggtaacaaaagaggatgccatgaagtggtttcaagttaaatatgagggtgtcatccttaacaagtctcaaacaactgcttcctagttttcttttgtttctgttccaaggatttcagcttcagttttgcttttgttgagtttctgtctacagataggaattaacacttgctttctatggaaagaatagtcttaagttgtattggggaagacatttttgtttttagtttgtcggtatttttgaaaggtgactttctttttatgcccagcgccagttttc

SEQ ID NO: 5092 - DNA, 817 bp, Allium cepa
cacctgagaccttcgaaatggcatcggagaagaagctttcgaatccaatgagggagattaaggtgcagaaattggtacttaatatatcagtcggggaaagcggagatagactaactagagctgccaaggtcctggaacaattgagtgggcagactcctgtattttccaaagctagatatactgttcgatcttttggaattaggagaaatgaaaagatcgcatgctatgtgacaatcagaggtgaaaaggcaatgcagctcttggagagcgggttgaaagttaaggaatatgagttagtgaggaagaacttcagtgatactggttgctttggcttcggtattcaagaacacatcgaccttggaatcaagtacgatccatctactggtatctatggtatggacttctacgtagtgttggaacgtgcaggataccgtgttggacgtcgccgacgctgcaagtcaagggttgggatccaacaccgagttacaaaggatgatgccatgaagtggtttcaggttaagtacgagggtgtcattctcaacaaggctcatgccatcactggttgatgaactttatgatcagagcttatgaatacccttcttcttttcccaatattttgttttctttgaacaatttagctgtttggttgcttgtgtccttcgttcttattattatgattaatgcagtagaatgtggtatgcgctggattttgctttggatatcttttattgttacttgcaaaactctttcttatactttgaaatgttattacctttgatgacgatatagttgtatgcttttgtgctgtagagcacct

SEQ ID NO: 5093 - DNA, 1029 bp, Allium cepa
aaaaatggttcactcccagttcatttgttttcgcgcataaataacgcttcatcgcagttagggttttagttcccattctcagccgccactctcccttcatctggaagcaaccgttcgtcatggcgtcggagaagaagttgtcgaatccaatgagagagattaaggtgcagaaattagtgcttaatatttcagtcggagaaagtggagatagactcactagagcatctaaggttttggaacaattgagtggacagactcccgtgttttccaaggctagatatactgttcggtccttcggtatcaggcgtaatgagaagattgcgtgctatgtgacagtcagaggtgagaaagcaatgcagctcttggaaagtggactgaaggtcaaggagtacgaattggtgagaaggaacttcagtgatactggctgttttggttttggtatccaagaacatatcgatcttgggatcaagtatgacccatctactggtatctatggaatggacttctacgtggttctagaacgtgcaggctatcgcgtgggtcgccgccgtcgctgcaagtcgcgtgttggaattcagcaccgtgtcacaaaagatgatgccatgaaatggtttcaggttaagtatgagggtgttattctcaacaaagctcatgccatgactggttaatcaaacttcgctttactgacaaggaagagactgcctttatttgctgcttcatttgttttttcccctctccttatgaactgttttatttgttagttttgtcgtccttgctgtgtagaatgtgttaatttgtcgcctgagattaaattattgattaatgtaagggtgagatttgttgatcaggattttactaggttgagtccttttattgttgaacttggttagttatgatgcttcgatttggacattggcagctggataattcaagcatttataggtcacgttctgctgtgcttagccgttttggaggcatctgttagaaactattgatcaacttgttgaatggtataagtatgatctatcc

SEQ ID NO: 5094 - DNA, 697 bp, Raphanus sativus
  misc_feature (129)..(129): n is a, c, g, or t
ccggagtgttctcgcaaccttaatcgcaaatggcgtcggagaagaagctaacgaacccaatgagggacataaaagtgcagaagctggtgctcaacatctccgtcggcgagagtggagatcgtctcaccngagcctccaaggtcttggaacagttgagtggccagactcctgttttctccaaagcaaggtacactgttcgttcttttggtatcagacgtaacgagaagattgcttgctacgttactgtcaggggagataaagctatgcagctccttgaaagtggtctcaaggttaaagagtatgagctcttgagaaggaacttcagcgacactggttgcttcggtttcggtattcaggagcacattgatcttggtatcaagtatgacccgtcgactggaatctacggtatggacttctatgttgttcttgagcgtcccggttaccgtgtggcgcgtcgcagaagatgcaaggctcgtgttgggatccagcacagagtcacgaaggatgatgccatgaaatggttccaagttaaatacgaaggagtcattctcaacaagtctcagaacattactggttaaacaacaaaattgtctcagttagagagatctgtaatctgtgtgttttgtccacccctggtttgagtcgtattttatcagttttgtttttgcttctttgtctcagacatttgagtttcttt

SEQ ID NO: 5095 - DNA, 1227 bp, Sorghum bicolor
cacaaatccgttgtagtctagctggttaggatactcggctctcacccgagagacccgggttcgagtcgcggcaacggaatcttttttttgtcatttgctcacacgaaattactaaaacaccccctagtagaggccccgagactcgctgcatccttggggttacgtacgtaattgtacacgggcatggtaggatttagggtttcgttacaaagctgctgctccttccaccgccgccgcacgccccgcgctgctggaccctctcacctccttcgccgtcgtctaacagatcttcccatggcgtcggagaagaagcagtcgaacccgatgcgggagatcaaggtccagaagctcgtgctcaacatctccgtcggcgagagcggtgatcgcctcacccgtgccgccaaggtgctggagcagctgagtggccagtcaccggtgttctccaaggcaaggtacactgtgaggtcgtttgggatccggcgtaatgagaagatcgcgtgctatgtgacggtgcggggtgagaaggcaatgcagctgctggagagtggcctgaaggtgaaggagtacgagctgctgaggaggaacttcagtgagactggctgctttggatttggtatccaagagcacattgatcttggcatcaagtatgacccatctactggtatctacggcatggacttctacgtcgtccttgagcgtgccgggtaccgtgtcgcacgtcgccgcaggtgcaagtcccgtgttgggatccagcacagggtcaccaaggaggatgccatgaagtggttccaggtcaagtacgagggtgtgatcctcaacaaggcccaagccaacacctcctaagcatcaccataagatattagaccctctttttagtgcttcgtgttaatgaagtgtttgtggcagtgggatttgtattagaagaaaaatcggatgcattatcagttttgccctgtactggtcctactggagttggatccatgtttttgtgtgcgccctatcttaaaaacttttattgaacagtttggcaaatgggctttgcattttggttgacttggcaaattattggccaggtttggcatatacgccaaccgtgtattgcacttgacatcgtgtagtcccgcgcgtttttcttccccgtgcgtggttctcctgacgctgctgttttgggttttgccaactcaatttttagatagcgcgcgaagaaagatgcgcgaccaagttgac

SEQ ID NO: 5096 - DNA, 877 bp, Saccharum officinarum
ccgcagccacatccccaacaccaaaaccctccgtctcttcccccctccgccgccgtctctgttctccacgatcaccatggcgtcagaaaagaagcagtcgaacccgatgcgggagatcaaggtgcagaagctcgtgctcaacatctccgttggagagagtggagatcgacttacccgcgccgccaaggtgttggagcagttgagtgggcagtcccctgttttctccaaggcaaggtataccgtgaggtctttcggtattcgtcgtaatgagaagatcgcgtgctacgtcacagtcaggggtgagaaggcgatgcagcttctcgagagtggcctcaaggtgaaggagtatgagcttctgaggaggaacttcagtgagactggctgctttggttttggtattcaggagcacattgatcttggcatcaagtatgacccatctactggtatttatggtatggacttttacgtcgttctggagcgggctggttaccgtgttgctcgccggcgcaggtgcaagtctcgcgttggcatccagcacagggtgaccaaagaagacgccatgaagtggttccaggtgaagtacgagggtgtcatcctcaacaaggcccaagcaaacacctcgtaatcatcgatagtcatcaaatgagttgccctttagtactccagtttaagtttaatctgtgtaccatgaattgtatgtttgttggataccaaatgcactgccagttttgcctctgttggagttgactttttgtgtccataattccatcttgatgatcagactagcagtaagcaacaaatagctgcagtttttattgtgttaatgtgaactcgccagtaaaagttgaaggacatctaccaggtactttgttcacac

SEQ ID NO: 5097 - DNA, 811 bp, Saccharum officinarum
ccatccatctcactcccctgccgccggcgcacaagggcctcgccgccgtcgccgcgttatccatggcgtcggagaagaagcagtccaacccgatgagggagatcaaggtgcagaagctggtgctcaacatctccgtcggagagagtggggatcgcctcactcgcgccgccaaggtcctggagcagctgagtggccagtcaccagtgttctctaaggctaggtacactgtccgttcctttggtatcaggcgtaatgagaagattgcctgctatgttactgtaaggggtgagaaggcaatgcagcttctggagagtggactgaaggtcaaggaatatgaactgctaaggaggaacttcagtgagacagggtgctttggttttggaatccaggagcacattgatcttggcatcaagtatgatccttcaaccggtatctacggaatggacttctacgtcgtccttgagcgcgctggctaccgtgttgcccgacgccgcaggtgcaagtcccgtgttggaatccagcacagagtgaccaaggaggatgctatgaagtggttccaggtcaagtatgagggtgtcatcctcaacaaggcccaggctaacacttcttagaaacattatgtcacagctcagccgttagacatgttaccagttgcaacagagtcgcatctctactcaagttttcgatctcagatgatattatttaccaagactcgagtactcgaattagttttggaccgaggagcttatgttctatattattatactttgaaggctgaatcatggatatgcgcagtttcatttggttttgc

SEQ ID NO: 5098 - DNA, 780 bp, Helianthus annuus
tcctcctttacaaccctccgccgccgccgtactcctccgcatctccaatggcatcagaaaggaagcaagcgaatccaatgagggagattaaggttcagaaactggttctcaatatctccgttggtgaaagtggtgatcgtctcactcgcgctgctaaggttttggaacaacttattggccagtctcctgtgttctccaaggcaaggtacactgtgagatcttttggcattaggcgtaacgaaaagattgcgtgctatgtcactgttaggggtgacaaggcaatgcatctcttggaaagtggcctgaaggttaaggaatacgagcttttgagacgcaacttcagcgacactggctgctttggttttggtattcaggagcacattgatcttggtatcaagtatgatccatctactggtatctatggtatggacttctttgtggttcttgaacgcccgggttaccgtgtgggtcgcagacgtaggtgcaaggctcgcgttggtatccagcacagagttacaaaggacgacgcaatgaagtggttccaggtgaagtatgaaggagttatcctcaacaaatcccaacagattggagcttagaagacatcgtaagtttttttttggtcggttaacgtttgatgtggcttaccagaagttctattacatcaattttgttgttttctagtcttgcattttgtactagttatgttgttattctcttgttatagtggctgtttttaggtatggaatttattcaactttgttttgtatcagatgtcttttt

SEQ ID NO: 5099 - DNA, 1282 bp, Panicum virgatum
ttttttgcccatccgtcgaaaagaaattaccaaagcacccctcccctcactgcattgctcggggtcaagtacgtaattgttcacaacataaggatttagggtttccttgtctccttacaaagcttcctctttccgccgccgccgccgcccctcaccgcgctgcagagaaccctctcacctcgctcgcggtcgcctcccagatctccccatggcgtcggagaagaaacagtcgaacccgatgcgggagatcaaggttcagaagctcgtgctcaacatctccgtcggcgagagcggtgatcgcctcacccgcgccgccaaggtactcgagcagctgagtgggcagtcaccggtgttctccaaggcgaggtacactgtgaggtcgttcggcatcaggcgtaatgagaagattgcgtgctatgtgacagtgaggggagagaaggcgatgcagctgctggagagtggcctgaaagtcaaggagtatgagctgttgaggaggaacttcagtgagactggctgctttgggtttggtatccaggagcacattgatcttggcatcaagtatgacccatctaccggtatctacggcatggacttctacgtcgtccttgagcgtgccgggtaccgtgttgcccgccgccgcaggtgcaagtcccgtgttggtatccagcacagggtcaccaaggaggacgccatgaagtggttccaggtcaagtacgagggtgtgatcctcaacaaggcccaagccaacacctcctaagtttcacaagaccttagccccctctttagagctcgagtcaattaagtttatccggtgcttggatttgtactagaagaaaccaaatgcattgtcagttttgcctgtactggagttggatcctttttagggtgccccgtattttcatcttattttgttgttggataagcccaaatagcgtttgtttgctacaagaatggtgctaagatagacctgaacttaattgtgctaagataattgagacgttcaaccgaaactgaacctgaactcagttgtgctaaatagaacatgaagcatgagaattatgcagctcatttcttgtagctaatagtcttctctctgtgctcggtctgaaaccactgcatcagcatagaaaacacaggtttcagttcagatattcagcatgccttgccttccaaatgagaaggtacctgaacagatcgggaccctctgctcccaccttaggaagtttgatctcactgattgctgtactgtgatgaggtgatcgaaagatacagctgtgtgttg

SEQ ID NO: 5100 - DNA, 1047 bp, Panicum virgatum
tttagggtttctttgtctacatataaagcttcctccctcgtccgccgccgccgccccgcacagcactgcagaaccatctcacctccctcgccgtcgcctcccagatcttccaatggcgtcagagaagaagcagtcgaacccgatgcgggagatcaaggtccagaagctcgtgctcaacatctccgtcggcgagagcggtgatcgcctcacccgtgccgccaaggtgctcgagcagctgagtgggcagtcaccggtgttctccaaggcgaggtacactgtgaggtcgtttggaattaggcgtaatgagaagattgcgtgctacgtgacagtgaggggagagaaggcgatgcagctgctggagagtggcctgaaggtcaaggagtacgagctgctgaggaggaacttcagtgagaccggctgcttcgggtttggtatccaggagcacattgatcttggcatcaagtatgacccatctaccggtatctacggcatggacttctacgttgttcttgagcgtgctgggtaccgtgtcgcccgccggcgcaggtgcaagtcccgtgttggtatccagcacagggtcaccaaggaggatgccatgaagtggttccaggtcaagtacgagggtgtgatcctcaacaaggcccaagccaacacctcctaagcatcacaagagcttagccccgctttagagctcgcgttacttaagtttctctggtggttggatttttactagaaagaaacaaaatgctgtcagttttgcctgtactgcagttggaccctttttctgggtgccctgtactttcatcttaattctcgcttgtgttttacccacattggcagaaatagtagataactggcttattctctcaagtagcgttttgttttgttttgttttgtttcgtttcgttcttggaaaatcctgagtaccaatgtgctacaaaatcgtgctaaattagatctgaacttaatttcgggagatagtatgcgcaatcgaaactgaacctgtaatcgcccgtgcattgtgctgaactgaacttgacgccatgt

SEQ ID NO: 5101 - DNA, 794 bp, Tabernaemontana elegans
agaccctctgcgctgctctacccatcgtccgtcgtcgcagctcgcagcgtcatggcatcagagaagaaattgagcaacccaatgagggagatcaaggtccagaagctggtcctcaatatctccgttggagagagcggtgatcgtctcacccgagctgccaaggtcttggaacaactcagtggccaaagccctgttttttccaaggctagatacactgtgaggtcctttggaatcaggcgtaatgaaaagattgcctgctatgtcactgtgagaggagagaaggcaatgcagctcctggagagtgggctgaaggtcaaggaatatgagctcttgcggagaaactttagtgcaactggctgctttggttttggtattcaggagcacattgatcttggaatcaagtatgacccttcaactggtatttatggtatggatttctacgtggtcttggagcgtgctggttaccgtgtagcacgtcgccgaaggtgcaagtcccgtgttggaatccagcacagagtcacaaaggaggatgccatgaaatggttccaggtcaagtatgaaggtgtcatccttaacaaggcacagaatattcatactgcgtagattgggtgagctgtcgtaaatcagtttgagttttagaaagttaagcttatgcattttgtagaccaaatctaccgatgagttcaattttggggatttgctttgttgttattgaaccaggatatatttacttttttattttcttgaaatgaatttttgccggatatgttttattacgttacatgaatggcagt

SEQ ID NO: 5102 - DNA, 876 bp, Eutrema halophilum
ctgttttacgtgatgcaggcgtcggagaagaagctctcgaaccctatgagggatattaaggttcagaagctcgttcttaacatctctgtcggtgagagtggtgatcgtctcactcgtgcatccaaggtgttggaacagctcagtggtcaaacccctgtcttctccaaggcgaggtacactgtgaggtctttcggtatcaggcgtaatgaaaagattgcttgctatgtcaccgtgagaggcgacaaggcaatgcagcttcttgagagtggcttgaaagtgaaggaatacgagctgttgagaaggaacttcagtgacactggctgctttggattcggtatccaggagcacattgatcttggaatcaagtacgatccttctactggtatctatggaatggacttctatgtggttcttgaacgccctggataccgtgtggcccgtcgccgtagatgcaaggctcgtgttgggatccaacatagagttacaaaggatgatgccatgaagtggttccaagttaagtatgaaggtgttatcctcaacaagtcccagaacatcaccggttgaaaagctttttttcgttttgttttgtggtgtttagctctgttttaagttcttacatttacgattctggatgataaagatttcttgttgtggtgacctttttgacttgagctggtttagaatccttaagtaccctcgagatatgaacaatttttggagtttatcgctactaacttcaaactctctctactttaaacaatccaagtcatatattgttctctgatttgcatgtcaaagagagtatgtctgaaagttaaaaatgtgatctgagtagctccagaatctcactcttcttcaactttgagtaccctttga

SEQ ID NO: 5103 - DNA, 1400 bp, Eutrema parvulum
gtcataacttctacaataaaccctaatgcgtctcatataactatcagacttcgcagccgacgctattcgtctgccactctttttgctcatctccctcgattttgaatccctcaatcctgagatggcgtcggagaagaagctctcgaaccctatgagggatattaaggtccagaagctcgttcttaacatctctgttggtgagagtggtgatcgtctcactcgtgcctccaaggtgttggaacagctcagtggtcaaatccccgtcttctccaaggcgaggtacactgtgaggtctttcgggatcaggcgtaatgaaaagattgcgtgccatgtcaccgtgagaggagacaaggcaatgcagcttcttgagagtggcttgaaggttaaggaatacgagttgttgaggaggaacttcagtgacactggctgctttggattcggtatccaggagcacattgatcttggaatcaagtatgatccttctaccggtatctatggaatggacttctatgttgttcttgaacgtccgggttaccgtgttgcccgtcgccgtaggtgcaaggctcgcgttgggattcaacatagagttacgaaggatgatgccatgaagtggttccaagtgaagtatgaaggtgttatcctcaacaagtctcagaacatcactggttgaaaagtttccattaattttgttttgtggtgttagctctgtttcaagttcttacatttacgattctggatgataaggatttcttgttgtggtaacctttttgacttcagttggtttagaatcctcaagtaccctcgagatatgaacaatttttggagtttatcgttatcaattttattctctctatctaatttaaacaactccaagccatatctctgtctctgatttgcatgtcagaaagattgtggactgaaaattaaaatcagaacgatctgagtagatccagtatctcactcttcttcaaccttgagtatcctttgagtcctctcttctttgcaacttccttgagctctgcaagtttcattgtttctatcaatggaggtttctcttccttccctgtttcttccaaagctttatcgctctttcttattggaaccttacctctaggacctgaagcagaaggtctactaggagatctcttggcataactagatggtgcccgaactacttgactctttggtggctccttcacaccagtctcgcctacatttttttctttcttggtttctcaagcacgtcaagaatagctttactcagtggctctctctcagaagacacatcacggttcttctcctcagctttggagatggaagattgaatccgtctgaagagagaaatgatctcctcttgctttgatttactcgggcttgagctccgttcatcagacggtctc

SEQ ID NO: 5104 - DNA, 787 bp, Fagopyrum esculentum
tcgaaatggcgaccaaggacaagaaactgtcgaaccccatgcgtgacatcaaggttcagaagcttgttctcaatatctccgtaggagaaagtggagatcgtctcacccgagcttctaaggttttggagcaactcagtggtcaaaccccagtattctccaaggcaaggtacactgttcgatctttcggtatcaggcgtaatgagaagattgcttgctatgtcacagttaggggagacaaggcaatgcagcttcttgagagtggtttgaaggtcaaggaatacgagttgttgaggcgtaacttcagtgacactggctgctttggatttggtatccaggaacacattgatttgggatcaagtacgatccatctaccggtatctatggtatggacttctacgtggtgttggagcgcccaggataccgtgttgctcgtagacgccgatgcaagtcccgtgttggaattcagcacagagttactaaggatgatgccatgaagtggttccagatgaaatatgaaggtgtcatccttaacaagtcacaaaacattactggttaggagcctaaaattttcagttggtagaaattttattttcttaatgaattttgagagatatacatgctcatttcctttgaatgatacaagatcttgtatgaaacttgtagtatttgttgcttgtttgctttcgaggatgaatccctggttacttttagtgttgaatttcatctccaagttctatttgataatctctgtttaaattttataaaatcatgaatcagtttcagtttt

SEQ ID NO: 5105 - DNA, 956 bp, Picea glauca
agggttgggcggcagtatcagcagaagcaggcgcaggagtagcagagaatcatccaaaatggcagcggagaagaagctgaacaaccccatgagggaaattaaggtgcagaagttggtgctcaacatatcagttggtgagagtggtgatcgactcactcgagcttcaaaggtgttggagcaactcagtaggcagactccagtttttccaaggcaaggtatactgtaaggtcctttggaatcaggcgaaatgaaagattgcctgctatgttactgttaggggagagaaggctcttcagcttttggagagtgggctgaaagtgaaggaatatgagttactcagaaggaactttagtgatacaggttgctttggttttggaattcaggagcacattgatctgggaatcaagtatgatccttctactggtatttatggtatggacttctttgtagtcctagagcgccctggatacagaatcggcaggagaaagagagcccaatcccgcgttggcattcagcacagggttaccaaggaagattctatgaagtggttccaagttaaatatgaaggagtcatccttaacaagtcacaaaatatttgaatgagaagttttggtatgttccttaataagaagtagtcttggcttggtttgccacttctgttgatacctaaaggaaggaattttttccggttataggtccacattggtcttttgaagagattttggaagggcggattatttttatttgcaggaaactattgtactttttttatagtgtttagatcatttgttggtgcgaagttcaaggccatgcttccttgttaagtacaaggacatgttctctgatttgaaaatttgttgtcaattctcaaatggaagagattaatatcaatgttggatttgaactaaaatagagtaatacatgattttaatggatggatgtaactttccattcca

SEQ ID NO: 5106 - DNA, 941 bp, Picea glauca
gggttgggcggctgtatcagcagaagcaggcgcaggagtagcagagcatcatccaaaatggcagcggagaagaagctgaacaaccccatgagggaaattaaggtgcagaagttggtgctcaacatatcagttggtgagagtggtgatcgactcactcgagcttcaaaggtgttggagcaactcagtgggcagactccagtttttccaaggcaaggtacactgtaaggtcctttggaatcaggcgaaatgaaaagattgcctgctatgttactgttaggggagagaaggctcttcagcttttggagagtgggctgaaagtgaaggaatacgagttactcagaaggaacttcagtgatacaggttgctttggttttggaattcaggagcacattgatctgggaatcaagtatgatccttctactggtatttacggtatggacttctttgttgtcctagagcgtcctggatacagaatcggcaggagaaagagagctcagtcccgtgttggcattcagcacagggttaccaaggacgatgccatgaagtggtttcaagttaaatatgaaggagtcatccttaacaagtcacaaaatatttgaatgagaagttttggtatggtccttaataagaagtagtcttggcttggtttgccacttctgttgatacctaaaggaaggattttttcccggtataggttcacatttgccttttgaagagattttggaagggcggattatttttatttgcaggaaactattgtacttttttttatagtgtttagatcatttgttggtgcgaagttcaaggccatgcttccttgttaagtacaaggacatgttctctgatttgaaaatttgttgtcaattctcaaatggaagagattaatatcaatgttggatttgaactaaaatagagtaatacatgattttaatggatggatg

SEQ ID NO: 5107 - DNA, 1112 bp, Picea glauca
tgtgagggttgggcggctgtatcagcagaagcaggcgcaggagtagcagagcatcatccaaaatggcagcggagaagaagctgaacaaccccatgagggaaattaaggtgcagaagttggtgctcaacatatcagttggtgagagtggtgatcgactcactcgagcttcaaaggtgttggagcaactcagtgggcagactccagtttttccaaggcaaggtatactgtaaggtcctttggaatcaggcgaaatgaaaagattgcctgctatgttactgttaggggagagaaggctcttcagcttttggagagtgggctgaaagtgaaggaatacgagttactcagaaggaacttcagtgatacaggttgctttggttttggaattcaggagcacattgatctgggaatcaagtatgatccttctactggtatttacggtatggacttctttgttgtcctagagcgtcctggatacagaatcggcaggagaaagagagctcagtcccgtgttggcattcagcacagggttaccaaggacgatgccatgaagtggtttcaagttaaatatgaaggagtcattcttaacaagtcacaaaatatttaaactagtagtcttggtatattccttattaagagtagtcttggcgtggatccacttctgttgacacagggattttgtcttggcttggtttaatagatgggtggaacattccatcatgtagccttagtaagagtagtctcaaattagtgtaccatttctgctgacagctaaaggaatgaactttctatctcgtagatttatctcttttaaagagattttggaagtgttgattatttttacttgagaattttttggtagtttgtgtgttgagatcaccttgtttcttaattgaatgtatgcgttggattttgaacagagattactacctatgcgtttaatggatggttgtaacattccgtatgtctatcaaaattttaggtggttgtgctacggctacccggcattcattttatgtgtgcaagtgttcttgctttgggacatatttgtttttggttatctctgtgtcaatggttaaccttgaagatacgcttcttattttaagggggcttga

SEQ ID NO: 5108 - DNA, 832 bp, Cenchrus ciliaris
ccctcgccgtcgcctccccagatcttgcccatggcgtcggagaagaagcaggcgaacccgatgcgggagatcaaggtccagaagctcgtgctcaacatctccgtcggcgagagcggtgatcggctcacccgcgcggccaaggtgctcgagcagctgagtgggcagtcaccggtgttctccaaggcgaggtacactgtgaggtcattcggcatcaggcgtaatgagaagattgcgtgctatgtgactgtgaggggagagaaggcgatgcagcttctggagagtggcttgaaggttaaggagtatgagctgctgaggaggaacttcagtgagactggctgctttgggtttggtatccaggagcacattgatcttggcatcaagtatgacccatctactggtatctacgggatggacttctatgtcgtccttgaacgggctgggtaccgtgttgcccgccgccgtaggtgcaaatcccgagtcggtatccagcacagggtcaccaaggaggacgccatgaagtggttccaggtcaagtatgagggtgtgatcctcaacaaggcccaagccaactcctaagctgcaacatcacaaggagagcttagcatctttagagctcgagttaattaagtttatcaggtggttggatttgtaccaaaagaaaccaaaaatctttcagttttgcctgtgctgcagttggatcttttctgggtgccctgtacttttcatcttaattctcgcttgtttcatccccgattggcagcaatagtaaatgtatgtgttatgaccagtgaaatagtgttgttttgttctgttattggatgaccctgcgtac

SEQ ID NO: 5109 - DNA, 722 bp, Medicago truncatula
cttcattgccgcacaacctctcttccatttccgatcccaaatggcttcggagaagaaactctcgaaccccatgagggatattaaggttcagaaacttgttcttaatatctctgttggtgaaagtggcgatcgtctcaccagagctgcaaaggtgttggaacaactcagtggccaaaccccagtgttttccaaagctcgatacactgtccgttcttttggtattagaagaaatgaaaagattgcttgctatgtgactgttagaggtgacaaggcaatgcaacttttggagagcggtttgaaggtgaaggaatatgaattgctgagaagaaattttagtgatactgggtgttttggattcggtattcaggagcatattgatttgggaatcaagtatgatccttctaccggtatttatggaatggactttttcgttgttctagagcgtcccggttaccgtgtgggacgtcgtcgtcggtgcaaggctcgtgttgggatccaacatcgggtaacaaaggatgattccatgaagtggttccaggtgaaatatgagggtgtgatcctcaacaagtcacaggcgattgtttagttacttaggctagttgacaaagcaatttgcaagttttgttaattataatttgaagtttcttgaaccattatcttaaacttcttgaatatctgtctggttatatggaccgtcttaaagtatttatttctgatccttt

SEQ ID NO: 5110 - DNA, 693 bp, Medicago truncatula
ccgagtgttaccgtctccattcgcgccgttctctttcgtttctgtcagaaagaacaaccaattcattccaaatggcgttgtcagagaagaaactgtcgaatcctatgagggaaatcaaagtgcaaaaacttgtcctcaacatctccgttggtgaaagtggagatcgtctcaccagagctgcaaaggttcttgaacagctaagtggccaaactcctgttttctccaaagctaggtacaccgtccgttcctttggtattagaaggaatgaaaagattgcatgctacgtcactgttagaggcgacaaggcaatgcagcttttggagagtggcttgaaggtcaaggaatatgagctgttgaggagaaacttcagtgataccgggtgttttggcttcggtattcaggaacatattgatttgggaatcaagtatgatccttccactggtatttatggaatggatttttttgttgtcttggagcgccctggttatcgtgttggacgtcgtcgtaggtgcaaggcaagagttggaatccagcatcgtgtcacaaaggatgatgccatgaagtggttccaagttaaatatgaaggtgtgatcctaaacaagtcccaggcaattgtttagtgagatcaggacattcttgagtacgagttctgaattttgttgagtgtagtttgatgtttcttgaatcagtagc

SEQ ID NO: 5111 - DNA, 941 bp, Cedrus atlantica
agagcatcagttgaagcaggggaaggaggatcagagcatcagttgaagcaggggaaagaggatcagcgcatcagtcaaaatgatgtcggagaagagactgagcaaccccatgagggaaattaaggtgcagaagttggtgctcaacatatcagttggtgagagtggtgatcgactcactcgagcttcaaaggtgttagagcaactcagtgggcagactccagttttctccaaggcaaggtatactgtaaggtcctttggaattaggcgaaatgaaaagattgcctgctatgtcactgttaggggagagaaagctcttcagcttttggagagtgggctgaaagtgaaggaatatgagttactcagaaggaactttagtgatacaggttgtttcggttttggaattcaagagcacattgatctgggaatcaagtacgatccttcaactggtatttatggtatggacttctttgtagtcctagagcgtcctggatacagaatcggcaggagaaagagagctcaatcccgtgttggcattcagcacagggttaccaaggaagatgccatgaagtggtttcaagttaaatatgaaggagtgatccttaataaatcgcaaaatatttaaataagtagtcttggcattgcttaccacttctgttgacacctaaatgtttttatcttggcttggtttcatagatggacataacattccatcatgcagccttaggaagagtagtctcagcttggtgtaccatttctgtcgacagctaaaggaatgaactttctatctcatatagattcatctattttaaagagattttgcagattttggaagcgctgattattttacttggagaatttcttttgtagtttttgtgttcagatcactttgttaattgaagttgaagacatgcactcttaattgaacacgtgtgttggatttt

SEQ ID NO: 5112 - DNA, 930 bp, Setaria italica
aaccatcttacctccgccgccgtcgccccgcacagcactgcagaaccatctcacccccgccgccgtcgcctcccggatcttcccatggcgtcggagaagaagcaggcgaacccgatgcgggagatcaaggtccagaagctcgtgctcaacatctccgtcggcgagagcggtgatcgcctcacccgcgcggccaaggtgctcgagcagctgagtgggcagtcaccggtgttctccaaggcgaggtacactgtgaggtcattcggcatcaggcgtaatgagaagattgcgtgctatgtgacagttaggggagagaaggcgatgcagctgctggagagtggcttgaaggtcaaggagtatgagctgctgaggaggaacttcagtgagactggctgctttgggtttggtatccaggagcacattgatcttggcatcaagtatgacccatctactggtatctacggcatggacttctacgtcgtccttgagcgggctgggtaccgcgttgcccgccgccgcaggtgcaagtcccgtgttggtatccagcacagggtcaccaaggaggacgccatgaagtggttccaggtcaagtacgagggtgtgatcctcaacaaggcccaggccaactcctaagcatcacaagaagagcttagctcctcgtcaaatctcgagttcattaagtctatctggtggttgggtttgtactagaattaaccaaaaatccatgtcagttttgcatgtactgagctggatccttttttgggtgccatgtactttcatctggattctcgcttgtgttttacccacattggcagcaatagtagatgtctggcttattctgtgaaatagcgttttgttttgttttgttctcgaataatcctgactataaccgtttgctacagcaattgtgcgaaattaaacctgaaattaaac

SEQ ID NO: 5113 - DNA, 814 bp, Pennisetum glaucum
gcactacagaacccatcccacctccctcgccgtcgcctccccagatcttccccatggcgtcggagaagaagcaggcgaacccgatgcgggagatcaaggtccagaagctcgtgctcaacatctccgtcggcgagagcggtgatcgcctcacacgcgcggccaaggtgctcgagcagctgagtgggcagtcaccggtgttctccaaggcgaggtacactgtgaggtcattcggcatcaggcgtaatgagaagattgcgtgctacgtgacagtgaggggagagaaggcgatgcagcttctggagagtggcttgaaggttaaggagtatgagctgctgaggaggaacttcagtgagaccggctgcttcgggtttggtatccaggagcacattgatcttggcatcaagtatgacccatctactggtatctatggcatggacttctacgttgtccttgagcgggctgggtaccgtgttgcccgccgccgaaggtgcaagtctcgcgttggtatccagcacagggtcaccaaggaggacgccatgaaatggttccaggtcaagtatgagggtgtgatcctcaacaaggcacaagccaactcgtaagctgcacatcacaaggagagcttagcatctttagagctcgagttaattaagtttatcaggtggttggatttgtaccaaaagaatccaaaaatctttcagttttgcctgtgctgcagttggatcttttctgggcgccctgtacttttcatcttaattctggctttgtttcatccccgattggcagcaatagtagatgtatgtgttatgaccaatga

SEQ ID NO: 5114 - DNA, 1057 bp, Capsicum annuum
cccctgcagctgcaacaaagcgccatggcttcagagaataaattgaacaatccaatgagggatatcaaagtccagaaacttgttctcaacatttccgttggtgaaagtggagatcgtctcaccagagctgctaaggtcctggagcaacttagtggccaaagccctgttttctctaaagcaaggtatactgtgcggtccttcggaatcagacgtaatgaaaagattgcctgctacgtcactgtcagaggggaaaaagctatgcagctccttgagagtggattgaaggtcaaggagtatgagttgttgagaaggaacttcagcgaaactggctgctttggatttggtattcaagagcacattgatcttggaattaagtatgacccttcaactggtatctatggtatggatttctatgttgtcctggagcgcccaggataccgtgttgccagacgtcgtaggtgcaagtctcgtgttgggatccaacacagggtcacaaaggaagacgcaatgaagtggttccaggtcaaatatgaaggtgttatccttaacaagtcctcaaacattcagtaagctgagagccgactgctggatcagtttatctggtagcaagtttaatgtttatgcattttgtagaccagcatctaattactcctagagttgaatagttttccagaggtgctgttacttggcatagtatgctgttttcattttggtttatgagatgaattcaatctatataaaaaaaaaaaaaaaaaaaactcgagactagttctctctctcctagaaactagtctattgttgctgcttcttcgaataatgctgagataatagctattacaaataactatgtatattttttctttcactagaatttttcttttacatgagcattcaagagtgttgtatattgtatgtccatgtgacatcctttatgcctaagaaagtggatagctttgtgcccaagataacgggctccccaaaatactttgtacccaagtaagttggcttattaacacttttatatgtattaagagatatacgaaaaggaaatgacgga

SEQ ID NO: 5115 - DNA, 803 bp, Physcomitrella patens
tcctttctcgcagctgcacccgccgccgttgccctccgctgcagcagcagcagcagcagcagcagcagcagcaccggctcgacagccatggcctccgaaaagaagcagcagaattctatgcgggagattaaggttcagaagttagttctgaacatctctgttggtgagagcggagatcgtcttactcgtgcctccaaagtgttggagcaacttagtggccaaagccctgtcttctctaaggctaggtacactgtccgctctttcggaatcaggcgtaacgagaagattgcatgctatgtgaccgttcgtggcgagaaagctatgcagctgttggagagtggcttgaaggtgaaggaatacgagcttctgcgtcgcaacttcagtgaatcgggttgctttggttttggaatccaagagcacattgatcttggtatcaagtacgacccttccactggtatctacggaatggacttctacgttgtgcttgagcgcccaggttacagagtcggaaggagacgcagagctaagtctcgcgttggtattcaacaccgcgttaccaaggaagatgccatgaagtggttccaggttaaatacgagggagtgattctgaacaagtctcaagctatcgcatagaagcccgcttcagatatgtgaaagaggtagaatttttgtgagtatttggttatcacaagcttgttagctgagttcttcaagtctcgatgttattttgccaaaaacatgagaaattcgtactcgagcatttcacatctcgtcaaggctcttgtgtgtttcttggtacgatg

SEQ ID NO: 5116 - DNA, 748 bp, Physcomitrella patens
cccgccgccgttgccctccgctgcagcagcagcagcagcagcagcagcagcagcaccggctcgacagccatggcctccgaaaagaagcagcagaattctatgcgggagattaaggttcagaagttagttctgaacatctctgttggtgagagcggagatcgtcttactcgtgcctccaaagtgttggagcaacttagtggccaaagccctgtcttctctaaggctaggtacactgtccgctctttcggaatcaggcgtaacgagaagattgcatgctatgtgaccgttcgtggcgagaaagctatgcagctgttggagagtggcttgaaggtgaaggaatacgagcttctgcgtcgcaacttcagtgaatcgggttgctttggttttggaatccaagagcacattgatcttggtatcaagtacgacccttccactggtatctacggaatggacttctacgttgtgcttgagcgcccaggttacagagtcggaaggagacgcagagctaagtctcgcgttggtattcaacaccgcgttaccaaggaagatgccatgaagtggttccaggttaaatacgagggagtgattctgaacaagtctcaagctatcgcatagaagcccgcttcagatatgtgaaagaggtagaatttttgtgagtatttggttatcacaagcttgttagctgagttcttcaagtctcgatgttattttgccaaaaacatgagaaattcgtactcgagcatttcac

SEQ ID NO: 5117 - DNA, 1072 bp, Picea glauca
gatccgaaacaaaagaaaaaaagaaccctaattgaaatcgactcataaaatagaggaagtttaggttagggtgtgtttcagcaggcgtgttcgggtttgaggcagaggcggttgcagaaagagcagtcggcgggaaccagcgaaggagaaatggcagcggagaagaaactgaacaaccccatgcgggatattaaggtgcagaagttagtgctcaacatatcagtcggtgagagtggtgatcgactcactcgagcttctaaggtgttggagcagcttagtggccagactccggttttttcgaaggcaaggtatactgtgaggtcctttggaattaggcgaaatgaaaagattgcctgctacgttactgttagaggagaaaaggctcttcaacttttggagagtgggctgaaagtgaaagaatacgagttgctccgaaggaactttagcgacacagggtgctttggttttgggattcaggagcacattgatctgggaatcaagtatgatccttctactggtatttacggtatggacttctttgttgtcctagagcgtcctggatacagaatcggcaggagaaagagagctcagtcccgtgttggcattcagcacagggttaccaaggacgatgccatgaagtggtttcaagttaaatatgaaggagtcattcttaacaagtcacaaaatatttaaactagtagtcttggtatattccttattaagagtagtcttggcgtggatccacttctgttgacacagggattttgtcttggcttggtttaatagatgggtggaacattccatcatgtagccttagtaagagtagtctcgaattagtgtaccatttctgctgacagctaaaggaatgaactttctatctcgtagatttatctcttttaaagagattttggaagtgttgattatttttacttgagaatttttggtagtttgtgtgttgagatcaccttgtttcttaattgaatatatgcgttggattttgaacagagattactacctatgcgtttaatggatggttgtaacattccgtatgtctatcaaaatttaggtggtt

SEQ ID NO: 5118 - DNA, 623 bp, Tamarix hispida
ggggggcgctgtagggtttttaagtggtttcttctctcttcttctccatacgcctcatcggccgctgcgaaaactgattcagaaatggcatcggagaggaaactagcaaacccaatgagagagatcaaggtccagaagttggtcctcaacatctctgttggtgaaagcggcgatcgtctcaccagggctgctaaggtgctggagcagctcagtggacaatctcccgttttctccaaagcgagatacactgtccgatctttcggtatcagacgtaatgagaagattgcttgctacgtcactgtaagaggtgagaaggcaatgcagcttcttgaaagtggattgaaggtcaaggaatatgaacttctgaggagaaacttcagcgacactggttgttttggctttggtattcaagaacacattgatcttggaatcaagtacgatccttctactggaatttatggtatggacttctatgttgttcttgagcgcccaggctaccgtgtgggtcgccgtcggaggtgcaaatctcgagttggaatccagcacagggttactaaggatgatgccatgaagtggtaccagatgaaatatgagggtgtgatcctcaacaagtcacaaaacct

SEQ ID NO: 5119 - DNA, 660 bp, Ambrosia trifida
ttcttcttcttccacctccgccgcatcagcagcaatggctttcagaaagaaaacaaagaaaaccccaatgagagaaatcaaggttctgaaactcgttcttaatatctctgtcggtgagagtggtgatcgtctcactcgagctgccaaggttttggagcaattgagtggtcaatcccctgtttctccaaggcaaggtacactgtgagatcatttggcatcaggcgtaacgagaaaattgcttgctatgtaaccgtaggggtgacaaagcaatgcagcttcttgaaagcgggttgaaagtcaaagaatacgagttgctgagacgcaacttcagtgacacgggctgctttggatttggtattcaggaacatattgatcttggtatcaaatatgatccttctactggtatctatggcatggactttttcgtggttctagagcgccctggttaccgtgtgggtcgtagacgcagatgcaaggcgcgtgttggtattcaacatagagttacaaaggaagatgcaatgaagtggtttcaggtgaaatatgagggagtaattctcaataaatctcaacaaattggagcttaaaagtagtcgtttctgatcagctgaggtgacctttaaccatctgctgattgtgagtgtgtgctcgtgatactatttt

SEQ ID NO: 5120 - DNA, 946 bp, Abies balsamea
gaggcggtatcagcagcagcaggggcaggagtagcagagcagcatacgaaatgacgacggagaagagactgaacaactccatgagggaaattaaggtgcagaaattggtgctcaacatatcggttggtgagagtggtgatcgactcactcgagcttcaaaggtgttggagcaactcagtgggcaaactccagttttttcgaaggcaaggtatactgtgaggtcctttggaatcaggagaaatgaaaagattgcctgctatgttactgttcgtggagagaaggcccttcagcttttggagagtgggctgaaagtgaaggaatatgagttactcagaaggaactttagtgatacaggttgtttcggttttggaatccaggagcacattgatcttggaatcaagtacgatccttcaactggtatttatggtatggacttctttgtggtcctagagcgtcctggatacagagttggcaggagaaagagagctcaatcccgtgttggcattcagcacagggttaccaaggaagatgccatgaagtggtttcaagttaaatatgaaggagtcatcctcaacaagtcacaaaatatttaaatgatcagtcttggtatgctccttattaagagtagtctagccatggatttccacttgttggcactgaaaggatttttcttcgcctggtttaatagttggatgtaacattccagcatgtagccatagtaagagtagtctcaacttggagtaccatttctgctgacagcttaaagaatgaactttctatctcatcgattcatctctttaaagagattttgaagattttggaagtgctgattaattttacttgagaaaaaattgtagttttattgtttagatcacctcgttccttagtttaagacatgcactcttaattgaacgttttctattggattttgaacagagataattac

SEQ ID NO: 5121 - DNA, 727 bp, Antirrhinum majus
gaatccgatgagagagataaaggtacagaagctggttctgaacatctcagtgggtgagagtggagatcgtctcaccagagctgctaaggtgttggagcaactcagtggccaaactcctgttttctccaaggctagatacactgtccggtcttttgggatcaggcgaaatgaaaagattgcatgctatgtgaccgtcagaggtgataaggcaatgcagctcctcgagagcggcttgaaggttaaggaatacgagttgttgaggcgtaacttcagtgacactggctgttttggtttcggtattcaggagcatattgatcttggaatcaagtatgacccctctactggtatctatggtatggatttctatgttgtgttggagcgtcctggttaccgtgtgggtcgtcgccgtaggtgcaagtcccgtgttggaattcagcacagggtcactaaggaggattcgatgaagtggttccaggtgaaatacgaaggtgtcatcctcaacaagtctaacgctattggagcttaggtttatgtttctcatttgtccaatttttgaaaacaagttttgtagaattgcatggttttttctgccgggacaagtccatgttttatttctatgttttatattttatagacggttggctgtgtttgtgctttgactgtctcagttgagtagctatttagtacttggtgtcaatggtgcaatagtttgctttgttatgctaaa

SEQ ID NO: 5122 - DNA, 978 bp, Beta vulgaris
aaataaaagggcacaataaaaaccctagctcgcccttcgcttcccattagggtttttattcttctcctccgcatcgcacacaaacactttctctctctctccccttcttcctcattcggctgctactcccaactcacagaaatggcgccggagaagaagctttcgaaccctatgagggacatcaaggtccagaaacttgttcttaacatctcagttggtgaaagtggtgatcgtctcaccagagctgcaaaggttttggagcaactcagtggtcagactcctgtttactccaaagccaggtacactgtccgatccttcggtatcagacgtaatgaaaagattgcttgctacgtgactgtcagaggtgagaaggcaatgcagctacttgaaagtggtttgaaggtcaaggaatacgagttgctgaggaggaacttcagtgacaccggttgcttcggttttggtattcaagagcacattgatcttggaattaagtatgatccttctactggtatctatggtatggacttctacgttgtgctcgagcgtcccggttaccgtgtggctcgtcgcagaaggtgcaaggcccgtgttggaatccagcacagagttaccaaggacgatgccatgaagtggttccaggtcaaatacgaaggagttatcctcaacaaggcccataatattggttcttaagcttttgctagcttatctcttatgttaaaacttttggtatcttagcttttatcccagtacggctaaattgcattattagtgaaaaagggttcttgacgattttgtagtttgtttcttgtactgctggatcaatggttctagaatttttgaatttatgttgcgttaattatactatctttaccatgagttctcaatcctactttcatttgatatctcactaaaaagtgttcgtctggttgattctatcttttgaaatttaagttgcgttaattatacaatcaaaaaaaa

SEQ ID NO: 5123 - DNA, 826 bp, Chelidonium majus
ttaagtcacttttagggttctagtttcatctcctccacttccttcccaaaacccctcaaacttctctaacctacctcggcagacagtcatggccgcagagaagaaactcttgaaccccatgagggaaatcaaagttcagaagctcgtcctcaacatctccgttggtgaaagcggagatcgtctcaccagagccgcgaaggtcttggaacagctaagtggtcaatcacctgttttttccaaagcaaggtacaccgttaggtcttttggaatcaggcgtaacgaaaagattgcttgtcacgttactgtgaggggtgagaaggcgatgcagcttctagagagtggattgaaggttaaggaatacgagctcttgaggaaaaacttcagtgacactggttgctttggattcggtatccaggagcacattgatcttggaattaagtatgatccttccaccggtatttatggtatggacttctatgtggtcttggaacgccctggatatcgtgttggtcgtcgtcgtaggtgcaaggccaaggttggtattcagcacagagttaagaaggatgatgcaatgaagtggttccaggttaagtacgagggtgtcattctcaacaagtcccaaaatatcactggttaattgttagacttttatcagattcaagttttgtgaaagttcaggtgacttattaattgtgttcttgtagtctagtgaactatttctttttcatatgcaagagaattttgagctgtagtagtgaatatctatcatggtttgacagtaaattttggataattttgttattgaaatgaatgtgttttatacttc

SEQ ID NO: 5124 - DNA, 962 bp, Cycas rumphii
  misc_feature (65)..(66): n is a, c, g, or t
tggatccaaaggttttttccctttaacaggcaggagtgagcgttgtagcaggaggaggtcgaggnngagacggtgtttacgaagaaatggcctctgaaaagaaacttaacaacccgatgagggaaattaaggtgcagaagttggtgctgaacatatcagttggcgagagtggtgatcgactgactcgagctgcgaaggtattagagcagttgagcggtcagactccagttttttcaaaggcaagatacactgtaaggtcttttggaatcagacggaatgaaaagatcgcttgctatgttactgtaagaggggacaaggctctgcagctcttggagagtgggttgaaagtaaaggaatatgagttgcttcgaaggaattttagcgagacaggttgctttggatttggtatccaggagcacattgatttggggatcaagtatgatccttcaactggtatttatggtatggacttctatgtggtcttagagcgccctggttacagaattgctagaagaaagagagccaaggcccgtgttggtattcagcacagggtcacgaaagaggatgccatgaagtggttccaagttaaatatgagggagtcatcctcaacaagtcacagtcaacaacataactgtgcataattcaggcatattgaatattccttgccatgccaatttcagttttgtctagcactctatggacaatccaggaaaggtttacttcagaagtggccttcaaggggatatcatcatagttgaaagcaacttttctactgatttgtttgtgtttagattatctcaaggacatgttctcttgaacatccgtgttggatttttgaagtagaggggttcttaagatacatttcatggatggaagtaacatttcatgctgtatttcaagtttttcagttttatgtgctttttgaatctctatttaataatgaagtagcaatccatgctgt

SEQ ID NO: 5125 - DNA, 681 bp, Flaveria ramosissima
caatggcttcagaaaggaagcaagcgaatccaatgagggagatcaaggttcagaagcttgttctcaacatctccgtcggtgaaagcggcgatcggctcactcgcgccgctaaggtgttggagcagctgagtggtcaatcccctgtgttttccaaggcaaggtacacggtgaggatcgttttggctattaggcgtaacgaaaagatcgcatgctatgtaactgttaggggagacaaggcaatgcaactcttagagagtggcttgaaggtcaaggagtacgagcttttgaggcgcaacttcagtgacaccggctgctttggttttggtattcaggagcacattgatcttggcatcaagtatgacccgtcaacgggtatctatggtatggacttctttgtggttctagaaaggcctgggtaccgtgtgggtcgcagacgcaggtgcaaggcacgtgttggtatccagcatcgagttacaaaggaggatgcaatgaagtggttccaggtgaagtatgaaggagttatcctgaacaaatcccaacaaattggagcttagaagaaatctatgtttaatgtaagttttttaaggatgttaatcgttacttcgcttgcttttaattcctgtttgtctttttaatttcgactagtaatcgcctttgtgctattctcatgttatagtagtt

SEQ ID NO: 5126 - DNA, 824 bp, Gnetum gnemon
gaagcactgcaaggaaggaaggacgggagggaggagcagcagcagcagcagcaatggcgtcggagaggaagctcaacaatcccatgcgtgagatcaaagtgcagaaacttgttcttaacatctccgttggtgagagtggagatcgtctcaccagggctgccaaggtgcttgagcaactcagcggccagaccccggttttttccaaggcgagatacactgtcaggtcatttggaatcaggagaaacgaaaaaattgcgtgctatgtgactgtcagaggcgaaaaggctctgcagcttctggagagtggcttgaaggtcaaggagtatgaattgctgcgaaggaatttcagtgaaactggatgttttgggtttggaattcaggaacacattgatctgggaattaagtatgatccatccaccggaatttatggtatggatttttatgtggtcttggaacgccctgggtacagggtgtgcaggagaaagagagccaagtctcgtgttggtattcagcacagggtaactaaggaggatgcaatgaagtggttccaagttaaatacgagggagtgatccttaacaagtcacagaatattggcccatgacagattatctctgggattttgcatcacttatatttacaaagttgtaggtttattgcatttgttttaacgtcggaatttggataatcaattttgtaatagaatctatgggagtatggctgttcaaaactattcctgttcgtttctgctcttaaaccacgaatattcatcttcaagtcttaatttgcagtaaattgggaagggtcttattgctctgtttttaaa

SEQ ID NO: 5127 - DNA, 899 bp, Mesembryanthemum crystallinum
  misc_feature (607)..(607): n is a, c, g, or t
  misc_feature (697)..(697): n is a, c, g, or t
  misc_feature (717)..(717): n is a, c, g, or t
  misc_feature (719)..(719): n is a, c, g, or t
  misc_feature (741)..(742): n is a, c, g, or t
  misc_feature (744)..(745): n is a, c, g, or t
  misc_feature (753)..(753): n is a, c, g, or t
  misc_feature (755)..(757): n is a, c, g, or t
  misc_feature (759)..(759): n is a, c, g, or t
  misc_feature (761)..(763): n is a, c, g, or t
  misc_feature (766)..(769): n is a, c, g, or t
  misc_feature (811)..(811): n is a, c, g, or t
  misc_feature (814)..(814): n is a, c, g, or t
  misc_feature (818)..(818): n is a, c, g, or t
  misc_feature (824)..(826): n is a, c, g, or t
  misc_feature (829)..(829): n is a, c, g, or t
  misc_feature (831)..(839): n is a, c, g, or t
  misc_feature (841)..(845): n is a, c, g, or t
  misc_feature (850)..(850): n is a, c, g, or t
  misc_feature (852)..(852): n is a, c, g, or t
  misc_feature (854)..(864): n is a, c, g, or t
  misc_feature (867)..(867): n is a, c, g, or t
  misc_feature (869)..(879): n is a, c, g, or t
  misc_feature (881)..(882): n is a, c, g, or t
  misc_feature (885)..(885): n is a, c, g, or t
  misc_feature (888)..(890): n is a, c, g, or t
  misc_feature (897)..(897): n is a, c, g, or t
cgatgagccgcttacctgctatagtgagtcacgagctagtctcgagtttttatttcttcttcttcctcctcctcctctcccccccctcccttccgcagcagctcctaccatcactgcagacatggcgtcggagaagaagctcgcgaacccaatgagggacatcaaggtccagaaactcgtcctcaacatctccgttggtgagagtggtgatcgtctcaccagagctgctaaggtgttggagcaactcagtggccaatcacccgtcttctccaaagctaggtacactgtgagatctttcggtatcagacgtaatgagaagattgcctgctatgtcactgtcagaggtgagaaggcaatgcagctccttgaaagtggattgaaggtcaaggagtacgagttgctgaggagaaacttcagtgacactggctgctttggattcggtatccaggagcacattgatcttggaatcaagtacgatccatctaccggtatctacggtatggacttctatgtcgtccttgagcgcccaggttaccgtgttggacgcagaagaaggtgcaagtcccgtgttggaatccagcacagagtcacaaaggatgatgccatnaagtggttccaggttaaatatgaaggtgttatcctcaacaaggcccagaacgttggtgcttaagttttcctgtcgcttactccctgtgantaaggttttgctatcatagntngtgcccttttggggttaaattnngnncatttagntnnnangnnntcnnnngacgattttgtagttgacttaaatctattgctggattaatgntcntagnttttgnnngangnnnnnnnnngnnnnnagttntntnnnnnnnnnnntcngnnnnnnnnnnntnntgnatnnnacggtcnat

SEQ ID NO: 5128 - DNA, 1040 bp, Pennisetum glaucum
ggtatccaggagcacattgatcttggcatcaagtatgacccatctaccggccagtagcactacagaacccatcccacctccctcgccgtcgcctccccagatcttccccatggcgtcggagaagaagcaggcgaacccgatgcgggagatcaaggtccagaagctcgtgctcaacatctccgtcggcgagagcggtgatcgcctcactcgcgccgctaaggtgctcgagcagctgagtggacagtcaccggtgttctccaaggcgagatacactgtgaggtcgttcggcatcaggcgtaatgagaagatcgcgtgctatgtgacagtgaggggagagaaggcgatgcagcttctggagagtggtctgaaggtcaaggagtacgagctgctgcggaggaacttcagtgagactggctgctttgggtttggtatccaggagcacattgatcttggcatcaagtatgacccatctaccggtatctacggcatggacttctatgttgtccttgagcgtgctgggtaccgtgttgccaggcgccgtaggtgcaaggctcgggttggtatccagcacagggtcaccaaggaggacgccatgaagtggttccaggtcaagtacgagggtgtgatcctcaacaaggcccaagccaactcctaagcacatcacaagaagagcttagcccctctttagaacgtggtcaatttaagtctatctggtggttggatttgaactagaagaaaccagaatgtttttgtcagttttgcctgtactactgcagttggatcctttctgggcgccctacacattcatcttaattctgcttgtgttttacccccatttgcactggcagcaatagtagatgtctggcttaatctgttcgtttcgtttcgtttcgtttgtgttgtgttgtgttgtgttgtgttgtttgtgttgtgttgtttgtgttgtgttgtgttgtgttgtgttctgttttgttctgttctgttctttgaaaatcatgggtaccaacgtttgctaaatagaattgtcctaaatcggaacc

SEQ ID NO: 5129 - DNA, 990 bp, Pennisetum glaucum
cacattagagaggacatccaatccagcagcactacagaacccatcccacctccctcgccgtcgcctccccagatcttccccatggcgtcggagaagaagcaggcgaacccgatgcgggagatcaaggtccagaagctcgtgctcaacatctccgtcggcgagagcggtgatcgcctcactcgcgccgctaaggtgctcgagcagctgagtggacagtcaccggtgttctccaaggcgagatacactgtgaggtcgttcggcatcaggcgtaatgagaagatcgcgtgctatgtgacagtgaggggagagaaggcgatgcagcttctggagagtggtctgaaggtcaaggagtacgagctgctgcggaggaacttcagtgagactggctgctttgggtttggtatccaggagcacattgatcttggcatcaagtatgacccatctaccggcatctacggcatggacttctatgttgtccttgagcgtgctgggtaccgtgttgccaggcgccgcaggtgcaaggctcgggttggtatccagcacagggtcaccaaggaggacgccatgaagtggttccaggtcaagtacgagggtgtgatcctcaacaaggcccaagccaactcctaagcacatcacaagaagagcttagcccctctttagaacgtgatcaatttaagtctatttggtggttggatttgaactagaagaaaccagaatgtttttgtcagttttgcctgtactactgcagttggatcctttctgggcgccctatacattcatcttaattctgcttgtgttttacccccatttgcactggcagcaatagtagatgtctggcttaatctgttcgtttcgtttcgtttcgttttgtgtcgtgttgtgttgtgttgtgttgttttgtgttgtgttgttttgtgttgtgttgtgttgtgttgtgttctgttctgttctgttctgttctttgaaatcatgggtaccacgtttgctaat

SEQ ID NO: 5130 - DNA, 764 bp, Physcomitrella patens
gtctctttctcgcagcatcagccgcctctttccctcacgtcgagcccgcactcagccatggcgtccgaaaagaagcagcagaatttaatgcgggagattaaggttcagaaacttgttctgaacatctctgtcggagagagcggagatcgtctcacacgtgcttccaaggtgttggagcaactcagtggtcaatcccctgtcttctccaaggctaggtacactgtccgttctttcggaatcaggcgtaatgagaagattgcatgctacgtgactgtgcgtggtgaaaaagccatgcagcttttggagagtggattgaaggtgaaggagtacgagctgttgcgccgcaactttagtgaatctggttgcttcgggtttggtattcaagaacacattgaccttggaatcaagtacgatccttctacgggcatttacggtatggacttctacgtagtacttgagcgcccaggttacagagttggaagaagacgcagagcgaaatctcgcgttggtatccagcaccgcgttactaaggaagacgcaatgaagtggttccaggtcaaatatgagggagtgatcttgaacaagtctaatgcaatcgcgtaaggtcccactgcaggtatttgatagaggcagaaatttgagagtaaggttatcactcttgcttgtgattaagtttgcaatatttagtgtgacctattttgtcctaaatcttggcttaccatacatgcagcagtactggttgaagtctgtcattttcctgtgcg

SEQ ID NO: 5131 - DNA, 1014 bp, Physcomitrella patens
acagtctctttctcgcagcatcagccgcctctttccctcacgtcgagcccgcactcagccatggcgtccgaaaagaagcagcagaatttaatgcgggagattaaggttcagaaacttgttctgaacatctctgtcggagagagcggagatcgtctcacacgtgcttccaaggtgttggagcaactcagtggtcaatcccctgtcttctccaaggctaggtacactgtccgttctttcggaatcaggcgtaatgagaagattgcatgctacgtgactgtgcgtggtgaaaaagccatgcagcttttggagagtggattgaaggtgaaggagtacgagctgttgcgccgcaactttagtgaatctggttgcttcgggtttggtattcaagaacacattgaccttggaatcaagtacgatccttctacgggcatttacggtatggacttctacgtagtacttgagcgcccaggttacagagttggaagaagacgcagagcgaaatctcgcgttggtatccagcaccgcgttactaaggaagacgcaatgaagtggttccaggtcaaatatgagggagtgatcttgaacaagtctaatgcaatcgcgtaaggtcccactgcaggtatttgatagaggcagaaatttgagagtaaggttatcactcttgcttgtgattaagtttgcaatatttagtgtgacctattttgtcctaaatcttggcttaccatacatgcagcagtactggttgaagtctgtcattttcctgtgcgtttcccttgagttgcaccattgcgtcatgtgaggggtctgtgtttcatggttacatttctactttgcaattggatttgaagtaaatgtctttgaatgggtttctcataacaaaccatacttaagctatactttatataatcctgtaatgtgattggtcaaaaattctaccctttttagctattctggaaaggactagtactttggccaattaaccatgaaacaagaagattgggattggcacttgat

SEQ ID NO: 5132 - DNA, 950 bp, Physcomitrella patens
accctttgctctcccctgagctcggtccccatcgccagcgtcgtgcaaatttcggccgcgatggcttcggaaaagaagatgcagaactccatgcgggagattaaagtgcagaagcttgtcctcaacatctcagtgggagaaagtggtgacagattgactcgtgcgtccaaggtgctggagcagctgagtgggcagagtcctgtcttctccaaggctaggtacaccgttcgttccttcggtatcaggcgtaatgagaaaattgcatgctacgttactgttcgtggtgagaaagcgatgcagcttcttgagagtggcttgaaagtgaaggaatacgaactgctgcgccgcaacttcagcgaatctggatgctttgggttcggtatccaggagcacatcgatcttggtatcaagtatgatccttcaacaggtatctacggtatggacttctatgtcgttcttgaacggccaggctacagggttggaaggaggaggagggccaagtcccgagttggtattcaacaccgagtgactaaggaagatgctatgaagtggtttcaggttaagtatgagggagttatcctgaacaagtcgcaacaaatcgcttagaccttagtatctactgcatgtccaagtctttcatccttaaggaagagcaggtggaccttgttttttcacgcagctgatccgagaaaaattctaattgattcccgtttttttattcgtgtgaacatgcatccagttcaactatgttatggtgaaatgcttgaattaagttttaggatataatttatttaatggttttgcggtatatttagaacgctaccagacaagtgatgggcattgcgccaagatttcccctgatctggctgtttaggcttttgatatcaagagccggagttcaacggatttgaaatcaagatgaaagtgcttccggagccaatttttttctc

SEQ ID NO: 5133 - DNA, 940 bp, Physcomitrella patens
accctttgctctcccctgagctcggtccccatcgccagcgtcgtgcaaatttcggccgcgatggcttcggaaaagaagatgcagaactccatgcgggagattaaagtgcagaagcttgtcctcaacatctcagtgggagaaagtggtgacagattgactcgtgcgtccaaggtgctggagcagctgagtgggcagagtcctgtcttctccaaggctaggtacaccgttcgttccttcggtatcaggcgtaatgagaaaattgcatgctacgttactgttcgtggtgagaaagcgatgcagcttcttgagagtggcttgaaagtgaaggaatacgaactgctgcgccgcaacttcagcgaatctggatgctttgggttcggtatccaggagcacatcgatcttggtatcaagtatgatccttcaacaggtatctacggtatggacttctatgtcgttcttgaacggccaggctacagggttggaaggaggaggagggccaagtcccgagttggtattcaacaccgagtgactaaggaagatgctatgaagtggtttcaggttaagtatgagggagttatcctgaacaagtcgcaacaaatcgcttagaccttagtatctactgcatgtccaagtctttcatccttaaggaagagcaggtggaccttgttttttcacgcagctgatccgagaaaaattctaattgattcccgtttttttattcgtgtgaacatgcatccagttcaactatgttatggtgaaatgcttgaattaagttttaggatataatttatttaatggttttgcggtatatttagaacgctaccagacaagtgatgggcattgcgccaagatttcccctgatctggctgtttaggcttttgatatcaagagccggagttcaacggatttgaaatcaagatgaaagtgcttccggagccaa

SEQ ID NO: 5134 - DNA, 755 bp, Physcomitrella patens
ctttctctcgtcttcggccccgtcgtcgtcggtagcgctgtgagcaaaatttgccgctatggcttcagaaaagaagatgcagaactccatgcgggagattaaagtgcagaagcttgtcctcaacatctccgtgggagagagtggagacagattgactcgtgcatccaaggtgttggagcagttgagcggtcagtcccccgtcttctcaaaggcaaggtacactgtgcgatcctttggtatcaggcgtaatgagaaaattgcatgctatgtcaccgttcgtggtgagaaggcgatgcagctccttgaaagtgggttgaaggtgaaggaatacgagttgctgcgccgcaacttcagtgaatccggatgttttggattcggtatccaagagcacatcgatctcggcattaagtacgatccttccacaggtatctacggtatggatttctacgttgtcctggaacgcccaggatacagagtgggccgaaggaggagagccaaatcccgtgttggtattcaacaccgtgtcaccaaggaggatgccatgaagtggttccaagttaagtacgagggagttatcctgaacaaatcgcaacaaattgcctagatcttcatgtctgttgtgtttgttaactcctagtcgtttcactttattgaggatggaggcaggcgagtcttgtaccttcacgtaactgaatctagcgaattccaacatgatacgaattcctgatacttaaacaggcttggcatgctagcta

SEQ ID NO: 5135 - DNA, 730 bp, Physcomitrella patens
tcttcggccccgtcgtcgtcggtagcgctgtgagcaaaatttgccgctatggcttcagaaaagaagatgcagaactccatgcgggagattaaagtgcagaagcttgtcctcaacatctccgtgggagagagtggagacagattgactcgtgcatccaaggtgttggagcagttgagcggtcagtcccccgtcttctcaaaggcaaggtacactgtgcgatcctttggtatcaggcgtaatgagaaaattgcatgctatgtcaccgttcgtggtgagaaggcgatgcagctccttgaaagtgggttgaaggtgaaggaatacgagttgctgcgccgcaacttcagtgaatccggatgttttggattcggtatccaagagcacatcgatctcggcattaagtacgatccttccacaggtatctacggtatggatttctacgttgtcctggaacgcccaggatacagagtgggccgaaggaggagagccaaatcccgtgttggtattcaacaccgtgtcaccaaggaggatgccatgaagtggttccaagttaagtacgagggagttatcctgaacaaatcgcaacaaattgcctagatcttcatgtctgttgtgtttgttaactcctagtcgtttcactttattgaggatggaggcaggcgagtcttgtaccttcacgtaactgaatctagcgaattccaacatgatacgaattcctgatacttaaacaggc

SEQ ID NO: 5136 - DNA, 750 bp, Physcomitrella patens
gaagctctttctcacctcctcttcggccgccatctccagcgtcgtgagcaatctgctgcaatggcttcggaaaagaagatgcagaactccatgcgggagattaaagtgcagaaacttgtcctcaacatttccgtaggagagagcggcgacagattgactcgtgcgtccaaggtgttggagcaactgagcggacaatctcctgtcttctcaaaggcaagatacactgtgcgttcctttggaatcaggcgtaatgagaaaatcgcatgctacgtcactgttcgtggtgagaaagccatgcagcttctcgaaagtggcttgaaggtgaaggaatacgagttgctgcgccgcaacttcagtgaatctggttgctttggatttggtatccaggagcacatcgatctcggaatcaagtacgatccatctacaggtatctacggtatggacttttacgttgtccttgaacgcccaggatacagagtggggcgaagaaggagagccaagtcccgtgttggtattcaacaccgtgtgaccaaggaggatgccatgaagtggttccaggttaagtacgagggagttatcctgaacaagtcccaacaaattgcctagttcttcgtatctgttgcatgtctcaagtcctagtccttcatcctttccaaggatgttcataggctgacgctttctttttcatgcagctgattaagctaagttaaatatgatcctactgtctcatgattcaacctttattggttt

SEQ ID NO: 5137 - DNA, 725 bp, Physcomitrella patens
tcctcttcggccgccatctccagcgtcgtgagcaatctgctgcaatggcttcggaaaagaagatgcagaactccatgcgggagattaaagtgcagaaacttgtcctcaacatttccgtaggagagagcggcgacagattgactcgtgcgtccaaggtgttggagcaactgagcggacaatctcctgtcttctcaaaggcaagatacactgtgcgttcctttggaatcaggcgtaatgagaaaatcgcatgctacgtcactgttcgtggtgagaaagccatgcagcttctcgaaagtggcttgaaggtgaaggaatacgagttgctgcgccgcaacttcagtgaatctggttgctttggatttggtatccaggagcacatcgatctcggaatcaagtacgatccatctacaggtatctacggtatggacttttacgttgtccttgaacgcccaggatacagagtggggcgaagaaggagagccaagtcccgtgttggtattcaacaccgtgtgaccaaggaggatgccatgaagtggttccaggttaagtacgagggagttatcctgaacaagtcccaacaaattgcctagttcttcgtatctgttgcatgtctcaagtcctagtccttcatcctttccaaggatgttcataggctgacgctttctttttcatgcagctgattaagctaagttaaatatgatcctactgtctcatgattcaacctt

SEQ ID NO: 5138 - DNA, 927 bp, Physcomitrella patens
ctctttcccttgcgttcgggtcggccgccatcacctgtgttgtgagcaaatcggccgcaatggcttccgaaaagaagtcacagaactccatgcgggagatcaaagtgcaaaagcttgttctcaacatttccgtgggggaaagtggagacagattaactcgtgcatccaaggtgttggagcagctgagcggtcaaagccctgtcttttccaaggctaggtacactgtgcgttccttcggcatcaggcgtaatgagaaaatcgcatgctatgtcaccgtacgtggtgagaaggctatgcaacttctcgagagtgggttgaaggttaaggaatacgagctgctgcgtcgcaacttcagtgaatctggttgctttgggtttggtattcaggagcacattgatctcggcatcaagtacgatccctccacaggtatctacggtatggacttctacgtcgtactcgaacgccctgggtacagggtcgggagaaggaggagggctaagtcccgtgttggtatccagcaccgtgtgactaaagaggatgctatgaagtggttccaggttaagtacgagggagttatcctgaacaagtcccagcaaatcgcttaggtcctagtctttcatccttcgggggagggcaaggaggcattgtattttgaagcaattaaaccgggctaagcttgaattgacgtatgcctcatctgtctgaacactggaccttctcctttgtgctagtctgtaatgactgtttcaaactagtacattgttggtatgcaatgtactccgaactcctgacgctatactggatcttttctggggattgtttaacttttttcacttagaccattgtttttcaggaatgatcaactcattctggtatgttgtgcccttaaaaccttcttttggaagagctgttacagaattggtagtc

SEQ ID NO: 5139 - DNA, 865 bp, Physcomitrella patens
gttcgggtcggccgccatcacctgtgttgtgagcaaatcggccgcaatggcttccgaaaagaagtcacagaactccatgcgggagatcaaagtgcaaaagcttgttctcaacatttccgtgggggaaagtggagacagattaactcgtgcatccaaggtgttggagcagctgagcggtcaaagccctgtcttttccaaggctaggtacactgtgcgttccttcggcatcaggcgtaatgagaaaatcgcatgctatgtcaccgtacgtggtgagaaggctatgcaacttctcgagagtgggttgaaggttaaggaatacgagctgctgcgtcgcaacttcagtgaatctggttgctttgggtttggtattcaggagcacattgatctcggcatcaagtacgatccctccacaggtatctacggtatggacttctacgtcgtactcgaacgccctgggtacagggtcgggagaaggaggagggctaagtcccgtgttggtatccagcaccgtgtgactaaagaggatgctatgaagtggttccaggttaagtacgagggagttatcctgaacaagtcccagcaaatcgcttaggtcctagtctttcatccttcgggggagggcaaggaggcattgtattttgaagcaattaaaccgggctaagcttgaattgacgtatgcctcatctgtctgaacactggaccttctcctttgtgctagtctgtaatgactgtttcaaactagtacattgttggtatgcaatgtactccgaactcctgacgctatactggatcttttctggggattgtttaacttttttcacttagaccattgtttttcaggaatgatcaactcattctggtatgt

SEQ ID NO: 5140 - DNA, 1011 bp, Pteridium aquilinum
cagcgcacccgggagatctgcacgcctcttctcgtcccaacaatggctgtctctgagaagaaggctgctaaccctatgcgggagattaaggtgcagaagcttgtactgaacatctcagtgggtgagagcggagatcggctcacaagggctgctaaggttcttgaacagctgagtgggcaaactccggttttctccaaagctcgctacactgtcaggtcttttggaatcaggaggaatgaaaaaattgcatgctatgttactgttcgtggagccaaggccatgcagctactagaaagtggtttgaaggtgaaagagtatgagctgattaggaagaacttcagcgacacagggtgctttggatttggcattcaagagcatattgacctgggtatcaagtatgacccatctactggtatttatggtatggatttctatgtcgtgcttgagcgagctggatacagagttggtaggagaaagagagccaagactcgcgtcggcattcagcacagggtgaccaaggaggacgcgatgaagtggtttcaagtgaagtatgaaggagttattctgaacaagtctcaagccattaactagaattttgcaaggtgccaaggcaaattttgagtcccgacatctgagtggttaccactgtactgtgaatgatacctttgtttgaatgccagcttttacttacatggatatcagggctttgcaataccctctccaatgaggattgtttttggcagtagaagattgagttaatctatttttgaacggttctcaggtttaaagacccattcaaaagcttagagtgtgaaattagtttgcctaatattagaggagattttaagttcttgcatgagttcctgtgaattggttcattatgcgtccagagttttgttaatgttgtggtgcttatagagcaaccacagcagtgaagctgcagggacctttcgtatgcttgccctccaattttcacatgctttcaagtctaaaatgtttcgaaaaaagaaa

SEQ ID NO: 5141 - DNA, 1101 bp, Oryza sativa
gccgtccattccgcgatcagagcgctctctccgccacccccctcgctatataagcacccgagggtgcatttctagggtttccgccgccgaagccaccacacctaaacccttcttccctctcctcctccgccgccgccgccctcccctctcgccatggcgtcggagaagaagcagtcgaacccgatgcgggagatcaaggtgcagaagctcgtgctcaacatctccgtcggcgagagcggcgacaggctcacccgcgcctccaaggtgttggagcagctgagtgggcagagcccagttttctccaaggcgaggtacaccgtgaggtcattcggtatccgtcgtaacgagaagatcgcgtgctacgtcaccgtcaggggcgagaaggccatgcagcttttggagagtggcctcaaggtcaaggagtacgagctgctgaggaggaacttcagcgagaccggatgcttcgggttcggtatccaggagcacattgatcttggcatcaagtacgacccgtcaactggtatttatggcatggacttctatgttgttcttgagcgtgctggataccgtgttgctcgccggcgcaggtgcaagtcccgtgttggaatccagcacagggtgaccaaggaagatgccatgaagtggttccaggtcaagtatgagggtgtcatcctcaacaaggcccaagcaaacacgtcgtaattggcaagggtttaaccagttatcctgtagaattaagtgagggttcatttgaatcatggaactgtctttcttgaaagccaaatgcactgtcaattttgcctctgttggagttgacctgcgtctatatttccattaaatgcttaatgatatccttgttttaaatcttaatattaaggcagacttggaatcaatccacccgctttgttacctgtatttctgccttatcctgtgtcaggcaaaagctaagtagcaacagtcaaattgttcattttagtgatgttttatttggggtgccaatttcttcttttggactgcgacttgtgacatcttcatggcggtatacatcttactctcttggtaatgtcaatgcattgctatgctttgggcgcatgtttttat

SEQ ID NO: 5142 - DNA, 1114 bp, Oryza sativa
ggtgcatttctagggtttccgccgccgaagccaccacacctaaacccttcttccctctcctcctccgccgccgccgccctcccctctcgccatggcgtcggagaagaagcagtcgaacccgatgcgggagatcaaggtgcagaagctcgtgctcaacatctccgtcggcgagagcggcgacaggctcacccgcgcctccaaggtgttggagcagctgagtgggcagagcccagttttctccaaggcgaggtacaccgtgaggtcattcggtatccgtcgtaacgagaagatcgcgtgctacgtcaccgtcaggggcgagaaggccatgcagcttttggagagtggcctcaaggtcaaggagtacgagctgctgaggaggaacttcagcgagaccggatgcttcgggttcggtatccaggagcacattgatcttggcatcaagtacgacccgtcaactggtatttatggcatggacttctatgttgttcttgagcgtgctggataccgtgttgctcgccggcgcaggtgcaagtcccgtgttggaatccagcacagggtgaccaaggaagatgccatgaagtggttccaggtcaagtatgagggtgtcatcctcaacaaggcccaagcaaacacgtcgtaattggcaagggtttaaccagttatcctgtagaattaagtgagggttcatttgaatcatggaactgtctttcttgaaagccaaatgcactgtcaattttgcctctgttggagttgacctgcgtctatatttccattaaatgcttaatgatatccttgttttaaatcttaatattaaggcagacttggaatcaatccacccgctttgttacctgtatttctgccttatcctgtgtcaggcaaaagctaagtagcaacagtcaaattgttcattttagtgatgttttatttggggtgccaatttcttcttttggactgcgacttgtgacatcttcatggcggtatacatcttactctcttggtaatgtcaatgcattgctatgctttgggcgcatgtttttatcgatatggtgtgtatttgttcttggggacatatccggtaaaaatgagctaagtgttgaaaactcgtgaaaattat

SEQ ID NO: 5143 - DNA, 1079 bp, Oryza sativa
cggacccggcccacgtaaaccctcgtgctccccatccgttctagggtttccctgatttaacccccccgccgccgcctcccaccgcggcagccgcgactcctcccctaccgccgccctccctcgccgccgcgacgtcaccgtctgccatggcgtcggagaagaagcagtccaacccaatgagggagatcaaggtgcagaagctggtgctcaacatctccgtcggggagagcggagatcgcctcacccgtgcctccaaggtcttggagcaactgagtgggcagtcaccagtgttctctaaggctagatacaccgttcgctcatttggcatcaggcgtaatgagaagattgcgtgctatgtaactgttaggggtgagaaggcaatgcagcttcttgagagtggactgaaggtgaaggaatatgaacttctgagaagaaacttcagtgaaactgggtgttttggttttggaatccaggagcacattgatcttggcatcaagtatgatccttcaacaggtatttatggcatggacttctatgttgtccttgagcgtgctggataccgtgttgctcgccgtcgcaggtgcaagtcccgtgttggcattcagcaccgggtgaccaaggaggatgccatgaagtggttccaggtcaagtacgaaggtgttatcctcaacaaggcccaggctaatacatcttaagacctgatttgataggttttaggtccagtcactgcttgttatgagcgcagacaagtttttatttcacctaatgcaatgccggagtatattattttgccaagtcgttttgtttgagttcgttttgcacttgggagcgtataacgccggtcacttgaaaaaagaaaaatccgaaatcatgtcttgcctttcatactgccctctcctctctgttcctttgttgcaccatcttacatttcttagctttcctgagcttaagaaaagtgttatttattgtccaacacaacattgcatggtgaacgtgagatggtgatccttgaaccgcatagttgtcatgaccatggtgcttttcgaaattatatcagtataaaataccagatatttgga

SEQ ID NO: 5144 - DNA, 1082 bp, Oryza sativa
ggacccggcccacgtaaaccctcgtgctccccatccgttctagggtttccctgatttaacccccccgccgccgcctcccaccgcggcagccgcgactcctcccctaccgccgccctccctcgccgccgcgacgtcaccgtccgccatggcgtcggagaagaagcagtccaacccaatgagggagatcaaggtgcagaagctggtgctcaacatctccgtcggggagagcggagatcgcctcacccgtgcctccaaggtcttggagcaactgagtgggcagtcaccagtgttctctaaggctagatacaccgttcgctcatttggcatcaggcgtaatgagaagattgcgtgctatgtaactgttaggggtgagaaggcaatgcagcttcttgagagtggactgaaggtgaaggaatatgaacttctgagaagaaacttcagtgaaactgggtgttttggttttggaatccaggagcacattgatcttggcatcaagtatgatccttcaacaggtatttatggcatggacttctatgttgtccttgagcgtgctggataccgtgttgctcgccgtcgcaggtgcaagtcccgtgttggcattcagcaccgggtgaccaaggaggatgccatgaagtggttccaggtcaagtacgaaggtgttatcctcaacaaggcccaggctaatacatcttaagacctgatttgataggttttaggtccagtcactgcttgttatgagcgcagacaagtttttatttcacctaatgcaatgccggagtatattattttgccaagtcgttttgtttgagttcgttttgcacttgggagcgtataacgccggtcacttgaaaaaagaaaaatccgaaatcatgtcttgcctttcatactgccctctcctctctgttcctttgttgcaccatcttacatttcttagctttcctgagcttaagaaaagtgttatttattgtccaacacaacattgcatggtgaacgtgagatggtgatccttgaaccgcatagttgtcatgaccatggtgcttttcgaaattatatcagtataaaataccagatatttggaataa

SEQ ID NO: 5145 - DNA, 1055 bp, Panicum virgatum
caccccttcccctcacaacattgctcggggtcaagtacgtaattttacacaccataaggatttagggtttccttgtctccttacaaagcttcctctttccgccgccgccgccgccgcccctcaccgcgctgcagaaaaccctgtcaccacgctcgcgttcgcctcccagatctccccatggcgtcggagaagaagcagttgaaccctatgcgggagatcaaggttcagaagctcgtgctcaacatctccgtcggcgagagcggtgatcgcctcacccgcgccgccaaggtgctcgagcagctgagtgggcagtcaccggtgttctcaaaggcgaggtacactgtgaggtcgttcggtatcaggcgtaatgagaagattgcatgctatgtgacggtgaggggagagaaggcgatgcagctgctggagagtggcctgaaggtcaaggagtatgagcttctgaggaggaacttcagtgagactggctgctttgggtttggtatccaggagcacattgatcttggcatcaagtatgacccatctaccggtatctatggcatggacttctacgtcgtccttgagcgtgccgggtaccgtgttgcccgccgccgcaggtgcaagtcccgtgttggtatccagcacagggtcaccaaggaggacgccatgaagtggttccaggtcaagtacgagggtgtgatcctcaacaaggcccaagccaacacctcctaagtgtcacaagaccttagccccctccttagagctcgagtcaattaagtttgtctggtgcttggatttgtactagaagaagccaaatgcattgtcagttttgcctgtactggagttggatcctttttagggtgtcccgtactttcatctttatttgttgttggataatcccaaatagcctttgtttgctacaggagtggtgctaagataattgatacgttcaaccgagactaaacctaaactcagatgtgctaaactgaacatgacgcatgagaattatgcagctcatttcctatagctaatgaacccttgtttagttgccttcaaaattt

SEQ ID NO: 5146 - DNA, 901 bp, Cryptomeria japonica
  misc_feature (6)..(6): n is a, c, g, or t
  misc_feature (490)..(490): n is a, c, g, or t
  misc_feature (493)..(493): n is a, c, g, or t
  misc_feature (692)..(692): n is a, c, g, or t
  misc_feature (788)..(789): n is a, c, g, or t
ggttgnaatcagaggtttgttttcaagtttttggattgttcgaactctggacgtttgtttcactggtgaagaggactccgccaaagtcaagagcctcatggctgacaaactcaagaaccccatgagggaaattaaggtgcagaagctggttctcaacatatcagttggagagagtggagatcggcttaccagagctgcaaaggttttggaacagttaagtggtcaaactcctgtcttctccaaggctagatatactgtcaggtcgtttggaatcaggcgcaatgaaaaaatagcttgctatgttaccgtacgaggagaaaaagctatgcaacttttggagagtggattgaaagtgaaggagtatgaattacttagaagaaacttcagtgatacaggttgttttggttttggaattcaggagcacattgatttgggtatcaagtatgatccttcaactggtatttatggcatggacttctttgtagtcctngancgccctggttacagaattagtagaaggaagagagctgtgtcccgtgttggcattcaacatagggtgaccaaggacgattctatgaagtggttccagaacaaatatgagggagtgatccttaacaagtcgcagaatatcaccggttaaatgcctagttgtgtttattttttgctgtgagtacccttagtttctgcgtaanatttttgacactcaacaaagggtctttcttttctgccgagaagttttcttattaaagaattttggaagatcataacacttttaagtaagaggaacnnttttcttttatatatcatgttaaattcgaagaagtcttatttggatgtttgtgttggattgttacaaaagctaataactacagcagcatgtgaaatgatgtataattcttct

SEQ ID NO: 5147 - DNA, 858 bp, Sequoia sempervirens
cgtttggagagggtgagtgaaatagaagcagagcagcagacgggagaaagaaggctgccattagaaggagaacaatggccgctgataaactcaagaaccccatgagagaaattaaggtgcagaagctggttctcaacatctcagttggtgagagtggtgatcgactgacaagggctgctaaggttttggagcagttaagtggtcagactccagttttctccaaggcaagatatactgtgaggtcttttggaatcaggcgaaatgaaaagattgcttgctatgttactgtgagaggagaaaagctatgcagcttttggagagcggattgaaagtcaaggagtatgaattgcttcgaagaaacttcagtgacacaggctgttttggttttggaattcaggagcacattgatttggggatcaaatatgatccatcaactggtatttatggcatggacttctatgtggtcctagagcgtcccggttacagaattagtaggaggaagagggctgtgtctcgtgttggcattcaacacagggtgactaaggatgattctatgaagtggttccagaacaaatatgagggagtgattcttaacaagtcacagaatatcactggttaaatacctggttttgttaatttcttatcgagtacccttagtgcttgtttaccattcttgacactcaacaaaaggatgttaattgtttttcggagaagttttgtattaaagaattttgaaagctcattccttttagtaaggaggaacctcttagtttgatatgttatattgttaaatttgaggaatcttatctggatatttgtttttattaaaggctgatatttatgagtagcatgtgaaac

SEQ ID NO: 5148 - DNA, 853 bp, Panax ginseng
ttaccacccgggaaatcgccatggcttcagagaaaaactattgaacccgatgagagagatcaaggtccagaaactcgtactcaacatttctgtgggggagagtggagatcgactcactagagcctctaaggtcctggaacaactcagtggtcagacccctgttttctccaaagcaaggtatactgtgaggtcttttgggatcaggcgtaatgagaagattgcctgctacgtcacagtgaggggagacaaggcaatgcagcttctggagagcgggttgaaggtgaaggaatacgaattgctgaggaggaacttcagtgatactggctgctttggattcggtatccaggagcacattgatctcggaattaagtatgacccttcaactggcatttatggtatggatttctttgttgtacttgaacgtcctggttaccgtgtgggacgtcgtcgtagatgcaaatctcgtgttggaatccagcacagggtcacaaaggaggatgcaatgaagtggttccaagtcaaatacgagggtgtgatccttaacaagtcccagaatattgggggttaattgaatgttgtgggatcagattggataattacaagccaagttttgtgctttttagaccagcaatgcatattaagtcatgttttgaatagatgcagtcatgttttctctagaggcggatgtttttttcacagcgattttaggataatttctgctgtactatgtactggcttgcttattaattgtgtaactgtttggcattctatggtagttttagaatccagttcaggctttgagcacttgcctatacatcctcaaaatataacaaataaataaaattttatagaa

SEQ ID NO: 5149 - DNA, 960 bp, Chenopodium quinoa
ctctattttagggtttttatttcattcccacatttcactctaacgcttcctctctctccatccgtcggctgctgctccagtttttctctaatggcgccggagaagaagttatcgaaccccatgagggacatcaaggtccaaaagcttgttctcaacatctctgttggtgaaagtggtgatcgtcttaccagagctgctaaggtgttggaacaactcagcggtcaaaccccagtttactccaaagccagatacactgtccgatcttttggaatcagacgtaatgaaaagattgcttgtcacgtgactgttagaggtgacaaggcaatgcagttgcttgaaagtggtttgaaggttaaggaatacgagttgttgaggagaaacttcagtgagactggatgctttggttttggtattcaagagcacattgatcttggaatcaagtacgatccctctactggtatttatggtatggacttctatgttgtcctagagcgtcctggttaccgtgttgctcgtcgcagaaggtgcaaggcccgtgttggaatccagcacagagttaccaaggatgatgccatgaagtggttccaggtcaaatatgagggagttatcctcaacaaggcccaaaatctatctgcttaaacctttgttttttctttaatgctaaacctttgtctatcttaatagttgttatcccgctagggttaaattggattttgtagtgaaaaagagctttttttgacgatttattagtgttctttgtactgttgggtcacattggttctagaatttttgttctatgcttgaaggttttacagttgtcataaccatgaataccccatcgtacttctgtttacatcaatcaagtgttgctagtttgatccactctttcattgatttatggctctgcaatcttctgagattgtgggatgggcaaagatgttccaccctaatttgtccaac

SEQ ID NO: 5150 - DNA, 720 bp, Antirrhinum majus
  misc_feature (14)..(14): n is a, c, g, or t
ccatggcttagagnagaactatcgaacccgatgagagagatcaaggttcaaaagctcgtcctcaacatctccgtcggagagagcggcgatcgtctcacccgagccgctaaggttttggagcaactcagtggtcaaactcctgttttctccaaagcgaggtacactgttcgttcttttgggatcaggcgtaatgaaaaaattgcatgctatgtcacagtcaggggtgacaaggcaatgcagcttcttgagagcgggttgaaagttaaggagtacgaattgttgagaaggaacttcagtgacactggatgtttcggctttggtattcaggagcacatcgatcttggaattaagtatgacccttctaccggtatctatggtatggacttctacgtcgttcttgagcgccctggttacagagtgggccgtcgccgaagatgcaaggctcgtgttggaatccaacacagagtcaccaaggaggactcaatgaagtggttccaagtgaaatatgagggtgttatcctcaacaagtccaacgccatcggagcttaattattagaatgttaaatggactcaacaacacttgttttcttatccaagatttatttctttttgaacctcaaagaatctgtttttggagcaagtttatctatagaacatctgtactatgttgagtatatcaatgtctttataattttgctttgctttcttgcttaaaaaaaa

SEQ ID NO: 5151 - DNA, 909 bp, Coffea canephora
cggccgggggggtgagataaactagggtttctttcattctcttagcgctttacccatttttttctaaaccctacacacctcagctgcctccctcgccgcaccaccatggcgtcagagaagaaattgaacaaccccatgagggagatcaaggttcagaagctggttctcaacatctccgtcggcgagagtggagatcgtctcaccagagctgctaaggtgttggagcaactcagtggccaatcccctgttttctccaaggctagatacactgtgaggtcctttggcatcaggcgtaatgagaagattgcatgctatgttactgtcagaggtgacaaggcaatgcaactccttgagagtgggttgaaggtcaaggaatatgagcttctcaagagaaactttagtgagactggctgctttggcttcggtattcaagagcacattgatcttggaattaagtatgacccttcaactggtatctatggtatggacttctatgttgttttggaacgtcctggctaccgggtggcacgtcgccgtaggtgcaagtcacgtgttggaatccatcaaagagttaccaaggaggatgcaatgaagtggttccaggtcaaatatgaaggtgtcatccttaacaaggcccagaatattcaaactgcttagacagggtgttgttaccagttttactcttaggagattatgtttatgccttttgtagaccatgtctgtttactattgagtttggaaattttgaagaggtgttcgctatgctttaagactaagacatgttacttctgtttatttctggcaaaacgaattccagctttaccattttatcaagttaaattgttcttgccaaagtgttagcttatatgggatctacggtatctgcatgatttggaaaaaaaaaaaaaa

SEQ ID NO: 5152 - DNA, 813 bp, Platanus occidentalis
gtccaacccaatgagagagatcaaggtacagaagctcgtgctcaacatctccgtcggagaaagcggagatcgtcttaccagagccgccaaggtgttggagcagctgagtggccaaacccccgtgttctcgaaagctaggtacactgttcgatcgttcggtatcagacgtaatgaaaagattgcgtgctatgttaccgtcagaggtgacaaggcgatgcagcttctggagagcggattgaaggtgaaggagtacgagctcttgaggaggaacttcagtgataccggctgctttggcttcggcattcaggaacatattgatctcggaatcaagtatgatccttcgactggcatttacggtatggacttttatgtcgttctggaacgtccagggtaccgtgttggtcgtcgacgtaggtgcaagtctcgcgtcgggatccagcacagggtcacaaaagaggatgcgatgaagtggttccaggtcaaatacgagggtgtgatcctcaacaaatcccagaacatcacaggttgagagattccttaggccagtttcaagttttggcaagttcaagttacttttttttggtgttctctgtagacgtggagtcataatttcctttttgttttttcaattattttgagctatagcagtattagtttcactggttgtgatcatgttatgacatctttaagttgattttagctgtgaggaactgagaatggatgtttgttattttatacctggggttaatatgtacctgaagctcgagcttaaatttcgagtagactcatatcacatgaatgtcatcaccgtgt

SEQ ID NO: 5153 - DNA, 1064 bp, Oryza sativa
ccggggcaatatagtaattgtcaccatacaaacacccagcacaacaattttagggtttcctcccctactcctacaaagctccttccccgccgccgcccgagcaacactaaaccccccatctccgccgctcccgcctccccctcgccgccgccgcctcccagatctcgccatggcgtcggagaagaagcaggcgaacccgatgcgggagatcaaggtgcagaagcttgtcctcaacatctccgtcggcgagagcggagatcgcctcacccgcgcctcgaaggtgctggagcagctgagtgggcagtcaccggtgttctccaaggcgaggtacactgtgaggtcgttcggcatccggcgtaatgagaagatcgcgtgctacgtgacagtgcgtggtgagaaggcaatgcagctcctggagagtggcctgaaggtgaaggagtacgagctgctgaggaggaacttcagtgagactggatgctttggttttggtatccaggagcacattgatcttggcatcaagtatgacccatccactggtatttacggtatggacttctacgtcgttcttgagcgtgctgggtaccgtgttgcgcggcgccgtaggtgcaagtcccgtgttggtatccagcacagggtcaccaaggaggatgccatgaagtggttccaggtcaagtacgagggtgtcatcctcaacaaggcccaagccaacacctcctaagcgtcactagtgcctagttctctttagaacttgagttatttggatgttggatttgtatgcttcttaaaactaaagatgttttgttattttgtcaactttgagttggatcagttttggtggtatgtactttcatcttaatgctcagatctatttactctcttagcagagatagatatatgatttgacatatgctacgaactgctgtcaatgttgataaaatgaaaagagaatggtttagaaaaagaaaatgtcactacagatgtttctttggcaatgatccaataaatgtaactcagaaagttcaaacccttctggcaatttagtagataccaggatccccatggta

SEQ ID NO: 5154 - DNA, 1053 bp, Oryza sativa
gtaattgtcaccatacaaacacccagcacaacaattttagggtttcctcccctactcctacaaagctccttccccgccgccgcccgagcaacactaaaccccccatctccgccgctcccgcctccccctcgccgccgccgcctcccagatctcgccatggcgtcggagaagaagcaggcgaacccgatgcgggagatcaaggtgcagaagcttgtcctcaacatctccgtcggcgagagcggagatcgcctcacccgcgcctcgaaggtgctggagcagctgagtgggcagtcaccggtgttctccaaggcgaggtacactgtgaggtcgttcggcatccggcgtaatgagaagatcgcgtgctacgtgacagtgcgtggtgagaaggcaatgcagctcctggagagtggcctgaaggtgaaggagtacgagctgctgaggaggaacttcagtgagactggatgctttggttttggtatccaggagcacattgatcttggcatcaagtatgacccatccactggtatttacggtatggacttctacgtcgttcttgagcgtgctgggtaccgtgttgcgcggcgccgtaggtgcaagtcccgtgttggtatccagcacagggtcaccaaggaggatgccatgaagtggttccaggtcaagtacgagggtgtcatcctcaacaaggcccaagccaacacctcctaagcgtcactagtgcctagttctctttagaacttgagttatttggatgttggatttgtatgcttcttaaaactaaagatgttttgttattttgtcaactttgagttggatcagttttggtggtatgtactttcatcttaatgctcagatctatttactctcttagcagagatagatatatgatttgacatatgctacgaactgctgtcaatgttgataaaatgaaaagagaatggtttagaaaaagaaaatgtcactacagatgtttctttggcaatgatccaataaatgtaactcagaaagttcaaacccttctggcaatttagtagaataccaggaatccccatggta

SEQ ID NO: 5155 - DNA, 600 bp, Euphorbia esula
  misc_feature (180)..(180): n is a, c, g, or t
  misc_feature (203)..(203): n is a, c, g, or t
  misc_feature (321)..(321): n is a, c, g, or t
  misc_feature (329)..(329): n is a, c, g, or t
  misc_feature (375)..(375): n is a, c, g, or t
  misc_feature (561)..(561): n is a, c, g, or t
ggcacgaggtgcctccgtcagagctccgcctccaatcccctaaaaatggcttcagagaggaagctatcgaacccaatgagggagatcaaggttcaaaagctcgttctcaacatctccgtcggtgagagcggcgatcgtctaacccgtgcctccaaggttctggagcaactaagtggccanacaccagtcttctcaaaagctanatatactgttagatcttttgggattagacgtaatgagaagattgcttgctatgtcactgtaaggggtgacaaagctatgcagctacttgagagtggattgaaggttaaggaatacgancttttganaaggaactttagtgatactggttgctttggttttggcatccaggancacattgatcttggaatcaagtatgacccttccaccggtatctacggtatggatttctttgttgtgcttgagcgtccaggttaccgtgtgggtcgccgcaaacgatgcaagtcccgtgttggaattcatcaaagggtgacaaaggaggacgcaatgaaatggtttcaagtcaaatatgaaggtgtnatccttaacaaggcccagaacattggagcttagaacatt

SEQ ID NO: 5156 - DNA, 1186 bp, Panicum virgatum
gcagcacagcaggcttgtagcccagatttaattgggccacatctgtatttgcacagatggtccaggaggaagaggtcaggcattaaaacccaaatagctttttcttcgtaagggtcacatgcaaagcccataggtaaaccaagtggcccggcccagcaaaagccctcgcttcttccttcccaccctcaagcgtctcgctagggtttccctcttttaatcccctgccgccgccacccgccactctcggcacccgaccgtcccatctcctcgctccgccgccgccgccgcccaagggtccattcgccgcgtcaccgatggcttccgagaagaagcaggcgaacccaatgcgggagatcaaggtgcagaagctggtgctcaacatctccgtcggagagagcggggatcgtctcacccgtgcctccaaggtcttggagcaactgagtggccagtcaccagtgttctctaaggctaggtacactgtccgttcctttggtatcaggcgtaatgagaagattgcctgctatgttactgtaaggggtgagaaggcaatgcaacttctggagagtggactgaaggtcaaggaatatgaactgctaaggaggaacttcagtgagacagggtgctttggttttggtatccaggagcacattgatcttggcatcaagtatgatccttccactggtatttatggaatggacttctacgtcgtccttgagcgcgctggttaccgcgtcgcccgccgccgcaggtgcaagtcccgagttgggatccagcacagggtgaccaaggaggacgccatgaagtggttccaggtgaagtacgaaggtgtcatcctcaacaaggcccaggctaacacttcttagaacccacggtgtgtagtcccagccgttagacatgttatcgtggcagatgattttacctgtatggaagttctcggtctactttgtgcaatgtcggatcatattatttaccaagactaggttctcaaatcagttttggagtgaggagcttatggtcactctgttttgtttggtttgttgcgcattgcgctgcatgtgatgatcatcgatatgccagtgctcaaccttatctgcgatggatgagttccctactgattgtacaacgctctaccttatcttgttcgatctacatgtgagcatgcatgaatttatatgcttatcttgca

SEQ ID NO: 5157 - DNA, 688 bp, Utricularia gibba
ctaggaagcagcgtatcccgatgggttccgagaagaaattgacgaatcccatgagggacatcaaggtgcagaagctcgttctcaacatttccgtcggggaaagtggagatcgtcttactagagctgccaaggtgctggagcaactcagcggccagacaccggttttctccaaggcaagatacacagttaggtcttttgggattcgaagaaatgaaaaaattgcttgctatgtcaccgtgaggggggaaaaggcgatgcagctccttgaaagtggtttgaaagtcaaggagtatgagcttttgaggaggaatttcagtgagaccggctgctttggttttggcattcaggagcacatcgacttgggaataaagtatgacccttcaactggtatctatggcatggacttctatgtggtcttggagcgacctggctatcgtgttggcagacgccggaggtgcaaatctcgcgttggaatccagcacagggtaacaaaagatgatgcaatgaaatggttccaggtaaaatatgaaggagttatcctcaataaggcatccaacatcggagcctcatgagtttttccttgactagaagtcttgtgacactgttagaaggcagacccttgttctgtatgctgagagttttgtgacactgcttcccctctagttgctggggtatccttatgcttgtt

SEQ ID NO: 5158 - DNA, 549 bp, Musa acuminata
ccgcctcttcccttgcaggattccgagaagaagctgtcgaacccgatgagggagatcaaggtccagaagctcgtcctcaacatctccgttggcgagagtggcgatcgtctcacgagggccgctaaggttttggagcagctaagtggacagacaccagtgttctcaaaggtgaggtatactgtccggtcatttggaatcaggcgtaatgagaagatcgcgtgctatgtaacagtaagaggtgacaaggcaacgcaacttctagaaagtggactaaaagttaaggaatacgagctgttgaggagaaacttcagtgacactggttgctttggttttggcatacaagagcatattgatcttggaattaagtatgatccctcaactggtatctatggtatggatttctatgttgtattggagcgtgctggctatctcgtcgccgccgatgcaagtcactagttggcattcagaaccgtgtcaccaaggaggatgcaatgaagtggttccaagtcaaatatgagggtgtcatcctcaacaagtctcaggcaacta

SEQ ID NO: 5159 - DNA, 799 bp, Lupinus angustifolius
catggggattgctgcaaagtgtgaaactccgattgagttagattccatttgcaatggcttcagagaagaaattatcgaacccgatgagggaaatcaaggtgcaaaagcttgtccttaatatctctgttggtgagagtggagatcgtctcactagagctgccaaggtgttggaacagctcagtggccaaacccctgttttttctaaagcaaggtacactgtgcgttcctttggtattagaagaaatgaaaagattgcatgctatgttactgttagaggcgacaaggcaatgcagcttttggagagtggtttgaaggtgaaggaatatgaacttctgcgaagaaacttcagtgatactggatgttttggcttcggtatccaggagcatatcgatttaggaatcaagtatgatccttccactggtatttatggaatggacttctatgttgttctggaacgccctggttatcgtgttggacgtcgtcgtcgctgcaaggctcgtgttggtatccaacatcgtgttacaaaggaagatgcaatgaagtggttccaggtgaaatatgaaggtgtgatcctgaacaagtcgcagaatatttcttagattgaggtagttgtataccagttttgttcaatgttaactgcatttcaatgtttcttgaactagtagcttaaatttctggaaaacgcctcttgtcatttgagttgtttgatggtacttttttaatcatttatttttggcatctctatatctatattatgcttttaacactcacatgattgtaatgaatcagcagatgaact

SEQ ID NO: 5160 - DNA, 695 bp, Medicago truncatula
aaaagcttcagattttagggtaggggtttattcattccattcatctctgccgccgcaacacatcaatggcttccgacaagaaactggcgaacccaatgagggatatgaaggttcagaagctcgtcctcaacatctccgtcggtgagagtggagatcgtctcaccagagctgccaaggtgctggaacaacttagtggtcaaaccccagtgttctccaaagcgaggtacactgtgcgatcctttggaatcagaagaaacgagaagattgcatgctatgttactgtcagaggcgacaaggcaatgcagcttttggaaagtggtttaaaggtgaaggagtatgaactgttgaggaggaacttcagtgatactgggtgctttggatttggtattcaggagcatattgatttgggaatcaagtatgacccttctactggtatttatggaatggatttctttgtggttctggaacgccctggctatcgtgtgggtcgtcgccgtagatgcaaggcccgtgttggaattcaacaccgtgtcaccaaggatgacgccatgaagtggttccaggtgaaatatgagggagtgatccttaacaaatctcaggcaattgtttagttaaactgagttcttttagaagtatgttactgtttttggcaactatagtttggtctctcttggacaatgtcttaattatcagac

SEQ ID NO: 5161 - DNA, 738 bp, Distylium racemosum
ggcaggcgggaggagaaggcttctggtggacaaagatggccgcagacaagcttaagaaccccatgagggaaattaaagtgcagaagttggttctcaacatatctgtcggtgagagtggtgatcgactgactcgagctgcgaaggtgttggagcagcttagtggtcagactccagtattttcgaaagcaagatacactgtaaggtcgtttggaatcaggcgaaatgaaaagattgcctgctatgtcactgtaagaggagataaagctatgcagcttttggagagtggattgaaagtcaaggagtatgagttgcttcgaagaaactttagtgagacaggttgctttggttttggaattcaggaacacattgatttggggatcaagtatgatccttcaactggtatttatggtatggatttttatgtagtccttgagcgtccaggttacagaattgctaggagaaagagatgtaagtcccgtgttggcattgatcacagggtaatcaaggaggatgctatgaagtggttccagaacaaatatgagggtgtgatccttaacaagtcgcagtcttcataaatgtgtttggtcttggtagtttcttgttatgggtagcctgcagttttggtgtatatgtctgtctacactacacctaacagtaggaccccttctggtattaaaaggaattttgatcggtcttgacatttttcagtgggaggaatcttctttgagtaatttttat

SEQ ID NO: 5162 - DNA, 868 bp, Petunia hybrida
gcggggatagtggggattggaactagggtttgtctcacacacttgctctttcgctgctgcaacaatggcatcagagaagaaattgaacaacccaatgagggacattaaagtccagaagctggttctcaatatctccgttggtgaaagtggagatcgtctcaccagagccgccaaggtgttggaacaactcagtggccaatcccctgttttctccaaggcaaggtatactgtgaggtcctttggtatcagacgtaatgaaaaaattgcctgctacgtcactgtcagaggggaaaaagctatgcaactacttgagagtggattgaaggtcaaggagtatgagttgttgagaaggaacttcagtgagactggctgctttggattcggtattcaggagcacattgatcttggaattaagtatgacccttccactggtatctatggtatggatttctatgttgtcctagaacgcccagggtaccgtgttgccagacgtcgtaggtgcaagtctcgggttgggatccatcaaagggtcaccaaggatgacgcaatgaagtggttccaagtcaaatatgaaggtgttatccttaacaagtcctcgaacattcagtgagctgactgctggataatttgtccggtggcatgtttatgtttatgcattttgtagaccaacaactaattactcctagagttaaagagttcggagagttgctgttatttggaatactatatgcttgttttcattttggttttgtatgagatgaattcaatctttatcatttttctgttaattttccgttgtgcactctagtagttccatcatggctataagctgattatgtttaatatatttaaattactatgaccgtct

SEQ ID NO: 5163 - DNA, 739 bp, Primula obconica
ggagaagaagctgtcgaacccaatgagagagataaaggtgcagaagctcgttctcaatatctccgtcggagagagtggcgatcgcctcacacgcgccgccaaggttttggagcagctcagtggccaaaccccagttttctccaaggctaggtacactgttaggtcattcggtattaggcgtaatgagaagatcgcttgttacgtaactgtgagaggtgacaaagcaatgcaacttcttgagagtggcctgaaagtgaaggagtatgagctgctgagacgcaacttcagcgacactggctgctttgggtttggtattcaggagcacattgatctcggcatcaagtatgacccctcaaccggtatttatggtatggacttttatgtggtgcttgagcgcccaggttaccgtgtgggccgtcgtcgtaggtgcaaagcacgtgttgggatccaacacagagtcactaaggaagattccatgaagtggttccaagtcaagtacgaaggtgtgatcctcaacaaagctcagacaatcggttgaataatccaccaccgtccttttgaatattattgtgctttttgagatttaatagcataagagatatttgcttttcttgtagaaccaggataatcgtatttttgtcagtttttgtaaggtttggtaaactaagatttggtttattctacttttctatgtttgtaacttctaccatcttttcttaatattatgctggcgttgttg

SEQ ID NO: 5164 - DNA, 774 bp, Zostera marina
cggccggggacactagggtttttttctctgtaaatttcggcaaaccagcggcgaagaaatggcgtcggagaggaagctccagaatcccatgagagaaatcaaagtgcaaaaacttgttctgaatatctcagttggtgaatctggtgatcgtctcaccagggcgtcaaaggttttggagcaattgagtgggcagtcacctgttttttctaaagctagattcactgtacgatcttttggtattaggagaaacgagaaaattgcttgccatgtcactgtaagaggcgagaaagcgatgcagttacttgaaagtggcctaaaggtgaaggagtacgaacttttaaggaaaaatttctctgatacaggttgttttggatttggcatccaggaacatattgatcttggtatcaaatatgatccttctaccggtatatatggtatggatttctttgttgttcttgaaagaccaggatatcgagtggcaaggcgccgtcgatgtaaggcacgtgtggggattcagcatcgcgtcaccaaggatgatgcaatgaaatggtttcaagtaaaatacgagggagtcattctcaacaagtctcaaaatatctaagattaatatcttcctttataggcttctgtattcctaagttatctgttttttttgtaaaaccatctttaatgctttcttctgcttgaattgaattttgttttattttctgcttactacattttaactttatcgtgttttgttgttttctcatttaatcaaaactttgatccaca

SEQ ID NO: 5165 - DNA, 1009 bp, Picea glauca
actcataaaatagaggaagtttaggctacggtgagtttcagcaggcgtgttcgggtttgaggcagaggcgggagcagaaagagcagtcggcgggaaccagcgaaggagaaatggcagcggagaagaaactgaacaacccatgcgggatattaaggtgcagaagttagtgctcaacatatcagtcggtgagagtggtgatcgactcactcgagcttctaaggtgttggagcagcttagtggccagactccggttttttcgaaggcaaggtatactgtgaggtcctttggaattaggcgaaatgaaaagattgcctgctacgttactgttagaggagaaaaggctcttcaacttttggagagtgggctgaaagtgaaagaatacgagttgactccgaaggaactttagcggacacagggtagctttggtttttggggattcaggagcacattgatctgggaatcaagtatgatccttcaactggtatttaatggtatggacttctttgtagtcctagagcgccctggatacagagtcggcaggagaaagagagcccaatcccgtgttggcattcagcacagggttaccaaggaagattctatgaagtggttccaagttaaatatgaaggagtcatccttaacaagtcacaaaatatttgaatgagaagttttggtatgttccttaataagaagtagtcttggcttggtttgccacttctgttgatacctaaaggaaggaatttttcccggttataggttcacatttgtcttttgaagagattttggaagggcggattatttttatttgcaggaaactattgtactttttttttagtgtttagatcatttgttggtgcgaagttcaaggccatgcttccttgttaagtacaaggacatgttctctgatttgaaaatttgttgtcaattctcaaatggaagagattaatatcaatgttggatttgaactaaaatagagtaatacatgatttaaatggatggatgtaactttcc

SEQ ID NO: 5166 - DNA, 837 bp, Gossypium raimondii
taacgcagctgccattttcgtaactctacccccgctgctctcaaccccttccgcttcgccatggcatcagagaagaagctttcgaacccaatgagggagatcaaagtccagaaacttgtcctcaacatctccgtcggtgagagcggcgatcgtcttacacgtgccgccaaggtcttggaacagctcagtggtcaaaccccagtcttctccaaggctagatacactgtgagatcttttggaattcggcgtaatgagaagattgcttgttatgtgactgtgaggggggagaaagctatgcagcttcttgagagtggtttgaaggttaaggaatatgagcttttgaggaggaacttcagtgatactggctgctttggattcggtatccaagagcacattgatcttggtatcaagtatgacccttcaactggtatctatggtatggacttctatgttgttctcgaacgagctgggtaccgtgtgggtcgtcgccgcaggtgcaagtcacgtgtcggtattcagcaccgagtcaccaaggaggattccatgaagtggttccaagtcaaatatgaaggtgttatccttaacaagtctcaaaatatcggagcttaggaatagccaggtaaacaagatcaatcgagttgtttttaagatttttgctacttgatattggttttaagtttgtgtatcagttgtagtttggctgaagagatttgtgaaatgctaaagtaattttgctgttggattaaatggcttcatttaatatagcacttggaaaatacaatgtctattcaaatattttgagctagtgttaaaaataaagtcataacatttgagaga

SEQ ID NO: 5167 - DNA, 818 bp, Lupinus angustifolius
accaccacgatattgctactccaccgctgcgaagtgctgagaattcaaatcgatttgcaatggcttcagagaagaaactatcgaacccgatgagggaaatcaaggttcagaagcttgtcctcaatatctctgttggtgagagtggagatcgtctcaccagagctgcaaaggtgttggaacagcttagtggccaaacccctgttttttctaaagcaaggtacactgttcgttcttttggtattcgaagaaatgaaaaaattgcatgttatgttactgttagaggtgacaaggcaacacagcttttggagagtggtttgaaggtgaaggaatacgaacttctccgaagaaacttcagtgatactggatgttttggctttggtattcaggagcatatcgacttgggaatcaagtatgatccttcaaccggtatttatggaatggacttctatgttgttttggaacgccctggttaccgtgttggacgtcgtcgtcgctgcaaggctcgtgttggtatccagcatcgtgttacaaaggaagatgctatgaagtggttccaagtgaaatatgaaggtgtgatcctgaacaagtcgcagaatatctcttagattgagctaattgtaatagggattttacaagttttgttaaatgtaatttgatgtttcttgaactagtagcttaaatttctgggatattaatgcctctggtcatttgagccgtttggaggacttttttttaatcatttatttttgccatcaatatcaatattatgcttttgacactagcacttgaatgttctaaattttacatttatttaccca

SEQ ID NO: 5168 - DNA, 556 bp, Ambrosia trifida
atcagagaggaaacaagcgaacccgatgagagaaataaaggtccagaagctcgttctcaacatttctgtcggagaaagcggtgatcgtctcactcgtgccgctaaggttttggagcaactcagtggccaatctcctgtcttttctaaggcaaggtacactgtgaggtcttttggcatcaggcgtaatgagaagattgcgtgttatgtcactgttagaggagacaaggctatgcagcttttggagagtggtttgaaggtgaaggaatacgagttgttgaggcgcaactttagtgacaccggatgctttggattcggtattcaggagcacattgatcttggtatcaagtatgatccatctacgggtatctacggtatggatttctttgtggttctagaacgccctggttaccgtgtggggcgtcgccgccgatgcaaggctcgtgttgggatccaacacagggtcaccaaggaggatgctatgaagtggtttcaagtgaagtacgagggtgtcatccttaacaagtcccaacaaattggagcttagattgttggtttt

SEQ ID NO: 5169 - DNA, 775 bp, Ambrosia trifida
cgttcttcttccacctccgccgcagcaatggcttcagaaagaaaacaaagcaaacccaatgagagaaatcaaggttcagaaactcgttcttaacatctctgttggtgagagtggtgatcgtctcactagagctgccaaggttttggagcaattgagtggtcaatcccctgttttctccaaggcaaggtacactgtgagatcatttggcatcaggcgtaacgagaaaattgcttgctatgtaaccgttaggggtgacaaagcaatgcaacttcttgaaagcgggttgaaagtcaaagaatacgagttgctgagacgcaacttcagtgacacgggctgctttggatttggtattcaggaacatattgatcttggtatcaaatatgatccttctactggtatctatggtatggactttttcgtggttctagagcgccctggttaccgtgtgggtcgcagacgcagatgcaaggcgcgtgttggtattcaacatagagttacaaaggaagacgcaatgaagtggtttcaggtgaaatatgagggagtaattctcaacaaatctcaacaaattggagcttaaaagtagtcgtttctgatcagctgaggtgactttaaccgtctgctgattgtgagtgtgtgctcgggatactatttctattgctctgtcttttgtgtgtgtcgtgaaagaatatgcatgttaatcgatttttatgagatatttaccatctttatttacagttgttttgattattgtttttacaaaatttagttatctggt

SEQ ID NO: 5170 - DNA, 606 bp, Arnica chamissonis
cgtattggcttcagagaggaagcaggcgaacccaatgagggaaatcaaggttcagaagctggttctcaacatttctgtcggagaaagcggcgatcgtctcactcgtgctgctaaggttttggagcaactgagcggccaatctcctgtcttctcgaaggcaaggtatactgtgagatcctttggtatcaggcgtaatgagaagattgcatgctatgttactgttagaggagacaaggccatgcagcttttagagagtggtttgaaggtgaaagaatacgagttgttgaggcgcaattttagtgacacgggttgttttgggtttggtattcaagaacacatcgatcttggcatcaagtatgacccttctacgggtatctatggtatggatttctttgtggttctagaacgacccggttaccgtgtggggcgtcgccgccgatgcaaggctcgtgttgggatccagcaccgggtcacgaaggaggatgccatgaaatggtttcaggtgaaatacgagggtgttattcttaacaaatctcaacaaattggagcttagttagaagtgtcttcatgttttgtaaaattttctgaattcagttttataatttt

SEQ ID NO: 5171 - DNA, 765 bp, Artemisia annua
tggcttcagagaggaaacaagcaaacccaatgagggaaatcaaggttcagaaacttgttctcaacatttctgttggtgagagtggtgatcgtcttactcgtgctgccaaggttttggagcaactcagtggccagtcccctgtcttctctaaggcaagatacactgtgaggtctttcgggattaggcgtaatgaaaagattgcgtgctatgtgactgttaggggagacaaggcaatgcagcttctggaaagtgggttgaaggtcaaggaatacgagttgttgagacgcaactttagtgacactggttgctttggatttggtattcaggaacacattgatcttggtatcaagtatgatccttctactggtatctatggtatggacttctttgtggttctagaacgtccaggataccgtgttggtcgtcgccgtaggtgcaaggctcgtgttggtatccaacatagagttacaaaggaagatgccatgaaatggtttcaggtgaaatacgagggagttattctcaacaagtctcaacaaattggagcataactgtcttttaagtagtcctttttttgtggtcacttgaggtatcttaaaattgtatgtgcttgtgtgcaccagatattatattactattgctttgttttggttggatcctactagtagtgaaaatattgaactttctcagttttaaatgaggtgtttaacttctttttgacatgttttttcccttctcacaagtgattagagcttcaactttttagaa

SEQ ID NO: 5172 - DNA, 749 bp, Cephalotaxus harringtonia
gctctgagttttttctttcttaccgaggggaaggggaaggggaaggcgaaggatacacagaagcaggcgcaggagataacgaagaaggtcgccattacaacaaaaaaaatggcctctgacaaactcaagaacccaatgagggaaattaaggtgcagaagttggttctcaatatatcagttggtgagagtggggatcgactgactagggctgcaaaggttttggagcagctgagtggtcagactccagtcttttccaaggcaagatatactgtgaggtcttttggaatcaggcgaaatgaaaagattgcttgctatgttactgtgagaggagacaaagctatgcagcttttggagagtggattgaaagtcaaggaatatgaattgcttagaagaaactttagtgacacaggttgtttcggttttggaattcaggagcacattgatttggggattaagtatgatccttcaacaggtatttatggcatggacttctatgtagtcctagagcgtccaggttacagaatcagtaggaggaagagagctgtatcccgtgttggcattcaacacagggtgaccaaggatgatgctatgaagtggttccagaacaaatatgagggagtgatccttaacaagtcacagaatatcactggttaattgtctggtgttaattccttgctgtgagtagccggagttttttgtgtaccatttctatgataccaaacaaaaggatttttgttcctcattgatag

SEQ ID NO: 5173 - DNA, 1058 bp, Ceratodon purpureus
ggactgccctcgcctcctctttcgcaactgttaggctgccgcgaccccgccccgcaagccacctccgccccgcttccgccatcgccatcgccatggcgtccgaaaagaagcagcagaactctatgcgggatatcaaggttcagaagcttgttctgaacatctcggtgggtgagagcggagatcgtctcacccgtgcgtccaaggtgttggaacagctcagtggccagtcccctgtgttttccaaggcaaggtacactgtccgttccttcggtatcaggcgtaatgagaagattgcctgctacgtgactgtccgtggtgagaaagctatgcagctcttggagagtggattgaaggttaaggagtacgagctgctgcgccgcaatttcagtgaatctggatgcttcggtttcggtatccaagagcacattgatctcggaatcaagtacgatccctccacaggtatctacggtatggacttctacgttgtgcttgagcgcccaggttacagagttggaaggagacgcagagctaaatctcgcgttggtatccagcaccgtgttaccaaggaagatgccatgaagtggttccaggttaaatatgagggagtgatcttgaacaaatctcagaatattacagggtaggcctgctgcagatatttgaaagaggcagaaattttgtgagtatttggcccactattaattgagttcgcaagtcccctatggcatgggattttttgctagaaatatgagaaaatcaaactcacagcatcaatgatccaatttctgtctcaccttatagtgtccttagttattacatcgacatctttggagaggttcttcttcttcaaattcaaggtctggtcattagaaacaaacttgctccgtttttgttaggaggtttagggtttgtggggcagtcatctaaagagtctaaagttggggtgataaagtgttacagtaatctgcatggggtgcatttcattcctcccgtatgtatcatcgctgactgggttgttccatgttgctgtcatattttcaagtagtggccccgttttaccc

SEQ ID NO: 5174 - DNA, 842 bp, Ceratodon purpureus
cggctcggccgccatcgccaccgttgtcaccctagcaatctgccgcaatggcttcggagaagaagatgcagaactccatgcgggacattaaagtccagaagcttgtcttgaacatctcggttggcgagagtggagacaggttgactcgtgcgtccaaggtgttggagcagctgagcggtcagagccccgtcttctcaaaggcgaggtacactgtgcgttccttcggcatcaggcgtaatgagaagatcgcatgctacgtcaccgttcgtggtgagaaggccatgcagcttcttgagagtggcttgaaggtgaaggagtacgagttgctgcgccgcaacttcagtgagtctggatgctttggattcggtatccaggagcacattgatcttggtatcaagtacgacccttccaccggtatttatggtatggacttctacgtcgtccttgaacgcccagggtacagggttggacgaagaaggagagccaagtcccgtgttggtatccagcaccgcgtgaccaaggaggatgccatgaagtggttccaggtcaagtacgagggagttatcctgaacaagtcccaaaacatcacaggctaaatcgcctagatcttagtctctggtgcatgttgaaagtcctagtcctccagcccaggaaggagttttgtaggcaggccttgtattttcatgcagctaaaccaagccaatttcacattaattccacctgtcggatgattcagctacacttggtgtttgctctgtggcatgtccgtctgcatctgaaactttgttattctagaggaccgacttgaatgtcatcttaaacagatatattgcatgctcagt

SEQ ID NO: 5175 - DNA, 869 bp, Ceratodon purpureus
gctctttctcgctgcagcagccgccatcgcccttccgcccgtctccgccatggcgtccgaaaagaagcagcagaattgtatgcgggatattaaggttcagaagttggttctgaacatctctgttggtgagagtggagatcgtctcacgcgtgcctccaaggtgttggagcaattgagcggccagagccctgtcttctctaaggcgaggtacaccgtgcgttccttcggaatcaggcgtaatgagaagatcgcttgctacgtgactgttcgtggcgagaaagccatgcagctcttggagagtggcttgaaggtgaaggagtacgagctgctgcgtcgcaacttcagtgaatctggatgcttcggttttggtattcaagagcacattgatcttggaatcaagtacgatccctccaccggtatctacggaatggacttttacgtggtgcttgagcgcccaggatacagagttggaaggagacgcagagccaagtctcgcgttggaatccagcaccgcgttaccaaggaagacgccatgaagtggttccaggtcaaatatgagggagtgatcttgaacaagtctcagaatatcacaggttaagtatgtgatatcaggaggtttctggaagaggcagaaattttgtgcttatgcgggtactgctcgtgcttgtaatctgagtttgcaagtctccatggcatggggtatttgctacaaacatgggtacaagatcaaaatttcacttttacagggttgtttcaattctccgtctctttccattctgttgggtttgtgaaatagcaaacatatatgggattgctggatctatgtcacacattcatttcaagacaacaatatattaagtgtgcatgtg

SEQ ID NO: 5176 - DNA, 709 bp, Distylium racemosum
gcgagacggaggaagaagaagagcaggcgacgaagagaaaagaggaggagcctgttgttgcacaaaaatggcctctgataaactcaagaacccaatgagggaaattaaggtgcagaagctggttctcaacatatcagttggcgagagtggtgatcgactaactagggcggcaaaggtgttggagcagctgagtggtcagactccagtcttttccaaggcaagatacactgtaaggtcttttggaatcagaagaaatgaaaagattgcttgctttgtcactgtgagaggggataaagctatgcagcttttggagagtggattgaaagttaaggaatatgaattgcttcgaagaaacttcagtgatacaggttgttttggatttggaattcaggagcacattgatttggggatcaagtatgatccttcaactggtatttatggaatggacttctttgtagtcctagagcgtccaggttatagaattagtaggaggaagagatgtacgtcccgtgttggcattgaacacagggtgaccaaggacgatgctatgaagtggttccagaacaaatatgagggagtcatcctgaacaagtcacagtctaactgatgatgcctgttgacttggtaattccttgttatgagcagtctgagttttggtgtaccatttctctgatgcttaataagaggatctttctttcgacatggatag

SEQ ID NO: 5177 - DNA, 767 bp, Flaveria ramosissima
ggcatcagagaggaagcaagccaatccaatgagggagatcaaggttcagaagctcgtgctcaacatctccgttggtgagagcggagatcgtctcactcgtgctgcaaaggttttggaacaactgagtggccagtctccagtgttttccaaggcaaggtacactgtgaggtcatttggcattaggcgtaatgaaaagattgcatgctatgtaaccgttaggggagacaaggcaatgcagcttctggagagtgggttgaaggtcaaggaatacgagctgctgagacgcaactttagtgacactggttgctttggatttggtatccaggaacatattgatctgggtatcaagtatgatccttccactggtatctacggtatggacttcttcgttgttctagaacgcccaggttaccgtgttggccgtaggcgcaggtgcaaggctcgtgttggcatccaacatagagttacaaaggaagatgcaatgaagtggtttcaggtgaaatatgaaggagtaattcttaacaagtctcaaaaaattggagcataatttgaggtgactaaaattcgttctgtttgccagatattatatatctatttcgttgtcttttgtgccttttaatcttactactagtggaagtacgaaacttcctcagttttatgagaagacttttttgacatttggtgtgatttcttttaaacagtgattatctctctgcttttgttaaatgatcgaaaaacaagcaataacagggctgggttgatgatac

SEQ ID NO: 5178 - DNA, 598 bp, Flaveria ramosissima
ggcttcagagaggaagcaagcgaatccaatgagagagatcaaggttcagaagctcgtcctcaacatctccgtcggtgagagcggagatcgtctcactcgtgctgcaaaggttttggagcaattgagtggccagtcgccagtgttttccaaggcaaggtacactgtgaggtcatttggcattaggcgtaatgaaaagattgcatgctatgtaaccgttaggggagacaaggcaatgcagcttctggagagcgggttgaaggtcaaggaatacgagctgctgagacgcaactttagtgacactggttgctttggatttggtattcaggaacatattgatctgggtatcaagtatgatccttccactggtatctacggtatggacttcttcgttgttctagagcgtccaggttaccgtgttggccgtaggcgcaggtgcaaggctcgtgttggcatccaacatagagttacaaaagaagatgcaatgaagtggtttcaggtgaaatatgaaggagtaattctcaacaagtctcaacaaattggagcataatttgaggtgacttaaatttgttatgtttgccagatattatatttctatttt

SEQ ID NO: 5179 - DNA, 868 bp, Platanus occidentalis
ctcgaaccctatgagggaaatcaaggtgcagaagctcgtgctcaacatctccgtcggagaaagcggagatcgtcttaccagagccgctaaggttttggaacaattgagtggccaaaccccggtgttctccaaggctaggtacactgttcgatcatttggtattagacgtaatgaaaagattgcgtgctacgttaccgtcagggacgataaggcgatgcagctattggagagtggattgaaggtgaaggaatatgagttattgaggaggaactttagtgataccggatgctttggttttggtattcaggaacacatcgacctcggaatcaagtatgatccttcgactggcatttatggtatggacttttacgttgttctcgaacgtccagggtaccgtgtgggccgtcgtcgtaggtgcaagtctcgtgttgggatccagcacagggtcacaaaggaggacgcaatgaagtggttccaggtcaagtatgaaggtgtgatccttaacaagtctcaaaacatcacaggctagagatacatcctttgcctgtttcaagtgatggcaaggtcattttttttgggtggttttttgtccatcaggagttttaactcttctattctaaaagagaatttgagccatcttagtgttattatgggtttttgcttaaaacactttttaagttaatgatcttttctatgtgaagtggggtttctttttctttatttgggatttggtatgtgcttaaaatttgttgaactcagatgtaacacatcaccatgtcacgcaagggtgtaaaaatacaaagaggctgcttcgttgcataaactcttatcagtatagagattggccaatactgctagtccaaatttc

SEQ ID NO: 5180 - DNA, 858 bp, Podocarpus macrophillus
cgtttttagcgaggcggagcgagcggagagaagtttagcagcaggagaataaggagggaggagataaatcggtgaaagaacaatgtcttcggataaactgaagaatccaatgagggaaattaaagtgcagaagctggttctcaacatatctgttggtgagagcggtgatcgactgactcgagcttcaaaggtgttggagcagttgagtggtcagactccagtcttttcgaaggctagatatactgtgaggtcctttgggattaggagaaatgagaagattgcttgctatgtaactgtgagaggggaaaaagcgatgcaacttttagaaagtggactgaaggtaaaggagtacgagttgcttcgaagaaactttagtgatacaggctgttttggatttggaatccaggagcacatcgatttgggaatcaaatatgatccttctacaggaatttatggtatggacttctatgttgtcctagagcgtccaggttacagaatctctaggaggaagagatgcaagtctcgtgttggcattaagcacagagtaaccaaggaagattcaatgaaatggttccaaaacaaatatgagggtgtgatccttaataagtcacagtccaatacataattatgtgggccattgatatatgtcttttttaatcctctagactctggtgtataattaatttgcacacctatcacaaatttttgttgttgtaggaaatagttttacctttgagaggggattttgaaagtgcatcagtggatgctatttctttaaaagttttggttagtttgaattacacttttgatgtctttttggattaaaaatgttgatgaattataaatgatcgagtatgt

SEQ ID NO: 5181 - DNA, 704 bp, Helianthus annuus
ggcttcagaaagaaaacaagcaaacccaatgagagagatcaaggttcagaaactcgtccttaacatctccgttggtgagagcggcgatcgtctcactcgagctgccaaggttttggagcaattgagtggtcaatcccctgtgttttccaaggctaggtacaccgtgagatcatttggcatcaggcgtaacgagaaaattgcttgctacgtaaccgttaggggcgacaaagcaatgcaacttctggaaagcgggttgaaggtcaaagaatacgagttgttgagacgcaactttagtgacacaggctgctttggatttggtatccaggaacatattgatttgggtatcaaatatgatccttctactggtatctatggtatggactttttcgtggttctggaacgccctggttaccgtgtgggtcgtagacgcaggtgcaaggcgcgtgttggtattcaacatagagtaacaaaggaagatgcaatgaagtggtttcaggtgaaatatgaaggagtaattctcaacaagtctcaacaaattggagcttagtttgaggtgacttttaactttgttctctttcctacgatattatatttcttatttctttgttcatttattgcctttcgtaattctaccagttttatttactaatatgggagttttcttcagttttattgacaagatgttattttagtcatcttttttg

SEQ ID NO: 5182 - DNA, 945 bp, Juglans hindsii x Juglans regia
  misc_feature (155)..(155): n is a, c, g, or t
  misc_feature (164)..(164): n is a, c, g, or t
  misc_feature (173)..(173): n is a, c, g, or t
  misc_feature (185)..(185): n is a, c, g, or t
  misc_feature (215)..(215): n is a, c, g, or t
  misc_feature (221)..(221): n is a, c, g, or t
  misc_feature (233)..(233): n is a, c, g, or t
  misc_feature (254)..(254): n is a, c, g, or t
  misc_feature (257)..(257): n is a, c, g, or t
  misc_feature (269)..(269): n is a, c, g, or t
  misc_feature (296)..(296): n is a, c, g, or t
  misc_feature (302)..(302): n is a, c, g, or t
  misc_feature (323)..(323): n is a, c, g, or t
  misc_feature (359)..(359): n is a, c, g, or t
  misc_feature (647)..(647): n is a, c, g, or t
  misc_feature (762)..(762): n is a, c, g, or t
  misc_feature (770)..(770): n is a, c, g, or t
  misc_feature (773)..(773): n is a, c, g, or t
  misc_feature (788)..(788): n is a, c, g, or t
  misc_feature (801)..(802): n is a, c, g, or t
  misc_feature (811)..(812): n is a, c, g, or t
  misc_feature (814)..(814): n is a, c, g, or t
  misc_feature (826)..(826): n is a, c, g, or t
  misc_feature (841)..(843): n is a, c, g, or t
  misc_feature (851)..(851): n is a, c, g, or t
atgaaacaggcgcacgaagaaccctatcacacattttaggcttcctttcccacgctaaagtctagaccctctcggctgcagcagaccttctccgccctccccccgacacccctctgacatactcaaatggcttcggagaagaaactgagtatccnatgaggganatcaaggtncagaagctcgtnctcaacatctccgtcggtgagagcggtgancgtctnaccagggccgcnaaggtgttggagcagctcagnggncaaaatccagtnttctccaaggcaaggtacactgtgcgntccttnggtattagacgtaatgaaaanattgcatgctatgtcactgttaggggtgacaaggcnatgcagcttttggagagcggtttgaaggtgaaggaatatgagttgctgaggaggaacttcagtgatactggatgttttggctttggtattcaggagcacatcgacctgggaatcaagtatgatccttcaactggaatttatggaatggacttctatgttattttggagcgccctggttaccgtgttggccgtcgtcgccgatgtaagtctcgtgttgggatccagcacagggtcacaaaggaggatgccatgaagtggttccaggtcaaatatgaaggtgtcattctnaacaagtctcagaatatcacttaagcctggaacattgtcacagttttgagtgaggctggacccctggtgttatgtagaccagcgtcctatactgctatcttctttgaagttatgngaggagcntgngatgtgttttctggnccagaatctgttnntttatttgnncnatatgctttcancggcactactaactnnngtgatagntttaggctccgtttggatagtaaaagtgtctcgtctcattattacaaattttttaaattttcatataaaatataataaacaattaattttttcg

SEQ ID NO: 5183 - DNA, 1034 bp, Zamia vazquezii
  misc_feature (120)..(120): n is a, c, g, or t
  misc_feature (137)..(137): n is a, c, g, or t
  misc_feature (741)..(742): n is a, c, g, or t
tgatgcctctgtctctgttgccccattaaaacgaaaacgttctttttttttcgattgttttatttttaaggttccaaagattctgatacgattcagcaaatgcagttttctgcgactttntgtaggggcgtctgggngccgcgtttggttttatttcgagtgacttccagcaggcattctcggtttcggaatggcctctgaaaagaaactgaacaaccctatgagggaaattaaagtgcagaagttggtgctgaacatatcagttggtgagagtggagatcgactgactcgagctgcaaaggtgttggagcagttgagtggtcaggctccagtattttccaaggcaagatacaccgtgaggtctttcggaatcaggcgaaatgaaaagattgcctgctatgttactgtaagaggggaaaaggccctgcagctattggagagtgggttgaaagtgaaagaatatgagttgcttcgaaggaacttcagtgacactggttgttttggatttggcatacaggagcacatcgatttagggatcaagtatgatccttcgactggtatttatggtatggatttctatgttgtattagagcgccctggctacaggatttgtaggagaaagagagccaaggcacgtgttggcattaagcaccgagttaccaaagaggatgccatgaagtggttccaagttaaatacgagggagtcatccttaacaagtcacagtcaacaacataactgtnnataattttggtatatattgaatattccttgctatgtcaatttcagtttgttgagcattctgttgacaatcaaggaaaggcatttctttgctatcaaaacaaaattttttctgaaagtgatcgaagggactgtagttttacttagaggattttttggtactgatttgcttgtgtttagtttataaaaacaacatatgtactggggcttctgcgttgaatttttgtagtaaagagattattaagatatgtttcaaagatggtaataacctttacatgttgtattttggattttc

SEQ ID NO: 5184 - DNA, 758 bp, Centaurea maculosa
ggcttcagagaggaaacaggcgaatccaatgagggaaatcaaggttcagaagctcgttctcaacatttctgttggagaaagtggagatcgtctcactcgtgctgctaaggttttggagcaactcagcggccaatctcccgttttctccaaggcaagatacactgtgaggtcattcggtatcaggcgtaatgaaaagattgcatgctatgtcactgttagaggagacaaggctatgcagctcttggagagtggtttgaaggtgaaggaatacgagttgttgaggcgcaatttcagtgacactggatgctttggctttggtattcaggagcacatcgatcttggtatcaagtatgacccttctaccggtatctacggtatggatttctttgtcgttttggaacgtcccggttaccgtgttggacgtcgccgtaggtgcaaggctcgtgttgggattcaacacagagtgactaaggacgatgccatgaagtggtttcaagtgaagtacgagggtgtcatcctcaacaaatctcaacaaatcggaggctaagtatgtgggtttgtttttgtaaaattttggagttgagttaaaaggtttttacttaccatcaaggattatgagatcatattgttttgttgtgttttggaccatttgaagaatgctagtagtaccaatgtttttaagtatctatgaagttgtctttcgagcttgggaattacatgccaaaaaagaaaaaagtaccgactgcgtggccgctcgt

SEQ ID NO: 5185 - DNA, 753 bp, Echinacea purpurea
agagagatcaaggttcagaaactcgtccttaacatctccgttggagagagcggcgatcgtctcactcgtgctgcaaaggttttggagcaattgagtggtcagtcccctgtgttctccaaggcaaggtacaccgtgagatcatttggcatcaggcgtaatgagaaaatcgcttgctatgtaaccgttaggggtgacaaagcaatgcagcttcttgaaagtgggttaaaagtcaaagaatacgagttgctgagacgcaactttagtgacacgggctgctttggatttggtattcaggaacatattgatcttggtatcaaatatgatccttctaccggtatctatggaatggacttttttgtggttctagaacgccctggttaccgtgtgggtcgtagacgcagatgcaaggcgcgtgttggtattcaacatagagttacaaaggaagatgcaatgaagtggtttcaggtgaagtatgagggagtaattctcaacaaatctcaacaaattggaggttaaaagtaatcgttttttatcagctgaagtgacttaaatttgtgattgtgagcgtgaccaggatattatttctattgctttatcttttatatgcaaatttctcagtttttgagatatttaccttgtcttacatttgttatgattcctttaaactacctgttgtatcttctagttctaagaagaagataagattctgcattctaatttcttttttgtttctcaaggttgaatctgctaaat

SEQ ID NO: 5186 - DNA, 785 bp, Gossypium raimondii
tgacaaccctagagtgaggaattagacccagctgcctcttcgtcacttgtcagtacaacgctgctctcaacctccatttcccatcatggcatcggagaagaagctgtcgaacccaatgagggagattaaagttcaaaaacttgtcctcaacatctccgtcggtgaaagcggcgatcgtctcacccgtgccgccaaggtcttggaacaactcagtggtcaaacccccgtcttctccaaagctaggtacactgtgagatctttcggaattcggcgtaatgagaagattgcttgctacgtgactgtgaggggagagaaagctatgcagcttcttgagagtgggttgaaggttaaggagtatgaacttttgaggaggaacttcagtgataccggctgcttcggattcggtatccaggaacacattgatcttggcatcaagtacgatccttcaactggtatctacggcatggacttctacgttgttctggaacgagctggttatcgcgttggccgtcgtcgccgatgcaagtcacgtgttggtattcagcacagagttactaaggaagatgccatgaagtggttccaggtcaaatatgaaggtgtcatccttaacaagtcccaaaatattggagcttaagaaatagcagtaacgagctcagtttgagttgttttcagttttggctacttgattttgactagtttgtgtatcagtttctctctttttcctgaatagatttatgcttgagactttcctgttggttttatatttattcttcaatttttagtaa

SEQ ID NO: 5187 - DNA, 975 bp, Gossypium raimondii
accctcaaaagggtatcacttcgcagttgacactcgtatatgaaccctaaaaaccctaatcctaaaaagtaaatttcagtatattaatttgttagatctgtctcagctgctctccaagtctttcaagtcgccatggcatcagagaagaaattgtcgaacccaatgagggaaatcaaagttcaaaagctcgtcctcaatatctccgtcggcgaaagtggcgatcgtctcacacgcgccgccaaggtcttggaacaactcagtggtcaaacccctgttttctctaaggcgagatataccgtgagatctttcggaattaggcgtaatgagaaaattgcttgctacgttacggtgaggggagagaaggcaatgcaacttctcgagagtggtttgaaggttaaggaatacgagcttttaaggaggaactttagcgatactggctgcttcggattcggtatccaagaacacattgatcttggcatcaagtatgatccttcaactggtatctacggtatggatttctatgttgttctcgaacgagctggataccgtgtaggtcgtcgtcgcaggtgcaagtcacgtgttggcattcagcacagagttacaaaggaagatgccatgaaatggttccaagtcaaatacgaaggtgtcatccttaacaagtcgcaaaacatcggagcttaagagtagtagttacgagctaagttgagtttgtttcgagttttgggtactcggccttttgctagtttctgttgtctcggttctcgttttctcgaagagatttatgactaactctacggtcgtaactacttttttttttcttcttttggtttaattacattttgatatagcatttggaaaatggctttctctatctatgcttgttgatgttgatggagatgtaaggaaaagacccagtttgaaactagccatcggcttccaacgatcttttcgcatttcagtcgaaacatttctttt

SEQ ID NO: 5188 - DNA, 832 bp, Gossypium raimondii
ctctcacctctactctcaaacgccgctgccttctttgtttctgcgccgctgctctacaccttccttcggttcgcccaatggcatcggaaaagaagctgtcgaacccaatgagggagattaaagttcaaaaacttgtcctcaacatctctgtcggtgaaagcggtgatcgtctcacccgtgccgctaaggtcttggaacaactcagtggtcaaacccctgtcttctccaaggctaggtacactgtgagatcttttggaatcaggcgtaatgaaaagattgcttgctacgtgacggtgaggggagagaaggctatgcaacttctcgagagcggtttgaaggttaaggagtatgaacttttgaggagaaacttcagtgatactggatgcttcggatttggcatccaggagcacattgatcttggcatcaagtacgacccttcaactggtatctacggtatggacttttatgttgtcctggaacgagctgggtaccgcgttggtcgtcgtcgcaggtgcaagtcacgtgttggtattcagcacagagtaacaaaggaggatgccatgaaatggttccaggtcaaatatgaaggtgtcatccttaacaagtctcaaaatattggagcttaggggtagcatttacaagttcagttgagttgtttgaagttttggttatttgattttgactatttactgtatctggttttttgttttaccggagagatatatgattgacttgaaattccaaagtaccttccttgttggtttattacattatcaatatcagtatttatacaattggagaatgcctttctctgttcaagtattttgaattg

SEQ ID NO: 5189 - DNA, 796 bp, Gossypium raimondii
ctattcacgcaggcgccccttcatcactctgccgccgctctattcaacctccgtcgcttcgccatggcatccgagaagaagctgtcgaacccaatgagggaaattaaagttcaaaagcttgtcctcaatatctccgttggtgaaagtggtgatcgtctcacccgtgctgccaaggttttggaacaactcagtggtcaaacccctgtcttctccaaagctaggtacactgtgagatctttcggaatcaggcgtaatgagaagattgcttgctacgtgacagtgaggggagagaaggctatgcagcttcttgagagcggtttgaaggtcaaggaatatgagcttttgaggaggaacttcagtgatactggctgctttggattcggcatccaggagcacatagatcttggaatcaagtatgacccttcaaccggtatctacggtatggatttctatgttgttcttgaacgagctgggtaccgtgttggccgtcgtcgcagatgcaagtcacgtgttggtattcagcacagagttacaaaggaggatgccatgaagtggttccaggtcaaatatgaaggtgtcatccttaacaagtcccaaaatattggagcttagaagtagcagtatgagtttatttttagttttgagtacctgattttggctagtttatatttatcagatattattttcctgaacaaatttattttatgttttagggtggaatcctaagtttttctttttgttggtttagtttattaatatatttacaatcggaagaaagttttttgtttcttttcaa

SEQ ID NO: 5190 - DNA, 920 bp, Ceratodon purpureus
ttcgcaagtagccgccatcgcctaactgccctgtgtccaccttccaccatggcgtccgagagaaagcagcagaactgcatgcgggatatcaaggttcagaagcttgttctgaacatctctgttggggagagtggagatcgtcttacgcgtgcttccaaggtgttggaacagctcagcgggcagtcccccgtcttttcgaaagcaagatacactgtccgttccttcggaatcaggcgtaatgaaaagattgcatgctacgtgactgttcgtggcgagaaagccatgcaactcttggagagtggcttgaaggtgaaggaatacgagctgctccgtcgtaacttcagtgaatctggttgctttggttttggaattcaagagcacattgatcttggaatcaagtacgatccctccacaggtatctacggtatggacttctacgtagtgcttgagcgcccaggttacagagtaggaagaagacgcagagccaaatctcgcgttggtatccagcaccgcgttaccaaggaggatgctatgaagtggttccaggttaaatatgagggtgtgatcttaaacaagtctcagaacatcacaggttaagtgtgtggtacactgcagatctttgaaagagggagagtttttgagtaattgattacggtacccgctcgcttgtagtttgatttcgcaagtctccgtagtattgggaattttgccacaagcaatcgtgaatcttacttgctgcgttcagtgttaaactttgtgtgcccaatagtattgatctaccgaagcttctgttgttgcgacggtcagccatgttgagacacattgcagcgtgtctacggttttggaactctgtgcgtcttcatttgaatttcagtgtgttaatcctcgcacctagtaggtgtgcacacctccagaaaaaa

SEQ ID NO: 5191 - DNA, 750 bp, Cichorium intybus
cttggcgggggagcacaatggcttcagagaggaacaggcgaatccaatgagagagattaaggttcagaaacttgttctcaacatatccgtcggcgagagtggcgatcgtctcactcgtgccgccaaggttttggaacagttaagcggccaatctcctgtattttccaaggcaaggtacacggtgaggtcatttggcatcaggcgtaatgagaagattgcatgctatgttactgttaggggagataaagcgatgcagcttttggagagtggtttgaaggtcaaggaatatgagttattgagacgtaacttcagtgacaccggatgctttggatttggtattcaggaacacattgatcttggaatcaagtatgacccatcaacgggtatctatgggatggacttctttgtggtgttggagcggcccgggtaccgcgttggtcgtcgccgtaggtgcaaagcacgtgttggcattcagcatagagttacaaaggatgatgctatgaagtggttccaggttaaatacgagggagtaatccttaataagtcccaacaaattggaggataattggtcggttgagttgaatttacgaatatgccattctagccgtttgtgctgtttttgtagctgttttatggaagaaatatgttccttggacctatttctcattaccattttgttatttcatcatggttttagtatttttttttatattgcggatgtcttttttcttattgagaaattctattttg

SEQ ID NO: 5192 - DNA, 720 bp, Cichorium intybus
atggcttcgagaggaagcagtgaacccaatgagggagattaaggttcagaaactggttctgaacatctccgttggtgaaagcggtgatcgtctcactcgtgctgccaaggttttggagcaacttagtggccaatcccctgtcttttccaaggcaaggtacactgtgaggtcatttggaattaggcgtaatgaaaagattgcatgctatgtgactgttaggggagacaaagcaatgcagcttttggagagtggcttgaaggttaaggaatatgaacttttgaggcgcaactttagtgacactggctgctttggttttggtatccaggagcatattgatcttggtatcaagtacgatccatcaacaggtatctatggaatggacttctttgtggttctagaaaggccagggtaccgtgtgggtaggcgccgtaggtgcaaggcacgtgttgggattcaacacagagttacaaaggatgatgcaatgaagtggttccaagtcaagtatgaaggagtcatccttaacaaatctcaacaaattggaggatagacattttgtcttttccgccttttcaatccgactagttatggtcttatttttagttgttttaggcttcattatgtactccctttatttttgctcaaatgttttctacaagatccttgatatcatgttttgatttattatcattaacagaaaagatgcattgtttttaccaaaaa

SEQ ID NO: 5193 - DNA, 881 bp, Cryptomeria japonica
gggtcgagaaggtcggtcgagagagagagcagagcagcagacgagggggaaagaaggctgtcattagaaggaagaaatggccttggataaactcaagaaccccatgagagaaatgaaggtgcagaagctggttcttaatatatcagttggtgagagtggtgatcgactgacaagggctgcaaaggttttggagcagctaagtggtcaaactccagtcttctccaaggcaagatatactgtgaggtcttttgggatcaggcgaaatgaaaagattgcttgctatgtcactgtgagaggagaaaaagctatgcagcttttggagagtggattgaaagtcaaggagtatgaattgctccgaagaaacttcagtgatacaggctgttttggttttggaattcaggagcatattgatctggggatcaaatatgatccatcaacaggtatttatggcatggacttctttgtggtcctagagcgtcctggttacagaattagtaggaggaagagagctgtgtcacgtgttggcattcaacacagggtaactaaggatgatgctatgaaatggttccagaacaaatacgagggagtgattcttaacaagtcacagaatatcactggttaaatacctggttttgttaatttcttaccaagtacccttagtgcttgtttaccattggatgttaattttttaccaagaatttttgtattaaagaattttggaaggtcatatcacttttggtaagtaggaacctcttagtttgatatattatattgttaaactcaaggaatcttgtctggatatttgtgtttattaaagaagctgataattgtagcagcgtgtgaagatgtagaattcttgcaatatgcagacaatgttccgt

SEQ ID NO: 5194 - DNA, 639 bp, Flaveria ramosissima
caatgagggagatcaaggttcagaagctcgtgctcaacatctctgtcggtgagagcggagatcgtctcactcgtgctgcaaaggttttggagcaattgagtggccagtcaccagtgttttccaaggcagggtacactgtgaggtcatttggcattaggcgtaatgaaaagattgcatgctacgtaaccgttaggggagacaaggcaatgcagcttctggagagcgggttgaaggtcaaggaatacgagctgctgagacgcaactttagtgacactggttgctttggatttggtattcaggaacatattgatctgggaatcaagtatgatccttccactggtatctacggtatggacttctttgttgttctagaacgcccaggttaccgtgttggccgtaggcgcaggtgcaaggctcgtgttggcatccaacatagagttacaaaagaagatgcaatgaagtggtttcaggtgaaatatgaaggagtgattctcaacaagtctcaacaaattggagcataatttgaggtgacttaaatttgttatgtttgccagatattatttctttttgctgtcttatgtgccttttaatcttactagtagtgaaaatatggaacttcctcagttttatgagaagact

SEQ ID NO: 5195 - DNA, 1102 bp, Vitis vinifera
tagagttactgggttggcaacgtggaaaaggaggtacattttgctccagggctttattgtcattccattgaaaaataaaaccctagcgccttagctcccatataataccctacttcagacccgcagtccgcctcagtatcggtcctgtggctcctcaactcaatcctatctcccaatggcttcggagaggaaactggcgaacccaatgagggacatcaaagtccagaagctcgtcctcaacatctccgtcggtgaaagcggcgatcgcctcaccagggctgctaaggttttggaacagttgagtggccaaagtcctgtgttctcaaaggcaagatatactgtccggtcctttgcgatcaggcgtaatgagaagattgcttgctatgtcactgtcaggggtgaaaaggcaatgcagcttcttgagagtgggttgaaggttaaggaatatgagctcttgaggaggaactttagtgatactggttgctttggttttggtattcaagagcacattgatcttggaatcaagtatgacccttcaactggtatctatggcatggacttctatgttgttttagaacgcccagggtatcgtgtaggtcgtcgccgaagatgcaaggcccgtgttggaccccaccacagagttactaaggatgatgcaatgaagtggttccaggtgaaatatgagggagtgatccttaataaggcccaaaacattgtaggttcatagagagatcctttacatccatgcgtatgtgtgttgcttctttttattggtgtctgcaggataagatgggatttatgagttggtaggactagaaaataccacttgtggtggttttcagttttttttattattaatttttgtggttttaattctagttgcttttagtaatagataatatgctggtttgtggcatttgataccgttattttgctttacacagctgtgcccataagttatcttaatgttctgtaatgttggagacctacctctagtttctctttgcatcgttagctttataatcaattacttgtgctattcagtctactagtacatggttactgctggcagagttcttccgagtctccaaaaaagatggtt

SEQ ID NO: 5196 - DNA, 867 bp, Taxus baccata
ccacacatagtgaagggacctagggtttagggcaaaatatagttagggtttacaaaagttatttgacggtattttttgagctctttcttttctcacagcgttgaaggcgaacgtaaaacagaaccaggcgcaggagataacgaagaaggccgccattacaacaaataaaatggccgctgacaaactcaagaacccgatgagggaaattaaggtgcagaagttggttctcaatatatcagttggtgagagcggtgatcgactgacgagagcttcaaaggttttggagcagctaagtggtcagactccagtcttttctaaggcaagatatactgtgaggtcttttggaatcaggcgaaatgaaaagattgcttgctatgttactgtgagaggagaaaaagcaatgcagcttttggagagtgggttgaaagtaaaagaatatgaattacttcgaagaaactttagtgatacaggctgttttggttttggaattcaggagcacatcgatttggggatcaagtatgatccttcaactggtatttacggcatggacttctatgtagtcctagagcgtccaggatacagaattagtaggaggaagagagctgtgtcacgtgttggcattcaacacagagtgaccaaggatgatgctatgaagtggttccagaacaaatatgagggagtgatccttaacaagtcgcagaatatcactggttaaatttctggtcttgttaattccttgctgtgagtagcatgagtttttgtgtaccatttccccgacacccaacaaaacgaatgttctttttcattggtagaattttgcctttaaaggatttcggcaggtaatatcagttctattaaggaggaaac

SEQ ID NO: 5197 - DNA, 801 bp, Catharanthus roseus
tatatgtcaatatgaaccggagtcattcttcctaatcccatagcgccaaccaaccctaacccccttttaactcgcaatattttcacgatctcatctccactctctaccatcgctggcggcgcatccatctcttgccattcgcactcatggcttcggagaagaaattaaacaatccaatgagagaaatcaaagtgcagaagcttgtacttaacatttctgttggtgaaagtggtgatcgtctcacccgtgcagccaaggtgttggaacaactgagtggccaaagtcctgtgttctctaaggcaaggtacactgtccgatcatttggaattaggcgtaatgagaagattgcctgctatgttactgttagaggtgaaaaggcaatgcaacttttggaaagttggtttaaaagttaagagtatgagttgctaaggagaaacttcagtgaaactggatgctttggttttggtattcaagagcacatcgatcttggaatcaagtatgatccttctactggtatttatggaatggacttctatgttgttctagagcgcccaggttacagggtagctcgacgcagaaggtgcaaatctcgtgttggaatccagcatagagttacaaaggatgatgcaatgaagtggttccagggcaaatatgaaggagtgatcctcaacaaagctcaaacaattggatcttagatgtgtctagatatcttgataatgagatttgtaggggttttaaatactagttttgattctacttctgagactgagggtttactagaccaccctgatttacaatttc

SEQ ID NO: 5198 - DNA, 541 bp, Zea mays
gtttaaatcgtgctggcctgagccttgttgaggatgacaccttcatacttgacctggaaccacttcatggagtcctccttggtcaccctatgctgaatcccaacacgggacttgcacctcctgcggcgcgcgacgcgatagccagcacgctcaagcacgacgtagaagtccatcccatagatgcctacggagccgtacttgataccaaggtcgatgtgctcctggatgccgaacccgaagcagccggtgtcgctgaagttcctcctgagcagctcgtactccttgaccttgaggccgctctcaagcagctgcatggccttgtcgcccctgaccgtgacgtagcaggcgatcttctcgttacgccggatgccgaacgagcgcacccacccacccttggagaagacgggggtctggccgctgagctgctccagcaccttggcggcgcgggtgaggcggtcgccgctctcccctacggatatgttgaggaccagcttctgcaccttgatctcccgcatcgggttggactgcttcttctcggacg

SEQ ID NO: 5199 - DNA, 1069 bp, Lupinus angustifolius
atgtgaaaaaaatagttatgaaaaggggtgttatggtcttttaaaatccatccaatattggactcaaatgcagtatccaaaaccctagcaatagcatatatagctcattgtggttgatgcgcctctttccgtcatcaaactcaaacacacttctccttcttcgcacgaactcgcaatggcatcagagaagaaattatcgaacccaatgagggaaatcaaggttcagaagcttgttctcaacatctccgttggtgagagtggtgatcgtctcaccagagccgcaaaggttttggaacaactgagtggccaaagccctgtcttttctaaggctaggtacactgtgagatccttcgggattaggcgtaacgaaaagattgcttgctatgtcactgttaggggtgataaggcaatgcagcttcttgagagtggattgaaggttaaggagtatgaattgttgaggagaaacttcagtgacaccggttgtttcggattcggtattcaggagcacattgatcttggaatcaagtatgacccttcgacaggtatctatggtatggatttctatgttgttttagaacgccctggataccgtgttggtcgccgcagaagatgcaaggcccgtgttggaattcagcacagggtgaccaaagatgatgcaatgaagtggttccaagttaaatatgaaggagttattctcaacaagtcccaacaaatttcttaggcaagagtatttgcaaatgtgatgacaactgctttttatatgttttggtgggttgttgcccaatttagccacatcagtgttgtatcatttgaagggatttagttattgttgctcagattttggttgtttttgttgtttcctttgacttcaatacaatgtcactgtttgtgttttaatccaaatatcgatattatgatgtcaccctcttgatttatttcaacacaacccaatgaagtctaaagagggttacatatctgtttctttgaattttggactcttttctcttaacagtatggaagactaccctatccaggacttgagtattttgatgagatcaccctttagttt

SEQ ID NO: 5200 - DNA, 1141 bp, Populus trichocarpa
ctgttgtttttcttgttgctgttgcttagtgttgttttttttgttgtgcttaaatcaggcttcagagaagaaactatcgaacccaatgagagagatcaaggtccagaagttggtcctcaacatctctgtcggggagagtggtgatcgcctcacccgtgccgccaaggtccttgaacagcttagtggtcaaacaccagtcttctcgaaggctaggtatactgtgagatcttttgggatcaggcgtaacgagaagattgcttgctatgtcactgtgaggggagacaaggctatgcagttgctggaaagtgggttgaaggtgaaggagtatgagcttttgagaaggaacttcagtgatactggttgcttcggattcggtattcaggagcacattgatcttggcatcaagtacgacccttctacaggtatttatggcatggacttctatgttgttttggaacgtcctggataccgtgttggccgtcgtcgtaggtgcaagagtcgtgttggaattcaccagagagttacaaaggacgacgcaatgaagtggttccaagtcaagtatgaaggagtcatacttaacaagtcccaaaatatttgatcctagttcttttcccttggttgagttaaaagttttcactagttacatttggcaggattgtgcatctgaatttaaaattttgttgatgagatttttgaattggtagcatctgttacacactacttggttttcttgctcgccatttatgctcactggggtagattgtgcaaatatcttgtgttcggtattctttgcctgaaccgcagtttgttatttgagctgggctccatgattgttgtttatgcatgctgggctgcatgatcatgagatcataatctgtaaagggagaaattgcagatgctggtcaacagtagtaagctggattccctcattcagtgaaaaacggttggcagtgtattgaactgctatgacctgttatagggtatttgagtgatgcgtctaagaatgaccgcatataatggctggcagattcaagtaagaatcaccaatctacagtggtttttttcctttagtttttttttatttaattatttcatgttttgttaattgataatttaacttcataatctgttttgtactttt

SEQ ID NO: 5201 - DNA, 815 bp, Pseudoroegneria spicata
gccacacccagaaccaaccaaaccctcctatcttccgcttcctctccaccggcggcctccccggtcagatcaccatgtcgacggagaagaagcagttgaatccgatgcgggagatcaaggtgcagaagctcgtcctcaacatctccgtcggcgagagcggcgatcgcctcactcgcgctgccaaggtgttggagcagttgagcgggcagtcgccagttttctccaaggcgaggtacactgtcaggtctttcggcattcgtcgtaatgagaagattgcctgctacgtgacgatcaggggtgagaaggcaatgcagcttctcgagagtgggctgaaggtgaaggagtacgagctcctgaggaggaacttcagtgacactggttgctttgggtttggtattcaggagcatattgatcttggaatgaagtatgacccatcaactggcatctacggtatggacttcttcgtcgtactggagcgagctggataccgcgtctcccgcaggcgccgatgcaaggcccgtgttgggatccatcaaagggtgaccaaggaagatgccatgaagtggttccaggtcaagtatgagggtgtcatcctgaacaagtcccacgctagctagtaacctttcgagtgattgagttgtcgttagagcttaaggcagtcaagcttcatctggatcatggaatcgtatgtttattggatacaaagttgcactatcaattttgcctcgtctgttgggctgacctgcatctataattccatcaaatcttttcattgtttcatatttgaagttgaacatttcatcaaaaaaaaaaaa

SEQ ID NO: 5202 - DNA, 1181 bp, Secale cereale
gccgggagtccggtccaggtagccatccggctgggccggagaacgtcaacagcccagcaggagccgacctgaatatcctagccgtccacccattgatcggaccgctccaaactcccccacgccattctgccaaatcgtcgctcggcaacctctagcaacccctatataagaccgggagatttctagggtttccgcccccgcagccacacccagaaccagataaaccctcccatcttccgcttcctctccaccggcggcctccccggtcagatcaccatgtcgacggagaagaagcagttgaaccccatgcgggagatcaaggtgcagaagctcgtcctcaatatctccgtcggcgagagcggcgatcgcctcactcgcgctgccaaggtgttggagcagctcagcgggcagtcgccagttttctccaaggcgaggtacactgttaggtcttttggcattcgtcgtaatgagaagatcgcctgctacgtgacgatcaggggcgagaaggcaatgcagcttctcgagagtgggctgaaggtgaaggagtacgagctcctgaggaggaacttcagtgacactggttgctttgggtttggtattcaggagcacattgatcttggcatgaagtatgacccatcaactggcatctacggtatggacttctttgtcgtactggagcgagctggataccgtgtctcccgccggcgccgatgcaaggcacgtgttgggatccaccaaagggtgaccaaggaagatgccatgaagtggttccaggtcaagtatgagggtgtcatcctcaacaagtcccacgccagctagtaaccttccgagtgattgagttgtcgttagagcttaagtcagtcaagcgtaatcaggatcatggaatcatatgtttattggatacaaagttgcactatcaattttacctcaactgttgagcttaagtcgagcgtaatcaggatcatggaatcatatgatttctggggtttttttgttcagattatcattctgttgagtggttttagttgaattagagcattacaaccggacggcctgtcctgatgtaaaattgccactcaactgcgcttgttggcaaaccctatatccatccataacgccttggacgtgcccaccacgctggatctagcagggcgcccgtcactatggccgatctgactatg

SEQ ID NO: 5203 - DNA, 986 bp, Triticum aestivum
ccagaaccagctaaaccctaccatcttcggattcctctccaccggcggcctcccccgtcagatcaccatgtcgacggagaagaagcagttgaacccgatgcgggagatcaaggtgcagaagcttgtcctcaacatctccgtcggggagagcggcgatcgcctcactcgcgctgccaaggtgttggagcagctgagcgggcagtcgccagttttctccaaggcgaggtacactgtcaggtcttttggcattcgtcgtaatgagaagattgcctgctatgtgacgatcaggggtgagaaggcaatgcagcttctcgagagtgggctgaaggtgaaggagtacgagctcctgaggaggaacttcagtgacactggttgctttgggtttggtattcaggagcacattgatcttggcatgaagtatgacccatcaaccggcatctacggtatggacttctttgtggttctggagcgagctggataccgtgtctcccgccggcgccgatgcaaggcccgtgttgggatccaccaaagggtgaccaaggaagacgccatgaagtggttccaggtcaagtatgagggtgtcatcctgaacaagtcccacgctagctagtaacctttcgagtgattgagttgtcgttagagctttaagtcagtcaagcttaatctggatcatggaatcttatgtttattggatacaaagtttgcactatcaattttgcctgttccgttgggctgacctgcatctataattccaccaaatcttttcatggtttcatatttgaagttgaacatttcatcaacttttttcctactatatactattgtctatcattctctcatttagccagcaaagcaactgcaaacagcgatgatatctggctcgtgtttttgttaggatcaccatgcttgctacactgttttaagttgaattagagcatctctagcagatcccttgaacacctggcgaactatgctggctgatttat

SEQ ID NO: 5204 - DNA, 906 bp, Panax ginseng
ttcaccgagaacatcatcaaaaccctagatttactcgcactcccgcttcctatatttagggtttctctcctattcccgattctgcatttttcccccacttgcagagttgcagttgcagttgcagttacgaacttcaccaccggcgaatcgccatggcttcagagagaaaattagcgaacccgatgagggagattaaggttaaaaaactcgtccttaatatttctgttggagagagtggagatcgactcactagagcctctaaggtcttggaacaactcagtggtcaaacccctgttttctccaaagcaaggtatactgtgaggtcttttgcgatcaggcgtaatgagaagattgcctgctatgtcacagtgagaggtgacaaggcaatgcaacttctagatagcgggttgaaggtgaaggaatatgaattgtataggaagaacttcagtgattctggctgttttggctttggtatcccggagcacattgatcttggaattaagtatgatccttccactggcatttacggtatggatttctatgttgtgcttgaacgtccgggttaccgtgtgggacgacgccgtaaatgcaaatcacgtgttggaatccagcacagggttgcaaaggaggatgcaatgaaatggttccaagtcaaatatgagggggtgattcttaacaagtcccagaatattgggaattaattgagtgatgtctgatctgttaggtttatgccttttggactagcggaggataaaaaatttaagagcaatgttttgaatagttgcagactggcagtcatgtttgcatctagtttgtcaaatttgacatattttttgagagaatttgaacttcacaatgtttttggctttatgttggctaaattttaattccagttgattgtttgag

SEQ ID NO: 5205 - DNA, 719 bp, Aquilegia formosa
aaaaaaaaaatctctttttacaggcatcagaacagaaactggcgaacccaatgagggaaatcaaagttcagaagcttgttctcaatatctctgttggtgaaagtggagatcgtctcactagagccgctaaggtgttagaacagttgagtggacaatcacctgttttctccaaagctaggtatactgttagatcttttggaatcaggcgtaatgagaagattgcttgctatgttactgttcgaggtgataaagctatgcagcttttggagagtggattgaaggtgaaagagtatgagttgttgagaaggaacttcagtgatactggctgttttggtttcggtatccaggaacacatcgatttggggattaagtatgatccttcaactggtatctatggtatggatttctatgtggtcttggaacgtcctggataccgtgtgggacgtcgtcgtagatgcaagtctcgcattgggatccaacaccgtgtgacaaaggatgatgccatgaagtggttccaggtgaagtacgagggtgtgattctcaacaagtcgcagaatatcacagggtagtagaaagtgtgcattaggtggccatttgtaacttttgaaggttaagattactctgtttgaatagcgaacatttgaaaaggaaaagtgttgaatagtcaaattttgtgtttttggttgaattatccaagacaaatgtgattcccaatcctt

SEQ ID NO: 5206 - DNA, 789 bp, Musa acuminata
ttcctctcttcttcgcaggcttccgagaagaagctgtcgaacccgatgagggagatcaaggtccagaagctcgtcctcaacatctcggtcggtgagagcggtgaccgtctcaccagagccgccaaggtcttggagcagttgagcgggcagacaccagtgttctcaaaggcaagatatactgtcaggtcgtttgggatcaggcgtaacgaaaagattgcgtgctatgtcactgtcagaggtgacaaggcaatgcaactcttggagagtggattgaaagtgaaggagtacgagttattgaggagaaacttcagtgatactggctgttttggttttggcatacaagagcacattgatctcgggattaagtatgacccatcgaccggtatctatggaatggatttctatgtggtgttggaacgtgctggttatcgtgtggcccgtcgtcggcgatgcaagtcacgtgttggaatccagcatagggttaccaaggaggacgccatgaagtggttccaggtcaaatatgagggtgttatcctcaacaagtctcaatcaagcactgtttaagatcacttaatctcccagaacctgttcttcaaattgtagttcactagtcttgttaaaacagttgactttatagtatgccatggacttatttgcttttccagtttttgatctgtaacctgagcattttgatcacaaagtatgaagattaatttttatactacattttattgggttaggtttgtaagttcatagtcttgctatcatagatatgacaaagttacttgt

SEQ ID NO: 5207 - DNA, 1064 bp, Hordeum vulgare
cggagaacctcaacagcccagctagtaagaaagcacaagccgagctgaatatcctagccgtccatccattgatcggaccactccaagccccccacgccattccgcgaaatcgtcgctcggcaacctccagcgccccccctatataagacccgggagatttctagggtttccgccgccgcagccacacccagaaccaaaaccctcccatcgtccgcttcctctccaccggcggcctccccggtcagatcatcatgtcgactgaaaagaaacagttgaacaccatgcgggagatcaaggtgcagaagctcgtcctcaacatctccgtcggcgagagcggcgatcgcctcactcgcgctgccaaggtgttggagcagctgagcgggcagtcgccagttttctccaaggcgaggtacactgtcaggtctttcggcattcgtcgtaatgagaagattgcctgctatgtgacaatcaggggtgagaaggcaatgcagcttctcgagagtgggctgaaggtgaaggagtacgagctcctgaggaggaacttcagtgacactggttgctttgggtttggtattcaggagcacattgatcttggcatgaagtatgacccgtcaactggtatctatggtatggacttctttgtcgttctggagcgtgctggataccgtgtctcccgccggcgccgatgcaaggcccgtgttgggatccaccaaagggtgaccaaggaagatgccatgaagtggttccaggtcaagtatgagggtgtcatcctgaacaagtcccatgctagctagtatcctttggactgattaagttgttgttagagcctaagtcagtcctccttctggatcatggaatcgtatgtttattggatacaaagttgcactatcaattttgcctcatctgttgggctgacatgcatctataattccatcaaatcttttcatgtttcatatttgaaattgaacatttcatcaacttattttctgctatgagtgaagtttgttttaaaccctgaattcataccgtccgtcgagaatgaaccctaacctttcaatccctga

SEQ ID NO: 5208 - DNA, 859 bp, Fagus grandifolia
tactccatattatactctcctccttcccatctttctttctctcgtctgccgcttgctgcaaactcaaactcaaacgctcccaaatggcttcagagaagaaattgagtaacccaatgagggaaatcaaggtccagaagctcgtcctcaacatctccgttggtgagagtggtgatcgtctcaccagggccgccaaggtgttggagcagctcagtggtcaaaatccagtgttctccaaggcaaggtacactgtgcgatcctttggtatcaggcgtaatgaaaagattgcatgctatgtcactgttaggggtgagaaggcaatgcagcttttggagagtggtttgaaggtgaaggaatatgagctgctgcggaggaacttcagtgatactggatgttttggctttggtatccaggagcacattgatttgggaatcaagtatgatccttccaccggtatttatgggatggacttctttgttgtgctggagcgccctggttaccgtgttggccgtcgtcgcaggtgcaagtctcgtgttgggatccagcacagggtcacaaaggatgatgccatgaaatggttccaggtcaaatatgaaggtgtgatcctcaacaagtctacaaaacaccacaagttaatcctggaagattttgatttaggttgatgttctgtagaccagtttcttttactactatttctttttcaagttttgggagagcttgggataatgttttttgggccaaaatctgttaatttattggtcctccatatattttcagcagtttcagcagctctgaatcactatcatcatagtttatgtttagacaattagtctttctatgataatgactgttttgtgtttgg

SEQ ID NO: 5209 - DNA, 1100 bp, Brachypodium distachyon
agcgcctccgcactagggtttccttctcttcctacaaagccctcgccgccgccgccggcccacaccacgctctaaacgtctcaacccccccctccctcccctcccccgccgtcgaccccccagatcccccgcctccatgtcgacggagaagaagcagctgaaccccatgcgggagatcaaggtgcaaaagctcgtcctcaacatctccgtcggcgagagcggagatcgcctcacccgcgcctccaaggtgctggagcagctgagtggacaatcacccgtgttctccaaggcgaggtacactgtgaggtcgttcggtatcaggcgtaatgagaagattgcgtgctacgttacagtcaggggtgagaaggcgatgcagctgctggagagtggcctgaaggtgaaggagtatgagcttctgaggaggaacttcagtgacaccgggtgctttgggtttggtatccaggagcacattgaccttggcatgaagtatgacccatctactggtatctatggtatggacttctacgttgttcttgagcgtgctggctaccgtgtttcccgccgccgcagatgcaaggcccgcgttgggatccaccagagggtcaccaaggaggacgccatgaagtggttccaggtcaaatacgagggtgtcatcctcaacaagtcccatgcgagctaagaagaacaccaagttgattaaactagtgttgatgctggatttgtatgtttcttagaaaccaaaatgctttgtcagttttgcctgtactgaagttggatattttcgggtggtctgcactttcgtctaaaatgctcacttgtgttttatccttgcaagaatagagatatatgtttggcatatgggataagatgaactgccgttgtttggtccctcctgaattccatgcacagccgtggtgaagtctttttgagtcagaaaaggatgaaagcaacaaacgccatgaaaaatgattcgcaacgtatgatgtatttgcatttgccacctccaaaccttcattttcaatgattatctacttaagataccttcattttcaatgattgtctacttaagattttaattatgattgataaacatgagtaaa

SEQ ID NO: 5210 - DNA, 877 bp, Brachypodium distachyon
atataagagcccggggggttttctagggtttccgccgccgcagccacagcccagcaccagctaaaccctctcttctctgcgtacaggcgccatccctgttcagatcgccatgtcgaccgagaagaagcagttgaaccccatgcgggagatcaaggtgcaaaagctcgtactcaacatctccgtcggagagagcggcgatcgcctcacccgcgcctccaaggtgttggagcagcttagcgggcagtcgcctgttttctccaaggcgaggtacactgtgaggtctttcggcatccgtcgtaatgagaagattgcgtgctacgtaacggttaggggtgagaaggcgatgcagcttcttgagagcgggctgaaggtgaaggagtacgagctgctgaggaggaacttcagcgacaccggctgctttgggtttggtatccaggagcacattgatcttggcatgaagtatgacccgtcgactggtatttatggtatggatttctatgttgttctggagcgtgctggataccgtgtttctcgtcgccgcagatgcaaggcacgtgttgggatccaccaaagggtgaccaaggaagatgccatgaagtggttccaggtcaagtacgagggtgtcatcctgaacaagtcccacgcaagctagttatctttttgagtaaaccagttgccctttagaactccagtcaagtttcatctgtatccatggaatcatatgtttattgggtaccaaacgcactgtcaattttgcctctctttaaatttgtcctgcgcctatataattccatcaaatccttatggtctcgtattttcaatttgtgctccatgaggacttttggtctgataattttctgctcgttcccgtcagcta

SEQ ID NO: 5211 - DNA, 977 bp, Brachypodium distachyon
aggcccatgctcctgcgcagagaacctgtcaggcccattctcttttcccatcctagggttgctctcttttaaccccgcgccgccaccctcctcatccccctctcgacgccagtctccctgccgccgccgccgaagaagccgaaggatatccgatcttctgccgccatgtcgacggagaagaagcagttgaaccccatgcgggagatcaaggtgcagaaactcgtcctcaacatctccgtcggcgagagcggcgacaggctcacccgtgcctccaaggtgctcgagcagctcagcgggcagtcgcctgtgttctccaaggcgaggtacaccgtgcgttcatttggcatccggcgtaacgagaagatcgcgtgttatgtgacggtgcgaggtgagaaggccatgcagctgctcgagagcgggctcaaggtgaaggagtacgagcttctcaggaggaacttcagcgacaccggctgctttggcttcggtatccaggaacacatcgatcttggcatgaagtatgatccctcaacaggtatttatgggatggacttctatgtcgtacttgagcgtgctggctaccgtgtgtcccgtcgccgcaggtgcaaggctcgtgtcgggatccatcagagggtgaccaaggaggatgccatgaagtggttccaggtcaagtatgaaggagtcatcctcaacaagtcccatgcgtcttaaaatcttttctctaggtgcagcggctgttagaacctttctcttgttgcacaatcagaagttcaccttgcaaattgaattatctggccagatgtttttgcctgttacttgaagctgaatgctgacctttttctcatttgtgtttgtccttccctacctggttgcctaaatgcttaattgcttgccccttcatgattttgttacctgttcattgtgcatgactgtctgttgccattctgtttttttattgataacttcgtatttattggcta

SEQ ID NO: 5212 - DNA, 733 bp, Bupleurum chinense
agacagaaaattagcgaacccaatgagagagatcaaagtgcagaagcttgttctcaacatatctgtgggagagagtggagatagactcactagagcctccaaggtcttggagcaactctctggacaaatgcctgttttctcaaaagcaaggtatactgtaagatctttcggaattaggcgtaatgagaagatcgcgtgctatgtaactgtgaggggtgataaggcaatgcagctcttggagagtggactgaaggttaaggagtatgagttgttgagaaagaacttcagtgatactggatgttttggctttggtatccaggagcatattgatcttggaattaagtatgacccttctactgggatttatggtatggatttctatgtcgtacttgaacgtcctggttaccgtgttggtcgtcgtagaagatgcaagtctcgtgttggaatccagcacagggtcacaaaggaggatgcaatgaagtggttccaagtcaagtacgagggtgtgatccttaacaagtcacagaatatcggaaattgagtgtgagataaagttgaaagttgacatcatagtagtgtttctagactagcggtgcatttttgttccgtgtttaatagtgccggtcatgttttctccagacaacaatgtattcttacatttgtttttgttataattccaagtttggtatgttatgcataattatatcagatggcaatgtaccatacacttgag

SEQ ID NO: 5213 - DNA, 688 bp, Hevea brasiliensis
ctgcaggaattcggcacgagcggagaagaagctctcaaatcctatgcgagagataaaagtacagaaacgcgtacttaacatctccgtcggcgaaagtggcgatcgtctcacccgtgctgccaaggttcttgagcaactcagtggtcaggccccagtcttctctaaggctaggtacactgttagatctttcgggatcaggcgtaatgaaaagattgcgtgctatgtgaccgtgaggggagacaaggccatgcagctgcttgagagcgggttgaaggtcaaggaatacgaacttttaaggaggaactttagtgataccggttgctttggatttggtatccaggagcacattgatcttggaattaagtatgacccatcaactggtatatatggaatggatttctatgttgttctcgagcgcccagggtaccgtgttggtcgtcgccgaagatgcaagtcacgtgttggaattcagcacagggtgacaaaggaggatgccatgaagtggtttcaagtgaaatatgaaggtgtcatccttaacaaggcccaaactattggggcttagaagtggttggttattttaagtttttgcgagttctgttttggcaggataatttttatgttcttggagttgtaaactttttttctgaagaattttgaattggtagaatctggaatactaattctgttt

SEQ ID NO: 5214 - DNA, 1022 bp, Ipomoea batatas
ataaaaaagccttacggtggcaaaaccgcgttttgcggtcccactagtggctccaaacaattcgcacgagggccgtttctccgtctcctcgtcagccgaaagccatggcattcagagaaaaaattgaacaacccaatgagggagatcaaggtccagaagcttgtcctcaacatctccgtcggtgagagcggcgatcgtctcaccagagctgcgaaggtgttggagcagctcagtggccaaacccctgttttctcaaaggctaggtacactgtgaggtcctttggtatcaggcgtaatgagaaaattgcgtgctatgtaactgtcaggggtgataaggcaatgcaactccttgagagtggattgaaggtgaaggaatatgagctgctaagaaggaatttcagtgataccgggcgctttggttttggtattcaggagcacattgatctcgggattaagtatgacccatcaaccggtatttacggtatggatttcttcgttgttttggaacgccctgggtaccgcgttgctcgccgacgcaggtgcaaggcccgcgttggaatccagcacagggtgactaaggaggatgcaatgaagtggttccaggtcaaatatgaaggtgtcatcctcaacaaggcatccaatatttaatgttttgggggattgaggaatgtgattgatgaatcagttgtttgcgttttggttttgttgtagacttgagattatattattactgagttacaagttttgagtacaaggctctatgttagctaattggtcattttctcataagatgaattatctattttgttggtttgtatacttaggttttgtattggaattttctactttgagccatacatttggtttgaatctgctgttgcccaaagaaaccatcactatattttttttggaaccaaaatcatccctattaaaaatgaacgttttagtgtaaagtggattgtggtccatctagattcattctatatatataaaatagggcctaactagcccgttagactgcg

SEQ ID NO: 5215 - DNA, 949 bp, Avena sativa
cagccacacaccacagccccagccaacccatctcttcttcggcttcctctccacctgcggcctccccgttcagatcaccatgtcgacggagaagaagcagtcgaacccgatgcgggagatcaaggtgcagaagctcgtgctcaacatctccgttggcgagagcggtgatcggctcactcgcgcctccaaggtgttggagcagctgagcgggcagtcgccagttttctcaaaggctaggtacactgtgaggtcttttggcatccgtcgtaatgagaagattgcttgctacgttacaatcaggggtgagaaggcaatgcagcttctcgaaagtgggctgaaggtgaaggagtacgagctgctcaggaggaacttcagtgacactggctgctttggatttggtatccaggagcacattgatcttggcatgaagtatgacccgtcaactggtatctatggtatggatttctttgttgttctggagcgtgctggataccgcgtttctcgcaggcgccgatgcaaggcccgcattggtatccaccagagggtgaccaaggaagatgcgatgaagtggttccaggtcaaatacgagggtgtcatcctcaacaagtctcacgcgagctagtgatctttcgagtgaacaagttctttagaactccagtcagtcaagtgtcgtccggatcatggaatcatatgtttattggctacaaagtgcactgtcaattttgcctctgttcgagttgacctgcgtctataattccatcaaatcctttgttctcatatttgaaatctcacatttcctgaactctttgtttgctgatgtgattcagtttacttgcccgtatcatttagccagcaataacgggtaaccactaccaaagaagactcctgattttgttttagttttattatgttccaatgtcaatcgtgctctccgtctgtttcatataag

SEQ ID NO: 5216 - DNA, 778 bp, Avena sativa
ggccgccgcagccacacaccacaacgccagccaaaccctcttttcttcggctccctctcccccggcggcctccccgttcggatcaccatgtcgacggagaagaagcagtcgaacccgatgcgggagatcaaggtgcagaagctcgtgctcaacatctccgtcggcgagagtggagataggctcactcgcgcctccaaggtgttggagcagcttagcggacagtcgccagttttctcaaaggcgaggtacactgtgaggtcttttggcatccgtcgtaatgagaagattgcctgctacgttacaatcaggggtgagaaggcaatgcagcttctcgaaagtgggctgaaggtgaaggagtacgagctgctcaggaggaacttcagtgacactggctgctttgggtttggtatccaggagcacattgatcttggcatgaagtatgacccgtcaactggtatttatggtatggatttctttgttgttctggagcgtgctggataccgtgtttctcgcaggcgccgatgcaaggcccgcattggtatccaccagagggtgaccaaggaagatgcgatgaagtggttccaggtcaagtacgagggtgtcatcctcaacaagtctcacgcgagctagtaatctttctagcaaacaagttctttagaactccagtcagtataagtgtcatctggatcatggaatcatatgtttattggctacaaaatgcactgtcaattttgcctctgttcgagttgacctgcgtctataattccatcaaatcctt

SEQ ID NO: 5217 - DNA, 824 bp, Avena sativa
cacagcaccagccaaaccctctcttcttcggcttactctccacctgcggcctccccgttcagatcaccatgtcgacggagaagaagcagtcgaacccgatgcgggagatcaaggtgcagaaactcgtgctcaacatctccgttggcgagagcggtgatcggctcactcgcgcctccaaggtgttggagcagctgagcgggcagtcaccagttttctcaaaggccaggtacactgtgaggtcttttggcatccgtcgtaatgagaagattgcttgctacgttacaatcaggggtgagaaggcaatgcagcttctcgaaagtgggctgaaggtgaaggagtacgagctgctcaggaggaacttcagtgacactggctgctttggatttggtatccaggagcacattgatcttggcatgaagtatgacccgtcaactggtatctatggtatggatttctttgttgttctggagcgtgctggataccgtgtttctcgcaggcgccgatgcaaggcccgcattggtatccaccagagggtgaccaaggaagatgcgatgaagtggttccaggtcaagtacgagggtgtcatcctcaacaagtctcacgcgagctagtgatctttcgagtgaacaagttctttagaactccagtcagtcaagtgtcgtccagatcatggaatcatatgtttattggctacaaagtgcactgtcaattttgcctctgttcgagttgacctgcgtctataattccatcaaatccttagttctcatatttgaaatctcacatttcatcaactctttgcttgctgatgtgattcagtttacttg

SEQ ID NO: 5218 - DNA, 1271 bp, Sorghum bicolor
aaagccgagacctccctgtctctagggtttccctcttttaatcccccgccgccgcctccctcgcaccctgccgccacccatccatctcactccacctgacgccggcgcacagggccctgccgccgtcgccgcgttatccatggcgtcggagaagaagcagtccaacccgatgagggagatcaaggtgcagaagctggtgctcaacatctccgtcggagagagtggggatcgcctcacccgcgccgctaaggtcctggaggggccaatcaccagtgttctctaaggctaggtacactgtccgttccttcggtatcaggcgtaatgagaagattgtctgctatgttactgtaaggggtgagaaggcaatgcagcttctggagagtgggctgaaggtcaaggaatatgaactgctaaggaggaactttagtgagacagggtgctttggttttggaatccaggagcacattgatcttggcatcaagtatgatccttcaaccggtatctacggaatggacttctacgtcgtccttgagcgcgctgggtaccgtgttgcccgacgctgcaggtgcaagtcccgtgttggaatccagcacatagtgaccaaggaggatgctatgaagtggttccaggtcaagtatgagggtgtcatcctcaacaaggctcaggctaacacttcttagaaacactgttataaagctcagcccttaggcatgataccgatcgcagcagagtttcacctctactcaagttttcgatctcggacgacattatttaccaagactcaagtgcttgaattagttttggatcgaggagcttatggtctctattatactttgaaagctgaatcatggatatgcgcagttttatttggtttcgcaatgtgcttcgtttgacctactttcctctagtggcccatgtatacagagaaggatgtcttttttttgtcccctgttttgaccctacagctgtagtcatggtgcattcggtagtccaatggttgtctgatttgttttgcatttgtagtctgaactcaaaaggacgacgtcaccaacacgtcgacatgcgagaagcatttggaccgagcaaagagttagccgattggcttctgctcgttgatgtgcgtaacacacttaaaagtcataagagacactagctgttgacagcgttgtacaaacagtacctgtcatttcaaacacgatctgcactatccgacgatctcgagcaataattttccgctgtatatagtgtgtatatataatatattctggtcc

SEQ ID NO: 5219 - DNA, 713 bp, Eschscholzia californica
cttcggagaagaagctcttaaacccaatgagggacatcaaagtccagaagctcgttctcaatatttccgttggtgaaagcggagatcgtctcactagagcggctaaggttttggaacaattgagtggtcaaagccctgttttttccaaagctaggtacaccgttaggtcatttggaatcagacgtaatgaaaagattgcttgctacgttactgttaggggtgaaaaagctatgcaacttctggagagtggtttgaaggttaaggagtatgagctcttgaggagaaacttcagtgatactggttgcttcggcttcggtattcaagaacatattgatcttggaattaagtatgatccttcaactggtatttacggtatggacttttacgtggttttggaacgcccaggataccgtgttggtcgtcgccggaggtgcaagtcaagagttggtatccaacatagagtcacaaaggatgatgcaatgaagtggttccaggtcaaatacgagggtgtcattctcaacaagtcccaaaatatcactggttaattctaaggttcgagtctgttttagagttttgtgaagttaagacatccatttaattgtttttattccagcaagctctttgtttcgtcttgaaagaaacttaagatatagtattagtttcgtatctatcatgtttttggcagtaaagtttagaagttgggcatgaaaaaa

SEQ ID NO: 5220 - DNA, 809 bp, Papaver somniferum
tacgaacccaatgagggacatcaaagtccaaaagcttgtccttaacatttctgttggtgaatctggagatcgtctcaccagagccgctaaggttttggaacaattgagtggtcaagccccagtcttctccaaggctaggtacactgttagatcttttggaatcaggcgtaatgaaaagattgcttgttacgttaccgtgagaggtgagaaagctatgcagcttcttgaaagtggattgaaggttaaggaatacgagctcttgaggagaaacttcagcgatactggatgttttggattcggtattcaggagcatattgatcttggaattaagtatgatccttcaaccggtatttatggaatggacttctacgttgttttagaacgcccaggataccgtgttggacgtcgtcgtaggtgcaagtcaagagttggtattcaacacagggttactaaggatgatgccatgaagtggttccaggtcaaatacgagggagtcattctcaacaagtctcagaatatcactggttaattggagtcattcacactcgttaattggaagggctaggttttgttttcatgctataagaaaaaccatgtcacttagcttttcatgtaggcaatcaaactgcgttttcatttttatggtctggattttgagttaatagtagttggcagaatatattttgttatgaaattggattgtgtttgttaaatgtttctctttttcttctggagcatcatatttgcttaaaccaagcttaaaatgtggttatggtatctatgtctaggaggaagaagtggtaattggt
